United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 9

SEQ ID NO: 336020 - DNA, 14 bp, Homo sapiens
gctttcctgcccca

SEQ ID NO: 336021 - DNA, 17 bp, Homo sapiens
gctttcctgccccaggc

SEQ ID NO: 336022 - DNA, 19 bp, Homo sapiens
gctttcctgccccaggcct

SEQ ID NO: 336023 - DNA, 21 bp, Homo sapiens
gctttctattacccctcattt

SEQ ID NO: 336024 - DNA, 12 bp, Homo sapiens
gctttctccttt

SEQ ID NO: 336025 - DNA, 18 bp, Homo sapiens
gctttcttctacaaccag

SEQ ID NO: 336026 - DNA, 20 bp, Homo sapiens
gctttcttctacaaccagag

SEQ ID NO: 336027 - DNA, 21 bp, Homo sapiens
gctttcttctacaaccagagc

SEQ ID NO: 336028 - DNA, 13 bp, Homo sapiens
gctttcttgctgg

SEQ ID NO: 336029 - DNA, 18 bp, Homo sapiens
gctttgacatgaaaagat

SEQ ID NO: 336030 - DNA, 21 bp, Homo sapiens
gctttgacatgaaaagatagg

SEQ ID NO: 336031 - DNA, 18 bp, Homo sapiens
gctttgaggacaaagaga

SEQ ID NO: 336032 - DNA, 16 bp, Homo sapiens
gctttgattccatctc

SEQ ID NO: 336033 - DNA, 17 bp, Homo sapiens
gctttgattccatctcc

SEQ ID NO: 336034 - DNA, 18 bp, Homo sapiens
gctttgcagggagaccag

SEQ ID NO: 336035 - DNA, 19 bp, Homo sapiens
gctttgccatgggcctgct

SEQ ID NO: 336036 - DNA, 20 bp, Homo sapiens
gctttgccatgggcctgctg

SEQ ID NO: 336037 - DNA, 18 bp, Homo sapiens
gctttgcccaacctcagc

SEQ ID NO: 336038 - DNA, 19 bp, Homo sapiens
gctttgcccaacctcagca

SEQ ID NO: 336039 - DNA, 14 bp, Homo sapiens
gctttgctgctacc

SEQ ID NO: 336040 - DNA, 13 bp, Homo sapiens
gctttgctgctat

SEQ ID NO: 336041 - DNA, 18 bp, Homo sapiens
gctttgctggagtcctgt

SEQ ID NO: 336042 - DNA, 22 bp, Homo sapiens
gctttgctggagtcctgttctc

SEQ ID NO: 336043 - DNA, 20 bp, Homo sapiens
gctttggaagctctgttgca

SEQ ID NO: 336044 - DNA, 18 bp, Homo sapiens
gctttggacacacacagc

SEQ ID NO: 336045 - DNA, 19 bp, Homo sapiens
gctttggacacacacagct

SEQ ID NO: 336046 - DNA, 21 bp, Homo sapiens
gctttggctcgggacttcaaa

SEQ ID NO: 336047 - DNA, 14 bp, Homo sapiens
gctttgggaggcca

SEQ ID NO: 336048 - DNA, 14 bp, Homo sapiens
gctttgggctgccc

SEQ ID NO: 336049 - DNA, 15 bp, Homo sapiens
gctttgggctgccct

SEQ ID NO: 336050 - DNA, 19 bp, Homo sapiens
gctttgggctgccctggtg

SEQ ID NO: 336051 - DNA, 17 bp, Homo sapiens
gctttggtctcttgctt

SEQ ID NO: 336052 - DNA, 18 bp, Homo sapiens
gctttggtggcccctccc

SEQ ID NO: 336053 - DNA, 13 bp, Homo sapiens
gctttgtagctta

SEQ ID NO: 336054 - DNA, 18 bp, Homo sapiens
gctttgtagcttaaaaaa

SEQ ID NO: 336055 - DNA, 16 bp, Homo sapiens
gctttgtcccacagct

SEQ ID NO: 336056 - DNA, 19 bp, Homo sapiens
gctttgttaccttaaaact

SEQ ID NO: 336057 - DNA, 17 bp, Homo sapiens
gctttgttactgaaatg

SEQ ID NO: 336058 - DNA, 16 bp, Homo sapiens
gctttgttcttgtcat

SEQ ID NO: 336059 - DNA, 21 bp, Homo sapiens
gctttgtttaacccaaaagat

SEQ ID NO: 336060 - DNA, 22 bp, Homo sapiens
gctttgttttcccacacatatt

SEQ ID NO: 336061 - DNA, 17 bp, Homo sapiens
gcttttaacttctgata

SEQ ID NO: 336062 - DNA, 23 bp, Homo sapiens
gcttttaataaaattgacaacat

SEQ ID NO: 336063 - DNA, 13 bp, Homo sapiens
gcttttactgttt

SEQ ID NO: 336064 - DNA, 14 bp, Homo sapiens
gcttttagtaccca

SEQ ID NO: 336065 - DNA, 12 bp, Homo sapiens
gcttttcactgc

SEQ ID NO: 336066 - DNA, 13 bp, Homo sapiens
gcttttcactgct

SEQ ID NO: 336067 - DNA, 14 bp, Homo sapiens
gcttttcagaagaa

SEQ ID NO: 336068 - DNA, 14 bp, Homo sapiens
gcttttcagccaat

SEQ ID NO: 336069 - DNA, 19 bp, Homo sapiens
gcttttccaggatcctgca

SEQ ID NO: 336070 - DNA, 21 bp, Homo sapiens
gcttttccaggatcctgcagg

SEQ ID NO: 336071 - DNA, 22 bp, Homo sapiens
gcttttcctatttgttttcatg

SEQ ID NO: 336072 - DNA, 13 bp, Homo sapiens
gcttttctcatgg

SEQ ID NO: 336073 - DNA, 17 bp, Homo sapiens
gcttttctgcaattcaa

SEQ ID NO: 336074 - DNA, 17 bp, Homo sapiens
gcttttgatggctatgt

SEQ ID NO: 336075 - DNA, 22 bp, Homo sapiens
gcttttgccccagaaaggggaa

SEQ ID NO: 336076 - DNA, 13 bp, Homo sapiens
gcttttgttctag

SEQ ID NO: 336077 - DNA, 14 bp, Homo sapiens
gcttttgttctaga

SEQ ID NO: 336078 - DNA, 16 bp, Homo sapiens
gcttttgttctagact

SEQ ID NO: 336079 - DNA, 14 bp, Homo sapiens
gcttttgttgttta

SEQ ID NO: 336080 - DNA, 19 bp, Homo sapiens
gctttttaccgttcacttc

SEQ ID NO: 336081 - DNA, 13 bp, Homo sapiens
gctttttcccagc

SEQ ID NO: 336082 - DNA, 14 bp, Homo sapiens
gctttttcccagcc

SEQ ID NO: 336083 - DNA, 20 bp, Homo sapiens
ggaaaaaaaaaaaagaaaag

SEQ ID NO: 336084 - DNA, 13 bp, Homo sapiens
ggaaaaaaacttt

SEQ ID NO: 336085 - DNA, 16 bp, Homo sapiens
ggaaaaaaatgcgtat

SEQ ID NO: 336086 - DNA, 15 bp, Homo sapiens
ggaaaaaagttttga

SEQ ID NO: 336087 - DNA, 15 bp, Homo sapiens
ggaaaaaatatttta

SEQ ID NO: 336088 - DNA, 18 bp, Homo sapiens
ggaaaaacagaacatttc

SEQ ID NO: 336089 - DNA, 15 bp, Homo sapiens
ggaaaaagaaattct

SEQ ID NO: 336090 - DNA, 13 bp, Homo sapiens
ggaaaacagtgaa

SEQ ID NO: 336091 - DNA, 15 bp, Homo sapiens
ggaaaacataaaaat

SEQ ID NO: 336092 - DNA, 17 bp, Homo sapiens
ggaaaactcaccatttc

SEQ ID NO: 336093 - DNA, 22 bp, Homo sapiens
ggaaaagagtatcaaaggcaga

SEQ ID NO: 336094 - DNA, 19 bp, Homo sapiens
ggaaaatctgtaaaaaaga

SEQ ID NO: 336095 - DNA, 15 bp, Homo sapiens
ggaaaatgccaatct

SEQ ID NO: 336096 - DNA, 17 bp, Homo sapiens
ggaaacagaaaagagaa

SEQ ID NO: 336097 - DNA, 22 bp, Homo sapiens
ggaaacagagtccaatttaagg

SEQ ID NO: 336098 - DNA, 16 bp, Homo sapiens
ggaaaccaccctgagg

SEQ ID NO: 336099 - DNA, 13 bp, Homo sapiens
ggaaacctgccct

SEQ ID NO: 336100 - DNA, 16 bp, Homo sapiens
ggaaactcagatgtcc

SEQ ID NO: 336101 - DNA, 17 bp, Homo sapiens
ggaaactcagatgtcca

SEQ ID NO: 336102 - DNA, 16 bp, Homo sapiens
ggaaactgaggcccag

SEQ ID NO: 336103 - DNA, 18 bp, Homo sapiens
ggaaactgttgccagaga

SEQ ID NO: 336104 - DNA, 21 bp, Homo sapiens
ggaaacttccaagacctgact

SEQ ID NO: 336105 - DNA, 19 bp, Homo sapiens
ggaaagacaggaagaccaa

SEQ ID NO: 336106 - DNA, 14 bp, Homo sapiens
ggaaagaggctctg

SEQ ID NO: 336107 - DNA, 17 bp, Homo sapiens
ggaaagatttaatgtta

SEQ ID NO: 336108 - DNA, 21 bp, Homo sapiens
ggaaagcaccgcagcatgtgg

SEQ ID NO: 336109 - DNA, 23 bp, Homo sapiens
ggaaagccacctctccctcaaca

SEQ ID NO: 336110 - DNA, 20 bp, Homo sapiens
ggaaagccattgaccaccca

SEQ ID NO: 336111 - DNA, 18 bp, Homo sapiens
ggaaagcgggcagccccg

SEQ ID NO: 336112 - DNA, 13 bp, Homo sapiens
ggaaaggacccac

SEQ ID NO: 336113 - DNA, 19 bp, Homo sapiens
ggaaaggacccacccatct

SEQ ID NO: 336114 - DNA, 11 bp, Homo sapiens
ggaaaggcatc

SEQ ID NO: 336115 - DNA, 14 bp, Homo sapiens
ggaaaggctgaaca

SEQ ID NO: 336116 - DNA, 14 bp, Homo sapiens
ggaaaggggggagc

SEQ ID NO: 336117 - DNA, 15 bp, Homo sapiens
ggaaagggtgctgct

SEQ ID NO: 336118 - DNA, 17 bp, Homo sapiens
ggaaaggtcctgctgtg

SEQ ID NO: 336119 - DNA, 11 bp, Homo sapiens
ggaaaggtgct

SEQ ID NO: 336120 - DNA, 13 bp, Homo sapiens
ggaaaggtgctca

SEQ ID NO: 336121 - DNA, 23 bp, Homo sapiens
tggccagcctggggcctggcagg

SEQ ID NO: 336122 - DNA, 20 bp, Homo sapiens
tggccaggagctcttcaggc

SEQ ID NO: 336123 - DNA, 12 bp, Homo sapiens
tggccaggatgg

SEQ ID NO: 336124 - DNA, 16 bp, Homo sapiens
tggccaggcagatctg

SEQ ID NO: 336125 - DNA, 13 bp, Homo sapiens
tggccaggctggt

SEQ ID NO: 336126 - DNA, 23 bp, Homo sapiens
tggccagggtagacttggagctg

SEQ ID NO: 336127 - DNA, 17 bp, Homo sapiens
tggccaggtggccactc

SEQ ID NO: 336128 - DNA, 14 bp, Homo sapiens
tggccagtgtcatt

SEQ ID NO: 336129 - DNA, 19 bp, Homo sapiens
tggccataggagaggaggg

SEQ ID NO: 336130 - DNA, 20 bp, Homo sapiens
tggcccacccctcttccccc

SEQ ID NO: 336131 - DNA, 21 bp, Homo sapiens
tggcccacccctcttccccct

SEQ ID NO: 336132 - DNA, 23 bp, Homo sapiens
tggcccacccctcttcccccttc

SEQ ID NO: 336133 - DNA, 20 bp, Homo sapiens
tggcccagcagcggcccaga

SEQ ID NO: 336134 - DNA, 22 bp, Homo sapiens
tggcccagcagcggcccagatt

SEQ ID NO: 336135 - DNA, 12 bp, Homo sapiens
tggcccagccag

SEQ ID NO: 336136 - DNA, 16 bp, Homo sapiens
tggcccagccagcagg

SEQ ID NO: 336137 - DNA, 17 bp, Homo sapiens
tggcccagccagcaggt

SEQ ID NO: 336138 - DNA, 16 bp, Homo sapiens
tggcccagcggcccct

SEQ ID NO: 336139 - DNA, 19 bp, Homo sapiens
tggcccagtcctctcccaa

SEQ ID NO: 336140 - DNA, 16 bp, Homo sapiens
tggcccatctcagcct

SEQ ID NO: 336141 - DNA, 13 bp, Homo sapiens
tggccccaaatgt

SEQ ID NO: 336142 - DNA, 22 bp, Homo sapiens
tggccccaccctcgtggacacc

SEQ ID NO: 336143 - DNA, 17 bp, Homo sapiens
tggccccagctggctgg

SEQ ID NO: 336144 - DNA, 12 bp, Homo sapiens
tggccccaggcg

SEQ ID NO: 336145 - DNA, 14 bp, Homo sapiens
ggaagttgctgtgc

SEQ ID NO: 336146 - DNA, 13 bp, Homo sapiens
ggaagtttagaga

SEQ ID NO: 336147 - DNA, 18 bp, Homo sapiens
ggaagttttgcatttatg

SEQ ID NO: 336148 - DNA, 22 bp, Homo sapiens
ggaatactcttggtcacctcaa

SEQ ID NO: 336149 - DNA, 21 bp, Homo sapiens
ggaatagccagagaggagcac

SEQ ID NO: 336150 - DNA, 14 bp, Homo sapiens
ggaatcaaggagcc

SEQ ID NO: 336151 - DNA, 17 bp, Homo sapiens
ggaatccagaaggaagc

SEQ ID NO: 336152 - DNA, 14 bp, Homo sapiens
ggaatcctgtcctc

SEQ ID NO: 336153 - DNA, 19 bp, Homo sapiens
ggaatcctgtcctcagctt

SEQ ID NO: 336154 - DNA, 14 bp, Homo sapiens
ggaatctatagtat

SEQ ID NO: 336155 - DNA, 15 bp, Homo sapiens
ggaatctgccttcca

SEQ ID NO: 336156 - DNA, 18 bp, Homo sapiens
ggaatgaagataccatca

SEQ ID NO: 336157 - DNA, 17 bp, Homo sapiens
ggaatgaagcatgtagc

SEQ ID NO: 336158 - DNA, 14 bp, Homo sapiens
ggaatgattaatta

SEQ ID NO: 336159 - DNA, 13 bp, Homo sapiens
ggaatgcaagaga

SEQ ID NO: 336160 - DNA, 18 bp, Homo sapiens
ggaatgcaagagaaggag

SEQ ID NO: 336161 - DNA, 16 bp, Homo sapiens
ggaatgctcaatgtgc

SEQ ID NO: 336162 - DNA, 13 bp, Homo sapiens
ggaatgctccccc

SEQ ID NO: 336163 - DNA, 23 bp, Homo sapiens
ggaatgctcccccatcctcccct

SEQ ID NO: 336164 - DNA, 14 bp, Homo sapiens
ggaatgctgtgtta

SEQ ID NO: 336165 - DNA, 16 bp, Homo sapiens
ggaatggggacctggg

SEQ ID NO: 336166 - DNA, 20 bp, Homo sapiens
ggaatgttccctgcaccctg

SEQ ID NO: 336167 - DNA, 14 bp, Homo sapiens
ggaattaaaacaat

SEQ ID NO: 336168 - DNA, 17 bp, Homo sapiens
ggaattaaaacaatgtc

SEQ ID NO: 336169 - DNA, 14 bp, Homo sapiens
ggaattaacctggt

SEQ ID NO: 336170 - DNA, 20 bp, Homo sapiens
ggaattaacctggtgctgga

SEQ ID NO: 336171 - DNA, 21 bp, Homo sapiens
ggaattacataacaggcattg

SEQ ID NO: 336172 - DNA, 19 bp, Homo sapiens
ggaattacatgtaaaacat

SEQ ID NO: 336173 - DNA, 13 bp, Homo sapiens
ggaattacatttt

SEQ ID NO: 336174 - DNA, 22 bp, Homo sapiens
ggaattctcttggctggcttcc

SEQ ID NO: 336175 - DNA, 19 bp, Homo sapiens
ggaattgagaggtggggga

SEQ ID NO: 336176 - DNA, 21 bp, Homo sapiens
ggaattggtggcagattttac

SEQ ID NO: 336177 - DNA, 23 bp, Homo sapiens
ggaattggtggcagattttacaa

SEQ ID NO: 336178 - DNA, 18 bp, Homo sapiens
ggacaaaacccaccttgt

SEQ ID NO: 336179 - DNA, 20 bp, Homo sapiens
ggacaacctgcccctcccca

SEQ ID NO: 336180 - DNA, 14 bp, Homo sapiens
ggacaagaagctgc

SEQ ID NO: 336181 - DNA, 20 bp, Homo sapiens
ggacaagccaacttgtaaat

SEQ ID NO: 336182 - DNA, 23 bp, Homo sapiens
ggacaagggggaggaaaggggcg

SEQ ID NO: 336183 - DNA, 21 bp, Homo sapiens
ggacaatcatgaaatatgcat

SEQ ID NO: 336184 - DNA, 18 bp, Homo sapiens
ggacaatgagtggaatac

SEQ ID NO: 336185 - DNA, 23 bp, Homo sapiens
ggacacaccccacaccccagccc

SEQ ID NO: 336186 - DNA, 12 bp, Homo sapiens
ggacacactaat

SEQ ID NO: 336187 - DNA, 12 bp, Homo sapiens
ggacacactgta

SEQ ID NO: 336188 - DNA, 14 bp, Homo sapiens
ggacacatcccggc

SEQ ID NO: 336189 - DNA, 15 bp, Homo sapiens
ggacacatcccggcc

SEQ ID NO: 336190 - DNA, 17 bp, Homo sapiens
ggacacatcccggcctc

SEQ ID NO: 336191 - DNA, 20 bp, Homo sapiens
ggacacatcccggcctcttc

SEQ ID NO: 336192 - DNA, 22 bp, Homo sapiens
ggacacatcccggcctcttcca

SEQ ID NO: 336193 - DNA, 13 bp, Homo sapiens
ggacacatgtcca

SEQ ID NO: 336194 - DNA, 19 bp, Homo sapiens
ggacacatgtccagtggga

SEQ ID NO: 336195 - DNA, 13 bp, Homo sapiens
ggacacccctgct

SEQ ID NO: 336196 - DNA, 12 bp, Homo sapiens
ggacaccgggca

SEQ ID NO: 336197 - DNA, 13 bp, Homo sapiens
ggacacctgccct

SEQ ID NO: 336198 - DNA, 13 bp, Homo sapiens
ggacacggcctct

SEQ ID NO: 336199 - DNA, 19 bp, Homo sapiens
ggacacggcctctggggag

SEQ ID NO: 336200 - DNA, 21 bp, Homo sapiens
ggacactgatgggtcctgctg

SEQ ID NO: 336201 - DNA, 23 bp, Homo sapiens
ggacagaaccaacgggtctgtgg

SEQ ID NO: 336202 - DNA, 15 bp, Homo sapiens
ggacagacacagagg

SEQ ID NO: 336203 - DNA, 18 bp, Homo sapiens
ggacagagttcagggagg

SEQ ID NO: 336204 - DNA, 22 bp, Homo sapiens
ggacagcaaaaccattgcttca

SEQ ID NO: 336205 - DNA, 13 bp, Homo sapiens
ggacagcagcctc

SEQ ID NO: 336206 - DNA, 17 bp, Homo sapiens
ggacagcagcctccctg

SEQ ID NO: 336207 - DNA, 17 bp, Homo sapiens
ggacagcatggtgcatg

SEQ ID NO: 336208 - DNA, 19 bp, Homo sapiens
ggacagcatggtgcatgcc

SEQ ID NO: 336209 - DNA, 17 bp, Homo sapiens
ggacagcggcccggccc

SEQ ID NO: 336210 - DNA, 22 bp, Homo sapiens
ggacagcggcccggcccacgca

SEQ ID NO: 336211 - DNA, 11 bp, Homo sapiens
ggacaggaaat

SEQ ID NO: 336212 - DNA, 16 bp, Homo sapiens
ggacaggaacacccag

SEQ ID NO: 336213 - DNA, 17 bp, Homo sapiens
ggacaggaacacccagc

SEQ ID NO: 336214 - DNA, 20 bp, Homo sapiens
ggacaggaacacccagcccc

SEQ ID NO: 336215 - DNA, 12 bp, Homo sapiens
ggacaggaagca

SEQ ID NO: 336216 - DNA, 23 bp, Homo sapiens
ggacaggaagcacagcaggttta

SEQ ID NO: 336217 - DNA, 16 bp, Homo sapiens
ggacaggaggaggaga

SEQ ID NO: 336218 - DNA, 21 bp, Homo sapiens
ggacagggagggaacagacct

SEQ ID NO: 336219 - DNA, 15 bp, Homo sapiens
ggacagggcatggcc

SEQ ID NO: 336220 - DNA, 16 bp, Homo sapiens
ggacagggccagggtt

SEQ ID NO: 336221 - DNA, 23 bp, Homo sapiens
ggacagtgctgaccccaggaagt

SEQ ID NO: 336222 - DNA, 15 bp, Homo sapiens
ggacagtggatgccc

SEQ ID NO: 336223 - DNA, 15 bp, Homo sapiens
ggacagttcacaccc

SEQ ID NO: 336224 - DNA, 19 bp, Homo sapiens
ggacagttcacaccctgca

SEQ ID NO: 336225 - DNA, 15 bp, Homo sapiens
ggacagttggcagag

SEQ ID NO: 336226 - DNA, 16 bp, Homo sapiens
ggacagttggcagaga

SEQ ID NO: 336227 - DNA, 23 bp, Homo sapiens
ggacagttggcagagaaggcctc

SEQ ID NO: 336228 - DNA, 21 bp, Homo sapiens
ggacatgatttagggaagcag

SEQ ID NO: 336229 - DNA, 16 bp, Homo sapiens
ggacattgccccaaga

SEQ ID NO: 336230 - DNA, 18 bp, Homo sapiens
ggacattgccccaagata

SEQ ID NO: 336231 - DNA, 19 bp, Homo sapiens
ggacatttgggactgtctt

SEQ ID NO: 336232 - DNA, 13 bp, Homo sapiens
ggaccaaagctga

SEQ ID NO: 336233 - DNA, 18 bp, Homo sapiens
ggaccaacccatgccctg

SEQ ID NO: 336234 - DNA, 19 bp, Homo sapiens
ggaccaacccatgccctgc

SEQ ID NO: 336235 - DNA, 20 bp, Homo sapiens
ggaccaagcttaaggagagg

SEQ ID NO: 336236 - DNA, 15 bp, Homo sapiens
ggaccaaggacccct

SEQ ID NO: 336237 - DNA, 14 bp, Homo sapiens
ggaccagatgctga

SEQ ID NO: 336238 - DNA, 17 bp, Homo sapiens
ggaccagctggggggca

SEQ ID NO: 336239 - DNA, 12 bp, Homo sapiens
ggaccaggagcc

SEQ ID NO: 336240 - DNA, 15 bp, Homo sapiens
ggaccagtgagacag

SEQ ID NO: 336241 - DNA, 13 bp, Homo sapiens
ggaccatgtgatt

SEQ ID NO: 336242 - DNA, 20 bp, Homo sapiens
ggaccattgacctcagctgc

SEQ ID NO: 336243 - DNA, 10 bp, Homo sapiens
ggacccacca

SEQ ID NO: 336244 - DNA, 23 bp, Homo sapiens
ggacccacccatcttcctgctgc

SEQ ID NO: 336245 - DNA, 14 bp, Homo sapiens
ggacccaccccaac

SEQ ID NO: 336246 - DNA, 15 bp, Homo sapiens
ggacccaccccaact

SEQ ID NO: 336247 - DNA, 17 bp, Homo sapiens
ggacccagcaggggcag

SEQ ID NO: 336248 - DNA, 22 bp, Homo sapiens
ggacccagcaggggcagaagga

SEQ ID NO: 336249 - DNA, 13 bp, Homo sapiens
ggacccagctact

SEQ ID NO: 336250 - DNA, 20 bp, Homo sapiens
ggacccagctactctgtcca

SEQ ID NO: 336251 - DNA, 21 bp, Homo sapiens
ggacccagctactctgtccag

SEQ ID NO: 336252 - DNA, 19 bp, Homo sapiens
ggacccatagatcttctga

SEQ ID NO: 336253 - DNA, 22 bp, Homo sapiens
ggaccccagagggaccagctgg

SEQ ID NO: 336254 - DNA, 21 bp, Homo sapiens
ggacccccggcctccaggctg

SEQ ID NO: 336255 - DNA, 21 bp, Homo sapiens
ggacccctcccttgctcagtg

SEQ ID NO: 336256 - DNA, 20 bp, Homo sapiens
ggacccggaggggcctggca

SEQ ID NO: 336257 - DNA, 21 bp, Homo sapiens
ggacccgggaccacagctgct

SEQ ID NO: 336258 - DNA, 16 bp, Homo sapiens
ggaccctgccgagggg

SEQ ID NO: 336259 - DNA, 15 bp, Homo sapiens
ggaccgggagcctgc

SEQ ID NO: 336260 - DNA, 20 bp, Homo sapiens
ggaccgggtgggcctggcct

SEQ ID NO: 336261 - DNA, 21 bp, Homo sapiens
ggaccgggtgggcctggcctg

SEQ ID NO: 336262 - DNA, 19 bp, Homo sapiens
ggacctcagagtccaggcc

SEQ ID NO: 336263 - DNA, 17 bp, Homo sapiens
ggacctccacctgggag

SEQ ID NO: 336264 - DNA, 22 bp, Homo sapiens
ggacctccacctgggagatgct

SEQ ID NO: 336265 - DNA, 15 bp, Homo sapiens
ggacctccccctctt

SEQ ID NO: 336266 - DNA, 14 bp, Homo sapiens
ggacctcctgagcg

SEQ ID NO: 336267 - DNA, 20 bp, Homo sapiens
tgggaaccccttcatcctct

SEQ ID NO: 336268 - DNA, 18 bp, Homo sapiens
tgggaacccgactgtgaa

SEQ ID NO: 336269 - DNA, 19 bp, Homo sapiens
tgggaacggggtggacgag

SEQ ID NO: 336270 - DNA, 17 bp, Homo sapiens
tgggaactcccaagaac

SEQ ID NO: 336271 - DNA, 14 bp, Homo sapiens
tgggaagaaacaaa

SEQ ID NO: 336272 - DNA, 18 bp, Homo sapiens
tgggaagaacagaattgc

SEQ ID NO: 336273 - DNA, 23 bp, Homo sapiens
tgggaagaccagctttgcagtga

SEQ ID NO: 336274 - DNA, 12 bp, Homo sapiens
tgggaagagctg

SEQ ID NO: 336275 - DNA, 20 bp, Homo sapiens
tgggcagggccgcagggcgc

SEQ ID NO: 336276 - DNA, 22 bp, Homo sapiens
tgggcagggccgcagggcgctc

SEQ ID NO: 336277 - DNA, 20 bp, Homo sapiens
tgggcaggggttccagcttc

SEQ ID NO: 336278 - DNA, 15 bp, Homo sapiens
tgggcaggtcctggg

SEQ ID NO: 336279 - DNA, 15 bp, Homo sapiens
tgggcaggtggccac

SEQ ID NO: 336280 - DNA, 15 bp, Homo sapiens
tgggcatcaaagatg

SEQ ID NO: 336281 - DNA, 15 bp, Homo sapiens
tgggcatccacccag

SEQ ID NO: 336282 - DNA, 21 bp, Homo sapiens
tgggcatccacccagtgctgc

SEQ ID NO: 336283 - DNA, 14 bp, Homo sapiens
tgggcatctctaga

SEQ ID NO: 336284 - DNA, 14 bp, Homo sapiens
tgggcatgccaccc

SEQ ID NO: 336285 - DNA, 15 bp, Homo sapiens
tgggcatggggtggg

SEQ ID NO: 336286 - DNA, 20 bp, Homo sapiens
tgggcatggggtgggcctct

SEQ ID NO: 336287 - DNA, 21 bp, Homo sapiens
tgggcatggggtgggcctctg

SEQ ID NO: 336288 - DNA, 21 bp, Homo sapiens
tgggcatggtaccagccctgg

SEQ ID NO: 336289 - DNA, 15 bp, Homo sapiens
tgggcattgggctga

SEQ ID NO: 336290 - DNA, 16 bp, Homo sapiens
tgggcatttgtgaggc

SEQ ID NO: 336291 - DNA, 15 bp, Homo sapiens
tgggccaagccaggg

SEQ ID NO: 336292 - DNA, 19 bp, Homo sapiens
tgggccaagccagggatgg

SEQ ID NO: 336293 - DNA, 22 bp, Homo sapiens
tgggccaagccagggttccaga

SEQ ID NO: 336294 - DNA, 23 bp, Homo sapiens
tgggccaagccagggttccagac

SEQ ID NO: 336295 - DNA, 15 bp, Homo sapiens
tgggccacccaccag

SEQ ID NO: 336296 - DNA, 21 bp, Homo sapiens
tgggccacccaccagggctca

SEQ ID NO: 336297 - DNA, 22 bp, Homo sapiens
tgggccacccttcacgctggct

SEQ ID NO: 336298 - DNA, 12 bp, Homo sapiens
tgggccactgcc

SEQ ID NO: 336299 - DNA, 15 bp, Homo sapiens
tgggccactgccctc

SEQ ID NO: 336300 - DNA, 13 bp, Homo sapiens
tgggccagcccct

SEQ ID NO: 336301 - DNA, 21 bp, Homo sapiens
tgggccagggtctcgtcagga

SEQ ID NO: 336302 - DNA, 20 bp, Homo sapiens
tgggccaggttggaaaagaa

SEQ ID NO: 336303 - DNA, 21 bp, Homo sapiens
tgggccatggctttcatcctg

SEQ ID NO: 336304 - DNA, 22 bp, Homo sapiens
tgggcccaagacagatgcccca

SEQ ID NO: 336305 - DNA, 24 bp, Homo sapiens
tgggcccagagagaggcgtcctgg

SEQ ID NO: 336306 - DNA, 13 bp, Homo sapiens
tgggcccagatct

SEQ ID NO: 336307 - DNA, 14 bp, Homo sapiens
tgggcccagatctg

SEQ ID NO: 336308 - DNA, 12 bp, Homo sapiens
tgggcccagccg

SEQ ID NO: 336309 - DNA, 12 bp, Homo sapiens
tgggcccagctg

SEQ ID NO: 336310 - DNA, 17 bp, Homo sapiens
tgggcccagctgggctc

SEQ ID NO: 336311 - DNA, 20 bp, Homo sapiens
tgggcccagctgggctctgc

SEQ ID NO: 336312 - DNA, 15 bp, Homo sapiens
tgggcccaggcagca

SEQ ID NO: 336313 - DNA, 15 bp, Homo sapiens
tgggcccaggggctg

SEQ ID NO: 336314 - DNA, 18 bp, Homo sapiens
tgggccccagaccccagg

SEQ ID NO: 336315 - DNA, 17 bp, Homo sapiens
tgggccccatgctctgc

SEQ ID NO: 336316 - DNA, 11 bp, Homo sapiens
tgggcccctcc

SEQ ID NO: 336317 - DNA, 16 bp, Homo sapiens
tgggcccctccctacc

SEQ ID NO: 336318 - DNA, 20 bp, Homo sapiens
tgggcccctccctacctcaa

SEQ ID NO: 336319 - DNA, 13 bp, Homo sapiens
tgggccctaggca

SEQ ID NO: 336320 - DNA, 11 bp, Homo sapiens
tgggccctgca

SEQ ID NO: 336321 - DNA, 15 bp, Homo sapiens
tgggccctgcaggag

SEQ ID NO: 336322 - DNA, 14 bp, Homo sapiens
tgggccctggttcc

SEQ ID NO: 336323 - DNA, 19 bp, Homo sapiens
tgggccctggttcccccag

SEQ ID NO: 336324 - DNA, 14 bp, Homo sapiens
tgggccgctgcacc

SEQ ID NO: 336325 - DNA, 17 bp, Homo sapiens
tgggccggcagcctggt

SEQ ID NO: 336326 - DNA, 18 bp, Homo sapiens
tgggccggccccaggctc

SEQ ID NO: 336327 - DNA, 16 bp, Homo sapiens
tgggcctcaaggactt

SEQ ID NO: 336328 - DNA, 20 bp, Homo sapiens
tgggcctcccatagtgctgg

SEQ ID NO: 336329 - DNA, 24 bp, Homo sapiens
tgggcctccttcccatgcctgtct

SEQ ID NO: 336330 - DNA, 18 bp, Homo sapiens
tgggcctgatggagagga

SEQ ID NO: 336331 - DNA, 13 bp, Homo sapiens
tgggcctgctgcg

SEQ ID NO: 336332 - DNA, 22 bp, Homo sapiens
tgggcctgcttttccaggatcc

SEQ ID NO: 336333 - DNA, 11 bp, Homo sapiens
tgggcctggcc

SEQ ID NO: 336334 - DNA, 20 bp, Homo sapiens
tgggcctggcctgagctggg

SEQ ID NO: 336335 - DNA, 17 bp, Homo sapiens
tgggcctgggcctgctt

SEQ ID NO: 336336 - DNA, 16 bp, Homo sapiens
tgggcctgtcgtgcca

SEQ ID NO: 336337 - DNA, 22 bp, Homo sapiens
tgggcctgtcgtgccagtcctg

SEQ ID NO: 336338 - DNA, 18 bp, Homo sapiens
tgggcctgtgcagcagcc

SEQ ID NO: 336339 - DNA, 19 bp, Homo sapiens
tgggcctgtgcagcagccc

SEQ ID NO: 336340 - DNA, 22 bp, Homo sapiens
tgggcctgtgcagcagcccagc

SEQ ID NO: 336341 - DNA, 18 bp, Homo sapiens
tgggccttgctttgggct

SEQ ID NO: 336342 - DNA, 22 bp, Homo sapiens
tgggccttgtgtgctggcttcc

SEQ ID NO: 336343 - DNA, 14 bp, Homo sapiens
tgggcctttcctgt

SEQ ID NO: 336344 - DNA, 16 bp, Homo sapiens
tgggcgccctggaagc

SEQ ID NO: 336345 - DNA, 22 bp, Homo sapiens
tgggcgcggtggctcacgcctg

SEQ ID NO: 336346 - DNA, 19 bp, Homo sapiens
tgggcggcagagaggactg

SEQ ID NO: 336347 - DNA, 12 bp, Homo sapiens
tgggcggctgag

SEQ ID NO: 336348 - DNA, 16 bp, Homo sapiens
tgggcggctgagagcc

SEQ ID NO: 336349 - DNA, 21 bp, Homo sapiens
tgggctaacatttaggagaag

SEQ ID NO: 336350 - DNA, 21 bp, Homo sapiens
tgggctagtgtgagtggcagc

SEQ ID NO: 336351 - DNA, 20 bp, Homo sapiens
tgggctattgaagatacaca

SEQ ID NO: 336352 - DNA, 21 bp, Homo sapiens
tgggctattgaagatacacaa

SEQ ID NO: 336353 - DNA, 23 bp, Homo sapiens
tgggctcaagcaatcctcctgag

SEQ ID NO: 336354 - DNA, 14 bp, Homo sapiens
tgggctcagggctg

SEQ ID NO: 336355 - DNA, 20 bp, Homo sapiens
tgggctcagggctggagtgc

SEQ ID NO: 336356 - DNA, 17 bp, Homo sapiens
tgggctcccttgtgcgt

SEQ ID NO: 336357 - DNA, 11 bp, Homo sapiens
tgggctcctgg

SEQ ID NO: 336358 - DNA, 14 bp, Homo sapiens
tgggctcctggctg

SEQ ID NO: 336359 - DNA, 18 bp, Homo sapiens
tgggctcctggctgccag

SEQ ID NO: 336360 - DNA, 13 bp, Homo sapiens
tgggctctgccac

SEQ ID NO: 336361 - DNA, 14 bp, Homo sapiens
tgggctctgcgtcc

SEQ ID NO: 336362 - DNA, 13 bp, Homo sapiens
tgggctctggctc

SEQ ID NO: 336363 - DNA, 14 bp, Homo sapiens
tgggctctggctcc

SEQ ID NO: 336364 - DNA, 14 bp, Homo sapiens
tgggctctgggttc

SEQ ID NO: 336365 - DNA, 19 bp, Homo sapiens
tgggctcttggccgtggca

SEQ ID NO: 336366 - DNA, 23 bp, Homo sapiens
tgggctgagactggatactgccc

SEQ ID NO: 336367 - DNA, 18 bp, Homo sapiens
tgggctgagcccctaccc

SEQ ID NO: 336368 - DNA, 17 bp, Homo sapiens
tgggctgagcctactgt

SEQ ID NO: 336369 - DNA, 21 bp, Homo sapiens
tgggctgagcctactgtctcc

SEQ ID NO: 336370 - DNA, 15 bp, Homo sapiens
tgggctgccctggtg

SEQ ID NO: 336371 - DNA, 21 bp, Homo sapiens
tgggctgccctggtgctgcca

SEQ ID NO: 336372 - DNA, 16 bp, Homo sapiens
tgggctggactggagg

SEQ ID NO: 336373 - DNA, 17 bp, Homo sapiens
tgggctggcagagggga

SEQ ID NO: 336374 - DNA, 14 bp, Homo sapiens
tgggctgggagaag

SEQ ID NO: 336375 - DNA, 15 bp, Homo sapiens
tgggctggtattctc

SEQ ID NO: 336376 - DNA, 19 bp, Homo sapiens
tgggctggtattctctcta

SEQ ID NO: 336377 - DNA, 23 bp, Homo sapiens
tgggctggtattctctctatgca

SEQ ID NO: 336378 - DNA, 12 bp, Homo sapiens
tgggctgtgagt

SEQ ID NO: 336379 - DNA, 22 bp, Homo sapiens
tgggctgtgagtgtaagtgtga

SEQ ID NO: 336380 - DNA, 21 bp, Homo sapiens
tgggctgtgttgactgctgct

SEQ ID NO: 336381 - DNA, 21 bp, Homo sapiens
tgggctgttttagtgccaggc

SEQ ID NO: 336382 - DNA, 23 bp, Homo sapiens
tgggcttccatttgtgtgtgtgc

SEQ ID NO: 336383 - DNA, 14 bp, Homo sapiens
tgggctttccaggg

SEQ ID NO: 336384 - DNA, 23 bp, Homo sapiens
tgggctttccagggtctttactg

SEQ ID NO: 336385 - DNA, 17 bp, Homo sapiens
tgggctttgattccatc

SEQ ID NO: 336386 - DNA, 23 bp, Homo sapiens
tgggctttgattccatctccttg

SEQ ID NO: 336387 - DNA, 17 bp, Homo sapiens
tgggctttgcaggctct

SEQ ID NO: 336388 - DNA, 19 bp, Homo sapiens
tgggctttgcaggctctgg

SEQ ID NO: 336389 - DNA, 14 bp, Homo sapiens
tggggaagagagcc

SEQ ID NO: 336390 - DNA, 15 bp, Homo sapiens
tggggaagagagcct

SEQ ID NO: 336391 - DNA, 16 bp, Homo sapiens
tggggaagagagcctg

SEQ ID NO: 336392 - DNA, 19 bp, Homo sapiens
tggggaagggaaccagccc

SEQ ID NO: 336393 - DNA, 20 bp, Homo sapiens
tggggacagctttcctgggt

SEQ ID NO: 336394 - DNA, 13 bp, Homo sapiens
tggggacagggct

SEQ ID NO: 336395 - DNA, 23 bp, Homo sapiens
tggggacagttggcagagaaggc

SEQ ID NO: 336396 - DNA, 17 bp, Homo sapiens
tggggacgccaaggagg

SEQ ID NO: 336397 - DNA, 18 bp, Homo sapiens
tggggacgggggctgctt

SEQ ID NO: 336398 - DNA, 22 bp, Homo sapiens
tggggacgggggctgcttctcc

SEQ ID NO: 336399 - DNA, 21 bp, Homo sapiens
tggggacgtcctgccacctgg

SEQ ID NO: 336400 - DNA, 17 bp, Homo sapiens
tggggactaagggaaga

SEQ ID NO: 336401 - DNA, 20 bp, Homo sapiens
tggggagacacctcagagcc

SEQ ID NO: 336402 - DNA, 14 bp, Homo sapiens
tggggagagggcat

SEQ ID NO: 336403 - DNA, 20 bp, Homo sapiens
tggggagatcggggccagag

SEQ ID NO: 336404 - DNA, 23 bp, Homo sapiens
tggggagatcggggccagaggca

SEQ ID NO: 336405 - DNA, 23 bp, Homo sapiens
tgggtgacggtcctttaggcagc

SEQ ID NO: 336406 - DNA, 16 bp, Homo sapiens
tgggtgatttctagaa

SEQ ID NO: 336407 - DNA, 20 bp, Homo sapiens
tgggtggagtcaggcttctc

SEQ ID NO: 336408 - DNA, 14 bp, Homo sapiens
tgggtgggacacag

SEQ ID NO: 336409 - DNA, 24 bp, Homo sapiens
tgggtggtttgtgagccttgctgc

SEQ ID NO: 336410 - DNA, 20 bp, Homo sapiens
tgggtgtatttattttcctc

SEQ ID NO: 336411 - DNA, 13 bp, Homo sapiens
tgggtgtgccctg

SEQ ID NO: 336412 - DNA, 16 bp, Homo sapiens
tgggtgtgccctggct

SEQ ID NO: 336413 - DNA, 14 bp, Homo sapiens
tgggtgtgtttcag

SEQ ID NO: 336414 - DNA, 13 bp, Homo sapiens
tgggttcattatt

SEQ ID NO: 336415 - DNA, 13 bp, Homo sapiens
ggaggcagaacca

SEQ ID NO: 336416 - DNA, 12 bp, Homo sapiens
ggaggcagactc

SEQ ID NO: 336417 - DNA, 10 bp, Homo sapiens
ggaggcaggt

SEQ ID NO: 336418 - DNA, 19 bp, Homo sapiens
ggaggcaggtcccgagccc

SEQ ID NO: 336419 - DNA, 13 bp, Homo sapiens
ggaggcattccca

SEQ ID NO: 336420 - DNA, 18 bp, Homo sapiens
ggaggccaaggcaggtag

SEQ ID NO: 336421 - DNA, 18 bp, Homo sapiens
ggaggccaagtgcaggct

SEQ ID NO: 336422 - DNA, 18 bp, Homo sapiens
ggaggccacgggggaggc

SEQ ID NO: 336423 - DNA, 22 bp, Homo sapiens
ggaggccacgggggaggccgag

SEQ ID NO: 336424 - DNA, 13 bp, Homo sapiens
ggaggccaggccc

SEQ ID NO: 336425 - DNA, 17 bp, Homo sapiens
ggaggcccctggcccag

SEQ ID NO: 336426 - DNA, 23 bp, Homo sapiens
ggaggccgaggcaggggctgggc

SEQ ID NO: 336427 - DNA, 14 bp, Homo sapiens
ggaggcctcaccct

SEQ ID NO: 336428 - DNA, 15 bp, Homo sapiens
ggaggcctctgggcc

SEQ ID NO: 336429 - DNA, 13 bp, Homo sapiens
ggaggcctgggag

SEQ ID NO: 336430 - DNA, 14 bp, Homo sapiens
ggaggcctgggagg

SEQ ID NO: 336431 - DNA, 15 bp, Homo sapiens
ggaggcctgggaggg

SEQ ID NO: 336432 - DNA, 17 bp, Homo sapiens
ggaggcctggtctggag

SEQ ID NO: 336433 - DNA, 20 bp, Homo sapiens
ggaggcctggtctggagccc

SEQ ID NO: 336434 - DNA, 19 bp, Homo sapiens
ggaggcgcccacctgccca

SEQ ID NO: 336435 - DNA, 23 bp, Homo sapiens
ggaggctcccagacccagggcag

SEQ ID NO: 336436 - DNA, 16 bp, Homo sapiens
ggaggcttgggaccgc

SEQ ID NO: 336437 - DNA, 20 bp, Homo sapiens
ggaggctttaagctccagct

SEQ ID NO: 336438 - DNA, 12 bp, Homo sapiens
ggagggaccagg

SEQ ID NO: 336439 - DNA, 20 bp, Homo sapiens
ggagggattgaacacaggca

SEQ ID NO: 336440 - DNA, 23 bp, Homo sapiens
ggagggattgaacacaggcaaag

SEQ ID NO: 336441 - DNA, 14 bp, Homo sapiens
ggagggcagagcca

SEQ ID NO: 336442 - DNA, 15 bp, Homo sapiens
ggagggcagagccat

SEQ ID NO: 336443 - DNA, 23 bp, Homo sapiens
ggagggcagagccatgggcctgg

SEQ ID NO: 336444 - DNA, 19 bp, Homo sapiens
ggagggcccctgcgtgggg

SEQ ID NO: 336445 - DNA, 21 bp, Homo sapiens
ggagggcccctgcgtgggggc

SEQ ID NO: 336446 - DNA, 14 bp, Homo sapiens
ggagggcctcagag

SEQ ID NO: 336447 - DNA, 15 bp, Homo sapiens
ggagggcctcagaga

SEQ ID NO: 336448 - DNA, 17 bp, Homo sapiens
ggaggggcggcaggagg

SEQ ID NO: 336449 - DNA, 18 bp, Homo sapiens
ggaggggctgagtctggc

SEQ ID NO: 336450 - DNA, 13 bp, Homo sapiens
ggaggggcttgga

SEQ ID NO: 336451 - DNA, 21 bp, Homo sapiens
ggagggggctatttctctccc

SEQ ID NO: 336452 - DNA, 12 bp, Homo sapiens
ggaggggggagc

SEQ ID NO: 336453 - DNA, 15 bp, Homo sapiens
ggaggggggagccat

SEQ ID NO: 336454 - DNA, 18 bp, Homo sapiens
ggagggggtttgggggct

SEQ ID NO: 336455 - DNA, 12 bp, Homo sapiens
ggaggggtaaat

SEQ ID NO: 336456 - DNA, 13 bp, Homo sapiens
ggaggggtaaata

SEQ ID NO: 336457 - DNA, 14 bp, Homo sapiens
ggaggggtaaatat

SEQ ID NO: 336458 - DNA, 15 bp, Homo sapiens
ggaggggtaaatata

SEQ ID NO: 336459 - DNA, 23 bp, Homo sapiens
ggaggggtcagcaggggggttgg

SEQ ID NO: 336460 - DNA, 23 bp, Homo sapiens
ggagggtaaatgatgtggtgcct

SEQ ID NO: 336461 - DNA, 24 bp, Homo sapiens
ggagggtccctaattctcttcgct

SEQ ID NO: 336462 - DNA, 21 bp, Homo sapiens
ggaggtagagaggggactggg

SEQ ID NO: 336463 - DNA, 17 bp, Homo sapiens
ggaggtgagaccacctc

SEQ ID NO: 336464 - DNA, 22 bp, Homo sapiens
ggaggtgagatcacagcctcca

SEQ ID NO: 336465 - DNA, 22 bp, Homo sapiens
ggaggtgcttaagcagaagcat

SEQ ID NO: 336466 - DNA, 20 bp, Homo sapiens
ggaggtgggcatgccaccct

SEQ ID NO: 336467 - DNA, 22 bp, Homo sapiens
ggaggtgggcatgccaccctca

SEQ ID NO: 336468 - DNA, 23 bp, Homo sapiens
ggaggtgggccacacccaggaag

SEQ ID NO: 336469 - DNA, 23 bp, Homo sapiens
ggaggtgggtgagcgggtggggt

SEQ ID NO: 336470 - DNA, 21 bp, Homo sapiens
ggaggtgtttaaagagaggtt

SEQ ID NO: 336471 - DNA, 14 bp, Homo sapiens
ggaggttctcagag

SEQ ID NO: 336472 - DNA, 19 bp, Homo sapiens
ggaggttctcagagccaag

SEQ ID NO: 336473 - DNA, 20 bp, Homo sapiens
ggaggttctcagagccaagt

SEQ ID NO: 336474 - DNA, 21 bp, Homo sapiens
ggaggttgccgtgagccaaga

SEQ ID NO: 336475 - DNA, 16 bp, Homo sapiens
ggaggttggtgactga

SEQ ID NO: 336476 - DNA, 16 bp, Homo sapiens
ggagtacaaagacagg

SEQ ID NO: 336477 - DNA, 20 bp, Homo sapiens
ggagtacaaagacagggaat

SEQ ID NO: 336478 - DNA, 13 bp, Homo sapiens
ggagtacctgctg

SEQ ID NO: 336479 - DNA, 11 bp, Homo sapiens
ggagtactttc

SEQ ID NO: 336480 - DNA, 14 bp, Homo sapiens
ggagtactttcctt

SEQ ID NO: 336481 - DNA, 14 bp, Homo sapiens
ggagtatctgggaa

SEQ ID NO: 336482 - DNA, 19 bp, Homo sapiens
ggagtcaagtgtgcctgct

SEQ ID NO: 336483 - DNA, 19 bp, Homo sapiens
ggagtcagagccctggctg

SEQ ID NO: 336484 - DNA, 13 bp, Homo sapiens
ggagtcagggagc

SEQ ID NO: 336485 - DNA, 18 bp, Homo sapiens
ggagtcagggagccctgg

SEQ ID NO: 336486 - DNA, 21 bp, Homo sapiens
ggagtcccctccccggcccta

SEQ ID NO: 336487 - DNA, 23 bp, Homo sapiens
ggagtcccctccccggccctacc

SEQ ID NO: 336488 - DNA, 14 bp, Homo sapiens
ggagtcctgttctc

SEQ ID NO: 336489 - DNA, 20 bp, Homo sapiens
ggagtcctgttctcagagct

SEQ ID NO: 336490 - DNA, 12 bp, Homo sapiens
ggagtctccctc

SEQ ID NO: 336491 - DNA, 17 bp, Homo sapiens
ggagtctgaaggagagg

SEQ ID NO: 336492 - DNA, 15 bp, Homo sapiens
ggagtctgcttgtct

SEQ ID NO: 336493 - DNA, 16 bp, Homo sapiens
ggagtctgtgctcttt

SEQ ID NO: 336494 - DNA, 21 bp, Homo sapiens
ggagtgaggcttccaggctct

SEQ ID NO: 336495 - DNA, 18 bp, Homo sapiens
ggagtgcagggaggagag

SEQ ID NO: 336496 - DNA, 12 bp, Homo sapiens
ggagtgcagtgg

SEQ ID NO: 336497 - DNA, 22 bp, Homo sapiens
ggagtgcatggccacagccacc

SEQ ID NO: 336498 - DNA, 17 bp, Homo sapiens
ggagtgctgcttgtgcc

SEQ ID NO: 336499 - DNA, 20 bp, Homo sapiens
ggagtgctgcttgtgcctcc

SEQ ID NO: 336500 - DNA, 22 bp, Homo sapiens
ggagtgctggaatggggacctg

SEQ ID NO: 336501 - DNA, 18 bp, Homo sapiens
ggagtggaaggtctattg

SEQ ID NO: 336502 - DNA, 13 bp, Homo sapiens
ggagtgggagagg

SEQ ID NO: 336503 - DNA, 24 bp, Homo sapiens
ggagtgggagaggaagccacgtgc

SEQ ID NO: 336504 - DNA, 18 bp, Homo sapiens
ggagtgggtgggacacag

SEQ ID NO: 336505 - DNA, 22 bp, Homo sapiens
ggagtggtaacaagaggagcag

SEQ ID NO: 336506 - DNA, 15 bp, Homo sapiens
ggagtgtgtgggggt

SEQ ID NO: 336507 - DNA, 23 bp, Homo sapiens
ggagtgtgtgggggtctgggagg

SEQ ID NO: 336508 - DNA, 17 bp, Homo sapiens
ggagtgttctgtttccc

SEQ ID NO: 336509 - DNA, 22 bp, Homo sapiens
ggagttacattaatgttaattc

SEQ ID NO: 336510 - DNA, 12 bp, Homo sapiens
ggagttcaatga

SEQ ID NO: 336511 - DNA, 17 bp, Homo sapiens
ggagttcaatgatctag

SEQ ID NO: 336512 - DNA, 12 bp, Homo sapiens
ggagttcagagg

SEQ ID NO: 336513 - DNA, 15 bp, Homo sapiens
ggagttcctaacagg

SEQ ID NO: 336514 - DNA, 15 bp, Homo sapiens
ggagttctggttcct

SEQ ID NO: 336515 - DNA, 13 bp, Homo sapiens
ggataaaaaagaa

SEQ ID NO: 336516 - DNA, 22 bp, Homo sapiens
ggataaaacattagaagaaaac

SEQ ID NO: 336517 - DNA, 12 bp, Homo sapiens
ggataaatcatt

SEQ ID NO: 336518 - DNA, 15 bp, Homo sapiens
ggataagccagctgc

SEQ ID NO: 336519 - DNA, 12 bp, Homo sapiens
ggatagcctttg

SEQ ID NO: 336520 - DNA, 22 bp, Homo sapiens
ggatatctgttagatgctacta

SEQ ID NO: 336521 - DNA, 11 bp, Homo sapiens
ggatatttaac

SEQ ID NO: 336522 - DNA, 16 bp, Homo sapiens
ggatatttaagaaaat

SEQ ID NO: 336523 - DNA, 22 bp, Homo sapiens
ggatatttaagaaaatacaata

SEQ ID NO: 336524 - DNA, 13 bp, Homo sapiens
ggatattttcaaa

SEQ ID NO: 336525 - DNA, 23 bp, Homo sapiens
ggatcagagtctggcctgccagg

SEQ ID NO: 336526 - DNA, 12 bp, Homo sapiens
ggatcagcctcc

SEQ ID NO: 336527 - DNA, 22 bp, Homo sapiens
ggatcagcctccgccattccaa

SEQ ID NO: 336528 - DNA, 20 bp, Homo sapiens
ggatcagggaatccagctcc

SEQ ID NO: 336529 - DNA, 21 bp, Homo sapiens
ggatccaattgatgtatatgt

SEQ ID NO: 336530 - DNA, 15 bp, Homo sapiens
ggatccagagagaag

SEQ ID NO: 336531 - DNA, 16 bp, Homo sapiens
ggatccgctgccacca

SEQ ID NO: 336532 - DNA, 23 bp, Homo sapiens
ggatccgtgctgtctcctttgga

SEQ ID NO: 336533 - DNA, 13 bp, Homo sapiens
ggatcctgcagga

SEQ ID NO: 336534 - DNA, 15 bp, Homo sapiens
ggatcctggagcccc

SEQ ID NO: 336535 - DNA, 17 bp, Homo sapiens
ggcaccagccccctgga

SEQ ID NO: 336536 - DNA, 18 bp, Homo sapiens
ggcaccagccccctggat

SEQ ID NO: 336537 - DNA, 18 bp, Homo sapiens
ggcaccagctctgtggcc

SEQ ID NO: 336538 - DNA, 20 bp, Homo sapiens
ggcaccagctctgtggcctg

SEQ ID NO: 336539 - DNA, 20 bp, Homo sapiens
ggcaccatagaagaacagca

SEQ ID NO: 336540 - DNA, 19 bp, Homo sapiens
ggcaccattcaggaacctg

SEQ ID NO: 336541 - DNA, 14 bp, Homo sapiens
ggcaccgcagcctg

SEQ ID NO: 336542 - DNA, 13 bp, Homo sapiens
ggcaccgcccacc

SEQ ID NO: 336543 - DNA, 15 bp, Homo sapiens
ggcaccggcgctgca

SEQ ID NO: 336544 - DNA, 16 bp, Homo sapiens
ggcaccggcgctgcag

SEQ ID NO: 336545 - DNA, 19 bp, Homo sapiens
ggcaccggcgctgcaggta

SEQ ID NO: 336546 - DNA, 13 bp, Homo sapiens
ggcacctcctgag

SEQ ID NO: 336547 - DNA, 12 bp, Homo sapiens
ggcacctgctgg

SEQ ID NO: 336548 - DNA, 14 bp, Homo sapiens
ggcacctggcctgc

SEQ ID NO: 336549 - DNA, 15 bp, Homo sapiens
ggcacctggcctgct

SEQ ID NO: 336550 - DNA, 16 bp, Homo sapiens
ggcacctggcctgctg

SEQ ID NO: 336551 - DNA, 19 bp, Homo sapiens
ggcacctggcctgctggga

SEQ ID NO: 336552 - DNA, 14 bp, Homo sapiens
ggcacctggggagt

SEQ ID NO: 336553 - DNA, 17 bp, Homo sapiens
ggcacctggggagtggg

SEQ ID NO: 336554 - DNA, 16 bp, Homo sapiens
ggcacctgtggccaga

SEQ ID NO: 336555 - DNA, 17 bp, Homo sapiens
ggcacctgtggccagag

SEQ ID NO: 336556 - DNA, 23 bp, Homo sapiens
tggtggaggaaacttccaacttt

SEQ ID NO: 336557 - DNA, 16 bp, Homo sapiens
tggtggcaataaatgt

SEQ ID NO: 336558 - DNA, 19 bp, Homo sapiens
tggtggcagattttacaaa

SEQ ID NO: 336559 - DNA, 12 bp, Homo sapiens
tggtggccccag

SEQ ID NO: 336560 - DNA, 16 bp, Homo sapiens
tggtggcccctcccca

SEQ ID NO: 336561 - DNA, 19 bp, Homo sapiens
tggtggcccgacagcctgg

SEQ ID NO: 336562 - DNA, 21 bp, Homo sapiens
tggtggcccgacagcctggca

SEQ ID NO: 336563 - DNA, 22 bp, Homo sapiens
tggtggccgtcacgctttcatg

SEQ ID NO: 336564 - DNA, 13 bp, Homo sapiens
tggtggctggagg

SEQ ID NO: 336565 - DNA, 16 bp, Homo sapiens
tggtgggctccagagt

SEQ ID NO: 336566 - DNA, 19 bp, Homo sapiens
tggtgggctccagagtagg

SEQ ID NO: 336567 - DNA, 16 bp, Homo sapiens
tggtggggatattttt

SEQ ID NO: 336568 - DNA, 16 bp, Homo sapiens
tggtggggctgagcct

SEQ ID NO: 336569 - DNA, 17 bp, Homo sapiens
tggtgggggtagagctg

SEQ ID NO: 336570 - DNA, 23 bp, Homo sapiens
tggtggggtgtgttccaactgcc

SEQ ID NO: 336571 - DNA, 18 bp, Homo sapiens
tggtggttatgtcccatg

SEQ ID NO: 336572 - DNA, 14 bp, Homo sapiens
tggtggtttcagaa

SEQ ID NO: 336573 - DNA, 18 bp, Homo sapiens
tggtggtttctatacatg

SEQ ID NO: 336574 - DNA, 16 bp, Homo sapiens
tggtggtttttgctct

SEQ ID NO: 336575 - DNA, 20 bp, Homo sapiens
tggtgtactgggttaatggc

SEQ ID NO: 336576 - DNA, 13 bp, Homo sapiens
tggtgtagctgtc

SEQ ID NO: 336577 - DNA, 22 bp, Homo sapiens
tggtgtatatcatgaagccttg

SEQ ID NO: 336578 - DNA, 23 bp, Homo sapiens
tggtgtccccttcccctgctgac

SEQ ID NO: 336579 - DNA, 15 bp, Homo sapiens
tggtgtccttcttcc

SEQ ID NO: 336580 - DNA, 19 bp, Homo sapiens
tggtgtcctttccctccac

SEQ ID NO: 336581 - DNA, 22 bp, Homo sapiens
tggtgtctgatgtgtgcccaga

SEQ ID NO: 336582 - DNA, 18 bp, Homo sapiens
tggtgtgaggcccccgga

SEQ ID NO: 336583 - DNA, 20 bp, Homo sapiens
tggtgtgccacaggctgcaa

SEQ ID NO: 336584 - DNA, 15 bp, Homo sapiens
tggtgtgtgtctctg

SEQ ID NO: 336585 - DNA, 16 bp, Homo sapiens
tggtgtgtgtctctga

SEQ ID NO: 336586 - DNA, 18 bp, Homo sapiens
tggtgtgtgtctctgaca

SEQ ID NO: 336587 - DNA, 18 bp, Homo sapiens
tggtgttggcagtgtttg

SEQ ID NO: 336588 - DNA, 17 bp, Homo sapiens
tggtgttttaaagagaa

SEQ ID NO: 336589 - DNA, 19 bp, Homo sapiens
tggttaccgagtatctgta

SEQ ID NO: 336590 - DNA, 13 bp, Homo sapiens
tggttagctcagc

SEQ ID NO: 336591 - DNA, 18 bp, Homo sapiens
tggttagctcagccccag

SEQ ID NO: 336592 - DNA, 23 bp, Homo sapiens
tggttagctcagccccagcccag

SEQ ID NO: 336593 - DNA, 13 bp, Homo sapiens
tggttatgtccca

SEQ ID NO: 336594 - DNA, 16 bp, Homo sapiens
tggttatgtcccatga

SEQ ID NO: 336595 - DNA, 17 bp, Homo sapiens
tggttattagcaaggct

SEQ ID NO: 336596 - DNA, 13 bp, Homo sapiens
tggttcagtggga

SEQ ID NO: 336597 - DNA, 16 bp, Homo sapiens
tggttcatcagtgtta

SEQ ID NO: 336598 - DNA, 23 bp, Homo sapiens
tggttcatcagtgttaaaaaatt

SEQ ID NO: 336599 - DNA, 23 bp, Homo sapiens
tggttccagaacgtctctcacct

SEQ ID NO: 336600 - DNA, 13 bp, Homo sapiens
tggttccatgcct

SEQ ID NO: 336601 - DNA, 22 bp, Homo sapiens
tggttccatgcctgagggtgga

SEQ ID NO: 336602 - DNA, 15 bp, Homo sapiens
tggttcccaataaaa

SEQ ID NO: 336603 - DNA, 21 bp, Homo sapiens
tggttcccccaggaccctgag

SEQ ID NO: 336604 - DNA, 11 bp, Homo sapiens
tggttcccctg

SEQ ID NO: 336605 - DNA, 18 bp, Homo sapiens
tggttcccctgttcactc

SEQ ID NO: 336606 - DNA, 19 bp, Homo sapiens
tggttcccctgttcactct

SEQ ID NO: 336607 - DNA, 23 bp, Homo sapiens
tggttcccctgttcactctactt

SEQ ID NO: 336608 - DNA, 17 bp, Homo sapiens
tggttccctctttcctg

SEQ ID NO: 336609 - DNA, 23 bp, Homo sapiens
tggttccctttgctccaccccac

SEQ ID NO: 336610 - DNA, 17 bp, Homo sapiens
tggttcctaagcctgtt

SEQ ID NO: 336611 - DNA, 13 bp, Homo sapiens
tggttcctccagc

SEQ ID NO: 336612 - DNA, 14 bp, Homo sapiens
tggttcctccagca

SEQ ID NO: 336613 - DNA, 16 bp, Homo sapiens
tggttccttccctggg

SEQ ID NO: 336614 - DNA, 15 bp, Homo sapiens
tggttctaatagaac

SEQ ID NO: 336615 - DNA, 15 bp, Homo sapiens
tggttctgcttcaat

SEQ ID NO: 336616 - DNA, 14 bp, Homo sapiens
tggttcttgccttc

SEQ ID NO: 336617 - DNA, 17 bp, Homo sapiens
tggttgagaaatgaata

SEQ ID NO: 336618 - DNA, 15 bp, Homo sapiens
tggttgatgggttct

SEQ ID NO: 336619 - DNA, 17 bp, Homo sapiens
tggttgcacgttaaaaa

SEQ ID NO: 336620 - DNA, 13 bp, Homo sapiens
tggttggaggccc

SEQ ID NO: 336621 - DNA, 15 bp, Homo sapiens
tggttggaggcctgg

SEQ ID NO: 336622 - DNA, 20 bp, Homo sapiens
tggttgggacaatggcaata

SEQ ID NO: 336623 - DNA, 12 bp, Homo sapiens
tggttgtatttc

SEQ ID NO: 336624 - DNA, 14 bp, Homo sapiens
tggttgtatttcta

SEQ ID NO: 336625 - DNA, 15 bp, Homo sapiens
tggttgtcaatatta

SEQ ID NO: 336626 - DNA, 23 bp, Homo sapiens
tggttgtcatttttgcagtagag

SEQ ID NO: 336627 - DNA, 12 bp, Homo sapiens
tggttgttgcca

SEQ ID NO: 336628 - DNA, 17 bp, Homo sapiens
tggttgttgccaggttg

SEQ ID NO: 336629 - DNA, 22 bp, Homo sapiens
tggtttaaaaagtttcacgtct

SEQ ID NO: 336630 - DNA, 18 bp, Homo sapiens
tggtttaacttctgcctg

SEQ ID NO: 336631 - DNA, 15 bp, Homo sapiens
tggtttactgctgtc

SEQ ID NO: 336632 - DNA, 12 bp, Homo sapiens
tggtttataatc

SEQ ID NO: 336633 - DNA, 21 bp, Homo sapiens
tggtttgactcattaatttct

SEQ ID NO: 336634 - DNA, 22 bp, Homo sapiens
tggtttgccatgtcgcttttgg

SEQ ID NO: 336635 - DNA, 15 bp, Homo sapiens
tggtttgtgagcctt

SEQ ID NO: 336636 - DNA, 22 bp, Homo sapiens
tggttttcctaaatgcagtgaa

SEQ ID NO: 336637 - DNA, 19 bp, Homo sapiens
tggttttcttttgccatga

SEQ ID NO: 336638 - DNA, 20 bp, Homo sapiens
tggtttttctgttccctgct

SEQ ID NO: 336639 - DNA, 16 bp, Homo sapiens
tggtttttcttttctt

SEQ ID NO: 336640 - DNA, 15 bp, Homo sapiens
tggtttttgttgagt

SEQ ID NO: 336641 - DNA, 22 bp, Homo sapiens
tggttttttttttttttttggc

SEQ ID NO: 336642 - DNA, 16 bp, Homo sapiens
tgtaaaaatatatatg

SEQ ID NO: 336643 - DNA, 13 bp, Homo sapiens
tgtaaaacaaaaa

SEQ ID NO: 336644 - DNA, 15 bp, Homo sapiens
tgtaaaacaaaaaac

SEQ ID NO: 336645 - DNA, 15 bp, Homo sapiens
tgtaaaactgaggca

SEQ ID NO: 336646 - DNA, 12 bp, Homo sapiens
tgtaaaactgtg

SEQ ID NO: 336647 - DNA, 19 bp, Homo sapiens
tgtaaaactgtgacattcc

SEQ ID NO: 336648 - DNA, 22 bp, Homo sapiens
tgtaaaactgtgacattccaca

SEQ ID NO: 336649 - DNA, 14 bp, Homo sapiens
tgtaaaactttatt

SEQ ID NO: 336650 - DNA, 19 bp, Homo sapiens
tgtaaaagcaacatcagct

SEQ ID NO: 336651 - DNA, 15 bp, Homo sapiens
tgtaaaatcttgtca

SEQ ID NO: 336652 - DNA, 16 bp, Homo sapiens
tgtaaaatcttgtcat

SEQ ID NO: 336653 - DNA, 18 bp, Homo sapiens
tgtaaaatcttgtcatgt

SEQ ID NO: 336654 - DNA, 13 bp, Homo sapiens
tgtaaaattcata

SEQ ID NO: 336655 - DNA, 15 bp, Homo sapiens
tgtaaacacagtgtg

SEQ ID NO: 336656 - DNA, 16 bp, Homo sapiens
tgtaaactcttcacct

SEQ ID NO: 336657 - DNA, 22 bp, Homo sapiens
tgtaaaggtaggtgcatgcctt

SEQ ID NO: 336658 - DNA, 19 bp, Homo sapiens
tgtaaataaaaatagctat

SEQ ID NO: 336659 - DNA, 12 bp, Homo sapiens
tgtaaataagag

SEQ ID NO: 336660 - DNA, 21 bp, Homo sapiens
tgtaaatacaaaataaaatta

SEQ ID NO: 336661 - DNA, 20 bp, Homo sapiens
tgtaaatacatgtgtggatg

SEQ ID NO: 336662 - DNA, 20 bp, Homo sapiens
tgtaaatattctatatgaat

SEQ ID NO: 336663 - DNA, 15 bp, Homo sapiens
tgtaaatatttttcc

SEQ ID NO: 336664 - DNA, 19 bp, Homo sapiens
tgtaaatatttttccctcc

SEQ ID NO: 336665 - DNA, 19 bp, Homo sapiens
tgtaaatcctagacttgaa

SEQ ID NO: 336666 - DNA, 16 bp, Homo sapiens
tgtattcactaaaata

SEQ ID NO: 336667 - DNA, 13 bp, Homo sapiens
tgtattcagagcc

SEQ ID NO: 336668 - DNA, 14 bp, Homo sapiens
tgtattcagagcca

SEQ ID NO: 336669 - DNA, 15 bp, Homo sapiens
tgtattcatacagca

SEQ ID NO: 336670 - DNA, 20 bp, Homo sapiens
tgtattcccgttttacagat

SEQ ID NO: 336671 - DNA, 17 bp, Homo sapiens
tgtattcgtgcattttt

SEQ ID NO: 336672 - DNA, 20 bp, Homo sapiens
tgtattctagctaatgtaat

SEQ ID NO: 336673 - DNA, 20 bp, Homo sapiens
tgtattctctgtccagggct

SEQ ID NO: 336674 - DNA, 18 bp, Homo sapiens
tgtattctgtggattcta

SEQ ID NO: 336675 - DNA, 19 bp, Homo sapiens
tgtattctgtggattctat

SEQ ID NO: 336676 - DNA, 18 bp, Homo sapiens
tgtattgcagctaagctc

SEQ ID NO: 336677 - DNA, 22 bp, Homo sapiens
tgtattgccatcgggtgccaaa

SEQ ID NO: 336678 - DNA, 19 bp, Homo sapiens
tgtattgtaaacatgtgtt

SEQ ID NO: 336679 - DNA, 14 bp, Homo sapiens
tgtattgttcccag

SEQ ID NO: 336680 - DNA, 15 bp, Homo sapiens
tgtattgttcccagt

SEQ ID NO: 336681 - DNA, 15 bp, Homo sapiens
tgtatttatattaga

SEQ ID NO: 336682 - DNA, 19 bp, Homo sapiens
tgtatttattttcctcccc

SEQ ID NO: 336683 - DNA, 12 bp, Homo sapiens
tgtatttctgta

SEQ ID NO: 336684 - DNA, 13 bp, Homo sapiens
tgtatttctgtag

SEQ ID NO: 336685 - DNA, 14 bp, Homo sapiens
tgtatttctgtgga

SEQ ID NO: 336686 - DNA, 10 bp, Homo sapiens
tgtatttctt

SEQ ID NO: 336687 - DNA, 15 bp, Homo sapiens
tgtatttcttttata

SEQ ID NO: 336688 - DNA, 17 bp, Homo sapiens
tgtatttcttttatata

SEQ ID NO: 336689 - DNA, 20 bp, Homo sapiens
tgtattttaaattctcagtc

SEQ ID NO: 336690 - DNA, 14 bp, Homo sapiens
tgtattttaactca

SEQ ID NO: 336691 - DNA, 16 bp, Homo sapiens
tgtattttctgtcact

SEQ ID NO: 336692 - DNA, 20 bp, Homo sapiens
tgtattttctgtcactgtag

SEQ ID NO: 336693 - DNA, 22 bp, Homo sapiens
tgtattttcttcccatttgtaa

SEQ ID NO: 336694 - DNA, 19 bp, Homo sapiens
tgtattttcttttatatct

SEQ ID NO: 336695 - DNA, 17 bp, Homo sapiens
tgtattttgaaaacact

SEQ ID NO: 336696 - DNA, 20 bp, Homo sapiens
tgtatttttaaattctgctc

SEQ ID NO: 336697 - DNA, 14 bp, Homo sapiens
tgtatttttagaga

SEQ ID NO: 336698 - DNA, 19 bp, Homo sapiens
tgtatttttagtagagaca

SEQ ID NO: 336699 - DNA, 17 bp, Homo sapiens
tgtatttttattttcct

SEQ ID NO: 336700 - DNA, 15 bp, Homo sapiens
tgtcaaaaaccagaa

SEQ ID NO: 336701 - DNA, 16 bp, Homo sapiens
tgtcaaagtggtgaga

SEQ ID NO: 336702 - DNA, 22 bp, Homo sapiens
aatgttttcatttacaggaaat

SEQ ID NO: 336703 - DNA, 18 bp, Homo sapiens
aatgttttcttttctgtg

SEQ ID NO: 336704 - DNA, 13 bp, Homo sapiens
aatgttttgtaca

SEQ ID NO: 336705 - DNA, 21 bp, Homo sapiens
aatgtttttctgccagggagc

SEQ ID NO: 336706 - DNA, 22 bp, Homo sapiens
aattaaaaaaatatatattgta

SEQ ID NO: 336707 - DNA, 21 bp, Homo sapiens
aattaaaacaatgtcaaggtg

SEQ ID NO: 336708 - DNA, 13 bp, Homo sapiens
aattaaaacactt

SEQ ID NO: 336709 - DNA, 14 bp, Homo sapiens
aattaaaacacttt

SEQ ID NO: 336710 - DNA, 18 bp, Homo sapiens
aattaaaatccagcatcc

SEQ ID NO: 336711 - DNA, 14 bp, Homo sapiens
aattaaacaattta

SEQ ID NO: 336712 - DNA, 13 bp, Homo sapiens
aattaaactccta

SEQ ID NO: 336713 - DNA, 14 bp, Homo sapiens
aattaaataaaata

SEQ ID NO: 336714 - DNA, 14 bp, Homo sapiens
aattaaatatatgt

SEQ ID NO: 336715 - DNA, 12 bp, Homo sapiens
aattaaatgtag

SEQ ID NO: 336716 - DNA, 18 bp, Homo sapiens
aattaacatataatatat

SEQ ID NO: 336717 - DNA, 18 bp, Homo sapiens
aattaacctggtgctgga

SEQ ID NO: 336718 - DNA, 23 bp, Homo sapiens
aattaataaaaaatggaaagaat

SEQ ID NO: 336719 - DNA, 21 bp, Homo sapiens
aattaataaatcatgttttga

SEQ ID NO: 336720 - DNA, 19 bp, Homo sapiens
aattacaaccggttatcag

SEQ ID NO: 336721 - DNA, 11 bp, Homo sapiens
aattacaagtt

SEQ ID NO: 336722 - DNA, 12 bp, Homo sapiens
aattacaagttt

SEQ ID NO: 336723 - DNA, 16 bp, Homo sapiens
aattacaagtttcagt

SEQ ID NO: 336724 - DNA, 17 bp, Homo sapiens
aattacaagtttcagta

SEQ ID NO: 336725 - DNA, 15 bp, Homo sapiens
aattacacccatgca

SEQ ID NO: 336726 - DNA, 11 bp, Homo sapiens
aattacaggaa

SEQ ID NO: 336727 - DNA, 19 bp, Homo sapiens
aattacaggaagtactgga

SEQ ID NO: 336728 - DNA, 16 bp, Homo sapiens
aattacataacaggca

SEQ ID NO: 336729 - DNA, 21 bp, Homo sapiens
aattacctgataagggagagg

SEQ ID NO: 336730 - DNA, 22 bp, Homo sapiens
aattacctgtcatctgggccac

SEQ ID NO: 336731 - DNA, 16 bp, Homo sapiens
aattactaaattgtat

SEQ ID NO: 336732 - DNA, 15 bp, Homo sapiens
aattactttctgaat

SEQ ID NO: 336733 - DNA, 16 bp, Homo sapiens
aattagaaaatatagt

SEQ ID NO: 336734 - DNA, 20 bp, Homo sapiens
aattagaagaaaatggatga

SEQ ID NO: 336735 - DNA, 13 bp, Homo sapiens
aattagattttaa

SEQ ID NO: 336736 - DNA, 21 bp, Homo sapiens
aattagattttaaaacttcat

SEQ ID NO: 336737 - DNA, 20 bp, Homo sapiens
aattaggaataaataaaaat

SEQ ID NO: 336738 - DNA, 18 bp, Homo sapiens
aattagggctctaatttc

SEQ ID NO: 336739 - DNA, 13 bp, Homo sapiens
aattaggtcaagt

SEQ ID NO: 336740 - DNA, 22 bp, Homo sapiens
aattaggtcaagttcatagttt

SEQ ID NO: 336741 - DNA, 15 bp, Homo sapiens
aattagtaatgtact

SEQ ID NO: 336742 - DNA, 20 bp, Homo sapiens
aattataagctatgtcacta

SEQ ID NO: 336743 - DNA, 14 bp, Homo sapiens
aattataaggactg

SEQ ID NO: 336744 - DNA, 18 bp, Homo sapiens
aattataaggactgcatg

SEQ ID NO: 336745 - DNA, 15 bp, Homo sapiens
aattataatgcaaat

SEQ ID NO: 336746 - DNA, 16 bp, Homo sapiens
aattataatgcaaatt

SEQ ID NO: 336747 - DNA, 22 bp, Homo sapiens
aattatacagacctaatatcat

SEQ ID NO: 336748 - DNA, 23 bp, Homo sapiens
aattataccagtgttaagtgaca

SEQ ID NO: 336749 - DNA, 13 bp, Homo sapiens
aattatagtttca

SEQ ID NO: 336750 - DNA, 22 bp, Homo sapiens
aattatatcagagtatgtcagt

SEQ ID NO: 336751 - DNA, 17 bp, Homo sapiens
aattatatgatatgcat

SEQ ID NO: 336752 - DNA, 20 bp, Homo sapiens
aattatatgatatgcatgta

SEQ ID NO: 336753 - DNA, 15 bp, Homo sapiens
aattatcaagctaat

SEQ ID NO: 336754 - DNA, 19 bp, Homo sapiens
aattatcatcccaacagcc

SEQ ID NO: 336755 - DNA, 18 bp, Homo sapiens
aattatccaggatgtgtg

SEQ ID NO: 336756 - DNA, 17 bp, Homo sapiens
aattatcggaagcagtg

SEQ ID NO: 336757 - DNA, 19 bp, Homo sapiens
aattatcgggaacagtgtt

SEQ ID NO: 336758 - DNA, 23 bp, Homo sapiens
aattatctatttgtatatataca

SEQ ID NO: 336759 - DNA, 15 bp, Homo sapiens
aattatctttaaaac

SEQ ID NO: 336760 - DNA, 13 bp, Homo sapiens
aattatgacagtt

SEQ ID NO: 336761 - DNA, 15 bp, Homo sapiens
aattatgacagttat

SEQ ID NO: 336762 - DNA, 23 bp, Homo sapiens
aattatgctaacaaactgaaaaa

SEQ ID NO: 336763 - DNA, 17 bp, Homo sapiens
aattatgggaacaagtg

SEQ ID NO: 336764 - DNA, 22 bp, Homo sapiens
aattatgggaacaagtgtacag

SEQ ID NO: 336765 - DNA, 12 bp, Homo sapiens
aattatggtgaa

SEQ ID NO: 336766 - DNA, 18 bp, Homo sapiens
aattatgtatgtttacat

SEQ ID NO: 336767 - DNA, 18 bp, Homo sapiens
aattatgtcaaatggatg

SEQ ID NO: 336768 - DNA, 22 bp, Homo sapiens
aattatgtgacaacctttgtgt

SEQ ID NO: 336769 - DNA, 12 bp, Homo sapiens
aattatgtgcat

SEQ ID NO: 336770 - DNA, 17 bp, Homo sapiens
aattatgttattgaaaa

SEQ ID NO: 336771 - DNA, 14 bp, Homo sapiens
aattatgtttacct

SEQ ID NO: 336772 - DNA, 18 bp, Homo sapiens
aattattaactacattta

SEQ ID NO: 336773 - DNA, 19 bp, Homo sapiens
aattattaactacatttat

SEQ ID NO: 336774 - DNA, 19 bp, Homo sapiens
aattattacatctttatta

SEQ ID NO: 336775 - DNA, 13 bp, Homo sapiens
aattattattctt

SEQ ID NO: 336776 - DNA, 13 bp, Homo sapiens
aattattatttat

SEQ ID NO: 336777 - DNA, 21 bp, Homo sapiens
aattattatttatatatgtat

SEQ ID NO: 336778 - DNA, 18 bp, Homo sapiens
aattattcagttaagaaa

SEQ ID NO: 336779 - DNA, 17 bp, Homo sapiens
aattattcatagctgta

SEQ ID NO: 336780 - DNA, 20 bp, Homo sapiens
aattattccctgaattgttt

SEQ ID NO: 336781 - DNA, 22 bp, Homo sapiens
aattattccctgaattgtttga

SEQ ID NO: 336782 - DNA, 13 bp, Homo sapiens
aattattctagtc

SEQ ID NO: 336783 - DNA, 19 bp, Homo sapiens
aattattgtaaactttttc

SEQ ID NO: 336784 - DNA, 23 bp, Homo sapiens
aattatttaactaattaaaaaat

SEQ ID NO: 336785 - DNA, 14 bp, Homo sapiens
aattatttaataaa

SEQ ID NO: 336786 - DNA, 20 bp, Homo sapiens
aattatttctaaaacattaa

SEQ ID NO: 336787 - DNA, 14 bp, Homo sapiens
aattatttgtgtaa

SEQ ID NO: 336788 - DNA, 15 bp, Homo sapiens
aattattttaaatta

SEQ ID NO: 336789 - DNA, 17 bp, Homo sapiens
aattattttaaattata

SEQ ID NO: 336790 - DNA, 20 bp, Homo sapiens
aattattttaaattataagg

SEQ ID NO: 336791 - DNA, 16 bp, Homo sapiens
aattattttgaatgtc

SEQ ID NO: 336792 - DNA, 19 bp, Homo sapiens
aattattttggatctatca

SEQ ID NO: 336793 - DNA, 15 bp, Homo sapiens
aattattttgttact

SEQ ID NO: 336794 - DNA, 19 bp, Homo sapiens
aattattttgttactgtct

SEQ ID NO: 336795 - DNA, 21 bp, Homo sapiens
aattattttgttactgtctgt

SEQ ID NO: 336796 - DNA, 13 bp, Homo sapiens
aatttaagcattg

SEQ ID NO: 336797 - DNA, 15 bp, Homo sapiens
aatttaagcattgtt

SEQ ID NO: 336798 - DNA, 23 bp, Homo sapiens
aatttaagcattgtttgcttatt

SEQ ID NO: 336799 - DNA, 20 bp, Homo sapiens
aatttaattcctctttttag

SEQ ID NO: 336800 - DNA, 17 bp, Homo sapiens
aatttacctgaagtctt

SEQ ID NO: 336801 - DNA, 20 bp, Homo sapiens
aatttacctttaaaataata

SEQ ID NO: 336802 - DNA, 13 bp, Homo sapiens
aatttacgtatat

SEQ ID NO: 336803 - DNA, 18 bp, Homo sapiens
aatttacgtatatttcat

SEQ ID NO: 336804 - DNA, 17 bp, Homo sapiens
aatttactttttaaaca

SEQ ID NO: 336805 - DNA, 16 bp, Homo sapiens
aatttaggaatgctca

SEQ ID NO: 336806 - DNA, 19 bp, Homo sapiens
aatttaggaatgctcaatg

SEQ ID NO: 336807 - DNA, 22 bp, Homo sapiens
aatttagtcccttaaaaattaa

SEQ ID NO: 336808 - DNA, 17 bp, Homo sapiens
aatttatacaatatcat

SEQ ID NO: 336809 - DNA, 16 bp, Homo sapiens
aatttatatttgtctc

SEQ ID NO: 336810 - DNA, 18 bp, Homo sapiens
aatttatcttgtctctgg

SEQ ID NO: 336811 - DNA, 20 bp, Homo sapiens
aatttatgagtttttgatag

SEQ ID NO: 336812 - DNA, 13 bp, Homo sapiens
aatttattcttat

SEQ ID NO: 336813 - DNA, 20 bp, Homo sapiens
aatttattttattttagcag

SEQ ID NO: 336814 - DNA, 14 bp, Homo sapiens
aatttcaaaatgca

SEQ ID NO: 336815 - DNA, 15 bp, Homo sapiens
aatttcaaaatgcat

SEQ ID NO: 336816 - DNA, 16 bp, Homo sapiens
aatttcaaaatgcatg

SEQ ID NO: 336817 - DNA, 22 bp, Homo sapiens
aatttcaaaatgcatgtgattg

SEQ ID NO: 336818 - DNA, 14 bp, Homo sapiens
aatttcaatttgtt

SEQ ID NO: 336819 - DNA, 15 bp, Homo sapiens
aatttcacagataat

SEQ ID NO: 336820 - DNA, 22 bp, Homo sapiens
aatttcagctagttaataattc

SEQ ID NO: 336821 - DNA, 16 bp, Homo sapiens
aatttcagtaagatca

SEQ ID NO: 336822 - DNA, 14 bp, Homo sapiens
aatttcataaattg

SEQ ID NO: 336823 - DNA, 16 bp, Homo sapiens
aatttcatatgctgta

SEQ ID NO: 336824 - DNA, 17 bp, Homo sapiens
aatttccagtacctttg

SEQ ID NO: 336825 - DNA, 17 bp, Homo sapiens
aatttcctaatgagata

SEQ ID NO: 336826 - DNA, 14 bp, Homo sapiens
aatttcctatctgt

SEQ ID NO: 336827 - DNA, 23 bp, Homo sapiens
aatttctacccatgttgggaaaa

SEQ ID NO: 336828 - DNA, 22 bp, Homo sapiens
aatttctagacagtattgccac

SEQ ID NO: 336829 - DNA, 20 bp, Homo sapiens
aatttctctcaatttgggtc

SEQ ID NO: 336830 - DNA, 18 bp, Homo sapiens
aatttctgtccagaaaat

SEQ ID NO: 336831 - DNA, 23 bp, Homo sapiens
aatttcttctgtagctattcttt

SEQ ID NO: 336832 - DNA, 24 bp, Homo sapiens
aatttcttgctctatctctcaaaa

SEQ ID NO: 336833 - DNA, 23 bp, Homo sapiens
aatttgaaatcaccttttctaaa

SEQ ID NO: 336834 - DNA, 13 bp, Homo sapiens
aatttgaaccaaa

SEQ ID NO: 336835 - DNA, 17 bp, Homo sapiens
aatttgaaccaaaacat

SEQ ID NO: 336836 - DNA, 23 bp, Homo sapiens
aatttgaaccaaaacattccgtt

SEQ ID NO: 336837 - DNA, 18 bp, Homo sapiens
aatttgaagaattaatga

SEQ ID NO: 336838 - DNA, 12 bp, Homo sapiens
aatttgaatgaa

SEQ ID NO: 336839 - DNA, 14 bp, Homo sapiens
ggcataggcctggg

SEQ ID NO: 336840 - DNA, 16 bp, Homo sapiens
ggcataggcctgggtg

SEQ ID NO: 336841 - DNA, 21 bp, Homo sapiens
ggcatcagctttccctggctc

SEQ ID NO: 336842 - DNA, 15 bp, Homo sapiens
ggcatcaggaaagga

SEQ ID NO: 336843 - DNA, 16 bp, Homo sapiens
ggcatcaggcactggt

SEQ ID NO: 336844 - DNA, 20 bp, Homo sapiens
ggcatcaggcactggtggca

SEQ ID NO: 336845 - DNA, 14 bp, Homo sapiens
ggcatcattttcac

SEQ ID NO: 336846 - DNA, 17 bp, Homo sapiens
ggcatccacccagtgct

SEQ ID NO: 336847 - DNA, 21 bp, Homo sapiens
ggcatccacccagtgctgcca

SEQ ID NO: 336848 - DNA, 22 bp, Homo sapiens
ggcatccacccagtgctgccat

SEQ ID NO: 336849 - DNA, 16 bp, Homo sapiens
ggcatccccagccccc

SEQ ID NO: 336850 - DNA, 17 bp, Homo sapiens
ggcatccccagccccct

SEQ ID NO: 336851 - DNA, 22 bp, Homo sapiens
ggcatcgtagaagagatgtggc

SEQ ID NO: 336852 - DNA, 10 bp, Homo sapiens
ggcatctaag

SEQ ID NO: 336853 - DNA, 14 bp, Homo sapiens
ggcatctccaggaa

SEQ ID NO: 336854 - DNA, 16 bp, Homo sapiens
ggcatctcctgtgcat

SEQ ID NO: 336855 - DNA, 17 bp, Homo sapiens
ggcatctcctgtgcatg

SEQ ID NO: 336856 - DNA, 21 bp, Homo sapiens
ggcatctcctgtgcatgggtg

SEQ ID NO: 336857 - DNA, 17 bp, Homo sapiens
ggcatctgacacaaaaa

SEQ ID NO: 336858 - DNA, 20 bp, Homo sapiens
ggcatctgacacaaaaaaag

SEQ ID NO: 336859 - DNA, 14 bp, Homo sapiens
ggcatctgcccctc

SEQ ID NO: 336860 - DNA, 18 bp, Homo sapiens
ggcatctgcccctccccc

SEQ ID NO: 336861 - DNA, 15 bp, Homo sapiens
ggcatgaagacagat

SEQ ID NO: 336862 - DNA, 14 bp, Homo sapiens
ggcatgacactcta

SEQ ID NO: 336863 - DNA, 15 bp, Homo sapiens
ggcatgacactctag

SEQ ID NO: 336864 - DNA, 23 bp, Homo sapiens
ggcatgacactctagtgacttcc

SEQ ID NO: 336865 - DNA, 20 bp, Homo sapiens
ggcatgaccctggagcccgg

SEQ ID NO: 336866 - DNA, 17 bp, Homo sapiens
ggcatgagctcttggca

SEQ ID NO: 336867 - DNA, 13 bp, Homo sapiens
ggcatgagggctg

SEQ ID NO: 336868 - DNA, 20 bp, Homo sapiens
ggcatgagggctgagatgcg

SEQ ID NO: 336869 - DNA, 13 bp, Homo sapiens
ggcatgccaccct

SEQ ID NO: 336870 - DNA, 14 bp, Homo sapiens
ggcatgccaccctc

SEQ ID NO: 336871 - DNA, 15 bp, Homo sapiens
ggcatgccgagtgcc

SEQ ID NO: 336872 - DNA, 16 bp, Homo sapiens
ggcatgcgaatgagct

SEQ ID NO: 336873 - DNA, 19 bp, Homo sapiens
ggcatgcgaatgagctggg

SEQ ID NO: 336874 - DNA, 23 bp, Homo sapiens
ggcatgcgaatgagctgggccct

SEQ ID NO: 336875 - DNA, 22 bp, Homo sapiens
ggcatgctggctcccagggcca

SEQ ID NO: 336876 - DNA, 17 bp, Homo sapiens
ggcatggcccagcctgg

SEQ ID NO: 336877 - DNA, 21 bp, Homo sapiens
ggcatggcccagcctggagcc

SEQ ID NO: 336878 - DNA, 21 bp, Homo sapiens
ggcatggctttatttgttttt

SEQ ID NO: 336879 - DNA, 18 bp, Homo sapiens
ggcatgggaatgaatgtc

SEQ ID NO: 336880 - DNA, 22 bp, Homo sapiens
ggcatgggaatgaatgtcagtg

SEQ ID NO: 336881 - DNA, 19 bp, Homo sapiens
ggcatgggggaggctctga

SEQ ID NO: 336882 - DNA, 19 bp, Homo sapiens
ggcatggtaccagccctgg

SEQ ID NO: 336883 - DNA, 19 bp, Homo sapiens
ggcatggtatttgagacat

SEQ ID NO: 336884 - DNA, 15 bp, Homo sapiens
ggcatgtattggcct

SEQ ID NO: 336885 - DNA, 21 bp, Homo sapiens
ggcatgtattggcctggaggt

SEQ ID NO: 336886 - DNA, 18 bp, Homo sapiens
ggcatgtgaaaagtaaaa

SEQ ID NO: 336887 - DNA, 21 bp, Homo sapiens
ggcatgtgtgcctgtggcaga

SEQ ID NO: 336888 - DNA, 16 bp, Homo sapiens
ggcattactctgcact

SEQ ID NO: 336889 - DNA, 17 bp, Homo sapiens
ggcattactctgcacta

SEQ ID NO: 336890 - DNA, 21 bp, Homo sapiens
ggcattcacacacagcctggc

SEQ ID NO: 336891 - DNA, 22 bp, Homo sapiens
ggcattcacacacagcctggcc

SEQ ID NO: 336892 - DNA, 23 bp, Homo sapiens
ggcattcacacacagcctggcct

SEQ ID NO: 336893 - DNA, 18 bp, Homo sapiens
ggcattcgcagtgcccag

SEQ ID NO: 336894 - DNA, 19 bp, Homo sapiens
ggcattcgcagtgcccagt

SEQ ID NO: 336895 - DNA, 13 bp, Homo sapiens
ggcattgggttct

SEQ ID NO: 336896 - DNA, 18 bp, Homo sapiens
ggcatttccgtggacagc

SEQ ID NO: 336897 - DNA, 21 bp, Homo sapiens
ggcatttgctgaataacaaca

SEQ ID NO: 336898 - DNA, 20 bp, Homo sapiens
ggcatttgtcttagagagag

SEQ ID NO: 336899 - DNA, 21 bp, Homo sapiens
ggcatttgtcttagagagaga

SEQ ID NO: 336900 - DNA, 22 bp, Homo sapiens
ggcatttttactactattctgt

SEQ ID NO: 336901 - DNA, 17 bp, Homo sapiens
ggccaaacatcagacct

SEQ ID NO: 336902 - DNA, 23 bp, Homo sapiens
ggccaaacatcagacctgtcttc

SEQ ID NO: 336903 - DNA, 16 bp, Homo sapiens
ggccaaatatgcactt

SEQ ID NO: 336904 - DNA, 17 bp, Homo sapiens
ggccaaatatgcacttt

SEQ ID NO: 336905 - DNA, 24 bp, Homo sapiens
ggccaaatatgcactttccctaga

SEQ ID NO: 336906 - DNA, 23 bp, Homo sapiens
ggccaacaatcctttctgcccac

SEQ ID NO: 336907 - DNA, 18 bp, Homo sapiens
ggccaacaccagggatgg

SEQ ID NO: 336908 - DNA, 20 bp, Homo sapiens
ggccaaggacactgatgggt

SEQ ID NO: 336909 - DNA, 15 bp, Homo sapiens
ggccaaggactgccg

SEQ ID NO: 336910 - DNA, 13 bp, Homo sapiens
ggccaaggcctca

SEQ ID NO: 336911 - DNA, 15 bp, Homo sapiens
ggccaaggcctcagg

SEQ ID NO: 336912 - DNA, 16 bp, Homo sapiens
ggccaaggccttctcc

SEQ ID NO: 336913 - DNA, 19 bp, Homo sapiens
ggccaaggccttctcctcc

SEQ ID NO: 336914 - DNA, 16 bp, Homo sapiens
ggccaagggctccagg

SEQ ID NO: 336915 - DNA, 15 bp, Homo sapiens
ggccaaggtcctgct

SEQ ID NO: 336916 - DNA, 16 bp, Homo sapiens
ggccaaggtcctgctc

SEQ ID NO: 336917 - DNA, 16 bp, Homo sapiens
ggccaagtgcaggctg

SEQ ID NO: 336918 - DNA, 18 bp, Homo sapiens
ggccaagtgcaggctggc

SEQ ID NO: 336919 - DNA, 15 bp, Homo sapiens
ggccacacccaggaa

SEQ ID NO: 336920 - DNA, 20 bp, Homo sapiens
ggccacagccacctccaccc

SEQ ID NO: 336921 - DNA, 17 bp, Homo sapiens
ggccacagccagaaccc

SEQ ID NO: 336922 - DNA, 14 bp, Homo sapiens
ggccacagctgctg

SEQ ID NO: 336923 - DNA, 15 bp, Homo sapiens
ggccacagctgctgg

SEQ ID NO: 336924 - DNA, 23 bp, Homo sapiens
ggccacagggcgagactccgtct

SEQ ID NO: 336925 - DNA, 22 bp, Homo sapiens
ggcccatctcaggtgccactcc

SEQ ID NO: 336926 - DNA, 21 bp, Homo sapiens
ggcccatctgccgcctggggc

SEQ ID NO: 336927 - DNA, 16 bp, Homo sapiens
ggcccatggccccagc

SEQ ID NO: 336928 - DNA, 17 bp, Homo sapiens
ggcccatggccccagct

SEQ ID NO: 336929 - DNA, 20 bp, Homo sapiens
ggcccatggccccagctggc

SEQ ID NO: 336930 - DNA, 20 bp, Homo sapiens
ggccccaaaaccacagccct

SEQ ID NO: 336931 - DNA, 20 bp, Homo sapiens
ggccccaaagcccagcccgg

SEQ ID NO: 336932 - DNA, 16 bp, Homo sapiens
ggccccacatgggaac

SEQ ID NO: 336933 - DNA, 21 bp, Homo sapiens
ggccccacccaccctctggtc

SEQ ID NO: 336934 - DNA, 23 bp, Homo sapiens
ggccccacccaccctctggtcct

SEQ ID NO: 336935 - DNA, 23 bp, Homo sapiens
ggccccaccctcgtggacacctg

SEQ ID NO: 336936 - DNA, 14 bp, Homo sapiens
ggccccagagactc

SEQ ID NO: 336937 - DNA, 13 bp, Homo sapiens
ggccccagatctg

SEQ ID NO: 336938 - DNA, 17 bp, Homo sapiens
ggccccagatctgcctg

SEQ ID NO: 336939 - DNA, 19 bp, Homo sapiens
ggccccagatctgcctggg

SEQ ID NO: 336940 - DNA, 13 bp, Homo sapiens
ggccccagcctcc

SEQ ID NO: 336941 - DNA, 12 bp, Homo sapiens
ggccccagctgg

SEQ ID NO: 336942 - DNA, 20 bp, Homo sapiens
ggccccaggtgccaccaata

SEQ ID NO: 336943 - DNA, 19 bp, Homo sapiens
ggccccatccagcatgtgt

SEQ ID NO: 336944 - DNA, 13 bp, Homo sapiens
ggccccatgctct

SEQ ID NO: 336945 - DNA, 17 bp, Homo sapiens
ggccccatgctctgccc

SEQ ID NO: 336946 - DNA, 15 bp, Homo sapiens
ggccccattctccct

SEQ ID NO: 336947 - DNA, 21 bp, Homo sapiens
ggccccattctccctccatgg

SEQ ID NO: 336948 - DNA, 23 bp, Homo sapiens
ggccccattctccctccatggca

SEQ ID NO: 336949 - DNA, 23 bp, Homo sapiens
ggcccccaaacatagcccctgcc

SEQ ID NO: 336950 - DNA, 20 bp, Homo sapiens
ggcccccaaattgccttcag

SEQ ID NO: 336951 - DNA, 15 bp, Homo sapiens
ggcccccagctgtgg

SEQ ID NO: 336952 - DNA, 19 bp, Homo sapiens
ggccccccaaatcccaggg

SEQ ID NO: 336953 - DNA, 17 bp, Homo sapiens
ggccccccagctcaggg

SEQ ID NO: 336954 - DNA, 19 bp, Homo sapiens
ggccccccagctcaggggc

SEQ ID NO: 336955 - DNA, 22 bp, Homo sapiens
ggccccccctcttttggccttg

SEQ ID NO: 336956 - DNA, 19 bp, Homo sapiens
ggcccccctccaggcatgc

SEQ ID NO: 336957 - DNA, 18 bp, Homo sapiens
ggcccccgccctctgccc

SEQ ID NO: 336958 - DNA, 18 bp, Homo sapiens
ggcccccggaggcgccca

SEQ ID NO: 336959 - DNA, 18 bp, Homo sapiens
ggcccccggccacgctcc

SEQ ID NO: 336960 - DNA, 13 bp, Homo sapiens
ggccccctgcatc

SEQ ID NO: 336961 - DNA, 20 bp, Homo sapiens
ggccccgcgcgtgcccccag

SEQ ID NO: 336962 - DNA, 21 bp, Homo sapiens
ggccccgcgcgtgcccccagc

SEQ ID NO: 336963 - DNA, 18 bp, Homo sapiens
ggccccggggctggcaag

SEQ ID NO: 336964 - DNA, 19 bp, Homo sapiens
ggccccggggctggcaagc

SEQ ID NO: 336965 - DNA, 19 bp, Homo sapiens
ggcccctcacctgggcctt

SEQ ID NO: 336966 - DNA, 22 bp, Homo sapiens
ggcccctcccacacacacccac

SEQ ID NO: 336967 - DNA, 22 bp, Homo sapiens
ggcccctccccaactccttcct

SEQ ID NO: 336968 - DNA, 23 bp, Homo sapiens
ggcccctccccaactccttcctc

SEQ ID NO: 336969 - DNA, 14 bp, Homo sapiens
ggcccctccctacc

SEQ ID NO: 336970 - DNA, 14 bp, Homo sapiens
ggcccctccctctg

SEQ ID NO: 336971 - DNA, 16 bp, Homo sapiens
ggcccctccctctgcc

SEQ ID NO: 336972 - DNA, 18 bp, Homo sapiens
ggcccctccctctgcccc

SEQ ID NO: 336973 - DNA, 14 bp, Homo sapiens
ggcccctcctctgt

SEQ ID NO: 336974 - DNA, 21 bp, Homo sapiens
ggcccctcctctgtgctccct

SEQ ID NO: 336975 - DNA, 15 bp, Homo sapiens
ggcccctccttctcc

SEQ ID NO: 336976 - DNA, 20 bp, Homo sapiens
ggcccctccttctcccctcc

SEQ ID NO: 336977 - DNA, 23 bp, Homo sapiens
ggcccctcggcattcacacacag

SEQ ID NO: 336978 - DNA, 14 bp, Homo sapiens
ggcccctctgccca

SEQ ID NO: 336979 - DNA, 12 bp, Homo sapiens
acaacagcaaca

SEQ ID NO: 336980 - DNA, 19 bp, Homo sapiens
acaacagcacgtgcagcca

SEQ ID NO: 336981 - DNA, 16 bp, Homo sapiens
acaacagcttcttgct

SEQ ID NO: 336982 - DNA, 18 bp, Homo sapiens
acaacagtcagccagctt

SEQ ID NO: 336983 - DNA, 17 bp, Homo sapiens
acaacatcaagaaaaca

SEQ ID NO: 336984 - DNA, 15 bp, Homo sapiens
acaaccacatttctg

SEQ ID NO: 336985 - DNA, 15 bp, Homo sapiens
acaaccaccgctccc

SEQ ID NO: 336986 - DNA, 16 bp, Homo sapiens
acaaccactaatttgt

SEQ ID NO: 336987 - DNA, 21 bp, Homo sapiens
acaaccactgggatcagctgg

SEQ ID NO: 336988 - DNA, 14 bp, Homo sapiens
acaaccagagcccc

SEQ ID NO: 336989 - DNA, 16 bp, Homo sapiens
acaaccatagaactgt

SEQ ID NO: 336990 - DNA, 19 bp, Homo sapiens
acaaccgatgctccagcca

SEQ ID NO: 336991 - DNA, 22 bp, Homo sapiens
acaaccggttatcagttggaca

SEQ ID NO: 336992 - DNA, 15 bp, Homo sapiens
acaacctgaaagaca

SEQ ID NO: 336993 - DNA, 16 bp, Homo sapiens
acaacctgaaagacaa

SEQ ID NO: 336994 - DNA, 17 bp, Homo sapiens
acaacctgaaagacaaa

SEQ ID NO: 336995 - DNA, 16 bp, Homo sapiens
acaacctgcccctccc

SEQ ID NO: 336996 - DNA, 19 bp, Homo sapiens
acaacctgtgtgagagaat

SEQ ID NO: 336997 - DNA, 16 bp, Homo sapiens
acaacctttcccattt

SEQ ID NO: 336998 - DNA, 22 bp, Homo sapiens
acaacctttcccatttcgtgta

SEQ ID NO: 336999 - DNA, 15 bp, Homo sapiens
acaacctttgtgtaa

SEQ ID NO: 337000 - DNA, 19 bp, Homo sapiens
acaacgtgtatagtgccta

SEQ ID NO: 337001 - DNA, 18 bp, Homo sapiens
acaactaacaatgccttg

SEQ ID NO: 337002 - DNA, 22 bp, Homo sapiens
acaactagcctcatctccagta

SEQ ID NO: 337003 - DNA, 16 bp, Homo sapiens
acaactatttttccaa

SEQ ID NO: 337004 - DNA, 14 bp, Homo sapiens
acaactccagccac

SEQ ID NO: 337005 - DNA, 22 bp, Homo sapiens
acaactccagccacccagccag

SEQ ID NO: 337006 - DNA, 21 bp, Homo sapiens
acaactccaggaaaactgttt

SEQ ID NO: 337007 - DNA, 13 bp, Homo sapiens
acaactctccaaa

SEQ ID NO: 337008 - DNA, 12 bp, Homo sapiens
acaactgagtcc

SEQ ID NO: 337009 - DNA, 13 bp, Homo sapiens
acaactgagtcct

SEQ ID NO: 337010 - DNA, 21 bp, Homo sapiens
acaactgatcatttgcagctg

SEQ ID NO: 337011 - DNA, 23 bp, Homo sapiens
acaactgatcatttgcagctgct

SEQ ID NO: 337012 - DNA, 19 bp, Homo sapiens
acaactgtctaactttaga

SEQ ID NO: 337013 - DNA, 16 bp, Homo sapiens
acaactttctcttgta

SEQ ID NO: 337014 - DNA, 17 bp, Homo sapiens
acaactttgtttctcat

SEQ ID NO: 337015 - DNA, 20 bp, Homo sapiens
acaagaaaccaagtgggctg

SEQ ID NO: 337016 - DNA, 22 bp, Homo sapiens
acaagaaaccaagtgggctggt

SEQ ID NO: 337017 - DNA, 15 bp, Homo sapiens
acaagaaagtttccc

SEQ ID NO: 337018 - DNA, 14 bp, Homo sapiens
acaagaagctgcta

SEQ ID NO: 337019 - DNA, 17 bp, Homo sapiens
acaagaagggagattca

SEQ ID NO: 337020 - DNA, 21 bp, Homo sapiens
acaagaagtgggagtgggaga

SEQ ID NO: 337021 - DNA, 23 bp, Homo sapiens
acaagactgcctccctctcttcc

SEQ ID NO: 337022 - DNA, 14 bp, Homo sapiens
acaagagcagcctg

SEQ ID NO: 337023 - DNA, 13 bp, Homo sapiens
acaagagctcctt

SEQ ID NO: 337024 - DNA, 16 bp, Homo sapiens
acaagaggaagagaga

SEQ ID NO: 337025 - DNA, 19 bp, Homo sapiens
acaagagggactgtatttc

SEQ ID NO: 337026 - DNA, 18 bp, Homo sapiens
acaagaggttaaggtggg

SEQ ID NO: 337027 - DNA, 22 bp, Homo sapiens
acaagagtttatttccaaataa

SEQ ID NO: 337028 - DNA, 17 bp, Homo sapiens
acaagataaaaaacgaa

SEQ ID NO: 337029 - DNA, 16 bp, Homo sapiens
acaagcaggatggctg

SEQ ID NO: 337030 - DNA, 21 bp, Homo sapiens
acaagccaaacattcttattt

SEQ ID NO: 337031 - DNA, 15 bp, Homo sapiens
acaagccagctggag

SEQ ID NO: 337032 - DNA, 15 bp, Homo sapiens
acaagccagggtgtg

SEQ ID NO: 337033 - DNA, 14 bp, Homo sapiens
acaagccccaggca

SEQ ID NO: 337034 - DNA, 15 bp, Homo sapiens
acaagccccaggcag

SEQ ID NO: 337035 - DNA, 17 bp, Homo sapiens
acaagccccaggcaggc

SEQ ID NO: 337036 - DNA, 16 bp, Homo sapiens
acaagctcctggtctt

SEQ ID NO: 337037 - DNA, 16 bp, Homo sapiens
acaagctgcctccctg

SEQ ID NO: 337038 - DNA, 14 bp, Homo sapiens
acaagctgcctctg

SEQ ID NO: 337039 - DNA, 15 bp, Homo sapiens
acaagctgcctctga

SEQ ID NO: 337040 - DNA, 24 bp, Homo sapiens
acaagctgcctctgacagcagcct

SEQ ID NO: 337041 - DNA, 18 bp, Homo sapiens
acaaggaatgcctgtgcc

SEQ ID NO: 337042 - DNA, 20 bp, Homo sapiens
acaaggagggcctctggtgt

SEQ ID NO: 337043 - DNA, 12 bp, Homo sapiens
acaaggcaaggc

SEQ ID NO: 337044 - DNA, 14 bp, Homo sapiens
acaaggcaaggctg

SEQ ID NO: 337045 - DNA, 21 bp, Homo sapiens
acaaggcaggcctttcctaca

SEQ ID NO: 337046 - DNA, 13 bp, Homo sapiens
acaaggccccaga

SEQ ID NO: 337047 - DNA, 16 bp, Homo sapiens
acaaggccccagagac

SEQ ID NO: 337048 - DNA, 15 bp, Homo sapiens
acaaggctggccagc

SEQ ID NO: 337049 - DNA, 16 bp, Homo sapiens
acaagggattctggga

SEQ ID NO: 337050 - DNA, 18 bp, Homo sapiens
acaagggtggcatcccag

SEQ ID NO: 337051 - DNA, 22 bp, Homo sapiens
acaaggtagccctggccagagg

SEQ ID NO: 337052 - DNA, 14 bp, Homo sapiens
acaaggtccactcc

SEQ ID NO: 337053 - DNA, 14 bp, Homo sapiens
acaaggtgggcagg

SEQ ID NO: 337054 - DNA, 22 bp, Homo sapiens
acaaggttgctggcatttgctg

SEQ ID NO: 337055 - DNA, 20 bp, Homo sapiens
tgtctaaaaataaaatgcat

SEQ ID NO: 337056 - DNA, 22 bp, Homo sapiens
tgtctaaaaataaaatgcattt

SEQ ID NO: 337057 - DNA, 19 bp, Homo sapiens
tgtctaaaagattctttaa

SEQ ID NO: 337058 - DNA, 23 bp, Homo sapiens
tgtctaaaagattctttaaacta

SEQ ID NO: 337059 - DNA, 18 bp, Homo sapiens
tgtctaaatttgaatgtt

SEQ ID NO: 337060 - DNA, 13 bp, Homo sapiens
tgtctaacaggac

SEQ ID NO: 337061 - DNA, 14 bp, Homo sapiens
tgtctaccatctcc

SEQ ID NO: 337062 - DNA, 16 bp, Homo sapiens
tgtctaccatctccct

SEQ ID NO: 337063 - DNA, 13 bp, Homo sapiens
tgtctactgcttg

SEQ ID NO: 337064 - DNA, 15 bp, Homo sapiens
tgtctactgtggtga

SEQ ID NO: 337065 - DNA, 18 bp, Homo sapiens
tgtctagaatcctgcttt

SEQ ID NO: 337066 - DNA, 15 bp, Homo sapiens
tgtctagtttgcata

SEQ ID NO: 337067 - DNA, 15 bp, Homo sapiens
tgtctattccctgga

SEQ ID NO: 337068 - DNA, 21 bp, Homo sapiens
tgtctattccctggaattcac

SEQ ID NO: 337069 - DNA, 14 bp, Homo sapiens
tgtctattctgagc

SEQ ID NO: 337070 - DNA, 17 bp, Homo sapiens
tgtctattctgagcctt

SEQ ID NO: 337071 - DNA, 17 bp, Homo sapiens
tgtctcaagagggcact

SEQ ID NO: 337072 - DNA, 19 bp, Homo sapiens
tgtctcaagagggcactgg

SEQ ID NO: 337073 - DNA, 13 bp, Homo sapiens
tgtctcagcctcc

SEQ ID NO: 337074 - DNA, 16 bp, Homo sapiens
tgtctcagccttccga

SEQ ID NO: 337075 - DNA, 16 bp, Homo sapiens
tgtctcaggtccctgc

SEQ ID NO: 337076 - DNA, 16 bp, Homo sapiens
tgtctcatccccaggg

SEQ ID NO: 337077 - DNA, 11 bp, Homo sapiens
tgtctccagac

SEQ ID NO: 337078 - DNA, 12 bp, Homo sapiens
tgtctccagacc

SEQ ID NO: 337079 - DNA, 14 bp, Homo sapiens
tgtctccagacccc

SEQ ID NO: 337080 - DNA, 22 bp, Homo sapiens
tgtctccagacccccacccctt

SEQ ID NO: 337081 - DNA, 14 bp, Homo sapiens
tgtctccagctgat

SEQ ID NO: 337082 - DNA, 20 bp, Homo sapiens
tgtctccctataatgctgga

SEQ ID NO: 337083 - DNA, 15 bp, Homo sapiens
tgtctcctactctgt

SEQ ID NO: 337084 - DNA, 16 bp, Homo sapiens
tgtctcctctgtcagt

SEQ ID NO: 337085 - DNA, 16 bp, Homo sapiens
tgtctctaacttattt

SEQ ID NO: 337086 - DNA, 18 bp, Homo sapiens
tgtctctatctgaaccac

SEQ ID NO: 337087 - DNA, 18 bp, Homo sapiens
tgtctctcccaccccggc

SEQ ID NO: 337088 - DNA, 23 bp, Homo sapiens
tgtctctccctaccctcttctca

SEQ ID NO: 337089 - DNA, 14 bp, Homo sapiens
tgtctctgccatgt

SEQ ID NO: 337090 - DNA, 17 bp, Homo sapiens
tgtctctgccatgtggc

SEQ ID NO: 337091 - DNA, 11 bp, Homo sapiens
tgtctctgctt

SEQ ID NO: 337092 - DNA, 13 bp, Homo sapiens
tgtctctgcttcc

SEQ ID NO: 337093 - DNA, 15 bp, Homo sapiens
tgtctctgcttccat

SEQ ID NO: 337094 - DNA, 17 bp, Homo sapiens
tgtctctgcttccatgg

SEQ ID NO: 337095 - DNA, 19 bp, Homo sapiens
tgtctctgtatatagctct

SEQ ID NO: 337096 - DNA, 18 bp, Homo sapiens
tgtctctgttcagatgtg

SEQ ID NO: 337097 - DNA, 20 bp, Homo sapiens
tgtctctgttcagatgtgca

SEQ ID NO: 337098 - DNA, 13 bp, Homo sapiens
tgtctcttagaaa

SEQ ID NO: 337099 - DNA, 15 bp, Homo sapiens
tgtctcttcctctgc

SEQ ID NO: 337100 - DNA, 21 bp, Homo sapiens
tgtctcttcctctgcaggaca

SEQ ID NO: 337101 - DNA, 14 bp, Homo sapiens
tgtctcttgtagaa

SEQ ID NO: 337102 - DNA, 18 bp, Homo sapiens
tgtctcttgtagaagatg

SEQ ID NO: 337103 - DNA, 18 bp, Homo sapiens
tgtctctttccactttgt

SEQ ID NO: 337104 - DNA, 23 bp, Homo sapiens
tgtctgaatcgagtgagacaaaa

SEQ ID NO: 337105 - DNA, 14 bp, Homo sapiens
tgtctgacacatgc

SEQ ID NO: 337106 - DNA, 14 bp, Homo sapiens
tgtctgagagacca

SEQ ID NO: 337107 - DNA, 19 bp, Homo sapiens
tgtctgagagaccatctcc

SEQ ID NO: 337108 - DNA, 20 bp, Homo sapiens
tgtctgagagaccatctcct

SEQ ID NO: 337109 - DNA, 16 bp, Homo sapiens
tgtctgagccctgccc

SEQ ID NO: 337110 - DNA, 21 bp, Homo sapiens
tgtctgagccctgccctcact

SEQ ID NO: 337111 - DNA, 13 bp, Homo sapiens
tgtctgagcctct

SEQ ID NO: 337112 - DNA, 12 bp, Homo sapiens
tgtctgatattg

SEQ ID NO: 337113 - DNA, 18 bp, Homo sapiens
tgtctgatgtgtgcccag

SEQ ID NO: 337114 - DNA, 14 bp, Homo sapiens
tgtctgattctatg

SEQ ID NO: 337115 - DNA, 18 bp, Homo sapiens
tgtctgcatggcagaagc

SEQ ID NO: 337116 - DNA, 13 bp, Homo sapiens
tgtctgcctgcct

SEQ ID NO: 337117 - DNA, 15 bp, Homo sapiens
tgtctgcgccgctgt

SEQ ID NO: 337118 - DNA, 15 bp, Homo sapiens
tgtctgctgctgcct

SEQ ID NO: 337119 - DNA, 19 bp, Homo sapiens
tgtctggaatcccagctcc

SEQ ID NO: 337120 - DNA, 19 bp, Homo sapiens
tgtctggacattcagaaca

SEQ ID NO: 337121 - DNA, 20 bp, Homo sapiens
tgtctggctcggacccaccc

SEQ ID NO: 337122 - DNA, 22 bp, Homo sapiens
acaatgtacaaggtatgtacag

SEQ ID NO: 337123 - DNA, 19 bp, Homo sapiens
acaatgtgatatgtgtaat

SEQ ID NO: 337124 - DNA, 14 bp, Homo sapiens
acaatgtggaatta

SEQ ID NO: 337125 - DNA, 21 bp, Homo sapiens
acaatgtggaattacataaca

SEQ ID NO: 337126 - DNA, 12 bp, Homo sapiens
acaattagagaa

SEQ ID NO: 337127 - DNA, 21 bp, Homo sapiens
acaattaggtctgcattttct

SEQ ID NO: 337128 - DNA, 16 bp, Homo sapiens
acaattccctgctgtc

SEQ ID NO: 337129 - DNA, 20 bp, Homo sapiens
acaattctttgttgcttaat

SEQ ID NO: 337130 - DNA, 22 bp, Homo sapiens
acaattctttgttgcttaatct

SEQ ID NO: 337131 - DNA, 16 bp, Homo sapiens
acaattgaaattttta

SEQ ID NO: 337132 - DNA, 21 bp, Homo sapiens
acaattgattttccccctaat

SEQ ID NO: 337133 - DNA, 12 bp, Homo sapiens
acaattgtgttt

SEQ ID NO: 337134 - DNA, 14 bp, Homo sapiens
acaatttaaattgt

SEQ ID NO: 337135 - DNA, 15 bp, Homo sapiens
acaatttcaaaatgc

SEQ ID NO: 337136 - DNA, 16 bp, Homo sapiens
acaatttcaaaatgca

SEQ ID NO: 337137 - DNA, 17 bp, Homo sapiens
acaatttcaaaatgcat

SEQ ID NO: 337138 - DNA, 19 bp, Homo sapiens
acaatttcaaaatgcatgt

SEQ ID NO: 337139 - DNA, 17 bp, Homo sapiens
acaatttcctttatatt

SEQ ID NO: 337140 - DNA, 13 bp, Homo sapiens
acaatttctgtgt

SEQ ID NO: 337141 - DNA, 19 bp, Homo sapiens
acaatttgcataatactaa

SEQ ID NO: 337142 - DNA, 23 bp, Homo sapiens
acaatttgccttaggaagtgact

SEQ ID NO: 337143 - DNA, 23 bp, Homo sapiens
acaatttggtcttagctttacat

SEQ ID NO: 337144 - DNA, 22 bp, Homo sapiens
acacaaaaaggagcgggcaggg

SEQ ID NO: 337145 - DNA, 13 bp, Homo sapiens
acacaaaacaaca

SEQ ID NO: 337146 - DNA, 20 bp, Homo sapiens
acacaaaacaacagcaacaa

SEQ ID NO: 337147 - DNA, 19 bp, Homo sapiens
acacaaatattgcttggac

SEQ ID NO: 337148 - DNA, 11 bp, Homo sapiens
acacaaatgca

SEQ ID NO: 337149 - DNA, 12 bp, Homo sapiens
acacaaatgcag

SEQ ID NO: 337150 - DNA, 12 bp, Homo sapiens
acacaacaaaaa

SEQ ID NO: 337151 - DNA, 14 bp, Homo sapiens
acacaacaccagga

SEQ ID NO: 337152 - DNA, 16 bp, Homo sapiens
acacaacaccaggact

SEQ ID NO: 337153 - DNA, 23 bp, Homo sapiens
acacaagagggactgtatttctg

SEQ ID NO: 337154 - DNA, 19 bp, Homo sapiens
acacaagcaaaccttctca

SEQ ID NO: 337155 - DNA, 16 bp, Homo sapiens
acacaagtagattgat

SEQ ID NO: 337156 - DNA, 19 bp, Homo sapiens
acacaagtagattgatcta

SEQ ID NO: 337157 - DNA, 22 bp, Homo sapiens
acacaagtgagggctttttaac

SEQ ID NO: 337158 - DNA, 16 bp, Homo sapiens
acacaagttgtttggt

SEQ ID NO: 337159 - DNA, 14 bp, Homo sapiens
acacaatatgaata

SEQ ID NO: 337160 - DNA, 23 bp, Homo sapiens
acacaatttaattcctcttttta

SEQ ID NO: 337161 - DNA, 9 bp, Homo sapiens
acacacaaa

SEQ ID NO: 337162 - DNA, 15 bp, Homo sapiens
acacacaaatgcaga

SEQ ID NO: 337163 - DNA, 13 bp, Homo sapiens
acacacaacaaaa

SEQ ID NO: 337164 - DNA, 9 bp, Homo sapiens
acacacaca

SEQ ID NO: 337165 - DNA, 15 bp, Homo sapiens
acacacacaaatgca

SEQ ID NO: 337166 - DNA, 16 bp, Homo sapiens
acacacacacaaatgc

SEQ ID NO: 337167 - DNA, 14 bp, Homo sapiens
acacacacacacaa

SEQ ID NO: 337168 - DNA, 16 bp, Homo sapiens
acacacacacacaaat

SEQ ID NO: 337169 - DNA, 14 bp, Homo sapiens
acacacacacacac

SEQ ID NO: 337170 - DNA, 15 bp, Homo sapiens
acacacacacacagc

SEQ ID NO: 337171 - DNA, 13 bp, Homo sapiens
acacacacacagc

SEQ ID NO: 337172 - DNA, 15 bp, Homo sapiens
acacacacacagcca

SEQ ID NO: 337173 - DNA, 13 bp, Homo sapiens
acacacacacgca

SEQ ID NO: 337174 - DNA, 10 bp, Homo sapiens
acacacacag

SEQ ID NO: 337175 - DNA, 12 bp, Homo sapiens
acacacacagcc

SEQ ID NO: 337176 - DNA, 13 bp, Homo sapiens
acacacacagcca

SEQ ID NO: 337177 - DNA, 12 bp, Homo sapiens
acacacacagct

SEQ ID NO: 337178 - DNA, 13 bp, Homo sapiens
acacacacagctg

SEQ ID NO: 337179 - DNA, 11 bp, Homo sapiens
acacacacagg

SEQ ID NO: 337180 - DNA, 17 bp, Homo sapiens
acacacaccacacatac

SEQ ID NO: 337181 - DNA, 14 bp, Homo sapiens
acacacacgcacgc

SEQ ID NO: 337182 - DNA, 11 bp, Homo sapiens
acacacagcct

SEQ ID NO: 337183 - DNA, 13 bp, Homo sapiens
acacacagccttt

SEQ ID NO: 337184 - DNA, 16 bp, Homo sapiens
acacacagcctttctg

SEQ ID NO: 337185 - DNA, 18 bp, Homo sapiens
acacacagcctttctgta

SEQ ID NO: 337186 - DNA, 13 bp, Homo sapiens
acacacagctcct

SEQ ID NO: 337187 - DNA, 11 bp, Homo sapiens
acacacagctg

SEQ ID NO: 337188 - DNA, 16 bp, Homo sapiens
acacgcgtgattgacc

SEQ ID NO: 337189 - DNA, 12 bp, Homo sapiens
acacgctgccca

SEQ ID NO: 337190 - DNA, 21 bp, Homo sapiens
acacggactcccgggccacgc

SEQ ID NO: 337191 - DNA, 12 bp, Homo sapiens
acacggcctctg

SEQ ID NO: 337192 - DNA, 22 bp, Homo sapiens
acacggctgcctgacactgagc

SEQ ID NO: 337193 - DNA, 14 bp, Homo sapiens
acacgtccacccca

SEQ ID NO: 337194 - DNA, 17 bp, Homo sapiens
acacgtggaggaatgct

SEQ ID NO: 337195 - DNA, 15 bp, Homo sapiens
acacgttggagtata

SEQ ID NO: 337196 - DNA, 14 bp, Homo sapiens
acactaagggtgta

SEQ ID NO: 337197 - DNA, 23 bp, Homo sapiens
acactaagttatagtatatctgg

SEQ ID NO: 337198 - DNA, 15 bp, Homo sapiens
acactaatgaggaaa

SEQ ID NO: 337199 - DNA, 13 bp, Homo sapiens
acactaattctgt

SEQ ID NO: 337200 - DNA, 13 bp, Homo sapiens
acactacaaacat

SEQ ID NO: 337201 - DNA, 17 bp, Homo sapiens
acactacagagcagctc

SEQ ID NO: 337202 - DNA, 20 bp, Homo sapiens
acactacagagcagctcccc

SEQ ID NO: 337203 - DNA, 22 bp, Homo sapiens
acactagtaccttcagatccta

SEQ ID NO: 337204 - DNA, 18 bp, Homo sapiens
acactagtagagcaaaga

SEQ ID NO: 337205 - DNA, 19 bp, Homo sapiens
acactagttttgtgccagc

SEQ ID NO: 337206 - DNA, 22 bp, Homo sapiens
acactatggtatttgagtgttt

SEQ ID NO: 337207 - DNA, 18 bp, Homo sapiens
acactattaccatgagaa

SEQ ID NO: 337208 - DNA, 14 bp, Homo sapiens
acactcaccattta

SEQ ID NO: 337209 - DNA, 17 bp, Homo sapiens
acactcaccgagaggaa

SEQ ID NO: 337210 - DNA, 12 bp, Homo sapiens
acactcagctgt

SEQ ID NO: 337211 - DNA, 24 bp, Homo sapiens
acactcgcccgcccactgtcctgg

SEQ ID NO: 337212 - DNA, 22 bp, Homo sapiens
acactctagtgacttcctggtg

SEQ ID NO: 337213 - DNA, 12 bp, Homo sapiens
acactctcctgg

SEQ ID NO: 337214 - DNA, 13 bp, Homo sapiens
acactctcctggg

SEQ ID NO: 337215 - DNA, 22 bp, Homo sapiens
acactctcctgggcccctccct

SEQ ID NO: 337216 - DNA, 14 bp, Homo sapiens
acactgaaggcaaa

SEQ ID NO: 337217 - DNA, 21 bp, Homo sapiens
acactgaatctcccctcctca

SEQ ID NO: 337218 - DNA, 17 bp, Homo sapiens
acactgaccatccactc

SEQ ID NO: 337219 - DNA, 16 bp, Homo sapiens
acactgacttggtgca

SEQ ID NO: 337220 - DNA, 11 bp, Homo sapiens
acactgagccc

SEQ ID NO: 337221 - DNA, 20 bp, Homo sapiens
acactgatgggtcctgctgc

SEQ ID NO: 337222 - DNA, 14 bp, Homo sapiens
acactgctgcacca

SEQ ID NO: 337223 - DNA, 21 bp, Homo sapiens
acactgctgctccagtgcagg

SEQ ID NO: 337224 - DNA, 12 bp, Homo sapiens
acactgctggga

SEQ ID NO: 337225 - DNA, 16 bp, Homo sapiens
acactgcttctcggag

SEQ ID NO: 337226 - DNA, 18 bp, Homo sapiens
acactgcttctcggaggc

SEQ ID NO: 337227 - DNA, 22 bp, Homo sapiens
acactgcttctcggaggccagg

SEQ ID NO: 337228 - DNA, 13 bp, Homo sapiens
acactggccccta

SEQ ID NO: 337229 - DNA, 15 bp, Homo sapiens
acactggctttacat

SEQ ID NO: 337230 - DNA, 21 bp, Homo sapiens
acactggtgggcagctgagga

SEQ ID NO: 337231 - DNA, 14 bp, Homo sapiens
acactgtaataggg

SEQ ID NO: 337232 - DNA, 15 bp, Homo sapiens
acactgtaatatctt

SEQ ID NO: 337233 - DNA, 17 bp, Homo sapiens
acactgtaatatcttta

SEQ ID NO: 337234 - DNA, 15 bp, Homo sapiens
acactgtactgcaat

SEQ ID NO: 337235 - DNA, 23 bp, Homo sapiens
acactgtatctaaaaaataactg

SEQ ID NO: 337236 - DNA, 18 bp, Homo sapiens
acactgtcaagattaagt

SEQ ID NO: 337237 - DNA, 11 bp, Homo sapiens
acactgtggaa

SEQ ID NO: 337238 - DNA, 21 bp, Homo sapiens
acactgttattttcagcatga

SEQ ID NO: 337239 - DNA, 14 bp, Homo sapiens
acacttaaatccag

SEQ ID NO: 337240 - DNA, 20 bp, Homo sapiens
acacttaagggttttagaaa

SEQ ID NO: 337241 - DNA, 21 bp, Homo sapiens
acacttacaagtaatgaattt

SEQ ID NO: 337242 - DNA, 23 bp, Homo sapiens
acacttattttacacagcaattt

SEQ ID NO: 337243 - DNA, 15 bp, Homo sapiens
acacttattttctga

SEQ ID NO: 337244 - DNA, 17 bp, Homo sapiens
acacttattttctgaat

SEQ ID NO: 337245 - DNA, 21 bp, Homo sapiens
acacttattttctgaattcat

SEQ ID NO: 337246 - DNA, 13 bp, Homo sapiens
acacttcagagag

SEQ ID NO: 337247 - DNA, 19 bp, Homo sapiens
acacttcagagagctggta

SEQ ID NO: 337248 - DNA, 22 bp, Homo sapiens
acacttcaggctcttctccttt

SEQ ID NO: 337249 - DNA, 16 bp, Homo sapiens
acacttcctgtccaga

SEQ ID NO: 337250 - DNA, 23 bp, Homo sapiens
acacttctgtgagacccccacac

SEQ ID NO: 337251 - DNA, 14 bp, Homo sapiens
acacttgagaggat

SEQ ID NO: 337252 - DNA, 15 bp, Homo sapiens
acacttggagcccgt

SEQ ID NO: 337253 - DNA, 15 bp, Homo sapiens
acacttggtgtactg

SEQ ID NO: 337254 - DNA, 19 bp, Homo sapiens
acacttgttccagctcttt

SEQ ID NO: 337255 - DNA, 20 bp, Homo sapiens
acacttgttccagctctttg

SEQ ID NO: 337256 - DNA, 13 bp, Homo sapiens
acactttcactgg

SEQ ID NO: 337257 - DNA, 19 bp, Homo sapiens
acactttctgactgcaact

SEQ ID NO: 337258 - DNA, 20 bp, Homo sapiens
acacttttgcacatatattt

SEQ ID NO: 337259 - DNA, 20 bp, Homo sapiens
acagaaaaaaaaatgtttta

SEQ ID NO: 337260 - DNA, 17 bp, Homo sapiens
acagaaaacaacaaaaa

SEQ ID NO: 337261 - DNA, 13 bp, Homo sapiens
acagaaaacctca

SEQ ID NO: 337262 - DNA, 20 bp, Homo sapiens
acagaaaacctcaagggctt

SEQ ID NO: 337263 - DNA, 21 bp, Homo sapiens
acagaaaagagaagaaagaag

SEQ ID NO: 337264 - DNA, 16 bp, Homo sapiens
acagaaaggttttctt

SEQ ID NO: 337265 - DNA, 17 bp, Homo sapiens
tgtgatttccatttctg

SEQ ID NO: 337266 - DNA, 13 bp, Homo sapiens
tgtgcaaacagtg

SEQ ID NO: 337267 - DNA, 18 bp, Homo sapiens
tgtgcaaacagtgtaagc

SEQ ID NO: 337268 - DNA, 15 bp, Homo sapiens
tgtgcaactcttgta

SEQ ID NO: 337269 - DNA, 23 bp, Homo sapiens
tgtgcaactcttgtattgctcca

SEQ ID NO: 337270 - DNA, 19 bp, Homo sapiens
tgtgcacatctctgcttga

SEQ ID NO: 337271 - DNA, 18 bp, Homo sapiens
tgtgcacatgtgtgcgtg

SEQ ID NO: 337272 - DNA, 22 bp, Homo sapiens
tgtgcaccttaccaactttctg

SEQ ID NO: 337273 - DNA, 21 bp, Homo sapiens
tgtgcacgagtgggaaggact

SEQ ID NO: 337274 - DNA, 15 bp, Homo sapiens
tgtgcactgtagcct

SEQ ID NO: 337275 - DNA, 13 bp, Homo sapiens
tgtgcagcaccct

SEQ ID NO: 337276 - DNA, 15 bp, Homo sapiens
tgtgcagcagcccag

SEQ ID NO: 337277 - DNA, 16 bp, Homo sapiens
tgtgcagcagcccagc

SEQ ID NO: 337278 - DNA, 18 bp, Homo sapiens
tgtgcaggctcctcctct

SEQ ID NO: 337279 - DNA, 16 bp, Homo sapiens
tgtgcaggctgtctca

SEQ ID NO: 337280 - DNA, 15 bp, Homo sapiens
tgtgcaggtgctgcc

SEQ ID NO: 337281 - DNA, 17 bp, Homo sapiens
tgtgcaggtttgttaca

SEQ ID NO: 337282 - DNA, 20 bp, Homo sapiens
tgtgcagtgaaggttgctga

SEQ ID NO: 337283 - DNA, 14 bp, Homo sapiens
tgtgcagtgtagcc

SEQ ID NO: 337284 - DNA, 12 bp, Homo sapiens
tgtgcagtgttg

SEQ ID NO: 337285 - DNA, 21 bp, Homo sapiens
tgtgcataaaagttaacatta

SEQ ID NO: 337286 - DNA, 22 bp, Homo sapiens
tgtgcatgtgtgcgagtgtgtg

SEQ ID NO: 337287 - DNA, 18 bp, Homo sapiens
tgtgcatttgtgtctgcc

SEQ ID NO: 337288 - DNA, 21 bp, Homo sapiens
tgtgcatttttgtgaaatgaa

SEQ ID NO: 337289 - DNA, 17 bp, Homo sapiens
tgtgccaaagcaggtca

SEQ ID NO: 337290 - DNA, 13 bp, Homo sapiens
tgtgccaacctga

SEQ ID NO: 337291 - DNA, 13 bp, Homo sapiens
tgtgccaccaccc

SEQ ID NO: 337292 - DNA, 14 bp, Homo sapiens
tgtgccaccacccc

SEQ ID NO: 337293 - DNA, 17 bp, Homo sapiens
tgtgccaccacccctcc

SEQ ID NO: 337294 - DNA, 21 bp, Homo sapiens
tgtgccaccacccctccctct

SEQ ID NO: 337295 - DNA, 20 bp, Homo sapiens
tgtgccacccaccagggcga

SEQ ID NO: 337296 - DNA, 15 bp, Homo sapiens
tgtgccaccctctgc

SEQ ID NO: 337297 - DNA, 16 bp, Homo sapiens
tgtgccaccctctgca

SEQ ID NO: 337298 - DNA, 17 bp, Homo sapiens
tgtgccaggactctctt

SEQ ID NO: 337299 - DNA, 12 bp, Homo sapiens
tgtgccaggctg

SEQ ID NO: 337300 - DNA, 18 bp, Homo sapiens
tgtgccatagagtttaac

SEQ ID NO: 337301 - DNA, 20 bp, Homo sapiens
tgtgccatagagtttaacac

SEQ ID NO: 337302 - DNA, 23 bp, Homo sapiens
tgtgccatctgtacatattactg

SEQ ID NO: 337303 - DNA, 12 bp, Homo sapiens
tgtgcccaccca

SEQ ID NO: 337304 - DNA, 21 bp, Homo sapiens
tgtgcccacccgtgttctcct

SEQ ID NO: 337305 - DNA, 13 bp, Homo sapiens
tgtgcccagctca

SEQ ID NO: 337306 - DNA, 20 bp, Homo sapiens
tgtgcccagtcatgacattt

SEQ ID NO: 337307 - DNA, 21 bp, Homo sapiens
tgtgcccagttaatcttgctt

SEQ ID NO: 337308 - DNA, 19 bp, Homo sapiens
tgtgcccatcatctctgcc

SEQ ID NO: 337309 - DNA, 22 bp, Homo sapiens
tgtgcccatcatctctgccttt

SEQ ID NO: 337310 - DNA, 19 bp, Homo sapiens
tgtgccccatgcctgtcca

SEQ ID NO: 337311 - DNA, 16 bp, Homo sapiens
tgtgccccatgtccaa

SEQ ID NO: 337312 - DNA, 16 bp, Homo sapiens
tgtgcccccagacgca

SEQ ID NO: 337313 - DNA, 14 bp, Homo sapiens
tgtgcccctggccc

SEQ ID NO: 337314 - DNA, 15 bp, Homo sapiens
tgtgcccctggccca

SEQ ID NO: 337315 - DNA, 19 bp, Homo sapiens
tgtgccgtctttggttcct

SEQ ID NO: 337316 - DNA, 16 bp, Homo sapiens
tgtgcctaacaccagc

SEQ ID NO: 337317 - DNA, 18 bp, Homo sapiens
tgtgcctcccttcccagt

SEQ ID NO: 337318 - DNA, 14 bp, Homo sapiens
tgtgtaaatttctc

SEQ ID NO: 337319 - DNA, 21 bp, Homo sapiens
tgtgtaacaattttaatgcta

SEQ ID NO: 337320 - DNA, 21 bp, Homo sapiens
tgtgtaaccagcagtcacagg

SEQ ID NO: 337321 - DNA, 18 bp, Homo sapiens
tgtgtaactgcccaaagc

SEQ ID NO: 337322 - DNA, 21 bp, Homo sapiens
tgtgtaactgcccaaagcagc

SEQ ID NO: 337323 - DNA, 14 bp, Homo sapiens
tgtgtaagagaatg

SEQ ID NO: 337324 - DNA, 13 bp, Homo sapiens
tgtgtaatattac

SEQ ID NO: 337325 - DNA, 19 bp, Homo sapiens
tgtgtacagtatgtgtcta

SEQ ID NO: 337326 - DNA, 17 bp, Homo sapiens
tgtgtactgataaaata

SEQ ID NO: 337327 - DNA, 19 bp, Homo sapiens
tgtgtacttcagtcttgga

SEQ ID NO: 337328 - DNA, 23 bp, Homo sapiens
tgtgtagggagatggagaaaatg

SEQ ID NO: 337329 - DNA, 12 bp, Homo sapiens
tgtgtatgagaa

SEQ ID NO: 337330 - DNA, 21 bp, Homo sapiens
tgtgtatgagaagtactttgt

SEQ ID NO: 337331 - DNA, 19 bp, Homo sapiens
tgtgtatgctgatgatcaa

SEQ ID NO: 337332 - DNA, 20 bp, Homo sapiens
tgtgtatgctgatgatcaaa

SEQ ID NO: 337333 - DNA, 19 bp, Homo sapiens
tgtgtatgtgcgtgtgtgc

SEQ ID NO: 337334 - DNA, 13 bp, Homo sapiens
tgtgtatgtgtgt

SEQ ID NO: 337335 - DNA, 13 bp, Homo sapiens
tgtgtatgtgttt

SEQ ID NO: 337336 - DNA, 13 bp, Homo sapiens
tgtgtattctgtg

SEQ ID NO: 337337 - DNA, 21 bp, Homo sapiens
tgtgtattctgtggattctat

SEQ ID NO: 337338 - DNA, 23 bp, Homo sapiens
tgtgtattctgtggattctatat

SEQ ID NO: 337339 - DNA, 13 bp, Homo sapiens
tgtgtattgttcc

SEQ ID NO: 337340 - DNA, 14 bp, Homo sapiens
tgtgtattgttccc

SEQ ID NO: 337341 - DNA, 13 bp, Homo sapiens
tgtgtatttctgt

SEQ ID NO: 337342 - DNA, 15 bp, Homo sapiens
tgtgtatttctgtag

SEQ ID NO: 337343 - DNA, 18 bp, Homo sapiens
tgtgtatttctgtagaat

SEQ ID NO: 337344 - DNA, 16 bp, Homo sapiens
tgtgtcatctgtcagc

SEQ ID NO: 337345 - DNA, 22 bp, Homo sapiens
tgtgtcatggtgatgcaagtca

SEQ ID NO: 337346 - DNA, 13 bp, Homo sapiens
tgtgtccagcagc

SEQ ID NO: 337347 - DNA, 14 bp, Homo sapiens
tgtgtccagcagct

SEQ ID NO: 337348 - DNA, 15 bp, Homo sapiens
tgtgtcccagtgaac

SEQ ID NO: 337349 - DNA, 15 bp, Homo sapiens
tgtgtccctctctct

SEQ ID NO: 337350 - DNA, 16 bp, Homo sapiens
tgtgtccctctctctg

SEQ ID NO: 337351 - DNA, 17 bp, Homo sapiens
tgtgtccctctctctgg

SEQ ID NO: 337352 - DNA, 19 bp, Homo sapiens
tgtgtcggggggcgaggga

SEQ ID NO: 337353 - DNA, 18 bp, Homo sapiens
tgtgtctccagctgattt

SEQ ID NO: 337354 - DNA, 13 bp, Homo sapiens
tgtgtctcctgca

SEQ ID NO: 337355 - DNA, 17 bp, Homo sapiens
tgtgtctgcctgcctca

SEQ ID NO: 337356 - DNA, 12 bp, Homo sapiens
tgtgtctgtatt

SEQ ID NO: 337357 - DNA, 21 bp, Homo sapiens
tgtgtctgtattcatacagca

SEQ ID NO: 337358 - DNA, 14 bp, Homo sapiens
tgtgtctgtggtcc

SEQ ID NO: 337359 - DNA, 17 bp, Homo sapiens
tgtgtcttcaatttgta

SEQ ID NO: 337360 - DNA, 16 bp, Homo sapiens
tgtgtctttttttact

SEQ ID NO: 337361 - DNA, 23 bp, Homo sapiens
tgtgtgaagatcacgttccttcc

SEQ ID NO: 337362 - DNA, 21 bp, Homo sapiens
tgtgtgaaggtaactaagaag

SEQ ID NO: 337363 - DNA, 19 bp, Homo sapiens
tgtgtgacgcagataactg

SEQ ID NO: 337364 - DNA, 20 bp, Homo sapiens
tgtgtgagataacttccttc

SEQ ID NO: 337365 - DNA, 16 bp, Homo sapiens
tgtgtgatgaactttc

SEQ ID NO: 337366 - DNA, 13 bp, Homo sapiens
tgtgtgcaatgtt

SEQ ID NO: 337367 - DNA, 20 bp, Homo sapiens
tgtgtgcatgtgtgtgctca

SEQ ID NO: 337368 - DNA, 24 bp, Homo sapiens
tgtgtgccatagagtttaacacaa

SEQ ID NO: 337369 - DNA, 17 bp, Homo sapiens
tgtgtgcctgtggcaga

SEQ ID NO: 337370 - DNA, 17 bp, Homo sapiens
tgtgtggactcaagtcc

SEQ ID NO: 337371 - DNA, 22 bp, Homo sapiens
tgtgtggagagggaatgtgaaa

SEQ ID NO: 337372 - DNA, 16 bp, Homo sapiens
tgtgtggcaaacattt

SEQ ID NO: 337373 - DNA, 20 bp, Homo sapiens
tgtgtggctcattcttttca

SEQ ID NO: 337374 - DNA, 14 bp, Homo sapiens
tgtgtgggagggcg

SEQ ID NO: 337375 - DNA, 16 bp, Homo sapiens
tgtgtgtaagctgact

SEQ ID NO: 337376 - DNA, 15 bp, Homo sapiens
tgtgtgtatgctgat

SEQ ID NO: 337377 - DNA, 16 bp, Homo sapiens
tgtgtgtctcacccct

SEQ ID NO: 337378 - DNA, 13 bp, Homo sapiens
tgtgtgtctctga

SEQ ID NO: 337379 - DNA, 15 bp, Homo sapiens
tgtgtgtgcaatgtt

SEQ ID NO: 337380 - DNA, 21 bp, Homo sapiens
tgtgtgtggaaggcacccgcc

SEQ ID NO: 337381 - DNA, 19 bp, Homo sapiens
tgtgtgtgggctgtgagtg

SEQ ID NO: 337382 - DNA, 12 bp, Homo sapiens
tgtgtgtgtctc

SEQ ID NO: 337383 - DNA, 14 bp, Homo sapiens
tgtgtgtgtgtatg

SEQ ID NO: 337384 - DNA, 23 bp, Homo sapiens
tgtgtgttctgtaatggaactga

SEQ ID NO: 337385 - DNA, 15 bp, Homo sapiens
tgtgtgtttaaataa

SEQ ID NO: 337386 - DNA, 18 bp, Homo sapiens
tgtgtgtttaaataaagt

SEQ ID NO: 337387 - DNA, 22 bp, Homo sapiens
tgtgtgtttaaataaagtatca

SEQ ID NO: 337388 - DNA, 11 bp, Homo sapiens
tgtgtgtttat

SEQ ID NO: 337389 - DNA, 16 bp, Homo sapiens
tgtgttaaacatgcta

SEQ ID NO: 337390 - DNA, 14 bp, Homo sapiens
tgtgttcagttcca

SEQ ID NO: 337391 - DNA, 17 bp, Homo sapiens
tgtgttctgattagaaa

SEQ ID NO: 337392 - DNA, 22 bp, Homo sapiens
tgtgttcttttgatacatttat

SEQ ID NO: 337393 - DNA, 23 bp, Homo sapiens
tgtgttgatgactcactcataaa

SEQ ID NO: 337394 - DNA, 13 bp, Homo sapiens
tgtgttgccaaag

SEQ ID NO: 337395 - DNA, 19 bp, Homo sapiens
tgtgttgccattttgtctg

SEQ ID NO: 337396 - DNA, 19 bp, Homo sapiens
tgtgttgctttctgactga

SEQ ID NO: 337397 - DNA, 12 bp, Homo sapiens
tgtgttggctgt

SEQ ID NO: 337398 - DNA, 13 bp, Homo sapiens
tgtgttgggcccc

SEQ ID NO: 337399 - DNA, 19 bp, Homo sapiens
tgtgttggggccttggcct

SEQ ID NO: 337400 - DNA, 13 bp, Homo sapiens
tgtgttgtctcta

SEQ ID NO: 337401 - DNA, 13 bp, Homo sapiens
tgtgtttaaataa

SEQ ID NO: 337402 - DNA, 22 bp, Homo sapiens
tgtgtttaaataaagtatcatg

SEQ ID NO: 337403 - DNA, 23 bp, Homo sapiens
tgtgtttcaggacagctgcttct

SEQ ID NO: 337404 - DNA, 20 bp, Homo sapiens
tgtgtttgaaacactcgtgt

SEQ ID NO: 337405 - DNA, 14 bp, Homo sapiens
tgtgtttgtatata

SEQ ID NO: 337406 - DNA, 21 bp, Homo sapiens
ggcctcccgtccgtccgcccg

SEQ ID NO: 337407 - DNA, 15 bp, Homo sapiens
ggcctccgaggctcc

SEQ ID NO: 337408 - DNA, 16 bp, Homo sapiens
ggcctccgaggctccc

SEQ ID NO: 337409 - DNA, 23 bp, Homo sapiens
ggcctcctcttcaccccggcagg

SEQ ID NO: 337410 - DNA, 19 bp, Homo sapiens
ggcctccttcccatgcctg

SEQ ID NO: 337411 - DNA, 21 bp, Homo sapiens
ggcctccttcccatgcctgtc

SEQ ID NO: 337412 - DNA, 22 bp, Homo sapiens
ggcctccttcccatgcctgtct

SEQ ID NO: 337413 - DNA, 18 bp, Homo sapiens
ggcctcggggcagggcag

SEQ ID NO: 337414 - DNA, 19 bp, Homo sapiens
ggcctcggggcagggcagg

SEQ ID NO: 337415 - DNA, 17 bp, Homo sapiens
ggcctctgaaatttccc

SEQ ID NO: 337416 - DNA, 13 bp, Homo sapiens
ggcctctgcctcc

SEQ ID NO: 337417 - DNA, 16 bp, Homo sapiens
ggcctctgcctccagg

SEQ ID NO: 337418 - DNA, 18 bp, Homo sapiens
ggcctctgcctccaggag

SEQ ID NO: 337419 - DNA, 16 bp, Homo sapiens
ggcctctggctgcctg

SEQ ID NO: 337420 - DNA, 23 bp, Homo sapiens
ggcctcttcctccctccctgcag

SEQ ID NO: 337421 - DNA, 22 bp, Homo sapiens
ggcctcttgagcagtggctggt

SEQ ID NO: 337422 - DNA, 19 bp, Homo sapiens
ggcctcttgggtcccccac

SEQ ID NO: 337423 - DNA, 17 bp, Homo sapiens
ggcctgaaagaggctga

SEQ ID NO: 337424 - DNA, 21 bp, Homo sapiens
ggcctgaaatgtttccaggca

SEQ ID NO: 337425 - DNA, 15 bp, Homo sapiens
ggcctgagctggggc

SEQ ID NO: 337426 - DNA, 17 bp, Homo sapiens
ggcctgagctggggcca

SEQ ID NO: 337427 - DNA, 19 bp, Homo sapiens
ggcctgagctggggccaca

SEQ ID NO: 337428 - DNA, 22 bp, Homo sapiens
ggcctgagctggggccacaaat

SEQ ID NO: 337429 - DNA, 19 bp, Homo sapiens
ggcctgaggatgagctgga

SEQ ID NO: 337430 - DNA, 17 bp, Homo sapiens
ggcctgagggaagccca

SEQ ID NO: 337431 - DNA, 19 bp, Homo sapiens
ggcctgagttgaggggctt

SEQ ID NO: 337432 - DNA, 17 bp, Homo sapiens
ggcctgatgctccctcc

SEQ ID NO: 337433 - DNA, 18 bp, Homo sapiens
ggcctgatgctccctccc

SEQ ID NO: 337434 - DNA, 20 bp, Homo sapiens
ggcctgatgctccctcccct

SEQ ID NO: 337435 - DNA, 13 bp, Homo sapiens
ggcctgatgctgc

SEQ ID NO: 337436 - DNA, 15 bp, Homo sapiens
ggcctgatgctgccc

SEQ ID NO: 337437 - DNA, 16 bp, Homo sapiens
ggcctgatgctgcccc

SEQ ID NO: 337438 - DNA, 19 bp, Homo sapiens
ggcctgatggagaggagaa

SEQ ID NO: 337439 - DNA, 13 bp, Homo sapiens
ggcctgcagccca

SEQ ID NO: 337440 - DNA, 16 bp, Homo sapiens
ggcctgcaggccccag

SEQ ID NO: 337441 - DNA, 21 bp, Homo sapiens
ggcctgcaggccccagccaag

SEQ ID NO: 337442 - DNA, 21 bp, Homo sapiens
ggcctgccaatgccacagcca

SEQ ID NO: 337443 - DNA, 22 bp, Homo sapiens
ggcctgccaatgccacagccaa

SEQ ID NO: 337444 - DNA, 23 bp, Homo sapiens
ggcctgccaatgccacagccaag

SEQ ID NO: 337445 - DNA, 13 bp, Homo sapiens
ggcctgccagacg

SEQ ID NO: 337446 - DNA, 15 bp, Homo sapiens
ggcctgccagcccct

SEQ ID NO: 337447 - DNA, 14 bp, Homo sapiens
ggcctgccaggctc

SEQ ID NO: 337448 - DNA, 16 bp, Homo sapiens
ggcgtaatgggcctgc

SEQ ID NO: 337449 - DNA, 21 bp, Homo sapiens
ggcgtccgcgcgccagcacag

SEQ ID NO: 337450 - DNA, 18 bp, Homo sapiens
ggcgtcctggtgaggaca

SEQ ID NO: 337451 - DNA, 23 bp, Homo sapiens
ggcgtcctggtgaggacaaggta

SEQ ID NO: 337452 - DNA, 20 bp, Homo sapiens
ggcgtggagagcccggcgcc

SEQ ID NO: 337453 - DNA, 16 bp, Homo sapiens
ggcgtggagccaggga

SEQ ID NO: 337454 - DNA, 18 bp, Homo sapiens
ggcgtgggacgtggtcag

SEQ ID NO: 337455 - DNA, 18 bp, Homo sapiens
ggcgtgggatccagagag

SEQ ID NO: 337456 - DNA, 19 bp, Homo sapiens
ggcgtgggatccagagaga

SEQ ID NO: 337457 - DNA, 17 bp, Homo sapiens
ggcgtgtgtccctgtgg

SEQ ID NO: 337458 - DNA, 14 bp, Homo sapiens
ggcgttctcctgct

SEQ ID NO: 337459 - DNA, 15 bp, Homo sapiens
ggcgttggtgccact

SEQ ID NO: 337460 - DNA, 17 bp, Homo sapiens
ggcgttggtgccacttc

SEQ ID NO: 337461 - DNA, 21 bp, Homo sapiens
ggctaaaggggagaaactgaa

SEQ ID NO: 337462 - DNA, 14 bp, Homo sapiens
ggctaacgggcgcc

SEQ ID NO: 337463 - DNA, 17 bp, Homo sapiens
ggctaactggccccagg

SEQ ID NO: 337464 - DNA, 19 bp, Homo sapiens
ggctaactggccccaggcg

SEQ ID NO: 337465 - DNA, 22 bp, Homo sapiens
ggctaagatgagatttgccagc

SEQ ID NO: 337466 - DNA, 15 bp, Homo sapiens
ggctaaggcaccagc

SEQ ID NO: 337467 - DNA, 17 bp, Homo sapiens
ggctaagtccagctctc

SEQ ID NO: 337468 - DNA, 21 bp, Homo sapiens
ggctagaagaaagtaaaaaga

SEQ ID NO: 337469 - DNA, 22 bp, Homo sapiens
ggctagaataggagaaaatgaa

SEQ ID NO: 337470 - DNA, 18 bp, Homo sapiens
ggctagaggccagcccca

SEQ ID NO: 337471 - DNA, 12 bp, Homo sapiens
ggctagccccag

SEQ ID NO: 337472 - DNA, 21 bp, Homo sapiens
ggctaggccggccagctcccc

SEQ ID NO: 337473 - DNA, 14 bp, Homo sapiens
ggctaggggccgag

SEQ ID NO: 337474 - DNA, 23 bp, Homo sapiens
ggctagtgacttgtgtcccatga

SEQ ID NO: 337475 - DNA, 21 bp, Homo sapiens
ggctagtgtgagtggcagcca

SEQ ID NO: 337476 - DNA, 23 bp, Homo sapiens
ggctagtgtgagtggcagccatg

SEQ ID NO: 337477 - DNA, 19 bp, Homo sapiens
ggctatagctacaggaagc

SEQ ID NO: 337478 - DNA, 15 bp, Homo sapiens
ggctatcccttctca

SEQ ID NO: 337479 - DNA, 19 bp, Homo sapiens
ggctattcctaggcctcag

SEQ ID NO: 337480 - DNA, 20 bp, Homo sapiens
ggctattcctaggcctcagg

SEQ ID NO: 337481 - DNA, 15 bp, Homo sapiens
ggctatttaccaggg

SEQ ID NO: 337482 - DNA, 16 bp, Homo sapiens
ggctatttgtgtgtat

SEQ ID NO: 337483 - DNA, 16 bp, Homo sapiens
ggctatttgttcagag

SEQ ID NO: 337484 - DNA, 18 bp, Homo sapiens
ggctatttgttcagagag

SEQ ID NO: 337485 - DNA, 14 bp, Homo sapiens
ggctcaagcagtct

SEQ ID NO: 337486 - DNA, 23 bp, Homo sapiens
ggctcaagcagtctacccacctc

SEQ ID NO: 337487 - DNA, 18 bp, Homo sapiens
ggctcaaggcaccgcagc

SEQ ID NO: 337488 - DNA, 14 bp, Homo sapiens
ggctcacagactgg

SEQ ID NO: 337489 - DNA, 15 bp, Homo sapiens
ggctcacagccacca

SEQ ID NO: 337490 - DNA, 20 bp, Homo sapiens
ggctcacggggcctccaacc

SEQ ID NO: 337491 - DNA, 17 bp, Homo sapiens
ggctcactctttccccc

SEQ ID NO: 337492 - DNA, 14 bp, Homo sapiens
ggctcactgcagcc

SEQ ID NO: 337493 - DNA, 12 bp, Homo sapiens
ggctcagctcct

SEQ ID NO: 337494 - DNA, 14 bp, Homo sapiens
ggctcagctctggc

SEQ ID NO: 337495 - DNA, 21 bp, Homo sapiens
ggctcagctctggctcacaga

SEQ ID NO: 337496 - DNA, 19 bp, Homo sapiens
ggctcaggcaagcccctca

SEQ ID NO: 337497 - DNA, 16 bp, Homo sapiens
ggctcagggcccacct

SEQ ID NO: 337498 - DNA, 19 bp, Homo sapiens
ggctcagggcccacctcct

SEQ ID NO: 337499 - DNA, 12 bp, Homo sapiens
ggctcagggctg

SEQ ID NO: 337500 - DNA, 17 bp, Homo sapiens
ggctcagggctggagtg

SEQ ID NO: 337501 - DNA, 13 bp, Homo sapiens
ggctcagtgccac

SEQ ID NO: 337502 - DNA, 23 bp, Homo sapiens
ggctcagtgccacctatgcctgt

SEQ ID NO: 337503 - DNA, 21 bp, Homo sapiens
ggctcatattcctgcagcctg

SEQ ID NO: 337504 - DNA, 22 bp, Homo sapiens
ggctcatattcctgcagcctgg

SEQ ID NO: 337505 - DNA, 13 bp, Homo sapiens
ggctcatcagaac

SEQ ID NO: 337506 - DNA, 21 bp, Homo sapiens
ggctcatggcgtaatgggcct

SEQ ID NO: 337507 - DNA, 14 bp, Homo sapiens
ggctcattcttttc

SEQ ID NO: 337508 - DNA, 17 bp, Homo sapiens
ggctccacgccctgggg

SEQ ID NO: 337509 - DNA, 18 bp, Homo sapiens
ggctccacgccctgggga

SEQ ID NO: 337510 - DNA, 21 bp, Homo sapiens
ggctccacgccctggggagtg

SEQ ID NO: 337511 - DNA, 18 bp, Homo sapiens
ggctccagagtaggtggg

SEQ ID NO: 337512 - DNA, 18 bp, Homo sapiens
ggctccagcatccagcct

SEQ ID NO: 337513 - DNA, 16 bp, Homo sapiens
ggctccagcgtggcct

SEQ ID NO: 337514 - DNA, 16 bp, Homo sapiens
ggctccaggctccagg

SEQ ID NO: 337515 - DNA, 14 bp, Homo sapiens
ggctcccagaccca

SEQ ID NO: 337516 - DNA, 23 bp, Homo sapiens
ggctcccagacccagggcagtgt

SEQ ID NO: 337517 - DNA, 13 bp, Homo sapiens
ggctcccaggaca

SEQ ID NO: 337518 - DNA, 13 bp, Homo sapiens
ggctccccacgag

SEQ ID NO: 337519 - DNA, 21 bp, Homo sapiens
ggctccccacgagtcacctgc

SEQ ID NO: 337520 - DNA, 15 bp, Homo sapiens
ggctccccctgccag

SEQ ID NO: 337521 - DNA, 16 bp, Homo sapiens
ggctccccgcctccac

SEQ ID NO: 337522 - DNA, 20 bp, Homo sapiens
ggctcccctttttcttcctc

SEQ ID NO: 337523 - DNA, 22 bp, Homo sapiens
ggctcccggagagggagtcagt

SEQ ID NO: 337524 - DNA, 15 bp, Homo sapiens
ggctccctcctggag

SEQ ID NO: 337525 - DNA, 14 bp, Homo sapiens
ggctcctccccgat

SEQ ID NO: 337526 - DNA, 21 bp, Homo sapiens
ggctcctccccgatccccgac

SEQ ID NO: 337527 - DNA, 17 bp, Homo sapiens
ggctcctcccggtgccc

SEQ ID NO: 337528 - DNA, 13 bp, Homo sapiens
ggctcctggagcc

SEQ ID NO: 337529 - DNA, 15 bp, Homo sapiens
ggctcctggagccag

SEQ ID NO: 337530 - DNA, 14 bp, Homo sapiens
ggctcctggctgcc

SEQ ID NO: 337531 - DNA, 16 bp, Homo sapiens
ggctcctggctgccag

SEQ ID NO: 337532 - DNA, 23 bp, Homo sapiens
ggctcctgtgtctggtccacaca

SEQ ID NO: 337533 - DNA, 16 bp, Homo sapiens
ggctcctgtgtggagt

SEQ ID NO: 337534 - DNA, 17 bp, Homo sapiens
ggctcctttcccacagt

SEQ ID NO: 337535 - DNA, 18 bp, Homo sapiens
ggctcctttcccacagtc

SEQ ID NO: 337536 - DNA, 17 bp, Homo sapiens
ggctcctttctccagcc

SEQ ID NO: 337537 - DNA, 14 bp, Homo sapiens
ggctcgccccaccc

SEQ ID NO: 337538 - DNA, 15 bp, Homo sapiens
ggctcgtgggctctg

SEQ ID NO: 337539 - DNA, 17 bp, Homo sapiens
ggctcgtgggctctggc

SEQ ID NO: 337540 - DNA, 19 bp, Homo sapiens
ggctctagggttgctggag

SEQ ID NO: 337541 - DNA, 22 bp, Homo sapiens
ggctctccaaaggggctgctgg

SEQ ID NO: 337542 - DNA, 14 bp, Homo sapiens
ggctctcggaaatg

SEQ ID NO: 337543 - DNA, 12 bp, Homo sapiens
ggctctctccag

SEQ ID NO: 337544 - DNA, 13 bp, Homo sapiens
ggctctctccagg

SEQ ID NO: 337545 - DNA, 21 bp, Homo sapiens
ggctctgaatctctcaaaatg

SEQ ID NO: 337546 - DNA, 18 bp, Homo sapiens
tgttgatcagatcttaca

SEQ ID NO: 337547 - DNA, 16 bp, Homo sapiens
tgttgattattagcca

SEQ ID NO: 337548 - DNA, 14 bp, Homo sapiens
tgttgattttctgt

SEQ ID NO: 337549 - DNA, 15 bp, Homo sapiens
tgttgattttctgtt

SEQ ID NO: 337550 - DNA, 18 bp, Homo sapiens
tgttgattttctgttgta

SEQ ID NO: 337551 - DNA, 18 bp, Homo sapiens
tgttgcaaattccacccc

SEQ ID NO: 337552 - DNA, 20 bp, Homo sapiens
tgttgcacagtccctcctgt

SEQ ID NO: 337553 - DNA, 19 bp, Homo sapiens
tgttgcagttaattcttgc

SEQ ID NO: 337554 - DNA, 11 bp, Homo sapiens
tgttgccaaag

SEQ ID NO: 337555 - DNA, 19 bp, Homo sapiens
tgttgccaaatatgtcctg

SEQ ID NO: 337556 - DNA, 20 bp, Homo sapiens
tgttgccaactaagccctcg

SEQ ID NO: 337557 - DNA, 17 bp, Homo sapiens
tgttgccacactttcac

SEQ ID NO: 337558 - DNA, 14 bp, Homo sapiens
tgttgccacaggac

SEQ ID NO: 337559 - DNA, 12 bp, Homo sapiens
tgttgccagaga

SEQ ID NO: 337560 - DNA, 12 bp, Homo sapiens
tgttgccaggtt

SEQ ID NO: 337561 - DNA, 20 bp, Homo sapiens
tgttgccaggttgcagctgc

SEQ ID NO: 337562 - DNA, 14 bp, Homo sapiens
tgttgcctcctccc

SEQ ID NO: 337563 - DNA, 19 bp, Homo sapiens
tgttgcctcctcccatcca

SEQ ID NO: 337564 - DNA, 20 bp, Homo sapiens
tgttgcctcctctctccctg

SEQ ID NO: 337565 - DNA, 22 bp, Homo sapiens
tgttgcctcctctctccctgcc

SEQ ID NO: 337566 - DNA, 16 bp, Homo sapiens
tgttgccttcatcttc

SEQ ID NO: 337567 - DNA, 16 bp, Homo sapiens
tgttgctgtctggctt

SEQ ID NO: 337568 - DNA, 19 bp, Homo sapiens
tgttgcttaatctagagct

SEQ ID NO: 337569 - DNA, 21 bp, Homo sapiens
tgttgcttaatctagagctat

SEQ ID NO: 337570 - DNA, 16 bp, Homo sapiens
tgttgcttagtcactt

SEQ ID NO: 337571 - DNA, 14 bp, Homo sapiens
tgttggagcctgca

SEQ ID NO: 337572 - DNA, 23 bp, Homo sapiens
tgttggataataactagatctcc

SEQ ID NO: 337573 - DNA, 14 bp, Homo sapiens
tgttggatcttcaa

SEQ ID NO: 337574 - DNA, 14 bp, Homo sapiens
tgttggccaggctg

SEQ ID NO: 337575 - DNA, 20 bp, Homo sapiens
tgttggcctccggcctcccc

SEQ ID NO: 337576 - DNA, 13 bp, Homo sapiens
tgttggctgctcc

SEQ ID NO: 337577 - DNA, 14 bp, Homo sapiens
tgttggctgctgcc

SEQ ID NO: 337578 - DNA, 19 bp, Homo sapiens
ggcttcccaggaccctggg

SEQ ID NO: 337579 - DNA, 19 bp, Homo sapiens
ggcttcccgctcagccctc

SEQ ID NO: 337580 - DNA, 22 bp, Homo sapiens
ggcttcccgctcagccctccct

SEQ ID NO: 337581 - DNA, 17 bp, Homo sapiens
ggcttccctctgctcca

SEQ ID NO: 337582 - DNA, 17 bp, Homo sapiens
ggcttccgtgagacaca

SEQ ID NO: 337583 - DNA, 19 bp, Homo sapiens
ggcttcctccgtccaccca

SEQ ID NO: 337584 - DNA, 21 bp, Homo sapiens
ggcttcctcctggtgtggaag

SEQ ID NO: 337585 - DNA, 12 bp, Homo sapiens
ggcttcctgtcc

SEQ ID NO: 337586 - DNA, 18 bp, Homo sapiens
ggcttcctgtccactctc

SEQ ID NO: 337587 - DNA, 13 bp, Homo sapiens
ggcttctcctgac

SEQ ID NO: 337588 - DNA, 16 bp, Homo sapiens
ggcttctcctgaccca

SEQ ID NO: 337589 - DNA, 20 bp, Homo sapiens
ggcttctgcggtgaggcagg

SEQ ID NO: 337590 - DNA, 17 bp, Homo sapiens
ggcttctgggacttgaa

SEQ ID NO: 337591 - DNA, 13 bp, Homo sapiens
ggcttcttcaact

SEQ ID NO: 337592 - DNA, 22 bp, Homo sapiens
ggcttggacttcctggggcccc

SEQ ID NO: 337593 - DNA, 15 bp, Homo sapiens
ggcttggagcagaga

SEQ ID NO: 337594 - DNA, 16 bp, Homo sapiens
ggcttggagcagagac

SEQ ID NO: 337595 - DNA, 17 bp, Homo sapiens
ggcttggagcagagacg

SEQ ID NO: 337596 - DNA, 12 bp, Homo sapiens
ggcttggccttg

SEQ ID NO: 337597 - DNA, 18 bp, Homo sapiens
ggcttggcgtggagcagg

SEQ ID NO: 337598 - DNA, 15 bp, Homo sapiens
ggcttgtcagagctg

SEQ ID NO: 337599 - DNA, 22 bp, Homo sapiens
ggcttgtgatttccatttctga

SEQ ID NO: 337600 - DNA, 13 bp, Homo sapiens
ggcttgtgggctg

SEQ ID NO: 337601 - DNA, 15 bp, Homo sapiens
ggcttgtgggctggt

SEQ ID NO: 337602 - DNA, 17 bp, Homo sapiens
ggctttaagctccagct

SEQ ID NO: 337603 - DNA, 16 bp, Homo sapiens
ggctttcatgaggagg

SEQ ID NO: 337604 - DNA, 24 bp, Homo sapiens
ggctttccagaaggccacaggcca

SEQ ID NO: 337605 - DNA, 18 bp, Homo sapiens
ggctttgattccatctcc

SEQ ID NO: 337606 - DNA, 24 bp, Homo sapiens
ggctttgattccatctccttgtct

SEQ ID NO: 337607 - DNA, 14 bp, Homo sapiens
ggctttgcaggctc

SEQ ID NO: 337608 - DNA, 16 bp, Homo sapiens
ggctttgcaggctctg

SEQ ID NO: 337609 - DNA, 19 bp, Homo sapiens
ggctttgcaggctctgggc

SEQ ID NO: 337610 - DNA, 19 bp, Homo sapiens
ggctttgcagggagaccag

SEQ ID NO: 337611 - DNA, 18 bp, Homo sapiens
ggctttgccatgggcctg

SEQ ID NO: 337612 - DNA, 17 bp, Homo sapiens
ggctttggcaacagaaa

SEQ ID NO: 337613 - DNA, 18 bp, Homo sapiens
ggctttggctcgggactt

SEQ ID NO: 337614 - DNA, 15 bp, Homo sapiens
ggctttgtcccacag

SEQ ID NO: 337615 - DNA, 16 bp, Homo sapiens
ggctttgtcccacagc

SEQ ID NO: 337616 - DNA, 18 bp, Homo sapiens
ggctttgtccctcccccg

SEQ ID NO: 337617 - DNA, 23 bp, Homo sapiens
ggcttttattttttaagttcaat

SEQ ID NO: 337618 - DNA, 18 bp, Homo sapiens
ggcttttgaatcaaagaa

SEQ ID NO: 337619 - DNA, 17 bp, Homo sapiens
ggcttttgtgccaggag

SEQ ID NO: 337620 - DNA, 14 bp, Homo sapiens
ggctttttcccagc

SEQ ID NO: 337621 - DNA, 17 bp, Homo sapiens
ggctttttttttctctt

SEQ ID NO: 337622 - DNA, 23 bp, Homo sapiens
gggaaaaactggctttttcccag

SEQ ID NO: 337623 - DNA, 16 bp, Homo sapiens
gggaaaacataatatc

SEQ ID NO: 337624 - DNA, 23 bp, Homo sapiens
gggaaaagggaacaggaaaagaa

SEQ ID NO: 337625 - DNA, 20 bp, Homo sapiens
gggaaaagggagaaaaagaa

SEQ ID NO: 337626 - DNA, 18 bp, Homo sapiens
gggaaagcgggcagcccc

SEQ ID NO: 337627 - DNA, 17 bp, Homo sapiens
gggaaaggatggagtgt

SEQ ID NO: 337628 - DNA, 19 bp, Homo sapiens
gggaaaggccggtgggaag

SEQ ID NO: 337629 - DNA, 13 bp, Homo sapiens
gggaaaggtgctc

SEQ ID NO: 337630 - DNA, 23 bp, Homo sapiens
gggaaagtcagctttcagagcca

SEQ ID NO: 337631 - DNA, 20 bp, Homo sapiens
gggaacagtgtttcccataa

SEQ ID NO: 337632 - DNA, 15 bp, Homo sapiens
gggaactccactctc

SEQ ID NO: 337633 - DNA, 15 bp, Homo sapiens
gggaactcccaagaa

SEQ ID NO: 337634 - DNA, 22 bp, Homo sapiens
gggaactcccaagaacagcagg

SEQ ID NO: 337635 - DNA, 16 bp, Homo sapiens
gggaagaatgtctcct

SEQ ID NO: 337636 - DNA, 23 bp, Homo sapiens
gggaagagaggagttcaatgatc

SEQ ID NO: 337637 - DNA, 12 bp, Homo sapiens
gggaagagctgg

SEQ ID NO: 337638 - DNA, 12 bp, Homo sapiens
gggaagagggca

SEQ ID NO: 337639 - DNA, 18 bp, Homo sapiens
gggaagatgctggcccca

SEQ ID NO: 337640 - DNA, 15 bp, Homo sapiens
gggaagcagggacac

SEQ ID NO: 337641 - DNA, 16 bp, Homo sapiens
gggaagcccacccgcc

SEQ ID NO: 337642 - DNA, 22 bp, Homo sapiens
gggaagctgcagcttgggagag

SEQ ID NO: 337643 - DNA, 15 bp, Homo sapiens
gggaagctggagtgc

SEQ ID NO: 337644 - DNA, 22 bp, Homo sapiens
gggaagctgtactcagagcaga

SEQ ID NO: 337645 - DNA, 16 bp, Homo sapiens
gggaaggaaataacat

SEQ ID NO: 337646 - DNA, 18 bp, Homo sapiens
gggaaggccacctgcagg

SEQ ID NO: 337647 - DNA, 19 bp, Homo sapiens
gggaaggccccacagacaa

SEQ ID NO: 337648 - DNA, 19 bp, Homo sapiens
gggaaggcctgagggaagc

SEQ ID NO: 337649 - DNA, 22 bp, Homo sapiens
gggaaggcctgagggaagccca

SEQ ID NO: 337650 - DNA, 12 bp, Homo sapiens
gggaagggccag

SEQ ID NO: 337651 - DNA, 21 bp, Homo sapiens
gggaatccagctccctagact

SEQ ID NO: 337652 - DNA, 18 bp, Homo sapiens
gggaatctcccagacttg

SEQ ID NO: 337653 - DNA, 17 bp, Homo sapiens
gggaatgttccctgcac

SEQ ID NO: 337654 - DNA, 23 bp, Homo sapiens
gggaatgttccctgcaccctgga

SEQ ID NO: 337655 - DNA, 12 bp, Homo sapiens
gggaattctctt

SEQ ID NO: 337656 - DNA, 18 bp, Homo sapiens
gggaattgtgtgatgttt

SEQ ID NO: 337657 - DNA, 13 bp, Homo sapiens
gggaatttcctct

SEQ ID NO: 337658 - DNA, 22 bp, Homo sapiens
gggacaaatttaaaacaaacaa

SEQ ID NO: 337659 - DNA, 16 bp, Homo sapiens
gggacaccccccgccc

SEQ ID NO: 337660 - DNA, 11 bp, Homo sapiens
gggacactgaa

SEQ ID NO: 337661 - DNA, 15 bp, Homo sapiens
gggacagagtctggg

SEQ ID NO: 337662 - DNA, 19 bp, Homo sapiens
gggacagagttcagggagg

SEQ ID NO: 337663 - DNA, 16 bp, Homo sapiens
gggacagcagcctccc

SEQ ID NO: 337664 - DNA, 12 bp, Homo sapiens
gggacagcggcc

SEQ ID NO: 337665 - DNA, 16 bp, Homo sapiens
gggacagcggcccggc

SEQ ID NO: 337666 - DNA, 22 bp, Homo sapiens
gggacagcggcccggcccacgc

SEQ ID NO: 337667 - DNA, 20 bp, Homo sapiens
gggacaggaacacccagccc

SEQ ID NO: 337668 - DNA, 19 bp, Homo sapiens
gggacagtgataggcccaa

SEQ ID NO: 337669 - DNA, 20 bp, Homo sapiens
gggacagttggcagagaagg

SEQ ID NO: 337670 - DNA, 18 bp, Homo sapiens
gggacatgctcacctcta

SEQ ID NO: 337671 - DNA, 16 bp, Homo sapiens
gggaccaactgggccc

SEQ ID NO: 337672 - DNA, 23 bp, Homo sapiens
gggaccacagctgctggccaggg

SEQ ID NO: 337673 - DNA, 13 bp, Homo sapiens
gggaccagctggg

SEQ ID NO: 337674 - DNA, 22 bp, Homo sapiens
gggacccccggcctccaggctg

SEQ ID NO: 337675 - DNA, 23 bp, Homo sapiens
gggacccccggcctccaggctgg

SEQ ID NO: 337676 - DNA, 23 bp, Homo sapiens
gggacccctgctcccagcctgct

SEQ ID NO: 337677 - DNA, 13 bp, Homo sapiens
gggaccttagaaa

SEQ ID NO: 337678 - DNA, 14 bp, Homo sapiens
gggaccttggagag

SEQ ID NO: 337679 - DNA, 17 bp, Homo sapiens
gggacgggggctgcttc

SEQ ID NO: 337680 - DNA, 14 bp, Homo sapiens
gggacgtggtcagg

SEQ ID NO: 337681 - DNA, 18 bp, Homo sapiens
gggactagcctggcttgg

SEQ ID NO: 337682 - DNA, 18 bp, Homo sapiens
gggactaggacctgagcc

SEQ ID NO: 337683 - DNA, 13 bp, Homo sapiens
gggactctcctcc

SEQ ID NO: 337684 - DNA, 16 bp, Homo sapiens
gggactctgcttggct

SEQ ID NO: 337685 - DNA, 20 bp, Homo sapiens
gggactctgcttggctgtcc

SEQ ID NO: 337686 - DNA, 19 bp, Homo sapiens
gggactgagccagtcccag

SEQ ID NO: 337687 - DNA, 16 bp, Homo sapiens
gggactggcccacccc

SEQ ID NO: 337688 - DNA, 21 bp, Homo sapiens
gggactggcccacccctcttc

SEQ ID NO: 337689 - DNA, 15 bp, Homo sapiens
gggactgggagggcc

SEQ ID NO: 337690 - DNA, 16 bp, Homo sapiens
gggactggtccaggca

SEQ ID NO: 337691 - DNA, 18 bp, Homo sapiens
gggactgtacctgtagga

SEQ ID NO: 337692 - DNA, 15 bp, Homo sapiens
ttaaatagcatctgc

SEQ ID NO: 337693 - DNA, 20 bp, Homo sapiens
ttaaatagcatctgctcttc

SEQ ID NO: 337694 - DNA, 23 bp, Homo sapiens
ttaaatagcatctgctcttctct

SEQ ID NO: 337695 - DNA, 19 bp, Homo sapiens
ttaaatataaatgtttgtc

SEQ ID NO: 337696 - DNA, 12 bp, Homo sapiens
ttaaatataatt

SEQ ID NO: 337697 - DNA, 18 bp, Homo sapiens
ttaaatataattctgtaa

SEQ ID NO: 337698 - DNA, 19 bp, Homo sapiens
ttaaatataattctgtaaa

SEQ ID NO: 337699 - DNA, 20 bp, Homo sapiens
ttaaatataattctgtaaat

SEQ ID NO: 337700 - DNA, 18 bp, Homo sapiens
ttaaatatatgtatgtaa

SEQ ID NO: 337701 - DNA, 20 bp, Homo sapiens
ttaaatatatgtatgtaaaa

SEQ ID NO: 337702 - DNA, 23 bp, Homo sapiens
ttaaatatcattctttgtatctt

SEQ ID NO: 337703 - DNA, 17 bp, Homo sapiens
ttaaatattcagaaaaa

SEQ ID NO: 337704 - DNA, 22 bp, Homo sapiens
ttaaatcacagaaaaaaatggt

SEQ ID NO: 337705 - DNA, 22 bp, Homo sapiens
ttaaatcactgaggcattttta

SEQ ID NO: 337706 - DNA, 13 bp, Homo sapiens
ttaaatcatttca

SEQ ID NO: 337707 - DNA, 18 bp, Homo sapiens
gggcagggctcccacaga

SEQ ID NO: 337708 - DNA, 22 bp, Homo sapiens
gggcaggggagccagggtagag

SEQ ID NO: 337709 - DNA, 19 bp, Homo sapiens
gggcaggtcctggggaggc

SEQ ID NO: 337710 - DNA, 21 bp, Homo sapiens
gggcaggtcctggggaggctg

SEQ ID NO: 337711 - DNA, 14 bp, Homo sapiens
gggcagtacctggg

SEQ ID NO: 337712 - DNA, 19 bp, Homo sapiens
gggcagtgacgtgagtggg

SEQ ID NO: 337713 - DNA, 20 bp, Homo sapiens
gggcagtgacgtgagtgggg

SEQ ID NO: 337714 - DNA, 16 bp, Homo sapiens
gggcagttctcactcc

SEQ ID NO: 337715 - DNA, 17 bp, Homo sapiens
gggcatcaggcactggt

SEQ ID NO: 337716 - DNA, 17 bp, Homo sapiens
gggcatccccagccccc

SEQ ID NO: 337717 - DNA, 22 bp, Homo sapiens
gggcatctgagtccagctcccc

SEQ ID NO: 337718 - DNA, 20 bp, Homo sapiens
gggcatctgcccctccccca

SEQ ID NO: 337719 - DNA, 16 bp, Homo sapiens
gggcatgccaccctca

SEQ ID NO: 337720 - DNA, 19 bp, Homo sapiens
gggcatggactaccagatg

SEQ ID NO: 337721 - DNA, 17 bp, Homo sapiens
gggcatggccaggtggc

SEQ ID NO: 337722 - DNA, 20 bp, Homo sapiens
gggcatggccaggtggccac

SEQ ID NO: 337723 - DNA, 15 bp, Homo sapiens
gggcatgggggaggc

SEQ ID NO: 337724 - DNA, 16 bp, Homo sapiens
gggcatgggtggaggg

SEQ ID NO: 337725 - DNA, 20 bp, Homo sapiens
gggcatggtaccagccctgg

SEQ ID NO: 337726 - DNA, 21 bp, Homo sapiens
gggcatgtattggcctggagg

SEQ ID NO: 337727 - DNA, 20 bp, Homo sapiens
gggcatgtgtgcctgtggca

SEQ ID NO: 337728 - DNA, 21 bp, Homo sapiens
gggcatgtgtgcctgtggcag

SEQ ID NO: 337729 - DNA, 14 bp, Homo sapiens
gggcattgggctga

SEQ ID NO: 337730 - DNA, 15 bp, Homo sapiens
gggccaacaccaggg

SEQ ID NO: 337731 - DNA, 24 bp, Homo sapiens
gggccaagccagggttccagacag

SEQ ID NO: 337732 - DNA, 20 bp, Homo sapiens
gggccacacccaggaaggga

SEQ ID NO: 337733 - DNA, 22 bp, Homo sapiens
gggccaccagctccactggcct

SEQ ID NO: 337734 - DNA, 14 bp, Homo sapiens
gggccacccaccag

SEQ ID NO: 337735 - DNA, 19 bp, Homo sapiens
gggccacccaccagggctc

SEQ ID NO: 337736 - DNA, 21 bp, Homo sapiens
gggccacccaccagggctcag

SEQ ID NO: 337737 - DNA, 15 bp, Homo sapiens
gggccacctccccag

SEQ ID NO: 337738 - DNA, 16 bp, Homo sapiens
gggccacgccccagcc

SEQ ID NO: 337739 - DNA, 21 bp, Homo sapiens
gggccacgccccagcccgaca

SEQ ID NO: 337740 - DNA, 22 bp, Homo sapiens
gggccacgccccagcccgacaa

SEQ ID NO: 337741 - DNA, 23 bp, Homo sapiens
gggccactggcatctctggagtg

SEQ ID NO: 337742 - DNA, 16 bp, Homo sapiens
gggccagactggctgc

SEQ ID NO: 337743 - DNA, 13 bp, Homo sapiens
gggccagatgaca

SEQ ID NO: 337744 - DNA, 12 bp, Homo sapiens
gggccagcccag

SEQ ID NO: 337745 - DNA, 15 bp, Homo sapiens
gggccagcccctccc

SEQ ID NO: 337746 - DNA, 13 bp, Homo sapiens
gggccagctgccc

SEQ ID NO: 337747 - DNA, 12 bp, Homo sapiens
gggccaggagaa

SEQ ID NO: 337748 - DNA, 12 bp, Homo sapiens
gggccagggctc

SEQ ID NO: 337749 - DNA, 21 bp, Homo sapiens
gggccagtcctgcctggccag

SEQ ID NO: 337750 - DNA, 23 bp, Homo sapiens
gggcccaagacagatgccccaga

SEQ ID NO: 337751 - DNA, 11 bp, Homo sapiens
gggcccagaac

SEQ ID NO: 337752 - DNA, 21 bp, Homo sapiens
gggcccagaactgcccccact

SEQ ID NO: 337753 - DNA, 11 bp, Homo sapiens
gggcccagaga

SEQ ID NO: 337754 - DNA, 14 bp, Homo sapiens
gggcccagaggctg

SEQ ID NO: 337755 - DNA, 21 bp, Homo sapiens
gggcccagctgggctctgcca

SEQ ID NO: 337756 - DNA, 16 bp, Homo sapiens
gggcccagctgtagcc

SEQ ID NO: 337757 - DNA, 22 bp, Homo sapiens
gggcccaggcagcacctggagc

SEQ ID NO: 337758 - DNA, 15 bp, Homo sapiens
gggcccaggcctgga

SEQ ID NO: 337759 - DNA, 18 bp, Homo sapiens
gggcccaggcctggagcg

SEQ ID NO: 337760 - DNA, 18 bp, Homo sapiens
gggcccatggccccagct

SEQ ID NO: 337761 - DNA, 13 bp, Homo sapiens
gggccccaaagcc

SEQ ID NO: 337762 - DNA, 20 bp, Homo sapiens
gggccccaaagcccagcccg

SEQ ID NO: 337763 - DNA, 17 bp, Homo sapiens
gggccccagatctgcct

SEQ ID NO: 337764 - DNA, 18 bp, Homo sapiens
gggccccagatctgcctg

SEQ ID NO: 337765 - DNA, 14 bp, Homo sapiens
gggccccagccgtg

SEQ ID NO: 337766 - DNA, 17 bp, Homo sapiens
gggccccatgctctgcc

SEQ ID NO: 337767 - DNA, 23 bp, Homo sapiens
gggccccattcagaactctcaga

SEQ ID NO: 337768 - DNA, 22 bp, Homo sapiens
gggccccccagctcaggggcag

SEQ ID NO: 337769 - DNA, 15 bp, Homo sapiens
gggcccccggccacg

SEQ ID NO: 337770 - DNA, 13 bp, Homo sapiens
gggccccctctct

SEQ ID NO: 337771 - DNA, 16 bp, Homo sapiens
gggccccggggctggc

SEQ ID NO: 337772 - DNA, 19 bp, Homo sapiens
gggcccctccctacctcaa

SEQ ID NO: 337773 - DNA, 21 bp, Homo sapiens
gggcccctcctctgtgctccc

SEQ ID NO: 337774 - DNA, 15 bp, Homo sapiens
gggcccctcggctac

SEQ ID NO: 337775 - DNA, 16 bp, Homo sapiens
gggcccctctgcccag

SEQ ID NO: 337776 - DNA, 23 bp, Homo sapiens
gggcccctctgcccagcttgggc

SEQ ID NO: 337777 - DNA, 23 bp, Homo sapiens
gggcccgagcgcgtgccttcccc

SEQ ID NO: 337778 - DNA, 17 bp, Homo sapiens
gggcccgctcaacctct

SEQ ID NO: 337779 - DNA, 17 bp, Homo sapiens
gggcccgttgaggatga

SEQ ID NO: 337780 - DNA, 14 bp, Homo sapiens
gggccctcccttgg

SEQ ID NO: 337781 - DNA, 23 bp, Homo sapiens
gggccctcctgaaacttacacac

SEQ ID NO: 337782 - DNA, 23 bp, Homo sapiens
gggccctctgtagctccctcctc

SEQ ID NO: 337783 - DNA, 10 bp, Homo sapiens
gggccctgca

SEQ ID NO: 337784 - DNA, 13 bp, Homo sapiens
gggccctgcagga

SEQ ID NO: 337785 - DNA, 15 bp, Homo sapiens
gggccctgcaggagg

SEQ ID NO: 337786 - DNA, 18 bp, Homo sapiens
gggccctgcaggaggcct

SEQ ID NO: 337787 - DNA, 15 bp, Homo sapiens
gggccctgctcaggc

SEQ ID NO: 337788 - DNA, 20 bp, Homo sapiens
gggccctggggtccccactc

SEQ ID NO: 337789 - DNA, 21 bp, Homo sapiens
gggccctggggtccccactcc

SEQ ID NO: 337790 - DNA, 19 bp, Homo sapiens
gggccctggggtctctgag

SEQ ID NO: 337791 - DNA, 18 bp, Homo sapiens
gggccctggttcccccag

SEQ ID NO: 337792 - DNA, 24 bp, Homo sapiens
gggccctggttcccccaggaccct

SEQ ID NO: 337793 - DNA, 19 bp, Homo sapiens
gggcccttgggacagccag

SEQ ID NO: 337794 - DNA, 18 bp, Homo sapiens
gggcccttggggcctggc

SEQ ID NO: 337795 - DNA, 17 bp, Homo sapiens
gggccgagtccaggagc

SEQ ID NO: 337796 - DNA, 16 bp, Homo sapiens
gggccgcctcctccag

SEQ ID NO: 337797 - DNA, 16 bp, Homo sapiens
gggccggcagcctggt

SEQ ID NO: 337798 - DNA, 16 bp, Homo sapiens
gggcctcaaggacttg

SEQ ID NO: 337799 - DNA, 16 bp, Homo sapiens
gggcctcacctttccc

SEQ ID NO: 337800 - DNA, 13 bp, Homo sapiens
gggcctcactcca

SEQ ID NO: 337801 - DNA, 14 bp, Homo sapiens
gggcctcagagaca

SEQ ID NO: 337802 - DNA, 21 bp, Homo sapiens
gggcctcccactcctgttcct

SEQ ID NO: 337803 - DNA, 20 bp, Homo sapiens
gggcctcccgtccgtccgcc

SEQ ID NO: 337804 - DNA, 21 bp, Homo sapiens
gggcctcccgtccgtccgccc

SEQ ID NO: 337805 - DNA, 23 bp, Homo sapiens
gggcctcctctaacaggggctgg

SEQ ID NO: 337806 - DNA, 16 bp, Homo sapiens
gggcctccttgtccag

SEQ ID NO: 337807 - DNA, 17 bp, Homo sapiens
gggcctccttgtccagg

SEQ ID NO: 337808 - DNA, 12 bp, Homo sapiens
gggcctctgcct

SEQ ID NO: 337809 - DNA, 17 bp, Homo sapiens
gggcctctgcctccagg

SEQ ID NO: 337810 - DNA, 20 bp, Homo sapiens
gggcctctgcctccaggagg

SEQ ID NO: 337811 - DNA, 17 bp, Homo sapiens
gggcctctggctgcctg

SEQ ID NO: 337812 - DNA, 19 bp, Homo sapiens
gggcctctggctgcctggc

SEQ ID NO: 337813 - DNA, 21 bp, Homo sapiens
gggcctctggctgcctggccc

SEQ ID NO: 337814 - DNA, 18 bp, Homo sapiens
gggcctgatggagaggag

SEQ ID NO: 337815 - DNA, 20 bp, Homo sapiens
gggcctgatggagaggagaa

SEQ ID NO: 337816 - DNA, 23 bp, Homo sapiens
gggcctgcctagcactcacatgc

SEQ ID NO: 337817 - DNA, 20 bp, Homo sapiens
gggcctgctagtctgtcagg

SEQ ID NO: 337818 - DNA, 15 bp, Homo sapiens
gggcctgctgtgggt

SEQ ID NO: 337819 - DNA, 18 bp, Homo sapiens
gggcctgcttttccagga

SEQ ID NO: 337820 - DNA, 14 bp, Homo sapiens
gggcctggacctgc

SEQ ID NO: 337821 - DNA, 12 bp, Homo sapiens
gggcctggccta

SEQ ID NO: 337822 - DNA, 16 bp, Homo sapiens
gggcctggcctgagct

SEQ ID NO: 337823 - DNA, 17 bp, Homo sapiens
gggcctggcctgagctg

SEQ ID NO: 337824 - DNA, 14 bp, Homo sapiens
gggcctggcctggg

SEQ ID NO: 337825 - DNA, 17 bp, Homo sapiens
gggcctggcttgctcca

SEQ ID NO: 337826 - DNA, 19 bp, Homo sapiens
gggcctggcttgctccagg

SEQ ID NO: 337827 - DNA, 21 bp, Homo sapiens
gggcctggcttgctccagggt

SEQ ID NO: 337828 - DNA, 23 bp, Homo sapiens
gggcctggcttgctccagggtct

SEQ ID NO: 337829 - DNA, 12 bp, Homo sapiens
gggcctgggcct

SEQ ID NO: 337830 - DNA, 15 bp, Homo sapiens
gggcctgggcctgct

SEQ ID NO: 337831 - DNA, 16 bp, Homo sapiens
gggcctgtcccccaag

SEQ ID NO: 337832 - DNA, 18 bp, Homo sapiens
gggcctgtgcagcagccc

SEQ ID NO: 337833 - DNA, 11 bp, Homo sapiens
gggccttctca

SEQ ID NO: 337834 - DNA, 22 bp, Homo sapiens
gggccttggcctcccctgctga

SEQ ID NO: 337835 - DNA, 11 bp, Homo sapiens
gggcctttccc

SEQ ID NO: 337836 - DNA, 22 bp, Homo sapiens
gggcctttcctgtgccaacctg

SEQ ID NO: 337837 - DNA, 21 bp, Homo sapiens
ggggcaggaatcaaggagcct

SEQ ID NO: 337838 - DNA, 23 bp, Homo sapiens
ggggcaggaatcaaggagcctcc

SEQ ID NO: 337839 - DNA, 16 bp, Homo sapiens
ggggcaggagctcaga

SEQ ID NO: 337840 - DNA, 16 bp, Homo sapiens
ggggcaggagggccct

SEQ ID NO: 337841 - DNA, 11 bp, Homo sapiens
ggggcaggcct

SEQ ID NO: 337842 - DNA, 15 bp, Homo sapiens
ggggcagggcagggc

SEQ ID NO: 337843 - DNA, 11 bp, Homo sapiens
ggggcagtctg

SEQ ID NO: 337844 - DNA, 22 bp, Homo sapiens
ggggcatggacagggccagggt

SEQ ID NO: 337845 - DNA, 15 bp, Homo sapiens
ttaggaagagaaacc

SEQ ID NO: 337846 - DNA, 13 bp, Homo sapiens
ttaggaagtgtaa

SEQ ID NO: 337847 - DNA, 20 bp, Homo sapiens
ttaggaagtgtaacagctga

SEQ ID NO: 337848 - DNA, 19 bp, Homo sapiens
ttaggaatgctcaatgtgc

SEQ ID NO: 337849 - DNA, 23 bp, Homo sapiens
ttaggaattaagttatctttaaa

SEQ ID NO: 337850 - DNA, 22 bp, Homo sapiens
ttaggacttcaaaaggtgatta

SEQ ID NO: 337851 - DNA, 14 bp, Homo sapiens
ttaggagtactttc

SEQ ID NO: 337852 - DNA, 14 bp, Homo sapiens
ttaggatttaacag

SEQ ID NO: 337853 - DNA, 14 bp, Homo sapiens
ttaggcaaaacctt

SEQ ID NO: 337854 - DNA, 21 bp, Homo sapiens
ttaggcaggaagtcaggagcc

SEQ ID NO: 337855 - DNA, 23 bp, Homo sapiens
ttaggcaggaagtcaggagccag

SEQ ID NO: 337856 - DNA, 19 bp, Homo sapiens
ttaggcagggatttgagga

SEQ ID NO: 337857 - DNA, 17 bp, Homo sapiens
ttaggctgggcccagag

SEQ ID NO: 337858 - DNA, 17 bp, Homo sapiens
ttaggcttacaatgtgc

SEQ ID NO: 337859 - DNA, 18 bp, Homo sapiens
ttaggcttaccttggtca

SEQ ID NO: 337860 - DNA, 15 bp, Homo sapiens
ttagggctctaattt

SEQ ID NO: 337861 - DNA, 19 bp, Homo sapiens
ttaggtagtagaatctcag

SEQ ID NO: 337862 - DNA, 16 bp, Homo sapiens
ttaggtcccagaatgg

SEQ ID NO: 337863 - DNA, 16 bp, Homo sapiens
ttaggtgaggaagcaa

SEQ ID NO: 337864 - DNA, 15 bp, Homo sapiens
ttaggtgtcttttaa

SEQ ID NO: 337865 - DNA, 14 bp, Homo sapiens
ttagtacccacctg

SEQ ID NO: 337866 - DNA, 18 bp, Homo sapiens
ttagtactatatctgttt

SEQ ID NO: 337867 - DNA, 12 bp, Homo sapiens
ttagtagcatgt

SEQ ID NO: 337868 - DNA, 13 bp, Homo sapiens
ttagtagcatgtt

SEQ ID NO: 337869 - DNA, 13 bp, Homo sapiens
ttagtattaacta

SEQ ID NO: 337870 - DNA, 20 bp, Homo sapiens
ttagtcattattattacttt

SEQ ID NO: 337871 - DNA, 17 bp, Homo sapiens
ttagtcctcacagccta

SEQ ID NO: 337872 - DNA, 18 bp, Homo sapiens
ttagtcttctcatagcat

SEQ ID NO: 337873 - DNA, 13 bp, Homo sapiens
ttagtgatttgct

SEQ ID NO: 337874 - DNA, 14 bp, Homo sapiens
ttagtgatttgcta

SEQ ID NO: 337875 - DNA, 15 bp, Homo sapiens
ttagtgcaatttctt

SEQ ID NO: 337876 - DNA, 14 bp, Homo sapiens
ttagtgccaggctg

SEQ ID NO: 337877 - DNA, 16 bp, Homo sapiens
ttagtgctttacatgc

SEQ ID NO: 337878 - DNA, 15 bp, Homo sapiens
ttagtgggcaggtgg

SEQ ID NO: 337879 - DNA, 18 bp, Homo sapiens
ttagtgggtgagaaattt

SEQ ID NO: 337880 - DNA, 19 bp, Homo sapiens
ttagtggtatgtctcttta

SEQ ID NO: 337881 - DNA, 12 bp, Homo sapiens
ttagtgtatttt

SEQ ID NO: 337882 - DNA, 14 bp, Homo sapiens
ttagtgtcacttac

SEQ ID NO: 337883 - DNA, 19 bp, Homo sapiens
ttagtgtggttttctgttt

SEQ ID NO: 337884 - DNA, 19 bp, Homo sapiens
ttagttaaaatctattttg

SEQ ID NO: 337885 - DNA, 15 bp, Homo sapiens
ttagttatagtttca

SEQ ID NO: 337886 - DNA, 21 bp, Homo sapiens
ttagttctcactgttccctct

SEQ ID NO: 337887 - DNA, 19 bp, Homo sapiens
ttagttgaaaaatctagtt

SEQ ID NO: 337888 - DNA, 22 bp, Homo sapiens
ttagttgagtcttcacatttag

SEQ ID NO: 337889 - DNA, 17 bp, Homo sapiens
ttagtttacaatcagcc

SEQ ID NO: 337890 - DNA, 13 bp, Homo sapiens
ttagtttcaaaat

SEQ ID NO: 337891 - DNA, 19 bp, Homo sapiens
ttagtttcagaagtactgg

SEQ ID NO: 337892 - DNA, 16 bp, Homo sapiens
ttagtttgttaattga

SEQ ID NO: 337893 - DNA, 14 bp, Homo sapiens
ttagttttgttcca

SEQ ID NO: 337894 - DNA, 20 bp, Homo sapiens
ttagtttttaaaaaggcctt

SEQ ID NO: 337895 - DNA, 15 bp, Homo sapiens
ttataaacagataat

SEQ ID NO: 337896 - DNA, 12 bp, Homo sapiens
ttataaatcata

SEQ ID NO: 337897 - DNA, 24 bp, Homo sapiens
ttataaatgcattaaataagagtt

SEQ ID NO: 337898 - DNA, 13 bp, Homo sapiens
ttataaattaaat

SEQ ID NO: 337899 - DNA, 15 bp, Homo sapiens
ttataaattaaatat

SEQ ID NO: 337900 - DNA, 15 bp, Homo sapiens
ttataacattgtaaa

SEQ ID NO: 337901 - DNA, 17 bp, Homo sapiens
ttataactcatcataaa

SEQ ID NO: 337902 - DNA, 19 bp, Homo sapiens
ttataactcatcataaaat

SEQ ID NO: 337903 - DNA, 20 bp, Homo sapiens
ttataactcatcataaaata

SEQ ID NO: 337904 - DNA, 21 bp, Homo sapiens
ttataactcatcataaaataa

SEQ ID NO: 337905 - DNA, 23 bp, Homo sapiens
ttataagatttttaggtgtcttt

SEQ ID NO: 337906 - DNA, 16 bp, Homo sapiens
ttataagcaacatgaa

SEQ ID NO: 337907 - DNA, 15 bp, Homo sapiens
ttataaggactgcat

SEQ ID NO: 337908 - DNA, 21 bp, Homo sapiens
ttataaggctgactcttacta

SEQ ID NO: 337909 - DNA, 16 bp, Homo sapiens
ttataagtcacaaaga

SEQ ID NO: 337910 - DNA, 14 bp, Homo sapiens
ttataataatgttc

SEQ ID NO: 337911 - DNA, 12 bp, Homo sapiens
ttataatgcaaa

SEQ ID NO: 337912 - DNA, 19 bp, Homo sapiens
ttataatttctacccatgt

SEQ ID NO: 337913 - DNA, 13 bp, Homo sapiens
ttatacagaccta

SEQ ID NO: 337914 - DNA, 12 bp, Homo sapiens
ttatacagtaca

SEQ ID NO: 337915 - DNA, 15 bp, Homo sapiens
ttatacagttttaaa

SEQ ID NO: 337916 - DNA, 16 bp, Homo sapiens
ttataccaaagggaaa

SEQ ID NO: 337917 - DNA, 14 bp, Homo sapiens
ttataccagtgtta

SEQ ID NO: 337918 - DNA, 12 bp, Homo sapiens
ttatactaagaa

SEQ ID NO: 337919 - DNA, 16 bp, Homo sapiens
ttatactaagaaaaga

SEQ ID NO: 337920 - DNA, 18 bp, Homo sapiens
ttatactaccaagtgacc

SEQ ID NO: 337921 - DNA, 14 bp, Homo sapiens
ttatacttaaacag

SEQ ID NO: 337922 - DNA, 14 bp, Homo sapiens
ttatagaatacttt

SEQ ID NO: 337923 - DNA, 15 bp, Homo sapiens
ttatagaatactttt

SEQ ID NO: 337924 - DNA, 19 bp, Homo sapiens
ttatagagggccaagactt

SEQ ID NO: 337925 - DNA, 16 bp, Homo sapiens
ttatagctcagtttat

SEQ ID NO: 337926 - DNA, 16 bp, Homo sapiens
ttatagcttaactaat

SEQ ID NO: 337927 - DNA, 17 bp, Homo sapiens
ttataggtcactcctgg

SEQ ID NO: 337928 - DNA, 18 bp, Homo sapiens
ttataggtcactcctggg

SEQ ID NO: 337929 - DNA, 15 bp, Homo sapiens
ttatagtatatctgg

SEQ ID NO: 337930 - DNA, 13 bp, Homo sapiens
ttatataaatgta

SEQ ID NO: 337931 - DNA, 16 bp, Homo sapiens
ttatataattatgtta

SEQ ID NO: 337932 - DNA, 17 bp, Homo sapiens
ttatataattatgttat

SEQ ID NO: 337933 - DNA, 21 bp, Homo sapiens
ttatatacctggcttttactt

SEQ ID NO: 337934 - DNA, 23 bp, Homo sapiens
ttatatactgggttcttgtttta

SEQ ID NO: 337935 - DNA, 13 bp, Homo sapiens
ttatatagcttga

SEQ ID NO: 337936 - DNA, 13 bp, Homo sapiens
ttatatataaaat

SEQ ID NO: 337937 - DNA, 17 bp, Homo sapiens
ttatatataaaataaat

SEQ ID NO: 337938 - DNA, 20 bp, Homo sapiens
ttatatataaaataaatata

SEQ ID NO: 337939 - DNA, 14 bp, Homo sapiens
ttatatatgaagta

SEQ ID NO: 337940 - DNA, 14 bp, Homo sapiens
ttatatatgtattt

SEQ ID NO: 337941 - DNA, 22 bp, Homo sapiens
ttatatcagactgctttgagaa

SEQ ID NO: 337942 - DNA, 16 bp, Homo sapiens
ttatatcagcctgagt

SEQ ID NO: 337943 - DNA, 21 bp, Homo sapiens
ttatatgacttcttgttcatg

SEQ ID NO: 337944 - DNA, 18 bp, Homo sapiens
ttatatgatatgcatgta

SEQ ID NO: 337945 - DNA, 15 bp, Homo sapiens
ttatattacttttgt

SEQ ID NO: 337946 - DNA, 16 bp, Homo sapiens
ttatattacttttgta

SEQ ID NO: 337947 - DNA, 19 bp, Homo sapiens
ttatattagagtgccctta

SEQ ID NO: 337948 - DNA, 23 bp, Homo sapiens
ttatattcagagatgtaccatgt

SEQ ID NO: 337949 - DNA, 23 bp, Homo sapiens
ttatattctcttatgatacttga

SEQ ID NO: 337950 - DNA, 14 bp, Homo sapiens
ttatattgagacaa

SEQ ID NO: 337951 - DNA, 22 bp, Homo sapiens
ttatatttagttatagtttcag

SEQ ID NO: 337952 - DNA, 22 bp, Homo sapiens
ttatatttccctaaaatacatt

SEQ ID NO: 337953 - DNA, 13 bp, Homo sapiens
ttatcaaatcatt

SEQ ID NO: 337954 - DNA, 14 bp, Homo sapiens
ttatcaaatcattc

SEQ ID NO: 337955 - DNA, 15 bp, Homo sapiens
ttatcaaatcattca

SEQ ID NO: 337956 - DNA, 18 bp, Homo sapiens
ttatcaaatcattcaaaa

SEQ ID NO: 337957 - DNA, 20 bp, Homo sapiens
ttatcaaatcattcaaaact

SEQ ID NO: 337958 - DNA, 15 bp, Homo sapiens
ttatcaacaatagtg

SEQ ID NO: 337959 - DNA, 12 bp, Homo sapiens
ttatcaacttta

SEQ ID NO: 337960 - DNA, 17 bp, Homo sapiens
ttatcaagtgtcttcca

SEQ ID NO: 337961 - DNA, 22 bp, Homo sapiens
ttatcaagtttgggtctgtgct

SEQ ID NO: 337962 - DNA, 15 bp, Homo sapiens
ttatcaataaagcac

SEQ ID NO: 337963 - DNA, 18 bp, Homo sapiens
ttatcagtgaatataaat

SEQ ID NO: 337964 - DNA, 23 bp, Homo sapiens
ttatcagtgaatataaatgtact

SEQ ID NO: 337965 - DNA, 17 bp, Homo sapiens
ttatcagtgacagagtt

SEQ ID NO: 337966 - DNA, 21 bp, Homo sapiens
ttatcagtttccagtctcaaa

SEQ ID NO: 337967 - DNA, 12 bp, Homo sapiens
ttatcatttcta

SEQ ID NO: 337968 - DNA, 20 bp, Homo sapiens
gggtactcttgatgtgaaga

SEQ ID NO: 337969 - DNA, 17 bp, Homo sapiens
gggtagacttggagctg

SEQ ID NO: 337970 - DNA, 23 bp, Homo sapiens
gggtagagcggagaaaggaaggg

SEQ ID NO: 337971 - DNA, 22 bp, Homo sapiens
gggtagatgatttctagcaggc

SEQ ID NO: 337972 - DNA, 21 bp, Homo sapiens
gggtaggaaaccaccctgagg

SEQ ID NO: 337973 - DNA, 15 bp, Homo sapiens
gggtagggggcctga

SEQ ID NO: 337974 - DNA, 23 bp, Homo sapiens
gggtataaaactttcctcgcctg

SEQ ID NO: 337975 - DNA, 19 bp, Homo sapiens
gggtatccaagttggactg

SEQ ID NO: 337976 - DNA, 22 bp, Homo sapiens
gggtatgtgttgccaaagctgg

SEQ ID NO: 337977 - DNA, 14 bp, Homo sapiens
gggtcaactccaag

SEQ ID NO: 337978 - DNA, 15 bp, Homo sapiens
gggtcaactccaagg

SEQ ID NO: 337979 - DNA, 23 bp, Homo sapiens
gggtcaagttattaatttcttca

SEQ ID NO: 337980 - DNA, 24 bp, Homo sapiens
gggtcacctcctccaagaagccct

SEQ ID NO: 337981 - DNA, 17 bp, Homo sapiens
gggtcagctctggccac

SEQ ID NO: 337982 - DNA, 15 bp, Homo sapiens
gggtcaggccacggc

SEQ ID NO: 337983 - DNA, 19 bp, Homo sapiens
ttatctagccaaagagctc

SEQ ID NO: 337984 - DNA, 23 bp, Homo sapiens
ttatctagtaggtctgcacacat

SEQ ID NO: 337985 - DNA, 13 bp, Homo sapiens
ttatctatttgta

SEQ ID NO: 337986 - DNA, 22 bp, Homo sapiens
ttatctatttgtatatatacat

SEQ ID NO: 337987 - DNA, 17 bp, Homo sapiens
ttatctccctgcttcat

SEQ ID NO: 337988 - DNA, 18 bp, Homo sapiens
ttatctctttctctcttt

SEQ ID NO: 337989 - DNA, 12 bp, Homo sapiens
ttatctgcctgg

SEQ ID NO: 337990 - DNA, 18 bp, Homo sapiens
ttatctgcctggcctggc

SEQ ID NO: 337991 - DNA, 13 bp, Homo sapiens
ttatctgctgttc

SEQ ID NO: 337992 - DNA, 15 bp, Homo sapiens
ttatctgctgttcct

SEQ ID NO: 337993 - DNA, 19 bp, Homo sapiens
ttatctgggttctcttcat

SEQ ID NO: 337994 - DNA, 17 bp, Homo sapiens
ttatctgtctgagccct

SEQ ID NO: 337995 - DNA, 17 bp, Homo sapiens
ttatcttatgccacggg

SEQ ID NO: 337996 - DNA, 14 bp, Homo sapiens
ttatcttctgtttt

SEQ ID NO: 337997 - DNA, 17 bp, Homo sapiens
ttatcttctgtttttct

SEQ ID NO: 337998 - DNA, 20 bp, Homo sapiens
ttatcttctgtttttctcaa

SEQ ID NO: 337999 - DNA, 21 bp, Homo sapiens
ttatcttctgtttttctcaaa

SEQ ID NO: 338000 - DNA, 22 bp, Homo sapiens
ttatcttctgtttttctcaaat

SEQ ID NO: 338001 - DNA, 19 bp, Homo sapiens
ttatcttgaaaaagtattg

SEQ ID NO: 338002 - DNA, 17 bp, Homo sapiens
ttatcttgtctctgggc

SEQ ID NO: 338003 - DNA, 14 bp, Homo sapiens
ttatcttgtgtatg

SEQ ID NO: 338004 - DNA, 15 bp, Homo sapiens
ttatctttgtaatta

SEQ ID NO: 338005 - DNA, 18 bp, Homo sapiens
ttatgaaaaaaatatatt

SEQ ID NO: 338006 - DNA, 15 bp, Homo sapiens
ttatgaactgcatgt

SEQ ID NO: 338007 - DNA, 22 bp, Homo sapiens
ttatgaatatttataacagcat

SEQ ID NO: 338008 - DNA, 13 bp, Homo sapiens
ttatgaatcagtg

SEQ ID NO: 338009 - DNA, 11 bp, Homo sapiens
ttatgactcca

SEQ ID NO: 338010 - DNA, 11 bp, Homo sapiens
ttatgagaaaa

SEQ ID NO: 338011 - DNA, 21 bp, Homo sapiens
ttatgagaactggttcttgcc

SEQ ID NO: 338012 - DNA, 18 bp, Homo sapiens
ttatgaggagtgaacatt

SEQ ID NO: 338013 - DNA, 19 bp, Homo sapiens
ttatgataaaggcttagga

SEQ ID NO: 338014 - DNA, 22 bp, Homo sapiens
ttatgatttcatgattagacaa

SEQ ID NO: 338015 - DNA, 13 bp, Homo sapiens
ttatgcaaagtac

SEQ ID NO: 338016 - DNA, 20 bp, Homo sapiens
ttatgcaagggactgtgtgt

SEQ ID NO: 338017 - DNA, 18 bp, Homo sapiens
ttatgcagatagaatcaa

SEQ ID NO: 338018 - DNA, 20 bp, Homo sapiens
ttatgcagcttccttttgag

SEQ ID NO: 338019 - DNA, 23 bp, Homo sapiens
ttatgcatgagaactaaatagat

SEQ ID NO: 338020 - DNA, 19 bp, Homo sapiens
ttatgccgtctcatatttt

SEQ ID NO: 338021 - DNA, 21 bp, Homo sapiens
ttatgccttttaaaaatacta

SEQ ID NO: 338022 - DNA, 14 bp, Homo sapiens
ttatgctgagtatg

SEQ ID NO: 338023 - DNA, 11 bp, Homo sapiens
ttatggacatc

SEQ ID NO: 338024 - DNA, 19 bp, Homo sapiens
ttatggacatcgatatgaa

SEQ ID NO: 338025 - DNA, 11 bp, Homo sapiens
ttatggcctca

SEQ ID NO: 338026 - DNA, 12 bp, Homo sapiens
ttatggcctcag

SEQ ID NO: 338027 - DNA, 18 bp, Homo sapiens
ttatgggaacaagtgtac

SEQ ID NO: 338028 - DNA, 15 bp, Homo sapiens
ttatggtataataaa

SEQ ID NO: 338029 - DNA, 17 bp, Homo sapiens
ttatggtataataaagt

SEQ ID NO: 338030 - DNA, 14 bp, Homo sapiens
ttatggtattttcg

SEQ ID NO: 338031 - DNA, 10 bp, Homo sapiens
ttatggtgaa

SEQ ID NO: 338032 - DNA, 11 bp, Homo sapiens
ttatggtgaaa

SEQ ID NO: 338033 - DNA, 17 bp, Homo sapiens
ttatggttttgtgatgt

SEQ ID NO: 338034 - DNA, 18 bp, Homo sapiens
ttatgtaagagcaccttc

SEQ ID NO: 338035 - DNA, 12 bp, Homo sapiens
ttatgtagaaat

SEQ ID NO: 338036 - DNA, 13 bp, Homo sapiens
ttatgtagaaata

SEQ ID NO: 338037 - DNA, 15 bp, Homo sapiens
ttatgtagatgtgca

SEQ ID NO: 338038 - DNA, 13 bp, Homo sapiens
ttatgtcatactc

SEQ ID NO: 338039 - DNA, 18 bp, Homo sapiens
ttatgtgccgtgttattg

SEQ ID NO: 338040 - DNA, 19 bp, Homo sapiens
ttatgtgtatgtgccattt

SEQ ID NO: 338041 - DNA, 19 bp, Homo sapiens
ttatgttttgtttctgaaa

SEQ ID NO: 338042 - DNA, 21 bp, Homo sapiens
ttattaactaatatgggcatt

SEQ ID NO: 338043 - DNA, 19 bp, Homo sapiens
ttattaagatggattctca

SEQ ID NO: 338044 - DNA, 22 bp, Homo sapiens
ttattaagttctcaatgtgaaa

SEQ ID NO: 338045 - DNA, 19 bp, Homo sapiens
ttattaatatgagttactg

SEQ ID NO: 338046 - DNA, 13 bp, Homo sapiens
ttattaatgctaa

SEQ ID NO: 338047 - DNA, 15 bp, Homo sapiens
ttattaattcattaa

SEQ ID NO: 338048 - DNA, 12 bp, Homo sapiens
ttattacaattt

SEQ ID NO: 338049 - DNA, 12 bp, Homo sapiens
ttattacatctt

SEQ ID NO: 338050 - DNA, 14 bp, Homo sapiens
ttattacatcttta

SEQ ID NO: 338051 - DNA, 12 bp, Homo sapiens
ttattacattta

SEQ ID NO: 338052 - DNA, 19 bp, Homo sapiens
ttattagaacttagttttg

SEQ ID NO: 338053 - DNA, 20 bp, Homo sapiens
ttattagtaaatgcttatca

SEQ ID NO: 338054 - DNA, 22 bp, Homo sapiens
ttattatctaaagtgtgttgtt

SEQ ID NO: 338055 - DNA, 12 bp, Homo sapiens
ttattattcaga

SEQ ID NO: 338056 - DNA, 16 bp, Homo sapiens
ttattattttcacctg

SEQ ID NO: 338057 - DNA, 16 bp, Homo sapiens
ttattcaagttattgt

SEQ ID NO: 338058 - DNA, 13 bp, Homo sapiens
ttattcaataact

SEQ ID NO: 338059 - DNA, 19 bp, Homo sapiens
ttattcaccatgtaaaaca

SEQ ID NO: 338060 - DNA, 17 bp, Homo sapiens
ttattcacttgtgtttg

SEQ ID NO: 338061 - DNA, 20 bp, Homo sapiens
ttattcagcttcatttgtgt

SEQ ID NO: 338062 - DNA, 22 bp, Homo sapiens
ttattcagtgccacaaattgaa

SEQ ID NO: 338063 - DNA, 17 bp, Homo sapiens
ttattcagttaagaaaa

SEQ ID NO: 338064 - DNA, 21 bp, Homo sapiens
ttattcatagctgtatatttg

SEQ ID NO: 338065 - DNA, 16 bp, Homo sapiens
ttattcatttaaaatg

SEQ ID NO: 338066 - DNA, 17 bp, Homo sapiens
ttattcatttaaaatga

SEQ ID NO: 338067 - DNA, 20 bp, Homo sapiens
ttattcctgataataattga

SEQ ID NO: 338068 - DNA, 15 bp, Homo sapiens
ttattcctgcactca

SEQ ID NO: 338069 - DNA, 12 bp, Homo sapiens
ttattctaatta

SEQ ID NO: 338070 - DNA, 16 bp, Homo sapiens
ttattctcaaagcagg

SEQ ID NO: 338071 - DNA, 17 bp, Homo sapiens
ttattcttattactatt

SEQ ID NO: 338072 - DNA, 12 bp, Homo sapiens
ttattcttgctg

SEQ ID NO: 338073 - DNA, 12 bp, Homo sapiens
ttattgaataac

SEQ ID NO: 338074 - DNA, 18 bp, Homo sapiens
ttattgcctgggcagtgc

SEQ ID NO: 338075 - DNA, 19 bp, Homo sapiens
ttattgcctgggcagtgcc

SEQ ID NO: 338076 - DNA, 22 bp, Homo sapiens
ttattgcctttagaaactgagt

SEQ ID NO: 338077 - DNA, 19 bp, Homo sapiens
ttattggaagtgttcaaga

SEQ ID NO: 338078 - DNA, 22 bp, Homo sapiens
ttattggaagtgttcaagaaat

SEQ ID NO: 338079 - DNA, 16 bp, Homo sapiens
ttattggaattaacct

SEQ ID NO: 338080 - DNA, 13 bp, Homo sapiens
ttattgtaaactt

SEQ ID NO: 338081 - DNA, 19 bp, Homo sapiens
ttattgtaaactttttcaa

SEQ ID NO: 338082 - DNA, 17 bp, Homo sapiens
ttattgtacctctctta

SEQ ID NO: 338083 - DNA, 14 bp, Homo sapiens
ttattgtataaact

SEQ ID NO: 338084 - DNA, 21 bp, Homo sapiens
ttattgtataaactatcagtt

SEQ ID NO: 338085 - DNA, 17 bp, Homo sapiens
ttattgttccaagacat

SEQ ID NO: 338086 - DNA, 18 bp, Homo sapiens
ttattgttccaagacatt

SEQ ID NO: 338087 - DNA, 23 bp, Homo sapiens
ttattgttccaagacattgtcaa

SEQ ID NO: 338088 - DNA, 21 bp, Homo sapiens
ttattgttcccctaagtggat

SEQ ID NO: 338089 - DNA, 19 bp, Homo sapiens
ttatttaaagcacatgcca

SEQ ID NO: 338090 - DNA, 14 bp, Homo sapiens
ttatttaataacaa

SEQ ID NO: 338091 - DNA, 15 bp, Homo sapiens
ttatttaatatgcat

SEQ ID NO: 338092 - DNA, 18 bp, Homo sapiens
ttatttaatatgcatctt

SEQ ID NO: 338093 - DNA, 15 bp, Homo sapiens
ttatttaatttcata

SEQ ID NO: 338094 - DNA, 19 bp, Homo sapiens
ttatttaatttcataaatt

SEQ ID NO: 338095 - DNA, 17 bp, Homo sapiens
ttatttactaattttct

SEQ ID NO: 338096 - DNA, 18 bp, Homo sapiens
ttatttagtattctgcct

SEQ ID NO: 338097 - DNA, 22 bp, Homo sapiens
ttatttagttgaaaaatctagt

SEQ ID NO: 338098 - DNA, 15 bp, Homo sapiens
ggtctcactgctttg

SEQ ID NO: 338099 - DNA, 23 bp, Homo sapiens
ggtctcagaggagggatagagac

SEQ ID NO: 338100 - DNA, 15 bp, Homo sapiens
ggtctcaggttcttt

SEQ ID NO: 338101 - DNA, 14 bp, Homo sapiens
ggtctccacccctc

SEQ ID NO: 338102 - DNA, 17 bp, Homo sapiens
ggtctccacccctcaag

SEQ ID NO: 338103 - DNA, 15 bp, Homo sapiens
ggtctccctgagcct

SEQ ID NO: 338104 - DNA, 21 bp, Homo sapiens
ggtctcctccccgtagccact

SEQ ID NO: 338105 - DNA, 18 bp, Homo sapiens
ggtctccttactctgagc

SEQ ID NO: 338106 - DNA, 15 bp, Homo sapiens
ggtctctttctttcc

SEQ ID NO: 338107 - DNA, 22 bp, Homo sapiens
ggtctgaaggaatagccagaga

SEQ ID NO: 338108 - DNA, 22 bp, Homo sapiens
ggtctgaatgttctgacattaa

SEQ ID NO: 338109 - DNA, 21 bp, Homo sapiens
ggtctgagaagattcaattta

SEQ ID NO: 338110 - DNA, 15 bp, Homo sapiens
ggtctgcaggccacc

SEQ ID NO: 338111 - DNA, 16 bp, Homo sapiens
ggtctgcaggccacca

SEQ ID NO: 338112 - DNA, 17 bp, Homo sapiens
ggtctgcaggccaccag

SEQ ID NO: 338113 - DNA, 14 bp, Homo sapiens
ggtctgcattttct

SEQ ID NO: 338114 - DNA, 18 bp, Homo sapiens
ggtctgcctcccacgctg

SEQ ID NO: 338115 - DNA, 20 bp, Homo sapiens
ggtctgggggtcaggaggca

SEQ ID NO: 338116 - DNA, 22 bp, Homo sapiens
ggtctgggggtcaggaggcagg

SEQ ID NO: 338117 - DNA, 18 bp, Homo sapiens
ggtctgtacgttacctct

SEQ ID NO: 338118 - DNA, 19 bp, Homo sapiens
ggtctgtgctgtgcctgct

SEQ ID NO: 338119 - DNA, 20 bp, Homo sapiens
ggtctgtgctgtgcctgcta

SEQ ID NO: 338120 - DNA, 21 bp, Homo sapiens
ggtctgtgctgtgcctgctag

SEQ ID NO: 338121 - DNA, 20 bp, Homo sapiens
ggtcttccctacctcaggca

SEQ ID NO: 338122 - DNA, 16 bp, Homo sapiens
ggtcttcttgtgtcct

SEQ ID NO: 338123 - DNA, 21 bp, Homo sapiens
ggtcttcttgtgtcctgatga

SEQ ID NO: 338124 - DNA, 13 bp, Homo sapiens
ggtcttggagagg

SEQ ID NO: 338125 - DNA, 16 bp, Homo sapiens
ggtcttggagaggagg

SEQ ID NO: 338126 - DNA, 20 bp, Homo sapiens
ggtcttggagaggaggtgtg

SEQ ID NO: 338127 - DNA, 16 bp, Homo sapiens
ggtcttgggctactgg

SEQ ID NO: 338128 - DNA, 20 bp, Homo sapiens
ggtcttgggctactggcagc

SEQ ID NO: 338129 - DNA, 21 bp, Homo sapiens
ggtctttgaaatatgcatgta

SEQ ID NO: 338130 - DNA, 15 bp, Homo sapiens
ggtctttgtgtgctg

SEQ ID NO: 338131 - DNA, 15 bp, Homo sapiens
ttcactattagagaa

SEQ ID NO: 338132 - DNA, 14 bp, Homo sapiens
ttcactattcctat

SEQ ID NO: 338133 - DNA, 13 bp, Homo sapiens
ttcactctctgaa

SEQ ID NO: 338134 - DNA, 15 bp, Homo sapiens
ttcactgaagtgaat

SEQ ID NO: 338135 - DNA, 19 bp, Homo sapiens
ttcactgaagttctcctga

SEQ ID NO: 338136 - DNA, 12 bp, Homo sapiens
ttcactgacact

SEQ ID NO: 338137 - DNA, 23 bp, Homo sapiens
ttcactgattggaagagtgacct

SEQ ID NO: 338138 - DNA, 13 bp, Homo sapiens
ttcactgcaattt

SEQ ID NO: 338139 - DNA, 21 bp, Homo sapiens
ttcactgcagatttctcacct

SEQ ID NO: 338140 - DNA, 10 bp, Homo sapiens
ttcactgctg

SEQ ID NO: 338141 - DNA, 13 bp, Homo sapiens
ttcactgctggct

SEQ ID NO: 338142 - DNA, 17 bp, Homo sapiens
ttcactgctggctgcct

SEQ ID NO: 338143 - DNA, 15 bp, Homo sapiens
ttcactgtctgttgt

SEQ ID NO: 338144 - DNA, 22 bp, Homo sapiens
ttcactgttagctttttaaaac

SEQ ID NO: 338145 - DNA, 12 bp, Homo sapiens
ttcacttcccct

SEQ ID NO: 338146 - DNA, 15 bp, Homo sapiens
ttcacttctatttat

SEQ ID NO: 338147 - DNA, 15 bp, Homo sapiens
ttcacttgtcttgct

SEQ ID NO: 338148 - DNA, 12 bp, Homo sapiens
ttcagaaaacag

SEQ ID NO: 338149 - DNA, 13 bp, Homo sapiens
ttcagaaaagaca

SEQ ID NO: 338150 - DNA, 20 bp, Homo sapiens
ttcagaaaatattatgtgtt

SEQ ID NO: 338151 - DNA, 15 bp, Homo sapiens
ttcagaaatgctgcc

SEQ ID NO: 338152 - DNA, 21 bp, Homo sapiens
ttcagaaatgctgcctgcctg

SEQ ID NO: 338153 - DNA, 12 bp, Homo sapiens
ttcagaacctct

SEQ ID NO: 338154 - DNA, 18 bp, Homo sapiens
ttcagaacctcttcccca

SEQ ID NO: 338155 - DNA, 11 bp, Homo sapiens
ttcagaactgc

SEQ ID NO: 338156 - DNA, 16 bp, Homo sapiens
ttcagaacttgtaact

SEQ ID NO: 338157 - DNA, 23 bp, Homo sapiens
ttcagaattgtttttagaaattt

SEQ ID NO: 338158 - DNA, 15 bp, Homo sapiens
ttcagactctctcct

SEQ ID NO: 338159 - DNA, 19 bp, Homo sapiens
ttcagactttgcttcccat

SEQ ID NO: 338160 - DNA, 11 bp, Homo sapiens
ttcagagaagt

SEQ ID NO: 338161 - DNA, 12 bp, Homo sapiens
ttcagagaagtc

SEQ ID NO: 338162 - DNA, 15 bp, Homo sapiens
ttcagagaggccttt

SEQ ID NO: 338163 - DNA, 19 bp, Homo sapiens
ttcagagccctcggagcca

SEQ ID NO: 338164 - DNA, 16 bp, Homo sapiens
ttcagatattttgcac

SEQ ID NO: 338165 - DNA, 12 bp, Homo sapiens
ttcagatcctac

SEQ ID NO: 338166 - DNA, 14 bp, Homo sapiens
ttcagatcctaccc

SEQ ID NO: 338167 - DNA, 14 bp, Homo sapiens
ttcagatgtcttct

SEQ ID NO: 338168 - DNA, 15 bp, Homo sapiens
ttcagatgtgcattt

SEQ ID NO: 338169 - DNA, 18 bp, Homo sapiens
ttcagattaggacacagt

SEQ ID NO: 338170 - DNA, 21 bp, Homo sapiens
ttcagattatttccagttttt

SEQ ID NO: 338171 - DNA, 19 bp, Homo sapiens
ttcagattggacataactg

SEQ ID NO: 338172 - DNA, 14 bp, Homo sapiens
ttcagattgtaaag

SEQ ID NO: 338173 - DNA, 15 bp, Homo sapiens
ttcagcacccccacc

SEQ ID NO: 338174 - DNA, 19 bp, Homo sapiens
ttcagcacccccacccacc

SEQ ID NO: 338175 - DNA, 13 bp, Homo sapiens
ttcagcaccctgg

SEQ ID NO: 338176 - DNA, 22 bp, Homo sapiens
ttcagcaccctgggtgccattc

SEQ ID NO: 338177 - DNA, 14 bp, Homo sapiens
ttcagccaagaatt

SEQ ID NO: 338178 - DNA, 19 bp, Homo sapiens
ttcagccaagaattcttaa

SEQ ID NO: 338179 - DNA, 20 bp, Homo sapiens
ttcagcccatatttcatcgt

SEQ ID NO: 338180 - DNA, 13 bp, Homo sapiens
ttcagctgcagtt

SEQ ID NO: 338181 - DNA, 14 bp, Homo sapiens
ttcagctgcagttg

SEQ ID NO: 338182 - DNA, 18 bp, Homo sapiens
ttcagctgcagttgaaga

SEQ ID NO: 338183 - DNA, 18 bp, Homo sapiens
ttcagctgcatacagttt

SEQ ID NO: 338184 - DNA, 17 bp, Homo sapiens
ttcagctgcctgaaaca

SEQ ID NO: 338185 - DNA, 18 bp, Homo sapiens
ttcagctgcctgaaacag

SEQ ID NO: 338186 - DNA, 23 bp, Homo sapiens
ttcagctgcctgaaacagccatg

SEQ ID NO: 338187 - DNA, 15 bp, Homo sapiens
ttcagctggcagagt

SEQ ID NO: 338188 - DNA, 11 bp, Homo sapiens
ttcagctggtg

SEQ ID NO: 338189 - DNA, 23 bp, Homo sapiens
ttcagctgtgaacatggactctt

SEQ ID NO: 338190 - DNA, 16 bp, Homo sapiens
ttcagcttaaaataaa

SEQ ID NO: 338191 - DNA, 19 bp, Homo sapiens
ttcagcttgtttctatact

SEQ ID NO: 338192 - DNA, 13 bp, Homo sapiens
ttcagctttggat

SEQ ID NO: 338193 - DNA, 19 bp, Homo sapiens
ttcaggaaagcagcagttt

SEQ ID NO: 338194 - DNA, 17 bp, Homo sapiens
ttcaggaacctggacca

SEQ ID NO: 338195 - DNA, 23 bp, Homo sapiens
ttcaggaacctggaccaaagctg

SEQ ID NO: 338196 - DNA, 22 bp, Homo sapiens
ttcaggaagggagaggagggaa

SEQ ID NO: 338197 - DNA, 17 bp, Homo sapiens
ttcaggaccccatctgc

SEQ ID NO: 338198 - DNA, 20 bp, Homo sapiens
ttcaggaccccatctgctga

SEQ ID NO: 338199 - DNA, 22 bp, Homo sapiens
ttcaggaccccatctgctgagc

SEQ ID NO: 338200 - DNA, 15 bp, Homo sapiens
ttcaggacccttcta

SEQ ID NO: 338201 - DNA, 14 bp, Homo sapiens
ttcaggagatgatg

SEQ ID NO: 338202 - DNA, 14 bp, Homo sapiens
ttcaggagcgcaag

SEQ ID NO: 338203 - DNA, 21 bp, Homo sapiens
ttcaggatgcacggtttctgt

SEQ ID NO: 338204 - DNA, 16 bp, Homo sapiens
ttcagggccagaagga

SEQ ID NO: 338205 - DNA, 11 bp, Homo sapiens
ttcagggctgg

SEQ ID NO: 338206 - DNA, 22 bp, Homo sapiens
ttcagggggccaggtgcacaga

SEQ ID NO: 338207 - DNA, 13 bp, Homo sapiens
ttcaggtaggccc

SEQ ID NO: 338208 - DNA, 15 bp, Homo sapiens
ttcaggtaggccctt

SEQ ID NO: 338209 - DNA, 22 bp, Homo sapiens
ttcaggtaggcccttgtcctgc

SEQ ID NO: 338210 - DNA, 14 bp, Homo sapiens
ttcaggttgttctg

SEQ ID NO: 338211 - DNA, 14 bp, Homo sapiens
ttcagtaatagctg

SEQ ID NO: 338212 - DNA, 17 bp, Homo sapiens
ttcagtaatagctgaac

SEQ ID NO: 338213 - DNA, 16 bp, Homo sapiens
ttcagtatcatctcca

SEQ ID NO: 338214 - DNA, 16 bp, Homo sapiens
ttcagtattaaactct

SEQ ID NO: 338215 - DNA, 20 bp, Homo sapiens
ttcagtattaaactctcctt

SEQ ID NO: 338216 - DNA, 22 bp, Homo sapiens
ttcagtattaaactctcctttg

SEQ ID NO: 338217 - DNA, 19 bp, Homo sapiens
ttcagtattttggagaaat

SEQ ID NO: 338218 - DNA, 20 bp, Homo sapiens
ttcagtattttggagaaatt

SEQ ID NO: 338219 - DNA, 22 bp, Homo sapiens
ttcagtccctgagcagtctact

SEQ ID NO: 338220 - DNA, 13 bp, Homo sapiens
ttcagtcttggag

SEQ ID NO: 338221 - DNA, 16 bp, Homo sapiens
ttcagtgaactaattt

SEQ ID NO: 338222 - DNA, 12 bp, Homo sapiens
ttcagtgaagca

SEQ ID NO: 338223 - DNA, 13 bp, Homo sapiens
ttcagtgaagcag

SEQ ID NO: 338224 - DNA, 17 bp, Homo sapiens
ttcagtgagcccctccc

SEQ ID NO: 338225 - DNA, 20 bp, Homo sapiens
ttcagtgagcccctccccag

SEQ ID NO: 338226 - DNA, 23 bp, Homo sapiens
ttcagtgagcccctccccagcca

SEQ ID NO: 338227 - DNA, 21 bp, Homo sapiens
ttcagtgcacctgtggcctct

SEQ ID NO: 338228 - DNA, 23 bp, Homo sapiens
ttcagtgccacaaattgaaagct

SEQ ID NO: 338229 - DNA, 17 bp, Homo sapiens
ttcccggagcacagccc

SEQ ID NO: 338230 - DNA, 23 bp, Homo sapiens
ttcccggagcacagccctgggag

SEQ ID NO: 338231 - DNA, 15 bp, Homo sapiens
ttccctaactctcgg

SEQ ID NO: 338232 - DNA, 19 bp, Homo sapiens
ttccctaagccaagggcct

SEQ ID NO: 338233 - DNA, 19 bp, Homo sapiens
ttccctactaacatcccaa

SEQ ID NO: 338234 - DNA, 14 bp, Homo sapiens
ttccctacttcctg

SEQ ID NO: 338235 - DNA, 16 bp, Homo sapiens
ttccctacttcctgtg

SEQ ID NO: 338236 - DNA, 21 bp, Homo sapiens
ttccctagatggttccctttg

SEQ ID NO: 338237 - DNA, 17 bp, Homo sapiens
ttccctagttctttgca

SEQ ID NO: 338238 - DNA, 13 bp, Homo sapiens
ttccctcactctt

SEQ ID NO: 338239 - DNA, 16 bp, Homo sapiens
ttccctcatgttctca

SEQ ID NO: 338240 - DNA, 16 bp, Homo sapiens
ttccctccgggcaggg

SEQ ID NO: 338241 - DNA, 19 bp, Homo sapiens
ttccctccgggcaggggag

SEQ ID NO: 338242 - DNA, 13 bp, Homo sapiens
ttccctctcatcc

SEQ ID NO: 338243 - DNA, 16 bp, Homo sapiens
ttccctctcctgccca

SEQ ID NO: 338244 - DNA, 19 bp, Homo sapiens
ttccctctcgctcccctct

SEQ ID NO: 338245 - DNA, 12 bp, Homo sapiens
ttccctctctag

SEQ ID NO: 338246 - DNA, 17 bp, Homo sapiens
ttccctctgcctgtccc

SEQ ID NO: 338247 - DNA, 21 bp, Homo sapiens
ttccctctgcctgtccctctc

SEQ ID NO: 338248 - DNA, 11 bp, Homo sapiens
ttccctctgct

SEQ ID NO: 338249 - DNA, 21 bp, Homo sapiens
ttccctcttgtccctttccct

SEQ ID NO: 338250 - DNA, 19 bp, Homo sapiens
ttccctctttcctgtgcca

SEQ ID NO: 338251 - DNA, 15 bp, Homo sapiens
ttccctgaatcctct

SEQ ID NO: 338252 - DNA, 10 bp, Homo sapiens
ttccctgcaa

SEQ ID NO: 338253 - DNA, 11 bp, Homo sapiens
ttccctgcacc

SEQ ID NO: 338254 - DNA, 12 bp, Homo sapiens
ttccctgctttg

SEQ ID NO: 338255 - DNA, 12 bp, Homo sapiens
ttccctggacca

SEQ ID NO: 338256 - DNA, 13 bp, Homo sapiens
ttccctggctcag

SEQ ID NO: 338257 - DNA, 17 bp, Homo sapiens
ttccctggctcagggat

SEQ ID NO: 338258 - DNA, 20 bp, Homo sapiens
ttccctgtctcttgaaaaat

SEQ ID NO: 338259 - DNA, 14 bp, Homo sapiens
ttcccttagcctct

SEQ ID NO: 338260 - DNA, 21 bp, Homo sapiens
ttcccttagcctctcccaccc

SEQ ID NO: 338261 - DNA, 18 bp, Homo sapiens
ttcccttatttttattta

SEQ ID NO: 338262 - DNA, 15 bp, Homo sapiens
ttcccttccactgcc

SEQ ID NO: 338263 - DNA, 22 bp, Homo sapiens
ttcccttgcaggggtcccccct

SEQ ID NO: 338264 - DNA, 15 bp, Homo sapiens
ttcccttgtgtctgt

SEQ ID NO: 338265 - DNA, 19 bp, Homo sapiens
ttccctttcactgaagtga

SEQ ID NO: 338266 - DNA, 15 bp, Homo sapiens
ttccctttccttcca

SEQ ID NO: 338267 - DNA, 14 bp, Homo sapiens
ttccctttgttgct

SEQ ID NO: 338268 - DNA, 14 bp, Homo sapiens
ttcccttttttctt

SEQ ID NO: 338269 - DNA, 16 bp, Homo sapiens
ttcccttttttcttcc

SEQ ID NO: 338270 - DNA, 14 bp, Homo sapiens
ttccgagtagctgg

SEQ ID NO: 338271 - DNA, 16 bp, Homo sapiens
ttccgctgtcacccag

SEQ ID NO: 338272 - DNA, 21 bp, Homo sapiens
ttccggaatcctgtcctcagc

SEQ ID NO: 338273 - DNA, 23 bp, Homo sapiens
ttccgtcacccttggtagagttt

SEQ ID NO: 338274 - DNA, 16 bp, Homo sapiens
ttccgtctcctctcca

SEQ ID NO: 338275 - DNA, 15 bp, Homo sapiens
ttccgtgagacacaa

SEQ ID NO: 338276 - DNA, 17 bp, Homo sapiens
ttccgtgagacacaaga

SEQ ID NO: 338277 - DNA, 13 bp, Homo sapiens
ttccgtttacatt

SEQ ID NO: 338278 - DNA, 18 bp, Homo sapiens
ttcctaaagaaaaagata

SEQ ID NO: 338279 - DNA, 13 bp, Homo sapiens
ttcctaaatgcag

SEQ ID NO: 338280 - DNA, 14 bp, Homo sapiens
gtaaatacaaaata

SEQ ID NO: 338281 - DNA, 20 bp, Homo sapiens
gtaaatacaaaataaaatta

SEQ ID NO: 338282 - DNA, 12 bp, Homo sapiens
gtaaatacacca

SEQ ID NO: 338283 - DNA, 16 bp, Homo sapiens
gtaaatacatgtgtgg

SEQ ID NO: 338284 - DNA, 14 bp, Homo sapiens
gtaaatatatgttt

SEQ ID NO: 338285 - DNA, 17 bp, Homo sapiens
gtaaatatatgttttga

SEQ ID NO: 338286 - DNA, 19 bp, Homo sapiens
gtaaatatatgttttgaga

SEQ ID NO: 338287 - DNA, 20 bp, Homo sapiens
gtaaatatatgttttgagaa

SEQ ID NO: 338288 - DNA, 16 bp, Homo sapiens
gtaaatattatgattt

SEQ ID NO: 338289 - DNA, 19 bp, Homo sapiens
gtaaatattatgattttat

SEQ ID NO: 338290 - DNA, 13 bp, Homo sapiens
gtaaatattctat

SEQ ID NO: 338291 - DNA, 15 bp, Homo sapiens
gtaaatattctatat

SEQ ID NO: 338292 - DNA, 17 bp, Homo sapiens
gtaaatccaacacaagt

SEQ ID NO: 338293 - DNA, 20 bp, Homo sapiens
gtaaatcctagacttgaaag

SEQ ID NO: 338294 - DNA, 21 bp, Homo sapiens
gtaaatcctagacttgaaagt

SEQ ID NO: 338295 - DNA, 22 bp, Homo sapiens
gtaaatcctagacttgaaagtt

SEQ ID NO: 338296 - DNA, 23 bp, Homo sapiens
gtaaatgaagggtcatttctctt

SEQ ID NO: 338297 - DNA, 15 bp, Homo sapiens
gtaaatgatatgtct

SEQ ID NO: 338298 - DNA, 17 bp, Homo sapiens
gtaaatgtttaatatct

SEQ ID NO: 338299 - DNA, 20 bp, Homo sapiens
gtaaattattcagttaagaa

SEQ ID NO: 338300 - DNA, 16 bp, Homo sapiens
gtaaattattgtaaac

SEQ ID NO: 338301 - DNA, 17 bp, Homo sapiens
gtaaattattgtaaact

SEQ ID NO: 338302 - DNA, 19 bp, Homo sapiens
gtaaattattgtaaacttt

SEQ ID NO: 338303 - DNA, 12 bp, Homo sapiens
gtaaattatttt

SEQ ID NO: 338304 - DNA, 18 bp, Homo sapiens
gtaaattattttaaatta

SEQ ID NO: 338305 - DNA, 22 bp, Homo sapiens
gtaaatttgtactatttaactg

SEQ ID NO: 338306 - DNA, 23 bp, Homo sapiens
gtaacaactaattataatgcaaa

SEQ ID NO: 338307 - DNA, 17 bp, Homo sapiens
gtaacaatgaagataaa

SEQ ID NO: 338308 - DNA, 20 bp, Homo sapiens
gtaaccaagagtattccatt

SEQ ID NO: 338309 - DNA, 14 bp, Homo sapiens
gtaaccacctctct

SEQ ID NO: 338310 - DNA, 19 bp, Homo sapiens
gtaaccacctctctgtctt

SEQ ID NO: 338311 - DNA, 19 bp, Homo sapiens
gtaaccagcagtcacaggt

SEQ ID NO: 338312 - DNA, 17 bp, Homo sapiens
gtaaccaggccccagcc

SEQ ID NO: 338313 - DNA, 20 bp, Homo sapiens
gtaaccaggccccagcctcc

SEQ ID NO: 338314 - DNA, 19 bp, Homo sapiens
gtaaccgagccagcagctg

SEQ ID NO: 338315 - DNA, 17 bp, Homo sapiens
gtaacctctacaggcat

SEQ ID NO: 338316 - DNA, 18 bp, Homo sapiens
gtaacctctacaggcatt

SEQ ID NO: 338317 - DNA, 16 bp, Homo sapiens
gtaacgcgtcttcctg

SEQ ID NO: 338318 - DNA, 23 bp, Homo sapiens
gtaacgggtcgtgctcatgtctg

SEQ ID NO: 338319 - DNA, 20 bp, Homo sapiens
gtaactaaagtatttaaaga

SEQ ID NO: 338320 - DNA, 14 bp, Homo sapiens
gtaactattcttca

SEQ ID NO: 338321 - DNA, 22 bp, Homo sapiens
gtaactgctgagccactcgcag

SEQ ID NO: 338322 - DNA, 18 bp, Homo sapiens
gtaactgtcaagtcatga

SEQ ID NO: 338323 - DNA, 22 bp, Homo sapiens
gtaacttaattataagctatgt

SEQ ID NO: 338324 - DNA, 15 bp, Homo sapiens
gtaactttgcatgtt

SEQ ID NO: 338325 - DNA, 18 bp, Homo sapiens
gtaactttgcatgttctt

SEQ ID NO: 338326 - DNA, 18 bp, Homo sapiens
gtaacttttacaaaacat

SEQ ID NO: 338327 - DNA, 15 bp, Homo sapiens
gtaagaagagactgg

SEQ ID NO: 338328 - DNA, 21 bp, Homo sapiens
gtaagaagcccgatccacatt

SEQ ID NO: 338329 - DNA, 19 bp, Homo sapiens
gtaagacacacagcctttc

SEQ ID NO: 338330 - DNA, 17 bp, Homo sapiens
gtaagagcaccttcctc

SEQ ID NO: 338331 - DNA, 21 bp, Homo sapiens
gtaagagcaccttcctcactt

SEQ ID NO: 338332 - DNA, 13 bp, Homo sapiens
gtaagagggagcc

SEQ ID NO: 338333 - DNA, 18 bp, Homo sapiens
gtaagatacaagtttcag

SEQ ID NO: 338334 - DNA, 23 bp, Homo sapiens
gtaagatacaagtttcagacagg

SEQ ID NO: 338335 - DNA, 22 bp, Homo sapiens
gtaagattttattttcaagcaa

SEQ ID NO: 338336 - DNA, 17 bp, Homo sapiens
gtaagcctccctcctcg

SEQ ID NO: 338337 - DNA, 20 bp, Homo sapiens
gtaagctctttgaaacaact

SEQ ID NO: 338338 - DNA, 14 bp, Homo sapiens
gtaagctgctgaat

SEQ ID NO: 338339 - DNA, 20 bp, Homo sapiens
gtaagcttagattttctgta

SEQ ID NO: 338340 - DNA, 15 bp, Homo sapiens
gtaaggaatgcttgg

SEQ ID NO: 338341 - DNA, 16 bp, Homo sapiens
gtaaggtgcagttccc

SEQ ID NO: 338342 - DNA, 17 bp, Homo sapiens
gtaagtaaactgccctg

SEQ ID NO: 338343 - DNA, 16 bp, Homo sapiens
gtaagtataacaaact

SEQ ID NO: 338344 - DNA, 20 bp, Homo sapiens
gtaagtataacaaactatgt

SEQ ID NO: 338345 - DNA, 16 bp, Homo sapiens
gtaagtgagagagaca

SEQ ID NO: 338346 - DNA, 15 bp, Homo sapiens
gtaagtttatccaaa

SEQ ID NO: 338347 - DNA, 16 bp, Homo sapiens
gtaagtttatccaaat

SEQ ID NO: 338348 - DNA, 12 bp, Homo sapiens
gtaataaagtat

SEQ ID NO: 338349 - DNA, 17 bp, Homo sapiens
gtaataaagtatataat

SEQ ID NO: 338350 - DNA, 19 bp, Homo sapiens
gtaatagaaaactgaaaat

SEQ ID NO: 338351 - DNA, 15 bp, Homo sapiens
gtaatagagcaaaat

SEQ ID NO: 338352 - DNA, 16 bp, Homo sapiens
gtaatagcctcacctt

SEQ ID NO: 338353 - DNA, 15 bp, Homo sapiens
gtaataggaagaaca

SEQ ID NO: 338354 - DNA, 22 bp, Homo sapiens
gtaataggaagaacagtacatt

SEQ ID NO: 338355 - DNA, 22 bp, Homo sapiens
gtaatataataatgtcctttcc

SEQ ID NO: 338356 - DNA, 22 bp, Homo sapiens
gtaatatattgccagtatataa

SEQ ID NO: 338357 - DNA, 15 bp, Homo sapiens
gtaatatattgctgc

SEQ ID NO: 338358 - DNA, 20 bp, Homo sapiens
gtaatatattgctgctggta

SEQ ID NO: 338359 - DNA, 22 bp, Homo sapiens
ttctaggcatctcctctcccca

SEQ ID NO: 338360 - DNA, 20 bp, Homo sapiens
ttctagggtgggccccagcc

SEQ ID NO: 338361 - DNA, 23 bp, Homo sapiens
ttctagtctctgatttgcaaatg

SEQ ID NO: 338362 - DNA, 19 bp, Homo sapiens
ttctagttagcaggaaata

SEQ ID NO: 338363 - DNA, 14 bp, Homo sapiens
ttctagttgctctt

SEQ ID NO: 338364 - DNA, 14 bp, Homo sapiens
ttctatactgttga

SEQ ID NO: 338365 - DNA, 19 bp, Homo sapiens
ttctatactgtttgtaata

SEQ ID NO: 338366 - DNA, 19 bp, Homo sapiens
ttctatataaaatgtattc

SEQ ID NO: 338367 - DNA, 21 bp, Homo sapiens
ttctatataaaatgtattcaa

SEQ ID NO: 338368 - DNA, 18 bp, Homo sapiens
ttctatatttattttcag

SEQ ID NO: 338369 - DNA, 14 bp, Homo sapiens
ttctatatttcata

SEQ ID NO: 338370 - DNA, 17 bp, Homo sapiens
ttctatatttgtaactt

SEQ ID NO: 338371 - DNA, 22 bp, Homo sapiens
ttctatatttgtaactttgcat

SEQ ID NO: 338372 - DNA, 23 bp, Homo sapiens
ttctatcaggaaaacaaatcact

SEQ ID NO: 338373 - DNA, 15 bp, Homo sapiens
ttctatgacaataaa

SEQ ID NO: 338374 - DNA, 12 bp, Homo sapiens
ttctatgatcag

SEQ ID NO: 338375 - DNA, 14 bp, Homo sapiens
ttctatgcctgtat

SEQ ID NO: 338376 - DNA, 16 bp, Homo sapiens
ttctatgcctgtattt

SEQ ID NO: 338377 - DNA, 20 bp, Homo sapiens
ttctatggattcacttctat

SEQ ID NO: 338378 - DNA, 21 bp, Homo sapiens
ttctatgtaaattattgtaaa

SEQ ID NO: 338379 - DNA, 22 bp, Homo sapiens
ttctatgtatgtgccaattttg

SEQ ID NO: 338380 - DNA, 22 bp, Homo sapiens
ttctatgtgacaattttgtaca

SEQ ID NO: 338381 - DNA, 14 bp, Homo sapiens
ttctattaaaagtg

SEQ ID NO: 338382 - DNA, 18 bp, Homo sapiens
ttctattaaaagtgggaa

SEQ ID NO: 338383 - DNA, 17 bp, Homo sapiens
ttctattgtattatttg

SEQ ID NO: 338384 - DNA, 17 bp, Homo sapiens
ttctattgttactctgg

SEQ ID NO: 338385 - DNA, 13 bp, Homo sapiens
ttctatttaagtg

SEQ ID NO: 338386 - DNA, 14 bp, Homo sapiens
ttctatttctatct

SEQ ID NO: 338387 - DNA, 15 bp, Homo sapiens
ttctatttctatctg

SEQ ID NO: 338388 - DNA, 15 bp, Homo sapiens
ttctatttgctgggc

SEQ ID NO: 338389 - DNA, 18 bp, Homo sapiens
ttctatttgctgggcttt

SEQ ID NO: 338390 - DNA, 15 bp, Homo sapiens
ttctcaaaagcattt

SEQ ID NO: 338391 - DNA, 18 bp, Homo sapiens
ttctcaaaagcatttatc

SEQ ID NO: 338392 - DNA, 20 bp, Homo sapiens
ttctcaaaagcatttatcat

SEQ ID NO: 338393 - DNA, 21 bp, Homo sapiens
ttctcaaaagcatttatcatt

SEQ ID NO: 338394 - DNA, 12 bp, Homo sapiens
ttctcaaataaa

SEQ ID NO: 338395 - DNA, 20 bp, Homo sapiens
ttctcaaatgctactcagta

SEQ ID NO: 338396 - DNA, 22 bp, Homo sapiens
ttctcaactaaagaatagtgcc

SEQ ID NO: 338397 - DNA, 17 bp, Homo sapiens
ttctcaagtgccttaat

SEQ ID NO: 338398 - DNA, 22 bp, Homo sapiens
ttctcaatacttgaatatggaa

SEQ ID NO: 338399 - DNA, 19 bp, Homo sapiens
ttctcaatcactgctcccc

SEQ ID NO: 338400 - DNA, 16 bp, Homo sapiens
ttctcaatgcttttct

SEQ ID NO: 338401 - DNA, 19 bp, Homo sapiens
ttctcacaatagacagaaa

SEQ ID NO: 338402 - DNA, 22 bp, Homo sapiens
ttctcacagcacatgctggcca

SEQ ID NO: 338403 - DNA, 13 bp, Homo sapiens
ttctcagaacagc

SEQ ID NO: 338404 - DNA, 21 bp, Homo sapiens
ttctcagaagtgaaaaagact

SEQ ID NO: 338405 - DNA, 22 bp, Homo sapiens
ttctcagaagtgaaaaagactt

SEQ ID NO: 338406 - DNA, 19 bp, Homo sapiens
ttctcagacgacacctgga

SEQ ID NO: 338407 - DNA, 23 bp, Homo sapiens
ttctcagagctccacagaagaca

SEQ ID NO: 338408 - DNA, 14 bp, Homo sapiens
ttctcagatattta

SEQ ID NO: 338409 - DNA, 15 bp, Homo sapiens
ttctcagatatttat

SEQ ID NO: 338410 - DNA, 12 bp, Homo sapiens
ttctcagcaagt

SEQ ID NO: 338411 - DNA, 15 bp, Homo sapiens
ttctcagcaagtgta

SEQ ID NO: 338412 - DNA, 16 bp, Homo sapiens
ttctcagcaagtgtac

SEQ ID NO: 338413 - DNA, 17 bp, Homo sapiens
ttctcagctccactctg

SEQ ID NO: 338414 - DNA, 13 bp, Homo sapiens
ttctcagctccca

SEQ ID NO: 338415 - DNA, 17 bp, Homo sapiens
ttctcaggtgttgccaa

SEQ ID NO: 338416 - DNA, 19 bp, Homo sapiens
ttctcaggtgttgccaaat

SEQ ID NO: 338417 - DNA, 22 bp, Homo sapiens
ttctcagtgctctcctacccca

SEQ ID NO: 338418 - DNA, 18 bp, Homo sapiens
ttctcagtttttgctgat

SEQ ID NO: 338419 - DNA, 18 bp, Homo sapiens
ttctcatagcattaacta

SEQ ID NO: 338420 - DNA, 21 bp, Homo sapiens
ttctcatagcattaactaatc

SEQ ID NO: 338421 - DNA, 22 bp, Homo sapiens
ttctcatagcattaactaatct

SEQ ID NO: 338422 - DNA, 16 bp, Homo sapiens
ttctcatagccccggt

SEQ ID NO: 338423 - DNA, 24 bp, Homo sapiens
ttctcataggaaaagtacatttaa

SEQ ID NO: 338424 - DNA, 15 bp, Homo sapiens
ttctcatccatagta

SEQ ID NO: 338425 - DNA, 13 bp, Homo sapiens
gtaggcagcctct

SEQ ID NO: 338426 - DNA, 17 bp, Homo sapiens
gtaggcccttgtcctgc

SEQ ID NO: 338427 - DNA, 18 bp, Homo sapiens
gtaggcccttgtcctgcc

SEQ ID NO: 338428 - DNA, 20 bp, Homo sapiens
gtaggcccttgtcctgccag

SEQ ID NO: 338429 - DNA, 16 bp, Homo sapiens
gtaggcgcccctgggg

SEQ ID NO: 338430 - DNA, 13 bp, Homo sapiens
gtaggctgtattt

SEQ ID NO: 338431 - DNA, 15 bp, Homo sapiens
gtaggctgtattttc

SEQ ID NO: 338432 - DNA, 18 bp, Homo sapiens
gtagggagtacctgctgc

SEQ ID NO: 338433 - DNA, 15 bp, Homo sapiens
gtagggccagggctc

SEQ ID NO: 338434 - DNA, 16 bp, Homo sapiens
gtagggccagggctct

SEQ ID NO: 338435 - DNA, 21 bp, Homo sapiens
gtagggctgccaccaaggtga

SEQ ID NO: 338436 - DNA, 15 bp, Homo sapiens
gtaggggtgtgtgtg

SEQ ID NO: 338437 - DNA, 17 bp, Homo sapiens
gtagggtagaaggaaag

SEQ ID NO: 338438 - DNA, 17 bp, Homo sapiens
gtagggtgaggcgtggg

SEQ ID NO: 338439 - DNA, 19 bp, Homo sapiens
gtagggttgccagtcctgc

SEQ ID NO: 338440 - DNA, 12 bp, Homo sapiens
gtagggtttcta

SEQ ID NO: 338441 - DNA, 15 bp, Homo sapiens
gtaggtctgcacaca

SEQ ID NO: 338442 - DNA, 14 bp, Homo sapiens
gtaggtgctggcct

SEQ ID NO: 338443 - DNA, 16 bp, Homo sapiens
gtaggtgctggcctca

SEQ ID NO: 338444 - DNA, 16 bp, Homo sapiens
gtaggtgttgaaaatg

SEQ ID NO: 338445 - DNA, 15 bp, Homo sapiens
gtaggttctgtctgt

SEQ ID NO: 338446 - DNA, 16 bp, Homo sapiens
gtaggttgtctaaaaa

SEQ ID NO: 338447 - DNA, 18 bp, Homo sapiens
gtagtaaaattagaaaaa

SEQ ID NO: 338448 - DNA, 14 bp, Homo sapiens
gtagtaattgttac

SEQ ID NO: 338449 - DNA, 19 bp, Homo sapiens
gtagtactccttaagaaca

SEQ ID NO: 338450 - DNA, 17 bp, Homo sapiens
gtagtagccctttctgt

SEQ ID NO: 338451 - DNA, 21 bp, Homo sapiens
gtagtagccctttctgtgtgc

SEQ ID NO: 338452 - DNA, 16 bp, Homo sapiens
gtagtcacctctgggc

SEQ ID NO: 338453 - DNA, 21 bp, Homo sapiens
gtagtcattcttacaattgca

SEQ ID NO: 338454 - DNA, 14 bp, Homo sapiens
gtagtccaggctgt

SEQ ID NO: 338455 - DNA, 18 bp, Homo sapiens
gtagtctcattacttttg

SEQ ID NO: 338456 - DNA, 13 bp, Homo sapiens
gtagtgagccttg

SEQ ID NO: 338457 - DNA, 13 bp, Homo sapiens
gtagtgatgaaat

SEQ ID NO: 338458 - DNA, 23 bp, Homo sapiens
gtagtgcccctcccatggcccag

SEQ ID NO: 338459 - DNA, 16 bp, Homo sapiens
gtagtggaagagcagc

SEQ ID NO: 338460 - DNA, 20 bp, Homo sapiens
gtagtggaagagcagcctga

SEQ ID NO: 338461 - DNA, 18 bp, Homo sapiens
gtagtggcttcttttgaa

SEQ ID NO: 338462 - DNA, 22 bp, Homo sapiens
gtagtggcttcttttgaactgt

SEQ ID NO: 338463 - DNA, 14 bp, Homo sapiens
gtagttaggaaata

SEQ ID NO: 338464 - DNA, 15 bp, Homo sapiens
gtagttaggaaataa

SEQ ID NO: 338465 - DNA, 20 bp, Homo sapiens
gtagttaggaaataaaacct

SEQ ID NO: 338466 - DNA, 16 bp, Homo sapiens
gtagttagtagcatgt

SEQ ID NO: 338467 - DNA, 20 bp, Homo sapiens
gtagttgagacgctgttgca

SEQ ID NO: 338468 - DNA, 20 bp, Homo sapiens
gtagttgatgaccaatctct

SEQ ID NO: 338469 - DNA, 16 bp, Homo sapiens
gtagtttgtattaaac

SEQ ID NO: 338470 - DNA, 16 bp, Homo sapiens
gtagttttggttttta

SEQ ID NO: 338471 - DNA, 17 bp, Homo sapiens
gtataaaaaagaaaact

SEQ ID NO: 338472 - DNA, 13 bp, Homo sapiens
gtataaaaaataa

SEQ ID NO: 338473 - DNA, 16 bp, Homo sapiens
gtataaaaataaaaaa

SEQ ID NO: 338474 - DNA, 16 bp, Homo sapiens
gtataaaactttcctc

SEQ ID NO: 338475 - DNA, 17 bp, Homo sapiens
gtataaactatcagttt

SEQ ID NO: 338476 - DNA, 17 bp, Homo sapiens
gtataaatatgaaatga

SEQ ID NO: 338477 - DNA, 23 bp, Homo sapiens
gtataaatgaagtttatacagta

SEQ ID NO: 338478 - DNA, 18 bp, Homo sapiens
gtataacaagccaaacat

SEQ ID NO: 338479 - DNA, 19 bp, Homo sapiens
gtataacaagccaaacatt

SEQ ID NO: 338480 - DNA, 16 bp, Homo sapiens
gtataacagcaaataa

SEQ ID NO: 338481 - DNA, 20 bp, Homo sapiens
gtataaccccaccttgccaa

SEQ ID NO: 338482 - DNA, 14 bp, Homo sapiens
gtatacaaacaggt

SEQ ID NO: 338483 - DNA, 19 bp, Homo sapiens
gtatacagttcaataaact

SEQ ID NO: 338484 - DNA, 13 bp, Homo sapiens
gtataccacctgt

SEQ ID NO: 338485 - DNA, 15 bp, Homo sapiens
gtatacctatttcat

SEQ ID NO: 338486 - DNA, 11 bp, Homo sapiens
gtatactgtgt

SEQ ID NO: 338487 - DNA, 18 bp, Homo sapiens
gtatagatgcaagatatt

SEQ ID NO: 338488 - DNA, 20 bp, Homo sapiens
gtatagcaacctatttgact

SEQ ID NO: 338489 - DNA, 16 bp, Homo sapiens
acagttttgatacaaa

SEQ ID NO: 338490 - DNA, 12 bp, Homo sapiens
acagttttgtct

SEQ ID NO: 338491 - DNA, 16 bp, Homo sapiens
acagtttttgtaacca

SEQ ID NO: 338492 - DNA, 21 bp, Homo sapiens
acagtttttgtaaccatatga

SEQ ID NO: 338493 - DNA, 19 bp, Homo sapiens
acataaaaagaaatgtgaa

SEQ ID NO: 338494 - DNA, 13 bp, Homo sapiens
acataaaaagtta

SEQ ID NO: 338495 - DNA, 17 bp, Homo sapiens
acataaaaagttaaaaa

SEQ ID NO: 338496 - DNA, 12 bp, Homo sapiens
acataaaacaaa

SEQ ID NO: 338497 - DNA, 18 bp, Homo sapiens
acataaaacaaaaccaag

SEQ ID NO: 338498 - DNA, 21 bp, Homo sapiens
acataaacccatctgtaatat

SEQ ID NO: 338499 - DNA, 19 bp, Homo sapiens
acataaagaaacactttct

SEQ ID NO: 338500 - DNA, 23 bp, Homo sapiens
acataaataaattaaataaaata

SEQ ID NO: 338501 - DNA, 14 bp, Homo sapiens
acataaatctgtct

SEQ ID NO: 338502 - DNA, 15 bp, Homo sapiens
acataaatctgtctg

SEQ ID NO: 338503 - DNA, 21 bp, Homo sapiens
acataacaacctttcccattt

SEQ ID NO: 338504 - DNA, 14 bp, Homo sapiens
acataacaggcatt

SEQ ID NO: 338505 - DNA, 17 bp, Homo sapiens
acataacaggcattgca

SEQ ID NO: 338506 - DNA, 15 bp, Homo sapiens
acataagtaattcaa

SEQ ID NO: 338507 - DNA, 20 bp, Homo sapiens
acataagtaattcaagaaaa

SEQ ID NO: 338508 - DNA, 18 bp, Homo sapiens
acataatagaatttccta

SEQ ID NO: 338509 - DNA, 19 bp, Homo sapiens
acataatatcttgaagaat

SEQ ID NO: 338510 - DNA, 22 bp, Homo sapiens
acataatctagtttacagaaaa

SEQ ID NO: 338511 - DNA, 19 bp, Homo sapiens
acataatgcttaatttcta

SEQ ID NO: 338512 - DNA, 20 bp, Homo sapiens
acataatgcttaatttctaa

SEQ ID NO: 338513 - DNA, 20 bp, Homo sapiens
acataatgtagtgagtgtag

SEQ ID NO: 338514 - DNA, 23 bp, Homo sapiens
acataatgtagtgagtgtagact

SEQ ID NO: 338515 - DNA, 23 bp, Homo sapiens
acataatgttagtagcactgaga

SEQ ID NO: 338516 - DNA, 19 bp, Homo sapiens
acataattaaattttgagt

SEQ ID NO: 338517 - DNA, 15 bp, Homo sapiens
acatacaaaagaatt

SEQ ID NO: 338518 - DNA, 19 bp, Homo sapiens
acatacaggagagctgcag

SEQ ID NO: 338519 - DNA, 15 bp, Homo sapiens
acatacatctaagtc

SEQ ID NO: 338520 - DNA, 14 bp, Homo sapiens
acataccctccccc

SEQ ID NO: 338521 - DNA, 13 bp, Homo sapiens
acatactgcatgt

SEQ ID NO: 338522 - DNA, 22 bp, Homo sapiens
acatacttcatcgcagtggact

SEQ ID NO: 338523 - DNA, 23 bp, Homo sapiens
acatacttcatcgcagtggactg

SEQ ID NO: 338524 - DNA, 17 bp, Homo sapiens
acatagattcacctgta

SEQ ID NO: 338525 - DNA, 16 bp, Homo sapiens
acatagcccctgcccc

SEQ ID NO: 338526 - DNA, 21 bp, Homo sapiens
acatagcttacaagccagctg

SEQ ID NO: 338527 - DNA, 17 bp, Homo sapiens
acatagtctttgtttac

SEQ ID NO: 338528 - DNA, 21 bp, Homo sapiens
acatagtgaattttaaaatgt

SEQ ID NO: 338529 - DNA, 21 bp, Homo sapiens
acatagttttaaactcatttt

SEQ ID NO: 338530 - DNA, 23 bp, Homo sapiens
acatataatgttgttatttaaag

SEQ ID NO: 338531 - DNA, 17 bp, Homo sapiens
acatatacacaaagata

SEQ ID NO: 338532 - DNA, 18 bp, Homo sapiens
acatatattttattttca

SEQ ID NO: 338533 - DNA, 18 bp, Homo sapiens
acatatcaagtcccgagg

SEQ ID NO: 338534 - DNA, 15 bp, Homo sapiens
acatatcatgtgtga

SEQ ID NO: 338535 - DNA, 22 bp, Homo sapiens
acatatctgtttaggagtgtct

SEQ ID NO: 338536 - DNA, 21 bp, Homo sapiens
acatatgagtgtggaagccgg

SEQ ID NO: 338537 - DNA, 13 bp, Homo sapiens
acatatgcaaaca

SEQ ID NO: 338538 - DNA, 15 bp, Homo sapiens
acatatgcacagggg

SEQ ID NO: 338539 - DNA, 20 bp, Homo sapiens
acatatgctttaagaatcga

SEQ ID NO: 338540 - DNA, 19 bp, Homo sapiens
acatatggaaatcctgtta

SEQ ID NO: 338541 - DNA, 12 bp, Homo sapiens
acatatgtctta

SEQ ID NO: 338542 - DNA, 20 bp, Homo sapiens
acatatgtcttactacttta

SEQ ID NO: 338543 - DNA, 19 bp, Homo sapiens
acatattactgttgcattt

SEQ ID NO: 338544 - DNA, 13 bp, Homo sapiens
acatattcaaatc

SEQ ID NO: 338545 - DNA, 16 bp, Homo sapiens
acatcaagaaaacagc

SEQ ID NO: 338546 - DNA, 17 bp, Homo sapiens
acatcaagaaaacagca

SEQ ID NO: 338547 - DNA, 17 bp, Homo sapiens
acatcaatgttcattgt

SEQ ID NO: 338548 - DNA, 20 bp, Homo sapiens
acatcagtggcatggctcca

SEQ ID NO: 338549 - DNA, 19 bp, Homo sapiens
acatcattggaatacagga

SEQ ID NO: 338550 - DNA, 11 bp, Homo sapiens
acatcatttct

SEQ ID NO: 338551 - DNA, 17 bp, Homo sapiens
acatccagtggggtctc

SEQ ID NO: 338552 - DNA, 18 bp, Homo sapiens
acatcccaataaagtcct

SEQ ID NO: 338553 - DNA, 22 bp, Homo sapiens
acatcccactggatctggctta

SEQ ID NO: 338554 - DNA, 17 bp, Homo sapiens
acatcccagcagcccaa

SEQ ID NO: 338555 - DNA, 18 bp, Homo sapiens
acatcccaggaggggcct

SEQ ID NO: 338556 - DNA, 12 bp, Homo sapiens
acatccccacct

SEQ ID NO: 338557 - DNA, 20 bp, Homo sapiens
acatccccaccttccaagga

SEQ ID NO: 338558 - DNA, 17 bp, Homo sapiens
acatcctccgtccagcc

SEQ ID NO: 338559 - DNA, 13 bp, Homo sapiens
acatcctcttctg

SEQ ID NO: 338560 - DNA, 15 bp, Homo sapiens
acatcctcttctgct

SEQ ID NO: 338561 - DNA, 11 bp, Homo sapiens
acatcctgtga

SEQ ID NO: 338562 - DNA, 14 bp, Homo sapiens
acatcggttcagga

SEQ ID NO: 338563 - DNA, 17 bp, Homo sapiens
acatcggttcaggagga

SEQ ID NO: 338564 - DNA, 17 bp, Homo sapiens
acatcgtgaaaccctgt

SEQ ID NO: 338565 - DNA, 20 bp, Homo sapiens
acatcgtgaaaccctgtctc

SEQ ID NO: 338566 - DNA, 16 bp, Homo sapiens
acatcgttcgatttaa

SEQ ID NO: 338567 - DNA, 12 bp, Homo sapiens
acatctaaattg

SEQ ID NO: 338568 - DNA, 20 bp, Homo sapiens
acatctaaattgatcattca

SEQ ID NO: 338569 - DNA, 21 bp, Homo sapiens
acatctaaattgatcattcat

SEQ ID NO: 338570 - DNA, 22 bp, Homo sapiens
acatctaaattgatcattcata

SEQ ID NO: 338571 - DNA, 14 bp, Homo sapiens
acatctaacaaagt

SEQ ID NO: 338572 - DNA, 22 bp, Homo sapiens
acatctaagtcagtttcacata

SEQ ID NO: 338573 - DNA, 14 bp, Homo sapiens
acatctagcacagc

SEQ ID NO: 338574 - DNA, 18 bp, Homo sapiens
acatctagcacagctgtg

SEQ ID NO: 338575 - DNA, 22 bp, Homo sapiens
acatctctgcaccctggggcct

SEQ ID NO: 338576 - DNA, 12 bp, Homo sapiens
acatctctgctt

SEQ ID NO: 338577 - DNA, 17 bp, Homo sapiens
acatctctttcatctag

SEQ ID NO: 338578 - DNA, 23 bp, Homo sapiens
gtcactggaacctccctgggcct

SEQ ID NO: 338579 - DNA, 15 bp, Homo sapiens
gtcactgtttctctg

SEQ ID NO: 338580 - DNA, 18 bp, Homo sapiens
gtcacttcgcgtgccctc

SEQ ID NO: 338581 - DNA, 17 bp, Homo sapiens
gtcactttgctctgggt

SEQ ID NO: 338582 - DNA, 18 bp, Homo sapiens
gtcacttttttcctgtca

SEQ ID NO: 338583 - DNA, 19 bp, Homo sapiens
gtcacttttttcctgtcaa

SEQ ID NO: 338584 - DNA, 21 bp, Homo sapiens
gtcagaaaccattgttcagaa

SEQ ID NO: 338585 - DNA, 20 bp, Homo sapiens
gtcagacatccatgtttgta

SEQ ID NO: 338586 - DNA, 18 bp, Homo sapiens
gtcagaccagtactggga

SEQ ID NO: 338587 - DNA, 19 bp, Homo sapiens
gtcagaccttcttccacag

SEQ ID NO: 338588 - DNA, 15 bp, Homo sapiens
gtcagactttaaaga

SEQ ID NO: 338589 - DNA, 12 bp, Homo sapiens
gtcagagccctg

SEQ ID NO: 338590 - DNA, 13 bp, Homo sapiens
gtcagagccctgg

SEQ ID NO: 338591 - DNA, 16 bp, Homo sapiens
gtcagagccctggctg

SEQ ID NO: 338592 - DNA, 14 bp, Homo sapiens
gtcagagctgggag

SEQ ID NO: 338593 - DNA, 23 bp, Homo sapiens
gtcagagggactgtcagctgagc

SEQ ID NO: 338594 - DNA, 18 bp, Homo sapiens
gtcagagtaagctgcttt

SEQ ID NO: 338595 - DNA, 16 bp, Homo sapiens
gtcagagtgttgttcc

SEQ ID NO: 338596 - DNA, 17 bp, Homo sapiens
gtcagatgagcaaggac

SEQ ID NO: 338597 - DNA, 20 bp, Homo sapiens
gtcagatgagcaaggacatt

SEQ ID NO: 338598 - DNA, 18 bp, Homo sapiens
gtcagatggatgtagata

SEQ ID NO: 338599 - DNA, 19 bp, Homo sapiens
gtcagatggatgtagatac

SEQ ID NO: 338600 - DNA, 21 bp, Homo sapiens
gtcagatggatgtagatacag

SEQ ID NO: 338601 - DNA, 22 bp, Homo sapiens
gtcagcaccgtggtgtgaggcc

SEQ ID NO: 338602 - DNA, 20 bp, Homo sapiens
gtcagcagaaacccccagga

SEQ ID NO: 338603 - DNA, 15 bp, Homo sapiens
gtcagcagctctgag

SEQ ID NO: 338604 - DNA, 18 bp, Homo sapiens
gtcagcccgaatgcctgt

SEQ ID NO: 338605 - DNA, 20 bp, Homo sapiens
gtcagccgagccgggcctgg

SEQ ID NO: 338606 - DNA, 14 bp, Homo sapiens
gtcagcgcctcaag

SEQ ID NO: 338607 - DNA, 14 bp, Homo sapiens
gtcagctactaatg

SEQ ID NO: 338608 - DNA, 19 bp, Homo sapiens
gtcagctactaatgatgtt

SEQ ID NO: 338609 - DNA, 16 bp, Homo sapiens
gtcagcttgctgccct

SEQ ID NO: 338610 - DNA, 14 bp, Homo sapiens
gtcagctttcagag

SEQ ID NO: 338611 - DNA, 16 bp, Homo sapiens
gtcagctttgccttcc

SEQ ID NO: 338612 - DNA, 19 bp, Homo sapiens
gtcagcttttgttgtttat

SEQ ID NO: 338613 - DNA, 19 bp, Homo sapiens
gtcaggaacagtggctggg

SEQ ID NO: 338614 - DNA, 20 bp, Homo sapiens
gtcaggagagccctctgctg

SEQ ID NO: 338615 - DNA, 17 bp, Homo sapiens
gtcaggagagtgcagat

SEQ ID NO: 338616 - DNA, 14 bp, Homo sapiens
gtcaggagccagca

SEQ ID NO: 338617 - DNA, 13 bp, Homo sapiens
gtcaggagttcct

SEQ ID NO: 338618 - DNA, 21 bp, Homo sapiens
gtcaggctctgaatctctcaa

SEQ ID NO: 338619 - DNA, 21 bp, Homo sapiens
gtcctcggtcttacccccacc

SEQ ID NO: 338620 - DNA, 18 bp, Homo sapiens
gtcctctcagaactcctg

SEQ ID NO: 338621 - DNA, 21 bp, Homo sapiens
gtcctctcagaactcctgtgt

SEQ ID NO: 338622 - DNA, 16 bp, Homo sapiens
gtcctctgtcagtcat

SEQ ID NO: 338623 - DNA, 18 bp, Homo sapiens
gtcctcttaggtcccggg

SEQ ID NO: 338624 - DNA, 23 bp, Homo sapiens
gtcctctttactcccttcctggc

SEQ ID NO: 338625 - DNA, 17 bp, Homo sapiens
gtcctctttcagaaaac

SEQ ID NO: 338626 - DNA, 19 bp, Homo sapiens
gtcctctttcagaaaacag

SEQ ID NO: 338627 - DNA, 17 bp, Homo sapiens
gtcctgacgccctgcgt

SEQ ID NO: 338628 - DNA, 17 bp, Homo sapiens
gtcctgagccccctgca

SEQ ID NO: 338629 - DNA, 12 bp, Homo sapiens
gtcctgaggaat

SEQ ID NO: 338630 - DNA, 19 bp, Homo sapiens
gtcctgaggcagaacctgg

SEQ ID NO: 338631 - DNA, 20 bp, Homo sapiens
gtcctgaggcagaacctggt

SEQ ID NO: 338632 - DNA, 22 bp, Homo sapiens
gtcctgaggcagaacctggtgg

SEQ ID NO: 338633 - DNA, 15 bp, Homo sapiens
gtcctgaggctgggg

SEQ ID NO: 338634 - DNA, 17 bp, Homo sapiens
gtcctgatggtcagctc

SEQ ID NO: 338635 - DNA, 18 bp, Homo sapiens
gtcctgatggtcagctcc

SEQ ID NO: 338636 - DNA, 20 bp, Homo sapiens
gtcctgatggtcagctccct

SEQ ID NO: 338637 - DNA, 21 bp, Homo sapiens
gtcctgcaagtccatagctga

SEQ ID NO: 338638 - DNA, 22 bp, Homo sapiens
gtcctgcaagtccatagctgag

SEQ ID NO: 338639 - DNA, 17 bp, Homo sapiens
gtcctgcaatctccagg

SEQ ID NO: 338640 - DNA, 12 bp, Homo sapiens
gtcctgcagagg

SEQ ID NO: 338641 - DNA, 17 bp, Homo sapiens
gtcctgcagtgtgagat

SEQ ID NO: 338642 - DNA, 15 bp, Homo sapiens
gtcctgcctcagcct

SEQ ID NO: 338643 - DNA, 14 bp, Homo sapiens
gtcctgcctttggg

SEQ ID NO: 338644 - DNA, 21 bp, Homo sapiens
gtcctgctcacgtctgtgagt

SEQ ID NO: 338645 - DNA, 22 bp, Homo sapiens
gtcctgctgctcgggaaggcct

SEQ ID NO: 338646 - DNA, 20 bp, Homo sapiens
gtcctggaatgaagcatgta

SEQ ID NO: 338647 - DNA, 22 bp, Homo sapiens
gtcctggaatgaagcatgtagc

SEQ ID NO: 338648 - DNA, 14 bp, Homo sapiens
gtcctggcagggca

SEQ ID NO: 338649 - DNA, 17 bp, Homo sapiens
gtcctggcatgggaatg

SEQ ID NO: 338650 - DNA, 20 bp, Homo sapiens
gtcctggctacatcccagcc

SEQ ID NO: 338651 - DNA, 21 bp, Homo sapiens
gtcctggctacatcccagcct

SEQ ID NO: 338652 - DNA, 22 bp, Homo sapiens
gtcctggctacatcccagcctg

SEQ ID NO: 338653 - DNA, 19 bp, Homo sapiens
gtcctggctcctgaggggc

SEQ ID NO: 338654 - DNA, 19 bp, Homo sapiens
gtcctgggcgccctggaag

SEQ ID NO: 338655 - DNA, 20 bp, Homo sapiens
gtcctgggcgccctggaagc

SEQ ID NO: 338656 - DNA, 14 bp, Homo sapiens
gtcctggggaggct

SEQ ID NO: 338657 - DNA, 15 bp, Homo sapiens
gtcctggggctgggt

SEQ ID NO: 338658 - DNA, 13 bp, Homo sapiens
gtcctggggtggt

SEQ ID NO: 338659 - DNA, 21 bp, Homo sapiens
gtcctggtacagcagggtctt

SEQ ID NO: 338660 - DNA, 15 bp, Homo sapiens
gtcctggtgaggaca

SEQ ID NO: 338661 - DNA, 17 bp, Homo sapiens
gtcctggtggggctgag

SEQ ID NO: 338662 - DNA, 20 bp, Homo sapiens
gtcctggtggggctgagcct

SEQ ID NO: 338663 - DNA, 19 bp, Homo sapiens
gtcctggttcagtgggaat

SEQ ID NO: 338664 - DNA, 16 bp, Homo sapiens
gtcctgtatagcaacc

SEQ ID NO: 338665 - DNA, 11 bp, Homo sapiens
gtcctgtccca

SEQ ID NO: 338666 - DNA, 12 bp, Homo sapiens
gtcctgtcccag

SEQ ID NO: 338667 - DNA, 14 bp, Homo sapiens
gtcctgtcccagag

SEQ ID NO: 338668 - DNA, 16 bp, Homo sapiens
gtcctgtgtcatctgt

SEQ ID NO: 338669 - DNA, 18 bp, Homo sapiens
gtcctgtgtcatctgtca

SEQ ID NO: 338670 - DNA, 14 bp, Homo sapiens
gtcctgttctcaga

SEQ ID NO: 338671 - DNA, 15 bp, Homo sapiens
gtcctgttctcagag

SEQ ID NO: 338672 - DNA, 23 bp, Homo sapiens
gtccttaaacagggcatctccag

SEQ ID NO: 338673 - DNA, 18 bp, Homo sapiens
gtccttagactccttctc

SEQ ID NO: 338674 - DNA, 14 bp, Homo sapiens
gtccttcagagctc

SEQ ID NO: 338675 - DNA, 15 bp, Homo sapiens
gtccttcagatggaa

SEQ ID NO: 338676 - DNA, 20 bp, Homo sapiens
gtccttcagtgagcccctcc

SEQ ID NO: 338677 - DNA, 22 bp, Homo sapiens
gtccttcccacggccactgcag

SEQ ID NO: 338678 - DNA, 17 bp, Homo sapiens
gtccttctctcacctcc

SEQ ID NO: 338679 - DNA, 18 bp, Homo sapiens
gtccttctctcacctcct

SEQ ID NO: 338680 - DNA, 14 bp, Homo sapiens
gtccttcttcctca

SEQ ID NO: 338681 - DNA, 13 bp, Homo sapiens
gtcctttccctgg

SEQ ID NO: 338682 - DNA, 14 bp, Homo sapiens
gtcctttccttctc

SEQ ID NO: 338683 - DNA, 16 bp, Homo sapiens
gtcctttctccaggcc

SEQ ID NO: 338684 - DNA, 16 bp, Homo sapiens
gtcgactttgagctgg

SEQ ID NO: 338685 - DNA, 20 bp, Homo sapiens
gtcgcaggatccgctgccac

SEQ ID NO: 338686 - DNA, 22 bp, Homo sapiens
gtcgccaacacttgtgttgctt

SEQ ID NO: 338687 - DNA, 20 bp, Homo sapiens
gtcgcccctcctcgggcgcc

SEQ ID NO: 338688 - DNA, 15 bp, Homo sapiens
gtcgccctctgtgcc

SEQ ID NO: 338689 - DNA, 17 bp, Homo sapiens
gtcgccctctgtgccta

SEQ ID NO: 338690 - DNA, 19 bp, Homo sapiens
gtcgccctctgtgcctaat

SEQ ID NO: 338691 - DNA, 15 bp, Homo sapiens
gtcgccgtccctctg

SEQ ID NO: 338692 - DNA, 16 bp, Homo sapiens
gtcgcctgcggactcc

SEQ ID NO: 338693 - DNA, 21 bp, Homo sapiens
gtcgcctgcggactccatggc

SEQ ID NO: 338694 - DNA, 13 bp, Homo sapiens
gtcgcggctgcag

SEQ ID NO: 338695 - DNA, 14 bp, Homo sapiens
gtcgcggctgcagg

SEQ ID NO: 338696 - DNA, 16 bp, Homo sapiens
gtcggaagcctgtcct

SEQ ID NO: 338697 - DNA, 15 bp, Homo sapiens
gtcggctgggcaggg

SEQ ID NO: 338698 - DNA, 18 bp, Homo sapiens
gtcggctgggcagggccg

SEQ ID NO: 338699 - DNA, 20 bp, Homo sapiens
gtcgggaaattctgctgctt

SEQ ID NO: 338700 - DNA, 18 bp, Homo sapiens
gtcgggggctgaggggca

SEQ ID NO: 338701 - DNA, 22 bp, Homo sapiens
gtcggggggcgagggaggggag

SEQ ID NO: 338702 - DNA, 13 bp, Homo sapiens
gtcggtgtcccct

SEQ ID NO: 338703 - DNA, 14 bp, Homo sapiens
gtcgttcattttct

SEQ ID NO: 338704 - DNA, 21 bp, Homo sapiens
gtctaaaaataaaatgcattt

SEQ ID NO: 338705 - DNA, 22 bp, Homo sapiens
gtctaaaaataaaatgcattta

SEQ ID NO: 338706 - DNA, 15 bp, Homo sapiens
gtctaaagtttacag

SEQ ID NO: 338707 - DNA, 16 bp, Homo sapiens
gtctaaatatttcctt

SEQ ID NO: 338708 - DNA, 18 bp, Homo sapiens
gtctaaccccaggttttc

SEQ ID NO: 338709 - DNA, 19 bp, Homo sapiens
gtctaatgatattttatgc

SEQ ID NO: 338710 - DNA, 22 bp, Homo sapiens
gtctaattaaaacactttcaaa

SEQ ID NO: 338711 - DNA, 11 bp, Homo sapiens
gtctactgtgg

SEQ ID NO: 338712 - DNA, 14 bp, Homo sapiens
gtctactgtggtga

SEQ ID NO: 338713 - DNA, 14 bp, Homo sapiens
gtctacttctgtgt

SEQ ID NO: 338714 - DNA, 21 bp, Homo sapiens
gtctacttctgtgtctgtcac

SEQ ID NO: 338715 - DNA, 20 bp, Homo sapiens
gtctagaggcaacagtgttc

SEQ ID NO: 338716 - DNA, 18 bp, Homo sapiens
gtctagatggatgaatta

SEQ ID NO: 338717 - DNA, 15 bp, Homo sapiens
gtctagcaaagccac

SEQ ID NO: 338718 - DNA, 22 bp, Homo sapiens
gtctaggtcagtacccacctga

SEQ ID NO: 338719 - DNA, 12 bp, Homo sapiens
gtctagtagaac

SEQ ID NO: 338720 - DNA, 20 bp, Homo sapiens
gtctagtggaaagattgtgt

SEQ ID NO: 338721 - DNA, 23 bp, Homo sapiens
gtctagtggaaagattgtgtctg

SEQ ID NO: 338722 - DNA, 21 bp, Homo sapiens
gtctataatcccagcactttg

SEQ ID NO: 338723 - DNA, 14 bp, Homo sapiens
gtctatacattcct

SEQ ID NO: 338724 - DNA, 17 bp, Homo sapiens
gtctatacattcctgag

SEQ ID NO: 338725 - DNA, 14 bp, Homo sapiens
gtctattccctgga

SEQ ID NO: 338726 - DNA, 16 bp, Homo sapiens
gtctatttttgtctta

SEQ ID NO: 338727 - DNA, 19 bp, Homo sapiens
gtctatttttttaactgaa

SEQ ID NO: 338728 - DNA, 16 bp, Homo sapiens
gtctcaaaaatacaaa

SEQ ID NO: 338729 - DNA, 17 bp, Homo sapiens
gtctcaaaaatacaaaa

SEQ ID NO: 338730 - DNA, 16 bp, Homo sapiens
gtctcaaactcctggg

SEQ ID NO: 338731 - DNA, 19 bp, Homo sapiens
gtctcaaagcatcaaataa

SEQ ID NO: 338732 - DNA, 22 bp, Homo sapiens
gtctcaagagggcactggtggc

SEQ ID NO: 338733 - DNA, 19 bp, Homo sapiens
gtctcaagggctagcatcc

SEQ ID NO: 338734 - DNA, 17 bp, Homo sapiens
gtctcaattttgtattt

SEQ ID NO: 338735 - DNA, 14 bp, Homo sapiens
gtctcaccagctca

SEQ ID NO: 338736 - DNA, 15 bp, Homo sapiens
gtctcaccagctcag

SEQ ID NO: 338737 - DNA, 18 bp, Homo sapiens
gtctcaccagctcagccc

SEQ ID NO: 338738 - DNA, 15 bp, Homo sapiens
gtctcactctttctt

SEQ ID NO: 338739 - DNA, 16 bp, Homo sapiens
gtctcacttataccaa

SEQ ID NO: 338740 - DNA, 20 bp, Homo sapiens
gtctcagcaaattcttgaat

SEQ ID NO: 338741 - DNA, 15 bp, Homo sapiens
gtctcaggtccctgc

SEQ ID NO: 338742 - DNA, 16 bp, Homo sapiens
gtctcagtccacctga

SEQ ID NO: 338743 - DNA, 15 bp, Homo sapiens
gtctcatccccaggg

SEQ ID NO: 338744 - DNA, 18 bp, Homo sapiens
gtctcattcctctgtccc

SEQ ID NO: 338745 - DNA, 12 bp, Homo sapiens
gtctcattgcca

SEQ ID NO: 338746 - DNA, 23 bp, Homo sapiens
gtctcattttgtatgtatgtgta

SEQ ID NO: 338747 - DNA, 14 bp, Homo sapiens
gtctccaagaatac

SEQ ID NO: 338748 - DNA, 15 bp, Homo sapiens
gtctccaagaatgtt

SEQ ID NO: 338749 - DNA, 17 bp, Homo sapiens
gtgacagtgcctgggaa

SEQ ID NO: 338750 - DNA, 23 bp, Homo sapiens
gtgacagtgcctgggaatgtatt

SEQ ID NO: 338751 - DNA, 17 bp, Homo sapiens
gtgacagtgccttctct

SEQ ID NO: 338752 - DNA, 14 bp, Homo sapiens
gtgacatcagtggc

SEQ ID NO: 338753 - DNA, 17 bp, Homo sapiens
gtgacatcccaggaggg

SEQ ID NO: 338754 - DNA, 20 bp, Homo sapiens
gtgacatcccaggaggggcc

SEQ ID NO: 338755 - DNA, 18 bp, Homo sapiens
gtgacatcggttcaggag

SEQ ID NO: 338756 - DNA, 15 bp, Homo sapiens
gtgacatgcggctgc

SEQ ID NO: 338757 - DNA, 21 bp, Homo sapiens
gtgacatgcggctgcccacgc

SEQ ID NO: 338758 - DNA, 19 bp, Homo sapiens
gtgaccaattgccctgcca

SEQ ID NO: 338759 - DNA, 20 bp, Homo sapiens
gtgaccaattgccctgccag

SEQ ID NO: 338760 - DNA, 18 bp, Homo sapiens
gtgaccagcaccatctct

SEQ ID NO: 338761 - DNA, 17 bp, Homo sapiens
gtgaccccatctctgct

SEQ ID NO: 338762 - DNA, 23 bp, Homo sapiens
gtgaccccttttagtcaggagag

SEQ ID NO: 338763 - DNA, 15 bp, Homo sapiens
gtgacccggaggcca

SEQ ID NO: 338764 - DNA, 17 bp, Homo sapiens
gtgacccttcagggcca

SEQ ID NO: 338765 - DNA, 18 bp, Homo sapiens
gtgacccttcagggccag

SEQ ID NO: 338766 - DNA, 19 bp, Homo sapiens
gtgacccttcagggccaga

SEQ ID NO: 338767 - DNA, 20 bp, Homo sapiens
gtgacccttctgtctgtaag

SEQ ID NO: 338768 - DNA, 13 bp, Homo sapiens
gtgaccggggtcc

SEQ ID NO: 338769 - DNA, 15 bp, Homo sapiens
gtgaccggggtcctg

SEQ ID NO: 338770 - DNA, 16 bp, Homo sapiens
gtgaccggggtcctga

SEQ ID NO: 338771 - DNA, 15 bp, Homo sapiens
gtgaccttctgggaa

SEQ ID NO: 338772 - DNA, 21 bp, Homo sapiens
gtgacgggggttggggtgggg

SEQ ID NO: 338773 - DNA, 20 bp, Homo sapiens
gtgacggtcctttaggcagc

SEQ ID NO: 338774 - DNA, 19 bp, Homo sapiens
gtgactagtacaaattata

SEQ ID NO: 338775 - DNA, 17 bp, Homo sapiens
gtgactagtgctgaagc

SEQ ID NO: 338776 - DNA, 15 bp, Homo sapiens
gtgactatatagaga

SEQ ID NO: 338777 - DNA, 17 bp, Homo sapiens
gtgactatatagagatg

SEQ ID NO: 338778 - DNA, 20 bp, Homo sapiens
gtgactatatagagatgttt

SEQ ID NO: 338779 - DNA, 17 bp, Homo sapiens
gtgactcagtgtatttt

SEQ ID NO: 338780 - DNA, 16 bp, Homo sapiens
gtgactcattcccagt

SEQ ID NO: 338781 - DNA, 13 bp, Homo sapiens
gtgactcctccct

SEQ ID NO: 338782 - DNA, 23 bp, Homo sapiens
gtgactcctcccttccccactct

SEQ ID NO: 338783 - DNA, 12 bp, Homo sapiens
gtgactgaaggg

SEQ ID NO: 338784 - DNA, 17 bp, Homo sapiens
gtgactgaatttgggcc

SEQ ID NO: 338785 - DNA, 19 bp, Homo sapiens
gtgactgaatttgggcctc

SEQ ID NO: 338786 - DNA, 16 bp, Homo sapiens
gtgactgacggctgtg

SEQ ID NO: 338787 - DNA, 19 bp, Homo sapiens
gtgactgatgttaggctgg

SEQ ID NO: 338788 - DNA, 15 bp, Homo sapiens
gtgactgtttttgtt

SEQ ID NO: 338789 - DNA, 21 bp, Homo sapiens
gtgacttgaatgtacaaagat

SEQ ID NO: 338790 - DNA, 17 bp, Homo sapiens
gtgacttgtgtcccatg

SEQ ID NO: 338791 - DNA, 15 bp, Homo sapiens
gtgactttgaacaca

SEQ ID NO: 338792 - DNA, 11 bp, Homo sapiens
gtgagaactgt

SEQ ID NO: 338793 - DNA, 19 bp, Homo sapiens
gtgagaatcgacctcactg

SEQ ID NO: 338794 - DNA, 19 bp, Homo sapiens
gtgagaatctggctcctgt

SEQ ID NO: 338795 - DNA, 23 bp, Homo sapiens
gtgagacagccggatcttggaga

SEQ ID NO: 338796 - DNA, 15 bp, Homo sapiens
gtgagacagtggggg

SEQ ID NO: 338797 - DNA, 14 bp, Homo sapiens
gtgagaccacctct

SEQ ID NO: 338798 - DNA, 14 bp, Homo sapiens
gtgagacgaggcag

SEQ ID NO: 338799 - DNA, 12 bp, Homo sapiens
gtgagagcccat

SEQ ID NO: 338800 - DNA, 16 bp, Homo sapiens
gtgagataaatatcat

SEQ ID NO: 338801 - DNA, 23 bp, Homo sapiens
gtgagataacttccttcacatct

SEQ ID NO: 338802 - DNA, 18 bp, Homo sapiens
gtgagatacccagagaga

SEQ ID NO: 338803 - DNA, 19 bp, Homo sapiens
gtgagatacccagagagaa

SEQ ID NO: 338804 - DNA, 21 bp, Homo sapiens
gtgagatggtgccccctgggg

SEQ ID NO: 338805 - DNA, 21 bp, Homo sapiens
gtgagcaaaatatgccccttc

SEQ ID NO: 338806 - DNA, 17 bp, Homo sapiens
gtgagcaaacctgcccc

SEQ ID NO: 338807 - DNA, 15 bp, Homo sapiens
gtgagcaatcctgca

SEQ ID NO: 338808 - DNA, 17 bp, Homo sapiens
gtgagcagactggtggg

SEQ ID NO: 338809 - DNA, 20 bp, Homo sapiens
gtgagcaggaaggcctgggt

SEQ ID NO: 338810 - DNA, 19 bp, Homo sapiens
gtgagcagggccctcagag

SEQ ID NO: 338811 - DNA, 22 bp, Homo sapiens
gtgagcatgaaactatgcacct

SEQ ID NO: 338812 - DNA, 23 bp, Homo sapiens
gtgagccatagagatatttaaaa

SEQ ID NO: 338813 - DNA, 15 bp, Homo sapiens
gtgagcccctcccca

SEQ ID NO: 338814 - DNA, 17 bp, Homo sapiens
gtgagcccctccccagc

SEQ ID NO: 338815 - DNA, 18 bp, Homo sapiens
gtgagcccctccccagcc

SEQ ID NO: 338816 - DNA, 17 bp, Homo sapiens
gtgagcgccccgccccc

SEQ ID NO: 338817 - DNA, 14 bp, Homo sapiens
gtgagctgggaagc

SEQ ID NO: 338818 - DNA, 14 bp, Homo sapiens
gtgaggaagcctaa

SEQ ID NO: 338819 - DNA, 17 bp, Homo sapiens
gtgaggaatgctctgtg

SEQ ID NO: 338820 - DNA, 16 bp, Homo sapiens
gtgaggaccactcctg

SEQ ID NO: 338821 - DNA, 17 bp, Homo sapiens
gtgaggagctgctggct

SEQ ID NO: 338822 - DNA, 14 bp, Homo sapiens
gtgaggaggaggca

SEQ ID NO: 338823 - DNA, 15 bp, Homo sapiens
gtgaggcaagagaaa

SEQ ID NO: 338824 - DNA, 18 bp, Homo sapiens
gtgaggcaggggagtctg

SEQ ID NO: 338825 - DNA, 20 bp, Homo sapiens
gtgaggcaggggagtctgct

SEQ ID NO: 338826 - DNA, 22 bp, Homo sapiens
gtgaggcccccggaggcgccca

SEQ ID NO: 338827 - DNA, 13 bp, Homo sapiens
gtgaggcgtggga

SEQ ID NO: 338828 - DNA, 19 bp, Homo sapiens
gtgaggcgtgggatccaga

SEQ ID NO: 338829 - DNA, 16 bp, Homo sapiens
gtgaggcgttctcctg

SEQ ID NO: 338830 - DNA, 20 bp, Homo sapiens
gtgaggcgttctcctgcttg

SEQ ID NO: 338831 - DNA, 14 bp, Homo sapiens
gtgaggctgtcctg

SEQ ID NO: 338832 - DNA, 15 bp, Homo sapiens
gtgaggcttccaggc

SEQ ID NO: 338833 - DNA, 16 bp, Homo sapiens
gtgaggcttccaggct

SEQ ID NO: 338834 - DNA, 17 bp, Homo sapiens
gtgaggcttccaggctc

SEQ ID NO: 338835 - DNA, 14 bp, Homo sapiens
gtgagggaggcctg

SEQ ID NO: 338836 - DNA, 22 bp, Homo sapiens
gtgagggtcctgattctccctg

SEQ ID NO: 338837 - DNA, 22 bp, Homo sapiens
gtgaggtgggggtctggcctag

SEQ ID NO: 338838 - DNA, 14 bp, Homo sapiens
gtgagtctgtcctt

SEQ ID NO: 338839 - DNA, 13 bp, Homo sapiens
gtgagtggcagcc

SEQ ID NO: 338840 - DNA, 14 bp, Homo sapiens
gtgagtggcagcca

SEQ ID NO: 338841 - DNA, 12 bp, Homo sapiens
gtgagtgggagg

SEQ ID NO: 338842 - DNA, 16 bp, Homo sapiens
gtgagtgtaagtgtga

SEQ ID NO: 338843 - DNA, 20 bp, Homo sapiens
gtgagtgtgtgtttgtgctg

SEQ ID NO: 338844 - DNA, 14 bp, Homo sapiens
gtgagttctcacta

SEQ ID NO: 338845 - DNA, 17 bp, Homo sapiens
gtgatagagcctttgat

SEQ ID NO: 338846 - DNA, 19 bp, Homo sapiens
gtgatagcattgctttcgt

SEQ ID NO: 338847 - DNA, 18 bp, Homo sapiens
gtgatagctaacatttta

SEQ ID NO: 338848 - DNA, 23 bp, Homo sapiens
gtgataggcccaaggtcccctcc

SEQ ID NO: 338849 - DNA, 21 bp, Homo sapiens
gtgatatgtgtaatatcattt

SEQ ID NO: 338850 - DNA, 17 bp, Homo sapiens
gtgatcaactgttcagg

SEQ ID NO: 338851 - DNA, 16 bp, Homo sapiens
gtgatccacctgcctc

SEQ ID NO: 338852 - DNA, 14 bp, Homo sapiens
gtgatcctctattt

SEQ ID NO: 338853 - DNA, 15 bp, Homo sapiens
gtgatcctctatttt

SEQ ID NO: 338854 - DNA, 12 bp, Homo sapiens
gtgatctccata

SEQ ID NO: 338855 - DNA, 18 bp, Homo sapiens
gtgatctgtagacttctg

SEQ ID NO: 338856 - DNA, 22 bp, Homo sapiens
gtgatcttggcttactgcagcc

SEQ ID NO: 338857 - DNA, 15 bp, Homo sapiens
gtgatgaactttctc

SEQ ID NO: 338858 - DNA, 22 bp, Homo sapiens
gtgatgaagaaaagtgggccag

SEQ ID NO: 338859 - DNA, 22 bp, Homo sapiens
gtgatgcgcatgtcacggaggg

SEQ ID NO: 338860 - DNA, 19 bp, Homo sapiens
gtgatgcgccttgctgatg

SEQ ID NO: 338861 - DNA, 17 bp, Homo sapiens
gtgatggaacacacaca

SEQ ID NO: 338862 - DNA, 22 bp, Homo sapiens
gtgatggatggacacaaaaaaa

SEQ ID NO: 338863 - DNA, 21 bp, Homo sapiens
gtgatggcattactctgcact

SEQ ID NO: 338864 - DNA, 15 bp, Homo sapiens
gtgatgggccaccgg

SEQ ID NO: 338865 - DNA, 16 bp, Homo sapiens
gtgatggttcccctgt

SEQ ID NO: 338866 - DNA, 23 bp, Homo sapiens
gtgatggttcccctgttcactct

SEQ ID NO: 338867 - DNA, 15 bp, Homo sapiens
gtgatgtaaaacaga

SEQ ID NO: 338868 - DNA, 21 bp, Homo sapiens
gtgatgtatgttggtttttta

SEQ ID NO: 338869 - DNA, 15 bp, Homo sapiens
gtgatgtcctgtaaa

SEQ ID NO: 338870 - DNA, 21 bp, Homo sapiens
gtgatgtcctgtaaacactca

SEQ ID NO: 338871 - DNA, 20 bp, Homo sapiens
gtgatgtgatttatgcattt

SEQ ID NO: 338872 - DNA, 21 bp, Homo sapiens
gtgatgtttccagctgccaag

SEQ ID NO: 338873 - DNA, 15 bp, Homo sapiens
ttctggtactctcct

SEQ ID NO: 338874 - DNA, 17 bp, Homo sapiens
ttctggtagatagaaat

SEQ ID NO: 338875 - DNA, 21 bp, Homo sapiens
ttctggtaggttctgtctgtg

SEQ ID NO: 338876 - DNA, 21 bp, Homo sapiens
ttctggtatgaacttgaggac

SEQ ID NO: 338877 - DNA, 13 bp, Homo sapiens
ttctggtgactgc

SEQ ID NO: 338878 - DNA, 13 bp, Homo sapiens
ttctggttgtatt

SEQ ID NO: 338879 - DNA, 18 bp, Homo sapiens
ttgaggtcttttacatac

SEQ ID NO: 338880 - DNA, 22 bp, Homo sapiens
ttgaggtcttttgacatgtgga

SEQ ID NO: 338881 - DNA, 18 bp, Homo sapiens
ttgaggttaaaatataaa

SEQ ID NO: 338882 - DNA, 20 bp, Homo sapiens
ttgagtagagagcaagggaa

SEQ ID NO: 338883 - DNA, 13 bp, Homo sapiens
ttgagtatttgct

SEQ ID NO: 338884 - DNA, 19 bp, Homo sapiens
gtgcctagtgatgtagaaa

SEQ ID NO: 338885 - DNA, 14 bp, Homo sapiens
gtgcctatagaaaa

SEQ ID NO: 338886 - DNA, 10 bp, Homo sapiens
gtgcctcagc

SEQ ID NO: 338887 - DNA, 19 bp, Homo sapiens
gtgcctcagcgctgcccac

SEQ ID NO: 338888 - DNA, 14 bp, Homo sapiens
gtgcctcccttccc

SEQ ID NO: 338889 - DNA, 17 bp, Homo sapiens
gtgcctcccttcccagt

SEQ ID NO: 338890 - DNA, 13 bp, Homo sapiens
gtgcctcctctgg

SEQ ID NO: 338891 - DNA, 21 bp, Homo sapiens
gtgcctccttccacctccctc

SEQ ID NO: 338892 - DNA, 12 bp, Homo sapiens
gtgcctctgcct

SEQ ID NO: 338893 - DNA, 17 bp, Homo sapiens
gtgcctgagaatttaat

SEQ ID NO: 338894 - DNA, 15 bp, Homo sapiens
gtgcctgcaccagga

SEQ ID NO: 338895 - DNA, 19 bp, Homo sapiens
gtgcctgcaccaggagaca

SEQ ID NO: 338896 - DNA, 21 bp, Homo sapiens
gtgcctgcaccaggagacaga

SEQ ID NO: 338897 - DNA, 14 bp, Homo sapiens
gtgcctgccactct

SEQ ID NO: 338898 - DNA, 18 bp, Homo sapiens
gtgcctgctatccagccg

SEQ ID NO: 338899 - DNA, 14 bp, Homo sapiens
gtgcctgctctcct

SEQ ID NO: 338900 - DNA, 17 bp, Homo sapiens
gtgcctgggaatgtatt

SEQ ID NO: 338901 - DNA, 19 bp, Homo sapiens
gtgcctgtacaagctgatg

SEQ ID NO: 338902 - DNA, 22 bp, Homo sapiens
gtgcctgtgaccggggtcctga

SEQ ID NO: 338903 - DNA, 12 bp, Homo sapiens
gtgcctgtggca

SEQ ID NO: 338904 - DNA, 14 bp, Homo sapiens
gtgcctgtggcaga

SEQ ID NO: 338905 - DNA, 12 bp, Homo sapiens
gtgccttccata

SEQ ID NO: 338906 - DNA, 15 bp, Homo sapiens
gtgccttccataatt

SEQ ID NO: 338907 - DNA, 20 bp, Homo sapiens
gtgccttccccgtgcggccc

SEQ ID NO: 338908 - DNA, 11 bp, Homo sapiens
gtgccttctct

SEQ ID NO: 338909 - DNA, 15 bp, Homo sapiens
gtgccttgagctgcc

SEQ ID NO: 338910 - DNA, 20 bp, Homo sapiens
gtgccttggggaatttcctc

SEQ ID NO: 338911 - DNA, 23 bp, Homo sapiens
gtgcctttccccattcattcctg

SEQ ID NO: 338912 - DNA, 15 bp, Homo sapiens
gtgccttttgtgtga

SEQ ID NO: 338913 - DNA, 20 bp, Homo sapiens
gtgcgcagccgcgctctgcc

SEQ ID NO: 338914 - DNA, 23 bp, Homo sapiens
gtgcgcagccgcgctctgcccct

SEQ ID NO: 338915 - DNA, 17 bp, Homo sapiens
gtgcgctcacctgcagc

SEQ ID NO: 338916 - DNA, 12 bp, Homo sapiens
gtgcgctgtgct

SEQ ID NO: 338917 - DNA, 21 bp, Homo sapiens
gtgcgctgtgctccagcagtg

SEQ ID NO: 338918 - DNA, 17 bp, Homo sapiens
gtgcggcccgtgcgcag

SEQ ID NO: 338919 - DNA, 18 bp, Homo sapiens
gtgcggcccgtgcgcagc

SEQ ID NO: 338920 - DNA, 17 bp, Homo sapiens
gtgcggtaggtgctggc

SEQ ID NO: 338921 - DNA, 21 bp, Homo sapiens
gtgcgtctctgtcgtggacac

SEQ ID NO: 338922 - DNA, 15 bp, Homo sapiens
gtgcgtggctgtggc

SEQ ID NO: 338923 - DNA, 13 bp, Homo sapiens
gtgcgtgtggccc

SEQ ID NO: 338924 - DNA, 18 bp, Homo sapiens
gtgcgtgtggccctgtgg

SEQ ID NO: 338925 - DNA, 17 bp, Homo sapiens
gtgcgttcccttcagta

SEQ ID NO: 338926 - DNA, 19 bp, Homo sapiens
gtgctaaaaaattaaacca

SEQ ID NO: 338927 - DNA, 13 bp, Homo sapiens
gtgctaaattttc

SEQ ID NO: 338928 - DNA, 16 bp, Homo sapiens
gtgctaaattttcagt

SEQ ID NO: 338929 - DNA, 23 bp, Homo sapiens
gtgctaaccacgtctgtcttcac

SEQ ID NO: 338930 - DNA, 14 bp, Homo sapiens
gtgctaagttgtct

SEQ ID NO: 338931 - DNA, 15 bp, Homo sapiens
gtgctacagagaaaa

SEQ ID NO: 338932 - DNA, 19 bp, Homo sapiens
gtgctagaatactttttaa

SEQ ID NO: 338933 - DNA, 20 bp, Homo sapiens
gtgctcagatacacaagtga

SEQ ID NO: 338934 - DNA, 13 bp, Homo sapiens
gtgctcagggctg

SEQ ID NO: 338935 - DNA, 22 bp, Homo sapiens
gtgctcatcagaaacaatttct

SEQ ID NO: 338936 - DNA, 19 bp, Homo sapiens
gtgctccagcagtgctggg

SEQ ID NO: 338937 - DNA, 15 bp, Homo sapiens
gtgctccctcctcag

SEQ ID NO: 338938 - DNA, 13 bp, Homo sapiens
gtgctctggcggc

SEQ ID NO: 338939 - DNA, 24 bp, Homo sapiens
gtgctctggcggcttcctgtccac

SEQ ID NO: 338940 - DNA, 21 bp, Homo sapiens
gtgctctggggatttctggga

SEQ ID NO: 338941 - DNA, 18 bp, Homo sapiens
gtgctgaactgtgcatca

SEQ ID NO: 338942 - DNA, 21 bp, Homo sapiens
gtgctgaagcttattaatgct

SEQ ID NO: 338943 - DNA, 12 bp, Homo sapiens
gtgctgaggact

SEQ ID NO: 338944 - DNA, 21 bp, Homo sapiens
gtgctgcagacaaaaagaaca

SEQ ID NO: 338945 - DNA, 22 bp, Homo sapiens
gtgctgccatgccactgccagg

SEQ ID NO: 338946 - DNA, 17 bp, Homo sapiens
gtgctgctgtggcatca

SEQ ID NO: 338947 - DNA, 13 bp, Homo sapiens
gtgctgcttccct

SEQ ID NO: 338948 - DNA, 16 bp, Homo sapiens
gtgctgcttccctctg

SEQ ID NO: 338949 - DNA, 17 bp, Homo sapiens
gtgctgcttgtgcctcc

SEQ ID NO: 338950 - DNA, 15 bp, Homo sapiens
gtgctgctttggctg

SEQ ID NO: 338951 - DNA, 12 bp, Homo sapiens
gtgctggagagt

SEQ ID NO: 338952 - DNA, 19 bp, Homo sapiens
gtgctgggactgagccagt

SEQ ID NO: 338953 - DNA, 14 bp, Homo sapiens
gtgctgggccagtg

SEQ ID NO: 338954 - DNA, 15 bp, Homo sapiens
gtgctgggcccagcc

SEQ ID NO: 338955 - DNA, 20 bp, Homo sapiens
gtgctgggtgcctcccacac

SEQ ID NO: 338956 - DNA, 16 bp, Homo sapiens
gtgctgtacccttcca

SEQ ID NO: 338957 - DNA, 15 bp, Homo sapiens
gtgctgtcagcatta

SEQ ID NO: 338958 - DNA, 12 bp, Homo sapiens
gtgctgtgcctg

SEQ ID NO: 338959 - DNA, 16 bp, Homo sapiens
gtgctgtgcctgctag

SEQ ID NO: 338960 - DNA, 20 bp, Homo sapiens
gtgctgtgcctgctagagca

SEQ ID NO: 338961 - DNA, 21 bp, Homo sapiens
gtgcttatcccatagccagga

SEQ ID NO: 338962 - DNA, 19 bp, Homo sapiens
gtgcttattctcaaagcag

SEQ ID NO: 338963 - DNA, 15 bp, Homo sapiens
gtgcttcttgtaata

SEQ ID NO: 338964 - DNA, 21 bp, Homo sapiens
gtgcttcttgtaatatttctt

SEQ ID NO: 338965 - DNA, 21 bp, Homo sapiens
gtgcttgccaccaccagatga

SEQ ID NO: 338966 - DNA, 23 bp, Homo sapiens
gtgcttggcacatagtgggcctt

SEQ ID NO: 338967 - DNA, 16 bp, Homo sapiens
gtgcttgggcttctgc

SEQ ID NO: 338968 - DNA, 23 bp, Homo sapiens
gtgcttggtggggctcgtggcct

SEQ ID NO: 338969 - DNA, 18 bp, Homo sapiens
gtgcttggttgaaaagat

SEQ ID NO: 338970 - DNA, 19 bp, Homo sapiens
gtgcttttaaactggagag

SEQ ID NO: 338971 - DNA, 17 bp, Homo sapiens
gtggaaaaaagagaaaa

SEQ ID NO: 338972 - DNA, 16 bp, Homo sapiens
gtggaaagattgtgtc

SEQ ID NO: 338973 - DNA, 19 bp, Homo sapiens
gtggaaaggattctaaaca

SEQ ID NO: 338974 - DNA, 22 bp, Homo sapiens
gtggaaagggtgctgcttccct

SEQ ID NO: 338975 - DNA, 19 bp, Homo sapiens
gtggaacactaaagagcta

SEQ ID NO: 338976 - DNA, 22 bp, Homo sapiens
gtggaaccaaaacccatcgtgg

SEQ ID NO: 338977 - DNA, 23 bp, Homo sapiens
gtggaactctcctgctcctcagg

SEQ ID NO: 338978 - DNA, 13 bp, Homo sapiens
gtggaagagcagc

SEQ ID NO: 338979 - DNA, 16 bp, Homo sapiens
gtggaagagcagcctg

SEQ ID NO: 338980 - DNA, 17 bp, Homo sapiens
gtggaagagcagcctga

SEQ ID NO: 338981 - DNA, 22 bp, Homo sapiens
gtggaagcaggttgcttcaaga

SEQ ID NO: 338982 - DNA, 15 bp, Homo sapiens
gtggaagccactgga

SEQ ID NO: 338983 - DNA, 16 bp, Homo sapiens
gtggaaggagcctgcg

SEQ ID NO: 338984 - DNA, 18 bp, Homo sapiens
gtggaaggagcctgcggc

SEQ ID NO: 338985 - DNA, 23 bp, Homo sapiens
gtggaattacctgataagggaga

SEQ ID NO: 338986 - DNA, 19 bp, Homo sapiens
gtggacacctgccctgccc

SEQ ID NO: 338987 - DNA, 12 bp, Homo sapiens
gtggacagggcc

SEQ ID NO: 338988 - DNA, 13 bp, Homo sapiens
gtggacgagggag

SEQ ID NO: 338989 - DNA, 17 bp, Homo sapiens
gtggactctgtgctcac

SEQ ID NO: 338990 - DNA, 14 bp, Homo sapiens
gtggactcttccct

SEQ ID NO: 338991 - DNA, 18 bp, Homo sapiens
gtggactgggaagcatta

SEQ ID NO: 338992 - DNA, 9 bp, Homo sapiens
gtggacttt

SEQ ID NO: 338993 - DNA, 12 bp, Homo sapiens
gtggagagacca

SEQ ID NO: 338994 - DNA, 14 bp, Homo sapiens
gtggagagcccggc

SEQ ID NO: 338995 - DNA, 23 bp, Homo sapiens
gtggagagtgagaataattgtgt

SEQ ID NO: 338996 - DNA, 17 bp, Homo sapiens
gtggagatagtgccagg

SEQ ID NO: 338997 - DNA, 19 bp, Homo sapiens
gtggagatgtcttcgtaca

SEQ ID NO: 338998 - DNA, 14 bp, Homo sapiens
gtggagcaaaaggc

SEQ ID NO: 338999 - DNA, 18 bp, Homo sapiens
gtggagcaaaaggcagct

SEQ ID NO: 339000 - DNA, 21 bp, Homo sapiens
gtggagcacaaaagcctctca

SEQ ID NO: 339001 - DNA, 13 bp, Homo sapiens
gtggagccacagg

SEQ ID NO: 339002 - DNA, 19 bp, Homo sapiens
gtggagccacaggcagacg

SEQ ID NO: 339003 - DNA, 20 bp, Homo sapiens
gtggagccacaggcagacga

SEQ ID NO: 339004 - DNA, 13 bp, Homo sapiens
gtggagctgcttc

SEQ ID NO: 339005 - DNA, 23 bp, Homo sapiens
gtggaggaatgctcccccatcct

SEQ ID NO: 339006 - DNA, 17 bp, Homo sapiens
gtggaggagtccaggcc

SEQ ID NO: 339007 - DNA, 13 bp, Homo sapiens
gtggaggcagcca

SEQ ID NO: 339008 - DNA, 15 bp, Homo sapiens
gtggaggcagccagg

SEQ ID NO: 339009 - DNA, 11 bp, Homo sapiens
ttgcttctcaa

SEQ ID NO: 339010 - DNA, 23 bp, Homo sapiens
ttgcttctggctttgttcttgtc

SEQ ID NO: 339011 - DNA, 19 bp, Homo sapiens
ttgcttctgggaaggggtt

SEQ ID NO: 339012 - DNA, 12 bp, Homo sapiens
ttgcttctgtag

SEQ ID NO: 339013 - DNA, 21 bp, Homo sapiens
ttgcttctgtagtactcctta

SEQ ID NO: 339014 - DNA, 14 bp, Homo sapiens
ttgcttcttgtgtt

SEQ ID NO: 339015 - DNA, 17 bp, Homo sapiens
ttgcttgcgtgctggga

SEQ ID NO: 339016 - DNA, 23 bp, Homo sapiens
ttgcttgggccactgccctctcc

SEQ ID NO: 339017 - DNA, 16 bp, Homo sapiens
ttgcttgggttccttt

SEQ ID NO: 339018 - DNA, 23 bp, Homo sapiens
ttgctttaaagtacctgtagtga

SEQ ID NO: 339019 - DNA, 15 bp, Homo sapiens
ttgctttagagacag

SEQ ID NO: 339020 - DNA, 20 bp, Homo sapiens
ttgctttatgccttcttatt

SEQ ID NO: 339021 - DNA, 12 bp, Homo sapiens
ttgctttcaatt

SEQ ID NO: 339022 - DNA, 16 bp, Homo sapiens
ttgctttggatacaca

SEQ ID NO: 339023 - DNA, 20 bp, Homo sapiens
ttgctttgggctttgcaggc

SEQ ID NO: 339024 - DNA, 13 bp, Homo sapiens
ttgctttgtatgc

SEQ ID NO: 339025 - DNA, 16 bp, Homo sapiens
ttgctttgtatgcact

SEQ ID NO: 339026 - DNA, 13 bp, Homo sapiens
ttgcttttatcca

SEQ ID NO: 339027 - DNA, 20 bp, Homo sapiens
ttggaaaagaaatcaatttt

SEQ ID NO: 339028 - DNA, 18 bp, Homo sapiens
ttggaaacctgccctgcc

SEQ ID NO: 339029 - DNA, 17 bp, Homo sapiens
gtggggtctcagtccag

SEQ ID NO: 339030 - DNA, 15 bp, Homo sapiens
gtggggtgaagctgg

SEQ ID NO: 339031 - DNA, 13 bp, Homo sapiens
gtggggtgcctga

SEQ ID NO: 339032 - DNA, 14 bp, Homo sapiens
gtggggtgcctgag

SEQ ID NO: 339033 - DNA, 19 bp, Homo sapiens
gtggggtgcctgagcccga

SEQ ID NO: 339034 - DNA, 17 bp, Homo sapiens
gtgggtatcccacctcc

SEQ ID NO: 339035 - DNA, 20 bp, Homo sapiens
gtgggtattcaccaccctgg

SEQ ID NO: 339036 - DNA, 20 bp, Homo sapiens
gtgggtatttcttatttgaa

SEQ ID NO: 339037 - DNA, 13 bp, Homo sapiens
gtgggtcagtgtg

SEQ ID NO: 339038 - DNA, 19 bp, Homo sapiens
gtgggtcagtgtgccaccc

SEQ ID NO: 339039 - DNA, 12 bp, Homo sapiens
gtgggtccagga

SEQ ID NO: 339040 - DNA, 13 bp, Homo sapiens
gtgggtcttcagg

SEQ ID NO: 339041 - DNA, 15 bp, Homo sapiens
gtgggtggagtcagg

SEQ ID NO: 339042 - DNA, 16 bp, Homo sapiens
gtgggttccagggact

SEQ ID NO: 339043 - DNA, 17 bp, Homo sapiens
gtgggttgtgatattga

SEQ ID NO: 339044 - DNA, 17 bp, Homo sapiens
gtgggtttctctgtgct

SEQ ID NO: 339045 - DNA, 18 bp, Homo sapiens
gtggtaacaagaggagca

SEQ ID NO: 339046 - DNA, 20 bp, Homo sapiens
gtggtaacaagaggagcagg

SEQ ID NO: 339047 - DNA, 13 bp, Homo sapiens
gtggtaactgcca

SEQ ID NO: 339048 - DNA, 14 bp, Homo sapiens
gtggtacaggaagg

SEQ ID NO: 339049 - DNA, 20 bp, Homo sapiens
gtggtaccctggcagagaag

SEQ ID NO: 339050 - DNA, 22 bp, Homo sapiens
gtggtaccctggcagagaagag

SEQ ID NO: 339051 - DNA, 17 bp, Homo sapiens
gtggtagctctgagccc

SEQ ID NO: 339052 - DNA, 13 bp, Homo sapiens
gtggtatgtgaat

SEQ ID NO: 339053 - DNA, 23 bp, Homo sapiens
gtggtattggccgatgagctggt

SEQ ID NO: 339054 - DNA, 23 bp, Homo sapiens
gtggtcagcagaaacccccagga

SEQ ID NO: 339055 - DNA, 18 bp, Homo sapiens
gtggtcagggcagggctc

SEQ ID NO: 339056 - DNA, 23 bp, Homo sapiens
gtggtcatgaattcatactctgt

SEQ ID NO: 339057 - DNA, 21 bp, Homo sapiens
gtggtcccgaggaagggccag

SEQ ID NO: 339058 - DNA, 14 bp, Homo sapiens
gtggtccttaggct

SEQ ID NO: 339059 - DNA, 15 bp, Homo sapiens
gtggtctcctctcag

SEQ ID NO: 339060 - DNA, 13 bp, Homo sapiens
gtggtctgaatgt

SEQ ID NO: 339061 - DNA, 17 bp, Homo sapiens
gtggtctgaatgttctg

SEQ ID NO: 339062 - DNA, 20 bp, Homo sapiens
gtggtctgaatgttctgaca

SEQ ID NO: 339063 - DNA, 18 bp, Homo sapiens
gtggtcttggagaggagg

SEQ ID NO: 339064 - DNA, 18 bp, Homo sapiens
gtggtgaggggccactgg

SEQ ID NO: 339065 - DNA, 20 bp, Homo sapiens
gtggtgaggggccactgggc

SEQ ID NO: 339066 - DNA, 15 bp, Homo sapiens
gtggtgcagtaacca

SEQ ID NO: 339067 - DNA, 22 bp, Homo sapiens
gtggtggccgtcacgctttcat

SEQ ID NO: 339068 - DNA, 14 bp, Homo sapiens
gtggtgtgaggccc

SEQ ID NO: 339069 - DNA, 20 bp, Homo sapiens
gtggttcagagactggcagc

SEQ ID NO: 339070 - DNA, 19 bp, Homo sapiens
gtggttctacaatctattt

SEQ ID NO: 339071 - DNA, 13 bp, Homo sapiens
gtggttggaggcc

SEQ ID NO: 339072 - DNA, 15 bp, Homo sapiens
gtggttggaggcctg

SEQ ID NO: 339073 - DNA, 22 bp, Homo sapiens
gtggttgttgccaactaagccc

SEQ ID NO: 339074 - DNA, 16 bp, Homo sapiens
gtggtttataatctga

SEQ ID NO: 339075 - DNA, 14 bp, Homo sapiens
gtggttttctgttt

SEQ ID NO: 339076 - DNA, 17 bp, Homo sapiens
gtggttttctgtttcta

SEQ ID NO: 339077 - DNA, 22 bp, Homo sapiens
gtgtaaattatgtaatgcaaaa

SEQ ID NO: 339078 - DNA, 12 bp, Homo sapiens
gtgtaacagctg

SEQ ID NO: 339079 - DNA, 14 bp, Homo sapiens
gtgtaatattactt

SEQ ID NO: 339080 - DNA, 19 bp, Homo sapiens
gtgtaatcatttcttgggc

SEQ ID NO: 339081 - DNA, 23 bp, Homo sapiens
gtgtaatcatttcttgggccctc

SEQ ID NO: 339082 - DNA, 16 bp, Homo sapiens
gtgtaatctctgatta

SEQ ID NO: 339083 - DNA, 13 bp, Homo sapiens
gtgtacaaagtag

SEQ ID NO: 339084 - DNA, 13 bp, Homo sapiens
gtgtacagtatgt

SEQ ID NO: 339085 - DNA, 15 bp, Homo sapiens
gtgtacagtatgtgt

SEQ ID NO: 339086 - DNA, 14 bp, Homo sapiens
gtgtacatcatgtt

SEQ ID NO: 339087 - DNA, 17 bp, Homo sapiens
gtgtacatttatgtgtg

SEQ ID NO: 339088 - DNA, 19 bp, Homo sapiens
gtgtactgggttaatggct

SEQ ID NO: 339089 - DNA, 14 bp, Homo sapiens
gtgtactgtaaaga

SEQ ID NO: 339090 - DNA, 23 bp, Homo sapiens
gtgtagactggccatgcaagtgg

SEQ ID NO: 339091 - DNA, 20 bp, Homo sapiens
gtgtagtggaagagcagcct

SEQ ID NO: 339092 - DNA, 12 bp, Homo sapiens
gtgtataaaaat

SEQ ID NO: 339093 - DNA, 14 bp, Homo sapiens
gtgtatagtgccta

SEQ ID NO: 339094 - DNA, 23 bp, Homo sapiens
gtgtatatccttccaaaaaatta

SEQ ID NO: 339095 - DNA, 13 bp, Homo sapiens
gtgtatcctgggg

SEQ ID NO: 339096 - DNA, 16 bp, Homo sapiens
gtgtatgactaaagag

SEQ ID NO: 339097 - DNA, 21 bp, Homo sapiens
gtgtatgagaagtactttgtg

SEQ ID NO: 339098 - DNA, 22 bp, Homo sapiens
gtgtatgtttgcacacttgtgt

SEQ ID NO: 339099 - DNA, 19 bp, Homo sapiens
gtgtattctagttttgtca

SEQ ID NO: 339100 - DNA, 16 bp, Homo sapiens
gtgtcaactttcattt

SEQ ID NO: 339101 - DNA, 23 bp, Homo sapiens
gtgtcaagttgtgcttgtttaca

SEQ ID NO: 339102 - DNA, 14 bp, Homo sapiens
gtgtcaccctgcag

SEQ ID NO: 339103 - DNA, 17 bp, Homo sapiens
gtgtcaccctgcagagc

SEQ ID NO: 339104 - DNA, 16 bp, Homo sapiens
gtgtcactctgcctct

SEQ ID NO: 339105 - DNA, 22 bp, Homo sapiens
gtgtcactctgcctctaaggcc

SEQ ID NO: 339106 - DNA, 15 bp, Homo sapiens
gtgtcacttttttcc

SEQ ID NO: 339107 - DNA, 18 bp, Homo sapiens
gtgtcataccaggccgcc

SEQ ID NO: 339108 - DNA, 23 bp, Homo sapiens
gtgtcatatatggggggccaaca

SEQ ID NO: 339109 - DNA, 17 bp, Homo sapiens
gtgtcatggtgatgcaa

SEQ ID NO: 339110 - DNA, 19 bp, Homo sapiens
gtgtcatggtgatgcaagt

SEQ ID NO: 339111 - DNA, 18 bp, Homo sapiens
gtgtcatttatgaaaaga

SEQ ID NO: 339112 - DNA, 17 bp, Homo sapiens
gtgtccaagtgtgtgtg

SEQ ID NO: 339113 - DNA, 22 bp, Homo sapiens
gtgtccagagacatgggcctcc

SEQ ID NO: 339114 - DNA, 19 bp, Homo sapiens
gtgtccagcagctgcgggt

SEQ ID NO: 339115 - DNA, 15 bp, Homo sapiens
gtgtcccaaggagct

SEQ ID NO: 339116 - DNA, 21 bp, Homo sapiens
gtgtccccaacgtcccctccg

SEQ ID NO: 339117 - DNA, 20 bp, Homo sapiens
gtgtccccccaggtgctgga

SEQ ID NO: 339118 - DNA, 23 bp, Homo sapiens
gtgtccccttcccctgctgacct

SEQ ID NO: 339119 - DNA, 18 bp, Homo sapiens
gtgtccctctctctggaa

SEQ ID NO: 339120 - DNA, 18 bp, Homo sapiens
gtgtccctgtggtaccct

SEQ ID NO: 339121 - DNA, 21 bp, Homo sapiens
gtgtccctgtggtaccctggc

SEQ ID NO: 339122 - DNA, 21 bp, Homo sapiens
gtgtccgctgctgctttcctt

SEQ ID NO: 339123 - DNA, 14 bp, Homo sapiens
gtgtcctcatctat

SEQ ID NO: 339124 - DNA, 20 bp, Homo sapiens
gtgtcctgtgctttctgcat

SEQ ID NO: 339125 - DNA, 14 bp, Homo sapiens
gtgtccttcttcct

SEQ ID NO: 339126 - DNA, 17 bp, Homo sapiens
gtgtcgccgtccctctg

SEQ ID NO: 339127 - DNA, 14 bp, Homo sapiens
gtgtctattccctg

SEQ ID NO: 339128 - DNA, 16 bp, Homo sapiens
gtgtctcactctttct

SEQ ID NO: 339129 - DNA, 19 bp, Homo sapiens
gtgtctcactctttcttct

SEQ ID NO: 339130 - DNA, 22 bp, Homo sapiens
gtgtctcagtccacctgagctg

SEQ ID NO: 339131 - DNA, 17 bp, Homo sapiens
gtgtctcccttcatcct

SEQ ID NO: 339132 - DNA, 16 bp, Homo sapiens
gtgtctcctgcatgca

SEQ ID NO: 339133 - DNA, 23 bp, Homo sapiens
gtgtctcctgcatgcagaaaggg

SEQ ID NO: 339134 - DNA, 21 bp, Homo sapiens
gtgtctcggagggattcccct

SEQ ID NO: 339135 - DNA, 18 bp, Homo sapiens
gtgtctcttttctctttc

SEQ ID NO: 339136 - DNA, 19 bp, Homo sapiens
gtgtctcttttctctttct

SEQ ID NO: 339137 - DNA, 17 bp, Homo sapiens
gtgtctgcagtcctggt

SEQ ID NO: 339138 - DNA, 18 bp, Homo sapiens
gtgtctgcagtcctggtg

SEQ ID NO: 339139 - DNA, 20 bp, Homo sapiens
ttgtagtagttgatgaccaa

SEQ ID NO: 339140 - DNA, 18 bp, Homo sapiens
ttgtagtttttgctgaag

SEQ ID NO: 339141 - DNA, 17 bp, Homo sapiens
ttgtatagagatatgca

SEQ ID NO: 339142 - DNA, 20 bp, Homo sapiens
ttgtataggccatctgtaaa

SEQ ID NO: 339143 - DNA, 16 bp, Homo sapiens
ttgtatataaatggtg

SEQ ID NO: 339144 - DNA, 21 bp, Homo sapiens
ttgtatatatgtgtgtttaaa

SEQ ID NO: 339145 - DNA, 20 bp, Homo sapiens
ttgtatctctgaagcatgtt

SEQ ID NO: 339146 - DNA, 18 bp, Homo sapiens
ttgtatctttaaagactt

SEQ ID NO: 339147 - DNA, 12 bp, Homo sapiens
ttgtatgaaaat

SEQ ID NO: 339148 - DNA, 13 bp, Homo sapiens
ttgtatgatgtat

SEQ ID NO: 339149 - DNA, 16 bp, Homo sapiens
ttgtatgatgtgttgt

SEQ ID NO: 339150 - DNA, 21 bp, Homo sapiens
ttgtatgatgtgttgtgatag

SEQ ID NO: 339151 - DNA, 16 bp, Homo sapiens
ttgtattaaagacaga

SEQ ID NO: 339152 - DNA, 15 bp, Homo sapiens
ttgtattatcagtga

SEQ ID NO: 339153 - DNA, 22 bp, Homo sapiens
ttgtattatcagtgaatataaa

SEQ ID NO: 339154 - DNA, 13 bp, Homo sapiens
ttgtattatttgg

SEQ ID NO: 339155 - DNA, 12 bp, Homo sapiens
ttgtattgccat

SEQ ID NO: 339156 - DNA, 15 bp, Homo sapiens
ttgtatttctatatt

SEQ ID NO: 339157 - DNA, 20 bp, Homo sapiens
ttgtatttcttttatatata

SEQ ID NO: 339158 - DNA, 14 bp, Homo sapiens
ttgtattttaactc

SEQ ID NO: 339159 - DNA, 23 bp, Homo sapiens
ttgtattttcttcccatttgtaa

SEQ ID NO: 339160 - DNA, 18 bp, Homo sapiens
ttgtatttttgaataaaa

SEQ ID NO: 339161 - DNA, 13 bp, Homo sapiens
ttgtcaaatgtca

SEQ ID NO: 339162 - DNA, 16 bp, Homo sapiens
ttgtcaacttcagttg

SEQ ID NO: 339163 - DNA, 19 bp, Homo sapiens
ttgtcaatagtattaacta

SEQ ID NO: 339164 - DNA, 17 bp, Homo sapiens
ttgtcaatggaagaaac

SEQ ID NO: 339165 - DNA, 16 bp, Homo sapiens
ttgtcacatcagataa

SEQ ID NO: 339166 - DNA, 19 bp, Homo sapiens
ttgtcacctagcagatatg

SEQ ID NO: 339167 - DNA, 13 bp, Homo sapiens
ttgtcacttctgc

SEQ ID NO: 339168 - DNA, 14 bp, Homo sapiens
ttgtcacttctgct

SEQ ID NO: 339169 - DNA, 21 bp, Homo sapiens
ttgtcacttctgctgtacaga

SEQ ID NO: 339170 - DNA, 12 bp, Homo sapiens
ttgtcagacttt

SEQ ID NO: 339171 - DNA, 14 bp, Homo sapiens
ttgtcagactttaa

SEQ ID NO: 339172 - DNA, 23 bp, Homo sapiens
ttgtcatccacacaacaccagga

SEQ ID NO: 339173 - DNA, 23 bp, Homo sapiens
ttgtcatggaaaatgtcctgtgg

SEQ ID NO: 339174 - DNA, 13 bp, Homo sapiens
gttacttccttcc

SEQ ID NO: 339175 - DNA, 18 bp, Homo sapiens
gttacttgtctgaggcct

SEQ ID NO: 339176 - DNA, 23 bp, Homo sapiens
gttacttgtctgaggcctcatcc

SEQ ID NO: 339177 - DNA, 20 bp, Homo sapiens
gttagagaggtagcgagctg

SEQ ID NO: 339178 - DNA, 21 bp, Homo sapiens
gttagagaggtagcgagctgc

SEQ ID NO: 339179 - DNA, 11 bp, Homo sapiens
gttagatgctg

SEQ ID NO: 339180 - DNA, 20 bp, Homo sapiens
gttagatgctgaatatctgt

SEQ ID NO: 339181 - DNA, 23 bp, Homo sapiens
gttagattcctcttgcctctctc

SEQ ID NO: 339182 - DNA, 14 bp, Homo sapiens
gttagcaggaaata

SEQ ID NO: 339183 - DNA, 13 bp, Homo sapiens
gttagcccggcca

SEQ ID NO: 339184 - DNA, 13 bp, Homo sapiens
gttagccctcagt

SEQ ID NO: 339185 - DNA, 15 bp, Homo sapiens
gttagccctcagtca

SEQ ID NO: 339186 - DNA, 11 bp, Homo sapiens
gttagcctggt

SEQ ID NO: 339187 - DNA, 23 bp, Homo sapiens
gttagctcagccccagcccagcc

SEQ ID NO: 339188 - DNA, 12 bp, Homo sapiens
gttagctggaca

SEQ ID NO: 339189 - DNA, 14 bp, Homo sapiens
gttagctgggaaga

SEQ ID NO: 339190 - DNA, 18 bp, Homo sapiens
gttaggaaataaaacctt

SEQ ID NO: 339191 - DNA, 19 bp, Homo sapiens
gttaggaaataaaaccttt

SEQ ID NO: 339192 - DNA, 22 bp, Homo sapiens
gttaggaaataaaacctttcaa

SEQ ID NO: 339193 - DNA, 23 bp, Homo sapiens
gttaggaaataaaacctttcaaa

SEQ ID NO: 339194 - DNA, 17 bp, Homo sapiens
gttaggaataacactgc

SEQ ID NO: 339195 - DNA, 18 bp, Homo sapiens
gttaggaataacactgca

SEQ ID NO: 339196 - DNA, 16 bp, Homo sapiens
gttaggctgggcccag

SEQ ID NO: 339197 - DNA, 18 bp, Homo sapiens
gttaggctgggcccagag

SEQ ID NO: 339198 - DNA, 17 bp, Homo sapiens
gttaggggaaaatagta

SEQ ID NO: 339199 - DNA, 21 bp, Homo sapiens
gttaggtagagggagttgtca

SEQ ID NO: 339200 - DNA, 13 bp, Homo sapiens
gttagtagaaatt

SEQ ID NO: 339201 - DNA, 16 bp, Homo sapiens
gttagtagcatgttga

SEQ ID NO: 339202 - DNA, 15 bp, Homo sapiens
gttagtgatttgcta

SEQ ID NO: 339203 - DNA, 17 bp, Homo sapiens
gttagtgatttgctatc

SEQ ID NO: 339204 - DNA, 18 bp, Homo sapiens
gttagtgatttgctatca

SEQ ID NO: 339205 - DNA, 21 bp, Homo sapiens
gttagtgggaagagctgggtt

SEQ ID NO: 339206 - DNA, 16 bp, Homo sapiens
gttataccagcaaaag

SEQ ID NO: 339207 - DNA, 19 bp, Homo sapiens
gttatactgtcggtttttt

SEQ ID NO: 339208 - DNA, 23 bp, Homo sapiens
gttatagaatacttttttctagt

SEQ ID NO: 339209 - DNA, 16 bp, Homo sapiens
gttatagtatatctgg

SEQ ID NO: 339210 - DNA, 16 bp, Homo sapiens
gttatagttgatatgt

SEQ ID NO: 339211 - DNA, 18 bp, Homo sapiens
gttatatcagcagacact

SEQ ID NO: 339212 - DNA, 19 bp, Homo sapiens
gttatccaactattaagat

SEQ ID NO: 339213 - DNA, 17 bp, Homo sapiens
gttatcctgtgctacag

SEQ ID NO: 339214 - DNA, 17 bp, Homo sapiens
gttatctgcctggcctg

SEQ ID NO: 339215 - DNA, 20 bp, Homo sapiens
gttatctgcctggcctggct

SEQ ID NO: 339216 - DNA, 18 bp, Homo sapiens
gttatctgtctttatgat

SEQ ID NO: 339217 - DNA, 19 bp, Homo sapiens
gttatctgtctttatgatt

SEQ ID NO: 339218 - DNA, 21 bp, Homo sapiens
gttatcttacgctatttctgt

SEQ ID NO: 339219 - DNA, 11 bp, Homo sapiens
gttatgactcc

SEQ ID NO: 339220 - DNA, 21 bp, Homo sapiens
gttatgactccagaatttccc

SEQ ID NO: 339221 - DNA, 17 bp, Homo sapiens
gttatgagaaaaaaaca

SEQ ID NO: 339222 - DNA, 16 bp, Homo sapiens
gttatgcactttaaat

SEQ ID NO: 339223 - DNA, 19 bp, Homo sapiens
gttatgccaaacagttgta

SEQ ID NO: 339224 - DNA, 20 bp, Homo sapiens
gttatgccaaacagttgtac

SEQ ID NO: 339225 - DNA, 21 bp, Homo sapiens
gttatggcaagtttttggtaa

SEQ ID NO: 339226 - DNA, 12 bp, Homo sapiens
gttatgttgtgt

SEQ ID NO: 339227 - DNA, 13 bp, Homo sapiens
gttattaaatgat

SEQ ID NO: 339228 - DNA, 20 bp, Homo sapiens
gttattaatagccatttgaa

SEQ ID NO: 339229 - DNA, 21 bp, Homo sapiens
gttattagaacttagttttgt

SEQ ID NO: 339230 - DNA, 20 bp, Homo sapiens
gttattatgtagctgaaaca

SEQ ID NO: 339231 - DNA, 23 bp, Homo sapiens
gttattattggcttgcactttgt

SEQ ID NO: 339232 - DNA, 20 bp, Homo sapiens
gttattcactctcccagagg

SEQ ID NO: 339233 - DNA, 23 bp, Homo sapiens
gttattcattctgtgatcattta

SEQ ID NO: 339234 - DNA, 17 bp, Homo sapiens
gttattcttttattaat

SEQ ID NO: 339235 - DNA, 22 bp, Homo sapiens
gttattcttttccagaaagaaa

SEQ ID NO: 339236 - DNA, 22 bp, Homo sapiens
gttattggaagctgattcccag

SEQ ID NO: 339237 - DNA, 20 bp, Homo sapiens
gttattgggcaagtgattga

SEQ ID NO: 339238 - DNA, 12 bp, Homo sapiens
gttattgtggaa

SEQ ID NO: 339239 - DNA, 13 bp, Homo sapiens
gttatttgtacag

SEQ ID NO: 339240 - DNA, 20 bp, Homo sapiens
gttatttgtacagttcagtt

SEQ ID NO: 339241 - DNA, 24 bp, Homo sapiens
gttattttaatacctttaaatatc

SEQ ID NO: 339242 - DNA, 19 bp, Homo sapiens
gttatttttgtctcgaaat

SEQ ID NO: 339243 - DNA, 21 bp, Homo sapiens
gttattttttaattattattt

SEQ ID NO: 339244 - DNA, 21 bp, Homo sapiens
gttcaaaatgttaataaaggt

SEQ ID NO: 339245 - DNA, 19 bp, Homo sapiens
gttcaaactactgtacatt

SEQ ID NO: 339246 - DNA, 18 bp, Homo sapiens
gttcaaagaacccccctc

SEQ ID NO: 339247 - DNA, 21 bp, Homo sapiens
gttcaaagaacccccctcccc

SEQ ID NO: 339248 - DNA, 19 bp, Homo sapiens
gttcaaagaaccctagcac

SEQ ID NO: 339249 - DNA, 21 bp, Homo sapiens
gttcaacaagagtaaatattg

SEQ ID NO: 339250 - DNA, 19 bp, Homo sapiens
gttcaagcttttcctttct

SEQ ID NO: 339251 - DNA, 18 bp, Homo sapiens
gttcaataataaatattt

SEQ ID NO: 339252 - DNA, 21 bp, Homo sapiens
gttcaatctgtgaagccttta

SEQ ID NO: 339253 - DNA, 10 bp, Homo sapiens
gttcaatgat

SEQ ID NO: 339254 - DNA, 14 bp, Homo sapiens
gttcaatgatctag

SEQ ID NO: 339255 - DNA, 18 bp, Homo sapiens
gttcaatgctacaaaatg

SEQ ID NO: 339256 - DNA, 21 bp, Homo sapiens
gttcaatgctacaaaatgtgt

SEQ ID NO: 339257 - DNA, 24 bp, Homo sapiens
gttcaatgctacaaaatgtgtgct

SEQ ID NO: 339258 - DNA, 18 bp, Homo sapiens
gttcaattggacaattat

SEQ ID NO: 339259 - DNA, 17 bp, Homo sapiens
gttcacaccctgcaagg

SEQ ID NO: 339260 - DNA, 17 bp, Homo sapiens
gttcacagtagagtagg

SEQ ID NO: 339261 - DNA, 18 bp, Homo sapiens
gttcacagtagagtaggg

SEQ ID NO: 339262 - DNA, 12 bp, Homo sapiens
gttcacccctcc

SEQ ID NO: 339263 - DNA, 16 bp, Homo sapiens
gttcacccctccaccc

SEQ ID NO: 339264 - DNA, 18 bp, Homo sapiens
gttcacgtaagatacaag

SEQ ID NO: 339265 - DNA, 21 bp, Homo sapiens
gttcacttcctagagcatctg

SEQ ID NO: 339266 - DNA, 16 bp, Homo sapiens
gttcagagactggcag

SEQ ID NO: 339267 - DNA, 18 bp, Homo sapiens
gttcagagactggcagcc

SEQ ID NO: 339268 - DNA, 20 bp, Homo sapiens
accccatccagccaggggtg

SEQ ID NO: 339269 - DNA, 15 bp, Homo sapiens
accccatctctcttc

SEQ ID NO: 339270 - DNA, 16 bp, Homo sapiens
accccatctctgctgc

SEQ ID NO: 339271 - DNA, 22 bp, Homo sapiens
accccatctctgctgcttctgg

SEQ ID NO: 339272 - DNA, 14 bp, Homo sapiens
accccatgggcttg

SEQ ID NO: 339273 - DNA, 16 bp, Homo sapiens
acccccaaattttctt

SEQ ID NO: 339274 - DNA, 15 bp, Homo sapiens
acccccaacaccacc

SEQ ID NO: 339275 - DNA, 17 bp, Homo sapiens
acccccaacttcaccac

SEQ ID NO: 339276 - DNA, 21 bp, Homo sapiens
acccccaattaaacccagaac

SEQ ID NO: 339277 - DNA, 15 bp, Homo sapiens
acccccacacctcag

SEQ ID NO: 339278 - DNA, 17 bp, Homo sapiens
acccccacacctcagtt

SEQ ID NO: 339279 - DNA, 12 bp, Homo sapiens
acccccacccac

SEQ ID NO: 339280 - DNA, 15 bp, Homo sapiens
acccccacccacctc

SEQ ID NO: 339281 - DNA, 18 bp, Homo sapiens
acccccacccacctccac

SEQ ID NO: 339282 - DNA, 14 bp, Homo sapiens
acccccaccccaca

SEQ ID NO: 339283 - DNA, 15 bp, Homo sapiens
acccccaccccacac

SEQ ID NO: 339284 - DNA, 16 bp, Homo sapiens
acccccaccccacact

SEQ ID NO: 339285 - DNA, 14 bp, Homo sapiens
acccccaccccttc

SEQ ID NO: 339286 - DNA, 19 bp, Homo sapiens
acccccacccgttaattta

SEQ ID NO: 339287 - DNA, 11 bp, Homo sapiens
acccccagcaa

SEQ ID NO: 339288 - DNA, 13 bp, Homo sapiens
acccccagcaacc

SEQ ID NO: 339289 - DNA, 16 bp, Homo sapiens
acccccagcaaccctc

SEQ ID NO: 339290 - DNA, 13 bp, Homo sapiens
acccccagcctcc

SEQ ID NO: 339291 - DNA, 18 bp, Homo sapiens
acccccagcctcccccag

SEQ ID NO: 339292 - DNA, 17 bp, Homo sapiens
acccccagtgtattttg

SEQ ID NO: 339293 - DNA, 17 bp, Homo sapiens
acccccatgctgccttc

SEQ ID NO: 339294 - DNA, 18 bp, Homo sapiens
acccccatttctatttat

SEQ ID NO: 339295 - DNA, 14 bp, Homo sapiens
accccccactccct

SEQ ID NO: 339296 - DNA, 20 bp, Homo sapiens
accccccactccctgccacc

SEQ ID NO: 339297 - DNA, 22 bp, Homo sapiens
accccccccccccccgcccacc

SEQ ID NO: 339298 - DNA, 13 bp, Homo sapiens
acccccctcccag

SEQ ID NO: 339299 - DNA, 14 bp, Homo sapiens
acccccgccacggc

SEQ ID NO: 339300 - DNA, 19 bp, Homo sapiens
acccccgccacggccaccc

SEQ ID NO: 339301 - DNA, 23 bp, Homo sapiens
acccccgccacggccaccctcct

SEQ ID NO: 339302 - DNA, 15 bp, Homo sapiens
accccctccccgccc

SEQ ID NO: 339303 - DNA, 21 bp, Homo sapiens
accccctccccgcccttcttt

SEQ ID NO: 339304 - DNA, 16 bp, Homo sapiens
accccctccctggcct

SEQ ID NO: 339305 - DNA, 17 bp, Homo sapiens
accccctccctggcctg

SEQ ID NO: 339306 - DNA, 20 bp, Homo sapiens
accccctccctggcctgttc

SEQ ID NO: 339307 - DNA, 16 bp, Homo sapiens
accccctcggagcctg

SEQ ID NO: 339308 - DNA, 14 bp, Homo sapiens
accccctgccccag

SEQ ID NO: 339309 - DNA, 22 bp, Homo sapiens
accccctgtcccattctagatc

SEQ ID NO: 339310 - DNA, 17 bp, Homo sapiens
acccccttctctgctcc

SEQ ID NO: 339311 - DNA, 18 bp, Homo sapiens
acccccttctctgctcca

SEQ ID NO: 339312 - DNA, 19 bp, Homo sapiens
acccccttctctgctccac

SEQ ID NO: 339313 - DNA, 20 bp, Homo sapiens
acccccttctctgctccacc

SEQ ID NO: 339314 - DNA, 23 bp, Homo sapiens
acccccttctctgctccaccaca

SEQ ID NO: 339315 - DNA, 17 bp, Homo sapiens
accccgatgtggacctc

SEQ ID NO: 339316 - DNA, 12 bp, Homo sapiens
accccgcagccc

SEQ ID NO: 339317 - DNA, 14 bp, Homo sapiens
accccgcagcccgt

SEQ ID NO: 339318 - DNA, 15 bp, Homo sapiens
accccgcagcccgtg

SEQ ID NO: 339319 - DNA, 21 bp, Homo sapiens
gttgagcttcatataccagca

SEQ ID NO: 339320 - DNA, 21 bp, Homo sapiens
gttgaggggcttccctctgct

SEQ ID NO: 339321 - DNA, 16 bp, Homo sapiens
gttgaggtggtctgaa

SEQ ID NO: 339322 - DNA, 23 bp, Homo sapiens
gttgaggtggtctgaatgttctg

SEQ ID NO: 339323 - DNA, 16 bp, Homo sapiens
gttgagttggacacac

SEQ ID NO: 339324 - DNA, 23 bp, Homo sapiens
gttgagtttcttctaaagaggaa

SEQ ID NO: 339325 - DNA, 14 bp, Homo sapiens
gttgagtttgctgt

SEQ ID NO: 339326 - DNA, 16 bp, Homo sapiens
gttgatatattctttc

SEQ ID NO: 339327 - DNA, 22 bp, Homo sapiens
gttgatatattctttccatgca

SEQ ID NO: 339328 - DNA, 23 bp, Homo sapiens
gttgatatattctttccatgcag

SEQ ID NO: 339329 - DNA, 20 bp, Homo sapiens
gttgatatttcgaaagctgc

SEQ ID NO: 339330 - DNA, 14 bp, Homo sapiens
gttgatctcctggt

SEQ ID NO: 339331 - DNA, 12 bp, Homo sapiens
gttgatgaccaa

SEQ ID NO: 339332 - DNA, 13 bp, Homo sapiens
gttgatgaccaat

SEQ ID NO: 339333 - DNA, 17 bp, Homo sapiens
gttgatgggttctaatt

SEQ ID NO: 339334 - DNA, 17 bp, Homo sapiens
gttgcaaattccacccc

SEQ ID NO: 339335 - DNA, 14 bp, Homo sapiens
gttgcaaccactgc

SEQ ID NO: 339336 - DNA, 19 bp, Homo sapiens
gttgcacttggcctctgga

SEQ ID NO: 339337 - DNA, 15 bp, Homo sapiens
gttgcagcctgacca

SEQ ID NO: 339338 - DNA, 12 bp, Homo sapiens
gttgcagctgct

SEQ ID NO: 339339 - DNA, 13 bp, Homo sapiens
gttgccaaagctg

SEQ ID NO: 339340 - DNA, 20 bp, Homo sapiens
gttgccaaatatgtcctggg

SEQ ID NO: 339341 - DNA, 19 bp, Homo sapiens
gttgccaactaagccctcg

SEQ ID NO: 339342 - DNA, 22 bp, Homo sapiens
gttgccaagaactgaaaacata

SEQ ID NO: 339343 - DNA, 11 bp, Homo sapiens
gttgccagaga

SEQ ID NO: 339344 - DNA, 17 bp, Homo sapiens
gttgccagagatggagg

SEQ ID NO: 339345 - DNA, 19 bp, Homo sapiens
gttgccaggttgcagctgc

SEQ ID NO: 339346 - DNA, 16 bp, Homo sapiens
gttgccgggcctggac

SEQ ID NO: 339347 - DNA, 22 bp, Homo sapiens
gttgccgggcctggactgtcct

SEQ ID NO: 339348 - DNA, 12 bp, Homo sapiens
gttgcctcctct

SEQ ID NO: 339349 - DNA, 13 bp, Homo sapiens
gttgcctcctctc

SEQ ID NO: 339350 - DNA, 18 bp, Homo sapiens
gttgcctcctctctccct

SEQ ID NO: 339351 - DNA, 18 bp, Homo sapiens
gttgccttaaagaaagtc

SEQ ID NO: 339352 - DNA, 23 bp, Homo sapiens
gttgccttttttatcatttctac

SEQ ID NO: 339353 - DNA, 15 bp, Homo sapiens
gttgcgacggagaga

SEQ ID NO: 339354 - DNA, 20 bp, Homo sapiens
gttgctcaaatctattcaga

SEQ ID NO: 339355 - DNA, 20 bp, Homo sapiens
gttgctccgcctctgctggc

SEQ ID NO: 339356 - DNA, 22 bp, Homo sapiens
gttgctccgcctctgctggcac

SEQ ID NO: 339357 - DNA, 21 bp, Homo sapiens
gttgctcctacccctgtcctg

SEQ ID NO: 339358 - DNA, 18 bp, Homo sapiens
gttgctgggcctcattct

SEQ ID NO: 339359 - DNA, 19 bp, Homo sapiens
gttgctgttgttcagaagt

SEQ ID NO: 339360 - DNA, 20 bp, Homo sapiens
gttgctttcgtagcccctgc

SEQ ID NO: 339361 - DNA, 19 bp, Homo sapiens
gttgctttggatacacaca

SEQ ID NO: 339362 - DNA, 12 bp, Homo sapiens
gttgcttttacg

SEQ ID NO: 339363 - DNA, 16 bp, Homo sapiens
gttggaactctgtgca

SEQ ID NO: 339364 - DNA, 16 bp, Homo sapiens
gttggaactgctgcca

SEQ ID NO: 339365 - DNA, 14 bp, Homo sapiens
gttggaactttagg

SEQ ID NO: 339366 - DNA, 16 bp, Homo sapiens
gttggaattaaaacaa

SEQ ID NO: 339367 - DNA, 17 bp, Homo sapiens
gttggaattaaaacaat

SEQ ID NO: 339368 - DNA, 17 bp, Homo sapiens
gttggacacactgtaaa

SEQ ID NO: 339369 - DNA, 23 bp, Homo sapiens
gttggacagcaaaaccattgctt

SEQ ID NO: 339370 - DNA, 14 bp, Homo sapiens
gttggactctcagg

SEQ ID NO: 339371 - DNA, 23 bp, Homo sapiens
gttggacttttcgttaacattga

SEQ ID NO: 339372 - DNA, 14 bp, Homo sapiens
gttggagcctgcag

SEQ ID NO: 339373 - DNA, 22 bp, Homo sapiens
gttggaggcccttttctggctc

SEQ ID NO: 339374 - DNA, 15 bp, Homo sapiens
gttggaggcctcacc

SEQ ID NO: 339375 - DNA, 13 bp, Homo sapiens
gttggatcttcaa

SEQ ID NO: 339376 - DNA, 16 bp, Homo sapiens
gttggccggctggccg

SEQ ID NO: 339377 - DNA, 21 bp, Homo sapiens
gttggccggctggccggtcca

SEQ ID NO: 339378 - DNA, 23 bp, Homo sapiens
gttggcctcaagcaaggaagcag

SEQ ID NO: 339379 - DNA, 13 bp, Homo sapiens
gttggcctgcact

SEQ ID NO: 339380 - DNA, 15 bp, Homo sapiens
gttggctagaagaaa

SEQ ID NO: 339381 - DNA, 13 bp, Homo sapiens
gttggctgggccc

SEQ ID NO: 339382 - DNA, 16 bp, Homo sapiens
gttggctgggcccaga

SEQ ID NO: 339383 - DNA, 17 bp, Homo sapiens
gttggctgggcccagaa

SEQ ID NO: 339384 - DNA, 22 bp, Homo sapiens
gttggctgggggcatgggggag

SEQ ID NO: 339385 - DNA, 14 bp, Homo sapiens
gttgggagcactgg

SEQ ID NO: 339386 - DNA, 22 bp, Homo sapiens
gttgggagccctttggagaacg

SEQ ID NO: 339387 - DNA, 12 bp, Homo sapiens
gttggggaaggc

SEQ ID NO: 339388 - DNA, 16 bp, Homo sapiens
gttggggaaggcaaga

SEQ ID NO: 339389 - DNA, 14 bp, Homo sapiens
gttggggaggggcg

SEQ ID NO: 339390 - DNA, 12 bp, Homo sapiens
gttggggtgggg

SEQ ID NO: 339391 - DNA, 14 bp, Homo sapiens
gttgggttccagac

SEQ ID NO: 339392 - DNA, 15 bp, Homo sapiens
gttgggttccagaca

SEQ ID NO: 339393 - DNA, 16 bp, Homo sapiens
gttgggttccagacag

SEQ ID NO: 339394 - DNA, 22 bp, Homo sapiens
gttgggttccagacagagtgga

SEQ ID NO: 339395 - DNA, 21 bp, Homo sapiens
gttggtctttctaatgtagct

SEQ ID NO: 339396 - DNA, 14 bp, Homo sapiens
gttggtgactgaaa

SEQ ID NO: 339397 - DNA, 18 bp, Homo sapiens
gttggttacctattgctg

SEQ ID NO: 339398 - DNA, 20 bp, Homo sapiens
gttggttttgcatgtctgca

SEQ ID NO: 339399 - DNA, 15 bp, Homo sapiens
accgcctgcttcaca

SEQ ID NO: 339400 - DNA, 12 bp, Homo sapiens
accgccttctct

SEQ ID NO: 339401 - DNA, 20 bp, Homo sapiens
accgcgagactgagaggcag

SEQ ID NO: 339402 - DNA, 16 bp, Homo sapiens
accgcgagggcctgcg

SEQ ID NO: 339403 - DNA, 19 bp, Homo sapiens
accgcgtagagagccgggc

SEQ ID NO: 339404 - DNA, 19 bp, Homo sapiens
accgctccccagcccaggg

SEQ ID NO: 339405 - DNA, 14 bp, Homo sapiens
accgctgccagcac

SEQ ID NO: 339406 - DNA, 14 bp, Homo sapiens
accgcttcacccct

SEQ ID NO: 339407 - DNA, 19 bp, Homo sapiens
accgcttcacccctgcact

SEQ ID NO: 339408 - DNA, 14 bp, Homo sapiens
accggaagctcctg

SEQ ID NO: 339409 - DNA, 17 bp, Homo sapiens
accggagcggctgagga

SEQ ID NO: 339410 - DNA, 15 bp, Homo sapiens
accggcaacctgtaa

SEQ ID NO: 339411 - DNA, 17 bp, Homo sapiens
accggcaacctgtaact

SEQ ID NO: 339412 - DNA, 18 bp, Homo sapiens
accggcaacctgtaactg

SEQ ID NO: 339413 - DNA, 18 bp, Homo sapiens
accggcaatttccggcca

SEQ ID NO: 339414 - DNA, 21 bp, Homo sapiens
accgggaaaggcatctaagac

SEQ ID NO: 339415 - DNA, 13 bp, Homo sapiens
accgggacccgag

SEQ ID NO: 339416 - DNA, 16 bp, Homo sapiens
accgggccgctagatg

SEQ ID NO: 339417 - DNA, 23 bp, Homo sapiens
accgggctgggagctctgcagag

SEQ ID NO: 339418 - DNA, 14 bp, Homo sapiens
accggggcactggc

SEQ ID NO: 339419 - DNA, 23 bp, Homo sapiens
accggggtcctgaggctggggct

SEQ ID NO: 339420 - DNA, 19 bp, Homo sapiens
accgggtgggcctggcctg

SEQ ID NO: 339421 - DNA, 13 bp, Homo sapiens
accggtgcctcct

SEQ ID NO: 339422 - DNA, 19 bp, Homo sapiens
accggtgcctcctctgggg

SEQ ID NO: 339423 - DNA, 20 bp, Homo sapiens
accggttatcagttggacag

SEQ ID NO: 339424 - DNA, 18 bp, Homo sapiens
accgtactctcacatgtg

SEQ ID NO: 339425 - DNA, 22 bp, Homo sapiens
accgtcatggcttaatgtttat

SEQ ID NO: 339426 - DNA, 16 bp, Homo sapiens
accgtcgggggctgag

SEQ ID NO: 339427 - DNA, 21 bp, Homo sapiens
accgtgagcaggaaggcctgg

SEQ ID NO: 339428 - DNA, 20 bp, Homo sapiens
accgtgatttggaagagagg

SEQ ID NO: 339429 - DNA, 21 bp, Homo sapiens
accgtgtcccaaggagctgat

SEQ ID NO: 339430 - DNA, 16 bp, Homo sapiens
accgtgtgtcatgtca

SEQ ID NO: 339431 - DNA, 16 bp, Homo sapiens
accgttcacttcccct

SEQ ID NO: 339432 - DNA, 13 bp, Homo sapiens
accgttgttgttt

SEQ ID NO: 339433 - DNA, 21 bp, Homo sapiens
accgttttcatcctggcctcc

SEQ ID NO: 339434 - DNA, 21 bp, Homo sapiens
accgtttttatattacttttg

SEQ ID NO: 339435 - DNA, 16 bp, Homo sapiens
acctaaaacaatctgt

SEQ ID NO: 339436 - DNA, 21 bp, Homo sapiens
acctaaaaggaaatctcaccc

SEQ ID NO: 339437 - DNA, 20 bp, Homo sapiens
acctaaataaacacatagat

SEQ ID NO: 339438 - DNA, 21 bp, Homo sapiens
acctaaatccattttctaaac

SEQ ID NO: 339439 - DNA, 13 bp, Homo sapiens
acctaatatcatt

SEQ ID NO: 339440 - DNA, 16 bp, Homo sapiens
acctaatatcatttta

SEQ ID NO: 339441 - DNA, 19 bp, Homo sapiens
acctaatgtttatgagcca

SEQ ID NO: 339442 - DNA, 15 bp, Homo sapiens
acctaattaatttca

SEQ ID NO: 339443 - DNA, 22 bp, Homo sapiens
acctacagggaactgggaagat

SEQ ID NO: 339444 - DNA, 16 bp, Homo sapiens
acctacattccctctc

SEQ ID NO: 339445 - DNA, 19 bp, Homo sapiens
acctaccacagtgtctgta

SEQ ID NO: 339446 - DNA, 16 bp, Homo sapiens
acctaccctcaaagta

SEQ ID NO: 339447 - DNA, 17 bp, Homo sapiens
acctaccctcaaagtag

SEQ ID NO: 339448 - DNA, 15 bp, Homo sapiens
acctacctgtgaatc

SEQ ID NO: 339449 - DNA, 17 bp, Homo sapiens
acctactaaaaaagtta

SEQ ID NO: 339450 - DNA, 13 bp, Homo sapiens
acctagatcagaa

SEQ ID NO: 339451 - DNA, 22 bp, Homo sapiens
acctagatgtttaacaaatcta

SEQ ID NO: 339452 - DNA, 20 bp, Homo sapiens
acctagtactctctgctcta

SEQ ID NO: 339453 - DNA, 18 bp, Homo sapiens
acctataaagtaaagcta

SEQ ID NO: 339454 - DNA, 13 bp, Homo sapiens
acctataaatact

SEQ ID NO: 339455 - DNA, 23 bp, Homo sapiens
acctataaatactaaatatgaaa

SEQ ID NO: 339456 - DNA, 15 bp, Homo sapiens
acctataaatggact

SEQ ID NO: 339457 - DNA, 16 bp, Homo sapiens
acctataaatggactt

SEQ ID NO: 339458 - DNA, 18 bp, Homo sapiens
acctatctcgtgggagag

SEQ ID NO: 339459 - DNA, 14 bp, Homo sapiens
acctatgataaata

SEQ ID NO: 339460 - DNA, 19 bp, Homo sapiens
acctcaaaatgtctaagat

SEQ ID NO: 339461 - DNA, 17 bp, Homo sapiens
acctcaacaaagaagaa

SEQ ID NO: 339462 - DNA, 19 bp, Homo sapiens
acctcaacccccatttcta

SEQ ID NO: 339463 - DNA, 22 bp, Homo sapiens
acctcaacccccatttctattt

SEQ ID NO: 339464 - DNA, 21 bp, Homo sapiens
gttttcaccatctttctaatc

SEQ ID NO: 339465 - DNA, 20 bp, Homo sapiens
gttttcagaacctcttcccc

SEQ ID NO: 339466 - DNA, 20 bp, Homo sapiens
gttttcaggggctttggaag

SEQ ID NO: 339467 - DNA, 22 bp, Homo sapiens
gttttcataataaaactttaaa

SEQ ID NO: 339468 - DNA, 10 bp, Homo sapiens
gttttcatgg

SEQ ID NO: 339469 - DNA, 22 bp, Homo sapiens
gttttcatggtgaaaatgtact

SEQ ID NO: 339470 - DNA, 16 bp, Homo sapiens
gttttcatgtaaataa

SEQ ID NO: 339471 - DNA, 14 bp, Homo sapiens
gttttccatgaaaa

SEQ ID NO: 339472 - DNA, 15 bp, Homo sapiens
gttttccatgaaaac

SEQ ID NO: 339473 - DNA, 16 bp, Homo sapiens
gttttcccacacatat

SEQ ID NO: 339474 - DNA, 22 bp, Homo sapiens
gttttcccacacatattcaaat

SEQ ID NO: 339475 - DNA, 19 bp, Homo sapiens
gttttcccctctctttgag

SEQ ID NO: 339476 - DNA, 22 bp, Homo sapiens
gttttcctataatataataaat

SEQ ID NO: 339477 - DNA, 13 bp, Homo sapiens
gttttcctgaaga

SEQ ID NO: 339478 - DNA, 14 bp, Homo sapiens
gttttcctgctggt

SEQ ID NO: 339479 - DNA, 19 bp, Homo sapiens
gttttcctttgtcatcatt

SEQ ID NO: 339480 - DNA, 17 bp, Homo sapiens
gttttctcagaacagct

SEQ ID NO: 339481 - DNA, 20 bp, Homo sapiens
gttttctctttgtggggctt

SEQ ID NO: 339482 - DNA, 12 bp, Homo sapiens
gttttcttcctt

SEQ ID NO: 339483 - DNA, 19 bp, Homo sapiens
gttttcttccttgtaaatt

SEQ ID NO: 339484 - DNA, 15 bp, Homo sapiens
gttttcttctaatca

SEQ ID NO: 339485 - DNA, 14 bp, Homo sapiens
gttttctttgaatg

SEQ ID NO: 339486 - DNA, 18 bp, Homo sapiens
gttttctttgctgtgcca

SEQ ID NO: 339487 - DNA, 22 bp, Homo sapiens
gttttctttgctgtgccaaagc

SEQ ID NO: 339488 - DNA, 11 bp, Homo sapiens
gttttcttttt

SEQ ID NO: 339489 - DNA, 16 bp, Homo sapiens
gttttgacggatgatt

SEQ ID NO: 339490 - DNA, 12 bp, Homo sapiens
gttttgagaaaa

SEQ ID NO: 339491 - DNA, 23 bp, Homo sapiens
gttttgaggtttccttcagacag

SEQ ID NO: 339492 - DNA, 21 bp, Homo sapiens
gttttgatgtttgtggcctca

SEQ ID NO: 339493 - DNA, 22 bp, Homo sapiens
gttttgatgtttgtggcctcag

SEQ ID NO: 339494 - DNA, 11 bp, Homo sapiens
gttttgctaat

SEQ ID NO: 339495 - DNA, 21 bp, Homo sapiens
gttttgctaggtataaaaaat

SEQ ID NO: 339496 - DNA, 17 bp, Homo sapiens
gttttgctgctataatt

SEQ ID NO: 339497 - DNA, 11 bp, Homo sapiens
gttttggcctg

SEQ ID NO: 339498 - DNA, 22 bp, Homo sapiens
gttttgtataaataataaagaa

SEQ ID NO: 339499 - DNA, 18 bp, Homo sapiens
gttttgtcctttgagaaa

SEQ ID NO: 339500 - DNA, 21 bp, Homo sapiens
gttttgtcctttgagaaagaa

SEQ ID NO: 339501 - DNA, 20 bp, Homo sapiens
gttttgtgtacagtatgtgt

SEQ ID NO: 339502 - DNA, 15 bp, Homo sapiens
gttttgtgtgtatat

SEQ ID NO: 339503 - DNA, 15 bp, Homo sapiens
gttttgtgttttttt

SEQ ID NO: 339504 - DNA, 20 bp, Homo sapiens
gttttgttttttagttccca

SEQ ID NO: 339505 - DNA, 13 bp, Homo sapiens
gtttttaaaagtt

SEQ ID NO: 339506 - DNA, 21 bp, Homo sapiens
gtttttaacaactaatcaaga

SEQ ID NO: 339507 - DNA, 18 bp, Homo sapiens
gtttttaatataaagcct

SEQ ID NO: 339508 - DNA, 13 bp, Homo sapiens
gtttttacagtgt

SEQ ID NO: 339509 - DNA, 21 bp, Homo sapiens
gtttttacctaccacagtgtc

SEQ ID NO: 339510 - DNA, 16 bp, Homo sapiens
gtttttatattacttt

SEQ ID NO: 339511 - DNA, 20 bp, Homo sapiens
gtttttatattacttttgta

SEQ ID NO: 339512 - DNA, 16 bp, Homo sapiens
gtttttattccttgtg

SEQ ID NO: 339513 - DNA, 22 bp, Homo sapiens
gtttttcagcacccccacccac

SEQ ID NO: 339514 - DNA, 13 bp, Homo sapiens
gtttttctcaaat

SEQ ID NO: 339515 - DNA, 14 bp, Homo sapiens
gtttttctcaaata

SEQ ID NO: 339516 - DNA, 16 bp, Homo sapiens
gtttttctcaaataaa

SEQ ID NO: 339517 - DNA, 14 bp, Homo sapiens
gtttttctgccagg

SEQ ID NO: 339518 - DNA, 23 bp, Homo sapiens
gtttttcttcaacatcaatgttc

SEQ ID NO: 339519 - DNA, 17 bp, Homo sapiens
gtttttcttttcttgga

SEQ ID NO: 339520 - DNA, 12 bp, Homo sapiens
gtttttgaagaa

SEQ ID NO: 339521 - DNA, 13 bp, Homo sapiens
gtttttgctgaag

SEQ ID NO: 339522 - DNA, 16 bp, Homo sapiens
gtttttggatggctta

SEQ ID NO: 339523 - DNA, 13 bp, Homo sapiens
gtttttggctctt

SEQ ID NO: 339524 - DNA, 11 bp, Homo sapiens
gtttttgtaac

SEQ ID NO: 339525 - DNA, 19 bp, Homo sapiens
gtttttgtatctttaaaga

SEQ ID NO: 339526 - DNA, 13 bp, Homo sapiens
gtttttgttgagt

SEQ ID NO: 339527 - DNA, 20 bp, Homo sapiens
gtttttgttgagtctctgaa

SEQ ID NO: 339528 - DNA, 23 bp, Homo sapiens
gtttttgttgagtctctgaacat

SEQ ID NO: 339529 - DNA, 15 bp, Homo sapiens
tttagcctagttcat

SEQ ID NO: 339530 - DNA, 16 bp, Homo sapiens
tttagctgtatcaaac

SEQ ID NO: 339531 - DNA, 15 bp, Homo sapiens
tttagcttcctccag

SEQ ID NO: 339532 - DNA, 17 bp, Homo sapiens
tttagcttcctccagag

SEQ ID NO: 339533 - DNA, 14 bp, Homo sapiens
tttaggagacagtc

SEQ ID NO: 339534 - DNA, 13 bp, Homo sapiens
tttaggagatttt

SEQ ID NO: 339535 - DNA, 17 bp, Homo sapiens
tttaggagattttaggt

SEQ ID NO: 339536 - DNA, 13 bp, Homo sapiens
tttaggcagcctg

SEQ ID NO: 339537 - DNA, 20 bp, Homo sapiens
tttaggcagcctgccgccgt

SEQ ID NO: 339538 - DNA, 14 bp, Homo sapiens
tttaggcaggaagt

SEQ ID NO: 339539 - DNA, 21 bp, Homo sapiens
tttaggcttctatgtccaaca

SEQ ID NO: 339540 - DNA, 13 bp, Homo sapiens
tttagggaagcag

SEQ ID NO: 339541 - DNA, 19 bp, Homo sapiens
tttagtacccacctgagct

SEQ ID NO: 339542 - DNA, 20 bp, Homo sapiens
tttagtagagacagtgtttt

SEQ ID NO: 339543 - DNA, 17 bp, Homo sapiens
tttagtgactgtaatta

SEQ ID NO: 339544 - DNA, 13 bp, Homo sapiens
tttagtgattgct

SEQ ID NO: 339545 - DNA, 15 bp, Homo sapiens
tttagtgattgcttt

SEQ ID NO: 339546 - DNA, 21 bp, Homo sapiens
tttagtgcaatttcttctgta

SEQ ID NO: 339547 - DNA, 17 bp, Homo sapiens
tttagttaaatttctgg

SEQ ID NO: 339548 - DNA, 14 bp, Homo sapiens
tttagttatagttt

SEQ ID NO: 339549 - DNA, 15 bp, Homo sapiens
tttagttatagtttc

SEQ ID NO: 339550 - DNA, 14 bp, Homo sapiens
tttagttgaaaaat

SEQ ID NO: 339551 - DNA, 23 bp, Homo sapiens
tttagttgaattttttttaacat

SEQ ID NO: 339552 - DNA, 13 bp, Homo sapiens
tttataaatgtgt

SEQ ID NO: 339553 - DNA, 17 bp, Homo sapiens
tttataaattaaatata

SEQ ID NO: 339554 - DNA, 13 bp, Homo sapiens
tttataacaattg

SEQ ID NO: 339555 - DNA, 15 bp, Homo sapiens
tttataacattgtaa

SEQ ID NO: 339556 - DNA, 20 bp, Homo sapiens
tttataacattgtaaatgat

SEQ ID NO: 339557 - DNA, 18 bp, Homo sapiens
tttataactcatcataaa

SEQ ID NO: 339558 - DNA, 21 bp, Homo sapiens
tttataactcatcataaaata

SEQ ID NO: 339559 - DNA, 22 bp, Homo sapiens
tttataactcatcataaaataa

SEQ ID NO: 339560 - DNA, 17 bp, Homo sapiens
tttataaggctgactct

SEQ ID NO: 339561 - DNA, 14 bp, Homo sapiens
tttatacttaaaca

SEQ ID NO: 339562 - DNA, 12 bp, Homo sapiens
tttatagcttcc

SEQ ID NO: 339563 - DNA, 17 bp, Homo sapiens
tttatagtttgtacatg

SEQ ID NO: 339564 - DNA, 17 bp, Homo sapiens
tttatataagttaaaga

SEQ ID NO: 339565 - DNA, 21 bp, Homo sapiens
tttatataataaagtattcca

SEQ ID NO: 339566 - DNA, 14 bp, Homo sapiens
tttatataattatg

SEQ ID NO: 339567 - DNA, 19 bp, Homo sapiens
tttatataattatgttatt

SEQ ID NO: 339568 - DNA, 23 bp, Homo sapiens
tttatatactgggttcttgtttt

SEQ ID NO: 339569 - DNA, 19 bp, Homo sapiens
tttatatagcttgaaacat

SEQ ID NO: 339570 - DNA, 14 bp, Homo sapiens
tttatatataaaat

SEQ ID NO: 339571 - DNA, 21 bp, Homo sapiens
tttatatataaaataaatata

SEQ ID NO: 339572 - DNA, 12 bp, Homo sapiens
tttatatattta

SEQ ID NO: 339573 - DNA, 16 bp, Homo sapiens
tttatatatttataac

SEQ ID NO: 339574 - DNA, 16 bp, Homo sapiens
tttatatctgtaaatt

SEQ ID NO: 339575 - DNA, 18 bp, Homo sapiens
tttatatggcccagcctt

SEQ ID NO: 339576 - DNA, 13 bp, Homo sapiens
tttatatgtcttg

SEQ ID NO: 339577 - DNA, 13 bp, Homo sapiens
tttatattacttt

SEQ ID NO: 339578 - DNA, 19 bp, Homo sapiens
tttatattacttttgtaaa

SEQ ID NO: 339579 - DNA, 20 bp, Homo sapiens
tttatattacttttgtaaat

SEQ ID NO: 339580 - DNA, 22 bp, Homo sapiens
tttatattacttttgtaaatat

SEQ ID NO: 339581 - DNA, 21 bp, Homo sapiens
tttatattctaagccagtttt

SEQ ID NO: 339582 - DNA, 14 bp, Homo sapiens
tttatatttagtga

SEQ ID NO: 339583 - DNA, 13 bp, Homo sapiens
tttatatttgtct

SEQ ID NO: 339584 - DNA, 15 bp, Homo sapiens
tttatattttctata

SEQ ID NO: 339585 - DNA, 15 bp, Homo sapiens
tttatcacacttctg

SEQ ID NO: 339586 - DNA, 23 bp, Homo sapiens
tttatcagattgcttttgtgcat

SEQ ID NO: 339587 - DNA, 22 bp, Homo sapiens
tttatcagtttccagtctcaaa

SEQ ID NO: 339588 - DNA, 20 bp, Homo sapiens
tttatccagatgaactgaga

SEQ ID NO: 339589 - DNA, 19 bp, Homo sapiens
tttatccctgcttatctga

SEQ ID NO: 339590 - DNA, 16 bp, Homo sapiens
tttatctcttcttcct

SEQ ID NO: 339591 - DNA, 12 bp, Homo sapiens
tttatctgtgga

SEQ ID NO: 339592 - DNA, 20 bp, Homo sapiens
tttatcttccatatgctctt

SEQ ID NO: 339593 - DNA, 16 bp, Homo sapiens
tttatcttctgttttt

SEQ ID NO: 339594 - DNA, 18 bp, Homo sapiens
tttatcttctgtttttct

SEQ ID NO: 339595 - DNA, 22 bp, Homo sapiens
tttatcttctgtttttctcaaa

SEQ ID NO: 339596 - DNA, 23 bp, Homo sapiens
tttatcttctgtttttctcaaat

SEQ ID NO: 339597 - DNA, 18 bp, Homo sapiens
tttatgaaaggtttacat

SEQ ID NO: 339598 - DNA, 12 bp, Homo sapiens
tttatgaagaaa

SEQ ID NO: 339599 - DNA, 22 bp, Homo sapiens
tttatgaagttaacagtctcat

SEQ ID NO: 339600 - DNA, 20 bp, Homo sapiens
tttatgaatgaaaaaacagt

SEQ ID NO: 339601 - DNA, 17 bp, Homo sapiens
tttatgagccagacaaa

SEQ ID NO: 339602 - DNA, 17 bp, Homo sapiens
tttatgatttcatgatt

SEQ ID NO: 339603 - DNA, 19 bp, Homo sapiens
tttatgcagtgctgctttg

SEQ ID NO: 339604 - DNA, 13 bp, Homo sapiens
tttatggcctcag

SEQ ID NO: 339605 - DNA, 19 bp, Homo sapiens
tttatgtctaaagagcttt

SEQ ID NO: 339606 - DNA, 16 bp, Homo sapiens
tttatgtttgtacaca

SEQ ID NO: 339607 - DNA, 17 bp, Homo sapiens
tttatgttttgtttctg

SEQ ID NO: 339608 - DNA, 17 bp, Homo sapiens
tttattaaaaccattct

SEQ ID NO: 339609 - DNA, 23 bp, Homo sapiens
tttattaaaatgattgtaaaata

SEQ ID NO: 339610 - DNA, 22 bp, Homo sapiens
tttattaacatatattgttatt

SEQ ID NO: 339611 - DNA, 14 bp, Homo sapiens
taaagaaaaagata

SEQ ID NO: 339612 - DNA, 17 bp, Homo sapiens
taaagaaaatgtgtctg

SEQ ID NO: 339613 - DNA, 23 bp, Homo sapiens
taaagaaaatgtgtctgcaacat

SEQ ID NO: 339614 - DNA, 20 bp, Homo sapiens
taaagaaacagctttcaagt

SEQ ID NO: 339615 - DNA, 23 bp, Homo sapiens
taaagaaacagctttcaagtgcc

SEQ ID NO: 339616 - DNA, 17 bp, Homo sapiens
taaagaaaggcagagat

SEQ ID NO: 339617 - DNA, 20 bp, Homo sapiens
taaagaaaggcagagattgg

SEQ ID NO: 339618 - DNA, 19 bp, Homo sapiens
taaagaacaccctatattt

SEQ ID NO: 339619 - DNA, 21 bp, Homo sapiens
taaagaactccttattttgta

SEQ ID NO: 339620 - DNA, 23 bp, Homo sapiens
taaagaagtctcttaattctgat

SEQ ID NO: 339621 - DNA, 14 bp, Homo sapiens
taaagaataaagtc

SEQ ID NO: 339622 - DNA, 17 bp, Homo sapiens
taaagaatagtgcctca

SEQ ID NO: 339623 - DNA, 14 bp, Homo sapiens
taaagacaaaaaac

SEQ ID NO: 339624 - DNA, 9 bp, Homo sapiens
taaagacag

SEQ ID NO: 339625 - DNA, 10 bp, Homo sapiens
taaagacaga

SEQ ID NO: 339626 - DNA, 15 bp, Homo sapiens
taaagacagaggcag

SEQ ID NO: 339627 - DNA, 23 bp, Homo sapiens
taaagaccatttagtcctcacct

SEQ ID NO: 339628 - DNA, 15 bp, Homo sapiens
taaagacttaagatt

SEQ ID NO: 339629 - DNA, 15 bp, Homo sapiens
taaagacttcatgtt

SEQ ID NO: 339630 - DNA, 16 bp, Homo sapiens
taaagacttcatgttc

SEQ ID NO: 339631 - DNA, 12 bp, Homo sapiens
taaagacttgat

SEQ ID NO: 339632 - DNA, 16 bp, Homo sapiens
taaagacttgatgaat

SEQ ID NO: 339633 - DNA, 17 bp, Homo sapiens
taaagacttgatgaata

SEQ ID NO: 339634 - DNA, 21 bp, Homo sapiens
taaagacttgatgaataaaca

SEQ ID NO: 339635 - DNA, 17 bp, Homo sapiens
taaagaggaagccttgc

SEQ ID NO: 339636 - DNA, 22 bp, Homo sapiens
taaagaggcgtcttgtattttc

SEQ ID NO: 339637 - DNA, 17 bp, Homo sapiens
taaagaggctgaaagag

SEQ ID NO: 339638 - DNA, 22 bp, Homo sapiens
taaagataaaaggataggaaaa

SEQ ID NO: 339639 - DNA, 12 bp, Homo sapiens
taaagataatat

SEQ ID NO: 339640 - DNA, 17 bp, Homo sapiens
taaagatatcagagctc

SEQ ID NO: 339641 - DNA, 15 bp, Homo sapiens
taaagatattattca

SEQ ID NO: 339642 - DNA, 13 bp, Homo sapiens
taaagatgatcta

SEQ ID NO: 339643 - DNA, 21 bp, Homo sapiens
taaagatgatctactcagaaa

SEQ ID NO: 339644 - DNA, 13 bp, Homo sapiens
taaagatggaaaa

SEQ ID NO: 339645 - DNA, 16 bp, Homo sapiens
taaagcaaaaaatgaa

SEQ ID NO: 339646 - DNA, 19 bp, Homo sapiens
taaagcaaaaaatgaatgt

SEQ ID NO: 339647 - DNA, 16 bp, Homo sapiens
taaagcagtagacaat

SEQ ID NO: 339648 - DNA, 13 bp, Homo sapiens
taaagcagtgttt

SEQ ID NO: 339649 - DNA, 14 bp, Homo sapiens
taaagcatcagaga

SEQ ID NO: 339650 - DNA, 21 bp, Homo sapiens
taaagcatcagagatggtaat

SEQ ID NO: 339651 - DNA, 15 bp, Homo sapiens
taaagctagacaaag

SEQ ID NO: 339652 - DNA, 16 bp, Homo sapiens
taaagctgcctgtagt

SEQ ID NO: 339653 - DNA, 17 bp, Homo sapiens
taaagctgtttctaaac

SEQ ID NO: 339654 - DNA, 17 bp, Homo sapiens
taaagcttgtggcccct

SEQ ID NO: 339655 - DNA, 16 bp, Homo sapiens
taaagcttttgatgtg

SEQ ID NO: 339656 - DNA, 14 bp, Homo sapiens
taaaggacaaacag

SEQ ID NO: 339657 - DNA, 16 bp, Homo sapiens
taaaggacaaacagtg

SEQ ID NO: 339658 - DNA, 17 bp, Homo sapiens
taaaggacaaacagtga

SEQ ID NO: 339659 - DNA, 21 bp, Homo sapiens
taaaggacacccctcgccccc

SEQ ID NO: 339660 - DNA, 13 bp, Homo sapiens
tttcctgggcctt

SEQ ID NO: 339661 - DNA, 18 bp, Homo sapiens
tttcctgttcatgacagc

SEQ ID NO: 339662 - DNA, 19 bp, Homo sapiens
tttccttaaattatctaaa

SEQ ID NO: 339663 - DNA, 14 bp, Homo sapiens
tttccttccatccc

SEQ ID NO: 339664 - DNA, 15 bp, Homo sapiens
tttccttccatccct

SEQ ID NO: 339665 - DNA, 12 bp, Homo sapiens
tttccttgctca

SEQ ID NO: 339666 - DNA, 18 bp, Homo sapiens
tttccttgttggtcagag

SEQ ID NO: 339667 - DNA, 13 bp, Homo sapiens
tttcctttctgta

SEQ ID NO: 339668 - DNA, 12 bp, Homo sapiens
tttcctttggag

SEQ ID NO: 339669 - DNA, 16 bp, Homo sapiens
tttcctttgtcatcat

SEQ ID NO: 339670 - DNA, 21 bp, Homo sapiens
tttccttttaaaacacttcca

SEQ ID NO: 339671 - DNA, 15 bp, Homo sapiens
tttcgctttcctctg

SEQ ID NO: 339672 - DNA, 17 bp, Homo sapiens
tttcggtgccctgtgtc

SEQ ID NO: 339673 - DNA, 22 bp, Homo sapiens
tttcgtcacaggagtctttgta

SEQ ID NO: 339674 - DNA, 15 bp, Homo sapiens
tttcgtgcatttgtg

SEQ ID NO: 339675 - DNA, 19 bp, Homo sapiens
tttcgtgtagtggaagagc

SEQ ID NO: 339676 - DNA, 15 bp, Homo sapiens
tttcgttaacattga

SEQ ID NO: 339677 - DNA, 21 bp, Homo sapiens
tttcgttggttgtttctctga

SEQ ID NO: 339678 - DNA, 19 bp, Homo sapiens
tttcgtttttcttggggta

SEQ ID NO: 339679 - DNA, 19 bp, Homo sapiens
tttctaaaaagtcaattca

SEQ ID NO: 339680 - DNA, 18 bp, Homo sapiens
tttctaaggatagccttt

SEQ ID NO: 339681 - DNA, 20 bp, Homo sapiens
tttctaaggatagcctttgt

SEQ ID NO: 339682 - DNA, 22 bp, Homo sapiens
tttctaaggatagcctttgtag

SEQ ID NO: 339683 - DNA, 15 bp, Homo sapiens
tttctaagtatttaa

SEQ ID NO: 339684 - DNA, 14 bp, Homo sapiens
tttctaatttgaat

SEQ ID NO: 339685 - DNA, 19 bp, Homo sapiens
tttctacatgactgggcct

SEQ ID NO: 339686 - DNA, 21 bp, Homo sapiens
tttctagaatttatcacactt

SEQ ID NO: 339687 - DNA, 16 bp, Homo sapiens
tttctagcaattgctt

SEQ ID NO: 339688 - DNA, 19 bp, Homo sapiens
tttctagctagaaatatga

SEQ ID NO: 339689 - DNA, 20 bp, Homo sapiens
tttctagctagaaatatgat

SEQ ID NO: 339690 - DNA, 21 bp, Homo sapiens
tttctagtttcagtaaataat

SEQ ID NO: 339691 - DNA, 14 bp, Homo sapiens
tttctatactgttt

SEQ ID NO: 339692 - DNA, 13 bp, Homo sapiens
tttctatactttt

SEQ ID NO: 339693 - DNA, 21 bp, Homo sapiens
tttctatataaaatgtattca

SEQ ID NO: 339694 - DNA, 23 bp, Homo sapiens
tttctatataaaatgtattcaag

SEQ ID NO: 339695 - DNA, 14 bp, Homo sapiens
tttctatcacatat

SEQ ID NO: 339696 - DNA, 15 bp, Homo sapiens
tttctatctgcaaat

SEQ ID NO: 339697 - DNA, 17 bp, Homo sapiens
tttctatggattcactt

SEQ ID NO: 339698 - DNA, 20 bp, Homo sapiens
tttctatggattcacttcta

SEQ ID NO: 339699 - DNA, 15 bp, Homo sapiens
tttctatgtaaatta

SEQ ID NO: 339700 - DNA, 15 bp, Homo sapiens
tttctatgtagaact

SEQ ID NO: 339701 - DNA, 21 bp, Homo sapiens
tttctatgtagaactgttcat

SEQ ID NO: 339702 - DNA, 14 bp, Homo sapiens
tttctattccttct

SEQ ID NO: 339703 - DNA, 13 bp, Homo sapiens
tttctattgttac

SEQ ID NO: 339704 - DNA, 14 bp, Homo sapiens
tttctattgttact

SEQ ID NO: 339705 - DNA, 22 bp, Homo sapiens
tttctcaacaaagcacagtgtt

SEQ ID NO: 339706 - DNA, 10 bp, Homo sapiens
tttctcatgt

SEQ ID NO: 339707 - DNA, 12 bp, Homo sapiens
tttctcatgtgc

SEQ ID NO: 339708 - DNA, 17 bp, Homo sapiens
tttctcatgtgctttgt

SEQ ID NO: 339709 - DNA, 18 bp, Homo sapiens
tttctcatgtgctttgta

SEQ ID NO: 339710 - DNA, 18 bp, Homo sapiens
tttctccagccagcaatg

SEQ ID NO: 339711 - DNA, 23 bp, Homo sapiens
tttctccccatccccttcctaaa

SEQ ID NO: 339712 - DNA, 20 bp, Homo sapiens
tttctccggggtctgtgctg

SEQ ID NO: 339713 - DNA, 14 bp, Homo sapiens
tttctccgttgtgg

SEQ ID NO: 339714 - DNA, 23 bp, Homo sapiens
tttctcctggaaaacctcagcat

SEQ ID NO: 339715 - DNA, 12 bp, Homo sapiens
tttctcctgtgc

SEQ ID NO: 339716 - DNA, 14 bp, Homo sapiens
tttctcctgtgccc

SEQ ID NO: 339717 - DNA, 20 bp, Homo sapiens
tttctcctgtggtttgctcc

SEQ ID NO: 339718 - DNA, 19 bp, Homo sapiens
tttctccttagtcttctca

SEQ ID NO: 339719 - DNA, 19 bp, Homo sapiens
tttctcgtggtagaagcca

SEQ ID NO: 339720 - DNA, 19 bp, Homo sapiens
tttctctcagccttacatt

SEQ ID NO: 339721 - DNA, 21 bp, Homo sapiens
tttctctcagccttacatttg

SEQ ID NO: 339722 - DNA, 12 bp, Homo sapiens
tttctctctgtg

SEQ ID NO: 339723 - DNA, 17 bp, Homo sapiens
tttctctctgtgtggca

SEQ ID NO: 339724 - DNA, 16 bp, Homo sapiens
tttctctgagagagat

SEQ ID NO: 339725 - DNA, 11 bp, Homo sapiens
tttctctgcca

SEQ ID NO: 339726 - DNA, 19 bp, Homo sapiens
tttctctggcagcataatt

SEQ ID NO: 339727 - DNA, 11 bp, Homo sapiens
tttctctgtgg

SEQ ID NO: 339728 - DNA, 16 bp, Homo sapiens
tttctcttcatacttt

SEQ ID NO: 339729 - DNA, 15 bp, Homo sapiens
tttctcttctgtcca

SEQ ID NO: 339730 - DNA, 22 bp, Homo sapiens
tttctctttcctctaactcatt

SEQ ID NO: 339731 - DNA, 17 bp, Homo sapiens
tttctctttttttaaaa

SEQ ID NO: 339732 - DNA, 21 bp, Homo sapiens
tttctgaaaattccagaaagg

SEQ ID NO: 339733 - DNA, 22 bp, Homo sapiens
tttctgaaaattccagaaagga

SEQ ID NO: 339734 - DNA, 14 bp, Homo sapiens
tttctgagcgatta

SEQ ID NO: 339735 - DNA, 21 bp, Homo sapiens
tttctgagtagcatatataat

SEQ ID NO: 339736 - DNA, 22 bp, Homo sapiens
tttctgagtagcatatataatt

SEQ ID NO: 339737 - DNA, 22 bp, Homo sapiens
tttctgatgggaggaaagtagc

SEQ ID NO: 339738 - DNA, 13 bp, Homo sapiens
tttctgcagccct

SEQ ID NO: 339739 - DNA, 14 bp, Homo sapiens
tttctgcagccctt

SEQ ID NO: 339740 - DNA, 21 bp, Homo sapiens
tttctgcagcccttgggcagt

SEQ ID NO: 339741 - DNA, 18 bp, Homo sapiens
tttctggaatgtaatcaa

SEQ ID NO: 339742 - DNA, 16 bp, Homo sapiens
tttctggcctgccttc

SEQ ID NO: 339743 - DNA, 14 bp, Homo sapiens
tttctggctgggga

SEQ ID NO: 339744 - DNA, 15 bp, Homo sapiens
tttctggctggggat

SEQ ID NO: 339745 - DNA, 16 bp, Homo sapiens
tttctggctggggatg

SEQ ID NO: 339746 - DNA, 22 bp, Homo sapiens
tttctggttcttgtgttggctg

SEQ ID NO: 339747 - DNA, 13 bp, Homo sapiens
tttctgtaccatt

SEQ ID NO: 339748 - DNA, 16 bp, Homo sapiens
tttctgtccagaaaat

SEQ ID NO: 339749 - DNA, 17 bp, Homo sapiens
tttctgtgaagcccttt

SEQ ID NO: 339750 - DNA, 10 bp, Homo sapiens
tttctgtgga

SEQ ID NO: 339751 - DNA, 15 bp, Homo sapiens
tttctgttgaagttt

SEQ ID NO: 339752 - DNA, 20 bp, Homo sapiens
tttctgtttctaatttgctg

SEQ ID NO: 339753 - DNA, 13 bp, Homo sapiens
tttctgtttctca

SEQ ID NO: 339754 - DNA, 22 bp, Homo sapiens
tttctgttttttttttttgtat

SEQ ID NO: 339755 - DNA, 17 bp, Homo sapiens
tttcttaaaaagttata

SEQ ID NO: 339756 - DNA, 22 bp, Homo sapiens
tttcttaaatggaattattttg

SEQ ID NO: 339757 - DNA, 13 bp, Homo sapiens
tttcttactcaaa

SEQ ID NO: 339758 - DNA, 23 bp, Homo sapiens
taaatcaatgtcacttaaaggct

SEQ ID NO: 339759 - DNA, 11 bp, Homo sapiens
taaatcactga

SEQ ID NO: 339760 - DNA, 17 bp, Homo sapiens
taaatcactgaggcatt

SEQ ID NO: 339761 - DNA, 14 bp, Homo sapiens
taaatcataatcat

SEQ ID NO: 339762 - DNA, 14 bp, Homo sapiens
taaatcattaatac

SEQ ID NO: 339763 - DNA, 15 bp, Homo sapiens
taaatcatttcagta

SEQ ID NO: 339764 - DNA, 17 bp, Homo sapiens
taaatccaacacaagtt

SEQ ID NO: 339765 - DNA, 14 bp, Homo sapiens
taaatccagttcta

SEQ ID NO: 339766 - DNA, 18 bp, Homo sapiens
taaatccattttctaaac

SEQ ID NO: 339767 - DNA, 21 bp, Homo sapiens
taaatccattttctaaactgt

SEQ ID NO: 339768 - DNA, 14 bp, Homo sapiens
taaatcctaccaaa

SEQ ID NO: 339769 - DNA, 22 bp, Homo sapiens
taaatcctagacttgaaagttt

SEQ ID NO: 339770 - DNA, 14 bp, Homo sapiens
taaatctaaatgat

SEQ ID NO: 339771 - DNA, 17 bp, Homo sapiens
taaatctaaattaactt

SEQ ID NO: 339772 - DNA, 15 bp, Homo sapiens
taaatctcttctttg

SEQ ID NO: 339773 - DNA, 16 bp, Homo sapiens
taaatctgtctgattc

SEQ ID NO: 339774 - DNA, 20 bp, Homo sapiens
taaatctgtctgattctatg

SEQ ID NO: 339775 - DNA, 21 bp, Homo sapiens
taaatgaaaaaaatgatctat

SEQ ID NO: 339776 - DNA, 12 bp, Homo sapiens
taaatgaaatac

SEQ ID NO: 339777 - DNA, 22 bp, Homo sapiens
taaatgaaatacttgacaacat

SEQ ID NO: 339778 - DNA, 17 bp, Homo sapiens
taaatgaatgaaatata

SEQ ID NO: 339779 - DNA, 12 bp, Homo sapiens
taaatgaatgtt

SEQ ID NO: 339780 - DNA, 20 bp, Homo sapiens
taaatgaattaaatattgaa

SEQ ID NO: 339781 - DNA, 14 bp, Homo sapiens
taaatgaccagttt

SEQ ID NO: 339782 - DNA, 19 bp, Homo sapiens
taaatgatatgtctttaaa

SEQ ID NO: 339783 - DNA, 21 bp, Homo sapiens
taaatgatgtggtgcctgagg

SEQ ID NO: 339784 - DNA, 18 bp, Homo sapiens
taaatgcagttttaagaa

SEQ ID NO: 339785 - DNA, 12 bp, Homo sapiens
taaatgccctgc

SEQ ID NO: 339786 - DNA, 13 bp, Homo sapiens
taaatgccctgct

SEQ ID NO: 339787 - DNA, 21 bp, Homo sapiens
taaatgctacctctgatcaaa

SEQ ID NO: 339788 - DNA, 16 bp, Homo sapiens
taaatggcacctgtat

SEQ ID NO: 339789 - DNA, 23 bp, Homo sapiens
taaatggctcgtgggctctggct

SEQ ID NO: 339790 - DNA, 21 bp, Homo sapiens
taaatgtaaaaatgaaggaat

SEQ ID NO: 339791 - DNA, 17 bp, Homo sapiens
tttgggcccctcagagc

SEQ ID NO: 339792 - DNA, 16 bp, Homo sapiens
tttgggctaacattta

SEQ ID NO: 339793 - DNA, 14 bp, Homo sapiens
tttgggctgccctg

SEQ ID NO: 339794 - DNA, 14 bp, Homo sapiens
tttggggaactcaa

SEQ ID NO: 339795 - DNA, 22 bp, Homo sapiens
tttggtattacactgtatttgt

SEQ ID NO: 339796 - DNA, 15 bp, Homo sapiens
tttggtctccctggg

SEQ ID NO: 339797 - DNA, 15 bp, Homo sapiens
tttggtctcttgctt

SEQ ID NO: 339798 - DNA, 14 bp, Homo sapiens
tttggtctgggact

SEQ ID NO: 339799 - DNA, 16 bp, Homo sapiens
tttggtgatgtaaaac

SEQ ID NO: 339800 - DNA, 18 bp, Homo sapiens
tttggtgctggtctattt

SEQ ID NO: 339801 - DNA, 19 bp, Homo sapiens
tttggttcctcatggctgt

SEQ ID NO: 339802 - DNA, 18 bp, Homo sapiens
tttgtaaatactgcttga

SEQ ID NO: 339803 - DNA, 15 bp, Homo sapiens
tttgtaaccatatga

SEQ ID NO: 339804 - DNA, 15 bp, Homo sapiens
tttgtaacctcagct

SEQ ID NO: 339805 - DNA, 16 bp, Homo sapiens
tttgtaacctcagctc

SEQ ID NO: 339806 - DNA, 18 bp, Homo sapiens
tttgtaacctcagctctg

SEQ ID NO: 339807 - DNA, 14 bp, Homo sapiens
tttgtaatatacag

SEQ ID NO: 339808 - DNA, 15 bp, Homo sapiens
tttgtaatgtatctt

SEQ ID NO: 339809 - DNA, 13 bp, Homo sapiens
tttgtacattcct

SEQ ID NO: 339810 - DNA, 14 bp, Homo sapiens
tttgtacctctaag

SEQ ID NO: 339811 - DNA, 14 bp, Homo sapiens
tttgtactgtgctg

SEQ ID NO: 339812 - DNA, 19 bp, Homo sapiens
tttgtagatggcactttag

SEQ ID NO: 339813 - DNA, 20 bp, Homo sapiens
tttgtaggggtcaaagaaat

SEQ ID NO: 339814 - DNA, 21 bp, Homo sapiens
tttgtaggggtcaaagaaatg

SEQ ID NO: 339815 - DNA, 14 bp, Homo sapiens
tttgtagtttgtat

SEQ ID NO: 339816 - DNA, 19 bp, Homo sapiens
tttgtataacttcttaaaa

SEQ ID NO: 339817 - DNA, 17 bp, Homo sapiens
tttgtataccatgatgc

SEQ ID NO: 339818 - DNA, 22 bp, Homo sapiens
tttgtatcaaactcgtctgatg

SEQ ID NO: 339819 - DNA, 22 bp, Homo sapiens
tttgtatcctccattgtatctt

SEQ ID NO: 339820 - DNA, 20 bp, Homo sapiens
tttgtatctctgaagcatgt

SEQ ID NO: 339821 - DNA, 13 bp, Homo sapiens
tttgtatctgaag

SEQ ID NO: 339822 - DNA, 14 bp, Homo sapiens
tttgtatcttaaat

SEQ ID NO: 339823 - DNA, 15 bp, Homo sapiens
tttgtatcttaaatc

SEQ ID NO: 339824 - DNA, 16 bp, Homo sapiens
tttgtatcttaaatct

SEQ ID NO: 339825 - DNA, 14 bp, Homo sapiens
tttgtatcttgatg

SEQ ID NO: 339826 - DNA, 16 bp, Homo sapiens
tttgtatgaagtactt

SEQ ID NO: 339827 - DNA, 13 bp, Homo sapiens
tttgtatgtatgt

SEQ ID NO: 339828 - DNA, 17 bp, Homo sapiens
tttgtattacatctaat

SEQ ID NO: 339829 - DNA, 12 bp, Homo sapiens
tttgtattgcca

SEQ ID NO: 339830 - DNA, 10 bp, Homo sapiens
tttgtattta

SEQ ID NO: 339831 - DNA, 14 bp, Homo sapiens
tttgtatttaatga

SEQ ID NO: 339832 - DNA, 11 bp, Homo sapiens
tttgtatttct

SEQ ID NO: 339833 - DNA, 12 bp, Homo sapiens
tttgtatttctt

SEQ ID NO: 339834 - DNA, 13 bp, Homo sapiens
tttgtatttcttt

SEQ ID NO: 339835 - DNA, 15 bp, Homo sapiens
tttgtatttctttta

SEQ ID NO: 339836 - DNA, 22 bp, Homo sapiens
tttgtatttcttttatatataa

SEQ ID NO: 339837 - DNA, 14 bp, Homo sapiens
tttgtatttttagt

SEQ ID NO: 339838 - DNA, 17 bp, Homo sapiens
tttgtatttttgaataa

SEQ ID NO: 339839 - DNA, 23 bp, Homo sapiens
tttgtcacaatcctaacacatta

SEQ ID NO: 339840 - DNA, 19 bp, Homo sapiens
tttgtcacagctcttgttt

SEQ ID NO: 339841 - DNA, 14 bp, Homo sapiens
tttgtcactcggct

SEQ ID NO: 339842 - DNA, 13 bp, Homo sapiens
tttgtcactgaat

SEQ ID NO: 339843 - DNA, 13 bp, Homo sapiens
tttgtcacttctg

SEQ ID NO: 339844 - DNA, 19 bp, Homo sapiens
tttgtcatcagatggaaat

SEQ ID NO: 339845 - DNA, 22 bp, Homo sapiens
tttgtcatcagatggaaatatt

SEQ ID NO: 339846 - DNA, 23 bp, Homo sapiens
tttgtcattcaagcctgtgaata

SEQ ID NO: 339847 - DNA, 24 bp, Homo sapiens
tttgtccacccacttagtccactc

SEQ ID NO: 339848 - DNA, 20 bp, Homo sapiens
tttgtccccagggcccctcc

SEQ ID NO: 339849 - DNA, 20 bp, Homo sapiens
tttgtctcattttgtatgta

SEQ ID NO: 339850 - DNA, 19 bp, Homo sapiens
tttgtctcctactctgtgt

SEQ ID NO: 339851 - DNA, 20 bp, Homo sapiens
tttgtctcctactctgtgta

SEQ ID NO: 339852 - DNA, 22 bp, Homo sapiens
tttgtctcctactctgtgtaaa

SEQ ID NO: 339853 - DNA, 22 bp, Homo sapiens
tttgtctggctgtggcccctcc

SEQ ID NO: 339854 - DNA, 17 bp, Homo sapiens
tttgtctgtcttcatag

SEQ ID NO: 339855 - DNA, 18 bp, Homo sapiens
tttgtcttacattggctt

SEQ ID NO: 339856 - DNA, 20 bp, Homo sapiens
tttgtcttatatatatttct

SEQ ID NO: 339857 - DNA, 22 bp, Homo sapiens
tttgtgaaatgatggtgaaagt

SEQ ID NO: 339858 - DNA, 21 bp, Homo sapiens
tttgtgaagtgattgacattt

SEQ ID NO: 339859 - DNA, 22 bp, Homo sapiens
tttgtgactatatagagatgtt

SEQ ID NO: 339860 - DNA, 23 bp, Homo sapiens
tttgtgactatatagagatgttt

SEQ ID NO: 339861 - DNA, 12 bp, Homo sapiens
tttgtgagagcg

SEQ ID NO: 339862 - DNA, 15 bp, Homo sapiens
tttgtgagtatgtgt

SEQ ID NO: 339863 - DNA, 19 bp, Homo sapiens
tttgtgatatggagccctg

SEQ ID NO: 339864 - DNA, 14 bp, Homo sapiens
tttgtgatgatgct

SEQ ID NO: 339865 - DNA, 17 bp, Homo sapiens
tttgtgatttagaactg

SEQ ID NO: 339866 - DNA, 15 bp, Homo sapiens
tttgtgcttgttctt

SEQ ID NO: 339867 - DNA, 11 bp, Homo sapiens
tttgtggaaaa

SEQ ID NO: 339868 - DNA, 14 bp, Homo sapiens
tttgtggactttat

SEQ ID NO: 339869 - DNA, 14 bp, Homo sapiens
tttgtggagtactg

SEQ ID NO: 339870 - DNA, 14 bp, Homo sapiens
tttgtggcctcaga

SEQ ID NO: 339871 - DNA, 15 bp, Homo sapiens
tttgtggcctcagaa

SEQ ID NO: 339872 - DNA, 22 bp, Homo sapiens
tttgtggtacgacctttagatt

SEQ ID NO: 339873 - DNA, 15 bp, Homo sapiens
tttgtggttctattt

SEQ ID NO: 339874 - DNA, 19 bp, Homo sapiens
tttgtgtaatagaaaactg

SEQ ID NO: 339875 - DNA, 23 bp, Homo sapiens
tttgtgtaatattactttaacat

SEQ ID NO: 339876 - DNA, 18 bp, Homo sapiens
tttgtgtacagtatgtgt

SEQ ID NO: 339877 - DNA, 22 bp, Homo sapiens
tttgtgtcaatgggcaatgaca

SEQ ID NO: 339878 - DNA, 20 bp, Homo sapiens
tttgtgtccataagagaaat

SEQ ID NO: 339879 - DNA, 14 bp, Homo sapiens
tttgtgtgtatata

SEQ ID NO: 339880 - DNA, 21 bp, Homo sapiens
tttgttaaaactggcatctga

SEQ ID NO: 339881 - DNA, 22 bp, Homo sapiens
tttgttaattgattaaactgta

SEQ ID NO: 339882 - DNA, 17 bp, Homo sapiens
tttgttaccttaaaact

SEQ ID NO: 339883 - DNA, 22 bp, Homo sapiens
tttgttactgtctgtagtgttt

SEQ ID NO: 339884 - DNA, 12 bp, Homo sapiens
tttgttatttgt

SEQ ID NO: 339885 - DNA, 17 bp, Homo sapiens
tttgttatttgtacagt

SEQ ID NO: 339886 - DNA, 19 bp, Homo sapiens
tttgttatttgtacagttc

SEQ ID NO: 339887 - DNA, 14 bp, Homo sapiens
tttgttcattaaac

SEQ ID NO: 339888 - DNA, 21 bp, Homo sapiens
tttgttctagacttccccatc

SEQ ID NO: 339889 - DNA, 15 bp, Homo sapiens
tttgttctctcttgg

SEQ ID NO: 339890 - DNA, 21 bp, Homo sapiens
tttgttctgcagagacttcta

SEQ ID NO: 339891 - DNA, 17 bp, Homo sapiens
tttgttgagtctctgaa

SEQ ID NO: 339892 - DNA, 21 bp, Homo sapiens
tttgttgcagttaattcttgc

SEQ ID NO: 339893 - DNA, 22 bp, Homo sapiens
tttgttggcccttccagtggga

SEQ ID NO: 339894 - DNA, 15 bp, Homo sapiens
tttgttgtcatgtgt

SEQ ID NO: 339895 - DNA, 16 bp, Homo sapiens
tttgttgtcatgtgta

SEQ ID NO: 339896 - DNA, 13 bp, Homo sapiens
tttgttgtgactt

SEQ ID NO: 339897 - DNA, 16 bp, Homo sapiens
tttgtttcttccaaag

SEQ ID NO: 339898 - DNA, 11 bp, Homo sapiens
tttgtttgttt

SEQ ID NO: 339899 - DNA, 21 bp, Homo sapiens
tttgttttaaaataagttaaa

SEQ ID NO: 339900 - DNA, 14 bp, Homo sapiens
tttgttttcatggt

SEQ ID NO: 339901 - DNA, 11 bp, Homo sapiens
tttgttttgtt

SEQ ID NO: 339902 - DNA, 14 bp, Homo sapiens
tttgtttttgtctt

SEQ ID NO: 339903 - DNA, 18 bp, Homo sapiens
tttgttttttgacttctg

SEQ ID NO: 339904 - DNA, 18 bp, Homo sapiens
ttttaaaaaaataatata

SEQ ID NO: 339905 - DNA, 19 bp, Homo sapiens
taagacatagtctctacct

SEQ ID NO: 339906 - DNA, 21 bp, Homo sapiens
taagacatgcactatgaggaa

SEQ ID NO: 339907 - DNA, 23 bp, Homo sapiens
taagaccggaagctcctggtatg

SEQ ID NO: 339908 - DNA, 21 bp, Homo sapiens
taagaccgtgtcccaaggagc

SEQ ID NO: 339909 - DNA, 22 bp, Homo sapiens
taagacgacttatatatttgaa

SEQ ID NO: 339910 - DNA, 18 bp, Homo sapiens
taagagaaagaaaatgaa

SEQ ID NO: 339911 - DNA, 21 bp, Homo sapiens
taagagatctggtcaaagcaa

SEQ ID NO: 339912 - DNA, 19 bp, Homo sapiens
taagagcaccttcctcact

SEQ ID NO: 339913 - DNA, 17 bp, Homo sapiens
taagagctggtgtctga

SEQ ID NO: 339914 - DNA, 16 bp, Homo sapiens
taagagtcctgaggca

SEQ ID NO: 339915 - DNA, 19 bp, Homo sapiens
taagagtgggggagagcag

SEQ ID NO: 339916 - DNA, 18 bp, Homo sapiens
taagataattaaatgaaa

SEQ ID NO: 339917 - DNA, 20 bp, Homo sapiens
taagatactcaagcaggttt

SEQ ID NO: 339918 - DNA, 15 bp, Homo sapiens
taagatgaaattgcc

SEQ ID NO: 339919 - DNA, 18 bp, Homo sapiens
taagatgaaattgccaaa

SEQ ID NO: 339920 - DNA, 20 bp, Homo sapiens
taagatgagatttgccagca

SEQ ID NO: 339921 - DNA, 16 bp, Homo sapiens
ttttcagtattttgga

SEQ ID NO: 339922 - DNA, 18 bp, Homo sapiens
ttttcatacttttacctt

SEQ ID NO: 339923 - DNA, 19 bp, Homo sapiens
ttttcatcaatttaaaatc

SEQ ID NO: 339924 - DNA, 22 bp, Homo sapiens
ttttcatccctgccaagaactc

SEQ ID NO: 339925 - DNA, 14 bp, Homo sapiens
ttttcatcctggcc

SEQ ID NO: 339926 - DNA, 15 bp, Homo sapiens
ttttcattttctctc

SEQ ID NO: 339927 - DNA, 16 bp, Homo sapiens
ttttcattttctctcc

SEQ ID NO: 339928 - DNA, 13 bp, Homo sapiens
ttttccagcaagt

SEQ ID NO: 339929 - DNA, 11 bp, Homo sapiens
ttttccatgaa

SEQ ID NO: 339930 - DNA, 14 bp, Homo sapiens
ttttccatgaaaac

SEQ ID NO: 339931 - DNA, 14 bp, Homo sapiens
ttttccatgtatct

SEQ ID NO: 339932 - DNA, 18 bp, Homo sapiens
ttttccatttcttcagag

SEQ ID NO: 339933 - DNA, 19 bp, Homo sapiens
ttttcccaggacaggaaat

SEQ ID NO: 339934 - DNA, 18 bp, Homo sapiens
ttttccccccactctccc

SEQ ID NO: 339935 - DNA, 18 bp, Homo sapiens
ttttccccctaattctta

SEQ ID NO: 339936 - DNA, 22 bp, Homo sapiens
ttttcccctatcctgttcttcc

SEQ ID NO: 339937 - DNA, 14 bp, Homo sapiens
ttttcctaaatgca

SEQ ID NO: 339938 - DNA, 13 bp, Homo sapiens
ttttcctatttgt

SEQ ID NO: 339939 - DNA, 21 bp, Homo sapiens
ttttcctcccttgggttctga

SEQ ID NO: 339940 - DNA, 20 bp, Homo sapiens
ttttcctgggccttctcagc

SEQ ID NO: 339941 - DNA, 21 bp, Homo sapiens
ttttcctgggccttctcagct

SEQ ID NO: 339942 - DNA, 22 bp, Homo sapiens
ttttcctgggccttctcagctc

SEQ ID NO: 339943 - DNA, 12 bp, Homo sapiens
ttttcctgtcaa

SEQ ID NO: 339944 - DNA, 13 bp, Homo sapiens
ttttccttcctga

SEQ ID NO: 339945 - DNA, 14 bp, Homo sapiens
ttttccttcctgag

SEQ ID NO: 339946 - DNA, 15 bp, Homo sapiens
ttttccttcttagat

SEQ ID NO: 339947 - DNA, 12 bp, Homo sapiens
ttttcctttctg

SEQ ID NO: 339948 - DNA, 14 bp, Homo sapiens
ttttcgtcttccct

SEQ ID NO: 339949 - DNA, 17 bp, Homo sapiens
ttttcgtgcactctgct

SEQ ID NO: 339950 - DNA, 16 bp, Homo sapiens
ttttcgtgcatttgtg

SEQ ID NO: 339951 - DNA, 17 bp, Homo sapiens
ttttcgtgcatttgtga

SEQ ID NO: 339952 - DNA, 15 bp, Homo sapiens
ttttctaaactgttt

SEQ ID NO: 339953 - DNA, 22 bp, Homo sapiens
ttttctaaactgttttcatgtg

SEQ ID NO: 339954 - DNA, 13 bp, Homo sapiens
ttttctacagctt

SEQ ID NO: 339955 - DNA, 13 bp, Homo sapiens
ttttctacagtta

SEQ ID NO: 339956 - DNA, 22 bp, Homo sapiens
ttttctactcgagttacagaca

SEQ ID NO: 339957 - DNA, 17 bp, Homo sapiens
ttttctagttgtaatgt

SEQ ID NO: 339958 - DNA, 15 bp, Homo sapiens
ttttctagtttcagt

SEQ ID NO: 339959 - DNA, 16 bp, Homo sapiens
ttttctatatttgtaa

SEQ ID NO: 339960 - DNA, 18 bp, Homo sapiens
ttttctccacccaaaccc

SEQ ID NO: 339961 - DNA, 22 bp, Homo sapiens
ttttctcgagtccaaaatcatt

SEQ ID NO: 339962 - DNA, 12 bp, Homo sapiens
ttttctctttct

SEQ ID NO: 339963 - DNA, 22 bp, Homo sapiens
ttttctctttctccttagtctt

SEQ ID NO: 339964 - DNA, 17 bp, Homo sapiens
ttttctctttctctcct

SEQ ID NO: 339965 - DNA, 10 bp, Homo sapiens
ttttctgagc

SEQ ID NO: 339966 - DNA, 17 bp, Homo sapiens
ttttctggctcctgtgt

SEQ ID NO: 339967 - DNA, 19 bp, Homo sapiens
ttttctggtagatagaaat

SEQ ID NO: 339968 - DNA, 22 bp, Homo sapiens
ttttctggtaggttctgtctgt

SEQ ID NO: 339969 - DNA, 21 bp, Homo sapiens
ttttctgttgtacgtaaagct

SEQ ID NO: 339970 - DNA, 19 bp, Homo sapiens
ttttcttaccctctctttc

SEQ ID NO: 339971 - DNA, 21 bp, Homo sapiens
ttttcttaccctctctttcaa

SEQ ID NO: 339972 - DNA, 16 bp, Homo sapiens
ttttcttcatgcaatg

SEQ ID NO: 339973 - DNA, 22 bp, Homo sapiens
ttttcttcccatttgtaatgta

SEQ ID NO: 339974 - DNA, 11 bp, Homo sapiens
ttttcttcctt

SEQ ID NO: 339975 - DNA, 13 bp, Homo sapiens
ttttcttgccagc

SEQ ID NO: 339976 - DNA, 10 bp, Homo sapiens
ttttcttggt

SEQ ID NO: 339977 - DNA, 22 bp, Homo sapiens
ttttcttgtgtgtttattgtca

SEQ ID NO: 339978 - DNA, 13 bp, Homo sapiens
ttttctttctatg

SEQ ID NO: 339979 - DNA, 18 bp, Homo sapiens
ttttctttctatgtagaa

SEQ ID NO: 339980 - DNA, 21 bp, Homo sapiens
ttttctttgctgtgccaaagc

SEQ ID NO: 339981 - DNA, 17 bp, Homo sapiens
ttttcttttatatctgt

SEQ ID NO: 339982 - DNA, 20 bp, Homo sapiens
ttttctttttataactcatg

SEQ ID NO: 339983 - DNA, 20 bp, Homo sapiens
ttttgaaatttaaaaatctt

SEQ ID NO: 339984 - DNA, 18 bp, Homo sapiens
ttttgaactcacgagcct

SEQ ID NO: 339985 - DNA, 18 bp, Homo sapiens
ttttgaagaagggaaatt

SEQ ID NO: 339986 - DNA, 21 bp, Homo sapiens
ttttgaagcagtcttgctctg

SEQ ID NO: 339987 - DNA, 16 bp, Homo sapiens
ttttgaatttaaataa

SEQ ID NO: 339988 - DNA, 20 bp, Homo sapiens
ttttgacggatgattggatt

SEQ ID NO: 339989 - DNA, 20 bp, Homo sapiens
ttttgagtaattttctgatg

SEQ ID NO: 339990 - DNA, 20 bp, Homo sapiens
ttttgataaaatgttccttt

SEQ ID NO: 339991 - DNA, 12 bp, Homo sapiens
ttttgatacatt

SEQ ID NO: 339992 - DNA, 22 bp, Homo sapiens
ttttgatgccatttgtcttttg

SEQ ID NO: 339993 - DNA, 14 bp, Homo sapiens
ttttgatggctatg

SEQ ID NO: 339994 - DNA, 22 bp, Homo sapiens
ttttgatgtgcgtgctgtctgt

SEQ ID NO: 339995 - DNA, 20 bp, Homo sapiens
ttttgatgtttgtggcctca

SEQ ID NO: 339996 - DNA, 15 bp, Homo sapiens
ttttgatttatgcat

SEQ ID NO: 339997 - DNA, 16 bp, Homo sapiens
ttttgcaaaagaagtt

SEQ ID NO: 339998 - DNA, 14 bp, Homo sapiens
ttttgcaagggaat

SEQ ID NO: 339999 - DNA, 14 bp, Homo sapiens
ttttgcacatatat

SEQ ID NO: 340000 - DNA, 15 bp, Homo sapiens
ttttgcacatatatt

SEQ ID NO: 340001 - DNA, 12 bp, Homo sapiens
ttttgcactttt

SEQ ID NO: 340002 - DNA, 22 bp, Homo sapiens
ttttgcattgtgtgagcttcta

SEQ ID NO: 340003 - DNA, 23 bp, Homo sapiens
ttttgccactgcaaacaataaac

SEQ ID NO: 340004 - DNA, 15 bp, Homo sapiens
ttttgccattaaact

SEQ ID NO: 340005 - DNA, 12 bp, Homo sapiens
ttttgcctggct

SEQ ID NO: 340006 - DNA, 14 bp, Homo sapiens
ttttgcgatgtgtt

SEQ ID NO: 340007 - DNA, 18 bp, Homo sapiens
ttttgcgatgtgttttat

SEQ ID NO: 340008 - DNA, 21 bp, Homo sapiens
ttttgcgatgtgttttattca

SEQ ID NO: 340009 - DNA, 21 bp, Homo sapiens
ttttgctaggtataaaaaata

SEQ ID NO: 340010 - DNA, 18 bp, Homo sapiens
ttttgctcagttccatgg

SEQ ID NO: 340011 - DNA, 14 bp, Homo sapiens
ttttgctgaattcc

SEQ ID NO: 340012 - DNA, 15 bp, Homo sapiens
ttttgctgaattcct

SEQ ID NO: 340013 - DNA, 19 bp, Homo sapiens
ttttgctggtgtctgagct

SEQ ID NO: 340014 - DNA, 21 bp, Homo sapiens
ttttgcttttccctagtgctg

SEQ ID NO: 340015 - DNA, 22 bp, Homo sapiens
ttttggaaaacgatttaattta

SEQ ID NO: 340016 - DNA, 18 bp, Homo sapiens
ttttggaattggtgtata

SEQ ID NO: 340017 - DNA, 22 bp, Homo sapiens
ttttggatgaatgcagtataaa

SEQ ID NO: 340018 - DNA, 22 bp, Homo sapiens
ttttggcattatctctttctct

SEQ ID NO: 340019 - DNA, 15 bp, Homo sapiens
ttttggcctttgtaa

SEQ ID NO: 340020 - DNA, 22 bp, Homo sapiens
ttttgggaaattcttgcactgt

SEQ ID NO: 340021 - DNA, 21 bp, Homo sapiens
ttttggtccaagttgtgctta

SEQ ID NO: 340022 - DNA, 16 bp, Homo sapiens
ttttggttcttagttc

SEQ ID NO: 340023 - DNA, 14 bp, Homo sapiens
ttttggtttacctg

SEQ ID NO: 340024 - DNA, 21 bp, Homo sapiens
ttttgtaaactgtatcaaatc

SEQ ID NO: 340025 - DNA, 17 bp, Homo sapiens
ttttgtacaattactaa

SEQ ID NO: 340026 - DNA, 12 bp, Homo sapiens
ttttgtagctag

SEQ ID NO: 340027 - DNA, 22 bp, Homo sapiens
ttttgtaggggtcaaagaaatg

SEQ ID NO: 340028 - DNA, 23 bp, Homo sapiens
ttttgtaggggtcaaagaaatgc

SEQ ID NO: 340029 - DNA, 13 bp, Homo sapiens
ttttgtatatatc

SEQ ID NO: 340030 - DNA, 13 bp, Homo sapiens
ttttgtatcctcc

SEQ ID NO: 340031 - DNA, 14 bp, Homo sapiens
ttttgtatgtatgt

SEQ ID NO: 340032 - DNA, 16 bp, Homo sapiens
ttttgtattgtttaaa

SEQ ID NO: 340033 - DNA, 15 bp, Homo sapiens
ttttgtatttaatga

SEQ ID NO: 340034 - DNA, 14 bp, Homo sapiens
ttttgtatttcttt

SEQ ID NO: 340035 - DNA, 17 bp, Homo sapiens
ttttgtatttcttttat

SEQ ID NO: 340036 - DNA, 19 bp, Homo sapiens
ttttgtatttcttttatat

SEQ ID NO: 340037 - DNA, 18 bp, Homo sapiens
ttttgtccaagttcacag

SEQ ID NO: 340038 - DNA, 16 bp, Homo sapiens
ttttgtcccccaactt

SEQ ID NO: 340039 - DNA, 15 bp, Homo sapiens
ttttgtctcgaaata

SEQ ID NO: 340040 - DNA, 24 bp, Homo sapiens
ttttgtgaaatgaaaacatgtaat

SEQ ID NO: 340041 - DNA, 23 bp, Homo sapiens
ttttgtgactatatagagatgtt

SEQ ID NO: 340042 - DNA, 16 bp, Homo sapiens
ttttgtgtacagtatg

SEQ ID NO: 340043 - DNA, 19 bp, Homo sapiens
ttttgtgtacagtatgtgt

SEQ ID NO: 340044 - DNA, 15 bp, Homo sapiens
ttttgtgtcttaaga

SEQ ID NO: 340045 - DNA, 13 bp, Homo sapiens
ttttgtgtttcta

SEQ ID NO: 340046 - DNA, 19 bp, Homo sapiens
ttttgttaagttcaccgta

SEQ ID NO: 340047 - DNA, 12 bp, Homo sapiens
ttttgttactgt

SEQ ID NO: 340048 - DNA, 14 bp, Homo sapiens
ttttgttctagact

SEQ ID NO: 340049 - DNA, 18 bp, Homo sapiens
ttttgttgagtctctgaa

SEQ ID NO: 340050 - DNA, 13 bp, Homo sapiens
ttttgttgctgtt

SEQ ID NO: 340051 - DNA, 13 bp, Homo sapiens
taatgtagctatt

SEQ ID NO: 340052 - DNA, 17 bp, Homo sapiens
cagcttgttatttataa

SEQ ID NO: 340053 - DNA, 16 bp, Homo sapiens
cagcttgttttggact

SEQ ID NO: 340054 - DNA, 21 bp, Homo sapiens
cagctttacatgcaatttatt

SEQ ID NO: 340055 - DNA, 19 bp, Homo sapiens
cagctttcagagccagtga

SEQ ID NO: 340056 - DNA, 20 bp, Homo sapiens
cagctttcccaggtataaaa

SEQ ID NO: 340057 - DNA, 18 bp, Homo sapiens
cagctttccctggctcag

SEQ ID NO: 340058 - DNA, 19 bp, Homo sapiens
cagctttccctggctcagg

SEQ ID NO: 340059 - DNA, 20 bp, Homo sapiens
cagctttccctggctcaggg

SEQ ID NO: 340060 - DNA, 16 bp, Homo sapiens
cagctttcctgggtga

SEQ ID NO: 340061 - DNA, 22 bp, Homo sapiens
cagctttgactttatctcctgc

SEQ ID NO: 340062 - DNA, 15 bp, Homo sapiens
cagctttgccttcca

SEQ ID NO: 340063 - DNA, 17 bp, Homo sapiens
cagcttttaataaaatt

SEQ ID NO: 340064 - DNA, 14 bp, Homo sapiens
cagcttttactgtt

SEQ ID NO: 340065 - DNA, 20 bp, Homo sapiens
cagcttttagtacccacctg

SEQ ID NO: 340066 - DNA, 15 bp, Homo sapiens
cagcttttctctttt

SEQ ID NO: 340067 - DNA, 15 bp, Homo sapiens
cagcttttcttgcca

SEQ ID NO: 340068 - DNA, 18 bp, Homo sapiens
cagcttttcttgccagct

SEQ ID NO: 340069 - DNA, 18 bp, Homo sapiens
cagcttttttagaggtga

SEQ ID NO: 340070 - DNA, 15 bp, Homo sapiens
caggaaaaaaacttt

SEQ ID NO: 340071 - DNA, 15 bp, Homo sapiens
caggaaaaacctgtg

SEQ ID NO: 340072 - DNA, 17 bp, Homo sapiens
caggaaaactgtttttc

SEQ ID NO: 340073 - DNA, 15 bp, Homo sapiens
caggaaaccctggct

SEQ ID NO: 340074 - DNA, 14 bp, Homo sapiens
caggaaagatccca

SEQ ID NO: 340075 - DNA, 18 bp, Homo sapiens
caggaaagcgtttggaaa

SEQ ID NO: 340076 - DNA, 13 bp, Homo sapiens
caggaaatatata

SEQ ID NO: 340077 - DNA, 16 bp, Homo sapiens
caggaaatatatatgt

SEQ ID NO: 340078 - DNA, 17 bp, Homo sapiens
caggaaattgcaaagaa

SEQ ID NO: 340079 - DNA, 20 bp, Homo sapiens
caggaacacccagccccagc

SEQ ID NO: 340080 - DNA, 22 bp, Homo sapiens
caggaacagctatgggagcccc

SEQ ID NO: 340081 - DNA, 15 bp, Homo sapiens
caggaacctggacca

SEQ ID NO: 340082 - DNA, 16 bp, Homo sapiens
caggaacgagcactgg

SEQ ID NO: 340083 - DNA, 17 bp, Homo sapiens
caggaacgagcactggc

SEQ ID NO: 340084 - DNA, 19 bp, Homo sapiens
caggaacgagcactggcca

SEQ ID NO: 340085 - DNA, 18 bp, Homo sapiens
caggaagaaggcccggga

SEQ ID NO: 340086 - DNA, 20 bp, Homo sapiens
caggaagaaggcccgggagg

SEQ ID NO: 340087 - DNA, 13 bp, Homo sapiens
caggaagactgga

SEQ ID NO: 340088 - DNA, 17 bp, Homo sapiens
caggaagagatgctcta

SEQ ID NO: 340089 - DNA, 14 bp, Homo sapiens
caggaagcaaggcc

SEQ ID NO: 340090 - DNA, 16 bp, Homo sapiens
caggaagcaaggccag

SEQ ID NO: 340091 - DNA, 19 bp, Homo sapiens
caggaagcaaggccagccc

SEQ ID NO: 340092 - DNA, 18 bp, Homo sapiens
caggaagcacagcaggtt

SEQ ID NO: 340093 - DNA, 14 bp, Homo sapiens
caggaagcacccca

SEQ ID NO: 340094 - DNA, 17 bp, Homo sapiens
caggaagcaccccatgc

SEQ ID NO: 340095 - DNA, 12 bp, Homo sapiens
caggaagcaggg

SEQ ID NO: 340096 - DNA, 14 bp, Homo sapiens
caggaagcagggag

SEQ ID NO: 340097 - DNA, 22 bp, Homo sapiens
caggaagcctcctgctgagtgg

SEQ ID NO: 340098 - DNA, 12 bp, Homo sapiens
caggaaggagag

SEQ ID NO: 340099 - DNA, 14 bp, Homo sapiens
caggaaggagagcc

SEQ ID NO: 340100 - DNA, 16 bp, Homo sapiens
caggaaggagagcctg

SEQ ID NO: 340101 - DNA, 13 bp, Homo sapiens
caggaaggcagct

SEQ ID NO: 340102 - DNA, 15 bp, Homo sapiens
caggaagggagagga

SEQ ID NO: 340103 - DNA, 22 bp, Homo sapiens
caggaagggcctacagcccatt

SEQ ID NO: 340104 - DNA, 22 bp, Homo sapiens
caggaagggtcaaaacatttta

SEQ ID NO: 340105 - DNA, 12 bp, Homo sapiens
caggaagtactg

SEQ ID NO: 340106 - DNA, 14 bp, Homo sapiens
caggaagtactgga

SEQ ID NO: 340107 - DNA, 16 bp, Homo sapiens
caggaagtactggaga

SEQ ID NO: 340108 - DNA, 18 bp, Homo sapiens
caggaagtactggagaaa

SEQ ID NO: 340109 - DNA, 13 bp, Homo sapiens
caggaagtcagga

SEQ ID NO: 340110 - DNA, 18 bp, Homo sapiens
caggaagtcaggagccag

SEQ ID NO: 340111 - DNA, 21 bp, Homo sapiens
caggaagtcaggagccagcag

SEQ ID NO: 340112 - DNA, 18 bp, Homo sapiens
caggaagtccagctcctt

SEQ ID NO: 340113 - DNA, 21 bp, Homo sapiens
caggaagtccctgagaagcct

SEQ ID NO: 340114 - DNA, 16 bp, Homo sapiens
caggaagtcttcaggg

SEQ ID NO: 340115 - DNA, 19 bp, Homo sapiens
caggaagtgggagaagtgg

SEQ ID NO: 340116 - DNA, 23 bp, Homo sapiens
caggaagtgggagaagtggcccc

SEQ ID NO: 340117 - DNA, 16 bp, Homo sapiens
caggaatcaaggagcc

SEQ ID NO: 340118 - DNA, 17 bp, Homo sapiens
caggaatcaaggagcct

SEQ ID NO: 340119 - DNA, 19 bp, Homo sapiens
caggaatcaaggagcctcc

SEQ ID NO: 340120 - DNA, 14 bp, Homo sapiens
caggacacagatct

SEQ ID NO: 340121 - DNA, 19 bp, Homo sapiens
caggacagcatggtgcatg

SEQ ID NO: 340122 - DNA, 12 bp, Homo sapiens
caggacagctgc

SEQ ID NO: 340123 - DNA, 14 bp, Homo sapiens
caggacagctgcag

SEQ ID NO: 340124 - DNA, 13 bp, Homo sapiens
caggacaggaaat

SEQ ID NO: 340125 - DNA, 14 bp, Homo sapiens
caggacaggaaata

SEQ ID NO: 340126 - DNA, 13 bp, Homo sapiens
caggaccaggagc

SEQ ID NO: 340127 - DNA, 16 bp, Homo sapiens
caggaccaggagccag

SEQ ID NO: 340128 - DNA, 13 bp, Homo sapiens
caggacccaggcc

SEQ ID NO: 340129 - DNA, 16 bp, Homo sapiens
caggacccaggccctc

SEQ ID NO: 340130 - DNA, 18 bp, Homo sapiens
caggacccaggccctcca

SEQ ID NO: 340131 - DNA, 13 bp, Homo sapiens
caggaccccagag

SEQ ID NO: 340132 - DNA, 21 bp, Homo sapiens
caggaccccagagggaccagc

SEQ ID NO: 340133 - DNA, 22 bp, Homo sapiens
caggaccccagagggaccagct

SEQ ID NO: 340134 - DNA, 15 bp, Homo sapiens
caggaccccatctgc

SEQ ID NO: 340135 - DNA, 16 bp, Homo sapiens
caggaccccatctgct

SEQ ID NO: 340136 - DNA, 17 bp, Homo sapiens
caggaccccatctgctg

SEQ ID NO: 340137 - DNA, 22 bp, Homo sapiens
caggaccccatctgctgagctc

SEQ ID NO: 340138 - DNA, 13 bp, Homo sapiens
caggacccttcta

SEQ ID NO: 340139 - DNA, 13 bp, Homo sapiens
caggaccttttga

SEQ ID NO: 340140 - DNA, 17 bp, Homo sapiens
caggacgtctggggtgt

SEQ ID NO: 340141 - DNA, 23 bp, Homo sapiens
caggacgttaggcccgggcccct

SEQ ID NO: 340142 - DNA, 13 bp, Homo sapiens
caggactccctcc

SEQ ID NO: 340143 - DNA, 14 bp, Homo sapiens
caggactccctcct

SEQ ID NO: 340144 - DNA, 17 bp, Homo sapiens
caggactccctcctcac

SEQ ID NO: 340145 - DNA, 21 bp, Homo sapiens
caggactcgggctaagtccag

SEQ ID NO: 340146 - DNA, 14 bp, Homo sapiens
caggactctctttc

SEQ ID NO: 340147 - DNA, 15 bp, Homo sapiens
caggactctgcctcc

SEQ ID NO: 340148 - DNA, 16 bp, Homo sapiens
caggactctgcctcct

SEQ ID NO: 340149 - DNA, 15 bp, Homo sapiens
caggactctgccttc

SEQ ID NO: 340150 - DNA, 18 bp, Homo sapiens
caggactctgccttccag

SEQ ID NO: 340151 - DNA, 19 bp, Homo sapiens
caggactctgccttccagg

SEQ ID NO: 340152 - DNA, 23 bp, Homo sapiens
caggacttaacggctccaggatt

SEQ ID NO: 340153 - DNA, 21 bp, Homo sapiens
caggacttaagacaaatggga

SEQ ID NO: 340154 - DNA, 13 bp, Homo sapiens
caggacttgaatt

SEQ ID NO: 340155 - DNA, 23 bp, Homo sapiens
caggacttgcttccaagcccttc

SEQ ID NO: 340156 - DNA, 21 bp, Homo sapiens
caggagaatcgcttgaacctg

SEQ ID NO: 340157 - DNA, 17 bp, Homo sapiens
caggagacactggtctc

SEQ ID NO: 340158 - DNA, 20 bp, Homo sapiens
caggagacactggtctcaga

SEQ ID NO: 340159 - DNA, 13 bp, Homo sapiens
cagggaggcacca

SEQ ID NO: 340160 - DNA, 24 bp, Homo sapiens
cagggaggcaccattcaggaacct

SEQ ID NO: 340161 - DNA, 18 bp, Homo sapiens
cagggagggaaacccggg

SEQ ID NO: 340162 - DNA, 16 bp, Homo sapiens
cagggaggggaggcag

SEQ ID NO: 340163 - DNA, 14 bp, Homo sapiens
cagggaggtcaggc

SEQ ID NO: 340164 - DNA, 18 bp, Homo sapiens
cagggaggtcaggccctg

SEQ ID NO: 340165 - DNA, 16 bp, Homo sapiens
cagggaggtcattttg

SEQ ID NO: 340166 - DNA, 13 bp, Homo sapiens
cagggagtcccct

SEQ ID NO: 340167 - DNA, 23 bp, Homo sapiens
cagggatgccatctgtgggcacg

SEQ ID NO: 340168 - DNA, 21 bp, Homo sapiens
cagggatgtgggaatctccca

SEQ ID NO: 340169 - DNA, 20 bp, Homo sapiens
cagggattaacctctgcact

SEQ ID NO: 340170 - DNA, 23 bp, Homo sapiens
cagggattctgggcttggggtgt

SEQ ID NO: 340171 - DNA, 13 bp, Homo sapiens
cagggatttgagg

SEQ ID NO: 340172 - DNA, 16 bp, Homo sapiens
cagggcaccaagccca

SEQ ID NO: 340173 - DNA, 15 bp, Homo sapiens
cagggcactgctgct

SEQ ID NO: 340174 - DNA, 13 bp, Homo sapiens
cagggcagaggga

SEQ ID NO: 340175 - DNA, 11 bp, Homo sapiens
cagggcagcct

SEQ ID NO: 340176 - DNA, 19 bp, Homo sapiens
cagggcagcctgtgggaga

SEQ ID NO: 340177 - DNA, 23 bp, Homo sapiens
cagggcagcctgtgggagaaggg

SEQ ID NO: 340178 - DNA, 16 bp, Homo sapiens
cagggcaggcagagct

SEQ ID NO: 340179 - DNA, 17 bp, Homo sapiens
cagggcaggcagagctc

SEQ ID NO: 340180 - DNA, 15 bp, Homo sapiens
cagggcagggctcat

SEQ ID NO: 340181 - DNA, 16 bp, Homo sapiens
cagggcagggctctga

SEQ ID NO: 340182 - DNA, 17 bp, Homo sapiens
cagggcagggtgggcag

SEQ ID NO: 340183 - DNA, 23 bp, Homo sapiens
cagggcagggtgggcagcctatg

SEQ ID NO: 340184 - DNA, 15 bp, Homo sapiens
cagggcatctccagg

SEQ ID NO: 340185 - DNA, 13 bp, Homo sapiens
cagggcatctcct

SEQ ID NO: 340186 - DNA, 16 bp, Homo sapiens
cagggccagaaggagg

SEQ ID NO: 340187 - DNA, 21 bp, Homo sapiens
cagggccagaaggagggcaga

SEQ ID NO: 340188 - DNA, 15 bp, Homo sapiens
cagggcccaggcctg

SEQ ID NO: 340189 - DNA, 15 bp, Homo sapiens
cagggcccctccctc

SEQ ID NO: 340190 - DNA, 12 bp, Homo sapiens
cagggcccgagc

SEQ ID NO: 340191 - DNA, 15 bp, Homo sapiens
cagggcccgagcgcg

SEQ ID NO: 340192 - DNA, 12 bp, Homo sapiens
cagggccctgct

SEQ ID NO: 340193 - DNA, 22 bp, Homo sapiens
cagggccctggggtctctgagc

SEQ ID NO: 340194 - DNA, 19 bp, Homo sapiens
cagggccgcccgggcccag

SEQ ID NO: 340195 - DNA, 21 bp, Homo sapiens
cagggccgcccgggcccagag

SEQ ID NO: 340196 - DNA, 22 bp, Homo sapiens
cagggcctggggagatggagga

SEQ ID NO: 340197 - DNA, 19 bp, Homo sapiens
cagggcctgggggcagtga

SEQ ID NO: 340198 - DNA, 21 bp, Homo sapiens
cagggcctgggggcagtgact

SEQ ID NO: 340199 - DNA, 22 bp, Homo sapiens
cagggcctgggggcagtgactg

SEQ ID NO: 340200 - DNA, 13 bp, Homo sapiens
cagggcgctccgg

SEQ ID NO: 340201 - DNA, 18 bp, Homo sapiens
cagggcggctaggccggc

SEQ ID NO: 340202 - DNA, 14 bp, Homo sapiens
cagggcgggccagg

SEQ ID NO: 340203 - DNA, 15 bp, Homo sapiens
cagggcgggccagga

SEQ ID NO: 340204 - DNA, 18 bp, Homo sapiens
cagggcgggccaggagaa

SEQ ID NO: 340205 - DNA, 17 bp, Homo sapiens
cagggctaccctccccc

SEQ ID NO: 340206 - DNA, 14 bp, Homo sapiens
cagggctcagctcc

SEQ ID NO: 340207 - DNA, 15 bp, Homo sapiens
cagggctcagctcct

SEQ ID NO: 340208 - DNA, 23 bp, Homo sapiens
cagggctccacgggggcctagtg

SEQ ID NO: 340209 - DNA, 18 bp, Homo sapiens
cagggctcccacagagac

SEQ ID NO: 340210 - DNA, 19 bp, Homo sapiens
cagggctcccacagagaca

SEQ ID NO: 340211 - DNA, 22 bp, Homo sapiens
cagtgcacctgtggcctctcag

SEQ ID NO: 340212 - DNA, 13 bp, Homo sapiens
cagtgcagacagg

SEQ ID NO: 340213 - DNA, 13 bp, Homo sapiens
cagtgcagcaata

SEQ ID NO: 340214 - DNA, 18 bp, Homo sapiens
cagtgcatctcagcccac

SEQ ID NO: 340215 - DNA, 22 bp, Homo sapiens
cagtgcatgacgtttaaggcca

SEQ ID NO: 340216 - DNA, 17 bp, Homo sapiens
cagtgcatgctgtccct

SEQ ID NO: 340217 - DNA, 16 bp, Homo sapiens
cagtgcatgtgaagca

SEQ ID NO: 340218 - DNA, 14 bp, Homo sapiens
cagtgccacctatg

SEQ ID NO: 340219 - DNA, 20 bp, Homo sapiens
cagtgccacctatgcctgtg

SEQ ID NO: 340220 - DNA, 21 bp, Homo sapiens
cagtgccacctatgcctgtgg

SEQ ID NO: 340221 - DNA, 23 bp, Homo sapiens
cagtgccacctatgcctgtggtg

SEQ ID NO: 340222 - DNA, 15 bp, Homo sapiens
cagtgccatacatgt

SEQ ID NO: 340223 - DNA, 11 bp, Homo sapiens
cagtgcctcct

SEQ ID NO: 340224 - DNA, 13 bp, Homo sapiens
cagtgcctcctgg

SEQ ID NO: 340225 - DNA, 16 bp, Homo sapiens
cagtgcctcctggccg

SEQ ID NO: 340226 - DNA, 15 bp, Homo sapiens
cagtgcctcgaggca

SEQ ID NO: 340227 - DNA, 18 bp, Homo sapiens
cagtgcctcgaggcaccg

SEQ ID NO: 340228 - DNA, 19 bp, Homo sapiens
cagtgcctcgaggcaccgg

SEQ ID NO: 340229 - DNA, 14 bp, Homo sapiens
cagtgcctgccact

SEQ ID NO: 340230 - DNA, 15 bp, Homo sapiens
cagtgcctgccactc

SEQ ID NO: 340231 - DNA, 16 bp, Homo sapiens
cagtgcctgccactct

SEQ ID NO: 340232 - DNA, 21 bp, Homo sapiens
cagtgcctggatcccctctgt

SEQ ID NO: 340233 - DNA, 16 bp, Homo sapiens
cagtgcctggcaaggc

SEQ ID NO: 340234 - DNA, 15 bp, Homo sapiens
cagtgcctgtatctt

SEQ ID NO: 340235 - DNA, 16 bp, Homo sapiens
cagtgccttccataat

SEQ ID NO: 340236 - DNA, 23 bp, Homo sapiens
cagtgccttccataattatgaca

SEQ ID NO: 340237 - DNA, 13 bp, Homo sapiens
cagtgccttctct

SEQ ID NO: 340238 - DNA, 17 bp, Homo sapiens
cagtgcctttccccatt

SEQ ID NO: 340239 - DNA, 24 bp, Homo sapiens
cagtgcgcgtgcacgtggagagct

SEQ ID NO: 340240 - DNA, 19 bp, Homo sapiens
cagtgctagtgagctgggc

SEQ ID NO: 340241 - DNA, 18 bp, Homo sapiens
cagtgctcagttgtactt

SEQ ID NO: 340242 - DNA, 19 bp, Homo sapiens
cagttcatgttgctcagaa

SEQ ID NO: 340243 - DNA, 15 bp, Homo sapiens
cagttcattattttg

SEQ ID NO: 340244 - DNA, 19 bp, Homo sapiens
cagttcccccaacctcaga

SEQ ID NO: 340245 - DNA, 22 bp, Homo sapiens
cagttcccccagtacctccaag

SEQ ID NO: 340246 - DNA, 17 bp, Homo sapiens
cagttcccttggcctca

SEQ ID NO: 340247 - DNA, 19 bp, Homo sapiens
cagttcccttggcctcaga

SEQ ID NO: 340248 - DNA, 23 bp, Homo sapiens
cagttccgggagagcggctgccc

SEQ ID NO: 340249 - DNA, 14 bp, Homo sapiens
cagttcctgcagca

SEQ ID NO: 340250 - DNA, 16 bp, Homo sapiens
cagttcctgcagcaga

SEQ ID NO: 340251 - DNA, 21 bp, Homo sapiens
cagttcctgcagcagagcctg

SEQ ID NO: 340252 - DNA, 17 bp, Homo sapiens
cagttctcactcctagg

SEQ ID NO: 340253 - DNA, 15 bp, Homo sapiens
cagttctctccttct

SEQ ID NO: 340254 - DNA, 15 bp, Homo sapiens
cagttctgaataact

SEQ ID NO: 340255 - DNA, 11 bp, Homo sapiens
cagttctgcaa

SEQ ID NO: 340256 - DNA, 17 bp, Homo sapiens
cagttctgcaaatagaa

SEQ ID NO: 340257 - DNA, 19 bp, Homo sapiens
cagttcttcgggaagagag

SEQ ID NO: 340258 - DNA, 22 bp, Homo sapiens
cagttcttcgggaagagaggag

SEQ ID NO: 340259 - DNA, 23 bp, Homo sapiens
cagttcttcgggaagagaggagt

SEQ ID NO: 340260 - DNA, 19 bp, Homo sapiens
cagttcttggacccctgaa

SEQ ID NO: 340261 - DNA, 18 bp, Homo sapiens
cagttgaaaatggatttt

SEQ ID NO: 340262 - DNA, 20 bp, Homo sapiens
cagttgactggctttcctct

SEQ ID NO: 340263 - DNA, 21 bp, Homo sapiens
cagttgactggctttcctctc

SEQ ID NO: 340264 - DNA, 20 bp, Homo sapiens
cagttgagtcgtcatcactt

SEQ ID NO: 340265 - DNA, 16 bp, Homo sapiens
cagttgattagcagtt

SEQ ID NO: 340266 - DNA, 16 bp, Homo sapiens
cagttgcacttggcct

SEQ ID NO: 340267 - DNA, 19 bp, Homo sapiens
cagttgcacttggcctctg

SEQ ID NO: 340268 - DNA, 11 bp, Homo sapiens
cagttgcagcc

SEQ ID NO: 340269 - DNA, 20 bp, Homo sapiens
cagttggactgtggcctcag

SEQ ID NO: 340270 - DNA, 16 bp, Homo sapiens
cagttggccagagagc

SEQ ID NO: 340271 - DNA, 15 bp, Homo sapiens
cagttgggagcactg

SEQ ID NO: 340272 - DNA, 16 bp, Homo sapiens
cagttgggagcactgg

SEQ ID NO: 340273 - DNA, 18 bp, Homo sapiens
cagttgggagcactggag

SEQ ID NO: 340274 - DNA, 21 bp, Homo sapiens
cagttgggagcactggagtgc

SEQ ID NO: 340275 - DNA, 15 bp, Homo sapiens
cagttgggagtacat

SEQ ID NO: 340276 - DNA, 18 bp, Homo sapiens
cagttggttttgcatgtc

SEQ ID NO: 340277 - DNA, 21 bp, Homo sapiens
cagttggttttgcatgtctgc

SEQ ID NO: 340278 - DNA, 22 bp, Homo sapiens
cagttgtaacattctatttcaa

SEQ ID NO: 340279 - DNA, 20 bp, Homo sapiens
cagttgtcccgattgtaact

SEQ ID NO: 340280 - DNA, 20 bp, Homo sapiens
cagttgtctattctgagcct

SEQ ID NO: 340281 - DNA, 21 bp, Homo sapiens
cagttgtctattctgagcctt

SEQ ID NO: 340282 - DNA, 20 bp, Homo sapiens
cagttgttggcctccggcct

SEQ ID NO: 340283 - DNA, 17 bp, Homo sapiens
cagttgtttctaagagc

SEQ ID NO: 340284 - DNA, 21 bp, Homo sapiens
cagtttatatatatgctactt

SEQ ID NO: 340285 - DNA, 17 bp, Homo sapiens
cagtttctccatcagct

SEQ ID NO: 340286 - DNA, 18 bp, Homo sapiens
cagtttctgttgtttctt

SEQ ID NO: 340287 - DNA, 15 bp, Homo sapiens
cagtttgataactag

SEQ ID NO: 340288 - DNA, 12 bp, Homo sapiens
cagtttgatgct

SEQ ID NO: 340289 - DNA, 15 bp, Homo sapiens
cagtttgctatttgc

SEQ ID NO: 340290 - DNA, 19 bp, Homo sapiens
cagtttgctatttgcttta

SEQ ID NO: 340291 - DNA, 22 bp, Homo sapiens
cagtttgctatttgctttagag

SEQ ID NO: 340292 - DNA, 12 bp, Homo sapiens
cagtttgctttg

SEQ ID NO: 340293 - DNA, 14 bp, Homo sapiens
cagtttgctttgta

SEQ ID NO: 340294 - DNA, 13 bp, Homo sapiens
cagtttgtgcaag

SEQ ID NO: 340295 - DNA, 15 bp, Homo sapiens
cagttttatcatttt

SEQ ID NO: 340296 - DNA, 19 bp, Homo sapiens
cagttttcagtcaagttcc

SEQ ID NO: 340297 - DNA, 13 bp, Homo sapiens
cagttttccatga

SEQ ID NO: 340298 - DNA, 19 bp, Homo sapiens
cagttttccatgaaaacgt

SEQ ID NO: 340299 - DNA, 20 bp, Homo sapiens
cagttttcctagtctttggg

SEQ ID NO: 340300 - DNA, 11 bp, Homo sapiens
cagttttcctt

SEQ ID NO: 340301 - DNA, 16 bp, Homo sapiens
cagttttgaaagaaaa

SEQ ID NO: 340302 - DNA, 12 bp, Homo sapiens
cagttttgctgc

SEQ ID NO: 340303 - DNA, 19 bp, Homo sapiens
cagttttgctgctataatt

SEQ ID NO: 340304 - DNA, 21 bp, Homo sapiens
cagttttgtgtacagtatgtg

SEQ ID NO: 340305 - DNA, 22 bp, Homo sapiens
cagttttgtgtacagtatgtgt

SEQ ID NO: 340306 - DNA, 13 bp, Homo sapiens
cagttttgttttg

SEQ ID NO: 340307 - DNA, 12 bp, Homo sapiens
cagtttttcagg

SEQ ID NO: 340308 - DNA, 21 bp, Homo sapiens
cagtttttgttccttcctgcg

SEQ ID NO: 340309 - DNA, 23 bp, Homo sapiens
cataaaaagcctgcaatttcata

SEQ ID NO: 340310 - DNA, 20 bp, Homo sapiens
cataaaaggtgacccttctg

SEQ ID NO: 340311 - DNA, 17 bp, Homo sapiens
cataaaagtgctacttg

SEQ ID NO: 340312 - DNA, 14 bp, Homo sapiens
cataaaataaataa

SEQ ID NO: 340313 - DNA, 15 bp, Homo sapiens
cataaaataaataat

SEQ ID NO: 340314 - DNA, 17 bp, Homo sapiens
cataaaataaataatct

SEQ ID NO: 340315 - DNA, 13 bp, Homo sapiens
cataaaattggat

SEQ ID NO: 340316 - DNA, 14 bp, Homo sapiens
cataaacaacagta

SEQ ID NO: 340317 - DNA, 18 bp, Homo sapiens
cataaacagagtccctcc

SEQ ID NO: 340318 - DNA, 18 bp, Homo sapiens
cataaaccaataaaacaa

SEQ ID NO: 340319 - DNA, 17 bp, Homo sapiens
cataaacccatctgtaa

SEQ ID NO: 340320 - DNA, 18 bp, Homo sapiens
cataaacccatctgtaat

SEQ ID NO: 340321 - DNA, 13 bp, Homo sapiens
cataaactgactt

SEQ ID NO: 340322 - DNA, 22 bp, Homo sapiens
cataaataaattaaataaaata

SEQ ID NO: 340323 - DNA, 21 bp, Homo sapiens
cataaattatttctaaaacat

SEQ ID NO: 340324 - DNA, 11 bp, Homo sapiens
cataaattggc

SEQ ID NO: 340325 - DNA, 12 bp, Homo sapiens
cataacacacat

SEQ ID NO: 340326 - DNA, 14 bp, Homo sapiens
cataacacacatca

SEQ ID NO: 340327 - DNA, 16 bp, Homo sapiens
cataacaggcattgca

SEQ ID NO: 340328 - DNA, 21 bp, Homo sapiens
cataacaggcattgcactaaa

SEQ ID NO: 340329 - DNA, 22 bp, Homo sapiens
cataacagggtaaattattcag

SEQ ID NO: 340330 - DNA, 19 bp, Homo sapiens
cataactgacttagttctt

SEQ ID NO: 340331 - DNA, 19 bp, Homo sapiens
cataagatattctttacaa

SEQ ID NO: 340332 - DNA, 14 bp, Homo sapiens
cataagcaggagtt

SEQ ID NO: 340333 - DNA, 19 bp, Homo sapiens
cataaggcctgccctccca

SEQ ID NO: 340334 - DNA, 21 bp, Homo sapiens
cataagggacatgtctttggc

SEQ ID NO: 340335 - DNA, 18 bp, Homo sapiens
cataagtaattcaagaaa

SEQ ID NO: 340336 - DNA, 16 bp, Homo sapiens
cataagtggacccagc

SEQ ID NO: 340337 - DNA, 17 bp, Homo sapiens
cataagttaatattgga

SEQ ID NO: 340338 - DNA, 23 bp, Homo sapiens
cataatacattccatcacagcca

SEQ ID NO: 340339 - DNA, 17 bp, Homo sapiens
cataatagaatttccta

SEQ ID NO: 340340 - DNA, 17 bp, Homo sapiens
cataatagttagccctc

SEQ ID NO: 340341 - DNA, 20 bp, Homo sapiens
cataatatcttgaagaatat

SEQ ID NO: 340342 - DNA, 22 bp, Homo sapiens
cataatcatccttttttaaaaa

SEQ ID NO: 340343 - DNA, 22 bp, Homo sapiens
cataatgcactggggtaccaca

SEQ ID NO: 340344 - DNA, 21 bp, Homo sapiens
cataatgtagtgagtgtagac

SEQ ID NO: 340345 - DNA, 14 bp, Homo sapiens
cataattatgacag

SEQ ID NO: 340346 - DNA, 17 bp, Homo sapiens
cataattatgacagtta

SEQ ID NO: 340347 - DNA, 16 bp, Homo sapiens
cataattatgggaaca

SEQ ID NO: 340348 - DNA, 20 bp, Homo sapiens
cataattttcttcatgcaat

SEQ ID NO: 340349 - DNA, 17 bp, Homo sapiens
catacaaaaatatatta

SEQ ID NO: 340350 - DNA, 15 bp, Homo sapiens
cagtagctccaacac

SEQ ID NO: 340351 - DNA, 20 bp, Homo sapiens
cagtagctgccaaaaagaac

SEQ ID NO: 340352 - DNA, 16 bp, Homo sapiens
cagtaggtccaagggc

SEQ ID NO: 340353 - DNA, 17 bp, Homo sapiens
cagtaggtccaagggcc

SEQ ID NO: 340354 - DNA, 18 bp, Homo sapiens
cagtaggtccaagggcca

SEQ ID NO: 340355 - DNA, 17 bp, Homo sapiens
cagtagtgcctgtgatc

SEQ ID NO: 340356 - DNA, 23 bp, Homo sapiens
cagtagtgtcacttttttcctgt

SEQ ID NO: 340357 - DNA, 14 bp, Homo sapiens
cagtataaaagaca

SEQ ID NO: 340358 - DNA, 14 bp, Homo sapiens
cagtatactgtgtg

SEQ ID NO: 340359 - DNA, 17 bp, Homo sapiens
cagtatactgtgtggga

SEQ ID NO: 340360 - DNA, 16 bp, Homo sapiens
cagtatataagctgtt

SEQ ID NO: 340361 - DNA, 15 bp, Homo sapiens
cagtatcaaggctgc

SEQ ID NO: 340362 - DNA, 20 bp, Homo sapiens
cagtatcaggcctgccagac

SEQ ID NO: 340363 - DNA, 13 bp, Homo sapiens
cagtatcatctcc

SEQ ID NO: 340364 - DNA, 17 bp, Homo sapiens
cagtatcatctccatca

SEQ ID NO: 340365 - DNA, 23 bp, Homo sapiens
cagtatcctgctggttcactcta

SEQ ID NO: 340366 - DNA, 21 bp, Homo sapiens
cagtatcttgaagacttttct

SEQ ID NO: 340367 - DNA, 20 bp, Homo sapiens
cagtatgagtcaatgtgcag

SEQ ID NO: 340368 - DNA, 21 bp, Homo sapiens
cagtatggcggaggccatggg

SEQ ID NO: 340369 - DNA, 15 bp, Homo sapiens
cagtatgtattcttt

SEQ ID NO: 340370 - DNA, 19 bp, Homo sapiens
cagtatgttcaaagtcaaa

SEQ ID NO: 340371 - DNA, 19 bp, Homo sapiens
cagtattaaaggggggagg

SEQ ID NO: 340372 - DNA, 20 bp, Homo sapiens
cagtattaaaggggggaggg

SEQ ID NO: 340373 - DNA, 20 bp, Homo sapiens
cagtattaacatcaaagact

SEQ ID NO: 340374 - DNA, 20 bp, Homo sapiens
cagtattatagatataaata

SEQ ID NO: 340375 - DNA, 22 bp, Homo sapiens
cagtattatttctccatcccct

SEQ ID NO: 340376 - DNA, 20 bp, Homo sapiens
cagtattctcagagcatgtg

SEQ ID NO: 340377 - DNA, 16 bp, Homo sapiens
cagtattcttgtcaaa

SEQ ID NO: 340378 - DNA, 18 bp, Homo sapiens
cagtattgtgtaaaggaa

SEQ ID NO: 340379 - DNA, 23 bp, Homo sapiens
cagtatttaccttcctttgtctt

SEQ ID NO: 340380 - DNA, 19 bp, Homo sapiens
cagtatttattgttcccac

SEQ ID NO: 340381 - DNA, 18 bp, Homo sapiens
cagtattttggagaaatt

SEQ ID NO: 340382 - DNA, 20 bp, Homo sapiens
cagtattttggagaaattat

SEQ ID NO: 340383 - DNA, 19 bp, Homo sapiens
cagtattttggttcttagt

SEQ ID NO: 340384 - DNA, 15 bp, Homo sapiens
cagtcaaggagtggc

SEQ ID NO: 340385 - DNA, 14 bp, Homo sapiens
cagtcacccctgtc

SEQ ID NO: 340386 - DNA, 16 bp, Homo sapiens
cagtcacccctgtctg

SEQ ID NO: 340387 - DNA, 17 bp, Homo sapiens
cagtcagatttccagtc

SEQ ID NO: 340388 - DNA, 22 bp, Homo sapiens
cagtcaggaagcctcctgctga

SEQ ID NO: 340389 - DNA, 22 bp, Homo sapiens
catcgcaggagtctctgccacc

SEQ ID NO: 340390 - DNA, 18 bp, Homo sapiens
catcggagactgccccac

SEQ ID NO: 340391 - DNA, 12 bp, Homo sapiens
catcgggctttg

SEQ ID NO: 340392 - DNA, 17 bp, Homo sapiens
catcggtcctgtctccc

SEQ ID NO: 340393 - DNA, 22 bp, Homo sapiens
catcggtcctgtctcccctctg

SEQ ID NO: 340394 - DNA, 21 bp, Homo sapiens
catcggtgaaactaacagata

SEQ ID NO: 340395 - DNA, 15 bp, Homo sapiens
catcggttcaggagg

SEQ ID NO: 340396 - DNA, 14 bp, Homo sapiens
catcgtataaggaa

SEQ ID NO: 340397 - DNA, 23 bp, Homo sapiens
catcgtataaggaaatccagccc

SEQ ID NO: 340398 - DNA, 13 bp, Homo sapiens
catcgtgaccctt

SEQ ID NO: 340399 - DNA, 16 bp, Homo sapiens
catcgtgacccttcag

SEQ ID NO: 340400 - DNA, 20 bp, Homo sapiens
catcgttttctttgctgtgc

SEQ ID NO: 340401 - DNA, 23 bp, Homo sapiens
catcgttttctttgctgtgccaa

SEQ ID NO: 340402 - DNA, 14 bp, Homo sapiens
catctaaaatactc

SEQ ID NO: 340403 - DNA, 13 bp, Homo sapiens
catctaagacatt

SEQ ID NO: 340404 - DNA, 18 bp, Homo sapiens
catctaatgcttgtttat

SEQ ID NO: 340405 - DNA, 13 bp, Homo sapiens
catctagcacagc

SEQ ID NO: 340406 - DNA, 14 bp, Homo sapiens
catctataaaatga

SEQ ID NO: 340407 - DNA, 14 bp, Homo sapiens
catctatcgagttt

SEQ ID NO: 340408 - DNA, 20 bp, Homo sapiens
catctatcgagtttgcaatg

SEQ ID NO: 340409 - DNA, 14 bp, Homo sapiens
catctattttctca

SEQ ID NO: 340410 - DNA, 13 bp, Homo sapiens
catctcagaagat

SEQ ID NO: 340411 - DNA, 14 bp, Homo sapiens
catctcagcctcct

SEQ ID NO: 340412 - DNA, 19 bp, Homo sapiens
catctcagcctcctgagcc

SEQ ID NO: 340413 - DNA, 14 bp, Homo sapiens
catctcaggccacc

SEQ ID NO: 340414 - DNA, 22 bp, Homo sapiens
catctcaggccacctgccccct

SEQ ID NO: 340415 - DNA, 12 bp, Homo sapiens
catctcaggtgc

SEQ ID NO: 340416 - DNA, 17 bp, Homo sapiens
catctcaggtgccactc

SEQ ID NO: 340417 - DNA, 17 bp, Homo sapiens
catctcagtcctcaaag

SEQ ID NO: 340418 - DNA, 22 bp, Homo sapiens
catctcagtcctcaaagctttt

SEQ ID NO: 340419 - DNA, 21 bp, Homo sapiens
catctccagtatcctgctggt

SEQ ID NO: 340420 - DNA, 14 bp, Homo sapiens
catctccatcagct

SEQ ID NO: 340421 - DNA, 19 bp, Homo sapiens
catctccatcatatgcctg

SEQ ID NO: 340422 - DNA, 20 bp, Homo sapiens
catctccatcatatgcctga

SEQ ID NO: 340423 - DNA, 15 bp, Homo sapiens
catctccccaggcct

SEQ ID NO: 340424 - DNA, 17 bp, Homo sapiens
catctccccaggcctcc

SEQ ID NO: 340425 - DNA, 20 bp, Homo sapiens
catctccccaggcctccagc

SEQ ID NO: 340426 - DNA, 23 bp, Homo sapiens
catctccctcgaacccacactgc

SEQ ID NO: 340427 - DNA, 16 bp, Homo sapiens
catctcccttccacct

SEQ ID NO: 340428 - DNA, 16 bp, Homo sapiens
catctcctcaccccag

SEQ ID NO: 340429 - DNA, 13 bp, Homo sapiens
catctcctctccc

SEQ ID NO: 340430 - DNA, 20 bp, Homo sapiens
catctcctgtgcatgggtga

SEQ ID NO: 340431 - DNA, 15 bp, Homo sapiens
catctccttccccca

SEQ ID NO: 340432 - DNA, 16 bp, Homo sapiens
catctccttcccccag

SEQ ID NO: 340433 - DNA, 17 bp, Homo sapiens
catctccttcccccagc

SEQ ID NO: 340434 - DNA, 20 bp, Homo sapiens
catctccttcccccagccca

SEQ ID NO: 340435 - DNA, 18 bp, Homo sapiens
catctctaacagctcagg

SEQ ID NO: 340436 - DNA, 21 bp, Homo sapiens
catctctaacagctcaggatc

SEQ ID NO: 340437 - DNA, 15 bp, Homo sapiens
catctctctccctta

SEQ ID NO: 340438 - DNA, 12 bp, Homo sapiens
catctctcttcc

SEQ ID NO: 340439 - DNA, 18 bp, Homo sapiens
catctctgaacttcagct

SEQ ID NO: 340440 - DNA, 14 bp, Homo sapiens
catctctgcctttg

SEQ ID NO: 340441 - DNA, 14 bp, Homo sapiens
catctctgctgctt

SEQ ID NO: 340442 - DNA, 19 bp, Homo sapiens
catctctgctgcttctggg

SEQ ID NO: 340443 - DNA, 23 bp, Homo sapiens
catctctgctgcttctgggcctg

SEQ ID NO: 340444 - DNA, 12 bp, Homo sapiens
catctctgcttg

SEQ ID NO: 340445 - DNA, 20 bp, Homo sapiens
catctctgcttgagtcaggt

SEQ ID NO: 340446 - DNA, 14 bp, Homo sapiens
catctgaaaagaaa

SEQ ID NO: 340447 - DNA, 15 bp, Homo sapiens
catctgaaaagaaat

SEQ ID NO: 340448 - DNA, 16 bp, Homo sapiens
catctgacacaaaaaa

SEQ ID NO: 340449 - DNA, 17 bp, Homo sapiens
catctgagtccagctcc

SEQ ID NO: 340450 - DNA, 15 bp, Homo sapiens
catctgcagctcttt

SEQ ID NO: 340451 - DNA, 11 bp, Homo sapiens
catctgcccct

SEQ ID NO: 340452 - DNA, 14 bp, Homo sapiens
catctgcccctccc

SEQ ID NO: 340453 - DNA, 17 bp, Homo sapiens
catctgcccctccccca

SEQ ID NO: 340454 - DNA, 15 bp, Homo sapiens
catctgccgcctggg

SEQ ID NO: 340455 - DNA, 14 bp, Homo sapiens
catctgccttgctg

SEQ ID NO: 340456 - DNA, 15 bp, Homo sapiens
catctgccttgctgc

SEQ ID NO: 340457 - DNA, 17 bp, Homo sapiens
catctgccttgctgcac

SEQ ID NO: 340458 - DNA, 12 bp, Homo sapiens
catctgctaata

SEQ ID NO: 340459 - DNA, 16 bp, Homo sapiens
catctgctctgagacg

SEQ ID NO: 340460 - DNA, 21 bp, Homo sapiens
catctggagggttctaagtgg

SEQ ID NO: 340461 - DNA, 14 bp, Homo sapiens
catctggcctggcc

SEQ ID NO: 340462 - DNA, 16 bp, Homo sapiens
catctgggccaccagc

SEQ ID NO: 340463 - DNA, 16 bp, Homo sapiens
catctgggctggcaga

SEQ ID NO: 340464 - DNA, 19 bp, Homo sapiens
catctgggctggcagaggg

SEQ ID NO: 340465 - DNA, 14 bp, Homo sapiens
catctgtaaatatc

SEQ ID NO: 340466 - DNA, 22 bp, Homo sapiens
catctgtaaatatcccagagaa

SEQ ID NO: 340467 - DNA, 22 bp, Homo sapiens
catctgtaccctgcttcccaaa

SEQ ID NO: 340468 - DNA, 13 bp, Homo sapiens
catctgtcagctt

SEQ ID NO: 340469 - DNA, 14 bp, Homo sapiens
catctgtcccactg

SEQ ID NO: 340470 - DNA, 14 bp, Homo sapiens
catctgtctgtcct

SEQ ID NO: 340471 - DNA, 15 bp, Homo sapiens
catctgtctgtccta

SEQ ID NO: 340472 - DNA, 18 bp, Homo sapiens
catctgtctgtcctaccc

SEQ ID NO: 340473 - DNA, 23 bp, Homo sapiens
catctgtctgtcctacccgcccg

SEQ ID NO: 340474 - DNA, 17 bp, Homo sapiens
catctgtgggcacgctg

SEQ ID NO: 340475 - DNA, 12 bp, Homo sapiens
catctgttgttt

SEQ ID NO: 340476 - DNA, 15 bp, Homo sapiens
catcttcactgcaat

SEQ ID NO: 340477 - DNA, 14 bp, Homo sapiens
catcttcacttcta

SEQ ID NO: 340478 - DNA, 15 bp, Homo sapiens
catcttcatataaac

SEQ ID NO: 340479 - DNA, 23 bp, Homo sapiens
catcttccccaacgaaaagcaca

SEQ ID NO: 340480 - DNA, 18 bp, Homo sapiens
catcttcccgcctcagcc

SEQ ID NO: 340481 - DNA, 20 bp, Homo sapiens
catcttcccgcctcagcctc

SEQ ID NO: 340482 - DNA, 22 bp, Homo sapiens
catcttccctagagggttcctg

SEQ ID NO: 340483 - DNA, 13 bp, Homo sapiens
catcttcctgctg

SEQ ID NO: 340484 - DNA, 17 bp, Homo sapiens
catcttcctgctgctgt

SEQ ID NO: 340485 - DNA, 18 bp, Homo sapiens
catcttcctgctgctgta

SEQ ID NO: 340486 - DNA, 11 bp, Homo sapiens
catcttgagct

SEQ ID NO: 340487 - DNA, 20 bp, Homo sapiens
catcttgcacggtgacccct

SEQ ID NO: 340488 - DNA, 13 bp, Homo sapiens
catcttgcctcca

SEQ ID NO: 340489 - DNA, 19 bp, Homo sapiens
catcttggaaatcattgtg

SEQ ID NO: 340490 - DNA, 22 bp, Homo sapiens
catacacccccacctcctgcaa

SEQ ID NO: 340491 - DNA, 15 bp, Homo sapiens
catacatgttattgt

SEQ ID NO: 340492 - DNA, 17 bp, Homo sapiens
catacattgtataggcc

SEQ ID NO: 340493 - DNA, 21 bp, Homo sapiens
catacattgtataggccatct

SEQ ID NO: 340494 - DNA, 17 bp, Homo sapiens
catacatttataatgtt

SEQ ID NO: 340495 - DNA, 21 bp, Homo sapiens
catacatttataatgtttgct

SEQ ID NO: 340496 - DNA, 22 bp, Homo sapiens
cataccgtttggtgtctgatgt

SEQ ID NO: 340497 - DNA, 23 bp, Homo sapiens
catacctctctctatatatacat

SEQ ID NO: 340498 - DNA, 20 bp, Homo sapiens
catactccttccatcaaata

SEQ ID NO: 340499 - DNA, 16 bp, Homo sapiens
catactctgtctccct

SEQ ID NO: 340500 - DNA, 23 bp, Homo sapiens
catactctgtgtaatctctgatt

SEQ ID NO: 340501 - DNA, 22 bp, Homo sapiens
cattaagtattccttggcccag

SEQ ID NO: 340502 - DNA, 23 bp, Homo sapiens
cattaagtattccttggcccagc

SEQ ID NO: 340503 - DNA, 22 bp, Homo sapiens
cattaataggaaagatttaatg

SEQ ID NO: 340504 - DNA, 17 bp, Homo sapiens
cattaatcaccaaagta

SEQ ID NO: 340505 - DNA, 21 bp, Homo sapiens
cattaatttctctcaatttgg

SEQ ID NO: 340506 - DNA, 18 bp, Homo sapiens
cattacagagaggagaaa

SEQ ID NO: 340507 - DNA, 21 bp, Homo sapiens
cattacagagaggagaaacac

SEQ ID NO: 340508 - DNA, 18 bp, Homo sapiens
cattactattaactctgc

SEQ ID NO: 340509 - DNA, 20 bp, Homo sapiens
cattactattaactctgcat

SEQ ID NO: 340510 - DNA, 15 bp, Homo sapiens
cattagaagaaaaca

SEQ ID NO: 340511 - DNA, 19 bp, Homo sapiens
cattagaagaaaacatata

SEQ ID NO: 340512 - DNA, 22 bp, Homo sapiens
cattagaagaaaacatatattt

SEQ ID NO: 340513 - DNA, 17 bp, Homo sapiens
cattagcagtttgcttt

SEQ ID NO: 340514 - DNA, 22 bp, Homo sapiens
cattaggtagatgagaaaacag

SEQ ID NO: 340515 - DNA, 18 bp, Homo sapiens
cattaggttgtcctagaa

SEQ ID NO: 340516 - DNA, 11 bp, Homo sapiens
cattagtatcc

SEQ ID NO: 340517 - DNA, 16 bp, Homo sapiens
cattagtttcaggcaa

SEQ ID NO: 340518 - DNA, 22 bp, Homo sapiens
cattatagcatgtaatattaaa

SEQ ID NO: 340519 - DNA, 23 bp, Homo sapiens
cattatccttttatctcacaaat

SEQ ID NO: 340520 - DNA, 22 bp, Homo sapiens
cattatcgccttttgacagctg

SEQ ID NO: 340521 - DNA, 17 bp, Homo sapiens
cattatcgggagcagtg

SEQ ID NO: 340522 - DNA, 20 bp, Homo sapiens
cattatcgggagcagtgtct

SEQ ID NO: 340523 - DNA, 15 bp, Homo sapiens
cattatcttttggct

SEQ ID NO: 340524 - DNA, 17 bp, Homo sapiens
cattatggctttgtgct

SEQ ID NO: 340525 - DNA, 17 bp, Homo sapiens
cattatgtagaaatatt

SEQ ID NO: 340526 - DNA, 16 bp, Homo sapiens
cattatgttagagagg

SEQ ID NO: 340527 - DNA, 21 bp, Homo sapiens
cattattattactttttaaaa

SEQ ID NO: 340528 - DNA, 15 bp, Homo sapiens
cattattcaagaaag

SEQ ID NO: 340529 - DNA, 23 bp, Homo sapiens
cattattcaagaaagatatctat

SEQ ID NO: 340530 - DNA, 21 bp, Homo sapiens
cattatttgaaaacactgctg

SEQ ID NO: 340531 - DNA, 21 bp, Homo sapiens
cattatttgataacattttgt

SEQ ID NO: 340532 - DNA, 22 bp, Homo sapiens
cattattttgtggttctatttt

SEQ ID NO: 340533 - DNA, 15 bp, Homo sapiens
cattcaaaagcacaa

SEQ ID NO: 340534 - DNA, 13 bp, Homo sapiens
cattcaaaatagt

SEQ ID NO: 340535 - DNA, 17 bp, Homo sapiens
cattcaagcctgtgaat

SEQ ID NO: 340536 - DNA, 13 bp, Homo sapiens
cattcacacacag

SEQ ID NO: 340537 - DNA, 16 bp, Homo sapiens
cattcacacacagcct

SEQ ID NO: 340538 - DNA, 22 bp, Homo sapiens
cattcacacacagcctggcctc

SEQ ID NO: 340539 - DNA, 23 bp, Homo sapiens
cattcacacacagcctggcctcc

SEQ ID NO: 340540 - DNA, 17 bp, Homo sapiens
cattcacacagggctct

SEQ ID NO: 340541 - DNA, 11 bp, Homo sapiens
cattcacagca

SEQ ID NO: 340542 - DNA, 15 bp, Homo sapiens
cattcagaactctca

SEQ ID NO: 340543 - DNA, 22 bp, Homo sapiens
cattcagtactttatgaaaaaa

SEQ ID NO: 340544 - DNA, 21 bp, Homo sapiens
cattcatctgggctggcagag

SEQ ID NO: 340545 - DNA, 20 bp, Homo sapiens
cattcatctttcctttgctc

SEQ ID NO: 340546 - DNA, 16 bp, Homo sapiens
cattccaacagtgagt

SEQ ID NO: 340547 - DNA, 14 bp, Homo sapiens
cattccaagcctga

SEQ ID NO: 340548 - DNA, 22 bp, Homo sapiens
cattccaccttcccatgccctg

SEQ ID NO: 340549 - DNA, 15 bp, Homo sapiens
cattccagctctgcc

SEQ ID NO: 340550 - DNA, 17 bp, Homo sapiens
cattccagctctgcccc

SEQ ID NO: 340551 - DNA, 19 bp, Homo sapiens
cattccagctctgcccccg

SEQ ID NO: 340552 - DNA, 16 bp, Homo sapiens
cattccatcacagcca

SEQ ID NO: 340553 - DNA, 22 bp, Homo sapiens
cattccatcacagccagcccag

SEQ ID NO: 340554 - DNA, 23 bp, Homo sapiens
cattccatcacagccagcccagc

SEQ ID NO: 340555 - DNA, 15 bp, Homo sapiens
cattcccactgcact

SEQ ID NO: 340556 - DNA, 11 bp, Homo sapiens
cattcccagag

SEQ ID NO: 340557 - DNA, 21 bp, Homo sapiens
cattcccccatgtggctgaag

SEQ ID NO: 340558 - DNA, 23 bp, Homo sapiens
cattcccctcccacctctccttt

SEQ ID NO: 340559 - DNA, 10 bp, Homo sapiens
cattccctgt

SEQ ID NO: 340560 - DNA, 20 bp, Homo sapiens
cattcctaacacagcatgtg

SEQ ID NO: 340561 - DNA, 14 bp, Homo sapiens
cattcctcagctgc

SEQ ID NO: 340562 - DNA, 17 bp, Homo sapiens
cattcctcagctgccaa

SEQ ID NO: 340563 - DNA, 18 bp, Homo sapiens
cattcctcatgaatgtaa

SEQ ID NO: 340564 - DNA, 19 bp, Homo sapiens
cattcctcatgaatgtaaa

SEQ ID NO: 340565 - DNA, 14 bp, Homo sapiens
cattcctccagcct

SEQ ID NO: 340566 - DNA, 16 bp, Homo sapiens
cattcctccagcctcc

SEQ ID NO: 340567 - DNA, 12 bp, Homo sapiens
cattcctccctc

SEQ ID NO: 340568 - DNA, 19 bp, Homo sapiens
cattcctgaaagaaacagt

SEQ ID NO: 340569 - DNA, 16 bp, Homo sapiens
cattcctgagattctg

SEQ ID NO: 340570 - DNA, 18 bp, Homo sapiens
cattcctgttctctttgc

SEQ ID NO: 340571 - DNA, 23 bp, Homo sapiens
cattcctgttctctttgccttga

SEQ ID NO: 340572 - DNA, 17 bp, Homo sapiens
cattccttagcagctca

SEQ ID NO: 340573 - DNA, 21 bp, Homo sapiens
cattccttagcagctcaggcg

SEQ ID NO: 340574 - DNA, 16 bp, Homo sapiens
cattcgatctcattca

SEQ ID NO: 340575 - DNA, 13 bp, Homo sapiens
cattcgcagcagc

SEQ ID NO: 340576 - DNA, 15 bp, Homo sapiens
cattctaaaccaaaa

SEQ ID NO: 340577 - DNA, 15 bp, Homo sapiens
cattctacacctgga

SEQ ID NO: 340578 - DNA, 11 bp, Homo sapiens
cattctagatc

SEQ ID NO: 340579 - DNA, 13 bp, Homo sapiens
cattctagatcct

SEQ ID NO: 340580 - DNA, 18 bp, Homo sapiens
cattctagatcctgcacc

SEQ ID NO: 340581 - DNA, 20 bp, Homo sapiens
cattctcagcccctagcaga

SEQ ID NO: 340582 - DNA, 19 bp, Homo sapiens
cattctcattgcagaataa

SEQ ID NO: 340583 - DNA, 17 bp, Homo sapiens
cattctcctgcctcagc

SEQ ID NO: 340584 - DNA, 18 bp, Homo sapiens
cattctcctgcctcagcc

SEQ ID NO: 340585 - DNA, 20 bp, Homo sapiens
cattctgaaggccttgttaa

SEQ ID NO: 340586 - DNA, 19 bp, Homo sapiens
cattctgctttcttgccac

SEQ ID NO: 340587 - DNA, 18 bp, Homo sapiens
cattctggggtggggctt

SEQ ID NO: 340588 - DNA, 16 bp, Homo sapiens
cattctgtgatcattt

SEQ ID NO: 340589 - DNA, 21 bp, Homo sapiens
cattcttaaaattcaagaaaa

SEQ ID NO: 340590 - DNA, 13 bp, Homo sapiens
cattcttatttta

SEQ ID NO: 340591 - DNA, 14 bp, Homo sapiens
cattcttcactgtc

SEQ ID NO: 340592 - DNA, 15 bp, Homo sapiens
cattcttcactgtct

SEQ ID NO: 340593 - DNA, 17 bp, Homo sapiens
cattctttagtctacat

SEQ ID NO: 340594 - DNA, 21 bp, Homo sapiens
cattctttataaaccataaaa

SEQ ID NO: 340595 - DNA, 12 bp, Homo sapiens
cattctttcttc

SEQ ID NO: 340596 - DNA, 22 bp, Homo sapiens
cattctttcttcctccagtctg

SEQ ID NO: 340597 - DNA, 19 bp, Homo sapiens
cattctttgtatcttaaat

SEQ ID NO: 340598 - DNA, 17 bp, Homo sapiens
cattcttttaaatgggt

SEQ ID NO: 340599 - DNA, 23 bp, Homo sapiens
cattcttttcagcttgtttctat

SEQ ID NO: 340600 - DNA, 18 bp, Homo sapiens
cattgaaaatgtaagtaa

SEQ ID NO: 340601 - DNA, 14 bp, Homo sapiens
cattgaaagaatta

SEQ ID NO: 340602 - DNA, 14 bp, Homo sapiens
cattgaaataataa

SEQ ID NO: 340603 - DNA, 16 bp, Homo sapiens
cattgaaataataata

SEQ ID NO: 340604 - DNA, 17 bp, Homo sapiens
cattgaaataataatat

SEQ ID NO: 340605 - DNA, 19 bp, Homo sapiens
cattgaagtaatgaatttt

SEQ ID NO: 340606 - DNA, 20 bp, Homo sapiens
cattgaatttagtcattatt

SEQ ID NO: 340607 - DNA, 15 bp, Homo sapiens
cattgaccaagaact

SEQ ID NO: 340608 - DNA, 19 bp, Homo sapiens
cattgaccaagaactgcat

SEQ ID NO: 340609 - DNA, 20 bp, Homo sapiens
cattgaccaagaactgcatg

SEQ ID NO: 340610 - DNA, 17 bp, Homo sapiens
cattgatcacagatgtg

SEQ ID NO: 340611 - DNA, 18 bp, Homo sapiens
cattgatcacagatgtgc

SEQ ID NO: 340612 - DNA, 21 bp, Homo sapiens
cattgatcacagatgtgccca

SEQ ID NO: 340613 - DNA, 18 bp, Homo sapiens
cattgattgtcagctact

SEQ ID NO: 340614 - DNA, 18 bp, Homo sapiens
cattgcaaaaatatttta

SEQ ID NO: 340615 - DNA, 12 bp, Homo sapiens
cattgcactaaa

SEQ ID NO: 340616 - DNA, 23 bp, Homo sapiens
cattgcactaaaagtgatgtgat

SEQ ID NO: 340617 - DNA, 21 bp, Homo sapiens
cattgcagaacatgagtgctg

SEQ ID NO: 340618 - DNA, 23 bp, Homo sapiens
cattgcagaacatgagtgctgat

SEQ ID NO: 340619 - DNA, 16 bp, Homo sapiens
cattgcagaataatgt

SEQ ID NO: 340620 - DNA, 22 bp, Homo sapiens
cattgcagaataatgttctatt

SEQ ID NO: 340621 - DNA, 12 bp, Homo sapiens
cattgcaggcca

SEQ ID NO: 340622 - DNA, 17 bp, Homo sapiens
cattgcaggccagtgga

SEQ ID NO: 340623 - DNA, 23 bp, Homo sapiens
cattgcataagtggacccagctg

SEQ ID NO: 340624 - DNA, 18 bp, Homo sapiens
cattttgtctggctgtgg

SEQ ID NO: 340625 - DNA, 22 bp, Homo sapiens
cattttgtggtcattaagcatt

SEQ ID NO: 340626 - DNA, 22 bp, Homo sapiens
cattttgtgtcttaagaaaaat

SEQ ID NO: 340627 - DNA, 12 bp, Homo sapiens
catttttaaagg

SEQ ID NO: 340628 - DNA, 22 bp, Homo sapiens
catttttaaaggacaaacagtg

SEQ ID NO: 340629 - DNA, 22 bp, Homo sapiens
catttttaatattactgtcttt

SEQ ID NO: 340630 - DNA, 23 bp, Homo sapiens
catttttactactattctgttaa

SEQ ID NO: 340631 - DNA, 18 bp, Homo sapiens
catttttcctaacaggat

SEQ ID NO: 340632 - DNA, 17 bp, Homo sapiens
catttttgatttatgca

SEQ ID NO: 340633 - DNA, 23 bp, Homo sapiens
catttttgtcagtctgagtcatc

SEQ ID NO: 340634 - DNA, 16 bp, Homo sapiens
cattttttaaaacaag

SEQ ID NO: 340635 - DNA, 20 bp, Homo sapiens
catttttttcactcagaatt

SEQ ID NO: 340636 - DNA, 13 bp, Homo sapiens
ccaaaaattatta

SEQ ID NO: 340637 - DNA, 14 bp, Homo sapiens
ccaaaaattattat

SEQ ID NO: 340638 - DNA, 22 bp, Homo sapiens
ccaaaacattccgtttacattt

SEQ ID NO: 340639 - DNA, 13 bp, Homo sapiens
ccaaaagccttac

SEQ ID NO: 340640 - DNA, 22 bp, Homo sapiens
ccaaaagctagaggagattgct

SEQ ID NO: 340641 - DNA, 16 bp, Homo sapiens
ccaaaattccatccct

SEQ ID NO: 340642 - DNA, 16 bp, Homo sapiens
ccaaacaaatatgcaa

SEQ ID NO: 340643 - DNA, 22 bp, Homo sapiens
ccaaacagttgtaccactgcta

SEQ ID NO: 340644 - DNA, 20 bp, Homo sapiens
ccaaacatcagacctgtctt

SEQ ID NO: 340645 - DNA, 15 bp, Homo sapiens
ccaaaccaagtgcct

SEQ ID NO: 340646 - DNA, 15 bp, Homo sapiens
ccaaaccccttccca

SEQ ID NO: 340647 - DNA, 14 bp, Homo sapiens
ccaaaccctgtctg

SEQ ID NO: 340648 - DNA, 19 bp, Homo sapiens
ccaaacggaactcttcatc

SEQ ID NO: 340649 - DNA, 21 bp, Homo sapiens
ccaaacttctgaactttggaa

SEQ ID NO: 340650 - DNA, 11 bp, Homo sapiens
ccaaagaaagt

SEQ ID NO: 340651 - DNA, 20 bp, Homo sapiens
ccaaagaacttgatttgcat

SEQ ID NO: 340652 - DNA, 14 bp, Homo sapiens
ccaaagactgtact

SEQ ID NO: 340653 - DNA, 17 bp, Homo sapiens
ccaaagactgtactggc

SEQ ID NO: 340654 - DNA, 17 bp, Homo sapiens
ccaaagagaaggcctgg

SEQ ID NO: 340655 - DNA, 17 bp, Homo sapiens
ccaaagagctctttttt

SEQ ID NO: 340656 - DNA, 14 bp, Homo sapiens
ccaaagagctgcct

SEQ ID NO: 340657 - DNA, 15 bp, Homo sapiens
ccaaagagctgccta

SEQ ID NO: 340658 - DNA, 16 bp, Homo sapiens
ccaaagagtcatcatg

SEQ ID NO: 340659 - DNA, 19 bp, Homo sapiens
ccaaagatgcagccgcctt

SEQ ID NO: 340660 - DNA, 22 bp, Homo sapiens
ccaaagatgcagccgccttcct

SEQ ID NO: 340661 - DNA, 23 bp, Homo sapiens
ccaaagatgcagccgccttcctt

SEQ ID NO: 340662 - DNA, 19 bp, Homo sapiens
ccaaagcagtgcatgctgt

SEQ ID NO: 340663 - DNA, 14 bp, Homo sapiens
ccaaagcattgcag

SEQ ID NO: 340664 - DNA, 20 bp, Homo sapiens
ccaaagccatatcaccagtc

SEQ ID NO: 340665 - DNA, 15 bp, Homo sapiens
ccaaagcccagcccg

SEQ ID NO: 340666 - DNA, 18 bp, Homo sapiens
ccaaagctagggtggccc

SEQ ID NO: 340667 - DNA, 14 bp, Homo sapiens
ccaaagctttcctg

SEQ ID NO: 340668 - DNA, 20 bp, Homo sapiens
ccaaagctttcctgccccag

SEQ ID NO: 340669 - DNA, 15 bp, Homo sapiens
ccaaaggaggctggc

SEQ ID NO: 340670 - DNA, 16 bp, Homo sapiens
ccaaaggaggctggca

SEQ ID NO: 340671 - DNA, 18 bp, Homo sapiens
ccaaaggaggctggcagg

SEQ ID NO: 340672 - DNA, 23 bp, Homo sapiens
ccaaaggagtgcatggccacagc

SEQ ID NO: 340673 - DNA, 16 bp, Homo sapiens
ccaaaggcactgaccc

SEQ ID NO: 340674 - DNA, 19 bp, Homo sapiens
ccaaaggggctgctggggc

SEQ ID NO: 340675 - DNA, 20 bp, Homo sapiens
ccaaagtattaatgtacaga

SEQ ID NO: 340676 - DNA, 17 bp, Homo sapiens
ccaaagtattcttcttt

SEQ ID NO: 340677 - DNA, 15 bp, Homo sapiens
ccaaagtgcagccct

SEQ ID NO: 340678 - DNA, 19 bp, Homo sapiens
ccaaagtgcagcccttcct

SEQ ID NO: 340679 - DNA, 23 bp, Homo sapiens
ccaaagtgcagcccttcctcctg

SEQ ID NO: 340680 - DNA, 16 bp, Homo sapiens
ccaaataagaaaccta

SEQ ID NO: 340681 - DNA, 17 bp, Homo sapiens
ccaaataagaaacctaa

SEQ ID NO: 340682 - DNA, 20 bp, Homo sapiens
ccaaatagtgaaaagtagag

SEQ ID NO: 340683 - DNA, 20 bp, Homo sapiens
ccaaatatgcactttcccta

SEQ ID NO: 340684 - DNA, 23 bp, Homo sapiens
ccaaatatgcactttccctagaa

SEQ ID NO: 340685 - DNA, 17 bp, Homo sapiens
ccaaatattcattttga

SEQ ID NO: 340686 - DNA, 13 bp, Homo sapiens
ccaaatcccctcc

SEQ ID NO: 340687 - DNA, 24 bp, Homo sapiens
ccaaatctaaatagatacttttga

SEQ ID NO: 340688 - DNA, 15 bp, Homo sapiens
ccaaatcttcctctg

SEQ ID NO: 340689 - DNA, 17 bp, Homo sapiens
ccaaatgacttcatttc

SEQ ID NO: 340690 - DNA, 17 bp, Homo sapiens
ccaaatgcacaagctca

SEQ ID NO: 340691 - DNA, 18 bp, Homo sapiens
ccaaatgcacaagctcag

SEQ ID NO: 340692 - DNA, 23 bp, Homo sapiens
ccaaatgcagggaggggaggcag

SEQ ID NO: 340693 - DNA, 23 bp, Homo sapiens
ccaaatgctgtcgggcaagatag

SEQ ID NO: 340694 - DNA, 18 bp, Homo sapiens
ccaaatgtaattgaataa

SEQ ID NO: 340695 - DNA, 12 bp, Homo sapiens
ccaaattatttg

SEQ ID NO: 340696 - DNA, 14 bp, Homo sapiens
ccaaattatttgtg

SEQ ID NO: 340697 - DNA, 21 bp, Homo sapiens
ccaaattttccttcctgttct

SEQ ID NO: 340698 - DNA, 17 bp, Homo sapiens
ccaaattttctttttat

SEQ ID NO: 340699 - DNA, 17 bp, Homo sapiens
ccaacaacagtcagcca

SEQ ID NO: 340700 - DNA, 21 bp, Homo sapiens
ccaacaacagtcagccagctt

SEQ ID NO: 340701 - DNA, 20 bp, Homo sapiens
ccaacaatactttgtgtctt

SEQ ID NO: 340702 - DNA, 22 bp, Homo sapiens
ccaacaatactttgtgtctttt

SEQ ID NO: 340703 - DNA, 22 bp, Homo sapiens
ccaacaattaggtctgcatttt

SEQ ID NO: 340704 - DNA, 15 bp, Homo sapiens
ccaacaccacagaaa

SEQ ID NO: 340705 - DNA, 18 bp, Homo sapiens
ccaacaccacagacacac

SEQ ID NO: 340706 - DNA, 12 bp, Homo sapiens
ccaacaccaggg

SEQ ID NO: 340707 - DNA, 16 bp, Homo sapiens
ccaacaccatcacagc

SEQ ID NO: 340708 - DNA, 18 bp, Homo sapiens
ccaacaccatcacagctt

SEQ ID NO: 340709 - DNA, 20 bp, Homo sapiens
ccaacaccatcacagcttgt

SEQ ID NO: 340710 - DNA, 23 bp, Homo sapiens
ccaacaccttcttggcttctggg

SEQ ID NO: 340711 - DNA, 20 bp, Homo sapiens
ccaacagtgagtctgtcagc

SEQ ID NO: 340712 - DNA, 22 bp, Homo sapiens
ccaacattcaaaagcacaaacc

SEQ ID NO: 340713 - DNA, 23 bp, Homo sapiens
ccaaccaacttggttctgcttca

SEQ ID NO: 340714 - DNA, 22 bp, Homo sapiens
ccaaccaggaggggtctgcctc

SEQ ID NO: 340715 - DNA, 18 bp, Homo sapiens
ccaacccatgcatggcct

SEQ ID NO: 340716 - DNA, 17 bp, Homo sapiens
ccaacccccacctcccg

SEQ ID NO: 340717 - DNA, 21 bp, Homo sapiens
ccaaccccgcggtgctctggc

SEQ ID NO: 340718 - DNA, 15 bp, Homo sapiens
ccaaccctcagagcc

SEQ ID NO: 340719 - DNA, 15 bp, Homo sapiens
ccaaccctgcccctg

SEQ ID NO: 340720 - DNA, 16 bp, Homo sapiens
ccaaccctgcccctgc

SEQ ID NO: 340721 - DNA, 22 bp, Homo sapiens
ccaacctcaatgccctgccatt

SEQ ID NO: 340722 - DNA, 23 bp, Homo sapiens
ccaacctcaatgccctgccatta

SEQ ID NO: 340723 - DNA, 16 bp, Homo sapiens
ccaacctcactgccct

SEQ ID NO: 340724 - DNA, 21 bp, Homo sapiens
ccaacctcggcttgtgggctg

SEQ ID NO: 340725 - DNA, 21 bp, Homo sapiens
ccaacgggtctgtgggactgg

SEQ ID NO: 340726 - DNA, 16 bp, Homo sapiens
ccaacgtggggcagca

SEQ ID NO: 340727 - DNA, 19 bp, Homo sapiens
ccaacgttaaaagacagtg

SEQ ID NO: 340728 - DNA, 14 bp, Homo sapiens
ccaactaagccctc

SEQ ID NO: 340729 - DNA, 14 bp, Homo sapiens
ccaactcactgtgc

SEQ ID NO: 340730 - DNA, 15 bp, Homo sapiens
ccaactcactgtgct

SEQ ID NO: 340731 - DNA, 15 bp, Homo sapiens
ccaactccaggggca

SEQ ID NO: 340732 - DNA, 18 bp, Homo sapiens
ccaactccaggggcacct

SEQ ID NO: 340733 - DNA, 22 bp, Homo sapiens
ccaactccatggggttcgagac

SEQ ID NO: 340734 - DNA, 23 bp, Homo sapiens
ccaactccatggggttcgagact

SEQ ID NO: 340735 - DNA, 12 bp, Homo sapiens
ccaactcccagc

SEQ ID NO: 340736 - DNA, 15 bp, Homo sapiens
ccaactcccagccac

SEQ ID NO: 340737 - DNA, 13 bp, Homo sapiens
ccaactctcccca

SEQ ID NO: 340738 - DNA, 20 bp, Homo sapiens
ccaactctccccagtgcctg

SEQ ID NO: 340739 - DNA, 18 bp, Homo sapiens
ccaactctggccttggtt

SEQ ID NO: 340740 - DNA, 13 bp, Homo sapiens
ccaactgacttct

SEQ ID NO: 340741 - DNA, 18 bp, Homo sapiens
ccaactgacttctgctag

SEQ ID NO: 340742 - DNA, 13 bp, Homo sapiens
ccaactgagccaa

SEQ ID NO: 340743 - DNA, 15 bp, Homo sapiens
ccaatatgtattgta

SEQ ID NO: 340744 - DNA, 16 bp, Homo sapiens
ccaatatgtattgtaa

SEQ ID NO: 340745 - DNA, 17 bp, Homo sapiens
ccaatattaccatctta

SEQ ID NO: 340746 - DNA, 20 bp, Homo sapiens
ccaatcaacagcatgtctac

SEQ ID NO: 340747 - DNA, 22 bp, Homo sapiens
ccaatcaacagcatgtctactg

SEQ ID NO: 340748 - DNA, 19 bp, Homo sapiens
ccaatcacattcaggcatg

SEQ ID NO: 340749 - DNA, 19 bp, Homo sapiens
ccaatcactgagtttgtgg

SEQ ID NO: 340750 - DNA, 23 bp, Homo sapiens
ccaatcagcttttgttctagact

SEQ ID NO: 340751 - DNA, 21 bp, Homo sapiens
ccaatccctgtgtgtcgttcc

SEQ ID NO: 340752 - DNA, 15 bp, Homo sapiens
ccaatcctcactggg

SEQ ID NO: 340753 - DNA, 18 bp, Homo sapiens
ccaatcctcactgggtgg

SEQ ID NO: 340754 - DNA, 17 bp, Homo sapiens
ccaatgattcataacaa

SEQ ID NO: 340755 - DNA, 17 bp, Homo sapiens
ccaatgcatgcagccac

SEQ ID NO: 340756 - DNA, 23 bp, Homo sapiens
ccaatgccacagccaagcccacc

SEQ ID NO: 340757 - DNA, 20 bp, Homo sapiens
ccaatggagtagacccctgg

SEQ ID NO: 340758 - DNA, 19 bp, Homo sapiens
ccaatggtgatcctctatt

SEQ ID NO: 340759 - DNA, 22 bp, Homo sapiens
ccaatggtgatcctctattttg

SEQ ID NO: 340760 - DNA, 23 bp, Homo sapiens
ccaatggtgatcctctattttgt

SEQ ID NO: 340761 - DNA, 12 bp, Homo sapiens
ccaatgtgaaga

SEQ ID NO: 340762 - DNA, 19 bp, Homo sapiens
ccaattactattccctttg

SEQ ID NO: 340763 - DNA, 23 bp, Homo sapiens
ccaattaggaagtgtaacagctg

SEQ ID NO: 340764 - DNA, 19 bp, Homo sapiens
ccaattatgtgacaacctt

SEQ ID NO: 340765 - DNA, 20 bp, Homo sapiens
ccacatgtggggacagggct

SEQ ID NO: 340766 - DNA, 23 bp, Homo sapiens
ccacattgcataagtggacccag

SEQ ID NO: 340767 - DNA, 15 bp, Homo sapiens
ccacattgcccacac

SEQ ID NO: 340768 - DNA, 14 bp, Homo sapiens
ccacattttaacag

SEQ ID NO: 340769 - DNA, 15 bp, Homo sapiens
ccacattttgcttta

SEQ ID NO: 340770 - DNA, 16 bp, Homo sapiens
ccaccaaactgcacac

SEQ ID NO: 340771 - DNA, 22 bp, Homo sapiens
ccaccaaactgcacacacagct

SEQ ID NO: 340772 - DNA, 16 bp, Homo sapiens
ccaccaaatctgtcta

SEQ ID NO: 340773 - DNA, 20 bp, Homo sapiens
ccaccaaatgcctctgcctt

SEQ ID NO: 340774 - DNA, 19 bp, Homo sapiens
ccaccaacataaaacaaaa

SEQ ID NO: 340775 - DNA, 13 bp, Homo sapiens
ccaccaactctgc

SEQ ID NO: 340776 - DNA, 17 bp, Homo sapiens
ccaccaactctgcactc

SEQ ID NO: 340777 - DNA, 15 bp, Homo sapiens
ccaccaagggcctca

SEQ ID NO: 340778 - DNA, 23 bp, Homo sapiens
ccaccaagggtatctgctgcctc

SEQ ID NO: 340779 - DNA, 12 bp, Homo sapiens
ccaccaataaaa

SEQ ID NO: 340780 - DNA, 13 bp, Homo sapiens
ccaccaataaaaa

SEQ ID NO: 340781 - DNA, 15 bp, Homo sapiens
ccaccaccactgtcc

SEQ ID NO: 340782 - DNA, 14 bp, Homo sapiens
ccaccaccccagct

SEQ ID NO: 340783 - DNA, 20 bp, Homo sapiens
ccaccacccctccctctgct

SEQ ID NO: 340784 - DNA, 14 bp, Homo sapiens
ccaccaccggggca

SEQ ID NO: 340785 - DNA, 14 bp, Homo sapiens
ccaccacctggatg

SEQ ID NO: 340786 - DNA, 13 bp, Homo sapiens
ccaccacgtctgc

SEQ ID NO: 340787 - DNA, 20 bp, Homo sapiens
ccaccactaagagaatacag

SEQ ID NO: 340788 - DNA, 22 bp, Homo sapiens
ccaccactgtccctaccactga

SEQ ID NO: 340789 - DNA, 23 bp, Homo sapiens
ccaccagaacgcaccccactggg

SEQ ID NO: 340790 - DNA, 14 bp, Homo sapiens
ccaccagcagcaca

SEQ ID NO: 340791 - DNA, 19 bp, Homo sapiens
ccaccagccagcgcaggcc

SEQ ID NO: 340792 - DNA, 21 bp, Homo sapiens
ccaccagccgccccagcccct

SEQ ID NO: 340793 - DNA, 21 bp, Homo sapiens
ccaccagctccactggcctgc

SEQ ID NO: 340794 - DNA, 21 bp, Homo sapiens
ccagctgagtctatgtaggtg

SEQ ID NO: 340795 - DNA, 13 bp, Homo sapiens
ccagctgccaagt

SEQ ID NO: 340796 - DNA, 11 bp, Homo sapiens
ccagctgcccc

SEQ ID NO: 340797 - DNA, 11 bp, Homo sapiens
ccagctgcctt

SEQ ID NO: 340798 - DNA, 19 bp, Homo sapiens
ccagctgccttcctcatcc

SEQ ID NO: 340799 - DNA, 20 bp, Homo sapiens
ccagctgccttcctcatccc

SEQ ID NO: 340800 - DNA, 12 bp, Homo sapiens
ccagctgctctg

SEQ ID NO: 340801 - DNA, 14 bp, Homo sapiens
ccagctgctctgcc

SEQ ID NO: 340802 - DNA, 17 bp, Homo sapiens
ccagctgctctgcccag

SEQ ID NO: 340803 - DNA, 18 bp, Homo sapiens
ccagctgctctgcccaga

SEQ ID NO: 340804 - DNA, 22 bp, Homo sapiens
ccagctgctctgccccttgggc

SEQ ID NO: 340805 - DNA, 14 bp, Homo sapiens
ccagctgctgtcag

SEQ ID NO: 340806 - DNA, 15 bp, Homo sapiens
ccagctggcagcgcc

SEQ ID NO: 340807 - DNA, 16 bp, Homo sapiens
ccagctggcagcgcct

SEQ ID NO: 340808 - DNA, 19 bp, Homo sapiens
ccagctggcagcgcctccc

SEQ ID NO: 340809 - DNA, 13 bp, Homo sapiens
ccagctggctggg

SEQ ID NO: 340810 - DNA, 16 bp, Homo sapiens
ccagctggctgggtcg

SEQ ID NO: 340811 - DNA, 23 bp, Homo sapiens
ccagctggctgggtcgcccctcc

SEQ ID NO: 340812 - DNA, 22 bp, Homo sapiens
ccagctgggctctgccacccta

SEQ ID NO: 340813 - DNA, 12 bp, Homo sapiens
ccagctgggggg

SEQ ID NO: 340814 - DNA, 22 bp, Homo sapiens
ccagctggtgtcactctgcctc

SEQ ID NO: 340815 - DNA, 23 bp, Homo sapiens
ccagctggtgtcactctgcctct

SEQ ID NO: 340816 - DNA, 16 bp, Homo sapiens
ccagctgtactgagtt

SEQ ID NO: 340817 - DNA, 23 bp, Homo sapiens
ccagctgtactgagttctcatcc

SEQ ID NO: 340818 - DNA, 20 bp, Homo sapiens
ccagctgtagccatggctca

SEQ ID NO: 340819 - DNA, 23 bp, Homo sapiens
ccagctgtagccatggctcaggc

SEQ ID NO: 340820 - DNA, 15 bp, Homo sapiens
ccagctgtggttttc

SEQ ID NO: 340821 - DNA, 10 bp, Homo sapiens
ccagcttccc

SEQ ID NO: 340822 - DNA, 13 bp, Homo sapiens
ccagcttcctggt

SEQ ID NO: 340823 - DNA, 21 bp, Homo sapiens
ccagcttcggagggcccctgc

SEQ ID NO: 340824 - DNA, 21 bp, Homo sapiens
ccagcttcgtgctggaggaac

SEQ ID NO: 340825 - DNA, 24 bp, Homo sapiens
ccagcttgggcccagctgggctct

SEQ ID NO: 340826 - DNA, 17 bp, Homo sapiens
ccagcttgttatttata

SEQ ID NO: 340827 - DNA, 11 bp, Homo sapiens
ccaggaaaaac

SEQ ID NO: 340828 - DNA, 16 bp, Homo sapiens
ccaggaaaactgtttt

SEQ ID NO: 340829 - DNA, 18 bp, Homo sapiens
ccaggaagcacaggccag

SEQ ID NO: 340830 - DNA, 20 bp, Homo sapiens
ccaggaagcacaggccaggg

SEQ ID NO: 340831 - DNA, 13 bp, Homo sapiens
ccaggaagcaggg

SEQ ID NO: 340832 - DNA, 15 bp, Homo sapiens
ccaggaagccccgct

SEQ ID NO: 340833 - DNA, 18 bp, Homo sapiens
ccaggaagccccgctcag

SEQ ID NO: 340834 - DNA, 20 bp, Homo sapiens
ccaggaagccccgctcaggt

SEQ ID NO: 340835 - DNA, 14 bp, Homo sapiens
ccaggaaggcagct

SEQ ID NO: 340836 - DNA, 17 bp, Homo sapiens
ccaggaaggcagctgct

SEQ ID NO: 340837 - DNA, 18 bp, Homo sapiens
ccaggaaggcagctgctc

SEQ ID NO: 340838 - DNA, 19 bp, Homo sapiens
ccaggaaggcagctgctct

SEQ ID NO: 340839 - DNA, 15 bp, Homo sapiens
ccaggaaggcggggc

SEQ ID NO: 340840 - DNA, 21 bp, Homo sapiens
ccaggaagggaaagcgggcag

SEQ ID NO: 340841 - DNA, 15 bp, Homo sapiens
ccaggaagtccagct

SEQ ID NO: 340842 - DNA, 16 bp, Homo sapiens
ccaggaagtccagctc

SEQ ID NO: 340843 - DNA, 23 bp, Homo sapiens
ccaggaatgtttcagctgcagtt

SEQ ID NO: 340844 - DNA, 22 bp, Homo sapiens
ccaggaccctgggtcaccttcc

SEQ ID NO: 340845 - DNA, 23 bp, Homo sapiens
ccaggaccctgggtcaccttcct

SEQ ID NO: 340846 - DNA, 17 bp, Homo sapiens
ccaggacgcttctgaat

SEQ ID NO: 340847 - DNA, 19 bp, Homo sapiens
ccaggacgcttctgaatgc

SEQ ID NO: 340848 - DNA, 20 bp, Homo sapiens
ccaggacgtctggggtgtgg

SEQ ID NO: 340849 - DNA, 22 bp, Homo sapiens
ccaggactccctcctcacctct

SEQ ID NO: 340850 - DNA, 23 bp, Homo sapiens
ccaggactccctcctcacctctg

SEQ ID NO: 340851 - DNA, 13 bp, Homo sapiens
ccaggactctgcc

SEQ ID NO: 340852 - DNA, 14 bp, Homo sapiens
ccaggactctgccc

SEQ ID NO: 340853 - DNA, 14 bp, Homo sapiens
ccaggactctgcct

SEQ ID NO: 340854 - DNA, 20 bp, Homo sapiens
ccaggagagcccccaccagc

SEQ ID NO: 340855 - DNA, 14 bp, Homo sapiens
ccaggagcaatggg

SEQ ID NO: 340856 - DNA, 18 bp, Homo sapiens
ccaggagcaatgggactg

SEQ ID NO: 340857 - DNA, 12 bp, Homo sapiens
ccaggagcagcc

SEQ ID NO: 340858 - DNA, 14 bp, Homo sapiens
ccaggagcagcctc

SEQ ID NO: 340859 - DNA, 18 bp, Homo sapiens
ccaggagcagcctccaag

SEQ ID NO: 340860 - DNA, 18 bp, Homo sapiens
ccaggagcattttgtgtc

SEQ ID NO: 340861 - DNA, 20 bp, Homo sapiens
ccaggagcattttgtgtctt

SEQ ID NO: 340862 - DNA, 19 bp, Homo sapiens
ccaggagccaggtgtcctg

SEQ ID NO: 340863 - DNA, 22 bp, Homo sapiens
ccaggagcctcctgaccctgtg

SEQ ID NO: 340864 - DNA, 19 bp, Homo sapiens
ccaggagctagcccagtcc

SEQ ID NO: 340865 - DNA, 21 bp, Homo sapiens
ccaggagctcaggtggggagt

SEQ ID NO: 340866 - DNA, 23 bp, Homo sapiens
ccaggagctcttcaggcctccct

SEQ ID NO: 340867 - DNA, 20 bp, Homo sapiens
ccaggagctgagtcacctcc

SEQ ID NO: 340868 - DNA, 21 bp, Homo sapiens
ccaggagctgagtcacctcct

SEQ ID NO: 340869 - DNA, 20 bp, Homo sapiens
ccaggaggagagagatgctg

SEQ ID NO: 340870 - DNA, 22 bp, Homo sapiens
ccaggaggagagagatgctgct

SEQ ID NO: 340871 - DNA, 15 bp, Homo sapiens
ccaggaggggcctct

SEQ ID NO: 340872 - DNA, 21 bp, Homo sapiens
ccaggaggggtctgcctccca

SEQ ID NO: 340873 - DNA, 20 bp, Homo sapiens
ccaggagtctgagaccagcc

SEQ ID NO: 340874 - DNA, 13 bp, Homo sapiens
ccaggagtctgtg

SEQ ID NO: 340875 - DNA, 14 bp, Homo sapiens
ccaggagtctgtgc

SEQ ID NO: 340876 - DNA, 15 bp, Homo sapiens
ccaggagtctgtgct

SEQ ID NO: 340877 - DNA, 16 bp, Homo sapiens
ccaggagtctgtgctc

SEQ ID NO: 340878 - DNA, 21 bp, Homo sapiens
ccaggagtgggtgggacacag

SEQ ID NO: 340879 - DNA, 23 bp, Homo sapiens
ccaggagtgggtgggacacagag

SEQ ID NO: 340880 - DNA, 21 bp, Homo sapiens
ccaggagtttgagacaagccc

SEQ ID NO: 340881 - DNA, 15 bp, Homo sapiens
ccaggataaggagac

SEQ ID NO: 340882 - DNA, 17 bp, Homo sapiens
ccaggataaggagactg

SEQ ID NO: 340883 - DNA, 22 bp, Homo sapiens
ccaggataaggagactgaggct

SEQ ID NO: 340884 - DNA, 23 bp, Homo sapiens
ccaggataaggagactgaggctt

SEQ ID NO: 340885 - DNA, 14 bp, Homo sapiens
ccaggatggagggg

SEQ ID NO: 340886 - DNA, 20 bp, Homo sapiens
ccaggattaatctctaaaat

SEQ ID NO: 340887 - DNA, 23 bp, Homo sapiens
ccaggattaatctctaaaattct

SEQ ID NO: 340888 - DNA, 19 bp, Homo sapiens
ccaggattgtacgtgggag

SEQ ID NO: 340889 - DNA, 13 bp, Homo sapiens
ccaggattgtcca

SEQ ID NO: 340890 - DNA, 15 bp, Homo sapiens
ccaggattgtccaca

SEQ ID NO: 340891 - DNA, 23 bp, Homo sapiens
ccaggattgtccacaaatgtcct

SEQ ID NO: 340892 - DNA, 13 bp, Homo sapiens
ccaggatttctaa

SEQ ID NO: 340893 - DNA, 14 bp, Homo sapiens
ccaggattttgtat

SEQ ID NO: 340894 - DNA, 12 bp, Homo sapiens
ccaggcacctgg

SEQ ID NO: 340895 - DNA, 20 bp, Homo sapiens
ccaggcacctggcctgctgg

SEQ ID NO: 340896 - DNA, 18 bp, Homo sapiens
ccaggcacggaggctcgt

SEQ ID NO: 340897 - DNA, 12 bp, Homo sapiens
ccaggcactgcc

SEQ ID NO: 340898 - DNA, 19 bp, Homo sapiens
ccaggcactgccttctcct

SEQ ID NO: 340899 - DNA, 16 bp, Homo sapiens
ccaggcactgctgccc

SEQ ID NO: 340900 - DNA, 17 bp, Homo sapiens
ccaggcagaaaactggc

SEQ ID NO: 340901 - DNA, 17 bp, Homo sapiens
ccaggcagatctgtgcc

SEQ ID NO: 340902 - DNA, 21 bp, Homo sapiens
ccaggcagatctgtgccccat

SEQ ID NO: 340903 - DNA, 23 bp, Homo sapiens
ccaggcagatctgtgccccatgc

SEQ ID NO: 340904 - DNA, 15 bp, Homo sapiens
ccaggcagcacctgg

SEQ ID NO: 340905 - DNA, 16 bp, Homo sapiens
ccaggcaggacgagac

SEQ ID NO: 340906 - DNA, 23 bp, Homo sapiens
ccaggcaggacgagactcctcgg

SEQ ID NO: 340907 - DNA, 21 bp, Homo sapiens
ccaggcaggaggccattccag

SEQ ID NO: 340908 - DNA, 15 bp, Homo sapiens
ccaggcaggcacctg

SEQ ID NO: 340909 - DNA, 18 bp, Homo sapiens
ccaggcagggagggaaac

SEQ ID NO: 340910 - DNA, 17 bp, Homo sapiens
ccaggcatgaccctgga

SEQ ID NO: 340911 - DNA, 13 bp, Homo sapiens
ccaggcatgctgg

SEQ ID NO: 340912 - DNA, 19 bp, Homo sapiens
ccaggcatggcccagcctg

SEQ ID NO: 340913 - DNA, 16 bp, Homo sapiens
ccaggcatgggtccct

SEQ ID NO: 340914 - DNA, 16 bp, Homo sapiens
ccaggccacaaatgtg

SEQ ID NO: 340915 - DNA, 15 bp, Homo sapiens
ccaggccactgtggc

SEQ ID NO: 340916 - DNA, 15 bp, Homo sapiens
ccaggccagcgaggc

SEQ ID NO: 340917 - DNA, 19 bp, Homo sapiens
ccatcacagccagcccagc

SEQ ID NO: 340918 - DNA, 16 bp, Homo sapiens
ccatcaccccttcccc

SEQ ID NO: 340919 - DNA, 21 bp, Homo sapiens
ccatcactcggctgtggagaa

SEQ ID NO: 340920 - DNA, 13 bp, Homo sapiens
ccatcagcccctg

SEQ ID NO: 340921 - DNA, 24 bp, Homo sapiens
ccatcagctgtaagaagagactgg

SEQ ID NO: 340922 - DNA, 14 bp, Homo sapiens
ccatcataggctga

SEQ ID NO: 340923 - DNA, 18 bp, Homo sapiens
ccatcatatgcctgaccc

SEQ ID NO: 340924 - DNA, 13 bp, Homo sapiens
ccatcatcataga

SEQ ID NO: 340925 - DNA, 12 bp, Homo sapiens
ccatcatttctg

SEQ ID NO: 340926 - DNA, 20 bp, Homo sapiens
ccatccaaataagaaaccta

SEQ ID NO: 340927 - DNA, 13 bp, Homo sapiens
ccatccaccacct

SEQ ID NO: 340928 - DNA, 16 bp, Homo sapiens
ccatccagccaggggt

SEQ ID NO: 340929 - DNA, 17 bp, Homo sapiens
ccatccatcagctccct

SEQ ID NO: 340930 - DNA, 14 bp, Homo sapiens
ccatccatctccag

SEQ ID NO: 340931 - DNA, 23 bp, Homo sapiens
ccatcccaaacccttcagtgcca

SEQ ID NO: 340932 - DNA, 16 bp, Homo sapiens
ccatcccacaccctgg

SEQ ID NO: 340933 - DNA, 13 bp, Homo sapiens
ccatcccactgat

SEQ ID NO: 340934 - DNA, 14 bp, Homo sapiens
ccatcccactgata

SEQ ID NO: 340935 - DNA, 14 bp, Homo sapiens
ccatccccaccagc

SEQ ID NO: 340936 - DNA, 15 bp, Homo sapiens
ccatccccaccagct

SEQ ID NO: 340937 - DNA, 14 bp, Homo sapiens
ccatcccctccctg

SEQ ID NO: 340938 - DNA, 17 bp, Homo sapiens
ccatcccctccctgcct

SEQ ID NO: 340939 - DNA, 18 bp, Homo sapiens
ccatcccctcctagcaca

SEQ ID NO: 340940 - DNA, 19 bp, Homo sapiens
ccatcccgaaaatctctcg

SEQ ID NO: 340941 - DNA, 22 bp, Homo sapiens
ccatccctaagaattcccagat

SEQ ID NO: 340942 - DNA, 14 bp, Homo sapiens
ccatccctgggggc

SEQ ID NO: 340943 - DNA, 19 bp, Homo sapiens
ccatccggcccccagagcg

SEQ ID NO: 340944 - DNA, 14 bp, Homo sapiens
ccatcctccagctt

SEQ ID NO: 340945 - DNA, 15 bp, Homo sapiens
ccatcctccagcttc

SEQ ID NO: 340946 - DNA, 13 bp, Homo sapiens
ccatcctcccctt

SEQ ID NO: 340947 - DNA, 17 bp, Homo sapiens
ccatcctccccttccct

SEQ ID NO: 340948 - DNA, 15 bp, Homo sapiens
ccatcctgcagcctc

SEQ ID NO: 340949 - DNA, 16 bp, Homo sapiens
ccatcctgcagcctcc

SEQ ID NO: 340950 - DNA, 18 bp, Homo sapiens
ccatcctgcagcctcctc

SEQ ID NO: 340951 - DNA, 21 bp, Homo sapiens
ccatcctgccaggagcagcct

SEQ ID NO: 340952 - DNA, 12 bp, Homo sapiens
ccatcctggccc

SEQ ID NO: 340953 - DNA, 15 bp, Homo sapiens
ccatccttcccgcag

SEQ ID NO: 340954 - DNA, 16 bp, Homo sapiens
ccatccttcccgcagc

SEQ ID NO: 340955 - DNA, 17 bp, Homo sapiens
ccatccttcccgcagca

SEQ ID NO: 340956 - DNA, 17 bp, Homo sapiens
ccatcgggtgccaaata

SEQ ID NO: 340957 - DNA, 18 bp, Homo sapiens
ccatcggtcctgtctccc

SEQ ID NO: 340958 - DNA, 22 bp, Homo sapiens
ccatcggtgtccatttatagaa

SEQ ID NO: 340959 - DNA, 17 bp, Homo sapiens
ccatcgtataaggaaat

SEQ ID NO: 340960 - DNA, 14 bp, Homo sapiens
ccatctaaaatact

SEQ ID NO: 340961 - DNA, 15 bp, Homo sapiens
ccatctcagcctcct

SEQ ID NO: 340962 - DNA, 19 bp, Homo sapiens
ccatctcagcctcctgagc

SEQ ID NO: 340963 - DNA, 12 bp, Homo sapiens
cccagcctgctg

SEQ ID NO: 340964 - DNA, 22 bp, Homo sapiens
cccagcctgctgagagccccca

SEQ ID NO: 340965 - DNA, 10 bp, Homo sapiens
cccagcctgg

SEQ ID NO: 340966 - DNA, 13 bp, Homo sapiens
cccagcctggagc

SEQ ID NO: 340967 - DNA, 15 bp, Homo sapiens
cccagcctggagccg

SEQ ID NO: 340968 - DNA, 21 bp, Homo sapiens
cccagcctggccacgcagcca

SEQ ID NO: 340969 - DNA, 20 bp, Homo sapiens
cccagcctgtcctggtacag

SEQ ID NO: 340970 - DNA, 19 bp, Homo sapiens
cccagcggcccctcccaca

SEQ ID NO: 340971 - DNA, 14 bp, Homo sapiens
cccagcgttcttca

SEQ ID NO: 340972 - DNA, 18 bp, Homo sapiens
cccagctaatctgtaggg

SEQ ID NO: 340973 - DNA, 21 bp, Homo sapiens
cccagctacaggggaggctga

SEQ ID NO: 340974 - DNA, 16 bp, Homo sapiens
cccagctacattcctc

SEQ ID NO: 340975 - DNA, 17 bp, Homo sapiens
cccagctacattcctca

SEQ ID NO: 340976 - DNA, 18 bp, Homo sapiens
cccagctacattcctcag

SEQ ID NO: 340977 - DNA, 20 bp, Homo sapiens
cccagctacattcctcagct

SEQ ID NO: 340978 - DNA, 13 bp, Homo sapiens
cccagctacccct

SEQ ID NO: 340979 - DNA, 24 bp, Homo sapiens
cccagctactctgtccaggccact

SEQ ID NO: 340980 - DNA, 12 bp, Homo sapiens
cccagctcaggg

SEQ ID NO: 340981 - DNA, 13 bp, Homo sapiens
cccagctcagggg

SEQ ID NO: 340982 - DNA, 18 bp, Homo sapiens
cccagctcaggggcagct

SEQ ID NO: 340983 - DNA, 18 bp, Homo sapiens
cccagctcagtcttccct

SEQ ID NO: 340984 - DNA, 19 bp, Homo sapiens
cccagctccgctgcttact

SEQ ID NO: 340985 - DNA, 22 bp, Homo sapiens
cccagctccttttgtccccagg

SEQ ID NO: 340986 - DNA, 23 bp, Homo sapiens
cccagctccttttgtccccaggg

SEQ ID NO: 340987 - DNA, 21 bp, Homo sapiens
cccagctgactgtggccccct

SEQ ID NO: 340988 - DNA, 22 bp, Homo sapiens
cccagctgagtctatgtaggtg

SEQ ID NO: 340989 - DNA, 15 bp, Homo sapiens
cccagctgctcccct

SEQ ID NO: 340990 - DNA, 13 bp, Homo sapiens
cccagctgctctg

SEQ ID NO: 340991 - DNA, 18 bp, Homo sapiens
cccagctgctctgcccag

SEQ ID NO: 340992 - DNA, 12 bp, Homo sapiens
cccagctggcag

SEQ ID NO: 340993 - DNA, 15 bp, Homo sapiens
cccagctggcagcgc

SEQ ID NO: 340994 - DNA, 19 bp, Homo sapiens
cccagctggcagcgcctcc

SEQ ID NO: 340995 - DNA, 17 bp, Homo sapiens
cccagctgggctctgcc

SEQ ID NO: 340996 - DNA, 19 bp, Homo sapiens
cccagctgtagccatggct

SEQ ID NO: 340997 - DNA, 22 bp, Homo sapiens
cccagctgtagccatggctcag

SEQ ID NO: 340998 - DNA, 23 bp, Homo sapiens
cccagctgtagccatggctcagg

SEQ ID NO: 340999 - DNA, 19 bp, Homo sapiens
cccagcttgggcccagctg

SEQ ID NO: 341000 - DNA, 20 bp, Homo sapiens
cccagcttgggcccagctgg

SEQ ID NO: 341001 - DNA, 22 bp, Homo sapiens
cccagcttgggcccagctgggc

SEQ ID NO: 341002 - DNA, 20 bp, Homo sapiens
cccagcttttcttgccagct

SEQ ID NO: 341003 - DNA, 21 bp, Homo sapiens
cccagcttttcttgccagctc

SEQ ID NO: 341004 - DNA, 22 bp, Homo sapiens
cccagcttttcttgccagctca

SEQ ID NO: 341005 - DNA, 24 bp, Homo sapiens
cccagcttttcttgccagctcagc

SEQ ID NO: 341006 - DNA, 19 bp, Homo sapiens
cccaggaagtccagctcct

SEQ ID NO: 341007 - DNA, 18 bp, Homo sapiens
cccaggacaggaaatatg

SEQ ID NO: 341008 - DNA, 18 bp, Homo sapiens
cccaggacgcagggagac

SEQ ID NO: 341009 - DNA, 21 bp, Homo sapiens
cccaggacgcagggagaccct

SEQ ID NO: 341010 - DNA, 23 bp, Homo sapiens
cccaggacgcagggagaccctgg

SEQ ID NO: 341011 - DNA, 17 bp, Homo sapiens
cccaggacgcttctgaa

SEQ ID NO: 341012 - DNA, 21 bp, Homo sapiens
cccaggagagcccccaccagc

SEQ ID NO: 341013 - DNA, 23 bp, Homo sapiens
cccaggagagcccccaccagcag

SEQ ID NO: 341014 - DNA, 21 bp, Homo sapiens
cccaggagctcaggtggggag

SEQ ID NO: 341015 - DNA, 19 bp, Homo sapiens
cccaggagctgagtcacct

SEQ ID NO: 341016 - DNA, 20 bp, Homo sapiens
cccaggagctgagtcacctc

SEQ ID NO: 341017 - DNA, 23 bp, Homo sapiens
cccaggagctgagtcacctcctc

SEQ ID NO: 341018 - DNA, 19 bp, Homo sapiens
cccaggaggactccctgct

SEQ ID NO: 341019 - DNA, 14 bp, Homo sapiens
cccaggagggaggg

SEQ ID NO: 341020 - DNA, 23 bp, Homo sapiens
cccaggagtttgagacaagccct

SEQ ID NO: 341021 - DNA, 14 bp, Homo sapiens
cccaggatcccctg

SEQ ID NO: 341022 - DNA, 18 bp, Homo sapiens
cccaggcagtctttgctc

SEQ ID NO: 341023 - DNA, 24 bp, Homo sapiens
cccaggccaggtccctggaccagc

SEQ ID NO: 341024 - DNA, 15 bp, Homo sapiens
cccaggccccctgca

SEQ ID NO: 341025 - DNA, 16 bp, Homo sapiens
cccaggccccctgcat

SEQ ID NO: 341026 - DNA, 12 bp, Homo sapiens
cccaggccctcc

SEQ ID NO: 341027 - DNA, 18 bp, Homo sapiens
cccaggccctccatgggc

SEQ ID NO: 341028 - DNA, 20 bp, Homo sapiens
cccaggccctccatgggcta

SEQ ID NO: 341029 - DNA, 13 bp, Homo sapiens
cccaggccggcca

SEQ ID NO: 341030 - DNA, 21 bp, Homo sapiens
cccaggccggggtggagcatg

SEQ ID NO: 341031 - DNA, 13 bp, Homo sapiens
cccaggccgttcc

SEQ ID NO: 341032 - DNA, 13 bp, Homo sapiens
cccaggcctccag

SEQ ID NO: 341033 - DNA, 14 bp, Homo sapiens
cccaggcctccagc

SEQ ID NO: 341034 - DNA, 15 bp, Homo sapiens
cccaggcctccagcc

SEQ ID NO: 341035 - DNA, 22 bp, Homo sapiens
cccaggcctccagcctctcccg

SEQ ID NO: 341036 - DNA, 13 bp, Homo sapiens
cccaggcctggag

SEQ ID NO: 341037 - DNA, 20 bp, Homo sapiens
cccaggcctggcctcggggc

SEQ ID NO: 341038 - DNA, 16 bp, Homo sapiens
cccaggcggaggggct

SEQ ID NO: 341039 - DNA, 18 bp, Homo sapiens
cccaggcggaggggcttg

SEQ ID NO: 341040 - DNA, 15 bp, Homo sapiens
cccaggctcccctgc

SEQ ID NO: 341041 - DNA, 18 bp, Homo sapiens
cccaggctcccctggtct

SEQ ID NO: 341042 - DNA, 19 bp, Homo sapiens
cccaggctcccctggtctc

SEQ ID NO: 341043 - DNA, 15 bp, Homo sapiens
cccaggctctgctga

SEQ ID NO: 341044 - DNA, 17 bp, Homo sapiens
cccaggctctgctgact

SEQ ID NO: 341045 - DNA, 20 bp, Homo sapiens
cccaggctgcactgcagtga

SEQ ID NO: 341046 - DNA, 20 bp, Homo sapiens
cccaggctgcgcctgcccgc

SEQ ID NO: 341047 - DNA, 13 bp, Homo sapiens
cccagggaaggac

SEQ ID NO: 341048 - DNA, 13 bp, Homo sapiens
cccagggcagtgt

SEQ ID NO: 341049 - DNA, 13 bp, Homo sapiens
cccagggcccctc

SEQ ID NO: 341050 - DNA, 17 bp, Homo sapiens
cccagggcccctccctc

SEQ ID NO: 341051 - DNA, 13 bp, Homo sapiens
cccagggcccgag

SEQ ID NO: 341052 - DNA, 14 bp, Homo sapiens
cccagggcccgagc

SEQ ID NO: 341053 - DNA, 14 bp, Homo sapiens
cccagggcccggca

SEQ ID NO: 341054 - DNA, 14 bp, Homo sapiens
cccagggccctgct

SEQ ID NO: 341055 - DNA, 20 bp, Homo sapiens
cccagggccctgctcaggcc

SEQ ID NO: 341056 - DNA, 12 bp, Homo sapiens
cccagggcctgg

SEQ ID NO: 341057 - DNA, 24 bp, Homo sapiens
cccagggcctgggggcagtgactg

SEQ ID NO: 341058 - DNA, 21 bp, Homo sapiens
cccagggctccctcctggagc

SEQ ID NO: 341059 - DNA, 18 bp, Homo sapiens
cccagggctgtgggtggg

SEQ ID NO: 341060 - DNA, 15 bp, Homo sapiens
cccaggggtcccagc

SEQ ID NO: 341061 - DNA, 22 bp, Homo sapiens
cccaggggtctccctgagcctg

SEQ ID NO: 341062 - DNA, 15 bp, Homo sapiens
cccagggtcttccct

SEQ ID NO: 341063 - DNA, 13 bp, Homo sapiens
cccagggtgcagg

SEQ ID NO: 341064 - DNA, 18 bp, Homo sapiens
cccagggttcccccagcc

SEQ ID NO: 341065 - DNA, 15 bp, Homo sapiens
cccagggttctgtat

SEQ ID NO: 341066 - DNA, 12 bp, Homo sapiens
cccctcctccag

SEQ ID NO: 341067 - DNA, 13 bp, Homo sapiens
cccctcctccagt

SEQ ID NO: 341068 - DNA, 14 bp, Homo sapiens
cccctcctccagta

SEQ ID NO: 341069 - DNA, 22 bp, Homo sapiens
cccctcctcgggcgcctgcgct

SEQ ID NO: 341070 - DNA, 11 bp, Homo sapiens
cccctcctctc

SEQ ID NO: 341071 - DNA, 15 bp, Homo sapiens
cccctcctctgagca

SEQ ID NO: 341072 - DNA, 14 bp, Homo sapiens
cccctccttccagc

SEQ ID NO: 341073 - DNA, 16 bp, Homo sapiens
cccctccttccagcct

SEQ ID NO: 341074 - DNA, 12 bp, Homo sapiens
cccctccttctc

SEQ ID NO: 341075 - DNA, 19 bp, Homo sapiens
cccctccttctcccctcca

SEQ ID NO: 341076 - DNA, 21 bp, Homo sapiens
cccctccttctcccctccaga

SEQ ID NO: 341077 - DNA, 21 bp, Homo sapiens
cccctccttgccgctgggaga

SEQ ID NO: 341078 - DNA, 20 bp, Homo sapiens
cccctccttgcctcctgtgt

SEQ ID NO: 341079 - DNA, 15 bp, Homo sapiens
cccctcggagcctgt

SEQ ID NO: 341080 - DNA, 21 bp, Homo sapiens
cccctcggcattcacacacag

SEQ ID NO: 341081 - DNA, 23 bp, Homo sapiens
cccctcggcattcacacacagcc

SEQ ID NO: 341082 - DNA, 22 bp, Homo sapiens
cccctcggctaccccccgtctc

SEQ ID NO: 341083 - DNA, 17 bp, Homo sapiens
cccctcgtcctgtccca

SEQ ID NO: 341084 - DNA, 21 bp, Homo sapiens
cccctcgtcctgtcccagagg

SEQ ID NO: 341085 - DNA, 14 bp, Homo sapiens
cccctctccctggg

SEQ ID NO: 341086 - DNA, 15 bp, Homo sapiens
cccctctcctgaagc

SEQ ID NO: 341087 - DNA, 18 bp, Homo sapiens
cccctctcgccccatccc

SEQ ID NO: 341088 - DNA, 15 bp, Homo sapiens
cccctctgcccagct

SEQ ID NO: 341089 - DNA, 22 bp, Homo sapiens
cccctctgcccagcttgggccc

SEQ ID NO: 341090 - DNA, 22 bp, Homo sapiens
cccctctgccggtcccccatgc

SEQ ID NO: 341091 - DNA, 13 bp, Homo sapiens
cccctctgctggc

SEQ ID NO: 341092 - DNA, 13 bp, Homo sapiens
cccctctggccag

SEQ ID NO: 341093 - DNA, 17 bp, Homo sapiens
cccctcttcccccttcc

SEQ ID NO: 341094 - DNA, 23 bp, Homo sapiens
cccctcttcttgcggcaccgccc

SEQ ID NO: 341095 - DNA, 18 bp, Homo sapiens
cccctcttttggccttgt

SEQ ID NO: 341096 - DNA, 15 bp, Homo sapiens
cccctgacctgtcca

SEQ ID NO: 341097 - DNA, 17 bp, Homo sapiens
cccctgacctgtccagg

SEQ ID NO: 341098 - DNA, 23 bp, Homo sapiens
cccctgaggacaggggcatctct

SEQ ID NO: 341099 - DNA, 13 bp, Homo sapiens
cccctgaggactg

SEQ ID NO: 341100 - DNA, 14 bp, Homo sapiens
cccctgaggactgg

SEQ ID NO: 341101 - DNA, 17 bp, Homo sapiens
cccctgaggtcatgcat

SEQ ID NO: 341102 - DNA, 16 bp, Homo sapiens
cccctgcacccacccc

SEQ ID NO: 341103 - DNA, 21 bp, Homo sapiens
cccctgccacctccctgaccc

SEQ ID NO: 341104 - DNA, 12 bp, Homo sapiens
cccctgccccag

SEQ ID NO: 341105 - DNA, 18 bp, Homo sapiens
cccctgcccgagagctct

SEQ ID NO: 341106 - DNA, 19 bp, Homo sapiens
cccctgcccgagagctctt

SEQ ID NO: 341107 - DNA, 23 bp, Homo sapiens
cccctgcccggtggtttgccatg

SEQ ID NO: 341108 - DNA, 13 bp, Homo sapiens
cccctgccctgct

SEQ ID NO: 341109 - DNA, 17 bp, Homo sapiens
cccctgccctggtccag

SEQ ID NO: 341110 - DNA, 18 bp, Homo sapiens
cccctgccgcctgtgccc

SEQ ID NO: 341111 - DNA, 12 bp, Homo sapiens
cccctgcctgga

SEQ ID NO: 341112 - DNA, 22 bp, Homo sapiens
cccctgcctggatttcttccta

SEQ ID NO: 341113 - DNA, 14 bp, Homo sapiens
cccctgcgccctcc

SEQ ID NO: 341114 - DNA, 18 bp, Homo sapiens
cccctgcggagctgcatg

SEQ ID NO: 341115 - DNA, 14 bp, Homo sapiens
cccctgcgtggggg

SEQ ID NO: 341116 - DNA, 15 bp, Homo sapiens
cccctgctaagtgtt

SEQ ID NO: 341117 - DNA, 15 bp, Homo sapiens
cccctgctcccattc

SEQ ID NO: 341118 - DNA, 23 bp, Homo sapiens
cccctgctctacccatgagcctg

SEQ ID NO: 341119 - DNA, 14 bp, Homo sapiens
cccctgctgacctt

SEQ ID NO: 341120 - DNA, 12 bp, Homo sapiens
cccctgctgcct

SEQ ID NO: 341121 - DNA, 14 bp, Homo sapiens
cccctggaaccagc

SEQ ID NO: 341122 - DNA, 22 bp, Homo sapiens
cccctggaaccagcaagtccca

SEQ ID NO: 341123 - DNA, 23 bp, Homo sapiens
cccctggaaccagcaagtcccag

SEQ ID NO: 341124 - DNA, 17 bp, Homo sapiens
cccctggagccagcagg

SEQ ID NO: 341125 - DNA, 20 bp, Homo sapiens
cccctggatgtcccctgtcc

SEQ ID NO: 341126 - DNA, 21 bp, Homo sapiens
cccctggatgtcccctgtccc

SEQ ID NO: 341127 - DNA, 22 bp, Homo sapiens
cccctggatgtcccctgtccca

SEQ ID NO: 341128 - DNA, 21 bp, Homo sapiens
cccctggcacgtcctccaccg

SEQ ID NO: 341129 - DNA, 11 bp, Homo sapiens
cccctggccca

SEQ ID NO: 341130 - DNA, 14 bp, Homo sapiens
cccctggcccagcg

SEQ ID NO: 341131 - DNA, 16 bp, Homo sapiens
cccctggcccagcggc

SEQ ID NO: 341132 - DNA, 17 bp, Homo sapiens
cccctggcccagcggcc

SEQ ID NO: 341133 - DNA, 12 bp, Homo sapiens
cccctggcccct

SEQ ID NO: 341134 - DNA, 15 bp, Homo sapiens
cccctgggccaccct

SEQ ID NO: 341135 - DNA, 16 bp, Homo sapiens
cccctgggccaccctt

SEQ ID NO: 341136 - DNA, 20 bp, Homo sapiens
cccctgggccacccttcacg

SEQ ID NO: 341137 - DNA, 20 bp, Homo sapiens
cccctggggacgccaaggag

SEQ ID NO: 341138 - DNA, 20 bp, Homo sapiens
cccctggggggcacagccag

SEQ ID NO: 341139 - DNA, 19 bp, Homo sapiens
cccctggggtacttctgtg

SEQ ID NO: 341140 - DNA, 23 bp, Homo sapiens
cccctggtgcactggccccaccc

SEQ ID NO: 341141 - DNA, 22 bp, Homo sapiens
cccctgtacccagccaccttcc

SEQ ID NO: 341142 - DNA, 17 bp, Homo sapiens
cccctgtacccagctcc

SEQ ID NO: 341143 - DNA, 11 bp, Homo sapiens
cccctgtccca

SEQ ID NO: 341144 - DNA, 18 bp, Homo sapiens
cccctgtcccattctaga

SEQ ID NO: 341145 - DNA, 20 bp, Homo sapiens
cccctgtccttcccacggcc

SEQ ID NO: 341146 - DNA, 19 bp, Homo sapiens
cccctgtctgcgccgctgt

SEQ ID NO: 341147 - DNA, 19 bp, Homo sapiens
cccctgtgactcctccctt

SEQ ID NO: 341148 - DNA, 23 bp, Homo sapiens
cccctgtgtgggagggcgaggcg

SEQ ID NO: 341149 - DNA, 15 bp, Homo sapiens
cccctgttcactcta

SEQ ID NO: 341150 - DNA, 23 bp, Homo sapiens
ccccttaagggttgaaggcagtc

SEQ ID NO: 341151 - DNA, 17 bp, Homo sapiens
ccccttcacttctgacc

SEQ ID NO: 341152 - DNA, 19 bp, Homo sapiens
ccccttcacttctgaccac

SEQ ID NO: 341153 - DNA, 23 bp, Homo sapiens
ccccttcacttctgaccacactt

SEQ ID NO: 341154 - DNA, 18 bp, Homo sapiens
ccccttcagccgagccca

SEQ ID NO: 341155 - DNA, 11 bp, Homo sapiens
ccccttcccac

SEQ ID NO: 341156 - DNA, 15 bp, Homo sapiens
ccccttccccactgc

SEQ ID NO: 341157 - DNA, 19 bp, Homo sapiens
ccccttccccactgcctgc

SEQ ID NO: 341158 - DNA, 11 bp, Homo sapiens
ccccttcccct

SEQ ID NO: 341159 - DNA, 13 bp, Homo sapiens
ccccttcccctgc

SEQ ID NO: 341160 - DNA, 15 bp, Homo sapiens
ccccttcccctgcgc

SEQ ID NO: 341161 - DNA, 16 bp, Homo sapiens
cccggcctccaggctg

SEQ ID NO: 341162 - DNA, 18 bp, Homo sapiens
cccggcctccaggctggg

SEQ ID NO: 341163 - DNA, 20 bp, Homo sapiens
cccggcctccaggctggggc

SEQ ID NO: 341164 - DNA, 11 bp, Homo sapiens
cccggcctctt

SEQ ID NO: 341165 - DNA, 14 bp, Homo sapiens
cccggcctcttcca

SEQ ID NO: 341166 - DNA, 20 bp, Homo sapiens
cccggcctgctcccagcagc

SEQ ID NO: 341167 - DNA, 21 bp, Homo sapiens
cccggctgggtcggccctgcc

SEQ ID NO: 341168 - DNA, 17 bp, Homo sapiens
cccgggaccacagctgc

SEQ ID NO: 341169 - DNA, 21 bp, Homo sapiens
cccgggagatccgccctgggc

SEQ ID NO: 341170 - DNA, 20 bp, Homo sapiens
cccgggaggaggatccgggc

SEQ ID NO: 341171 - DNA, 23 bp, Homo sapiens
cccgggaggaggatccgggcttt

SEQ ID NO: 341172 - DNA, 21 bp, Homo sapiens
cccgggcaagacttttctttg

SEQ ID NO: 341173 - DNA, 13 bp, Homo sapiens
cccgggcaggcca

SEQ ID NO: 341174 - DNA, 15 bp, Homo sapiens
cccgggcaggccagc

SEQ ID NO: 341175 - DNA, 13 bp, Homo sapiens
cccgggcccagag

SEQ ID NO: 341176 - DNA, 16 bp, Homo sapiens
cccgggcccagaggag

SEQ ID NO: 341177 - DNA, 17 bp, Homo sapiens
cccgggccctcccttgg

SEQ ID NO: 341178 - DNA, 23 bp, Homo sapiens
cccgggcccttcagtccctgagc

SEQ ID NO: 341179 - DNA, 14 bp, Homo sapiens
cccgggcctgaccc

SEQ ID NO: 341180 - DNA, 16 bp, Homo sapiens
cccgggctctctgctg

SEQ ID NO: 341181 - DNA, 17 bp, Homo sapiens
cccggggcaaggtctcc

SEQ ID NO: 341182 - DNA, 19 bp, Homo sapiens
cccggggcagctgccagag

SEQ ID NO: 341183 - DNA, 20 bp, Homo sapiens
cccggggcagctgccagaga

SEQ ID NO: 341184 - DNA, 16 bp, Homo sapiens
cccggggcagctggca

SEQ ID NO: 341185 - DNA, 17 bp, Homo sapiens
cccggggctggcaagca

SEQ ID NO: 341186 - DNA, 22 bp, Homo sapiens
cccgggttcacgccattctcct

SEQ ID NO: 341187 - DNA, 16 bp, Homo sapiens
cccggtcccaggccgc

SEQ ID NO: 341188 - DNA, 17 bp, Homo sapiens
cccggtggtttgccatg

SEQ ID NO: 341189 - DNA, 17 bp, Homo sapiens
cccggtgtatgcagtgg

SEQ ID NO: 341190 - DNA, 18 bp, Homo sapiens
cccggttcagacccctgc

SEQ ID NO: 341191 - DNA, 16 bp, Homo sapiens
cccggtttcagaagct

SEQ ID NO: 341192 - DNA, 22 bp, Homo sapiens
cccggtttcagaagctgcagct

SEQ ID NO: 341193 - DNA, 23 bp, Homo sapiens
cccggtttcagaagctgcagctg

SEQ ID NO: 341194 - DNA, 14 bp, Homo sapiens
cccgtacctcttcc

SEQ ID NO: 341195 - DNA, 17 bp, Homo sapiens
cccgtcaccatctcagg

SEQ ID NO: 341196 - DNA, 18 bp, Homo sapiens
cccgtccctttccctgca

SEQ ID NO: 341197 - DNA, 19 bp, Homo sapiens
cccgtcggactgcccccag

SEQ ID NO: 341198 - DNA, 20 bp, Homo sapiens
cccgtcggactgcccccaga

SEQ ID NO: 341199 - DNA, 23 bp, Homo sapiens
cccgtcggactgcccccagaaag

SEQ ID NO: 341200 - DNA, 13 bp, Homo sapiens
cccgtctgcccct

SEQ ID NO: 341201 - DNA, 14 bp, Homo sapiens
cccgtctgcccctt

SEQ ID NO: 341202 - DNA, 19 bp, Homo sapiens
cccgtgaagcagtgcctcg

SEQ ID NO: 341203 - DNA, 16 bp, Homo sapiens
cccgtgcaaaacatgc

SEQ ID NO: 341204 - DNA, 15 bp, Homo sapiens
cccgtgcagactgga

SEQ ID NO: 341205 - DNA, 17 bp, Homo sapiens
cccgtgcagtacaggca

SEQ ID NO: 341206 - DNA, 12 bp, Homo sapiens
cccgtgccaccc

SEQ ID NO: 341207 - DNA, 23 bp, Homo sapiens
cccgtgtcggttcttcctggaag

SEQ ID NO: 341208 - DNA, 16 bp, Homo sapiens
cccgtgtgccccaaga

SEQ ID NO: 341209 - DNA, 17 bp, Homo sapiens
cccgtgtgccccaagag

SEQ ID NO: 341210 - DNA, 20 bp, Homo sapiens
cccgttccctgtcagaggct

SEQ ID NO: 341211 - DNA, 14 bp, Homo sapiens
cccttgcaggggtc

SEQ ID NO: 341212 - DNA, 23 bp, Homo sapiens
cccttgcagttcagcaccaccct

SEQ ID NO: 341213 - DNA, 14 bp, Homo sapiens
cccttgccaaggcc

SEQ ID NO: 341214 - DNA, 19 bp, Homo sapiens
cccttgccaaggccgccca

SEQ ID NO: 341215 - DNA, 15 bp, Homo sapiens
cccttgcccccatcc

SEQ ID NO: 341216 - DNA, 17 bp, Homo sapiens
cccttgcccgccagcca

SEQ ID NO: 341217 - DNA, 19 bp, Homo sapiens
cccttgcccgccagccagt

SEQ ID NO: 341218 - DNA, 16 bp, Homo sapiens
cccttgctcagtgcct

SEQ ID NO: 341219 - DNA, 20 bp, Homo sapiens
cccttgctcagtgcctcctg

SEQ ID NO: 341220 - DNA, 22 bp, Homo sapiens
cccttgctcagtgcctcctggc

SEQ ID NO: 341221 - DNA, 13 bp, Homo sapiens
cccttgcttctca

SEQ ID NO: 341222 - DNA, 19 bp, Homo sapiens
cccttggaaacctgccctg

SEQ ID NO: 341223 - DNA, 19 bp, Homo sapiens
cccttggccacggcctggg

SEQ ID NO: 341224 - DNA, 20 bp, Homo sapiens
cccttggccacggcctggga

SEQ ID NO: 341225 - DNA, 13 bp, Homo sapiens
cccttggcccctc

SEQ ID NO: 341226 - DNA, 12 bp, Homo sapiens
cccttggcctca

SEQ ID NO: 341227 - DNA, 14 bp, Homo sapiens
cccttggctcctgt

SEQ ID NO: 341228 - DNA, 14 bp, Homo sapiens
cccttggctgggac

SEQ ID NO: 341229 - DNA, 16 bp, Homo sapiens
cccttgggacagccag

SEQ ID NO: 341230 - DNA, 22 bp, Homo sapiens
cccttgggacagccagagctgg

SEQ ID NO: 341231 - DNA, 13 bp, Homo sapiens
cccttgggcagtt

SEQ ID NO: 341232 - DNA, 15 bp, Homo sapiens
cccttgggcagttct

SEQ ID NO: 341233 - DNA, 22 bp, Homo sapiens
cccttgggcagttctcactcct

SEQ ID NO: 341234 - DNA, 19 bp, Homo sapiens
cccttgggcatccacccag

SEQ ID NO: 341235 - DNA, 23 bp, Homo sapiens
cccttgggcatccacccagtgct

SEQ ID NO: 341236 - DNA, 18 bp, Homo sapiens
cccttgggcggctgagag

SEQ ID NO: 341237 - DNA, 15 bp, Homo sapiens
cccttgggctggaag

SEQ ID NO: 341238 - DNA, 18 bp, Homo sapiens
cccttggggcctggcttg

SEQ ID NO: 341239 - DNA, 19 bp, Homo sapiens
cccttggggcctggcttgc

SEQ ID NO: 341240 - DNA, 23 bp, Homo sapiens
cccttggggcctggcttgctcca

SEQ ID NO: 341241 - DNA, 14 bp, Homo sapiens
cccttgtcctgcca

SEQ ID NO: 341242 - DNA, 18 bp, Homo sapiens
cccttgtcctgccagctg

SEQ ID NO: 341243 - DNA, 19 bp, Homo sapiens
cccttgtcctgccagctgc

SEQ ID NO: 341244 - DNA, 21 bp, Homo sapiens
ccctttagccaaacccttgtc

SEQ ID NO: 341245 - DNA, 14 bp, Homo sapiens
ccctttccctgcat

SEQ ID NO: 341246 - DNA, 17 bp, Homo sapiens
ccctttccctgcatccc

SEQ ID NO: 341247 - DNA, 18 bp, Homo sapiens
ccctttccctgcatccct

SEQ ID NO: 341248 - DNA, 13 bp, Homo sapiens
ccctttccttcca

SEQ ID NO: 341249 - DNA, 15 bp, Homo sapiens
ccctttccttccatc

SEQ ID NO: 341250 - DNA, 17 bp, Homo sapiens
ccctttcttgacaaaac

SEQ ID NO: 341251 - DNA, 20 bp, Homo sapiens
ccctttgacttcagctgcct

SEQ ID NO: 341252 - DNA, 22 bp, Homo sapiens
ccctttgtggactttatttaat

SEQ ID NO: 341253 - DNA, 23 bp, Homo sapiens
ccctttgtggactttatttaatt

SEQ ID NO: 341254 - DNA, 11 bp, Homo sapiens
cccttttcctt

SEQ ID NO: 341255 - DNA, 13 bp, Homo sapiens
cccttttctggct

SEQ ID NO: 341256 - DNA, 20 bp, Homo sapiens
cccttttctggctcctgtgt

SEQ ID NO: 341257 - DNA, 22 bp, Homo sapiens
cccttttctggctcctgtgtgg

SEQ ID NO: 341258 - DNA, 13 bp, Homo sapiens
cccttttctgttt

SEQ ID NO: 341259 - DNA, 17 bp, Homo sapiens
cccttttgcctggctgt

SEQ ID NO: 341260 - DNA, 20 bp, Homo sapiens
cccttttggcccccgagctg

SEQ ID NO: 341261 - DNA, 16 bp, Homo sapiens
cccttttgggtttctg

SEQ ID NO: 341262 - DNA, 20 bp, Homo sapiens
cccttttgggtttctgccct

SEQ ID NO: 341263 - DNA, 18 bp, Homo sapiens
ccctttttactccccttg

SEQ ID NO: 341264 - DNA, 23 bp, Homo sapiens
ccctttttactccccttgagctg

SEQ ID NO: 341265 - DNA, 22 bp, Homo sapiens
ccctttttgagtaattttctga

SEQ ID NO: 341266 - DNA, 16 bp, Homo sapiens
cccttttttcttcccc

SEQ ID NO: 341267 - DNA, 19 bp, Homo sapiens
ccgaagaagggtccttccc

SEQ ID NO: 341268 - DNA, 20 bp, Homo sapiens
ccgaagaagggtccttccct

SEQ ID NO: 341269 - DNA, 17 bp, Homo sapiens
ccgaatggagtccagac

SEQ ID NO: 341270 - DNA, 13 bp, Homo sapiens
ccgaatgtgcagg

SEQ ID NO: 341271 - DNA, 13 bp, Homo sapiens
ccgacagcctggc

SEQ ID NO: 341272 - DNA, 14 bp, Homo sapiens
ccgacagcctggca

SEQ ID NO: 341273 - DNA, 16 bp, Homo sapiens
ccgacatgtactgcta

SEQ ID NO: 341274 - DNA, 18 bp, Homo sapiens
ccgacgccacagcccagc

SEQ ID NO: 341275 - DNA, 23 bp, Homo sapiens
ccgacggtgggcatttgtgaggc

SEQ ID NO: 341276 - DNA, 14 bp, Homo sapiens
ccgactgggctcaa

SEQ ID NO: 341277 - DNA, 13 bp, Homo sapiens
ccgagagctctta

SEQ ID NO: 341278 - DNA, 21 bp, Homo sapiens
ccgagagctcttagtttttaa

SEQ ID NO: 341279 - DNA, 15 bp, Homo sapiens
ccgagcaaagatcaa

SEQ ID NO: 341280 - DNA, 23 bp, Homo sapiens
ccgagcaaagatcaaaataaaaa

SEQ ID NO: 341281 - DNA, 14 bp, Homo sapiens
ccgagccagctctg

SEQ ID NO: 341282 - DNA, 12 bp, Homo sapiens
ccgagccagctt

SEQ ID NO: 341283 - DNA, 17 bp, Homo sapiens
ccgagccctacttccag

SEQ ID NO: 341284 - DNA, 22 bp, Homo sapiens
ccgctcagccctccctgcccct

SEQ ID NO: 341285 - DNA, 14 bp, Homo sapiens
ccgctcccacagct

SEQ ID NO: 341286 - DNA, 19 bp, Homo sapiens
ccgctcccacagcttcctg

SEQ ID NO: 341287 - DNA, 22 bp, Homo sapiens
ccgctcccacagcttcctgagg

SEQ ID NO: 341288 - DNA, 16 bp, Homo sapiens
ccgctccccagcccag

SEQ ID NO: 341289 - DNA, 18 bp, Homo sapiens
ccgctcccctttcccatc

SEQ ID NO: 341290 - DNA, 19 bp, Homo sapiens
ccgctctgccatcagcccc

SEQ ID NO: 341291 - DNA, 16 bp, Homo sapiens
ccgctgcaatgcctag

SEQ ID NO: 341292 - DNA, 19 bp, Homo sapiens
ccgctgcaatgcctagact

SEQ ID NO: 341293 - DNA, 23 bp, Homo sapiens
ccgctgccaccacgtctgccagg

SEQ ID NO: 341294 - DNA, 13 bp, Homo sapiens
ccgctgccagcac

SEQ ID NO: 341295 - DNA, 16 bp, Homo sapiens
ccgctgccagcacaga

SEQ ID NO: 341296 - DNA, 16 bp, Homo sapiens
ccgctgcccagccctc

SEQ ID NO: 341297 - DNA, 13 bp, Homo sapiens
ccgctgcctggcg

SEQ ID NO: 341298 - DNA, 21 bp, Homo sapiens
ccgctgcctggcgggcagccc

SEQ ID NO: 341299 - DNA, 19 bp, Homo sapiens
ccgctgcgtgccatcactc

SEQ ID NO: 341300 - DNA, 21 bp, Homo sapiens
ccgctgctgtgctctggggat

SEQ ID NO: 341301 - DNA, 16 bp, Homo sapiens
ccgctggagcatgagc

SEQ ID NO: 341302 - DNA, 19 bp, Homo sapiens
ccgctgggagaaaagccag

SEQ ID NO: 341303 - DNA, 20 bp, Homo sapiens
ccgctgggagaaaagccaga

SEQ ID NO: 341304 - DNA, 23 bp, Homo sapiens
ccgctgggagaaaagccagatga

SEQ ID NO: 341305 - DNA, 17 bp, Homo sapiens
ccgctgtcccaggggtc

SEQ ID NO: 341306 - DNA, 19 bp, Homo sapiens
ccgctgtgctgttgtctgc

SEQ ID NO: 341307 - DNA, 22 bp, Homo sapiens
ccgctgttgggggtttccctgt

SEQ ID NO: 341308 - DNA, 13 bp, Homo sapiens
ccgcttttgttct

SEQ ID NO: 341309 - DNA, 22 bp, Homo sapiens
ccggaattgagaggtgggggat

SEQ ID NO: 341310 - DNA, 14 bp, Homo sapiens
ccggacccacctca

SEQ ID NO: 341311 - DNA, 13 bp, Homo sapiens
ccggacgctggct

SEQ ID NO: 341312 - DNA, 18 bp, Homo sapiens
ccggacgctggctcggga

SEQ ID NO: 341313 - DNA, 20 bp, Homo sapiens
ccggactttcggagttgggg

SEQ ID NO: 341314 - DNA, 23 bp, Homo sapiens
ccggactttcggagttgggggtc

SEQ ID NO: 341315 - DNA, 21 bp, Homo sapiens
ccggagattggacggcctgat

SEQ ID NO: 341316 - DNA, 15 bp, Homo sapiens
ccggagcacagccct

SEQ ID NO: 341317 - DNA, 18 bp, Homo sapiens
ccggagcacagccctggg

SEQ ID NO: 341318 - DNA, 21 bp, Homo sapiens
ccggagcacagccctgggagg

SEQ ID NO: 341319 - DNA, 12 bp, Homo sapiens
ccggagcaccac

SEQ ID NO: 341320 - DNA, 11 bp, Homo sapiens
ccggagcccca

SEQ ID NO: 341321 - DNA, 16 bp, Homo sapiens
ccggagctaacactgg

SEQ ID NO: 341322 - DNA, 11 bp, Homo sapiens
ccggagctggg

SEQ ID NO: 341323 - DNA, 17 bp, Homo sapiens
ccggaggcagcagacac

SEQ ID NO: 341324 - DNA, 18 bp, Homo sapiens
ccggaggcgcccacctgc

SEQ ID NO: 341325 - DNA, 21 bp, Homo sapiens
ccggaggcgcccacctgccca

SEQ ID NO: 341326 - DNA, 16 bp, Homo sapiens
ccggaggggcctggca

SEQ ID NO: 341327 - DNA, 17 bp, Homo sapiens
ccggaggggcctggcag

SEQ ID NO: 341328 - DNA, 18 bp, Homo sapiens
ccggagggtgtttatgta

SEQ ID NO: 341329 - DNA, 15 bp, Homo sapiens
ccggatctccaggcc

SEQ ID NO: 341330 - DNA, 16 bp, Homo sapiens
ccggatctccaggccc

SEQ ID NO: 341331 - DNA, 20 bp, Homo sapiens
ccggatctccaggcccagcc

SEQ ID NO: 341332 - DNA, 15 bp, Homo sapiens
ccggatgcccacccc

SEQ ID NO: 341333 - DNA, 16 bp, Homo sapiens
ccggatgcccacccct

SEQ ID NO: 341334 - DNA, 16 bp, Homo sapiens
ccggcagaggcagggc

SEQ ID NO: 341335 - DNA, 18 bp, Homo sapiens
ccggcagaggcagggccc

SEQ ID NO: 341336 - DNA, 19 bp, Homo sapiens
ccggcagaggcagggccct

SEQ ID NO: 341337 - DNA, 21 bp, Homo sapiens
ccggcagaggcagggccctgg

SEQ ID NO: 341338 - DNA, 23 bp, Homo sapiens
ccggcagaggcagggccctgggg

SEQ ID NO: 341339 - DNA, 17 bp, Homo sapiens
ccggcagccccccagtg

SEQ ID NO: 341340 - DNA, 12 bp, Homo sapiens
ccggcagcctgg

SEQ ID NO: 341341 - DNA, 14 bp, Homo sapiens
ccggcagcctggtt

SEQ ID NO: 341342 - DNA, 14 bp, Homo sapiens
ccggcaggccctgc

SEQ ID NO: 341343 - DNA, 16 bp, Homo sapiens
ccggcaggccctgcag

SEQ ID NO: 341344 - DNA, 14 bp, Homo sapiens
ccggcatgccgagt

SEQ ID NO: 341345 - DNA, 19 bp, Homo sapiens
ccggcatgccgagtgcccc

SEQ ID NO: 341346 - DNA, 17 bp, Homo sapiens
cctatttactggaaacc

SEQ ID NO: 341347 - DNA, 23 bp, Homo sapiens
cctatttgactgcttcacggact

SEQ ID NO: 341348 - DNA, 14 bp, Homo sapiens
cctcaaaccctgtg

SEQ ID NO: 341349 - DNA, 21 bp, Homo sapiens
cctcaacaagggagagacctc

SEQ ID NO: 341350 - DNA, 19 bp, Homo sapiens
cctcaaccctccctcagcc

SEQ ID NO: 341351 - DNA, 20 bp, Homo sapiens
cctcaacctgtaaattattt

SEQ ID NO: 341352 - DNA, 23 bp, Homo sapiens
cctcaacctgtaaattattttaa

SEQ ID NO: 341353 - DNA, 14 bp, Homo sapiens
cctcaagaagtaat

SEQ ID NO: 341354 - DNA, 13 bp, Homo sapiens
cctcaagccagga

SEQ ID NO: 341355 - DNA, 15 bp, Homo sapiens
cctcaagccaggaga

SEQ ID NO: 341356 - DNA, 16 bp, Homo sapiens
cctcaagccaggagac

SEQ ID NO: 341357 - DNA, 20 bp, Homo sapiens
cctcaagccaggagaccctg

SEQ ID NO: 341358 - DNA, 13 bp, Homo sapiens
cctccctcctctg

SEQ ID NO: 341359 - DNA, 16 bp, Homo sapiens
cctccctcctgcaggc

SEQ ID NO: 341360 - DNA, 18 bp, Homo sapiens
cctccctcctgcaggctg

SEQ ID NO: 341361 - DNA, 22 bp, Homo sapiens
cctccctcctggctcacagcca

SEQ ID NO: 341362 - DNA, 14 bp, Homo sapiens
cctccctccttcct

SEQ ID NO: 341363 - DNA, 13 bp, Homo sapiens
cctccctctaatt

SEQ ID NO: 341364 - DNA, 13 bp, Homo sapiens
cctccctctccca

SEQ ID NO: 341365 - DNA, 18 bp, Homo sapiens
cctccctctctcttctgc

SEQ ID NO: 341366 - DNA, 17 bp, Homo sapiens
cctccctctgccccaag

SEQ ID NO: 341367 - DNA, 22 bp, Homo sapiens
cctccctctgccccaagcagcc

SEQ ID NO: 341368 - DNA, 12 bp, Homo sapiens
cctccctctgct

SEQ ID NO: 341369 - DNA, 13 bp, Homo sapiens
cctccctcttccc

SEQ ID NO: 341370 - DNA, 15 bp, Homo sapiens
cctccctgaccctgc

SEQ ID NO: 341371 - DNA, 22 bp, Homo sapiens
cctccctgaccctgcagagatg

SEQ ID NO: 341372 - DNA, 11 bp, Homo sapiens
cctccctgcag

SEQ ID NO: 341373 - DNA, 15 bp, Homo sapiens
cctccctgcccaggc

SEQ ID NO: 341374 - DNA, 21 bp, Homo sapiens
cctccctgcccctcccttcaa

SEQ ID NO: 341375 - DNA, 22 bp, Homo sapiens
cctccctgcccctcccttcaac

SEQ ID NO: 341376 - DNA, 13 bp, Homo sapiens
cctccctgcctgc

SEQ ID NO: 341377 - DNA, 14 bp, Homo sapiens
cctccctgcctgct

SEQ ID NO: 341378 - DNA, 16 bp, Homo sapiens
cctccctgctcagctg

SEQ ID NO: 341379 - DNA, 12 bp, Homo sapiens
cctccctggctc

SEQ ID NO: 341380 - DNA, 14 bp, Homo sapiens
cctccctggctccc

SEQ ID NO: 341381 - DNA, 16 bp, Homo sapiens
cctccctggctcccat

SEQ ID NO: 341382 - DNA, 23 bp, Homo sapiens
cctccctggggaccaggagctag

SEQ ID NO: 341383 - DNA, 15 bp, Homo sapiens
cctccctgggttcag

SEQ ID NO: 341384 - DNA, 11 bp, Homo sapiens
cctccctgtcc

SEQ ID NO: 341385 - DNA, 18 bp, Homo sapiens
cctccctgtctccagggc

SEQ ID NO: 341386 - DNA, 13 bp, Homo sapiens
cctcccttcccag

SEQ ID NO: 341387 - DNA, 16 bp, Homo sapiens
cctcccttcctccgct

SEQ ID NO: 341388 - DNA, 14 bp, Homo sapiens
cctcccttctttgc

SEQ ID NO: 341389 - DNA, 21 bp, Homo sapiens
cctcccttggaaacctgccct

SEQ ID NO: 341390 - DNA, 22 bp, Homo sapiens
cctccgaggctccccgcctcca

SEQ ID NO: 341391 - DNA, 14 bp, Homo sapiens
cctccgcccaaatc

SEQ ID NO: 341392 - DNA, 22 bp, Homo sapiens
cctccgcccaaatcaataaact

SEQ ID NO: 341393 - DNA, 18 bp, Homo sapiens
cctccgctcccctttccc

SEQ ID NO: 341394 - DNA, 19 bp, Homo sapiens
cctccgctcccctttccca

SEQ ID NO: 341395 - DNA, 21 bp, Homo sapiens
cctccgctcccctttcccatc

SEQ ID NO: 341396 - DNA, 19 bp, Homo sapiens
cctccggccctgccccaca

SEQ ID NO: 341397 - DNA, 20 bp, Homo sapiens
cctccggccctgccccacac

SEQ ID NO: 341398 - DNA, 15 bp, Homo sapiens
cctccggcctcccct

SEQ ID NO: 341399 - DNA, 16 bp, Homo sapiens
cctccggcctcccctc

SEQ ID NO: 341400 - DNA, 15 bp, Homo sapiens
cctccgggcagggga

SEQ ID NO: 341401 - DNA, 13 bp, Homo sapiens
cctccgtccaccc

SEQ ID NO: 341402 - DNA, 16 bp, Homo sapiens
cctccgtccacccagg

SEQ ID NO: 341403 - DNA, 20 bp, Homo sapiens
cctccgtccacccaggctgc

SEQ ID NO: 341404 - DNA, 23 bp, Homo sapiens
cctccgttgcggctgtgctcctg

SEQ ID NO: 341405 - DNA, 18 bp, Homo sapiens
cctccgtttatgggcctt

SEQ ID NO: 341406 - DNA, 23 bp, Homo sapiens
cctcctaccctcccaccagaacg

SEQ ID NO: 341407 - DNA, 22 bp, Homo sapiens
cctcctagcacaaggagtgccc

SEQ ID NO: 341408 - DNA, 18 bp, Homo sapiens
cctcctatcacctcccct

SEQ ID NO: 341409 - DNA, 20 bp, Homo sapiens
cctcctcaccccttcctttt

SEQ ID NO: 341410 - DNA, 22 bp, Homo sapiens
cctcctccaagaagccctcctt

SEQ ID NO: 341411 - DNA, 18 bp, Homo sapiens
cctcctccacagtgctgc

SEQ ID NO: 341412 - DNA, 14 bp, Homo sapiens
cctcctccactcac

SEQ ID NO: 341413 - DNA, 22 bp, Homo sapiens
cctcctccactcactccagccc

SEQ ID NO: 341414 - DNA, 11 bp, Homo sapiens
cctcctccaga

SEQ ID NO: 341415 - DNA, 13 bp, Homo sapiens
cctcctccagact

SEQ ID NO: 341416 - DNA, 14 bp, Homo sapiens
cctcctccagccca

SEQ ID NO: 341417 - DNA, 20 bp, Homo sapiens
cctcctcccatctccttccc

SEQ ID NO: 341418 - DNA, 14 bp, Homo sapiens
cctcctcccctcct

SEQ ID NO: 341419 - DNA, 13 bp, Homo sapiens
cctcctcctcctc

SEQ ID NO: 341420 - DNA, 13 bp, Homo sapiens
cctcctcctcctg

SEQ ID NO: 341421 - DNA, 14 bp, Homo sapiens
cctcctcctcctgt

SEQ ID NO: 341422 - DNA, 18 bp, Homo sapiens
cctcctcgctgtgccacc

SEQ ID NO: 341423 - DNA, 20 bp, Homo sapiens
cctcctcgctgtgccaccac

SEQ ID NO: 341424 - DNA, 22 bp, Homo sapiens
cctcctcgctgtgccaccaccc

SEQ ID NO: 341425 - DNA, 19 bp, Homo sapiens
cctcctcgggcgcctgcgc

SEQ ID NO: 341426 - DNA, 21 bp, Homo sapiens
cctcctcgggcgcctgcgctc

SEQ ID NO: 341427 - DNA, 15 bp, Homo sapiens
cctcctctcctcgtc

SEQ ID NO: 341428 - DNA, 16 bp, Homo sapiens
cctcctctctccctgc

SEQ ID NO: 341429 - DNA, 21 bp, Homo sapiens
cctcctctctccctgcctcac

SEQ ID NO: 341430 - DNA, 14 bp, Homo sapiens
cctcctctctgctg

SEQ ID NO: 341431 - DNA, 13 bp, Homo sapiens
cctcctctctgga

SEQ ID NO: 341432 - DNA, 15 bp, Homo sapiens
cctcctctctggact

SEQ ID NO: 341433 - DNA, 13 bp, Homo sapiens
cctcctctgcccc

SEQ ID NO: 341434 - DNA, 12 bp, Homo sapiens
cctcctctgtgc

SEQ ID NO: 341435 - DNA, 17 bp, Homo sapiens
cctcctctgtgctccct

SEQ ID NO: 341436 - DNA, 16 bp, Homo sapiens
cctcctcttcaccccg

SEQ ID NO: 341437 - DNA, 16 bp, Homo sapiens
cctcctgaagcctctg

SEQ ID NO: 341438 - DNA, 20 bp, Homo sapiens
cctcctgacagcgacagaaa

SEQ ID NO: 341439 - DNA, 16 bp, Homo sapiens
cctcctgagcctgtgg

SEQ ID NO: 341440 - DNA, 18 bp, Homo sapiens
cctcctgatggccaagag

SEQ ID NO: 341441 - DNA, 16 bp, Homo sapiens
cctcctgatgtttttc

SEQ ID NO: 341442 - DNA, 18 bp, Homo sapiens
cctcctgcaggctggctg

SEQ ID NO: 341443 - DNA, 17 bp, Homo sapiens
cctcgtccacaggggca

SEQ ID NO: 341444 - DNA, 16 bp, Homo sapiens
cctcgtcccctgcctc

SEQ ID NO: 341445 - DNA, 18 bp, Homo sapiens
cctcgtccggcctgcagc

SEQ ID NO: 341446 - DNA, 19 bp, Homo sapiens
cctcgtccggcctgcagcc

SEQ ID NO: 341447 - DNA, 20 bp, Homo sapiens
cctcgtggcggggcagcagg

SEQ ID NO: 341448 - DNA, 22 bp, Homo sapiens
cctcgtggttattagcaaggct

SEQ ID NO: 341449 - DNA, 15 bp, Homo sapiens
cctcgtttgatagtg

SEQ ID NO: 341450 - DNA, 20 bp, Homo sapiens
cctcgtttgatagtgcttct

SEQ ID NO: 341451 - DNA, 17 bp, Homo sapiens
cctctaacaggggctgg

SEQ ID NO: 341452 - DNA, 13 bp, Homo sapiens
cctctaactcatt

SEQ ID NO: 341453 - DNA, 17 bp, Homo sapiens
cctctaaggccaaggcc

SEQ ID NO: 341454 - DNA, 15 bp, Homo sapiens
cctctacagccgtcc

SEQ ID NO: 341455 - DNA, 21 bp, Homo sapiens
cctctacagccgtcccgcgtt

SEQ ID NO: 341456 - DNA, 22 bp, Homo sapiens
cctctatatctttaaataaatg

SEQ ID NO: 341457 - DNA, 20 bp, Homo sapiens
cctctcactccccagcccca

SEQ ID NO: 341458 - DNA, 16 bp, Homo sapiens
cctctcagaactcctg

SEQ ID NO: 341459 - DNA, 21 bp, Homo sapiens
cctctcagaactcctgtgtgt

SEQ ID NO: 341460 - DNA, 14 bp, Homo sapiens
cctctcagatccct

SEQ ID NO: 341461 - DNA, 17 bp, Homo sapiens
cctctcagttctctccc

SEQ ID NO: 341462 - DNA, 18 bp, Homo sapiens
cctctcatcagcccaggt

SEQ ID NO: 341463 - DNA, 22 bp, Homo sapiens
cctctcatcagcccaggtccca

SEQ ID NO: 341464 - DNA, 23 bp, Homo sapiens
cctctccaagtctctctgtgaat

SEQ ID NO: 341465 - DNA, 15 bp, Homo sapiens
cctctccacacccat

SEQ ID NO: 341466 - DNA, 14 bp, Homo sapiens
cctctccactccat

SEQ ID NO: 341467 - DNA, 13 bp, Homo sapiens
cctctccagccct

SEQ ID NO: 341468 - DNA, 22 bp, Homo sapiens
cctctcccaaataaactcctta

SEQ ID NO: 341469 - DNA, 23 bp, Homo sapiens
cctctcccaaataaactccttaa

SEQ ID NO: 341470 - DNA, 21 bp, Homo sapiens
cctctcccacccggccacagc

SEQ ID NO: 341471 - DNA, 22 bp, Homo sapiens
cctctcccacccggccacagct

SEQ ID NO: 341472 - DNA, 17 bp, Homo sapiens
cctctcccggctgcctg

SEQ ID NO: 341473 - DNA, 20 bp, Homo sapiens
cctctcccggctgcctgccg

SEQ ID NO: 341474 - DNA, 22 bp, Homo sapiens
cctctcccggctgcctgccgcc

SEQ ID NO: 341475 - DNA, 22 bp, Homo sapiens
cctctccctcaacaagggagag

SEQ ID NO: 341476 - DNA, 20 bp, Homo sapiens
cctctcctatgtggcagctg

SEQ ID NO: 341477 - DNA, 22 bp, Homo sapiens
cctctcctatgtggcagctggg

SEQ ID NO: 341478 - DNA, 13 bp, Homo sapiens
cctctcctgaagc

SEQ ID NO: 341479 - DNA, 13 bp, Homo sapiens
cctctcctgccca

SEQ ID NO: 341480 - DNA, 15 bp, Homo sapiens
cctgcaaactcactg

SEQ ID NO: 341481 - DNA, 17 bp, Homo sapiens
cctgcaactcaaggact

SEQ ID NO: 341482 - DNA, 13 bp, Homo sapiens
cctgcaagcccca

SEQ ID NO: 341483 - DNA, 21 bp, Homo sapiens
cctgcaagccccagggcctgg

SEQ ID NO: 341484 - DNA, 23 bp, Homo sapiens
cctgcaatctccagggctgcccc

SEQ ID NO: 341485 - DNA, 16 bp, Homo sapiens
cctgcacacacctgcc

SEQ ID NO: 341486 - DNA, 18 bp, Homo sapiens
cctgcacacacctgcctg

SEQ ID NO: 341487 - DNA, 12 bp, Homo sapiens
cctgcacccacc

SEQ ID NO: 341488 - DNA, 16 bp, Homo sapiens
cctgcacccacccctg

SEQ ID NO: 341489 - DNA, 17 bp, Homo sapiens
cctgcacccacccctgc

SEQ ID NO: 341490 - DNA, 17 bp, Homo sapiens
cctgcaccccagcattc

SEQ ID NO: 341491 - DNA, 14 bp, Homo sapiens
cctgcaccctctgc

SEQ ID NO: 341492 - DNA, 17 bp, Homo sapiens
cctgcaccctctgctat

SEQ ID NO: 341493 - DNA, 20 bp, Homo sapiens
cctgcaccctggaaagggga

SEQ ID NO: 341494 - DNA, 15 bp, Homo sapiens
cctgcacctgtgcag

SEQ ID NO: 341495 - DNA, 14 bp, Homo sapiens
cctgcactcacagg

SEQ ID NO: 341496 - DNA, 14 bp, Homo sapiens
cctgcactgtaaaa

SEQ ID NO: 341497 - DNA, 15 bp, Homo sapiens
cctgcacttcatatc

SEQ ID NO: 341498 - DNA, 16 bp, Homo sapiens
cctgcactttcctagt

SEQ ID NO: 341499 - DNA, 12 bp, Homo sapiens
cctgcagagatg

SEQ ID NO: 341500 - DNA, 14 bp, Homo sapiens
cctgcagagcagga

SEQ ID NO: 341501 - DNA, 11 bp, Homo sapiens
cctgcagagct

SEQ ID NO: 341502 - DNA, 16 bp, Homo sapiens
cctgcagagctggggg

SEQ ID NO: 341503 - DNA, 19 bp, Homo sapiens
cctgcagaggaccacagtg

SEQ ID NO: 341504 - DNA, 18 bp, Homo sapiens
cctgcagaggcccagcca

SEQ ID NO: 341505 - DNA, 21 bp, Homo sapiens
cctgcagcagagcctggaaga

SEQ ID NO: 341506 - DNA, 13 bp, Homo sapiens
cctgcagccagga

SEQ ID NO: 341507 - DNA, 14 bp, Homo sapiens
cctgcagccaggac

SEQ ID NO: 341508 - DNA, 15 bp, Homo sapiens
cctgcagcctggagg

SEQ ID NO: 341509 - DNA, 20 bp, Homo sapiens
cctgcaggaacgagcactgg

SEQ ID NO: 341510 - DNA, 21 bp, Homo sapiens
cctgcaggaacgagcactggc

SEQ ID NO: 341511 - DNA, 16 bp, Homo sapiens
cctgcaggactcgggc

SEQ ID NO: 341512 - DNA, 12 bp, Homo sapiens
cctgcaggaggc

SEQ ID NO: 341513 - DNA, 16 bp, Homo sapiens
cctgcaggaggcctgg

SEQ ID NO: 341514 - DNA, 15 bp, Homo sapiens
cctgcaggccccagc

SEQ ID NO: 341515 - DNA, 22 bp, Homo sapiens
cctgcaggcggtatccagaggt

SEQ ID NO: 341516 - DNA, 14 bp, Homo sapiens
cctgcaggctggct

SEQ ID NO: 341517 - DNA, 17 bp, Homo sapiens
cctgcaggctggctgtt

SEQ ID NO: 341518 - DNA, 18 bp, Homo sapiens
cctgcagtactttacctc

SEQ ID NO: 341519 - DNA, 14 bp, Homo sapiens
cctgcagtgtgaga

SEQ ID NO: 341520 - DNA, 20 bp, Homo sapiens
cctgcagtgttcgcttggct

SEQ ID NO: 341521 - DNA, 21 bp, Homo sapiens
cctgcatcagcctctggccag

SEQ ID NO: 341522 - DNA, 19 bp, Homo sapiens
cctgcatcatgacaaagtt

SEQ ID NO: 341523 - DNA, 13 bp, Homo sapiens
cctgcatccctcc

SEQ ID NO: 341524 - DNA, 14 bp, Homo sapiens
cctgcatccctcca

SEQ ID NO: 341525 - DNA, 15 bp, Homo sapiens
cctgcatccctccac

SEQ ID NO: 341526 - DNA, 19 bp, Homo sapiens
cctgcatccctccacccca

SEQ ID NO: 341527 - DNA, 22 bp, Homo sapiens
cctgcatcccttggcccctctc

SEQ ID NO: 341528 - DNA, 18 bp, Homo sapiens
cctgcatgcaactaattc

SEQ ID NO: 341529 - DNA, 23 bp, Homo sapiens
cctgcatgcagcaacacccaagt

SEQ ID NO: 341530 - DNA, 21 bp, Homo sapiens
cctgccaactccatgaccagg

SEQ ID NO: 341531 - DNA, 23 bp, Homo sapiens
cctgccaactccatgaccaggcc

SEQ ID NO: 341532 - DNA, 16 bp, Homo sapiens
cctgccaactttccag

SEQ ID NO: 341533 - DNA, 18 bp, Homo sapiens
cctgccaagcctggagcc

SEQ ID NO: 341534 - DNA, 22 bp, Homo sapiens
cctgccaagtggtttctatgag

SEQ ID NO: 341535 - DNA, 22 bp, Homo sapiens
cctgccaatgccacagccaagc

SEQ ID NO: 341536 - DNA, 19 bp, Homo sapiens
cctgccacaatgtgatatg

SEQ ID NO: 341537 - DNA, 18 bp, Homo sapiens
cctgccaccgtcacacag

SEQ ID NO: 341538 - DNA, 14 bp, Homo sapiens
cctgccacctccct

SEQ ID NO: 341539 - DNA, 13 bp, Homo sapiens
cctgccacctggg

SEQ ID NO: 341540 - DNA, 13 bp, Homo sapiens
cctgccagctgcc

SEQ ID NO: 341541 - DNA, 12 bp, Homo sapiens
cctgccaggagc

SEQ ID NO: 341542 - DNA, 19 bp, Homo sapiens
cctgccaggctcctctccc

SEQ ID NO: 341543 - DNA, 13 bp, Homo sapiens
cctgccaggctct

SEQ ID NO: 341544 - DNA, 13 bp, Homo sapiens
cctgccagggccc

SEQ ID NO: 341545 - DNA, 19 bp, Homo sapiens
cctgccagttgaaaatgga

SEQ ID NO: 341546 - DNA, 16 bp, Homo sapiens
cctgccatcatgcctg

SEQ ID NO: 341547 - DNA, 13 bp, Homo sapiens
cctgcccaatgct

SEQ ID NO: 341548 - DNA, 12 bp, Homo sapiens
cctgcccaggca

SEQ ID NO: 341549 - DNA, 16 bp, Homo sapiens
cctgcccaggccggcc

SEQ ID NO: 341550 - DNA, 22 bp, Homo sapiens
cctgcccaggccggccagcctc

SEQ ID NO: 341551 - DNA, 17 bp, Homo sapiens
cctgccccacacaggcc

SEQ ID NO: 341552 - DNA, 19 bp, Homo sapiens
cctgccccacacaggcctg

SEQ ID NO: 341553 - DNA, 13 bp, Homo sapiens
cctgccccagaga

SEQ ID NO: 341554 - DNA, 15 bp, Homo sapiens
cctgccccagagaag

SEQ ID NO: 341555 - DNA, 16 bp, Homo sapiens
cctgccccagagaagc

SEQ ID NO: 341556 - DNA, 14 bp, Homo sapiens
cctgccccagctgg

SEQ ID NO: 341557 - DNA, 14 bp, Homo sapiens
cctgccccaggcct

SEQ ID NO: 341558 - DNA, 17 bp, Homo sapiens
cctgccccagggctccc

SEQ ID NO: 341559 - DNA, 14 bp, Homo sapiens
cctgcccccatctc

SEQ ID NO: 341560 - DNA, 17 bp, Homo sapiens
cctgcccccgccctgct

SEQ ID NO: 341561 - DNA, 16 bp, Homo sapiens
cctgccccctgccagt

SEQ ID NO: 341562 - DNA, 18 bp, Homo sapiens
cctgccccctgccagtga

SEQ ID NO: 341563 - DNA, 16 bp, Homo sapiens
cctgcccccttctccc

SEQ ID NO: 341564 - DNA, 17 bp, Homo sapiens
cctgcccccttctccca

SEQ ID NO: 341565 - DNA, 19 bp, Homo sapiens
cctgcccccttctcccaca

SEQ ID NO: 341566 - DNA, 23 bp, Homo sapiens
cctgcccccttctcccacactgc

SEQ ID NO: 341567 - DNA, 23 bp, Homo sapiens
cctgccccgtcggactgccccca

SEQ ID NO: 341568 - DNA, 15 bp, Homo sapiens
cctgcccctcccttc

SEQ ID NO: 341569 - DNA, 15 bp, Homo sapiens
cctgcccctgcccga

SEQ ID NO: 341570 - DNA, 16 bp, Homo sapiens
cctgcccctgcccgag

SEQ ID NO: 341571 - DNA, 17 bp, Homo sapiens
cctgcccgcacagcagc

SEQ ID NO: 341572 - DNA, 22 bp, Homo sapiens
cctgcccgcacagcagcctgct

SEQ ID NO: 341573 - DNA, 16 bp, Homo sapiens
cctgcccggccggaga

SEQ ID NO: 341574 - DNA, 16 bp, Homo sapiens
cctgcccgttgccggg

SEQ ID NO: 341575 - DNA, 14 bp, Homo sapiens
cctgccctccccag

SEQ ID NO: 341576 - DNA, 19 bp, Homo sapiens
cctgccctccccagagcac

SEQ ID NO: 341577 - DNA, 22 bp, Homo sapiens
cctgccctccccagagcactgg

SEQ ID NO: 341578 - DNA, 19 bp, Homo sapiens
cctgccctcccccacggcc

SEQ ID NO: 341579 - DNA, 13 bp, Homo sapiens
cctgccctgagga

SEQ ID NO: 341580 - DNA, 13 bp, Homo sapiens
cctgccctgcacc

SEQ ID NO: 341581 - DNA, 12 bp, Homo sapiens
cctgccctgcca

SEQ ID NO: 341582 - DNA, 18 bp, Homo sapiens
cctgccctgccacctgtc

SEQ ID NO: 341583 - DNA, 15 bp, Homo sapiens
cctgccctggtccag

SEQ ID NO: 341584 - DNA, 21 bp, Homo sapiens
cctgccctgtacctctctctg

SEQ ID NO: 341585 - DNA, 15 bp, Homo sapiens
cctgccctgtccctg

SEQ ID NO: 341586 - DNA, 16 bp, Homo sapiens
cctgccctgtccctgt

SEQ ID NO: 341587 - DNA, 17 bp, Homo sapiens
cctgccctgtccctgtc

SEQ ID NO: 341588 - DNA, 17 bp, Homo sapiens
cctgcccttcagcatcc

SEQ ID NO: 341589 - DNA, 16 bp, Homo sapiens
cctgccgacacgctcc

SEQ ID NO: 341590 - DNA, 13 bp, Homo sapiens
cctgccgcctgtg

SEQ ID NO: 341591 - DNA, 14 bp, Homo sapiens
cctgccgcctgtgc

SEQ ID NO: 341592 - DNA, 22 bp, Homo sapiens
cctgccggccttggccttgggg

SEQ ID NO: 341593 - DNA, 23 bp, Homo sapiens
cctgccgggcaggtcccaggttg

SEQ ID NO: 341594 - DNA, 15 bp, Homo sapiens
cctgccgtgcatggc

SEQ ID NO: 341595 - DNA, 18 bp, Homo sapiens
cctgccgtgcatggctcc

SEQ ID NO: 341596 - DNA, 20 bp, Homo sapiens
cctgccgtgcatggctcctg

SEQ ID NO: 341597 - DNA, 20 bp, Homo sapiens
cctgcctagcactcacatgc

SEQ ID NO: 341598 - DNA, 18 bp, Homo sapiens
cctgcctaggagctgggg

SEQ ID NO: 341599 - DNA, 20 bp, Homo sapiens
cctgcctaggagctggggag

SEQ ID NO: 341600 - DNA, 16 bp, Homo sapiens
cctgcctatccatcct

SEQ ID NO: 341601 - DNA, 17 bp, Homo sapiens
cctgcctatccatcctg

SEQ ID NO: 341602 - DNA, 18 bp, Homo sapiens
cctgcctatccatcctgc

SEQ ID NO: 341603 - DNA, 13 bp, Homo sapiens
cctgcctcacatc

SEQ ID NO: 341604 - DNA, 17 bp, Homo sapiens
cctgcctcacatctccc

SEQ ID NO: 341605 - DNA, 21 bp, Homo sapiens
cctgcctccaccgagccagct

SEQ ID NO: 341606 - DNA, 12 bp, Homo sapiens
cctgcctccctt

SEQ ID NO: 341607 - DNA, 18 bp, Homo sapiens
cctgcctccctttctggg

SEQ ID NO: 341608 - DNA, 13 bp, Homo sapiens
cctgcctccggcc

SEQ ID NO: 341609 - DNA, 15 bp, Homo sapiens
cctgcctccggccct

SEQ ID NO: 341610 - DNA, 12 bp, Homo sapiens
cctgcctcctgc

SEQ ID NO: 341611 - DNA, 14 bp, Homo sapiens
cctgcctctcagag

SEQ ID NO: 341612 - DNA, 13 bp, Homo sapiens
cctgcctctcccc

SEQ ID NO: 341613 - DNA, 21 bp, Homo sapiens
cctgcctgaccatcccatgag

SEQ ID NO: 341614 - DNA, 13 bp, Homo sapiens
cctgcctgagccc

SEQ ID NO: 341615 - DNA, 19 bp, Homo sapiens
cctgcctgagcccaggagc

SEQ ID NO: 341616 - DNA, 18 bp, Homo sapiens
cctgcctgagggcccctc

SEQ ID NO: 341617 - DNA, 19 bp, Homo sapiens
cctgcctgagggcccctct

SEQ ID NO: 341618 - DNA, 21 bp, Homo sapiens
cctgcctgagggcccctctgc

SEQ ID NO: 341619 - DNA, 22 bp, Homo sapiens
cctgcctgagggcccctctgcc

SEQ ID NO: 341620 - DNA, 17 bp, Homo sapiens
cctgcctgcgaaaccca

SEQ ID NO: 341621 - DNA, 11 bp, Homo sapiens
cctgcctggcc

SEQ ID NO: 341622 - DNA, 18 bp, Homo sapiens
cctgcctggccaggcaga

SEQ ID NO: 341623 - DNA, 12 bp, Homo sapiens
cctgcctgtctg

SEQ ID NO: 341624 - DNA, 22 bp, Homo sapiens
cctgcctgttcccattcttgca

SEQ ID NO: 341625 - DNA, 20 bp, Homo sapiens
cctgccttctcttctatcct

SEQ ID NO: 341626 - DNA, 22 bp, Homo sapiens
cctgccttggggaaggtctccc

SEQ ID NO: 341627 - DNA, 12 bp, Homo sapiens
cctgcctttgtt

SEQ ID NO: 341628 - DNA, 13 bp, Homo sapiens
cctgcctttgttt

SEQ ID NO: 341629 - DNA, 11 bp, Homo sapiens
cctgcctttta

SEQ ID NO: 341630 - DNA, 15 bp, Homo sapiens
cctgcgcaggccctc

SEQ ID NO: 341631 - DNA, 14 bp, Homo sapiens
cctgcgccctccct

SEQ ID NO: 341632 - DNA, 22 bp, Homo sapiens
cctgcgccctccctccctccac

SEQ ID NO: 341633 - DNA, 23 bp, Homo sapiens
cctgcgccctccctccctccaca

SEQ ID NO: 341634 - DNA, 16 bp, Homo sapiens
cctgcgctcctctgca

SEQ ID NO: 341635 - DNA, 21 bp, Homo sapiens
cctgcgctcctctgcagcctg

SEQ ID NO: 341636 - DNA, 14 bp, Homo sapiens
cctgcggctgctgg

SEQ ID NO: 341637 - DNA, 21 bp, Homo sapiens
cctgcgtcctgacgccctgcg

SEQ ID NO: 341638 - DNA, 19 bp, Homo sapiens
cctgcgtggcctggggctg

SEQ ID NO: 341639 - DNA, 23 bp, Homo sapiens
cctgcgtggcctggggctgccgt

SEQ ID NO: 341640 - DNA, 12 bp, Homo sapiens
cctgcgtggggg

SEQ ID NO: 341641 - DNA, 15 bp, Homo sapiens
cctgcgttggagcca

SEQ ID NO: 341642 - DNA, 16 bp, Homo sapiens
cctgcgttggagccac

SEQ ID NO: 341643 - DNA, 18 bp, Homo sapiens
cctgcgttggagccactc

SEQ ID NO: 341644 - DNA, 21 bp, Homo sapiens
cctgcgttggagccactcctg

SEQ ID NO: 341645 - DNA, 20 bp, Homo sapiens
cctgctactccactgacctg

SEQ ID NO: 341646 - DNA, 23 bp, Homo sapiens
cctgctactccactgacctggaa

SEQ ID NO: 341647 - DNA, 17 bp, Homo sapiens
cctgctagctgtagaaa

SEQ ID NO: 341648 - DNA, 14 bp, Homo sapiens
cctgctatccagcc

SEQ ID NO: 341649 - DNA, 17 bp, Homo sapiens
cctgctatccagccgca

SEQ ID NO: 341650 - DNA, 21 bp, Homo sapiens
cctgctcaactctacccctgc

SEQ ID NO: 341651 - DNA, 22 bp, Homo sapiens
cctgctcaactctacccctgct

SEQ ID NO: 341652 - DNA, 16 bp, Homo sapiens
cctgctcacgtctgtg

SEQ ID NO: 341653 - DNA, 20 bp, Homo sapiens
cctgctcagctggccgggtt

SEQ ID NO: 341654 - DNA, 15 bp, Homo sapiens
cctgctcaggcctca

SEQ ID NO: 341655 - DNA, 22 bp, Homo sapiens
cctgctcaggcctcacctggct

SEQ ID NO: 341656 - DNA, 23 bp, Homo sapiens
cctgctccatgggcacctctgct

SEQ ID NO: 341657 - DNA, 13 bp, Homo sapiens
cctgctcccagcc

SEQ ID NO: 341658 - DNA, 15 bp, Homo sapiens
cctgctcccagcctg

SEQ ID NO: 341659 - DNA, 17 bp, Homo sapiens
cctgctcccagcctgct

SEQ ID NO: 341660 - DNA, 16 bp, Homo sapiens
cctgctccgccaggaa

SEQ ID NO: 341661 - DNA, 13 bp, Homo sapiens
cctgctcctcctg

SEQ ID NO: 341662 - DNA, 19 bp, Homo sapiens
cctgctctacccatgagcc

SEQ ID NO: 341663 - DNA, 22 bp, Homo sapiens
cctgctctacccatgagcctgc

SEQ ID NO: 341664 - DNA, 16 bp, Homo sapiens
cctgctctcctcttgc

SEQ ID NO: 341665 - DNA, 18 bp, Homo sapiens
cctgctctcctcttgcca

SEQ ID NO: 341666 - DNA, 19 bp, Homo sapiens
cctgctctcctcttgccac

SEQ ID NO: 341667 - DNA, 22 bp, Homo sapiens
cctgctctcctcttgccactgc

SEQ ID NO: 341668 - DNA, 21 bp, Homo sapiens
cctgctctccttgccctgggc

SEQ ID NO: 341669 - DNA, 16 bp, Homo sapiens
cctgctctctacccag

SEQ ID NO: 341670 - DNA, 17 bp, Homo sapiens
cctgctctctacccagc

SEQ ID NO: 341671 - DNA, 20 bp, Homo sapiens
cctgctctctacccagccca

SEQ ID NO: 341672 - DNA, 12 bp, Homo sapiens
cctgctctgcag

SEQ ID NO: 341673 - DNA, 15 bp, Homo sapiens
cctgctctgcagccc

SEQ ID NO: 341674 - DNA, 15 bp, Homo sapiens
cgcaagtctgcagcc

SEQ ID NO: 341675 - DNA, 21 bp, Homo sapiens
cgcaatccgagccagctctgg

SEQ ID NO: 341676 - DNA, 21 bp, Homo sapiens
cgcaattgtgggatgtcctct

SEQ ID NO: 341677 - DNA, 13 bp, Homo sapiens
cgcacacacacaa

SEQ ID NO: 341678 - DNA, 20 bp, Homo sapiens
cgcacacacacacacaggag

SEQ ID NO: 341679 - DNA, 22 bp, Homo sapiens
cgcacaccctcactctgccagg

SEQ ID NO: 341680 - DNA, 12 bp, Homo sapiens
cgcacagcagcc

SEQ ID NO: 341681 - DNA, 20 bp, Homo sapiens
cgcacagcagcctgcttccc

SEQ ID NO: 341682 - DNA, 16 bp, Homo sapiens
cgcaccagctgctctg

SEQ ID NO: 341683 - DNA, 20 bp, Homo sapiens
cgcaccagctgctctgcccc

SEQ ID NO: 341684 - DNA, 13 bp, Homo sapiens
cgcacccggcagc

SEQ ID NO: 341685 - DNA, 14 bp, Homo sapiens
cgcaccgcccaacc

SEQ ID NO: 341686 - DNA, 15 bp, Homo sapiens
cgcaccttgctgcag

SEQ ID NO: 341687 - DNA, 13 bp, Homo sapiens
cgcacgcacacac

SEQ ID NO: 341688 - DNA, 15 bp, Homo sapiens
cgcacgcacacacac

SEQ ID NO: 341689 - DNA, 22 bp, Homo sapiens
cgcactacatgtggtttataga

SEQ ID NO: 341690 - DNA, 16 bp, Homo sapiens
cgcactccatgagcac

SEQ ID NO: 341691 - DNA, 17 bp, Homo sapiens
cgcactccatgagcacc

SEQ ID NO: 341692 - DNA, 15 bp, Homo sapiens
cgcagacacacacac

SEQ ID NO: 341693 - DNA, 17 bp, Homo sapiens
cgcagagccccggagca

SEQ ID NO: 341694 - DNA, 12 bp, Homo sapiens
cgcagcaccagc

SEQ ID NO: 341695 - DNA, 22 bp, Homo sapiens
cgcagcaccagcctgagccaca

SEQ ID NO: 341696 - DNA, 20 bp, Homo sapiens
cgcagcagctgggacccctc

SEQ ID NO: 341697 - DNA, 15 bp, Homo sapiens
cgcagccaggacacc

SEQ ID NO: 341698 - DNA, 21 bp, Homo sapiens
cgcagcccgtgaagcagtgcc

SEQ ID NO: 341699 - DNA, 23 bp, Homo sapiens
cgcagccctagtgggagcccagc

SEQ ID NO: 341700 - DNA, 13 bp, Homo sapiens
cgcagccctgctt

SEQ ID NO: 341701 - DNA, 17 bp, Homo sapiens
cgcagccgcgctctgcc

SEQ ID NO: 341702 - DNA, 19 bp, Homo sapiens
cgcagccgcgctctgcccc

SEQ ID NO: 341703 - DNA, 12 bp, Homo sapiens
cgcagcctccag

SEQ ID NO: 341704 - DNA, 15 bp, Homo sapiens
cgcaggagagagaga

SEQ ID NO: 341705 - DNA, 23 bp, Homo sapiens
cgcaggagtctctgccacccact

SEQ ID NO: 341706 - DNA, 20 bp, Homo sapiens
cgcaggatccgctgccacca

SEQ ID NO: 341707 - DNA, 20 bp, Homo sapiens
cgcaggccctccgcggggga

SEQ ID NO: 341708 - DNA, 16 bp, Homo sapiens
cgcaggccctggtgga

SEQ ID NO: 341709 - DNA, 19 bp, Homo sapiens
cgcaggccctggtggagag

SEQ ID NO: 341710 - DNA, 21 bp, Homo sapiens
cgcaggctatttgttcagaga

SEQ ID NO: 341711 - DNA, 15 bp, Homo sapiens
cgcagggagaccctg

SEQ ID NO: 341712 - DNA, 16 bp, Homo sapiens
cgcagggagaccctgg

SEQ ID NO: 341713 - DNA, 21 bp, Homo sapiens
cgcagggcgctccggcagagg

SEQ ID NO: 341714 - DNA, 23 bp, Homo sapiens
cgcagggcgctccggcagaggca

SEQ ID NO: 341715 - DNA, 14 bp, Homo sapiens
cgcaggttaccttg

SEQ ID NO: 341716 - DNA, 19 bp, Homo sapiens
cgcaggttatgtcagcagc

SEQ ID NO: 341717 - DNA, 12 bp, Homo sapiens
cgcagtccccag

SEQ ID NO: 341718 - DNA, 13 bp, Homo sapiens
cgcagtccccagc

SEQ ID NO: 341719 - DNA, 16 bp, Homo sapiens
cgcagtccccagccct

SEQ ID NO: 341720 - DNA, 23 bp, Homo sapiens
cgcagtcgcaggatccgctgcca

SEQ ID NO: 341721 - DNA, 20 bp, Homo sapiens
cgcagtgcccagtgatggca

SEQ ID NO: 341722 - DNA, 16 bp, Homo sapiens
cgcagtggactgtgtc

SEQ ID NO: 341723 - DNA, 13 bp, Homo sapiens
cgcatatgcatgc

SEQ ID NO: 341724 - DNA, 14 bp, Homo sapiens
cgcatatgcatgcc

SEQ ID NO: 341725 - DNA, 19 bp, Homo sapiens
cgcatccgcctctgagcca

SEQ ID NO: 341726 - DNA, 13 bp, Homo sapiens
cgcatgcagcagc

SEQ ID NO: 341727 - DNA, 21 bp, Homo sapiens
cgcatgctgcctgcctccggc

SEQ ID NO: 341728 - DNA, 23 bp, Homo sapiens
cgcatgctgcctgcctccggccc

SEQ ID NO: 341729 - DNA, 18 bp, Homo sapiens
cgcatggagtgtgtattg

SEQ ID NO: 341730 - DNA, 14 bp, Homo sapiens
cgcatgtgtctgta

SEQ ID NO: 341731 - DNA, 20 bp, Homo sapiens
cgcatgtgtctgtattcata

SEQ ID NO: 341732 - DNA, 23 bp, Homo sapiens
cgccaaacttctgaactttggaa

SEQ ID NO: 341733 - DNA, 23 bp, Homo sapiens
cgccaagccatcacaggctctgc

SEQ ID NO: 341734 - DNA, 14 bp, Homo sapiens
cgccacagcccagc

SEQ ID NO: 341735 - DNA, 21 bp, Homo sapiens
cgccacagcccagccacggac

SEQ ID NO: 341736 - DNA, 23 bp, Homo sapiens
cgccacatccccgctggctgggg

SEQ ID NO: 341737 - DNA, 19 bp, Homo sapiens
cgccacctgtgtgttcttt

SEQ ID NO: 341738 - DNA, 20 bp, Homo sapiens
cgccaccttgtacagaacca

SEQ ID NO: 341739 - DNA, 14 bp, Homo sapiens
cgccacggccaccc

SEQ ID NO: 341740 - DNA, 16 bp, Homo sapiens
cgccacggccaccctc

SEQ ID NO: 341741 - DNA, 19 bp, Homo sapiens
cgccactaggtgtccccaa

SEQ ID NO: 341742 - DNA, 18 bp, Homo sapiens
cgccatgcaactccatgc

SEQ ID NO: 341743 - DNA, 19 bp, Homo sapiens
cgccatgcaactccatgcc

SEQ ID NO: 341744 - DNA, 19 bp, Homo sapiens
cgccattctcctgcctcag

SEQ ID NO: 341745 - DNA, 17 bp, Homo sapiens
cgccattgccaccagga

SEQ ID NO: 341746 - DNA, 18 bp, Homo sapiens
cgccattgccaccaggag

SEQ ID NO: 341747 - DNA, 19 bp, Homo sapiens
cgcccaacccccacctccc

SEQ ID NO: 341748 - DNA, 14 bp, Homo sapiens
cgcccaccagacct

SEQ ID NO: 341749 - DNA, 13 bp, Homo sapiens
cgcccacccacac

SEQ ID NO: 341750 - DNA, 17 bp, Homo sapiens
cgcccaccccgctgcct

SEQ ID NO: 341751 - DNA, 19 bp, Homo sapiens
cgcccaccccgctgcctgg

SEQ ID NO: 341752 - DNA, 13 bp, Homo sapiens
cgcccacctctgc

SEQ ID NO: 341753 - DNA, 18 bp, Homo sapiens
cgcccacctctgctgccc

SEQ ID NO: 341754 - DNA, 16 bp, Homo sapiens
cgcccacctgcatcag

SEQ ID NO: 341755 - DNA, 21 bp, Homo sapiens
actggagtgaggcttccaggc

SEQ ID NO: 341756 - DNA, 22 bp, Homo sapiens
actggagtgaggcttccaggct

SEQ ID NO: 341757 - DNA, 21 bp, Homo sapiens
actggagtggtaacaagagga

SEQ ID NO: 341758 - DNA, 16 bp, Homo sapiens
actggagttacattaa

SEQ ID NO: 341759 - DNA, 18 bp, Homo sapiens
actggatactgcccgggg

SEQ ID NO: 341760 - DNA, 14 bp, Homo sapiens
actggcagcatctt

SEQ ID NO: 341761 - DNA, 14 bp, Homo sapiens
actggcagccaggg

SEQ ID NO: 341762 - DNA, 14 bp, Homo sapiens
actggcaggtgcag

SEQ ID NO: 341763 - DNA, 22 bp, Homo sapiens
actggcaggtgcagatgggctg

SEQ ID NO: 341764 - DNA, 23 bp, Homo sapiens
actggcaggtgcagatgggctgt

SEQ ID NO: 341765 - DNA, 12 bp, Homo sapiens
actggcagtgca

SEQ ID NO: 341766 - DNA, 20 bp, Homo sapiens
actggcatctgacacaaaaa

SEQ ID NO: 341767 - DNA, 21 bp, Homo sapiens
actggcatctgacacaaaaaa

SEQ ID NO: 341768 - DNA, 17 bp, Homo sapiens
actggcattgtccctgt

SEQ ID NO: 341769 - DNA, 13 bp, Homo sapiens
actggccagagag

SEQ ID NO: 341770 - DNA, 22 bp, Homo sapiens
actggccagagagggcccagct

SEQ ID NO: 341771 - DNA, 23 bp, Homo sapiens
actggccagagagggcccagctg

SEQ ID NO: 341772 - DNA, 17 bp, Homo sapiens
actggccagaggcagct

SEQ ID NO: 341773 - DNA, 15 bp, Homo sapiens
actggccagctctgg

SEQ ID NO: 341774 - DNA, 12 bp, Homo sapiens
actggccccacc

SEQ ID NO: 341775 - DNA, 13 bp, Homo sapiens
actggccccaccc

SEQ ID NO: 341776 - DNA, 16 bp, Homo sapiens
actggccccaggcgga

SEQ ID NO: 341777 - DNA, 15 bp, Homo sapiens
actggcgcctccgag

SEQ ID NO: 341778 - DNA, 18 bp, Homo sapiens
actggctgcacagcccaa

SEQ ID NO: 341779 - DNA, 14 bp, Homo sapiens
actggctggggcag

SEQ ID NO: 341780 - DNA, 15 bp, Homo sapiens
actggctggggcaga

SEQ ID NO: 341781 - DNA, 16 bp, Homo sapiens
actggctgtcctttcc

SEQ ID NO: 341782 - DNA, 22 bp, Homo sapiens
actggctgtctgcctgtatttt

SEQ ID NO: 341783 - DNA, 16 bp, Homo sapiens
actggctgtgcctccc

SEQ ID NO: 341784 - DNA, 19 bp, Homo sapiens
actggctgtgcctcccccg

SEQ ID NO: 341785 - DNA, 16 bp, Homo sapiens
actggctttgtcccac

SEQ ID NO: 341786 - DNA, 20 bp, Homo sapiens
actggctttgtcccacagct

SEQ ID NO: 341787 - DNA, 14 bp, Homo sapiens
actggctttttccc

SEQ ID NO: 341788 - DNA, 17 bp, Homo sapiens
actggctttttcccagc

SEQ ID NO: 341789 - DNA, 22 bp, Homo sapiens
actgggaagataggctctgcac

SEQ ID NO: 341790 - DNA, 23 bp, Homo sapiens
actgggaagataggctctgcaca

SEQ ID NO: 341791 - DNA, 15 bp, Homo sapiens
actgggaagatgctg

SEQ ID NO: 341792 - DNA, 13 bp, Homo sapiens
actgggaagctgg

SEQ ID NO: 341793 - DNA, 22 bp, Homo sapiens
actgggaagctggagtgctgct

SEQ ID NO: 341794 - DNA, 20 bp, Homo sapiens
actgggagccacttctcccc

SEQ ID NO: 341795 - DNA, 19 bp, Homo sapiens
actgggagtcagagccctg

SEQ ID NO: 341796 - DNA, 15 bp, Homo sapiens
actgggatcgcacct

SEQ ID NO: 341797 - DNA, 22 bp, Homo sapiens
actgggatgggaacactggtgg

SEQ ID NO: 341798 - DNA, 17 bp, Homo sapiens
actgggccggcagcctg

SEQ ID NO: 341799 - DNA, 19 bp, Homo sapiens
actgggccggcagcctggt

SEQ ID NO: 341800 - DNA, 17 bp, Homo sapiens
actgggccttgtgtgct

SEQ ID NO: 341801 - DNA, 22 bp, Homo sapiens
actgggccttgtgtgctggctt

SEQ ID NO: 341802 - DNA, 17 bp, Homo sapiens
actggggattgggtggg

SEQ ID NO: 341803 - DNA, 20 bp, Homo sapiens
actggggctggggtgagaga

SEQ ID NO: 341804 - DNA, 14 bp, Homo sapiens
actgggggcctctg

SEQ ID NO: 341805 - DNA, 19 bp, Homo sapiens
actggggttcacgtcactg

SEQ ID NO: 341806 - DNA, 18 bp, Homo sapiens
actgggtggggtgaggac

SEQ ID NO: 341807 - DNA, 17 bp, Homo sapiens
actgggttaatggctag

SEQ ID NO: 341808 - DNA, 14 bp, Homo sapiens
actgggttcaaaaa

SEQ ID NO: 341809 - DNA, 15 bp, Homo sapiens
actgggttcaaaaag

SEQ ID NO: 341810 - DNA, 19 bp, Homo sapiens
actgggttcaaaaagaaaa

SEQ ID NO: 341811 - DNA, 21 bp, Homo sapiens
actggtccaggccaggcctca

SEQ ID NO: 341812 - DNA, 15 bp, Homo sapiens
actggtctcagagga

SEQ ID NO: 341813 - DNA, 20 bp, Homo sapiens
actggtgcatttaaaatgga

SEQ ID NO: 341814 - DNA, 20 bp, Homo sapiens
actggtggcccgacagcctg

SEQ ID NO: 341815 - DNA, 19 bp, Homo sapiens
actggttatagttgatatg

SEQ ID NO: 341816 - DNA, 23 bp, Homo sapiens
actggttccttaagtggctgtga

SEQ ID NO: 341817 - DNA, 21 bp, Homo sapiens
actggttcttgccttcccctt

SEQ ID NO: 341818 - DNA, 18 bp, Homo sapiens
actggtttcagttgacaa

SEQ ID NO: 341819 - DNA, 23 bp, Homo sapiens
actggtttttctgttccctgctg

SEQ ID NO: 341820 - DNA, 12 bp, Homo sapiens
actgtaaataca

SEQ ID NO: 341821 - DNA, 17 bp, Homo sapiens
actgtaaatacaaaata

SEQ ID NO: 341822 - DNA, 12 bp, Homo sapiens
actgtaagatgt

SEQ ID NO: 341823 - DNA, 13 bp, Homo sapiens
actgtaagatgtt

SEQ ID NO: 341824 - DNA, 16 bp, Homo sapiens
actgtaatatctttaa

SEQ ID NO: 341825 - DNA, 15 bp, Homo sapiens
actgtaatcttaaaa

SEQ ID NO: 341826 - DNA, 12 bp, Homo sapiens
actgtacctgta

SEQ ID NO: 341827 - DNA, 18 bp, Homo sapiens
actgtacctgtaggaaac

SEQ ID NO: 341828 - DNA, 17 bp, Homo sapiens
actgtactccagcctgg

SEQ ID NO: 341829 - DNA, 14 bp, Homo sapiens
actgtactgaggaa

SEQ ID NO: 341830 - DNA, 23 bp, Homo sapiens
actgtactggccagtgtcatttt

SEQ ID NO: 341831 - DNA, 15 bp, Homo sapiens
actgtagaaatgatg

SEQ ID NO: 341832 - DNA, 20 bp, Homo sapiens
actgtagattgcttctgtag

SEQ ID NO: 341833 - DNA, 21 bp, Homo sapiens
actgtagcctgcgtcatggct

SEQ ID NO: 341834 - DNA, 18 bp, Homo sapiens
actgtaggcgcccctggg

SEQ ID NO: 341835 - DNA, 20 bp, Homo sapiens
actgtataggtagatccaga

SEQ ID NO: 341836 - DNA, 21 bp, Homo sapiens
actgtataggtagatccagat

SEQ ID NO: 341837 - DNA, 16 bp, Homo sapiens
actgtatcaaatctgt

SEQ ID NO: 341838 - DNA, 11 bp, Homo sapiens
actgtatcctt

SEQ ID NO: 341839 - DNA, 15 bp, Homo sapiens
actgtatgtcttata

SEQ ID NO: 341840 - DNA, 11 bp, Homo sapiens
actgtatttct

SEQ ID NO: 341841 - DNA, 23 bp, Homo sapiens
actgtcaaaaagtttggttctgt

SEQ ID NO: 341842 - DNA, 12 bp, Homo sapiens
actgtcaataaa

SEQ ID NO: 341843 - DNA, 15 bp, Homo sapiens
actgtcaataaacag

SEQ ID NO: 341844 - DNA, 21 bp, Homo sapiens
actgtcaataaacagcttcat

SEQ ID NO: 341845 - DNA, 18 bp, Homo sapiens
actgtcactttgctctgg

SEQ ID NO: 341846 - DNA, 18 bp, Homo sapiens
actgtcagagaatatgac

SEQ ID NO: 341847 - DNA, 18 bp, Homo sapiens
actgtcagtgtcctcagg

SEQ ID NO: 341848 - DNA, 15 bp, Homo sapiens
actgtcatataatgc

SEQ ID NO: 341849 - DNA, 19 bp, Homo sapiens
actgtccccctacccaccg

SEQ ID NO: 341850 - DNA, 16 bp, Homo sapiens
actgtcccgacacagc

SEQ ID NO: 341851 - DNA, 21 bp, Homo sapiens
actgtccctaccactgagccc

SEQ ID NO: 341852 - DNA, 22 bp, Homo sapiens
actgtccctaccactgagccct

SEQ ID NO: 341853 - DNA, 16 bp, Homo sapiens
actgtcccttgcctca

SEQ ID NO: 341854 - DNA, 15 bp, Homo sapiens
actgtccgcctctgc

SEQ ID NO: 341855 - DNA, 18 bp, Homo sapiens
actgtcctctttcagaaa

SEQ ID NO: 341856 - DNA, 22 bp, Homo sapiens
actgtcctgggcgccctggaag

SEQ ID NO: 341857 - DNA, 20 bp, Homo sapiens
actgtcctttctccaggccc

SEQ ID NO: 341858 - DNA, 21 bp, Homo sapiens
actgtcctttctccaggccct

SEQ ID NO: 341859 - DNA, 19 bp, Homo sapiens
tggaacagcgggagacctg

SEQ ID NO: 341860 - DNA, 13 bp, Homo sapiens
tggaacaggagga

SEQ ID NO: 341861 - DNA, 14 bp, Homo sapiens
tggaacaggaggaa

SEQ ID NO: 341862 - DNA, 18 bp, Homo sapiens
tggaacaggaggaactgg

SEQ ID NO: 341863 - DNA, 15 bp, Homo sapiens
tggaaccagagccac

SEQ ID NO: 341864 - DNA, 19 bp, Homo sapiens
tggaaccagcaagtcccag

SEQ ID NO: 341865 - DNA, 17 bp, Homo sapiens
tggaaccagggaggaga

SEQ ID NO: 341866 - DNA, 19 bp, Homo sapiens
tggaacccttttggccccc

SEQ ID NO: 341867 - DNA, 12 bp, Homo sapiens
tggaacctccct

SEQ ID NO: 341868 - DNA, 21 bp, Homo sapiens
tggaactctatctgggcctgg

SEQ ID NO: 341869 - DNA, 23 bp, Homo sapiens
tggaactctatctgggcctgggc

SEQ ID NO: 341870 - DNA, 21 bp, Homo sapiens
tggaactctcctgctcctcag

SEQ ID NO: 341871 - DNA, 22 bp, Homo sapiens
tggaactgaccccctcccctga

SEQ ID NO: 341872 - DNA, 14 bp, Homo sapiens
tggaactgctgcca

SEQ ID NO: 341873 - DNA, 18 bp, Homo sapiens
tggaagaacatcaagata

SEQ ID NO: 341874 - DNA, 13 bp, Homo sapiens
tggaagaccccac

SEQ ID NO: 341875 - DNA, 12 bp, Homo sapiens
tggaagagaggc

SEQ ID NO: 341876 - DNA, 15 bp, Homo sapiens
tggaagagaggcacc

SEQ ID NO: 341877 - DNA, 14 bp, Homo sapiens
tggaagagcagcct

SEQ ID NO: 341878 - DNA, 18 bp, Homo sapiens
tggaagagcagcctgatg

SEQ ID NO: 341879 - DNA, 13 bp, Homo sapiens
tggaagagctggg

SEQ ID NO: 341880 - DNA, 23 bp, Homo sapiens
tggaagagggagggtcagtgcca

SEQ ID NO: 341881 - DNA, 21 bp, Homo sapiens
tggaagaggttctcagcaagt

SEQ ID NO: 341882 - DNA, 14 bp, Homo sapiens
tggaagctggcagg

SEQ ID NO: 341883 - DNA, 12 bp, Homo sapiens
tggaaggagaga

SEQ ID NO: 341884 - DNA, 15 bp, Homo sapiens
tggaaggagagaggt

SEQ ID NO: 341885 - DNA, 14 bp, Homo sapiens
tggaaggagcctgc

SEQ ID NO: 341886 - DNA, 15 bp, Homo sapiens
tggaaggagcctgcg

SEQ ID NO: 341887 - DNA, 14 bp, Homo sapiens
tggaaggcacccgc

SEQ ID NO: 341888 - DNA, 13 bp, Homo sapiens
tggaaggctggct

SEQ ID NO: 341889 - DNA, 14 bp, Homo sapiens
tggaaggctttgcc

SEQ ID NO: 341890 - DNA, 16 bp, Homo sapiens
tggaaggttcaggggc

SEQ ID NO: 341891 - DNA, 17 bp, Homo sapiens
tggaagtatttgagaga

SEQ ID NO: 341892 - DNA, 14 bp, Homo sapiens
tggaagtctgcgcc

SEQ ID NO: 341893 - DNA, 16 bp, Homo sapiens
tggaagtctgcgccct

SEQ ID NO: 341894 - DNA, 17 bp, Homo sapiens
tggaagtggcagtgaaa

SEQ ID NO: 341895 - DNA, 19 bp, Homo sapiens
tggaagtttgtgttctgtt

SEQ ID NO: 341896 - DNA, 18 bp, Homo sapiens
tggaatataaggaaagca

SEQ ID NO: 341897 - DNA, 21 bp, Homo sapiens
tggaatataaggaaagcaata

SEQ ID NO: 341898 - DNA, 17 bp, Homo sapiens
tggaatcagcttttaat

SEQ ID NO: 341899 - DNA, 16 bp, Homo sapiens
tggaatccagaaggaa

SEQ ID NO: 341900 - DNA, 18 bp, Homo sapiens
tggaatccagaaggaagc

SEQ ID NO: 341901 - DNA, 14 bp, Homo sapiens
tggaatgaagcatg

SEQ ID NO: 341902 - DNA, 15 bp, Homo sapiens
tggaatgaagcatgt

SEQ ID NO: 341903 - DNA, 22 bp, Homo sapiens
tggaatgactataaacattaaa

SEQ ID NO: 341904 - DNA, 18 bp, Homo sapiens
tggaatgcagggaagagg

SEQ ID NO: 341905 - DNA, 22 bp, Homo sapiens
tggaatgcatatcgctgggctc

SEQ ID NO: 341906 - DNA, 16 bp, Homo sapiens
tggaatgctgtgttaa

SEQ ID NO: 341907 - DNA, 14 bp, Homo sapiens
tggaatgtaatcaa

SEQ ID NO: 341908 - DNA, 17 bp, Homo sapiens
tggaattaaaacaatgt

SEQ ID NO: 341909 - DNA, 18 bp, Homo sapiens
tggaattacataacaggc

SEQ ID NO: 341910 - DNA, 20 bp, Homo sapiens
tggaattacataacaggcat

SEQ ID NO: 341911 - DNA, 21 bp, Homo sapiens
tggaattacataacaggcatt

SEQ ID NO: 341912 - DNA, 21 bp, Homo sapiens
tggaattccttggagccactg

SEQ ID NO: 341913 - DNA, 14 bp, Homo sapiens
tggaattggtgtat

SEQ ID NO: 341914 - DNA, 16 bp, Homo sapiens
tggaatttgtaacctc

SEQ ID NO: 341915 - DNA, 19 bp, Homo sapiens
tggaatttgtaacctcagc

SEQ ID NO: 341916 - DNA, 16 bp, Homo sapiens
tggaatttgtaagttt

SEQ ID NO: 341917 - DNA, 18 bp, Homo sapiens
tggaattttctaatataa

SEQ ID NO: 341918 - DNA, 22 bp, Homo sapiens
tggaattttctaatataatgac

SEQ ID NO: 341919 - DNA, 13 bp, Homo sapiens
tggacaagaagct

SEQ ID NO: 341920 - DNA, 17 bp, Homo sapiens
tggacaagccaacttgt

SEQ ID NO: 341921 - DNA, 15 bp, Homo sapiens
tggacacacacagct

SEQ ID NO: 341922 - DNA, 12 bp, Homo sapiens
tggacacactgt

SEQ ID NO: 341923 - DNA, 19 bp, Homo sapiens
tggcacaatctcacacagc

SEQ ID NO: 341924 - DNA, 20 bp, Homo sapiens
tggcacagaaagggcagctt

SEQ ID NO: 341925 - DNA, 16 bp, Homo sapiens
tggcacagggcagtgg

SEQ ID NO: 341926 - DNA, 18 bp, Homo sapiens
tggcacagggcagtggga

SEQ ID NO: 341927 - DNA, 19 bp, Homo sapiens
tggcaccaaagatgcagcc

SEQ ID NO: 341928 - DNA, 21 bp, Homo sapiens
tggcaccccagctaccccttc

SEQ ID NO: 341929 - DNA, 14 bp, Homo sapiens
tggcacctcctgag

SEQ ID NO: 341930 - DNA, 16 bp, Homo sapiens
tggcacctcctgagaa

SEQ ID NO: 341931 - DNA, 21 bp, Homo sapiens
tggcacctgggtgctctggct

SEQ ID NO: 341932 - DNA, 11 bp, Homo sapiens
tggcacctgta

SEQ ID NO: 341933 - DNA, 13 bp, Homo sapiens
tggcacctgtggc

SEQ ID NO: 341934 - DNA, 18 bp, Homo sapiens
tggcacctgtggccagag

SEQ ID NO: 341935 - DNA, 21 bp, Homo sapiens
tggcacctgtggccagagcac

SEQ ID NO: 341936 - DNA, 17 bp, Homo sapiens
tggcacgatctcagctc

SEQ ID NO: 341937 - DNA, 14 bp, Homo sapiens
tggcacgcacctgt

SEQ ID NO: 341938 - DNA, 17 bp, Homo sapiens
tggcacgtcctccaccg

SEQ ID NO: 341939 - DNA, 14 bp, Homo sapiens
tggcacgtgcctgt

SEQ ID NO: 341940 - DNA, 14 bp, Homo sapiens
tggcacttcgtgga

SEQ ID NO: 341941 - DNA, 20 bp, Homo sapiens
tggcactttttcacataagc

SEQ ID NO: 341942 - DNA, 24 bp, Homo sapiens
tggcagaaaagaggagaccctgga

SEQ ID NO: 341943 - DNA, 14 bp, Homo sapiens
tggcagaactgagc

SEQ ID NO: 341944 - DNA, 21 bp, Homo sapiens
tggcagaactgagctcctctg

SEQ ID NO: 341945 - DNA, 13 bp, Homo sapiens
tggcagaagcgtc

SEQ ID NO: 341946 - DNA, 14 bp, Homo sapiens
tggcagaagcgtct

SEQ ID NO: 341947 - DNA, 21 bp, Homo sapiens
tggcagaagggaattgctcag

SEQ ID NO: 341948 - DNA, 16 bp, Homo sapiens
tggcagagaagagacc

SEQ ID NO: 341949 - DNA, 14 bp, Homo sapiens
tggcagagaaggcc

SEQ ID NO: 341950 - DNA, 18 bp, Homo sapiens
tggcagagaaggcctctt

SEQ ID NO: 341951 - DNA, 23 bp, Homo sapiens
tggcagagaaggcctcttgtgct

SEQ ID NO: 341952 - DNA, 15 bp, Homo sapiens
tggcagagccaggat

SEQ ID NO: 341953 - DNA, 20 bp, Homo sapiens
tggcagataatcagcctctt

SEQ ID NO: 341954 - DNA, 15 bp, Homo sapiens
tggcagattttacaa

SEQ ID NO: 341955 - DNA, 22 bp, Homo sapiens
tggcagattttacaaaagatgt

SEQ ID NO: 341956 - DNA, 17 bp, Homo sapiens
tggcagcaaaggaagac

SEQ ID NO: 341957 - DNA, 20 bp, Homo sapiens
tggcagcaggcctgttgctt

SEQ ID NO: 341958 - DNA, 14 bp, Homo sapiens
tggcagccagggag

SEQ ID NO: 341959 - DNA, 13 bp, Homo sapiens
tggcagccatgcc

SEQ ID NO: 341960 - DNA, 17 bp, Homo sapiens
tggcagccgtgccttca

SEQ ID NO: 341961 - DNA, 20 bp, Homo sapiens
tggcagccgtgccttcagct

SEQ ID NO: 341962 - DNA, 21 bp, Homo sapiens
tggcagccgtgccttcagctc

SEQ ID NO: 341963 - DNA, 23 bp, Homo sapiens
tggcagccgtgccttcagctcta

SEQ ID NO: 341964 - DNA, 12 bp, Homo sapiens
tggcagctctcc

SEQ ID NO: 341965 - DNA, 12 bp, Homo sapiens
tggcaggacaca

SEQ ID NO: 341966 - DNA, 14 bp, Homo sapiens
tggcaggagaatca

SEQ ID NO: 341967 - DNA, 20 bp, Homo sapiens
tggcagggaggtcaggccct

SEQ ID NO: 341968 - DNA, 16 bp, Homo sapiens
tggcagggcaggcaga

SEQ ID NO: 341969 - DNA, 22 bp, Homo sapiens
tggcaggtgatgtcctgtaaac

SEQ ID NO: 341970 - DNA, 18 bp, Homo sapiens
tggcaggtggccagggct

SEQ ID NO: 341971 - DNA, 21 bp, Homo sapiens
tggcaggtgttgggacctgct

SEQ ID NO: 341972 - DNA, 12 bp, Homo sapiens
tggcagtacaga

SEQ ID NO: 341973 - DNA, 22 bp, Homo sapiens
tggcagtggccaggcagggagt

SEQ ID NO: 341974 - DNA, 15 bp, Homo sapiens
tggcagtgggaccaa

SEQ ID NO: 341975 - DNA, 16 bp, Homo sapiens
tggcctatttaagccc

SEQ ID NO: 341976 - DNA, 19 bp, Homo sapiens
tggcctatttaagccccct

SEQ ID NO: 341977 - DNA, 17 bp, Homo sapiens
tggcctcaaccctccct

SEQ ID NO: 341978 - DNA, 20 bp, Homo sapiens
tggcctcaaccctccctcag

SEQ ID NO: 341979 - DNA, 22 bp, Homo sapiens
tggcctcaaccctccctcagcc

SEQ ID NO: 341980 - DNA, 19 bp, Homo sapiens
tggcctcaagcaaggaagc

SEQ ID NO: 341981 - DNA, 23 bp, Homo sapiens
tggcctcaagcaaggaagcagag

SEQ ID NO: 341982 - DNA, 19 bp, Homo sapiens
tggcctcaagccatcttcc

SEQ ID NO: 341983 - DNA, 16 bp, Homo sapiens
tggcctcactggctgg

SEQ ID NO: 341984 - DNA, 23 bp, Homo sapiens
tggcctcactggctggggcagag

SEQ ID NO: 341985 - DNA, 16 bp, Homo sapiens
tggcctcagaccaact

SEQ ID NO: 341986 - DNA, 19 bp, Homo sapiens
tggcctcagccagctgccc

SEQ ID NO: 341987 - DNA, 21 bp, Homo sapiens
tggcctcagccagctgcccac

SEQ ID NO: 341988 - DNA, 17 bp, Homo sapiens
tggcctcagctgcctca

SEQ ID NO: 341989 - DNA, 19 bp, Homo sapiens
tggcctcagctgcctcact

SEQ ID NO: 341990 - DNA, 13 bp, Homo sapiens
tggcctcatttca

SEQ ID NO: 341991 - DNA, 17 bp, Homo sapiens
tggcctcccaataaagc

SEQ ID NO: 341992 - DNA, 18 bp, Homo sapiens
tggcctcccaataaagct

SEQ ID NO: 341993 - DNA, 20 bp, Homo sapiens
tggcctcccaataaagctgg

SEQ ID NO: 341994 - DNA, 22 bp, Homo sapiens
tggcctcccaataaagctggac

SEQ ID NO: 341995 - DNA, 14 bp, Homo sapiens
tggcctcccagcca

SEQ ID NO: 341996 - DNA, 18 bp, Homo sapiens
tggcctcccagccacccg

SEQ ID NO: 341997 - DNA, 15 bp, Homo sapiens
tggcctcccctgctg

SEQ ID NO: 341998 - DNA, 18 bp, Homo sapiens
tggcctccggcctcccct

SEQ ID NO: 341999 - DNA, 20 bp, Homo sapiens
tggcctcggggcagggcagg

SEQ ID NO: 342000 - DNA, 20 bp, Homo sapiens
tggcctcttgagcagtggct

SEQ ID NO: 342001 - DNA, 19 bp, Homo sapiens
tggcctgagaagagtcgag

SEQ ID NO: 342002 - DNA, 18 bp, Homo sapiens
tggcctgagctggggcca

SEQ ID NO: 342003 - DNA, 16 bp, Homo sapiens
tggcctgccaggctcc

SEQ ID NO: 342004 - DNA, 20 bp, Homo sapiens
tggcctgcgcctgcacctgc

SEQ ID NO: 342005 - DNA, 22 bp, Homo sapiens
tggcctgctgggaaccccgcag

SEQ ID NO: 342006 - DNA, 12 bp, Homo sapiens
tggcctggatct

SEQ ID NO: 342007 - DNA, 19 bp, Homo sapiens
tggcctggcctggccctgc

SEQ ID NO: 342008 - DNA, 12 bp, Homo sapiens
tggcctggctcc

SEQ ID NO: 342009 - DNA, 15 bp, Homo sapiens
tggcctggtccaggc

SEQ ID NO: 342010 - DNA, 20 bp, Homo sapiens
tggcctggtccaggcttggg

SEQ ID NO: 342011 - DNA, 18 bp, Homo sapiens
tggcctgtctcatcccca

SEQ ID NO: 342012 - DNA, 14 bp, Homo sapiens
tggcctgtgctggg

SEQ ID NO: 342013 - DNA, 15 bp, Homo sapiens
tggcctgtgtccagc

SEQ ID NO: 342014 - DNA, 18 bp, Homo sapiens
tggcctgtgtccagcagc

SEQ ID NO: 342015 - DNA, 20 bp, Homo sapiens
tggcctgtgtccagcagctg

SEQ ID NO: 342016 - DNA, 16 bp, Homo sapiens
tggcctgttctgtagg

SEQ ID NO: 342017 - DNA, 23 bp, Homo sapiens
tggcctgttctgtaggagagact

SEQ ID NO: 342018 - DNA, 21 bp, Homo sapiens
tggcctgtttctgcagccctt

SEQ ID NO: 342019 - DNA, 18 bp, Homo sapiens
tggccttccatttatatg

SEQ ID NO: 342020 - DNA, 11 bp, Homo sapiens
tggccttccct

SEQ ID NO: 342021 - DNA, 18 bp, Homo sapiens
tggccttccctccccaca

SEQ ID NO: 342022 - DNA, 16 bp, Homo sapiens
tggccttggggccaga

SEQ ID NO: 342023 - DNA, 19 bp, Homo sapiens
tggccttggggccagactg

SEQ ID NO: 342024 - DNA, 19 bp, Homo sapiens
tggccttggttcctccagc

SEQ ID NO: 342025 - DNA, 20 bp, Homo sapiens
tggccttggttcctccagca

SEQ ID NO: 342026 - DNA, 22 bp, Homo sapiens
tggccttgttctctctatggta

SEQ ID NO: 342027 - DNA, 18 bp, Homo sapiens
tggcctttgcttatgaat

SEQ ID NO: 342028 - DNA, 12 bp, Homo sapiens
tggcctttgtaa

SEQ ID NO: 342029 - DNA, 15 bp, Homo sapiens
tggcctttgtaagac

SEQ ID NO: 342030 - DNA, 12 bp, Homo sapiens
tggcgagccctt

SEQ ID NO: 342031 - DNA, 14 bp, Homo sapiens
tggcgagcccttag

SEQ ID NO: 342032 - DNA, 17 bp, Homo sapiens
tggcgagcccttagcct

SEQ ID NO: 342033 - DNA, 15 bp, Homo sapiens
tggcgcagtgcctct

SEQ ID NO: 342034 - DNA, 17 bp, Homo sapiens
tggcgcagtgcctctgg

SEQ ID NO: 342035 - DNA, 13 bp, Homo sapiens
tggcgcgggaggc

SEQ ID NO: 342036 - DNA, 19 bp, Homo sapiens
tggcgcgggaggcaccagc

SEQ ID NO: 342037 - DNA, 17 bp, Homo sapiens
tggcgctttctcctgtg

SEQ ID NO: 342038 - DNA, 16 bp, Homo sapiens
tggcggaacctggctg

SEQ ID NO: 342039 - DNA, 18 bp, Homo sapiens
tggcggaacctggctgcg

SEQ ID NO: 342040 - DNA, 12 bp, Homo sapiens
tggcggaggcca

SEQ ID NO: 342041 - DNA, 13 bp, Homo sapiens
tggcggaggccat

SEQ ID NO: 342042 - DNA, 15 bp, Homo sapiens
tggcggaggccatgg

SEQ ID NO: 342043 - DNA, 13 bp, Homo sapiens
tggcggcttcctg

SEQ ID NO: 342044 - DNA, 15 bp, Homo sapiens
tggcgggcagcccct

SEQ ID NO: 342045 - DNA, 18 bp, Homo sapiens
tggcggtgatcagcagag

SEQ ID NO: 342046 - DNA, 15 bp, Homo sapiens
tggcgtaatgggcct

SEQ ID NO: 342047 - DNA, 18 bp, Homo sapiens
tggcgtaatgggcctgcc

SEQ ID NO: 342048 - DNA, 20 bp, Homo sapiens
tggcgtctgcctaggagctg

SEQ ID NO: 342049 - DNA, 15 bp, Homo sapiens
tggcgtggagcaggc

SEQ ID NO: 342050 - DNA, 19 bp, Homo sapiens
tggcgtgtgtccctgtggt

SEQ ID NO: 342051 - DNA, 14 bp, Homo sapiens
tggctaaattcatg

SEQ ID NO: 342052 - DNA, 22 bp, Homo sapiens
tggctacatcccagcctgtggt

SEQ ID NO: 342053 - DNA, 23 bp, Homo sapiens
tggctagaggccagccccaccca

SEQ ID NO: 342054 - DNA, 16 bp, Homo sapiens
tggctagagtcctcac

SEQ ID NO: 342055 - DNA, 22 bp, Homo sapiens
tggctagggttccactggagaa

SEQ ID NO: 342056 - DNA, 15 bp, Homo sapiens
tggctagtactgtat

SEQ ID NO: 342057 - DNA, 19 bp, Homo sapiens
tggctataaatatataaaa

SEQ ID NO: 342058 - DNA, 22 bp, Homo sapiens
tggctataacatgtctttcagc

SEQ ID NO: 342059 - DNA, 22 bp, Homo sapiens
tggctatgttttggagagagca

SEQ ID NO: 342060 - DNA, 15 bp, Homo sapiens
tggctcaaggattca

SEQ ID NO: 342061 - DNA, 14 bp, Homo sapiens
tggctcacagccac

SEQ ID NO: 342062 - DNA, 16 bp, Homo sapiens
tggctcacgtgtgtga

SEQ ID NO: 342063 - DNA, 22 bp, Homo sapiens
tggctcactacaacctccacct

SEQ ID NO: 342064 - DNA, 14 bp, Homo sapiens
accttttaactcac

SEQ ID NO: 342065 - DNA, 13 bp, Homo sapiens
accttttatacca

SEQ ID NO: 342066 - DNA, 15 bp, Homo sapiens
accttttatcaataa

SEQ ID NO: 342067 - DNA, 21 bp, Homo sapiens
accttttatcaataaagcact

SEQ ID NO: 342068 - DNA, 16 bp, Homo sapiens
accttttctgttgtac

SEQ ID NO: 342069 - DNA, 21 bp, Homo sapiens
accttttgataaaatgttcct

SEQ ID NO: 342070 - DNA, 14 bp, Homo sapiens
accttttggccttt

SEQ ID NO: 342071 - DNA, 16 bp, Homo sapiens
acctttttttttgaaa

SEQ ID NO: 342072 - DNA, 21 bp, Homo sapiens
acgaaacacagaactcagcct

SEQ ID NO: 342073 - DNA, 14 bp, Homo sapiens
acgaacatggcatg

SEQ ID NO: 342074 - DNA, 11 bp, Homo sapiens
acgaagaaaaa

SEQ ID NO: 342075 - DNA, 21 bp, Homo sapiens
acgaatataagcttaaaataa

SEQ ID NO: 342076 - DNA, 21 bp, Homo sapiens
acgaatcccctaaacaaaaag

SEQ ID NO: 342077 - DNA, 11 bp, Homo sapiens
acgaccccaga

SEQ ID NO: 342078 - DNA, 11 bp, Homo sapiens
acgactcttcc

SEQ ID NO: 342079 - DNA, 13 bp, Homo sapiens
acgactcttcctg

SEQ ID NO: 342080 - DNA, 14 bp, Homo sapiens
acgacttcagggca

SEQ ID NO: 342081 - DNA, 20 bp, Homo sapiens
acgagaattgcttgaacccg

SEQ ID NO: 342082 - DNA, 15 bp, Homo sapiens
acgagatcttccttc

SEQ ID NO: 342083 - DNA, 20 bp, Homo sapiens
acgaggcaatgactgtgagc

SEQ ID NO: 342084 - DNA, 16 bp, Homo sapiens
acgaggccttcagaaa

SEQ ID NO: 342085 - DNA, 18 bp, Homo sapiens
acgaggccttcagaaaag

SEQ ID NO: 342086 - DNA, 22 bp, Homo sapiens
acgaggccttcagaaaagacac

SEQ ID NO: 342087 - DNA, 20 bp, Homo sapiens
acgagggatgggatttcatg

SEQ ID NO: 342088 - DNA, 22 bp, Homo sapiens
acgagggatgggatttcatgta

SEQ ID NO: 342089 - DNA, 19 bp, Homo sapiens
acgagggatgtggagcaca

SEQ ID NO: 342090 - DNA, 16 bp, Homo sapiens
acgagtcacctgcaag

SEQ ID NO: 342091 - DNA, 13 bp, Homo sapiens
acgatttaattta

SEQ ID NO: 342092 - DNA, 14 bp, Homo sapiens
acgatttaatttat

SEQ ID NO: 342093 - DNA, 17 bp, Homo sapiens
acgatttcactgacact

SEQ ID NO: 342094 - DNA, 21 bp, Homo sapiens
acgcaattgtgggatgtcctc

SEQ ID NO: 342095 - DNA, 21 bp, Homo sapiens
tggaggaaggggggttgcagt

SEQ ID NO: 342096 - DNA, 18 bp, Homo sapiens
tggaggaaggtgctgagc

SEQ ID NO: 342097 - DNA, 19 bp, Homo sapiens
tggaggaaggtgctgagct

SEQ ID NO: 342098 - DNA, 15 bp, Homo sapiens
tggaggaatgctccc

SEQ ID NO: 342099 - DNA, 20 bp, Homo sapiens
tggaggagacgtccaccctg

SEQ ID NO: 342100 - DNA, 18 bp, Homo sapiens
tggaggattctttcccca

SEQ ID NO: 342101 - DNA, 20 bp, Homo sapiens
tggaggattctttccccaga

SEQ ID NO: 342102 - DNA, 22 bp, Homo sapiens
tggaggattctttccccagagg

SEQ ID NO: 342103 - DNA, 17 bp, Homo sapiens
tggaggcacacagctgc

SEQ ID NO: 342104 - DNA, 19 bp, Homo sapiens
tggaggcacacagctgcag

SEQ ID NO: 342105 - DNA, 14 bp, Homo sapiens
tggaggcagactcg

SEQ ID NO: 342106 - DNA, 18 bp, Homo sapiens
tggaggcagactcgaggg

SEQ ID NO: 342107 - DNA, 19 bp, Homo sapiens
tggaggcagactcgagggc

SEQ ID NO: 342108 - DNA, 20 bp, Homo sapiens
tggaggcattcccagaggtg

SEQ ID NO: 342109 - DNA, 22 bp, Homo sapiens
tggaggcattcccagaggtggg

SEQ ID NO: 342110 - DNA, 13 bp, Homo sapiens
tggaggcattgtt

SEQ ID NO: 342111 - DNA, 14 bp, Homo sapiens
tggaggcattgttt

SEQ ID NO: 342112 - DNA, 16 bp, Homo sapiens
tggaggccaagcctgc

SEQ ID NO: 342113 - DNA, 21 bp, Homo sapiens
tggaggccaagcctgcagctt

SEQ ID NO: 342114 - DNA, 23 bp, Homo sapiens
tggaggccaccaagctgctctcc

SEQ ID NO: 342115 - DNA, 19 bp, Homo sapiens
tggaggccgggtgctcagg

SEQ ID NO: 342116 - DNA, 14 bp, Homo sapiens
tggaggcctcaccc

SEQ ID NO: 342117 - DNA, 16 bp, Homo sapiens
tggaggcctctgggcc

SEQ ID NO: 342118 - DNA, 22 bp, Homo sapiens
tggaggcctctgggcctcctct

SEQ ID NO: 342119 - DNA, 19 bp, Homo sapiens
tggaggcctgatgctgccc

SEQ ID NO: 342120 - DNA, 20 bp, Homo sapiens
tggaggcctgatgctgcccc

SEQ ID NO: 342121 - DNA, 20 bp, Homo sapiens
tggaggcctggtctggagcc

SEQ ID NO: 342122 - DNA, 20 bp, Homo sapiens
tggaggggcatggccagcag

SEQ ID NO: 342123 - DNA, 16 bp, Homo sapiens
tggaggggtcagcagg

SEQ ID NO: 342124 - DNA, 19 bp, Homo sapiens
tggaggggtggtcctgact

SEQ ID NO: 342125 - DNA, 15 bp, Homo sapiens
tggaggtgagaaaag

SEQ ID NO: 342126 - DNA, 15 bp, Homo sapiens
tggaggtggggttgg

SEQ ID NO: 342127 - DNA, 16 bp, Homo sapiens
tggaggttctcagagc

SEQ ID NO: 342128 - DNA, 18 bp, Homo sapiens
tggaggttctcagagcca

SEQ ID NO: 342129 - DNA, 20 bp, Homo sapiens
tggagtagacccctggctgg

SEQ ID NO: 342130 - DNA, 19 bp, Homo sapiens
tggagtattattattttaa

SEQ ID NO: 342131 - DNA, 15 bp, Homo sapiens
tggagtcctgttctc

SEQ ID NO: 342132 - DNA, 22 bp, Homo sapiens
tggagtcctgttctcagagctc

SEQ ID NO: 342133 - DNA, 17 bp, Homo sapiens
tggagtctgaaggagag

SEQ ID NO: 342134 - DNA, 12 bp, Homo sapiens
tggagtgagcag

SEQ ID NO: 342135 - DNA, 19 bp, Homo sapiens
tggagtgaggcttccaggc

SEQ ID NO: 342136 - DNA, 20 bp, Homo sapiens
tggagtgaggcttccaggct

SEQ ID NO: 342137 - DNA, 21 bp, Homo sapiens
tggagtgaggcttccaggctc

SEQ ID NO: 342138 - DNA, 15 bp, Homo sapiens
tggagtgcgctcttg

SEQ ID NO: 342139 - DNA, 22 bp, Homo sapiens
tggagtgctgcttgtgcctccc

SEQ ID NO: 342140 - DNA, 12 bp, Homo sapiens
tggagtgctggc

SEQ ID NO: 342141 - DNA, 13 bp, Homo sapiens
tggagtggggcag

SEQ ID NO: 342142 - DNA, 16 bp, Homo sapiens
tggagtggggcagtag

SEQ ID NO: 342143 - DNA, 15 bp, Homo sapiens
tggagtgtgtattgt

SEQ ID NO: 342144 - DNA, 14 bp, Homo sapiens
tggagtgtgtgggg

SEQ ID NO: 342145 - DNA, 18 bp, Homo sapiens
tggagttacattaatgtt

SEQ ID NO: 342146 - DNA, 23 bp, Homo sapiens
tggagttattcactctcccagag

SEQ ID NO: 342147 - DNA, 16 bp, Homo sapiens
tggagttcatcttgaa

SEQ ID NO: 342148 - DNA, 20 bp, Homo sapiens
tggagttcccgtgcacctac

SEQ ID NO: 342149 - DNA, 14 bp, Homo sapiens
tggataaaaaagaa

SEQ ID NO: 342150 - DNA, 15 bp, Homo sapiens
tggataacaccacca

SEQ ID NO: 342151 - DNA, 21 bp, Homo sapiens
tggatacacacatagtttctt

SEQ ID NO: 342152 - DNA, 22 bp, Homo sapiens
tgggaagctgtactcagagcag

SEQ ID NO: 342153 - DNA, 24 bp, Homo sapiens
tgggaagctgtactcagagcagag

SEQ ID NO: 342154 - DNA, 18 bp, Homo sapiens
tgggaagcttgagcctcc

SEQ ID NO: 342155 - DNA, 19 bp, Homo sapiens
tgggaaggctaagttcagt

SEQ ID NO: 342156 - DNA, 13 bp, Homo sapiens
tgggaagggctta

SEQ ID NO: 342157 - DNA, 15 bp, Homo sapiens
tgggaaggggtttct

SEQ ID NO: 342158 - DNA, 13 bp, Homo sapiens
tgggaatctccca

SEQ ID NO: 342159 - DNA, 19 bp, Homo sapiens
tgggaatctcccagacttg

SEQ ID NO: 342160 - DNA, 16 bp, Homo sapiens
tgggaatgaatgtcag

SEQ ID NO: 342161 - DNA, 21 bp, Homo sapiens
tgggaatgcagtgggtggggc

SEQ ID NO: 342162 - DNA, 23 bp, Homo sapiens
tgggaatgcgctcttcaccagga

SEQ ID NO: 342163 - DNA, 20 bp, Homo sapiens
tgggaatgttacattgtttg

SEQ ID NO: 342164 - DNA, 18 bp, Homo sapiens
tgggacaatggcaatagg

SEQ ID NO: 342165 - DNA, 11 bp, Homo sapiens
tgggacagcca

SEQ ID NO: 342166 - DNA, 23 bp, Homo sapiens
tgggacccagctactctgtccag

SEQ ID NO: 342167 - DNA, 20 bp, Homo sapiens
tgggacccatagatcttctg

SEQ ID NO: 342168 - DNA, 23 bp, Homo sapiens
tgggacctcagttttatcatttt

SEQ ID NO: 342169 - DNA, 15 bp, Homo sapiens
tgggacggaagtggc

SEQ ID NO: 342170 - DNA, 16 bp, Homo sapiens
tgggacgtggtcaggg

SEQ ID NO: 342171 - DNA, 17 bp, Homo sapiens
tgggactagcctggctt

SEQ ID NO: 342172 - DNA, 20 bp, Homo sapiens
tgggactaggacctgagcct

SEQ ID NO: 342173 - DNA, 17 bp, Homo sapiens
tgggactccaggccagc

SEQ ID NO: 342174 - DNA, 18 bp, Homo sapiens
tgggactccaggccagct

SEQ ID NO: 342175 - DNA, 16 bp, Homo sapiens
tgggactctcctcctc

SEQ ID NO: 342176 - DNA, 14 bp, Homo sapiens
tgggactgagccag

SEQ ID NO: 342177 - DNA, 16 bp, Homo sapiens
tgggactgatgtcatc

SEQ ID NO: 342178 - DNA, 13 bp, Homo sapiens
tgggactgggagg

SEQ ID NO: 342179 - DNA, 21 bp, Homo sapiens
tgggagaaccaaaaagaggct

SEQ ID NO: 342180 - DNA, 14 bp, Homo sapiens
tgggagaagggaca

SEQ ID NO: 342181 - DNA, 16 bp, Homo sapiens
tgggagaagtggcccc

SEQ ID NO: 342182 - DNA, 16 bp, Homo sapiens
tgggagactgagcttg

SEQ ID NO: 342183 - DNA, 12 bp, Homo sapiens
tgggagagactt

SEQ ID NO: 342184 - DNA, 14 bp, Homo sapiens
tgggagagacttgt

SEQ ID NO: 342185 - DNA, 16 bp, Homo sapiens
tgggagagcccctggg

SEQ ID NO: 342186 - DNA, 12 bp, Homo sapiens
tgggagaggaag

SEQ ID NO: 342187 - DNA, 15 bp, Homo sapiens
tgggagaggaagcca

SEQ ID NO: 342188 - DNA, 17 bp, Homo sapiens
tgggagaggaagccacg

SEQ ID NO: 342189 - DNA, 20 bp, Homo sapiens
tgggagaggatttttttctg

SEQ ID NO: 342190 - DNA, 18 bp, Homo sapiens
tgggagagggagcaagcc

SEQ ID NO: 342191 - DNA, 13 bp, Homo sapiens
tgggagagtgagg

SEQ ID NO: 342192 - DNA, 14 bp, Homo sapiens
tgggagagtgaggt

SEQ ID NO: 342193 - DNA, 23 bp, Homo sapiens
tgggagatgaaaacctgcatttt

SEQ ID NO: 342194 - DNA, 14 bp, Homo sapiens
tgggagatgctggg

SEQ ID NO: 342195 - DNA, 20 bp, Homo sapiens
tgggagcaaaataaggaaga

SEQ ID NO: 342196 - DNA, 21 bp, Homo sapiens
tgggagcagcggtttggggag

SEQ ID NO: 342197 - DNA, 22 bp, Homo sapiens
tgggagccaatactgagtgcct

SEQ ID NO: 342198 - DNA, 20 bp, Homo sapiens
tgggagccacttctccccag

SEQ ID NO: 342199 - DNA, 12 bp, Homo sapiens
tgggagccagaa

SEQ ID NO: 342200 - DNA, 12 bp, Homo sapiens
tgggagcccagc

SEQ ID NO: 342201 - DNA, 14 bp, Homo sapiens
tgggagcccagcac

SEQ ID NO: 342202 - DNA, 13 bp, Homo sapiens
tgggagccccagg

SEQ ID NO: 342203 - DNA, 16 bp, Homo sapiens
tgggagccccagggtc

SEQ ID NO: 342204 - DNA, 15 bp, Homo sapiens
tgggagccctttgga

SEQ ID NO: 342205 - DNA, 16 bp, Homo sapiens
tgggagcctgaggcag

SEQ ID NO: 342206 - DNA, 17 bp, Homo sapiens
tgggagcctgaggcagg

SEQ ID NO: 342207 - DNA, 20 bp, Homo sapiens
tgggagcctgcaaactcact

SEQ ID NO: 342208 - DNA, 17 bp, Homo sapiens
tgggaggagagggcaga

SEQ ID NO: 342209 - DNA, 16 bp, Homo sapiens
tgggaggatcacttga

SEQ ID NO: 342210 - DNA, 13 bp, Homo sapiens
tgggaggcagcat

SEQ ID NO: 342211 - DNA, 18 bp, Homo sapiens
tgggaggccaaggcaggt

SEQ ID NO: 342212 - DNA, 19 bp, Homo sapiens
tgggaggccaaggtgggcg

SEQ ID NO: 342213 - DNA, 18 bp, Homo sapiens
tgggaggcccctggtggc

SEQ ID NO: 342214 - DNA, 19 bp, Homo sapiens
tgggaggcccctggtggca

SEQ ID NO: 342215 - DNA, 17 bp, Homo sapiens
tgggaggctcccagacc

SEQ ID NO: 342216 - DNA, 18 bp, Homo sapiens
tgggagggcgaggcgggg

SEQ ID NO: 342217 - DNA, 23 bp, Homo sapiens
tgggagggggctatttctctccc

SEQ ID NO: 342218 - DNA, 14 bp, Homo sapiens
tgggaggtggccag

SEQ ID NO: 342219 - DNA, 19 bp, Homo sapiens
tgggaggttgatcagatct

SEQ ID NO: 342220 - DNA, 13 bp, Homo sapiens
tgggagtcagagc

SEQ ID NO: 342221 - DNA, 16 bp, Homo sapiens
tgggagtcagagccct

SEQ ID NO: 342222 - DNA, 21 bp, Homo sapiens
tgggagtcagagccctggctg

SEQ ID NO: 342223 - DNA, 19 bp, Homo sapiens
tgggagtcagggagccctg

SEQ ID NO: 342224 - DNA, 21 bp, Homo sapiens
tgggagtcagggagccctggg

SEQ ID NO: 342225 - DNA, 14 bp, Homo sapiens
tgggagtccacttt

SEQ ID NO: 342226 - DNA, 15 bp, Homo sapiens
tgggagtgggagagg

SEQ ID NO: 342227 - DNA, 18 bp, Homo sapiens
tgggagtgggcacctcag

SEQ ID NO: 342228 - DNA, 19 bp, Homo sapiens
tgggagtgggcacctcaga

SEQ ID NO: 342229 - DNA, 19 bp, Homo sapiens
tgggagttcagctgcttct

SEQ ID NO: 342230 - DNA, 22 bp, Homo sapiens
tgggatacttagtggtatgtct

SEQ ID NO: 342231 - DNA, 22 bp, Homo sapiens
tgggatatatggaggattcttt

SEQ ID NO: 342232 - DNA, 14 bp, Homo sapiens
tgggatcaaagcta

SEQ ID NO: 342233 - DNA, 14 bp, Homo sapiens
tgggatcagcctcc

SEQ ID NO: 342234 - DNA, 14 bp, Homo sapiens
tgggatcagtgggg

SEQ ID NO: 342235 - DNA, 15 bp, Homo sapiens
tgggatcagtggggc

SEQ ID NO: 342236 - DNA, 16 bp, Homo sapiens
tgggatccagagagaa

SEQ ID NO: 342237 - DNA, 18 bp, Homo sapiens
tgggatccagagagaagc

SEQ ID NO: 342238 - DNA, 13 bp, Homo sapiens
tgggatcctccct

SEQ ID NO: 342239 - DNA, 14 bp, Homo sapiens
tgggatgcttgcct

SEQ ID NO: 342240 - DNA, 17 bp, Homo sapiens
tgggatgggcacaggct

SEQ ID NO: 342241 - DNA, 21 bp, Homo sapiens
tgggatgggccacccaccagg

SEQ ID NO: 342242 - DNA, 21 bp, Homo sapiens
tgggatgttcagcactgtccc

SEQ ID NO: 342243 - DNA, 23 bp, Homo sapiens
tgggattcaaacctgcatattgt

SEQ ID NO: 342244 - DNA, 14 bp, Homo sapiens
tgggattcaggaat

SEQ ID NO: 342245 - DNA, 19 bp, Homo sapiens
tgggatttcttcgctgctc

SEQ ID NO: 342246 - DNA, 12 bp, Homo sapiens
tgggattttctt

SEQ ID NO: 342247 - DNA, 14 bp, Homo sapiens
tgggcaaacaggca

SEQ ID NO: 342248 - DNA, 15 bp, Homo sapiens
tgggcaaacaggcag

SEQ ID NO: 342249 - DNA, 16 bp, Homo sapiens
tgggcaaacaggcagt

SEQ ID NO: 342250 - DNA, 16 bp, Homo sapiens
tgggcaacagagcaag

SEQ ID NO: 342251 - DNA, 16 bp, Homo sapiens
tgggcaagtcccttga

SEQ ID NO: 342252 - DNA, 12 bp, Homo sapiens
tgggcacaggct

SEQ ID NO: 342253 - DNA, 13 bp, Homo sapiens
tgggcacaggctg

SEQ ID NO: 342254 - DNA, 18 bp, Homo sapiens
tgggcacccacctccacc

SEQ ID NO: 342255 - DNA, 18 bp, Homo sapiens
tgggcacgggagagcgcc

SEQ ID NO: 342256 - DNA, 13 bp, Homo sapiens
tgggcactggaaa

SEQ ID NO: 342257 - DNA, 17 bp, Homo sapiens
tgggcactggaaaacat

SEQ ID NO: 342258 - DNA, 16 bp, Homo sapiens
tgggcactggattagt

SEQ ID NO: 342259 - DNA, 14 bp, Homo sapiens
tgggcagagcctgt

SEQ ID NO: 342260 - DNA, 22 bp, Homo sapiens
tgggcagagcctgtccccgcct

SEQ ID NO: 342261 - DNA, 14 bp, Homo sapiens
tgggcagccaggct

SEQ ID NO: 342262 - DNA, 14 bp, Homo sapiens
tgggcagcccagag

SEQ ID NO: 342263 - DNA, 15 bp, Homo sapiens
tgggcagcccagaga

SEQ ID NO: 342264 - DNA, 16 bp, Homo sapiens
tgggcagcccagagag

SEQ ID NO: 342265 - DNA, 13 bp, Homo sapiens
tgggcagctgagg

SEQ ID NO: 342266 - DNA, 22 bp, Homo sapiens
tgggcagctggggggctgtcct

SEQ ID NO: 342267 - DNA, 13 bp, Homo sapiens
tgggcaggaaaag

SEQ ID NO: 342268 - DNA, 13 bp, Homo sapiens
tgggcaggacctc

SEQ ID NO: 342269 - DNA, 13 bp, Homo sapiens
tgggcagggccgc

SEQ ID NO: 342270 - DNA, 18 bp, Homo sapiens
tgggcagggccgcagggc

SEQ ID NO: 342271 - DNA, 23 bp, Homo sapiens
tgggcaggggttccagcttccct

SEQ ID NO: 342272 - DNA, 17 bp, Homo sapiens
tgggcaggtcctgggga

SEQ ID NO: 342273 - DNA, 21 bp, Homo sapiens
tgggcaggtcctggggaggct

SEQ ID NO: 342274 - DNA, 11 bp, Homo sapiens
tgggcaggtgg

SEQ ID NO: 342275 - DNA, 15 bp, Homo sapiens
tgggcaggtgggagc

SEQ ID NO: 342276 - DNA, 15 bp, Homo sapiens
tgggcagtggagagg

SEQ ID NO: 342277 - DNA, 17 bp, Homo sapiens
tgggcagtggagagggg

SEQ ID NO: 342278 - DNA, 16 bp, Homo sapiens
tgggcatccacccagt

SEQ ID NO: 342279 - DNA, 18 bp, Homo sapiens
tgggcatccacccagtgc

SEQ ID NO: 342280 - DNA, 23 bp, Homo sapiens
tgggcatccacccagtgctgcca

SEQ ID NO: 342281 - DNA, 21 bp, Homo sapiens
tgggcatccccagccccctgg

SEQ ID NO: 342282 - DNA, 22 bp, Homo sapiens
tgggcatccccagccccctggc

SEQ ID NO: 342283 - DNA, 13 bp, Homo sapiens
tgggcatgccacc

SEQ ID NO: 342284 - DNA, 16 bp, Homo sapiens
tgggcatgccaccctc

SEQ ID NO: 342285 - DNA, 20 bp, Homo sapiens
tgggcatgccaccctcacac

SEQ ID NO: 342286 - DNA, 20 bp, Homo sapiens
tgggcatggtaccagccctg

SEQ ID NO: 342287 - DNA, 18 bp, Homo sapiens
tgggccccccagctcagg

SEQ ID NO: 342288 - DNA, 16 bp, Homo sapiens
tgggcccctcagagcc

SEQ ID NO: 342289 - DNA, 13 bp, Homo sapiens
tgggcccctccct

SEQ ID NO: 342290 - DNA, 14 bp, Homo sapiens
tgggcccctcccta

SEQ ID NO: 342291 - DNA, 16 bp, Homo sapiens
tgggcccgggcaggcc

SEQ ID NO: 342292 - DNA, 11 bp, Homo sapiens
tgggccctcct

SEQ ID NO: 342293 - DNA, 13 bp, Homo sapiens
tgggccctctctc

SEQ ID NO: 342294 - DNA, 17 bp, Homo sapiens
tgggccctgcaggaggc

SEQ ID NO: 342295 - DNA, 23 bp, Homo sapiens
tgggccctgcaggaggcctggga

SEQ ID NO: 342296 - DNA, 21 bp, Homo sapiens
tgggccctggttcccccagga

SEQ ID NO: 342297 - DNA, 22 bp, Homo sapiens
tgggccggccccaggctcccct

SEQ ID NO: 342298 - DNA, 16 bp, Homo sapiens
tgggcctcccttgggc

SEQ ID NO: 342299 - DNA, 17 bp, Homo sapiens
tgggcctccttcccatg

SEQ ID NO: 342300 - DNA, 17 bp, Homo sapiens
tgggcctgatggagagg

SEQ ID NO: 342301 - DNA, 20 bp, Homo sapiens
tgggcctgatggagaggaga

SEQ ID NO: 342302 - DNA, 12 bp, Homo sapiens
tgggcctgctgc

SEQ ID NO: 342303 - DNA, 23 bp, Homo sapiens
tgggcctgcttttccaggatcct

SEQ ID NO: 342304 - DNA, 16 bp, Homo sapiens
tgggcctggcctgagc

SEQ ID NO: 342305 - DNA, 17 bp, Homo sapiens
tgggcctggcctgagct

SEQ ID NO: 342306 - DNA, 23 bp, Homo sapiens
tgggcctggcctgagctggggcc

SEQ ID NO: 342307 - DNA, 15 bp, Homo sapiens
tgggcctgggcctgc

SEQ ID NO: 342308 - DNA, 16 bp, Homo sapiens
tgggcctgggcctgct

SEQ ID NO: 342309 - DNA, 17 bp, Homo sapiens
tgggcctgtcgtgccag

SEQ ID NO: 342310 - DNA, 21 bp, Homo sapiens
tgggcctgtcgtgccagtcct

SEQ ID NO: 342311 - DNA, 13 bp, Homo sapiens
tgggcctgtctca

SEQ ID NO: 342312 - DNA, 20 bp, Homo sapiens
tgggcctgtgcagcagccca

SEQ ID NO: 342313 - DNA, 13 bp, Homo sapiens
tgggccttcatta

SEQ ID NO: 342314 - DNA, 22 bp, Homo sapiens
tgggccttcattaaatgtttgt

SEQ ID NO: 342315 - DNA, 13 bp, Homo sapiens
tgggccttgctac

SEQ ID NO: 342316 - DNA, 16 bp, Homo sapiens
tgggccttgctttggg

SEQ ID NO: 342317 - DNA, 19 bp, Homo sapiens
tgggcctttcctgtgccaa

SEQ ID NO: 342318 - DNA, 23 bp, Homo sapiens
tgggcgcggtggctcacgcctgt

SEQ ID NO: 342319 - DNA, 14 bp, Homo sapiens
tgggcgctgcttcc

SEQ ID NO: 342320 - DNA, 23 bp, Homo sapiens
tgggcggaagtacttccctcagg

SEQ ID NO: 342321 - DNA, 15 bp, Homo sapiens
tgggcggcagagagg

SEQ ID NO: 342322 - DNA, 16 bp, Homo sapiens
tgggctcaagcagtct

SEQ ID NO: 342323 - DNA, 20 bp, Homo sapiens
tgggctcaaggcaccgcagc

SEQ ID NO: 342324 - DNA, 16 bp, Homo sapiens
tgggctcagggctgga

SEQ ID NO: 342325 - DNA, 13 bp, Homo sapiens
tgggctccagagt

SEQ ID NO: 342326 - DNA, 14 bp, Homo sapiens
tgggctccagagta

SEQ ID NO: 342327 - DNA, 17 bp, Homo sapiens
tgggctcctggaaccaa

SEQ ID NO: 342328 - DNA, 21 bp, Homo sapiens
tgggctcctggctgccaggcg

SEQ ID NO: 342329 - DNA, 11 bp, Homo sapiens
tgggctctgac

SEQ ID NO: 342330 - DNA, 15 bp, Homo sapiens
tgggctctgccaccc

SEQ ID NO: 342331 - DNA, 15 bp, Homo sapiens
tgggctctgtcttcc

SEQ ID NO: 342332 - DNA, 21 bp, Homo sapiens
tgggctgacacctaccatgct

SEQ ID NO: 342333 - DNA, 14 bp, Homo sapiens
tgggctgagactgg

SEQ ID NO: 342334 - DNA, 15 bp, Homo sapiens
tgggctgagactgga

SEQ ID NO: 342335 - DNA, 16 bp, Homo sapiens
tgggctgaggaggcag

SEQ ID NO: 342336 - DNA, 15 bp, Homo sapiens
tgggctgctcctcat

SEQ ID NO: 342337 - DNA, 14 bp, Homo sapiens
tgggctggactgga

SEQ ID NO: 342338 - DNA, 14 bp, Homo sapiens
tgggctggcagagg

SEQ ID NO: 342339 - DNA, 18 bp, Homo sapiens
tgggctgggagaaggtgc

SEQ ID NO: 342340 - DNA, 19 bp, Homo sapiens
tgggctggtgccccacagc

SEQ ID NO: 342341 - DNA, 15 bp, Homo sapiens
tgggctgtgagtgta

SEQ ID NO: 342342 - DNA, 18 bp, Homo sapiens
tgggctgtgttgactgct

SEQ ID NO: 342343 - DNA, 22 bp, Homo sapiens
tgggcttctgcggtgaggcagg

SEQ ID NO: 342344 - DNA, 17 bp, Homo sapiens
tgggcttggacttcctg

SEQ ID NO: 342345 - DNA, 22 bp, Homo sapiens
tgggcttgtgatttccatttct

SEQ ID NO: 342346 - DNA, 15 bp, Homo sapiens
tgggctttaacaaaa

SEQ ID NO: 342347 - DNA, 16 bp, Homo sapiens
tgggctttaacaaaac

SEQ ID NO: 342348 - DNA, 19 bp, Homo sapiens
tgggctttaacaaaacaag

SEQ ID NO: 342349 - DNA, 11 bp, Homo sapiens
tgggctttctg

SEQ ID NO: 342350 - DNA, 20 bp, Homo sapiens
tgggctttgattccatctcc

SEQ ID NO: 342351 - DNA, 16 bp, Homo sapiens
tgggctttgcaggctc

SEQ ID NO: 342352 - DNA, 20 bp, Homo sapiens
tgggctttgcaggctctggg

SEQ ID NO: 342353 - DNA, 21 bp, Homo sapiens
tgggctttgcaggctctgggc

SEQ ID NO: 342354 - DNA, 22 bp, Homo sapiens
tgggctttgcaggctctgggct

SEQ ID NO: 342355 - DNA, 15 bp, Homo sapiens
tggggaacaagggtg

SEQ ID NO: 342356 - DNA, 15 bp, Homo sapiens
tggggaagaggcctt

SEQ ID NO: 342357 - DNA, 20 bp, Homo sapiens
tggggaagggaaccagccct

SEQ ID NO: 342358 - DNA, 23 bp, Homo sapiens
tggggaagggaaccagccctcca

SEQ ID NO: 342359 - DNA, 16 bp, Homo sapiens
tggggaatttcctcta

SEQ ID NO: 342360 - DNA, 21 bp, Homo sapiens
tggggacagttggcagagaag

SEQ ID NO: 342361 - DNA, 15 bp, Homo sapiens
tggggaccaggagct

SEQ ID NO: 342362 - DNA, 17 bp, Homo sapiens
tggggaccaggagctag

SEQ ID NO: 342363 - DNA, 14 bp, Homo sapiens
tggggacctggggt

SEQ ID NO: 342364 - DNA, 21 bp, Homo sapiens
tggggacgtgaacgttttaat

SEQ ID NO: 342365 - DNA, 18 bp, Homo sapiens
tggggagacacctcagag

SEQ ID NO: 342366 - DNA, 22 bp, Homo sapiens
tggggagaccgagtgtggagct

SEQ ID NO: 342367 - DNA, 15 bp, Homo sapiens
tggggagaggaactc

SEQ ID NO: 342368 - DNA, 15 bp, Homo sapiens
tggggagcagctggg

SEQ ID NO: 342369 - DNA, 23 bp, Homo sapiens
tggggaggagactcaggcccaca

SEQ ID NO: 342370 - DNA, 13 bp, Homo sapiens
tggggaggctgag

SEQ ID NO: 342371 - DNA, 13 bp, Homo sapiens
tggggagggagag

SEQ ID NO: 342372 - DNA, 21 bp, Homo sapiens
tggggaggggcctggcctggg

SEQ ID NO: 342373 - DNA, 22 bp, Homo sapiens
tggggaggggtcagctctggcc

SEQ ID NO: 342374 - DNA, 14 bp, Homo sapiens
tggggagggtgggc

SEQ ID NO: 342375 - DNA, 15 bp, Homo sapiens
tggggagggtgggcg

SEQ ID NO: 342376 - DNA, 14 bp, Homo sapiens
tggggagtgctgga

SEQ ID NO: 342377 - DNA, 19 bp, Homo sapiens
tggggatggagaatgccag

SEQ ID NO: 342378 - DNA, 14 bp, Homo sapiens
tggggatgtaacca

SEQ ID NO: 342379 - DNA, 23 bp, Homo sapiens
tggggattgggtgggcaggaaaa

SEQ ID NO: 342380 - DNA, 15 bp, Homo sapiens
tggggatttctccca

SEQ ID NO: 342381 - DNA, 13 bp, Homo sapiens
tggggcaagcctg

SEQ ID NO: 342382 - DNA, 21 bp, Homo sapiens
tggggcagaggggcagccgct

SEQ ID NO: 342383 - DNA, 19 bp, Homo sapiens
tggggcagggcctggcctg

SEQ ID NO: 342384 - DNA, 15 bp, Homo sapiens
tggggcatgtgtgcc

SEQ ID NO: 342385 - DNA, 18 bp, Homo sapiens
tggggcatgtgtgcctgt

SEQ ID NO: 342386 - DNA, 13 bp, Homo sapiens
tggggccacagcc

SEQ ID NO: 342387 - DNA, 15 bp, Homo sapiens
tggggccagactggc

SEQ ID NO: 342388 - DNA, 14 bp, Homo sapiens
tggggcccagcaca

SEQ ID NO: 342389 - DNA, 19 bp, Homo sapiens
tggggcccaggggctttgg

SEQ ID NO: 342390 - DNA, 19 bp, Homo sapiens
tggtaatttgtatctgaag

SEQ ID NO: 342391 - DNA, 13 bp, Homo sapiens
tggtacaggaagg

SEQ ID NO: 342392 - DNA, 21 bp, Homo sapiens
tggtacaggaaggcttgcagt

SEQ ID NO: 342393 - DNA, 15 bp, Homo sapiens
tggtaccagccctgg

SEQ ID NO: 342394 - DNA, 14 bp, Homo sapiens
tggtacgtgggtac

SEQ ID NO: 342395 - DNA, 16 bp, Homo sapiens
tggtactaaggagaat

SEQ ID NO: 342396 - DNA, 19 bp, Homo sapiens
tggtactttattcttgctg

SEQ ID NO: 342397 - DNA, 21 bp, Homo sapiens
tggtactttattcttgctggg

SEQ ID NO: 342398 - DNA, 13 bp, Homo sapiens
tggtagaagccag

SEQ ID NO: 342399 - DNA, 16 bp, Homo sapiens
tggtagcttttacttt

SEQ ID NO: 342400 - DNA, 20 bp, Homo sapiens
tggtagcttttactttttat

SEQ ID NO: 342401 - DNA, 17 bp, Homo sapiens
tggtagcttttcccttc

SEQ ID NO: 342402 - DNA, 20 bp, Homo sapiens
tggtagcttttcccttcttt

SEQ ID NO: 342403 - DNA, 21 bp, Homo sapiens
tggtaggtagtgattaactgt

SEQ ID NO: 342404 - DNA, 22 bp, Homo sapiens
tggtagtactcctgcaaaattt

SEQ ID NO: 342405 - DNA, 18 bp, Homo sapiens
tggtagttagtagcatgt

SEQ ID NO: 342406 - DNA, 16 bp, Homo sapiens
tggtatacctatttca

SEQ ID NO: 342407 - DNA, 16 bp, Homo sapiens
tggtatcttaaagtgt

SEQ ID NO: 342408 - DNA, 12 bp, Homo sapiens
tggtatgtgaat

SEQ ID NO: 342409 - DNA, 20 bp, Homo sapiens
tggtcaagccccctttgatt

SEQ ID NO: 342410 - DNA, 23 bp, Homo sapiens
tggtcaatacacataagaccgtg

SEQ ID NO: 342411 - DNA, 19 bp, Homo sapiens
tggtcacaggactctgcct

SEQ ID NO: 342412 - DNA, 22 bp, Homo sapiens
tggtcacaggactctgcctcct

SEQ ID NO: 342413 - DNA, 21 bp, Homo sapiens
tggtcaccacaattagagctt

SEQ ID NO: 342414 - DNA, 13 bp, Homo sapiens
tggtcactgccat

SEQ ID NO: 342415 - DNA, 12 bp, Homo sapiens
tggtcagaggag

SEQ ID NO: 342416 - DNA, 22 bp, Homo sapiens
tggtcagagggactgtcagctg

SEQ ID NO: 342417 - DNA, 22 bp, Homo sapiens
tggtcagatttgaactcttcaa

SEQ ID NO: 342418 - DNA, 23 bp, Homo sapiens
tggtcagcagaaacccccaggag

SEQ ID NO: 342419 - DNA, 15 bp, Homo sapiens
tggtcagcagagccg

SEQ ID NO: 342420 - DNA, 22 bp, Homo sapiens
tggtcagtgaagcccaggagga

SEQ ID NO: 342421 - DNA, 24 bp, Homo sapiens
tggtcagtgaagcccaggaggacc

SEQ ID NO: 342422 - DNA, 21 bp, Homo sapiens
tggtcagtgtggagaggggtg

SEQ ID NO: 342423 - DNA, 19 bp, Homo sapiens
tggtcatcagtattgtgta

SEQ ID NO: 342424 - DNA, 22 bp, Homo sapiens
tggtcatgaattcatactctgt

SEQ ID NO: 342425 - DNA, 17 bp, Homo sapiens
tggtccacattctgctg

SEQ ID NO: 342426 - DNA, 13 bp, Homo sapiens
tggtccaggccag

SEQ ID NO: 342427 - DNA, 17 bp, Homo sapiens
tggtccagggaagctgg

SEQ ID NO: 342428 - DNA, 13 bp, Homo sapiens
tggtccctcgtcc

SEQ ID NO: 342429 - DNA, 21 bp, Homo sapiens
tggtcctaagtccctgccccc

SEQ ID NO: 342430 - DNA, 22 bp, Homo sapiens
tggtcctgactcaacatgttac

SEQ ID NO: 342431 - DNA, 16 bp, Homo sapiens
tggtctcaaactcctg

SEQ ID NO: 342432 - DNA, 16 bp, Homo sapiens
tggtctcagaggaggg

SEQ ID NO: 342433 - DNA, 20 bp, Homo sapiens
tggtctccatttttcccagg

SEQ ID NO: 342434 - DNA, 15 bp, Homo sapiens
tggtctcctctcagc

SEQ ID NO: 342435 - DNA, 17 bp, Homo sapiens
tggtctcctctcagctt

SEQ ID NO: 342436 - DNA, 17 bp, Homo sapiens
tggtctcttccagccca

SEQ ID NO: 342437 - DNA, 15 bp, Homo sapiens
tggtctctttctttc

SEQ ID NO: 342438 - DNA, 18 bp, Homo sapiens
tggtctctttctttccaa

SEQ ID NO: 342439 - DNA, 14 bp, Homo sapiens
tggtctgaatgttc

SEQ ID NO: 342440 - DNA, 15 bp, Homo sapiens
tggtctgaatgttct

SEQ ID NO: 342441 - DNA, 16 bp, Homo sapiens
tggtctgaatgttctg

SEQ ID NO: 342442 - DNA, 15 bp, Homo sapiens
tggtctggagcccct

SEQ ID NO: 342443 - DNA, 16 bp, Homo sapiens
tggtctggagccccta

SEQ ID NO: 342444 - DNA, 21 bp, Homo sapiens
tggtctgggacttccttgctc

SEQ ID NO: 342445 - DNA, 23 bp, Homo sapiens
tggtctgtttccaggtcagaaac

SEQ ID NO: 342446 - DNA, 18 bp, Homo sapiens
tggtcttagctttacatt

SEQ ID NO: 342447 - DNA, 19 bp, Homo sapiens
tggtcttgtttaatatttg

SEQ ID NO: 342448 - DNA, 11 bp, Homo sapiens
tggtgaaatta

SEQ ID NO: 342449 - DNA, 19 bp, Homo sapiens
tggtgaacagaacaaaagg

SEQ ID NO: 342450 - DNA, 18 bp, Homo sapiens
tggtgaagtgtggctggt

SEQ ID NO: 342451 - DNA, 21 bp, Homo sapiens
tggtgaagtgtggctggtgtc

SEQ ID NO: 342452 - DNA, 16 bp, Homo sapiens
tggtgacaggcagaca

SEQ ID NO: 342453 - DNA, 23 bp, Homo sapiens
tggtgagaattaaaataaaacgt

SEQ ID NO: 342454 - DNA, 14 bp, Homo sapiens
tggtgagaggcatc

SEQ ID NO: 342455 - DNA, 14 bp, Homo sapiens
tggtgaggaggagg

SEQ ID NO: 342456 - DNA, 21 bp, Homo sapiens
tggtgagggctgagagggctg

SEQ ID NO: 342457 - DNA, 12 bp, Homo sapiens
tggtgaggggcc

SEQ ID NO: 342458 - DNA, 19 bp, Homo sapiens
tggtgaggggccactgggc

SEQ ID NO: 342459 - DNA, 14 bp, Homo sapiens
tggtgaggtgtgga

SEQ ID NO: 342460 - DNA, 17 bp, Homo sapiens
tggtgatcaattaaatg

SEQ ID NO: 342461 - DNA, 19 bp, Homo sapiens
tggtgatcgcacaaggaca

SEQ ID NO: 342462 - DNA, 18 bp, Homo sapiens
tggtgatgtaaaacagaa

SEQ ID NO: 342463 - DNA, 19 bp, Homo sapiens
tggtgcacatgacatttgt

SEQ ID NO: 342464 - DNA, 20 bp, Homo sapiens
tggtgcagaaaaaaaaaaag

SEQ ID NO: 342465 - DNA, 14 bp, Homo sapiens
tggtgcagccccag

SEQ ID NO: 342466 - DNA, 21 bp, Homo sapiens
tggtgcagccccaggaccaag

SEQ ID NO: 342467 - DNA, 14 bp, Homo sapiens
tggtgcatgttctt

SEQ ID NO: 342468 - DNA, 10 bp, Homo sapiens
tggtgcatta

SEQ ID NO: 342469 - DNA, 16 bp, Homo sapiens
tggtgcattacagaga

SEQ ID NO: 342470 - DNA, 16 bp, Homo sapiens
tggtgcatttaaaatg

SEQ ID NO: 342471 - DNA, 18 bp, Homo sapiens
tggtgcatttaaaatgga

SEQ ID NO: 342472 - DNA, 21 bp, Homo sapiens
tggtgcgctgtgctccagcag

SEQ ID NO: 342473 - DNA, 19 bp, Homo sapiens
tggtgcggtaggtgctggc

SEQ ID NO: 342474 - DNA, 20 bp, Homo sapiens
tggtgcggtaggtgctggcc

SEQ ID NO: 342475 - DNA, 12 bp, Homo sapiens
tggtgctaactg

SEQ ID NO: 342476 - DNA, 17 bp, Homo sapiens
tggtgctggatattttc

SEQ ID NO: 342477 - DNA, 21 bp, Homo sapiens
tggtgctggatattttcaaat

SEQ ID NO: 342478 - DNA, 19 bp, Homo sapiens
tggtgctgggactgagcca

SEQ ID NO: 342479 - DNA, 15 bp, Homo sapiens
tggtggcagagtgga

SEQ ID NO: 342480 - DNA, 22 bp, Homo sapiens
tggtggccccagctgtgactga

SEQ ID NO: 342481 - DNA, 12 bp, Homo sapiens
tggtggccctgg

SEQ ID NO: 342482 - DNA, 13 bp, Homo sapiens
tggtggccctggg

SEQ ID NO: 342483 - DNA, 15 bp, Homo sapiens
tggtggccctgggga

SEQ ID NO: 342484 - DNA, 17 bp, Homo sapiens
tggtgggcaccaagagc

SEQ ID NO: 342485 - DNA, 20 bp, Homo sapiens
tggtgggcagctgaggacac

SEQ ID NO: 342486 - DNA, 22 bp, Homo sapiens
tggtgggtctatgttccccagg

SEQ ID NO: 342487 - DNA, 22 bp, Homo sapiens
tggtggtactttattcttgctg

SEQ ID NO: 342488 - DNA, 23 bp, Homo sapiens
tggtgtatcccccccctgtatag

SEQ ID NO: 342489 - DNA, 21 bp, Homo sapiens
tggtgtatttttcaggtaggc

SEQ ID NO: 342490 - DNA, 18 bp, Homo sapiens
tggtgtcactctgcctct

SEQ ID NO: 342491 - DNA, 16 bp, Homo sapiens
tggtgtccccttcccc

SEQ ID NO: 342492 - DNA, 20 bp, Homo sapiens
tggtgtccccttcccctgct

SEQ ID NO: 342493 - DNA, 21 bp, Homo sapiens
tggtgtccccttcccctgctg

SEQ ID NO: 342494 - DNA, 14 bp, Homo sapiens
tggtgtctgatgtg

SEQ ID NO: 342495 - DNA, 16 bp, Homo sapiens
tggtgtcttggcactg

SEQ ID NO: 342496 - DNA, 15 bp, Homo sapiens
tggtgtgaatgctgt

SEQ ID NO: 342497 - DNA, 16 bp, Homo sapiens
tggtgtggctgctccc

SEQ ID NO: 342498 - DNA, 20 bp, Homo sapiens
tggtgtgttcgtggagccac

SEQ ID NO: 342499 - DNA, 13 bp, Homo sapiens
tggtgtgtttccc

SEQ ID NO: 342500 - DNA, 15 bp, Homo sapiens
tggtgtgtttcccta

SEQ ID NO: 342501 - DNA, 20 bp, Homo sapiens
tggtgttcttgctaactttg

SEQ ID NO: 342502 - DNA, 16 bp, Homo sapiens
tggtgttgtatgcctt

SEQ ID NO: 342503 - DNA, 22 bp, Homo sapiens
tggtgtttgggccacgatttta

SEQ ID NO: 342504 - DNA, 18 bp, Homo sapiens
tggttaagagaatgaatt

SEQ ID NO: 342505 - DNA, 16 bp, Homo sapiens
tggttaataaaactgc

SEQ ID NO: 342506 - DNA, 20 bp, Homo sapiens
tggttaccgagtatctgtaa

SEQ ID NO: 342507 - DNA, 21 bp, Homo sapiens
tggttaccgagtatctgtaac

SEQ ID NO: 342508 - DNA, 16 bp, Homo sapiens
tggttacctattgctg

SEQ ID NO: 342509 - DNA, 19 bp, Homo sapiens
tggttagagaagtaagcag

SEQ ID NO: 342510 - DNA, 16 bp, Homo sapiens
tggttagctcagcccc

SEQ ID NO: 342511 - DNA, 19 bp, Homo sapiens
tggttagctcagccccagc

SEQ ID NO: 342512 - DNA, 21 bp, Homo sapiens
tggttagctcagccccagccc

SEQ ID NO: 342513 - DNA, 22 bp, Homo sapiens
tggttagctcagccccagccca

SEQ ID NO: 342514 - DNA, 21 bp, Homo sapiens
tggttatagttgatatgtaac

SEQ ID NO: 342515 - DNA, 18 bp, Homo sapiens
tggttatcctgtgctaca

SEQ ID NO: 342516 - DNA, 20 bp, Homo sapiens
tggttatggggagagggcat

SEQ ID NO: 342517 - DNA, 19 bp, Homo sapiens
tggttatgtcccatgacct

SEQ ID NO: 342518 - DNA, 14 bp, Homo sapiens
tggttcagagactg

SEQ ID NO: 342519 - DNA, 23 bp, Homo sapiens
tggttcagagactggcagccagg

SEQ ID NO: 342520 - DNA, 21 bp, Homo sapiens
tggttcccaataaaagtgact

SEQ ID NO: 342521 - DNA, 20 bp, Homo sapiens
tggttcccccaggaccctga

SEQ ID NO: 342522 - DNA, 20 bp, Homo sapiens
tggttcccctgttcactcta

SEQ ID NO: 342523 - DNA, 12 bp, Homo sapiens
tggttccctctt

SEQ ID NO: 342524 - DNA, 21 bp, Homo sapiens
tggttccctttgctccacccc

SEQ ID NO: 342525 - DNA, 20 bp, Homo sapiens
tggttccggaatcctgtcct

SEQ ID NO: 342526 - DNA, 16 bp, Homo sapiens
tggttcctaagcctgt

SEQ ID NO: 342527 - DNA, 23 bp, Homo sapiens
tggttcctggggtgccctccact

SEQ ID NO: 342528 - DNA, 14 bp, Homo sapiens
tggttccttccctg

SEQ ID NO: 342529 - DNA, 12 bp, Homo sapiens
tggttctatttt

SEQ ID NO: 342530 - DNA, 13 bp, Homo sapiens
tggttctatttta

SEQ ID NO: 342531 - DNA, 19 bp, Homo sapiens
tggttcttagttctcactg

SEQ ID NO: 342532 - DNA, 18 bp, Homo sapiens
tggttcttgccttcccct

SEQ ID NO: 342533 - DNA, 21 bp, Homo sapiens
tggttcttggtagagattcat

SEQ ID NO: 342534 - DNA, 18 bp, Homo sapiens
tggttgcagcctgaccaa

SEQ ID NO: 342535 - DNA, 18 bp, Homo sapiens
tggttgctgggcctcatt

SEQ ID NO: 342536 - DNA, 21 bp, Homo sapiens
tggttggacctattgccagga

SEQ ID NO: 342537 - DNA, 18 bp, Homo sapiens
tgtaatcttaaaagtgta

SEQ ID NO: 342538 - DNA, 21 bp, Homo sapiens
tgtaatctttcatagccatac

SEQ ID NO: 342539 - DNA, 20 bp, Homo sapiens
tgtaatctttttctccaccc

SEQ ID NO: 342540 - DNA, 14 bp, Homo sapiens
tgtaatgacagaga

SEQ ID NO: 342541 - DNA, 16 bp, Homo sapiens
tgtaatgacagagagt

SEQ ID NO: 342542 - DNA, 12 bp, Homo sapiens
tgtaatgcaaaa

SEQ ID NO: 342543 - DNA, 20 bp, Homo sapiens
tgtaatggtatcttaaagtg

SEQ ID NO: 342544 - DNA, 15 bp, Homo sapiens
tgtaatgtatcttat

SEQ ID NO: 342545 - DNA, 21 bp, Homo sapiens
tgtaatgtatcttatttatat

SEQ ID NO: 342546 - DNA, 14 bp, Homo sapiens
tgtaatgttactga

SEQ ID NO: 342547 - DNA, 22 bp, Homo sapiens
tgtaatgttactgatcatgcat

SEQ ID NO: 342548 - DNA, 17 bp, Homo sapiens
tgtaattgcttacattt

SEQ ID NO: 342549 - DNA, 19 bp, Homo sapiens
tgtaattggcttttgaatc

SEQ ID NO: 342550 - DNA, 19 bp, Homo sapiens
tgtaattgtttgtctttaa

SEQ ID NO: 342551 - DNA, 15 bp, Homo sapiens
tgtaattttgtagta

SEQ ID NO: 342552 - DNA, 14 bp, Homo sapiens
tgtacaaagtaaaa

SEQ ID NO: 342553 - DNA, 18 bp, Homo sapiens
tgtacaaagtagagaagt

SEQ ID NO: 342554 - DNA, 13 bp, Homo sapiens
tgtacaaggtatg

SEQ ID NO: 342555 - DNA, 21 bp, Homo sapiens
tgtacaagtgctcagttccaa

SEQ ID NO: 342556 - DNA, 17 bp, Homo sapiens
tgtacaagttttgtata

SEQ ID NO: 342557 - DNA, 19 bp, Homo sapiens
tgtacactgaatatttata

SEQ ID NO: 342558 - DNA, 22 bp, Homo sapiens
tgtacagaaccagcactcccag

SEQ ID NO: 342559 - DNA, 15 bp, Homo sapiens
tgtacagtatgtgtc

SEQ ID NO: 342560 - DNA, 20 bp, Homo sapiens
tgtacagtatgtgtctagca

SEQ ID NO: 342561 - DNA, 18 bp, Homo sapiens
tgtacagtctcaattttg

SEQ ID NO: 342562 - DNA, 22 bp, Homo sapiens
tgtacagtctcaattttgtatt

SEQ ID NO: 342563 - DNA, 16 bp, Homo sapiens
tgtacagtctgtcatg

SEQ ID NO: 342564 - DNA, 15 bp, Homo sapiens
tgtacatacattgta

SEQ ID NO: 342565 - DNA, 16 bp, Homo sapiens
tgtacatacattgtat

SEQ ID NO: 342566 - DNA, 16 bp, Homo sapiens
tgtacatagtggtcat

SEQ ID NO: 342567 - DNA, 17 bp, Homo sapiens
tgtacatcatgttattt

SEQ ID NO: 342568 - DNA, 20 bp, Homo sapiens
tgtacatcatgttattttat

SEQ ID NO: 342569 - DNA, 14 bp, Homo sapiens
tgtacatctggcct

SEQ ID NO: 342570 - DNA, 14 bp, Homo sapiens
tgtacatgttcctg

SEQ ID NO: 342571 - DNA, 15 bp, Homo sapiens
tgtacattcctgata

SEQ ID NO: 342572 - DNA, 18 bp, Homo sapiens
tgtacattcctgatactg

SEQ ID NO: 342573 - DNA, 20 bp, Homo sapiens
tgtacatttatgtgtgaagc

SEQ ID NO: 342574 - DNA, 17 bp, Homo sapiens
tgtaccagggctctgta

SEQ ID NO: 342575 - DNA, 15 bp, Homo sapiens
tgtaccagtgtactg

SEQ ID NO: 342576 - DNA, 18 bp, Homo sapiens
tgtaccagtgtactgctt

SEQ ID NO: 342577 - DNA, 21 bp, Homo sapiens
tgtaccagtgtactgctttca

SEQ ID NO: 342578 - DNA, 14 bp, Homo sapiens
tgtaccatgttaaa

SEQ ID NO: 342579 - DNA, 17 bp, Homo sapiens
tgtaccatgttaaagag

SEQ ID NO: 342580 - DNA, 13 bp, Homo sapiens
tgtacccagccac

SEQ ID NO: 342581 - DNA, 14 bp, Homo sapiens
tgtacccagccacc

SEQ ID NO: 342582 - DNA, 14 bp, Homo sapiens
tgtacccagctcct

SEQ ID NO: 342583 - DNA, 21 bp, Homo sapiens
tgtacccagtattctaggtag

SEQ ID NO: 342584 - DNA, 22 bp, Homo sapiens
tgtacccttccacctcctagag

SEQ ID NO: 342585 - DNA, 15 bp, Homo sapiens
tgtaccgagaactgg

SEQ ID NO: 342586 - DNA, 18 bp, Homo sapiens
tgtacgtatgaatgatat

SEQ ID NO: 342587 - DNA, 20 bp, Homo sapiens
tgtacgtatgaatgatatct

SEQ ID NO: 342588 - DNA, 14 bp, Homo sapiens
tgtacgtctggtgt

SEQ ID NO: 342589 - DNA, 14 bp, Homo sapiens
tgtacgtggagagg

SEQ ID NO: 342590 - DNA, 15 bp, Homo sapiens
tgtacgtggagaggg

SEQ ID NO: 342591 - DNA, 20 bp, Homo sapiens
tgtacgtgggagaggcagaa

SEQ ID NO: 342592 - DNA, 15 bp, Homo sapiens
tgtactaagccagga

SEQ ID NO: 342593 - DNA, 17 bp, Homo sapiens
tgtactacatttgcatg

SEQ ID NO: 342594 - DNA, 14 bp, Homo sapiens
tgtactccagcctg

SEQ ID NO: 342595 - DNA, 16 bp, Homo sapiens
tgtactccagcctggg

SEQ ID NO: 342596 - DNA, 19 bp, Homo sapiens
tgtactccagcctgggtga

SEQ ID NO: 342597 - DNA, 14 bp, Homo sapiens
tgtactctttggct

SEQ ID NO: 342598 - DNA, 18 bp, Homo sapiens
tgtactgagttctcatcc

SEQ ID NO: 342599 - DNA, 18 bp, Homo sapiens
tgtactgcatgttaccat

SEQ ID NO: 342600 - DNA, 13 bp, Homo sapiens
tgtactgctttca

SEQ ID NO: 342601 - DNA, 18 bp, Homo sapiens
tgtactggagagtggcaa

SEQ ID NO: 342602 - DNA, 12 bp, Homo sapiens
tgtactgtagtt

SEQ ID NO: 342603 - DNA, 14 bp, Homo sapiens
tgtacttcaagtta

SEQ ID NO: 342604 - DNA, 21 bp, Homo sapiens
tgtacttcataagatattctt

SEQ ID NO: 342605 - DNA, 12 bp, Homo sapiens
tgtactttgact

SEQ ID NO: 342606 - DNA, 13 bp, Homo sapiens
tgtactttgcttc

SEQ ID NO: 342607 - DNA, 17 bp, Homo sapiens
tgtactttgtttttcca

SEQ ID NO: 342608 - DNA, 18 bp, Homo sapiens
tgtagaaatattataaat

SEQ ID NO: 342609 - DNA, 21 bp, Homo sapiens
tgtagaaatgatgatgtggaa

SEQ ID NO: 342610 - DNA, 21 bp, Homo sapiens
tgtagaactgttcatttccac

SEQ ID NO: 342611 - DNA, 13 bp, Homo sapiens
tgtagaagaggga

SEQ ID NO: 342612 - DNA, 13 bp, Homo sapiens
tgtagaagatgga

SEQ ID NO: 342613 - DNA, 20 bp, Homo sapiens
tgtagactggccatgcaagt

SEQ ID NO: 342614 - DNA, 18 bp, Homo sapiens
tgtagacttactttccta

SEQ ID NO: 342615 - DNA, 16 bp, Homo sapiens
tgtagagcagggcaag

SEQ ID NO: 342616 - DNA, 16 bp, Homo sapiens
tgtagagccagccttg

SEQ ID NO: 342617 - DNA, 18 bp, Homo sapiens
tgtagagccagccttggt

SEQ ID NO: 342618 - DNA, 15 bp, Homo sapiens
tgtagaggagcctgg

SEQ ID NO: 342619 - DNA, 16 bp, Homo sapiens
tgtagaggagcctgga

SEQ ID NO: 342620 - DNA, 17 bp, Homo sapiens
tgtagataacactatgg

SEQ ID NO: 342621 - DNA, 19 bp, Homo sapiens
tgtagatacaatcagctgc

SEQ ID NO: 342622 - DNA, 19 bp, Homo sapiens
tgtagatattgtgaagtac

SEQ ID NO: 342623 - DNA, 21 bp, Homo sapiens
tgtagatattgttttctgtaa

SEQ ID NO: 342624 - DNA, 20 bp, Homo sapiens
tgtagatggcactttagtga

SEQ ID NO: 342625 - DNA, 16 bp, Homo sapiens
tgtagatgtagcattg

SEQ ID NO: 342626 - DNA, 22 bp, Homo sapiens
tgtagatgtagcattgttccac

SEQ ID NO: 342627 - DNA, 22 bp, Homo sapiens
tgtagcaaaattcttaagtatg

SEQ ID NO: 342628 - DNA, 13 bp, Homo sapiens
tgtagcatataaa

SEQ ID NO: 342629 - DNA, 20 bp, Homo sapiens
tgtagcatattttctccgaa

SEQ ID NO: 342630 - DNA, 14 bp, Homo sapiens
tgtagcatgttcta

SEQ ID NO: 342631 - DNA, 15 bp, Homo sapiens
tgtagcattgttcca

SEQ ID NO: 342632 - DNA, 16 bp, Homo sapiens
tgtagcattgttccac

SEQ ID NO: 342633 - DNA, 17 bp, Homo sapiens
tgtagcatttcttgatg

SEQ ID NO: 342634 - DNA, 16 bp, Homo sapiens
tgtagccactggcata

SEQ ID NO: 342635 - DNA, 18 bp, Homo sapiens
tgtagccatggctcaggc

SEQ ID NO: 342636 - DNA, 19 bp, Homo sapiens
tgtagccatggctcaggca

SEQ ID NO: 342637 - DNA, 17 bp, Homo sapiens
tgtagccccaagaaggc

SEQ ID NO: 342638 - DNA, 21 bp, Homo sapiens
tgtagccccaagaaggctggg

SEQ ID NO: 342639 - DNA, 22 bp, Homo sapiens
tgtagccccaagaaggctgggg

SEQ ID NO: 342640 - DNA, 18 bp, Homo sapiens
tgtagcgtcctgaggaat

SEQ ID NO: 342641 - DNA, 24 bp, Homo sapiens
tgtagcgtttcctttcttccctca

SEQ ID NO: 342642 - DNA, 19 bp, Homo sapiens
tgtagctaattaggaagct

SEQ ID NO: 342643 - DNA, 15 bp, Homo sapiens
tgtagctatttttct

SEQ ID NO: 342644 - DNA, 20 bp, Homo sapiens
tgtagctcttagtcctccct

SEQ ID NO: 342645 - DNA, 14 bp, Homo sapiens
tgtagctgatgaaa

SEQ ID NO: 342646 - DNA, 14 bp, Homo sapiens
tgtagctggtttcc

SEQ ID NO: 342647 - DNA, 12 bp, Homo sapiens
tgtagctgtcct

SEQ ID NO: 342648 - DNA, 16 bp, Homo sapiens
tgtagcttatatttga

SEQ ID NO: 342649 - DNA, 12 bp, Homo sapiens
tgtaggaaacag

SEQ ID NO: 342650 - DNA, 22 bp, Homo sapiens
tgtaggaaacagaaaagagaag

SEQ ID NO: 342651 - DNA, 12 bp, Homo sapiens
tgtagggctgga

SEQ ID NO: 342652 - DNA, 16 bp, Homo sapiens
tgtagggctggaccta

SEQ ID NO: 342653 - DNA, 23 bp, Homo sapiens
tgtaggtgatgtttccagctgcc

SEQ ID NO: 342654 - DNA, 20 bp, Homo sapiens
tgtaggtgcaagatggaaag

SEQ ID NO: 342655 - DNA, 11 bp, Homo sapiens
tgtaggttgct

SEQ ID NO: 342656 - DNA, 13 bp, Homo sapiens
tgtaggttgctta

SEQ ID NO: 342657 - DNA, 19 bp, Homo sapiens
tgtagtaaatattatgatt

SEQ ID NO: 342658 - DNA, 18 bp, Homo sapiens
tgtagtaattgttacaat

SEQ ID NO: 342659 - DNA, 18 bp, Homo sapiens
tgtagtagccctttctgt

SEQ ID NO: 342660 - DNA, 15 bp, Homo sapiens
tgtagtagttgatga

SEQ ID NO: 342661 - DNA, 12 bp, Homo sapiens
tgtagttaggaa

SEQ ID NO: 342662 - DNA, 16 bp, Homo sapiens
tgtagttctttgttcc

SEQ ID NO: 342663 - DNA, 14 bp, Homo sapiens
tgtgattctaatgt

SEQ ID NO: 342664 - DNA, 23 bp, Homo sapiens
tgtgatttagaactgtatgtcag

SEQ ID NO: 342665 - DNA, 13 bp, Homo sapiens
tgtgatttatgca

SEQ ID NO: 342666 - DNA, 16 bp, Homo sapiens
tgtgatttatgcattt

SEQ ID NO: 342667 - DNA, 19 bp, Homo sapiens
tgtgatttatgcatttatg

SEQ ID NO: 342668 - DNA, 15 bp, Homo sapiens
tgtgatttatttgga

SEQ ID NO: 342669 - DNA, 15 bp, Homo sapiens
tgtgatttgtctctg

SEQ ID NO: 342670 - DNA, 24 bp, Homo sapiens
tgtgcaactcttgtattgctccat

SEQ ID NO: 342671 - DNA, 17 bp, Homo sapiens
tgtgcaagacacccagt

SEQ ID NO: 342672 - DNA, 17 bp, Homo sapiens
tgtgcaagtatgtgagt

SEQ ID NO: 342673 - DNA, 20 bp, Homo sapiens
tgtgcaagtgtctgtgtgca

SEQ ID NO: 342674 - DNA, 12 bp, Homo sapiens
tgtgcaagtgtg

SEQ ID NO: 342675 - DNA, 22 bp, Homo sapiens
tgtgcaatatgaggggactgca

SEQ ID NO: 342676 - DNA, 19 bp, Homo sapiens
tgtgcacacacaccacaca

SEQ ID NO: 342677 - DNA, 15 bp, Homo sapiens
tgtgcacatctctgc

SEQ ID NO: 342678 - DNA, 20 bp, Homo sapiens
tgtgcacatctctgcttgag

SEQ ID NO: 342679 - DNA, 16 bp, Homo sapiens
tgtgcacattctccct

SEQ ID NO: 342680 - DNA, 14 bp, Homo sapiens
tgtgcactgtcact

SEQ ID NO: 342681 - DNA, 21 bp, Homo sapiens
tgtgcactgtcactttgctct

SEQ ID NO: 342682 - DNA, 13 bp, Homo sapiens
tgtgcagcagccc

SEQ ID NO: 342683 - DNA, 14 bp, Homo sapiens
tgtgcagcagccca

SEQ ID NO: 342684 - DNA, 20 bp, Homo sapiens
tgtgcagcagcccagcttcc

SEQ ID NO: 342685 - DNA, 21 bp, Homo sapiens
tgtgcagcagcccagcttcct

SEQ ID NO: 342686 - DNA, 18 bp, Homo sapiens
tgtgcataaaagttaaca

SEQ ID NO: 342687 - DNA, 22 bp, Homo sapiens
tgtgcatgagaatgtcatttgc

SEQ ID NO: 342688 - DNA, 20 bp, Homo sapiens
tgtgcatgcaaaccaggagc

SEQ ID NO: 342689 - DNA, 16 bp, Homo sapiens
tgtgcatttcacctgt

SEQ ID NO: 342690 - DNA, 23 bp, Homo sapiens
tgtgccaccacccctccctctgc

SEQ ID NO: 342691 - DNA, 16 bp, Homo sapiens
tgtgccacccaccagg

SEQ ID NO: 342692 - DNA, 13 bp, Homo sapiens
tgtgccaccctct

SEQ ID NO: 342693 - DNA, 22 bp, Homo sapiens
tgtgccaccctctgcagggcag

SEQ ID NO: 342694 - DNA, 23 bp, Homo sapiens
tgtgccaccctctgcagggcagc

SEQ ID NO: 342695 - DNA, 22 bp, Homo sapiens
tgtgccaggaggcggcagctct

SEQ ID NO: 342696 - DNA, 12 bp, Homo sapiens
tgtgccaggagt

SEQ ID NO: 342697 - DNA, 21 bp, Homo sapiens
tgtgccatagagtttaacaca

SEQ ID NO: 342698 - DNA, 22 bp, Homo sapiens
tgtgccatagagtttaacacaa

SEQ ID NO: 342699 - DNA, 22 bp, Homo sapiens
tgtgcccacccagggcccggca

SEQ ID NO: 342700 - DNA, 12 bp, Homo sapiens
tgtgcccagagt

SEQ ID NO: 342701 - DNA, 19 bp, Homo sapiens
tgtgcccagcccggacctt

SEQ ID NO: 342702 - DNA, 14 bp, Homo sapiens
tgtgcccagctcag

SEQ ID NO: 342703 - DNA, 15 bp, Homo sapiens
tgtgcccagctcagt

SEQ ID NO: 342704 - DNA, 13 bp, Homo sapiens
tgtgcccagtcat

SEQ ID NO: 342705 - DNA, 22 bp, Homo sapiens
tgtgcccagttaatcttgcttt

SEQ ID NO: 342706 - DNA, 18 bp, Homo sapiens
tgtgcccatcatctctgc

SEQ ID NO: 342707 - DNA, 13 bp, Homo sapiens
tgtgccccaagag

SEQ ID NO: 342708 - DNA, 23 bp, Homo sapiens
tgtgccccatgcctgtccagcct

SEQ ID NO: 342709 - DNA, 23 bp, Homo sapiens
tgtgcccctggcccatctcagcc

SEQ ID NO: 342710 - DNA, 13 bp, Homo sapiens
tgtgccctggctc

SEQ ID NO: 342711 - DNA, 20 bp, Homo sapiens
tgtgccgtctttggttcctc

SEQ ID NO: 342712 - DNA, 15 bp, Homo sapiens
tgtgcctaacaccag

SEQ ID NO: 342713 - DNA, 19 bp, Homo sapiens
tgtgcctcccaagctcaga

SEQ ID NO: 342714 - DNA, 12 bp, Homo sapiens
tgtgcctccccc

SEQ ID NO: 342715 - DNA, 14 bp, Homo sapiens
tgtgcctcccccca

SEQ ID NO: 342716 - DNA, 15 bp, Homo sapiens
tgtgcctccccccag

SEQ ID NO: 342717 - DNA, 16 bp, Homo sapiens
tgtgcctccccccaga

SEQ ID NO: 342718 - DNA, 16 bp, Homo sapiens
tgtgcctcccttccca

SEQ ID NO: 342719 - DNA, 15 bp, Homo sapiens
tgtgcctctgcctgt

SEQ ID NO: 342720 - DNA, 18 bp, Homo sapiens
tgtgcctcttgggagacg

SEQ ID NO: 342721 - DNA, 17 bp, Homo sapiens
tgtgcctgcaccaggag

SEQ ID NO: 342722 - DNA, 17 bp, Homo sapiens
tgtgcctgctagagcaa

SEQ ID NO: 342723 - DNA, 17 bp, Homo sapiens
tgtgcctggagctcctg

SEQ ID NO: 342724 - DNA, 19 bp, Homo sapiens
tgtgcctggagctcctggg

SEQ ID NO: 342725 - DNA, 18 bp, Homo sapiens
tgtgcctgtcactactgg

SEQ ID NO: 342726 - DNA, 14 bp, Homo sapiens
tgtgcctgtggcag

SEQ ID NO: 342727 - DNA, 13 bp, Homo sapiens
tgtgcctttcact

SEQ ID NO: 342728 - DNA, 23 bp, Homo sapiens
tgtgcctttgggaggcagcatca

SEQ ID NO: 342729 - DNA, 16 bp, Homo sapiens
tgtgccttttatagct

SEQ ID NO: 342730 - DNA, 18 bp, Homo sapiens
tgtgccttttatagctat

SEQ ID NO: 342731 - DNA, 13 bp, Homo sapiens
tgtgcgtgaaaca

SEQ ID NO: 342732 - DNA, 15 bp, Homo sapiens
tgtgcgtgcatgtgc

SEQ ID NO: 342733 - DNA, 21 bp, Homo sapiens
tgtgcgtgtgtccatgtgtgt

SEQ ID NO: 342734 - DNA, 19 bp, Homo sapiens
tgtgctaatttctgtccag

SEQ ID NO: 342735 - DNA, 12 bp, Homo sapiens
tgtgctacagaa

SEQ ID NO: 342736 - DNA, 19 bp, Homo sapiens
tgtgctacagagaaaatca

SEQ ID NO: 342737 - DNA, 20 bp, Homo sapiens
tgtgctacagagaaaatcaa

SEQ ID NO: 342738 - DNA, 21 bp, Homo sapiens
tgtgctacagagaaaatcaaa

SEQ ID NO: 342739 - DNA, 14 bp, Homo sapiens
tgtgctacctctaa

SEQ ID NO: 342740 - DNA, 15 bp, Homo sapiens
tgtgctacctctaac

SEQ ID NO: 342741 - DNA, 14 bp, Homo sapiens
tgtgctagaatact

SEQ ID NO: 342742 - DNA, 16 bp, Homo sapiens
tgtgctagaatacttt

SEQ ID NO: 342743 - DNA, 18 bp, Homo sapiens
tgtgctagaatacttttt

SEQ ID NO: 342744 - DNA, 14 bp, Homo sapiens
tgtgctatgaattt

SEQ ID NO: 342745 - DNA, 14 bp, Homo sapiens
tgtgctcagataca

SEQ ID NO: 342746 - DNA, 22 bp, Homo sapiens
tgtgctccagcagtgctgggcc

SEQ ID NO: 342747 - DNA, 15 bp, Homo sapiens
tgtgctcggacacag

SEQ ID NO: 342748 - DNA, 16 bp, Homo sapiens
tgtgctcgggagtggc

SEQ ID NO: 342749 - DNA, 18 bp, Homo sapiens
tgtgctctttcctgccct

SEQ ID NO: 342750 - DNA, 22 bp, Homo sapiens
tgtgctgcatgcgacagcgtcc

SEQ ID NO: 342751 - DNA, 15 bp, Homo sapiens
tgtgctgctgtggca

SEQ ID NO: 342752 - DNA, 13 bp, Homo sapiens
tgtgctgggccag

SEQ ID NO: 342753 - DNA, 15 bp, Homo sapiens
tgtgctgtgcctgct

SEQ ID NO: 342754 - DNA, 19 bp, Homo sapiens
tgtgctgttgattctttca

SEQ ID NO: 342755 - DNA, 14 bp, Homo sapiens
tgtgcttgctccta

SEQ ID NO: 342756 - DNA, 14 bp, Homo sapiens
tgtgcttggggcta

SEQ ID NO: 342757 - DNA, 16 bp, Homo sapiens
tgtgcttgttcttcct

SEQ ID NO: 342758 - DNA, 19 bp, Homo sapiens
tgtgcttgttcttcctctt

SEQ ID NO: 342759 - DNA, 23 bp, Homo sapiens
tgtgcttgtttacagcactactc

SEQ ID NO: 342760 - DNA, 19 bp, Homo sapiens
tgtgctttatgctgaaaca

SEQ ID NO: 342761 - DNA, 12 bp, Homo sapiens
tgtgctttgtag

SEQ ID NO: 342762 - DNA, 12 bp, Homo sapiens
tgtgcttttcca

SEQ ID NO: 342763 - DNA, 18 bp, Homo sapiens
tgtgcttttccatctaaa

SEQ ID NO: 342764 - DNA, 20 bp, Homo sapiens
tgtgcttttccatctaaaat

SEQ ID NO: 342765 - DNA, 14 bp, Homo sapiens
tgtgcttttcctat

SEQ ID NO: 342766 - DNA, 16 bp, Homo sapiens
tgtggaaagtgaattt

SEQ ID NO: 342767 - DNA, 23 bp, Homo sapiens
tgtggaaagtgaatttgaatgaa

SEQ ID NO: 342768 - DNA, 20 bp, Homo sapiens
tgtggaacactaaagagcta

SEQ ID NO: 342769 - DNA, 17 bp, Homo sapiens
tgtgtccataagagaaa

SEQ ID NO: 342770 - DNA, 16 bp, Homo sapiens
tgtgtccatgtgtgtg

SEQ ID NO: 342771 - DNA, 18 bp, Homo sapiens
tgtgtccatgtgtgtgca

SEQ ID NO: 342772 - DNA, 14 bp, Homo sapiens
tgtgtcccagcacc

SEQ ID NO: 342773 - DNA, 14 bp, Homo sapiens
tgtgtccctgtggt

SEQ ID NO: 342774 - DNA, 21 bp, Homo sapiens
tgtgtcggggggcgagggagg

SEQ ID NO: 342775 - DNA, 22 bp, Homo sapiens
tgtgtcggggggcgagggaggg

SEQ ID NO: 342776 - DNA, 14 bp, Homo sapiens
tgtgtctcatgcca

SEQ ID NO: 342777 - DNA, 23 bp, Homo sapiens
tgtgtctcatgccagcagcacgt

SEQ ID NO: 342778 - DNA, 21 bp, Homo sapiens
tgtgtctctatcttgcatcta

SEQ ID NO: 342779 - DNA, 15 bp, Homo sapiens
tgtgtctctgtatat

SEQ ID NO: 342780 - DNA, 15 bp, Homo sapiens
tgtgtctgcctgcct

SEQ ID NO: 342781 - DNA, 13 bp, Homo sapiens
tgtgtctgtattc

SEQ ID NO: 342782 - DNA, 14 bp, Homo sapiens
tgtgtctgtattca

SEQ ID NO: 342783 - DNA, 14 bp, Homo sapiens
tgtgtgaagaaatg

SEQ ID NO: 342784 - DNA, 18 bp, Homo sapiens
tgtgtgaaggtaactaag

SEQ ID NO: 342785 - DNA, 17 bp, Homo sapiens
tgtgtgaattctgcaac

SEQ ID NO: 342786 - DNA, 20 bp, Homo sapiens
tgtgtgaggagctgctggct

SEQ ID NO: 342787 - DNA, 13 bp, Homo sapiens
tgtgtgagtgtga

SEQ ID NO: 342788 - DNA, 15 bp, Homo sapiens
tgtgtgatgcgcctt

SEQ ID NO: 342789 - DNA, 16 bp, Homo sapiens
tgtgtgattgaatctg

SEQ ID NO: 342790 - DNA, 17 bp, Homo sapiens
tgtgtgcaccttaccaa

SEQ ID NO: 342791 - DNA, 22 bp, Homo sapiens
tgtgtgcaccttaccaactttc

SEQ ID NO: 342792 - DNA, 23 bp, Homo sapiens
tgtgtgcaccttaccaactttct

SEQ ID NO: 342793 - DNA, 21 bp, Homo sapiens
tgtgtgcagtctctcttaccc

SEQ ID NO: 342794 - DNA, 21 bp, Homo sapiens
tgtgtgccatagagtttaaca

SEQ ID NO: 342795 - DNA, 23 bp, Homo sapiens
tgtgtgccatagagtttaacaca

SEQ ID NO: 342796 - DNA, 15 bp, Homo sapiens
tgtgtgcctagtgat

SEQ ID NO: 342797 - DNA, 17 bp, Homo sapiens
tgtgtgctcatgtatgt

SEQ ID NO: 342798 - DNA, 22 bp, Homo sapiens
tgtgtgctcatgtatgtgcgaa

SEQ ID NO: 342799 - DNA, 12 bp, Homo sapiens
tgtgtggaccat

SEQ ID NO: 342800 - DNA, 16 bp, Homo sapiens
tgtgtggactgtgatg

SEQ ID NO: 342801 - DNA, 21 bp, Homo sapiens
tgtgtggagagggaatgtgaa

SEQ ID NO: 342802 - DNA, 9 bp, Homo sapiens
tgtgtggca

SEQ ID NO: 342803 - DNA, 14 bp, Homo sapiens
tgtgtggtcagtgg

SEQ ID NO: 342804 - DNA, 15 bp, Homo sapiens
tggctcactgcagcc

SEQ ID NO: 342805 - DNA, 16 bp, Homo sapiens
tggctcactgcagcct

SEQ ID NO: 342806 - DNA, 14 bp, Homo sapiens
tggctcaggcaagc

SEQ ID NO: 342807 - DNA, 19 bp, Homo sapiens
tggctcaggcaagcccctc

SEQ ID NO: 342808 - DNA, 21 bp, Homo sapiens
tggctcaggcaagcccctcag

SEQ ID NO: 342809 - DNA, 20 bp, Homo sapiens
tggctcagtgccacctatgc

SEQ ID NO: 342810 - DNA, 22 bp, Homo sapiens
tggctcatattcctgcagcctg

SEQ ID NO: 342811 - DNA, 22 bp, Homo sapiens
tggctcatggcgtaatgggcct

SEQ ID NO: 342812 - DNA, 23 bp, Homo sapiens
tggctcatggcgtaatgggcctg

SEQ ID NO: 342813 - DNA, 16 bp, Homo sapiens
tggctccacgccctgg

SEQ ID NO: 342814 - DNA, 18 bp, Homo sapiens
tggctccacgccctgggg

SEQ ID NO: 342815 - DNA, 15 bp, Homo sapiens
tggctccagtctgct

SEQ ID NO: 342816 - DNA, 23 bp, Homo sapiens
tggctccagtctgctgccctcca

SEQ ID NO: 342817 - DNA, 15 bp, Homo sapiens
tggctccatgctcct

SEQ ID NO: 342818 - DNA, 17 bp, Homo sapiens
tggctcccacaggccct

SEQ ID NO: 342819 - DNA, 14 bp, Homo sapiens
tggctcccaggaca

SEQ ID NO: 342820 - DNA, 14 bp, Homo sapiens
tggctcccatgacc

SEQ ID NO: 342821 - DNA, 19 bp, Homo sapiens
tggctccccacgagtcacc

SEQ ID NO: 342822 - DNA, 23 bp, Homo sapiens
tggctcccctctatttagcatga

SEQ ID NO: 342823 - DNA, 23 bp, Homo sapiens
tggctccgtggccccgccctcag

SEQ ID NO: 342824 - DNA, 16 bp, Homo sapiens
tggctcctatctgtgt

SEQ ID NO: 342825 - DNA, 18 bp, Homo sapiens
tggctcctatctgtgttt

SEQ ID NO: 342826 - DNA, 14 bp, Homo sapiens
tggctcctcaccac

SEQ ID NO: 342827 - DNA, 16 bp, Homo sapiens
tggctcctcccggtgc

SEQ ID NO: 342828 - DNA, 18 bp, Homo sapiens
tggctcctcccggtgccc

SEQ ID NO: 342829 - DNA, 17 bp, Homo sapiens
tggctcctgtctggctc

SEQ ID NO: 342830 - DNA, 13 bp, Homo sapiens
tggctcctgtgtg

SEQ ID NO: 342831 - DNA, 15 bp, Homo sapiens
tggctcctgtttcca

SEQ ID NO: 342832 - DNA, 13 bp, Homo sapiens
tggctcctttccc

SEQ ID NO: 342833 - DNA, 15 bp, Homo sapiens
tggctcctttcccac

SEQ ID NO: 342834 - DNA, 17 bp, Homo sapiens
tggctcggacccacccc

SEQ ID NO: 342835 - DNA, 20 bp, Homo sapiens
tggctcggacccaccccaac

SEQ ID NO: 342836 - DNA, 13 bp, Homo sapiens
tggctcgtgggct

SEQ ID NO: 342837 - DNA, 14 bp, Homo sapiens
tggctcgtgggctc

SEQ ID NO: 342838 - DNA, 15 bp, Homo sapiens
tggctcgtgggctct

SEQ ID NO: 342839 - DNA, 20 bp, Homo sapiens
tggctctgggtgaggtaggc

SEQ ID NO: 342840 - DNA, 18 bp, Homo sapiens
tggctctgtggcttgcta

SEQ ID NO: 342841 - DNA, 15 bp, Homo sapiens
tggctctttcagaga

SEQ ID NO: 342842 - DNA, 15 bp, Homo sapiens
tggctgaaaatcact

SEQ ID NO: 342843 - DNA, 14 bp, Homo sapiens
tgttatgataaaag

SEQ ID NO: 342844 - DNA, 21 bp, Homo sapiens
tgttattcaataactattgct

SEQ ID NO: 342845 - DNA, 16 bp, Homo sapiens
tgttattcttttccag

SEQ ID NO: 342846 - DNA, 13 bp, Homo sapiens
tgttattgaaaaa

SEQ ID NO: 342847 - DNA, 16 bp, Homo sapiens
tgttattgaaaaaaat

SEQ ID NO: 342848 - DNA, 15 bp, Homo sapiens
tgttattgtggaaga

SEQ ID NO: 342849 - DNA, 14 bp, Homo sapiens
tgttatttaaagaa

SEQ ID NO: 342850 - DNA, 17 bp, Homo sapiens
tgttatttgtacagttc

SEQ ID NO: 342851 - DNA, 15 bp, Homo sapiens
tgttattttcagcat

SEQ ID NO: 342852 - DNA, 22 bp, Homo sapiens
tgttatttttatatcagcctga

SEQ ID NO: 342853 - DNA, 17 bp, Homo sapiens
tgttcaaaatgttaata

SEQ ID NO: 342854 - DNA, 19 bp, Homo sapiens
tgttcaaactactgtacat

SEQ ID NO: 342855 - DNA, 13 bp, Homo sapiens
tgttcaacaagag

SEQ ID NO: 342856 - DNA, 13 bp, Homo sapiens
tgttcaagctttt

SEQ ID NO: 342857 - DNA, 16 bp, Homo sapiens
tgttcaagcttttcct

SEQ ID NO: 342858 - DNA, 11 bp, Homo sapiens
tgttcagaaga

SEQ ID NO: 342859 - DNA, 19 bp, Homo sapiens
tgttcagagttccacagtt

SEQ ID NO: 342860 - DNA, 14 bp, Homo sapiens
tgttcagtctttca

SEQ ID NO: 342861 - DNA, 17 bp, Homo sapiens
tgttcagtgtcccgggc

SEQ ID NO: 342862 - DNA, 14 bp, Homo sapiens
tgttcatgttttgc

SEQ ID NO: 342863 - DNA, 13 bp, Homo sapiens
tgttcattgtaat

SEQ ID NO: 342864 - DNA, 18 bp, Homo sapiens
tgttcattgtaatgttac

SEQ ID NO: 342865 - DNA, 16 bp, Homo sapiens
tgttcatttctgtctc

SEQ ID NO: 342866 - DNA, 17 bp, Homo sapiens
tgttcatttctgtctcc

SEQ ID NO: 342867 - DNA, 20 bp, Homo sapiens
tgttccaacagttaaacttg

SEQ ID NO: 342868 - DNA, 22 bp, Homo sapiens
tgttccaacagttaaacttgca

SEQ ID NO: 342869 - DNA, 23 bp, Homo sapiens
tgttccaacagttaaacttgcaa

SEQ ID NO: 342870 - DNA, 14 bp, Homo sapiens
tgttccaactgccc

SEQ ID NO: 342871 - DNA, 11 bp, Homo sapiens
tgttccaagac

SEQ ID NO: 342872 - DNA, 14 bp, Homo sapiens
tgttccaagacatt

SEQ ID NO: 342873 - DNA, 18 bp, Homo sapiens
tgttccaagacattgtca

SEQ ID NO: 342874 - DNA, 21 bp, Homo sapiens
tgttccaagtgtgtgtgcaat

SEQ ID NO: 342875 - DNA, 22 bp, Homo sapiens
tgttccagactcaggttccaga

SEQ ID NO: 342876 - DNA, 19 bp, Homo sapiens
tgttccatcctgtacaagt

SEQ ID NO: 342877 - DNA, 16 bp, Homo sapiens
tgttcccattcttgca

SEQ ID NO: 342878 - DNA, 15 bp, Homo sapiens
tgttcccctaagtgg

SEQ ID NO: 342879 - DNA, 18 bp, Homo sapiens
tgttcccctaagtggatt

SEQ ID NO: 342880 - DNA, 14 bp, Homo sapiens
tgttcccctcactg

SEQ ID NO: 342881 - DNA, 21 bp, Homo sapiens
tgttcccctcactggatgaaa

SEQ ID NO: 342882 - DNA, 14 bp, Homo sapiens
tgttccctccaagg

SEQ ID NO: 342883 - DNA, 19 bp, Homo sapiens
tgttccctctgctcctgga

SEQ ID NO: 342884 - DNA, 12 bp, Homo sapiens
tgttccctgcac

SEQ ID NO: 342885 - DNA, 21 bp, Homo sapiens
tgttttttttttttgtatttc

SEQ ID NO: 342886 - DNA, 22 bp, Homo sapiens
tgttttttttttttgtatttct

SEQ ID NO: 342887 - DNA, 21 bp, Homo sapiens
tgttttttttttttttttaat

SEQ ID NO: 342888 - DNA, 19 bp, Homo sapiens
ttaaaaaaaggaaaactca

SEQ ID NO: 342889 - DNA, 20 bp, Homo sapiens
ttaaaaaaataatataaatg

SEQ ID NO: 342890 - DNA, 13 bp, Homo sapiens
ttaaaaaataaca

SEQ ID NO: 342891 - DNA, 14 bp, Homo sapiens
ttaaaaaataacat

SEQ ID NO: 342892 - DNA, 14 bp, Homo sapiens
ttaaaaaatagttg

SEQ ID NO: 342893 - DNA, 18 bp, Homo sapiens
ttaaaaaatgaatagtac

SEQ ID NO: 342894 - DNA, 17 bp, Homo sapiens
ttaaaaaatttttgaaa

SEQ ID NO: 342895 - DNA, 23 bp, Homo sapiens
ttaaaaacacctaagtgactacc

SEQ ID NO: 342896 - DNA, 13 bp, Homo sapiens
ttaaaaactggaa

SEQ ID NO: 342897 - DNA, 13 bp, Homo sapiens
ttaaaaaggcctt

SEQ ID NO: 342898 - DNA, 16 bp, Homo sapiens
ttaaaaagtctgcatt

SEQ ID NO: 342899 - DNA, 17 bp, Homo sapiens
ttaaaaagtctgcatta

SEQ ID NO: 342900 - DNA, 14 bp, Homo sapiens
ttaaaaagtcttca

SEQ ID NO: 342901 - DNA, 19 bp, Homo sapiens
ttaaaaagttgcacattag

SEQ ID NO: 342902 - DNA, 20 bp, Homo sapiens
ttaaaaatatggaacttcta

SEQ ID NO: 342903 - DNA, 14 bp, Homo sapiens
ttaaaaatatgtga

SEQ ID NO: 342904 - DNA, 17 bp, Homo sapiens
ttaaaaatgtaaatatt

SEQ ID NO: 342905 - DNA, 20 bp, Homo sapiens
ttaaaaattatctttaaaac

SEQ ID NO: 342906 - DNA, 15 bp, Homo sapiens
ttaaaacaaattaaa

SEQ ID NO: 342907 - DNA, 20 bp, Homo sapiens
ttaaaacaagaaagtttccc

SEQ ID NO: 342908 - DNA, 19 bp, Homo sapiens
ttaaaactaggcatttgta

SEQ ID NO: 342909 - DNA, 23 bp, Homo sapiens
ttaaaacttaaccgcatcagaag

SEQ ID NO: 342910 - DNA, 14 bp, Homo sapiens
ttaaaacttcatct

SEQ ID NO: 342911 - DNA, 14 bp, Homo sapiens
ttaaaactttaatc

SEQ ID NO: 342912 - DNA, 22 bp, Homo sapiens
ttaaaagaaagggttctgtaaa

SEQ ID NO: 342913 - DNA, 16 bp, Homo sapiens
ttaaaagaagactgga

SEQ ID NO: 342914 - DNA, 15 bp, Homo sapiens
ttaaaagacaaacac

SEQ ID NO: 342915 - DNA, 14 bp, Homo sapiens
ttaaaagacatttt

SEQ ID NO: 342916 - DNA, 16 bp, Homo sapiens
ttaaaagaggaaatta

SEQ ID NO: 342917 - DNA, 18 bp, Homo sapiens
ttaaaagaggaaattaaa

SEQ ID NO: 342918 - DNA, 20 bp, Homo sapiens
ttaaaagcacaagcgtgttt

SEQ ID NO: 342919 - DNA, 19 bp, Homo sapiens
ttaaaagcatatataaaac

SEQ ID NO: 342920 - DNA, 14 bp, Homo sapiens
ttaaaagtattcat

SEQ ID NO: 342921 - DNA, 17 bp, Homo sapiens
ttaaaagtttcaatgtg

SEQ ID NO: 342922 - DNA, 22 bp, Homo sapiens
ttaaaagtttcaatgtgattct

SEQ ID NO: 342923 - DNA, 16 bp, Homo sapiens
ttaaaagtttgtcctt

SEQ ID NO: 342924 - DNA, 19 bp, Homo sapiens
ttaaaataaacagttgtga

SEQ ID NO: 342925 - DNA, 20 bp, Homo sapiens
ttaaaataaacagttgtgaa

SEQ ID NO: 342926 - DNA, 14 bp, Homo sapiens
ttaaaataagtgaa

SEQ ID NO: 342927 - DNA, 18 bp, Homo sapiens
ttaaaatataaattaaga

SEQ ID NO: 342928 - DNA, 18 bp, Homo sapiens
ttaaaatcagactcttta

SEQ ID NO: 342929 - DNA, 23 bp, Homo sapiens
ttaaaatgattcacttttattgt

SEQ ID NO: 342930 - DNA, 18 bp, Homo sapiens
ttaaaatgcattgaaaga

SEQ ID NO: 342931 - DNA, 21 bp, Homo sapiens
ttaaaatgcattgaaagaatt

SEQ ID NO: 342932 - DNA, 19 bp, Homo sapiens
ttaaaatggtttgtcctga

SEQ ID NO: 342933 - DNA, 21 bp, Homo sapiens
ttaaaatggtttgtcctgatg

SEQ ID NO: 342934 - DNA, 16 bp, Homo sapiens
ttaaaatgtagaagaa

SEQ ID NO: 342935 - DNA, 17 bp, Homo sapiens
ttaaaatgtagaagaaa

SEQ ID NO: 342936 - DNA, 21 bp, Homo sapiens
ttaaaatgtagaagaaagcaa

SEQ ID NO: 342937 - DNA, 18 bp, Homo sapiens
ttaaaatgttggtgcaat

SEQ ID NO: 342938 - DNA, 14 bp, Homo sapiens
ttaaaattggcacc

SEQ ID NO: 342939 - DNA, 20 bp, Homo sapiens
ttaaacaaaatagaagctgt

SEQ ID NO: 342940 - DNA, 14 bp, Homo sapiens
ttaaacaaagtgac

SEQ ID NO: 342941 - DNA, 11 bp, Homo sapiens
ttaaacacctg

SEQ ID NO: 342942 - DNA, 14 bp, Homo sapiens
ttaaacacctgaca

SEQ ID NO: 342943 - DNA, 21 bp, Homo sapiens
ttaaacatcattggataaatt

SEQ ID NO: 342944 - DNA, 17 bp, Homo sapiens
ttaaacatgaatttaat

SEQ ID NO: 342945 - DNA, 20 bp, Homo sapiens
ttaaaccaaacggaactctt

SEQ ID NO: 342946 - DNA, 23 bp, Homo sapiens
ttaaacccacaagctgcctctga

SEQ ID NO: 342947 - DNA, 15 bp, Homo sapiens
ttaaactaaaataca

SEQ ID NO: 342948 - DNA, 16 bp, Homo sapiens
ttaaactataggtaat

SEQ ID NO: 342949 - DNA, 18 bp, Homo sapiens
ttaaactattcagaggaa

SEQ ID NO: 342950 - DNA, 13 bp, Homo sapiens
ttaaactcttaga

SEQ ID NO: 342951 - DNA, 15 bp, Homo sapiens
ttaaactgtatgtct

SEQ ID NO: 342952 - DNA, 20 bp, Homo sapiens
ttaaactgtgtggactgtga

SEQ ID NO: 342953 - DNA, 13 bp, Homo sapiens
ttaaacttgaact

SEQ ID NO: 342954 - DNA, 12 bp, Homo sapiens
ttaaacttgcaa

SEQ ID NO: 342955 - DNA, 16 bp, Homo sapiens
ttaaacttgtcagaat

SEQ ID NO: 342956 - DNA, 18 bp, Homo sapiens
ttaaagaaaatgtgtctg

SEQ ID NO: 342957 - DNA, 16 bp, Homo sapiens
ttaaagaaaggcagag

SEQ ID NO: 342958 - DNA, 12 bp, Homo sapiens
ttaaagacttga

SEQ ID NO: 342959 - DNA, 17 bp, Homo sapiens
ttaaagacttgatgaat

SEQ ID NO: 342960 - DNA, 20 bp, Homo sapiens
ttaaagaggcgtcttgtatt

SEQ ID NO: 342961 - DNA, 16 bp, Homo sapiens
ttaaagcacatgccag

SEQ ID NO: 342962 - DNA, 17 bp, Homo sapiens
ttaaagctgcctgtagt

SEQ ID NO: 342963 - DNA, 13 bp, Homo sapiens
ttaaagctgtttc

SEQ ID NO: 342964 - DNA, 21 bp, Homo sapiens
ttaaagctgtttctaaacagt

SEQ ID NO: 342965 - DNA, 17 bp, Homo sapiens
ttaaagcttttgatgtg

SEQ ID NO: 342966 - DNA, 15 bp, Homo sapiens
ttaaaggaacacgtg

SEQ ID NO: 342967 - DNA, 14 bp, Homo sapiens
ttaaaggacaaaca

SEQ ID NO: 342968 - DNA, 17 bp, Homo sapiens
ttaaaggacaaacagtg

SEQ ID NO: 342969 - DNA, 15 bp, Homo sapiens
ttaaaggctgtggta

SEQ ID NO: 342970 - DNA, 16 bp, Homo sapiens
ttaaagggcagatatt

SEQ ID NO: 342971 - DNA, 16 bp, Homo sapiens
ttaaaggtcctgccct

SEQ ID NO: 342972 - DNA, 13 bp, Homo sapiens
ttaaataaaacta

SEQ ID NO: 342973 - DNA, 13 bp, Homo sapiens
ttaaataaaagtg

SEQ ID NO: 342974 - DNA, 21 bp, Homo sapiens
ttaaataaagtatcatgcatt

SEQ ID NO: 342975 - DNA, 15 bp, Homo sapiens
ttaaataaatcataa

SEQ ID NO: 342976 - DNA, 10 bp, Homo sapiens
ttaaataatt

SEQ ID NO: 342977 - DNA, 17 bp, Homo sapiens
ttaaatacagacactaa

SEQ ID NO: 342978 - DNA, 13 bp, Homo sapiens
ttaaataccagta

SEQ ID NO: 342979 - DNA, 16 bp, Homo sapiens
ttaaataccagtactt

SEQ ID NO: 342980 - DNA, 13 bp, Homo sapiens
ttaaatataattc

SEQ ID NO: 342981 - DNA, 16 bp, Homo sapiens
ttaaatataattctgt

SEQ ID NO: 342982 - DNA, 17 bp, Homo sapiens
ttaaatataattctgta

SEQ ID NO: 342983 - DNA, 22 bp, Homo sapiens
ttaaatatatgtatgtaaaaat

SEQ ID NO: 342984 - DNA, 22 bp, Homo sapiens
ttaaatatcagtagaaactcta

SEQ ID NO: 342985 - DNA, 17 bp, Homo sapiens
ttaaatatcattctttg

SEQ ID NO: 342986 - DNA, 11 bp, Homo sapiens
ttaaatcactg

SEQ ID NO: 342987 - DNA, 16 bp, Homo sapiens
ttaaatcagttttgtg

SEQ ID NO: 342988 - DNA, 20 bp, Homo sapiens
ttaaatcagttttgtgtaca

SEQ ID NO: 342989 - DNA, 19 bp, Homo sapiens
ttaaatcattttaacttct

SEQ ID NO: 342990 - DNA, 21 bp, Homo sapiens
ttaaatccagtggggaaaaaa

SEQ ID NO: 342991 - DNA, 17 bp, Homo sapiens
ttaaatcctaccaaagt

SEQ ID NO: 342992 - DNA, 15 bp, Homo sapiens
ttaaatgaaagcatg

SEQ ID NO: 342993 - DNA, 12 bp, Homo sapiens
ttaaatgaaata

SEQ ID NO: 342994 - DNA, 21 bp, Homo sapiens
ttaaatgatgtacaggcagat

SEQ ID NO: 342995 - DNA, 16 bp, Homo sapiens
ttaaatggcacctgta

SEQ ID NO: 342996 - DNA, 18 bp, Homo sapiens
ttaaatggcacctgtata

SEQ ID NO: 342997 - DNA, 23 bp, Homo sapiens
ttaaatgttctaacagatcagaa

SEQ ID NO: 342998 - DNA, 14 bp, Homo sapiens
ttaaatgtttgttg

SEQ ID NO: 342999 - DNA, 12 bp, Homo sapiens
ttaaattaaaca

SEQ ID NO: 343000 - DNA, 12 bp, Homo sapiens
ttaaattataag

SEQ ID NO: 343001 - DNA, 14 bp, Homo sapiens
ttaaattataagga

SEQ ID NO: 343002 - DNA, 17 bp, Homo sapiens
ttaaattataaggactg

SEQ ID NO: 343003 - DNA, 14 bp, Homo sapiens
ttaaattatatgat

SEQ ID NO: 343004 - DNA, 15 bp, Homo sapiens
ttaaattctcagtca

SEQ ID NO: 343005 - DNA, 14 bp, Homo sapiens
ttaaattctccaac

SEQ ID NO: 343006 - DNA, 17 bp, Homo sapiens
ttaaattctgctcctga

SEQ ID NO: 343007 - DNA, 19 bp, Homo sapiens
ttaaattgcttttgttgtg

SEQ ID NO: 343008 - DNA, 16 bp, Homo sapiens
ttaaattttcacctgt

SEQ ID NO: 343009 - DNA, 20 bp, Homo sapiens
ttaaattttgagttctacat

SEQ ID NO: 343010 - DNA, 20 bp, Homo sapiens
ttaacaaaacaagaaagaaa

SEQ ID NO: 343011 - DNA, 18 bp, Homo sapiens
ttaacaaccctgttgagt

SEQ ID NO: 343012 - DNA, 20 bp, Homo sapiens
ttaacaactgactaaccatt

SEQ ID NO: 343013 - DNA, 16 bp, Homo sapiens
ttatcttgtgtatgga

SEQ ID NO: 343014 - DNA, 22 bp, Homo sapiens
ttatcttgtgtatggatatgtg

SEQ ID NO: 343015 - DNA, 18 bp, Homo sapiens
ttatgaaaggtttacatt

SEQ ID NO: 343016 - DNA, 11 bp, Homo sapiens
ttatgaaatgg

SEQ ID NO: 343017 - DNA, 22 bp, Homo sapiens
ttatgaactgcatgtataaatg

SEQ ID NO: 343018 - DNA, 17 bp, Homo sapiens
ttatgaatatttataac

SEQ ID NO: 343019 - DNA, 14 bp, Homo sapiens
ttatgaatgaaaaa

SEQ ID NO: 343020 - DNA, 15 bp, Homo sapiens
ttatgacctcaacaa

SEQ ID NO: 343021 - DNA, 16 bp, Homo sapiens
ttatgagaactggttc

SEQ ID NO: 343022 - DNA, 15 bp, Homo sapiens
ttatgagtaactatt

SEQ ID NO: 343023 - DNA, 13 bp, Homo sapiens
ttatgagtttttg

SEQ ID NO: 343024 - DNA, 16 bp, Homo sapiens
ttatgataaaaggaag

SEQ ID NO: 343025 - DNA, 22 bp, Homo sapiens
ttatgatattctcattatttca

SEQ ID NO: 343026 - DNA, 14 bp, Homo sapiens
ttatgatttcatga

SEQ ID NO: 343027 - DNA, 16 bp, Homo sapiens
ttatgatttcatgatt

SEQ ID NO: 343028 - DNA, 14 bp, Homo sapiens
ttatgcacatttgt

SEQ ID NO: 343029 - DNA, 20 bp, Homo sapiens
ttatgcagagtcagccattc

SEQ ID NO: 343030 - DNA, 20 bp, Homo sapiens
ttatgcatgagaactaaata

SEQ ID NO: 343031 - DNA, 18 bp, Homo sapiens
ttatgccatttgtttatt

SEQ ID NO: 343032 - DNA, 22 bp, Homo sapiens
ttatgctaacaaactgaaaaat

SEQ ID NO: 343033 - DNA, 14 bp, Homo sapiens
ttatgctcagggtc

SEQ ID NO: 343034 - DNA, 14 bp, Homo sapiens
ttatgctgctgtga

SEQ ID NO: 343035 - DNA, 17 bp, Homo sapiens
ttatgggaacaagtgta

SEQ ID NO: 343036 - DNA, 22 bp, Homo sapiens
ttatgggaacaagtgtacagaa

SEQ ID NO: 343037 - DNA, 11 bp, Homo sapiens
ttatgggtcac

SEQ ID NO: 343038 - DNA, 13 bp, Homo sapiens
ttatgggtcacag

SEQ ID NO: 343039 - DNA, 15 bp, Homo sapiens
ttatgggtcacagga

SEQ ID NO: 343040 - DNA, 16 bp, Homo sapiens
ttatggtacactccag

SEQ ID NO: 343041 - DNA, 21 bp, Homo sapiens
ttatggtattttcgtgcattt

SEQ ID NO: 343042 - DNA, 23 bp, Homo sapiens
ttatggtattttcgtgcatttgt

SEQ ID NO: 343043 - DNA, 13 bp, Homo sapiens
ttatggtgaaatt

SEQ ID NO: 343044 - DNA, 14 bp, Homo sapiens
ttatgtactgctgt

SEQ ID NO: 343045 - DNA, 16 bp, Homo sapiens
ttatgtagatgtgcat

SEQ ID NO: 343046 - DNA, 16 bp, Homo sapiens
ttatgtcaaatggatg

SEQ ID NO: 343047 - DNA, 14 bp, Homo sapiens
ttatgtcagcagct

SEQ ID NO: 343048 - DNA, 16 bp, Homo sapiens
ttatgtcagcagctct

SEQ ID NO: 343049 - DNA, 11 bp, Homo sapiens
ttatgtcatac

SEQ ID NO: 343050 - DNA, 23 bp, Homo sapiens
ttatgtcatactctgtgtaatct

SEQ ID NO: 343051 - DNA, 23 bp, Homo sapiens
ttatgtgaatgatctctctgaat

SEQ ID NO: 343052 - DNA, 23 bp, Homo sapiens
ttatgtgacaacctttgtgtaat

SEQ ID NO: 343053 - DNA, 15 bp, Homo sapiens
ttatgtggcttttat

SEQ ID NO: 343054 - DNA, 19 bp, Homo sapiens
ttatgtttaagtgcttggt

SEQ ID NO: 343055 - DNA, 15 bp, Homo sapiens
ttatgtttacctcac

SEQ ID NO: 343056 - DNA, 22 bp, Homo sapiens
ttatgtttacctcactggtgca

SEQ ID NO: 343057 - DNA, 13 bp, Homo sapiens
ttatgtttgtaat

SEQ ID NO: 343058 - DNA, 18 bp, Homo sapiens
ttatgtttgtaatctgta

SEQ ID NO: 343059 - DNA, 20 bp, Homo sapiens
ttattaaaatgattgtaaaa

SEQ ID NO: 343060 - DNA, 15 bp, Homo sapiens
ttattaaacttcagc

SEQ ID NO: 343061 - DNA, 19 bp, Homo sapiens
ttattaaatcagttttgtg

SEQ ID NO: 343062 - DNA, 22 bp, Homo sapiens
ttattaagcaaccttaaagcaa

SEQ ID NO: 343063 - DNA, 22 bp, Homo sapiens
ttattaagtctgggatgtagaa

SEQ ID NO: 343064 - DNA, 23 bp, Homo sapiens
ttattaagtctgggatgtagaac

SEQ ID NO: 343065 - DNA, 15 bp, Homo sapiens
ttattaatgctaagg

SEQ ID NO: 343066 - DNA, 14 bp, Homo sapiens
ttattaattcatta

SEQ ID NO: 343067 - DNA, 19 bp, Homo sapiens
ttattacatctttattaac

SEQ ID NO: 343068 - DNA, 18 bp, Homo sapiens
ttattacattagttaaga

SEQ ID NO: 343069 - DNA, 13 bp, Homo sapiens
ttattacctctga

SEQ ID NO: 343070 - DNA, 15 bp, Homo sapiens
ttattacctctgata

SEQ ID NO: 343071 - DNA, 14 bp, Homo sapiens
ttattactttttaa

SEQ ID NO: 343072 - DNA, 12 bp, Homo sapiens
ttattagctgta

SEQ ID NO: 343073 - DNA, 16 bp, Homo sapiens
ttattatctaaagtgt

SEQ ID NO: 343074 - DNA, 13 bp, Homo sapiens
ttattatgtagct

SEQ ID NO: 343075 - DNA, 21 bp, Homo sapiens
ttattcactctcccagaggct

SEQ ID NO: 343076 - DNA, 21 bp, Homo sapiens
ttattcactgaagttctcctg

SEQ ID NO: 343077 - DNA, 15 bp, Homo sapiens
ttattcagcttcatt

SEQ ID NO: 343078 - DNA, 18 bp, Homo sapiens
ttattcagttaagaaaaa

SEQ ID NO: 343079 - DNA, 12 bp, Homo sapiens
ttattcatttaa

SEQ ID NO: 343080 - DNA, 18 bp, Homo sapiens
ttattcatttaaaatgat

SEQ ID NO: 343081 - DNA, 16 bp, Homo sapiens
ttattctagtcaactg

SEQ ID NO: 343082 - DNA, 20 bp, Homo sapiens
ttattctagtcaactgctgt

SEQ ID NO: 343083 - DNA, 16 bp, Homo sapiens
ttattcttattactat

SEQ ID NO: 343084 - DNA, 16 bp, Homo sapiens
ttattcttgctgggca

SEQ ID NO: 343085 - DNA, 13 bp, Homo sapiens
ttattctttgaga

SEQ ID NO: 343086 - DNA, 16 bp, Homo sapiens
ttattcttttccagaa

SEQ ID NO: 343087 - DNA, 19 bp, Homo sapiens
ttattgaagatgtccccca

SEQ ID NO: 343088 - DNA, 19 bp, Homo sapiens
ttattgaagatttaccata

SEQ ID NO: 343089 - DNA, 14 bp, Homo sapiens
ttattgagttctga

SEQ ID NO: 343090 - DNA, 18 bp, Homo sapiens
ttattgagttctgaaggt

SEQ ID NO: 343091 - DNA, 18 bp, Homo sapiens
ttattgatctttgcccat

SEQ ID NO: 343092 - DNA, 15 bp, Homo sapiens
ttattgatgtgaaat

SEQ ID NO: 343093 - DNA, 17 bp, Homo sapiens
ttattgatgtgaaatta

SEQ ID NO: 343094 - DNA, 15 bp, Homo sapiens
ttattgattaagtat

SEQ ID NO: 343095 - DNA, 21 bp, Homo sapiens
ttattgattttctttctaatt

SEQ ID NO: 343096 - DNA, 14 bp, Homo sapiens
ttattgctattaaa

SEQ ID NO: 343097 - DNA, 14 bp, Homo sapiens
ttattgcttaatcc

SEQ ID NO: 343098 - DNA, 13 bp, Homo sapiens
ttattgcttttat

SEQ ID NO: 343099 - DNA, 13 bp, Homo sapiens
ttattggaattaa

SEQ ID NO: 343100 - DNA, 19 bp, Homo sapiens
ttattgggcaagtgattga

SEQ ID NO: 343101 - DNA, 20 bp, Homo sapiens
ttattgggcaagtgattgaa

SEQ ID NO: 343102 - DNA, 12 bp, Homo sapiens
ttattgtaaact

SEQ ID NO: 343103 - DNA, 15 bp, Homo sapiens
ttattgtaaactttt

SEQ ID NO: 343104 - DNA, 14 bp, Homo sapiens
ttattgtacctctc

SEQ ID NO: 343105 - DNA, 19 bp, Homo sapiens
ttattgttccaagacattg

SEQ ID NO: 343106 - DNA, 22 bp, Homo sapiens
ttattgttccaagacattgtca

SEQ ID NO: 343107 - DNA, 18 bp, Homo sapiens
ttatttaatttcataaat

SEQ ID NO: 343108 - DNA, 17 bp, Homo sapiens
ttatttactgagcttct

SEQ ID NO: 343109 - DNA, 15 bp, Homo sapiens
ttatttataacattg

SEQ ID NO: 343110 - DNA, 15 bp, Homo sapiens
ttatttattaaactt

SEQ ID NO: 343111 - DNA, 13 bp, Homo sapiens
ttatttattattg

SEQ ID NO: 343112 - DNA, 17 bp, Homo sapiens
ttatttattcagcttca

SEQ ID NO: 343113 - DNA, 14 bp, Homo sapiens
ttatttatttattg

SEQ ID NO: 343114 - DNA, 13 bp, Homo sapiens
ttatttcatcatg

SEQ ID NO: 343115 - DNA, 17 bp, Homo sapiens
ttatttccaaataaaat

SEQ ID NO: 343116 - DNA, 15 bp, Homo sapiens
ttatttctaaaacat

SEQ ID NO: 343117 - DNA, 12 bp, Homo sapiens
ttatttctaaat

SEQ ID NO: 343118 - DNA, 13 bp, Homo sapiens
ttatttctaaatc

SEQ ID NO: 343119 - DNA, 19 bp, Homo sapiens
ttatttctccatcccctcc

SEQ ID NO: 343120 - DNA, 14 bp, Homo sapiens
ttatttgacaaaat

SEQ ID NO: 343121 - DNA, 16 bp, Homo sapiens
ttatttgataacattt

SEQ ID NO: 343122 - DNA, 13 bp, Homo sapiens
ttatttgatctgg

SEQ ID NO: 343123 - DNA, 23 bp, Homo sapiens
ttatttggagtggaggcattgtt

SEQ ID NO: 343124 - DNA, 14 bp, Homo sapiens
ttattttaaacaaa

SEQ ID NO: 343125 - DNA, 12 bp, Homo sapiens
ttattttagcag

SEQ ID NO: 343126 - DNA, 16 bp, Homo sapiens
ttattttattattcag

SEQ ID NO: 343127 - DNA, 18 bp, Homo sapiens
ttattttattttagcagt

SEQ ID NO: 343128 - DNA, 16 bp, Homo sapiens
ttattttcaagcaaat

SEQ ID NO: 343129 - DNA, 14 bp, Homo sapiens
ttattttcagcatg

SEQ ID NO: 343130 - DNA, 12 bp, Homo sapiens
ttattttcagta

SEQ ID NO: 343131 - DNA, 19 bp, Homo sapiens
ttattttggaaagaagaaa

SEQ ID NO: 343132 - DNA, 18 bp, Homo sapiens
ttattttgtattacatct

SEQ ID NO: 343133 - DNA, 22 bp, Homo sapiens
ttattttgtattacatctaatg

SEQ ID NO: 343134 - DNA, 13 bp, Homo sapiens
ttatttttacgta

SEQ ID NO: 343135 - DNA, 23 bp, Homo sapiens
ttatttttgtttcttccaaagca

SEQ ID NO: 343136 - DNA, 13 bp, Homo sapiens
ttattttttattg

SEQ ID NO: 343137 - DNA, 22 bp, Homo sapiens
ttatttttttgatggctaagat

SEQ ID NO: 343138 - DNA, 15 bp, Homo sapiens
ttcaaaaaaaaaata

SEQ ID NO: 343139 - DNA, 17 bp, Homo sapiens
ttcaaaaaaacactagt

SEQ ID NO: 343140 - DNA, 18 bp, Homo sapiens
ttcaaaaaaacactagtt

SEQ ID NO: 343141 - DNA, 17 bp, Homo sapiens
ttcaaaaagtgtttatt

SEQ ID NO: 343142 - DNA, 16 bp, Homo sapiens
ttcaaaactagttctt

SEQ ID NO: 343143 - DNA, 12 bp, Homo sapiens
ttcaaaactttc

SEQ ID NO: 343144 - DNA, 13 bp, Homo sapiens
ttcaaaactttca

SEQ ID NO: 343145 - DNA, 14 bp, Homo sapiens
ttcaaaactttcag

SEQ ID NO: 343146 - DNA, 19 bp, Homo sapiens
ttcaaaagccataacttga

SEQ ID NO: 343147 - DNA, 15 bp, Homo sapiens
ttcaaaatacttctt

SEQ ID NO: 343148 - DNA, 17 bp, Homo sapiens
ttcaaaatagttctatt

SEQ ID NO: 343149 - DNA, 18 bp, Homo sapiens
ttcagcacccccacccac

SEQ ID NO: 343150 - DNA, 21 bp, Homo sapiens
ttcagcacccccacccacctc

SEQ ID NO: 343151 - DNA, 13 bp, Homo sapiens
ttcagcactgtcc

SEQ ID NO: 343152 - DNA, 15 bp, Homo sapiens
ttcagcactgtccct

SEQ ID NO: 343153 - DNA, 17 bp, Homo sapiens
ttcagcagcgtgcaata

SEQ ID NO: 343154 - DNA, 22 bp, Homo sapiens
ttcagcaggggtgggaggctcc

SEQ ID NO: 343155 - DNA, 18 bp, Homo sapiens
ttcagcatcaaacatgaa

SEQ ID NO: 343156 - DNA, 22 bp, Homo sapiens
ttcagcatgaaaatgtgtgttt

SEQ ID NO: 343157 - DNA, 18 bp, Homo sapiens
ttcagcattaggctttta

SEQ ID NO: 343158 - DNA, 19 bp, Homo sapiens
ttcagcctcattcactgtc

SEQ ID NO: 343159 - DNA, 18 bp, Homo sapiens
ttcagcgagacccttgca

SEQ ID NO: 343160 - DNA, 16 bp, Homo sapiens
ttcagctgcttctctt

SEQ ID NO: 343161 - DNA, 16 bp, Homo sapiens
ttcagctggcagagtt

SEQ ID NO: 343162 - DNA, 20 bp, Homo sapiens
ttcagctggtggatggtgac

SEQ ID NO: 343163 - DNA, 23 bp, Homo sapiens
ttcagctggtggatggtgacttt

SEQ ID NO: 343164 - DNA, 20 bp, Homo sapiens
ttcagctgtgaacatggact

SEQ ID NO: 343165 - DNA, 21 bp, Homo sapiens
ttcaggaaaaatgcttttgtg

SEQ ID NO: 343166 - DNA, 14 bp, Homo sapiens
ttcaggaagggaga

SEQ ID NO: 343167 - DNA, 19 bp, Homo sapiens
ttcaggaccccatctgctg

SEQ ID NO: 343168 - DNA, 14 bp, Homo sapiens
ttcaggacccttct

SEQ ID NO: 343169 - DNA, 20 bp, Homo sapiens
ttcaggagagtaaaaattca

SEQ ID NO: 343170 - DNA, 17 bp, Homo sapiens
ttcaggagcgcaagata

SEQ ID NO: 343171 - DNA, 12 bp, Homo sapiens
ttcaggagggat

SEQ ID NO: 343172 - DNA, 18 bp, Homo sapiens
ttcaggagtttgagacca

SEQ ID NO: 343173 - DNA, 20 bp, Homo sapiens
ttcaggatgcacggtttctg

SEQ ID NO: 343174 - DNA, 16 bp, Homo sapiens
ttcaggcaaggcagct

SEQ ID NO: 343175 - DNA, 17 bp, Homo sapiens
ttcaggcacatgtgttc

SEQ ID NO: 343176 - DNA, 18 bp, Homo sapiens
ttcaggcacatgtgttca

SEQ ID NO: 343177 - DNA, 18 bp, Homo sapiens
ttcagggcagggctctga

SEQ ID NO: 343178 - DNA, 17 bp, Homo sapiens
ttcaggggactcagccc

SEQ ID NO: 343179 - DNA, 19 bp, Homo sapiens
ttcaggggactcagccctg

SEQ ID NO: 343180 - DNA, 20 bp, Homo sapiens
ttcaggggactcagccctga

SEQ ID NO: 343181 - DNA, 23 bp, Homo sapiens
ttcaggggactcagccctgaggt

SEQ ID NO: 343182 - DNA, 13 bp, Homo sapiens
ttcagggggccag

SEQ ID NO: 343183 - DNA, 22 bp, Homo sapiens
ttcagggggcctttaaagactt

SEQ ID NO: 343184 - DNA, 16 bp, Homo sapiens
ttcagggtatcccaga

SEQ ID NO: 343185 - DNA, 21 bp, Homo sapiens
ttcaggtaggcccttgtcctg

SEQ ID NO: 343186 - DNA, 14 bp, Homo sapiens
ttcaggtcagggct

SEQ ID NO: 343187 - DNA, 20 bp, Homo sapiens
ttcaggtcccacgtctggcc

SEQ ID NO: 343188 - DNA, 17 bp, Homo sapiens
ttcagtaaataatgaaa

SEQ ID NO: 343189 - DNA, 21 bp, Homo sapiens
ttcagtacacttggtgtactg

SEQ ID NO: 343190 - DNA, 22 bp, Homo sapiens
ttcagtacacttggtgtactgg

SEQ ID NO: 343191 - DNA, 13 bp, Homo sapiens
ttcagtaccaaag

SEQ ID NO: 343192 - DNA, 17 bp, Homo sapiens
ttcagtaccaaagaaac

SEQ ID NO: 343193 - DNA, 15 bp, Homo sapiens
ttcagtatactgtgt

SEQ ID NO: 343194 - DNA, 15 bp, Homo sapiens
ttcagtatcaaggct

SEQ ID NO: 343195 - DNA, 16 bp, Homo sapiens
ttcagtatcaaggctg

SEQ ID NO: 343196 - DNA, 22 bp, Homo sapiens
ttcagtatcaaggctgcctgga

SEQ ID NO: 343197 - DNA, 21 bp, Homo sapiens
ttcagtattaaactctccttt

SEQ ID NO: 343198 - DNA, 21 bp, Homo sapiens
ttcagtattttggagaaatta

SEQ ID NO: 343199 - DNA, 21 bp, Homo sapiens
ttcagtccctgagcagtctac

SEQ ID NO: 343200 - DNA, 13 bp, Homo sapiens
ttcagtctttcat

SEQ ID NO: 343201 - DNA, 21 bp, Homo sapiens
ttcagtgagcccctccccagc

SEQ ID NO: 343202 - DNA, 20 bp, Homo sapiens
ttcagtgagggtcttcttac

SEQ ID NO: 343203 - DNA, 16 bp, Homo sapiens
ttcagtgccaaaaaca

SEQ ID NO: 343204 - DNA, 21 bp, Homo sapiens
ttcagtgccacaaattgaaag

SEQ ID NO: 343205 - DNA, 15 bp, Homo sapiens
ttcagttaagaaaaa

SEQ ID NO: 343206 - DNA, 16 bp, Homo sapiens
ttcagttaagaaaaaa

SEQ ID NO: 343207 - DNA, 18 bp, Homo sapiens
ttcagttattaaatgata

SEQ ID NO: 343208 - DNA, 15 bp, Homo sapiens
ttcagttccagcttt

SEQ ID NO: 343209 - DNA, 21 bp, Homo sapiens
ttcagtttgaaaatattttgt

SEQ ID NO: 343210 - DNA, 19 bp, Homo sapiens
ttcagtttttaacataatt

SEQ ID NO: 343211 - DNA, 12 bp, Homo sapiens
ttcataaattgg

SEQ ID NO: 343212 - DNA, 13 bp, Homo sapiens
ttcataaattggc

SEQ ID NO: 343213 - DNA, 21 bp, Homo sapiens
ttcataagatattctttacaa

SEQ ID NO: 343214 - DNA, 18 bp, Homo sapiens
ttcataaggcctgccctc

SEQ ID NO: 343215 - DNA, 18 bp, Homo sapiens
ttcataccagtcagtatt

SEQ ID NO: 343216 - DNA, 19 bp, Homo sapiens
ttcatactctgttgcctcc

SEQ ID NO: 343217 - DNA, 22 bp, Homo sapiens
ttcatactctgttgcctcctct

SEQ ID NO: 343218 - DNA, 12 bp, Homo sapiens
ttcataggcaga

SEQ ID NO: 343219 - DNA, 18 bp, Homo sapiens
ttcatagtgcctttttcc

SEQ ID NO: 343220 - DNA, 18 bp, Homo sapiens
ttcatagtttctgtaatt

SEQ ID NO: 343221 - DNA, 14 bp, Homo sapiens
ttcatataaagtgc

SEQ ID NO: 343222 - DNA, 13 bp, Homo sapiens
ttcatatctctcc

SEQ ID NO: 343223 - DNA, 16 bp, Homo sapiens
ttcatatctctccctt

SEQ ID NO: 343224 - DNA, 20 bp, Homo sapiens
ttcatatgtaccatgtacat

SEQ ID NO: 343225 - DNA, 18 bp, Homo sapiens
ttcatatgttgctcagtc

SEQ ID NO: 343226 - DNA, 20 bp, Homo sapiens
ttcatcaaataaaccttgtt

SEQ ID NO: 343227 - DNA, 20 bp, Homo sapiens
ttcatcaccagactttggct

SEQ ID NO: 343228 - DNA, 16 bp, Homo sapiens
ttcatcagtgttaaaa

SEQ ID NO: 343229 - DNA, 16 bp, Homo sapiens
ttcatccaatcctcac

SEQ ID NO: 343230 - DNA, 16 bp, Homo sapiens
ttcatccatagacaca

SEQ ID NO: 343231 - DNA, 17 bp, Homo sapiens
ttcatcctggcctcctt

SEQ ID NO: 343232 - DNA, 12 bp, Homo sapiens
ttcatcctgtgt

SEQ ID NO: 343233 - DNA, 17 bp, Homo sapiens
ttcatcctgtgtcccct

SEQ ID NO: 343234 - DNA, 20 bp, Homo sapiens
ttcatccttttttctcttct

SEQ ID NO: 343235 - DNA, 22 bp, Homo sapiens
ttcatccttttttctcttctgt

SEQ ID NO: 343236 - DNA, 20 bp, Homo sapiens
ttcatctaccattttctggt

SEQ ID NO: 343237 - DNA, 15 bp, Homo sapiens
ttcatctccagggag

SEQ ID NO: 343238 - DNA, 15 bp, Homo sapiens
ttcatctgaggagtc

SEQ ID NO: 343239 - DNA, 18 bp, Homo sapiens
ttcatctgaggagtccaa

SEQ ID NO: 343240 - DNA, 18 bp, Homo sapiens
ttcatctgttgttttgtt

SEQ ID NO: 343241 - DNA, 17 bp, Homo sapiens
ttcatcttgaattgtaa

SEQ ID NO: 343242 - DNA, 16 bp, Homo sapiens
ttcatctttccaaatt

SEQ ID NO: 343243 - DNA, 21 bp, Homo sapiens
ttcatcttttgaggcttctgt

SEQ ID NO: 343244 - DNA, 18 bp, Homo sapiens
ttcatgaaaatcctacca

SEQ ID NO: 343245 - DNA, 22 bp, Homo sapiens
ttcatgaattagaagaaaatgg

SEQ ID NO: 343246 - DNA, 14 bp, Homo sapiens
ttcatgattagaca

SEQ ID NO: 343247 - DNA, 15 bp, Homo sapiens
ttcatgattagacaa

SEQ ID NO: 343248 - DNA, 14 bp, Homo sapiens
ttcatgcaatgaca

SEQ ID NO: 343249 - DNA, 19 bp, Homo sapiens
ttcatgccaccatggccag

SEQ ID NO: 343250 - DNA, 14 bp, Homo sapiens
ttcatgcctttgta

SEQ ID NO: 343251 - DNA, 15 bp, Homo sapiens
ttcatgcctttgtaa

SEQ ID NO: 343252 - DNA, 14 bp, Homo sapiens
ttcatgctttctcc

SEQ ID NO: 343253 - DNA, 16 bp, Homo sapiens
ttcatgctttctcctt

SEQ ID NO: 343254 - DNA, 16 bp, Homo sapiens
ttcatgcttttctcat

SEQ ID NO: 343255 - DNA, 19 bp, Homo sapiens
ttcatgcttttctcatggt

SEQ ID NO: 343256 - DNA, 17 bp, Homo sapiens
ttcatgtttgtaaatta

SEQ ID NO: 343257 - DNA, 13 bp, Homo sapiens
ttcatgttttgct

SEQ ID NO: 343258 - DNA, 14 bp, Homo sapiens
ttcatgttttgcta

SEQ ID NO: 343259 - DNA, 16 bp, Homo sapiens
ttcatgttttgtgact

SEQ ID NO: 343260 - DNA, 13 bp, Homo sapiens
ttcattacagctt

SEQ ID NO: 343261 - DNA, 13 bp, Homo sapiens
ttcattattggaa

SEQ ID NO: 343262 - DNA, 20 bp, Homo sapiens
ttcattattggaattaacct

SEQ ID NO: 343263 - DNA, 22 bp, Homo sapiens
aggcctgccctcacgctctcca

SEQ ID NO: 343264 - DNA, 19 bp, Homo sapiens
aggcctgccctcccatgtt

SEQ ID NO: 343265 - DNA, 20 bp, Homo sapiens
aggcctggaaccagggagga

SEQ ID NO: 343266 - DNA, 12 bp, Homo sapiens
aggcctggccca

SEQ ID NO: 343267 - DNA, 14 bp, Homo sapiens
aggcctggcccagc

SEQ ID NO: 343268 - DNA, 20 bp, Homo sapiens
aggcctggcccagccagcag

SEQ ID NO: 343269 - DNA, 22 bp, Homo sapiens
aggcctggcccagccagcaggt

SEQ ID NO: 343270 - DNA, 22 bp, Homo sapiens
aggcctggcctcggggcagggc

SEQ ID NO: 343271 - DNA, 13 bp, Homo sapiens
aggcctgggaggg

SEQ ID NO: 343272 - DNA, 17 bp, Homo sapiens
aggcctgggagggcaag

SEQ ID NO: 343273 - DNA, 21 bp, Homo sapiens
aggcctgggggtgggggaggg

SEQ ID NO: 343274 - DNA, 16 bp, Homo sapiens
aggcctgggtctgtgt

SEQ ID NO: 343275 - DNA, 23 bp, Homo sapiens
aggcctgggtgctggctgcccag

SEQ ID NO: 343276 - DNA, 17 bp, Homo sapiens
aggcctggtcagcagag

SEQ ID NO: 343277 - DNA, 18 bp, Homo sapiens
aggcctggtcagcagagc

SEQ ID NO: 343278 - DNA, 19 bp, Homo sapiens
aggcctggtcagcagagcc

SEQ ID NO: 343279 - DNA, 22 bp, Homo sapiens
ttcatttacaggaaattgcaaa

SEQ ID NO: 343280 - DNA, 18 bp, Homo sapiens
ttcatttaggtgaggaag

SEQ ID NO: 343281 - DNA, 15 bp, Homo sapiens
ttcatttcaactgtt

SEQ ID NO: 343282 - DNA, 13 bp, Homo sapiens
ttcatttcatcta

SEQ ID NO: 343283 - DNA, 14 bp, Homo sapiens
ttcatttccaccaa

SEQ ID NO: 343284 - DNA, 14 bp, Homo sapiens
ttcatttctgtctc

SEQ ID NO: 343285 - DNA, 13 bp, Homo sapiens
ttcatttttccta

SEQ ID NO: 343286 - DNA, 23 bp, Homo sapiens
ttcatttttttcactggagttac

SEQ ID NO: 343287 - DNA, 13 bp, Homo sapiens
ttccaaaataatt

SEQ ID NO: 343288 - DNA, 13 bp, Homo sapiens
ttccaaaattcca

SEQ ID NO: 343289 - DNA, 16 bp, Homo sapiens
ttccaaagaattctta

SEQ ID NO: 343290 - DNA, 19 bp, Homo sapiens
ttccaaagcacattgaaag

SEQ ID NO: 343291 - DNA, 17 bp, Homo sapiens
ttccaaaggttgtacat

SEQ ID NO: 343292 - DNA, 21 bp, Homo sapiens
ttccaacaatggggtgggccc

SEQ ID NO: 343293 - DNA, 16 bp, Homo sapiens
ttccaacacacaatta

SEQ ID NO: 343294 - DNA, 12 bp, Homo sapiens
ttccaacaccac

SEQ ID NO: 343295 - DNA, 17 bp, Homo sapiens
ttccaacaccacagaca

SEQ ID NO: 343296 - DNA, 19 bp, Homo sapiens
ttccaacaccacagacaca

SEQ ID NO: 343297 - DNA, 14 bp, Homo sapiens
ttccaacagtgagt

SEQ ID NO: 343298 - DNA, 16 bp, Homo sapiens
ttccaaccaggcagta

SEQ ID NO: 343299 - DNA, 14 bp, Homo sapiens
ttccaactcaggtt

SEQ ID NO: 343300 - DNA, 13 bp, Homo sapiens
ttccaagacattg

SEQ ID NO: 343301 - DNA, 14 bp, Homo sapiens
ttccaagacattgt

SEQ ID NO: 343302 - DNA, 16 bp, Homo sapiens
ttccaagacattgtca

SEQ ID NO: 343303 - DNA, 17 bp, Homo sapiens
ttccaagacattgtcaa

SEQ ID NO: 343304 - DNA, 16 bp, Homo sapiens
ttccaagacctgactc

SEQ ID NO: 343305 - DNA, 14 bp, Homo sapiens
ttccaagcctgggc

SEQ ID NO: 343306 - DNA, 13 bp, Homo sapiens
ttccaaggagacc

SEQ ID NO: 343307 - DNA, 22 bp, Homo sapiens
ttccaagggtcttcctcctaaa

SEQ ID NO: 343308 - DNA, 21 bp, Homo sapiens
ttccaagtgtgtgtgcaatgt

SEQ ID NO: 343309 - DNA, 23 bp, Homo sapiens
ttccaatcctggctctgtggctt

SEQ ID NO: 343310 - DNA, 12 bp, Homo sapiens
ttccaatgtgcc

SEQ ID NO: 343311 - DNA, 16 bp, Homo sapiens
ttccaatgtgcccagt

SEQ ID NO: 343312 - DNA, 18 bp, Homo sapiens
ttccaatgtgcccagtca

SEQ ID NO: 343313 - DNA, 20 bp, Homo sapiens
ttccaatgtgcccagtcatg

SEQ ID NO: 343314 - DNA, 22 bp, Homo sapiens
ttccaatttacatactctgctt

SEQ ID NO: 343315 - DNA, 13 bp, Homo sapiens
ttccaatttggaa

SEQ ID NO: 343316 - DNA, 11 bp, Homo sapiens
ttccacaaaat

SEQ ID NO: 343317 - DNA, 16 bp, Homo sapiens
ttccacacagcctgtc

SEQ ID NO: 343318 - DNA, 22 bp, Homo sapiens
ttccaccaggattaatctctaa

SEQ ID NO: 343319 - DNA, 14 bp, Homo sapiens
ttccaccccctccc

SEQ ID NO: 343320 - DNA, 13 bp, Homo sapiens
ttccacccctcct

SEQ ID NO: 343321 - DNA, 13 bp, Homo sapiens
ttccacctccctc

SEQ ID NO: 343322 - DNA, 18 bp, Homo sapiens
ttccaccttaaattaaac

SEQ ID NO: 343323 - DNA, 15 bp, Homo sapiens
ttccaccttcccatg

SEQ ID NO: 343324 - DNA, 23 bp, Homo sapiens
ttccaccttggcgcgcagcccgg

SEQ ID NO: 343325 - DNA, 15 bp, Homo sapiens
ttccacgctgtctcc

SEQ ID NO: 343326 - DNA, 19 bp, Homo sapiens
ttccacgtccccctggggc

SEQ ID NO: 343327 - DNA, 12 bp, Homo sapiens
ttccactcagct

SEQ ID NO: 343328 - DNA, 15 bp, Homo sapiens
ttccactcccactgc

SEQ ID NO: 343329 - DNA, 13 bp, Homo sapiens
ttccactggagaa

SEQ ID NO: 343330 - DNA, 15 bp, Homo sapiens
ttccactttgttctt

SEQ ID NO: 343331 - DNA, 16 bp, Homo sapiens
ttccagaacagccctc

SEQ ID NO: 343332 - DNA, 20 bp, Homo sapiens
ttccagaacgtctctcacct

SEQ ID NO: 343333 - DNA, 11 bp, Homo sapiens
ttccagaattg

SEQ ID NO: 343334 - DNA, 15 bp, Homo sapiens
ttccagaccaaaata

SEQ ID NO: 343335 - DNA, 18 bp, Homo sapiens
ttccagactcaggttcca

SEQ ID NO: 343336 - DNA, 19 bp, Homo sapiens
ttccagactcaggttccag

SEQ ID NO: 343337 - DNA, 20 bp, Homo sapiens
ttccagactcaggttccaga

SEQ ID NO: 343338 - DNA, 23 bp, Homo sapiens
ttccagactcaggttccagaaca

SEQ ID NO: 343339 - DNA, 19 bp, Homo sapiens
ttccagagagtggctcctc

SEQ ID NO: 343340 - DNA, 19 bp, Homo sapiens
ttccagagtccggaggcag

SEQ ID NO: 343341 - DNA, 20 bp, Homo sapiens
ttccagagtccggaggcagc

SEQ ID NO: 343342 - DNA, 21 bp, Homo sapiens
ttccagagtccggaggcagca

SEQ ID NO: 343343 - DNA, 18 bp, Homo sapiens
ttccagataaccagctgt

SEQ ID NO: 343344 - DNA, 23 bp, Homo sapiens
ttccagataaccagctgtaacac

SEQ ID NO: 343345 - DNA, 21 bp, Homo sapiens
ttccagcagtgaaacttgtgc

SEQ ID NO: 343346 - DNA, 15 bp, Homo sapiens
ttccagcgggccctc

SEQ ID NO: 343347 - DNA, 13 bp, Homo sapiens
ttccagctctgcc

SEQ ID NO: 343348 - DNA, 11 bp, Homo sapiens
ttccagctgcc

SEQ ID NO: 343349 - DNA, 18 bp, Homo sapiens
ttccagctgccaagtgct

SEQ ID NO: 343350 - DNA, 15 bp, Homo sapiens
ttccaggaagcacag

SEQ ID NO: 343351 - DNA, 18 bp, Homo sapiens
ttccaggatcctgcagga

SEQ ID NO: 343352 - DNA, 19 bp, Homo sapiens
ttccaggcatgaccctgga

SEQ ID NO: 343353 - DNA, 16 bp, Homo sapiens
ttccaggcccctgagg

SEQ ID NO: 343354 - DNA, 22 bp, Homo sapiens
ttccaggcgtagggccagggct

SEQ ID NO: 343355 - DNA, 21 bp, Homo sapiens
ttccaggctagtccggaccca

SEQ ID NO: 343356 - DNA, 11 bp, Homo sapiens
ttccaggctct

SEQ ID NO: 343357 - DNA, 21 bp, Homo sapiens
ttccaggctcttcctggacct

SEQ ID NO: 343358 - DNA, 12 bp, Homo sapiens
ttccaggctgtg

SEQ ID NO: 343359 - DNA, 23 bp, Homo sapiens
ttccaggcttccctgacttgctt

SEQ ID NO: 343360 - DNA, 23 bp, Homo sapiens
ttccagggactgtacctgtagga

SEQ ID NO: 343361 - DNA, 18 bp, Homo sapiens
ttccagggcataaaactc

SEQ ID NO: 343362 - DNA, 19 bp, Homo sapiens
ttccagggcataaaactca

SEQ ID NO: 343363 - DNA, 18 bp, Homo sapiens
ttccagggtctttactgg

SEQ ID NO: 343364 - DNA, 15 bp, Homo sapiens
ttccaggtatgggac

SEQ ID NO: 343365 - DNA, 21 bp, Homo sapiens
ttccaggtatgggacctgcta

SEQ ID NO: 343366 - DNA, 17 bp, Homo sapiens
ttccaggtcagaaacca

SEQ ID NO: 343367 - DNA, 17 bp, Homo sapiens
ttccagtacctttgtca

SEQ ID NO: 343368 - DNA, 13 bp, Homo sapiens
ttccagtattgaa

SEQ ID NO: 343369 - DNA, 16 bp, Homo sapiens
ttccagtggcctggct

SEQ ID NO: 343370 - DNA, 15 bp, Homo sapiens
ttccagtgtattttc

SEQ ID NO: 343371 - DNA, 19 bp, Homo sapiens
ttccagtgtattttctgtg

SEQ ID NO: 343372 - DNA, 18 bp, Homo sapiens
ttccagttgcgtgtctgt

SEQ ID NO: 343373 - DNA, 17 bp, Homo sapiens
ttccataaagtgtaatt

SEQ ID NO: 343374 - DNA, 19 bp, Homo sapiens
ttccataatctggactcct

SEQ ID NO: 343375 - DNA, 23 bp, Homo sapiens
ttccataatctggactcctctgt

SEQ ID NO: 343376 - DNA, 16 bp, Homo sapiens
ttccataatgtataaa

SEQ ID NO: 343377 - DNA, 19 bp, Homo sapiens
ttccataatgtataaagaa

SEQ ID NO: 343378 - DNA, 18 bp, Homo sapiens
ttccataattatgacagt

SEQ ID NO: 343379 - DNA, 18 bp, Homo sapiens
ttccataggaatcatgtt

SEQ ID NO: 343380 - DNA, 14 bp, Homo sapiens
ttccatatgctctt

SEQ ID NO: 343381 - DNA, 22 bp, Homo sapiens
ttccatattgggaatatgtaga

SEQ ID NO: 343382 - DNA, 14 bp, Homo sapiens
ttccatcacagcca

SEQ ID NO: 343383 - DNA, 18 bp, Homo sapiens
ttccatcacagccagccc

SEQ ID NO: 343384 - DNA, 19 bp, Homo sapiens
ttccatcagcagtgattga

SEQ ID NO: 343385 - DNA, 12 bp, Homo sapiens
ttccatccacca

SEQ ID NO: 343386 - DNA, 21 bp, Homo sapiens
ttccatccctaccccctaaga

SEQ ID NO: 343387 - DNA, 19 bp, Homo sapiens
ttccatcctgtacaagtgc

SEQ ID NO: 343388 - DNA, 20 bp, Homo sapiens
ttccatcctgtacaagtgct

SEQ ID NO: 343389 - DNA, 22 bp, Homo sapiens
ttccatcctgtacaagtgctca

SEQ ID NO: 343390 - DNA, 15 bp, Homo sapiens
ttccatctaaaatac

SEQ ID NO: 343391 - DNA, 14 bp, Homo sapiens
ttccatctaggact

SEQ ID NO: 343392 - DNA, 19 bp, Homo sapiens
ttccatctcccttggttgt

SEQ ID NO: 343393 - DNA, 18 bp, Homo sapiens
ttccatgacagtagcata

SEQ ID NO: 343394 - DNA, 16 bp, Homo sapiens
ttccatgacttcagag

SEQ ID NO: 343395 - DNA, 24 bp, Homo sapiens
ttccatgcagttattagaacttag

SEQ ID NO: 343396 - DNA, 15 bp, Homo sapiens
ttccatgcctgaggg

SEQ ID NO: 343397 - DNA, 22 bp, Homo sapiens
ttccatgcctgagggtggagac

SEQ ID NO: 343398 - DNA, 17 bp, Homo sapiens
ttccatggcaattttgt

SEQ ID NO: 343399 - DNA, 19 bp, Homo sapiens
ttccatgtcgcctctgcat

SEQ ID NO: 343400 - DNA, 18 bp, Homo sapiens
ttccatgtgttttgcttt

SEQ ID NO: 343401 - DNA, 20 bp, Homo sapiens
ttccatgtgttttgctttta

SEQ ID NO: 343402 - DNA, 17 bp, Homo sapiens
ttcctattaatcttcag

SEQ ID NO: 343403 - DNA, 19 bp, Homo sapiens
ttcctatttgttttcatgg

SEQ ID NO: 343404 - DNA, 17 bp, Homo sapiens
ttcctattttcagccca

SEQ ID NO: 343405 - DNA, 13 bp, Homo sapiens
ttcctcaccaata

SEQ ID NO: 343406 - DNA, 16 bp, Homo sapiens
ttcctcaccaataact

SEQ ID NO: 343407 - DNA, 15 bp, Homo sapiens
ttcctcagctgccaa

SEQ ID NO: 343408 - DNA, 19 bp, Homo sapiens
ttcctcatcctgcttctct

SEQ ID NO: 343409 - DNA, 20 bp, Homo sapiens
ttcctcatcctgcttctctt

SEQ ID NO: 343410 - DNA, 17 bp, Homo sapiens
ttcctcatgaatgtaaa

SEQ ID NO: 343411 - DNA, 21 bp, Homo sapiens
ttcctcatgaatgtaaatttg

SEQ ID NO: 343412 - DNA, 22 bp, Homo sapiens
ttcctcatggctgttatctgtc

SEQ ID NO: 343413 - DNA, 16 bp, Homo sapiens
ttcctcattcctgaaa

SEQ ID NO: 343414 - DNA, 17 bp, Homo sapiens
ttcctcatttgttcatt

SEQ ID NO: 343415 - DNA, 16 bp, Homo sapiens
ttcctccaaactcctg

SEQ ID NO: 343416 - DNA, 17 bp, Homo sapiens
ttcctccaaactcctgc

SEQ ID NO: 343417 - DNA, 18 bp, Homo sapiens
ttcctccaaactcctgcc

SEQ ID NO: 343418 - DNA, 21 bp, Homo sapiens
ttcctccaaactcctgcctgt

SEQ ID NO: 343419 - DNA, 16 bp, Homo sapiens
ttcctccaaagcctgg

SEQ ID NO: 343420 - DNA, 15 bp, Homo sapiens
ttcctccagcctccc

SEQ ID NO: 343421 - DNA, 20 bp, Homo sapiens
ttcctccagcctcccctccc

SEQ ID NO: 343422 - DNA, 12 bp, Homo sapiens
ttcctccagtct

SEQ ID NO: 343423 - DNA, 13 bp, Homo sapiens
ttcctccatggcc

SEQ ID NO: 343424 - DNA, 13 bp, Homo sapiens
ttcctccccaccc

SEQ ID NO: 343425 - DNA, 20 bp, Homo sapiens
ttcctccccacccattttcc

SEQ ID NO: 343426 - DNA, 14 bp, Homo sapiens
ttcctccccagcag

SEQ ID NO: 343427 - DNA, 15 bp, Homo sapiens
ttcctcccttctgat

SEQ ID NO: 343428 - DNA, 23 bp, Homo sapiens
ttcctccgctcccctttcccatc

SEQ ID NO: 343429 - DNA, 14 bp, Homo sapiens
ttcctccgtccacc

SEQ ID NO: 343430 - DNA, 18 bp, Homo sapiens
ttcctcctgaagcctctg

SEQ ID NO: 343431 - DNA, 14 bp, Homo sapiens
ttcctcctgtctcc

SEQ ID NO: 343432 - DNA, 16 bp, Homo sapiens
ttcctcgcctaggcct

SEQ ID NO: 343433 - DNA, 17 bp, Homo sapiens
ttcctctattgatgtac

SEQ ID NO: 343434 - DNA, 21 bp, Homo sapiens
ttcctctattgatgtacagtc

SEQ ID NO: 343435 - DNA, 23 bp, Homo sapiens
ttcctctattgatgtacagtctg

SEQ ID NO: 343436 - DNA, 12 bp, Homo sapiens
ttcctctccact

SEQ ID NO: 343437 - DNA, 18 bp, Homo sapiens
ttcctctccactgccttc

SEQ ID NO: 343438 - DNA, 19 bp, Homo sapiens
ttcctctccactgccttcg

SEQ ID NO: 343439 - DNA, 19 bp, Homo sapiens
ttcctctcggctggaagaa

SEQ ID NO: 343440 - DNA, 12 bp, Homo sapiens
ttcctctctctc

SEQ ID NO: 343441 - DNA, 15 bp, Homo sapiens
ttcctctctctcacc

SEQ ID NO: 343442 - DNA, 15 bp, Homo sapiens
ttcctctgagctgtt

SEQ ID NO: 343443 - DNA, 16 bp, Homo sapiens
ttcctcttacctgtaa

SEQ ID NO: 343444 - DNA, 23 bp, Homo sapiens
ttcctcttgagggtcattttcct

SEQ ID NO: 343445 - DNA, 17 bp, Homo sapiens
ttcctcttgcctctctc

SEQ ID NO: 343446 - DNA, 12 bp, Homo sapiens
ttcctctttgtt

SEQ ID NO: 343447 - DNA, 12 bp, Homo sapiens
ttcctgaaagaa

SEQ ID NO: 343448 - DNA, 15 bp, Homo sapiens
ttcctgaaatgcagt

SEQ ID NO: 343449 - DNA, 16 bp, Homo sapiens
ttcctgaatgaaatat

SEQ ID NO: 343450 - DNA, 12 bp, Homo sapiens
ttcctgactggg

SEQ ID NO: 343451 - DNA, 13 bp, Homo sapiens
ttcctgactggga

SEQ ID NO: 343452 - DNA, 15 bp, Homo sapiens
ttcctgactgggaag

SEQ ID NO: 343453 - DNA, 21 bp, Homo sapiens
ttcctgagaaacgtccatctc

SEQ ID NO: 343454 - DNA, 22 bp, Homo sapiens
ttcctgagaaacgtccatctct

SEQ ID NO: 343455 - DNA, 22 bp, Homo sapiens
ttcctgagaaagcccacctggg

SEQ ID NO: 343456 - DNA, 14 bp, Homo sapiens
ttcctgagattctg

SEQ ID NO: 343457 - DNA, 18 bp, Homo sapiens
ttcctgagattctgggaa

SEQ ID NO: 343458 - DNA, 20 bp, Homo sapiens
ttcctgagattctgggaaag

SEQ ID NO: 343459 - DNA, 19 bp, Homo sapiens
ttcctgataataattgatc

SEQ ID NO: 343460 - DNA, 13 bp, Homo sapiens
ttcctgcatcttt

SEQ ID NO: 343461 - DNA, 20 bp, Homo sapiens
ttcctgcatctttcatagtt

SEQ ID NO: 343462 - DNA, 15 bp, Homo sapiens
ttcctgcatttgtga

SEQ ID NO: 343463 - DNA, 18 bp, Homo sapiens
ttcctgcatttgtgaaat

SEQ ID NO: 343464 - DNA, 11 bp, Homo sapiens
ttcctgccctg

SEQ ID NO: 343465 - DNA, 12 bp, Homo sapiens
ttcctgccctgt

SEQ ID NO: 343466 - DNA, 24 bp, Homo sapiens
ttcctgccctgtacctctctctgc

SEQ ID NO: 343467 - DNA, 18 bp, Homo sapiens
ttcctgccgcaacagttt

SEQ ID NO: 343468 - DNA, 22 bp, Homo sapiens
ttcctgctacagtagctgtggg

SEQ ID NO: 343469 - DNA, 11 bp, Homo sapiens
ttcctgctgct

SEQ ID NO: 343470 - DNA, 24 bp, Homo sapiens
ttcctgctgctgtaactgctgagc

SEQ ID NO: 343471 - DNA, 11 bp, Homo sapiens
ttcctgctttc

SEQ ID NO: 343472 - DNA, 14 bp, Homo sapiens
ttcctgctttctct

SEQ ID NO: 343473 - DNA, 17 bp, Homo sapiens
ttcctgctttctctttc

SEQ ID NO: 343474 - DNA, 17 bp, Homo sapiens
ttcctggacctgagtcg

SEQ ID NO: 343475 - DNA, 20 bp, Homo sapiens
ttcctggattttctttctat

SEQ ID NO: 343476 - DNA, 22 bp, Homo sapiens
ttcctggattttctttctatgt

SEQ ID NO: 343477 - DNA, 23 bp, Homo sapiens
ttcctggcaatagtgtgttctga

SEQ ID NO: 343478 - DNA, 18 bp, Homo sapiens
ttcctggcctcactggct

SEQ ID NO: 343479 - DNA, 14 bp, Homo sapiens
ttcctggctgtaaa

SEQ ID NO: 343480 - DNA, 18 bp, Homo sapiens
ttcctgggcagcccagag

SEQ ID NO: 343481 - DNA, 20 bp, Homo sapiens
ttcctgggcagcccagagag

SEQ ID NO: 343482 - DNA, 12 bp, Homo sapiens
ttcctgggcctg

SEQ ID NO: 343483 - DNA, 16 bp, Homo sapiens
ttcctgggccttctca

SEQ ID NO: 343484 - DNA, 15 bp, Homo sapiens
ttcctggggccccgc

SEQ ID NO: 343485 - DNA, 16 bp, Homo sapiens
ttcctggggccccgct

SEQ ID NO: 343486 - DNA, 19 bp, Homo sapiens
ttcctggtgaggcccagcc

SEQ ID NO: 343487 - DNA, 17 bp, Homo sapiens
ttcctgtagtgcccctc

SEQ ID NO: 343488 - DNA, 19 bp, Homo sapiens
ttcctgtagtgcccctccc

SEQ ID NO: 343489 - DNA, 13 bp, Homo sapiens
ttcctgtcctgct

SEQ ID NO: 343490 - DNA, 19 bp, Homo sapiens
ttcctgtgactgtttttgt

SEQ ID NO: 343491 - DNA, 15 bp, Homo sapiens
ttcctgtgccaacct

SEQ ID NO: 343492 - DNA, 14 bp, Homo sapiens
ttcctgtgccagga

SEQ ID NO: 343493 - DNA, 13 bp, Homo sapiens
ttcctgtgcccat

SEQ ID NO: 343494 - DNA, 18 bp, Homo sapiens
ttcctgtggccaggaggt

SEQ ID NO: 343495 - DNA, 19 bp, Homo sapiens
ttcctgtggccaggaggtt

SEQ ID NO: 343496 - DNA, 17 bp, Homo sapiens
ttcctgttcccatgaga

SEQ ID NO: 343497 - DNA, 13 bp, Homo sapiens
ttcctgttctgaa

SEQ ID NO: 343498 - DNA, 14 bp, Homo sapiens
ttcctgttgtctga

SEQ ID NO: 343499 - DNA, 22 bp, Homo sapiens
ttcctgttgttatggaaactgt

SEQ ID NO: 343500 - DNA, 18 bp, Homo sapiens
ttcctgtttatgcattca

SEQ ID NO: 343501 - DNA, 13 bp, Homo sapiens
ttcctgtttctaa

SEQ ID NO: 343502 - DNA, 19 bp, Homo sapiens
ttccttagacccgccaggt

SEQ ID NO: 343503 - DNA, 15 bp, Homo sapiens
ttccttagcagctca

SEQ ID NO: 343504 - DNA, 20 bp, Homo sapiens
ttccttccatccctaccccc

SEQ ID NO: 343505 - DNA, 13 bp, Homo sapiens
ttccttccctggg

SEQ ID NO: 343506 - DNA, 17 bp, Homo sapiens
ttccttccgctctgagg

SEQ ID NO: 343507 - DNA, 12 bp, Homo sapiens
ttccttcctgag

SEQ ID NO: 343508 - DNA, 13 bp, Homo sapiens
ttccttcctgccc

SEQ ID NO: 343509 - DNA, 15 bp, Homo sapiens
ttccttcctgccctg

SEQ ID NO: 343510 - DNA, 20 bp, Homo sapiens
ttccttcctgccctgtacct

SEQ ID NO: 343511 - DNA, 14 bp, Homo sapiens
ttccttcctgttct

SEQ ID NO: 343512 - DNA, 12 bp, Homo sapiens
ttccttctcgtc

SEQ ID NO: 343513 - DNA, 19 bp, Homo sapiens
ttccttgaccttcctctgg

SEQ ID NO: 343514 - DNA, 15 bp, Homo sapiens
ttccttgctcaacca

SEQ ID NO: 343515 - DNA, 14 bp, Homo sapiens
ttccttgctctccc

SEQ ID NO: 343516 - DNA, 17 bp, Homo sapiens
ttccttgctttctcttc

SEQ ID NO: 343517 - DNA, 14 bp, Homo sapiens
ttccttggcccagc

SEQ ID NO: 343518 - DNA, 13 bp, Homo sapiens
ttccttgtcacca

SEQ ID NO: 343519 - DNA, 22 bp, Homo sapiens
ttcctttaaatactcccttttt

SEQ ID NO: 343520 - DNA, 18 bp, Homo sapiens
ttcctttacaactaaata

SEQ ID NO: 343521 - DNA, 15 bp, Homo sapiens
ttcctttcatcctca

SEQ ID NO: 343522 - DNA, 16 bp, Homo sapiens
ttcctttcatcctcag

SEQ ID NO: 343523 - DNA, 21 bp, Homo sapiens
ttcctttgtttttttttcctg

SEQ ID NO: 343524 - DNA, 15 bp, Homo sapiens
ttcgaaaacagatga

SEQ ID NO: 343525 - DNA, 15 bp, Homo sapiens
ttcgaggtgtcaccc

SEQ ID NO: 343526 - DNA, 16 bp, Homo sapiens
ttcgaggtgtcaccct

SEQ ID NO: 343527 - DNA, 22 bp, Homo sapiens
ttctcatgcactgcaaatactt

SEQ ID NO: 343528 - DNA, 18 bp, Homo sapiens
ttctcatgtgctttgtag

SEQ ID NO: 343529 - DNA, 22 bp, Homo sapiens
ttctccacccaaaccccttccc

SEQ ID NO: 343530 - DNA, 16 bp, Homo sapiens
ttctccacccaccagt

SEQ ID NO: 343531 - DNA, 13 bp, Homo sapiens
ttctccacctccc

SEQ ID NO: 343532 - DNA, 12 bp, Homo sapiens
ttctccactgga

SEQ ID NO: 343533 - DNA, 13 bp, Homo sapiens
ttctccaggccct

SEQ ID NO: 343534 - DNA, 13 bp, Homo sapiens
ttctccatcagct

SEQ ID NO: 343535 - DNA, 12 bp, Homo sapiens
ttctccatcccc

SEQ ID NO: 343536 - DNA, 18 bp, Homo sapiens
ttctccatggccctgcca

SEQ ID NO: 343537 - DNA, 12 bp, Homo sapiens
ttctcccagcac

SEQ ID NO: 343538 - DNA, 22 bp, Homo sapiens
ttctccccatccccttcctaaa

SEQ ID NO: 343539 - DNA, 21 bp, Homo sapiens
ttctcccccgacactgctgca

SEQ ID NO: 343540 - DNA, 14 bp, Homo sapiens
ttctcccctccaga

SEQ ID NO: 343541 - DNA, 13 bp, Homo sapiens
ttctcccctgccc

SEQ ID NO: 343542 - DNA, 19 bp, Homo sapiens
ttctccctgaccttagcgt

SEQ ID NO: 343543 - DNA, 17 bp, Homo sapiens
ttctccctgtcccctca

SEQ ID NO: 343544 - DNA, 16 bp, Homo sapiens
ttctccggggtctgtg

SEQ ID NO: 343545 - DNA, 18 bp, Homo sapiens
ttctcctccaaatgctgt

SEQ ID NO: 343546 - DNA, 13 bp, Homo sapiens
ttctcctctccca

SEQ ID NO: 343547 - DNA, 22 bp, Homo sapiens
ttcctatgcccaggtaccaccc

SEQ ID NO: 343548 - DNA, 18 bp, Homo sapiens
ttctcctgacccagtccc

SEQ ID NO: 343549 - DNA, 21 bp, Homo sapiens
ttctcctgatagtcacctgct

SEQ ID NO: 343550 - DNA, 14 bp, Homo sapiens
ttctccttctcctt

SEQ ID NO: 343551 - DNA, 13 bp, Homo sapiens
ttctcctttttct

SEQ ID NO: 343552 - DNA, 13 bp, Homo sapiens
ttctcgagtccaa

SEQ ID NO: 343553 - DNA, 20 bp, Homo sapiens
ttctcggaggccaggccctc

SEQ ID NO: 343554 - DNA, 17 bp, Homo sapiens
ttctcgtagatgctgcc

SEQ ID NO: 343555 - DNA, 20 bp, Homo sapiens
ttctcgtagatgctgcctag

SEQ ID NO: 343556 - DNA, 12 bp, Homo sapiens
ttctctaaaaca

SEQ ID NO: 343557 - DNA, 15 bp, Homo sapiens
ttctctaatcgaaag

SEQ ID NO: 343558 - DNA, 13 bp, Homo sapiens
ttctctcccacac

SEQ ID NO: 343559 - DNA, 22 bp, Homo sapiens
ttctctccccttttccttcaga

SEQ ID NO: 343560 - DNA, 23 bp, Homo sapiens
ttctctctatgcaaaatgtctgt

SEQ ID NO: 343561 - DNA, 11 bp, Homo sapiens
ttctctctgtg

SEQ ID NO: 343562 - DNA, 13 bp, Homo sapiens
ttctctctgtgtg

SEQ ID NO: 343563 - DNA, 16 bp, Homo sapiens
ttctctctgtgtggca

SEQ ID NO: 343564 - DNA, 23 bp, Homo sapiens
ttctctctgtgtggcaaacattt

SEQ ID NO: 343565 - DNA, 13 bp, Homo sapiens
ttctctcttcaat

SEQ ID NO: 343566 - DNA, 22 bp, Homo sapiens
ttctctcttgattgatttttaa

SEQ ID NO: 343567 - DNA, 12 bp, Homo sapiens
ttctctctttgt

SEQ ID NO: 343568 - DNA, 19 bp, Homo sapiens
ttctctgagctttgttact

SEQ ID NO: 343569 - DNA, 15 bp, Homo sapiens
ttctctgcgagcaac

SEQ ID NO: 343570 - DNA, 11 bp, Homo sapiens
ttctctgctcc

SEQ ID NO: 343571 - DNA, 11 bp, Homo sapiens
ttctctgcttc

SEQ ID NO: 343572 - DNA, 15 bp, Homo sapiens
ttctctgcttcagct

SEQ ID NO: 343573 - DNA, 19 bp, Homo sapiens
ttctctgcttcagcttgct

SEQ ID NO: 343574 - DNA, 22 bp, Homo sapiens
ttctctggaaaggggggagctg

SEQ ID NO: 343575 - DNA, 17 bp, Homo sapiens
ttctctgtccagggctt

SEQ ID NO: 343576 - DNA, 22 bp, Homo sapiens
ttctctgtccagggcttcagat

SEQ ID NO: 343577 - DNA, 16 bp, Homo sapiens
ttctctgtgctctgaa

SEQ ID NO: 343578 - DNA, 21 bp, Homo sapiens
ttctctgtgctctgaatggga

SEQ ID NO: 343579 - DNA, 19 bp, Homo sapiens
ttctctgtgtttgttccta

SEQ ID NO: 343580 - DNA, 15 bp, Homo sapiens
ttctctgttcccttg

SEQ ID NO: 343581 - DNA, 19 bp, Homo sapiens
ttctcttcattcccactgc

SEQ ID NO: 343582 - DNA, 14 bp, Homo sapiens
ttctcttcgctgtg

SEQ ID NO: 343583 - DNA, 17 bp, Homo sapiens
ttctcttcgctgtgatg

SEQ ID NO: 343584 - DNA, 13 bp, Homo sapiens
ttctcttctcaga

SEQ ID NO: 343585 - DNA, 14 bp, Homo sapiens
ttctcttctgtcca

SEQ ID NO: 343586 - DNA, 16 bp, Homo sapiens
ttctcttggctggctt

SEQ ID NO: 343587 - DNA, 17 bp, Homo sapiens
ttctctttgccttgatg

SEQ ID NO: 343588 - DNA, 12 bp, Homo sapiens
ttctctttgggt

SEQ ID NO: 343589 - DNA, 17 bp, Homo sapiens
ttctctttttccagaat

SEQ ID NO: 343590 - DNA, 16 bp, Homo sapiens
ttctctttttttaaaa

SEQ ID NO: 343591 - DNA, 16 bp, Homo sapiens
ttctgaaaattccaga

SEQ ID NO: 343592 - DNA, 14 bp, Homo sapiens
ttctgaaatatttt

SEQ ID NO: 343593 - DNA, 21 bp, Homo sapiens
ttctgaacatgagtgtcaact

SEQ ID NO: 343594 - DNA, 13 bp, Homo sapiens
ttctgaactccat

SEQ ID NO: 343595 - DNA, 14 bp, Homo sapiens
ttctgaagatctca

SEQ ID NO: 343596 - DNA, 23 bp, Homo sapiens
ttctgaaggttggaactgctgcc

SEQ ID NO: 343597 - DNA, 18 bp, Homo sapiens
ttctgaagtttcctatga

SEQ ID NO: 343598 - DNA, 17 bp, Homo sapiens
ttctgaataatttctta

SEQ ID NO: 343599 - DNA, 16 bp, Homo sapiens
ttctgaatgctgctac

SEQ ID NO: 343600 - DNA, 18 bp, Homo sapiens
ttctgaatgctgctactt

SEQ ID NO: 343601 - DNA, 11 bp, Homo sapiens
ttctgaatgta

SEQ ID NO: 343602 - DNA, 22 bp, Homo sapiens
ttctgaccacacttcctgtcca

SEQ ID NO: 343603 - DNA, 20 bp, Homo sapiens
ttctgacctcatgagtgtca

SEQ ID NO: 343604 - DNA, 14 bp, Homo sapiens
ttctgacggccctg

SEQ ID NO: 343605 - DNA, 15 bp, Homo sapiens
ttctgacggccctgc

SEQ ID NO: 343606 - DNA, 17 bp, Homo sapiens
ttctgacggccctgcaa

SEQ ID NO: 343607 - DNA, 13 bp, Homo sapiens
ttctgactgcaac

SEQ ID NO: 343608 - DNA, 13 bp, Homo sapiens
ttctgagcagttt

SEQ ID NO: 343609 - DNA, 21 bp, Homo sapiens
ttctgagcagttttccaggag

SEQ ID NO: 343610 - DNA, 17 bp, Homo sapiens
ttctgagctataacatt

SEQ ID NO: 343611 - DNA, 13 bp, Homo sapiens
ttctgagctgggc

SEQ ID NO: 343612 - DNA, 23 bp, Homo sapiens
ttctgataagactggaaaatagt

SEQ ID NO: 343613 - DNA, 23 bp, Homo sapiens
ttctgatgtctccagattggcac

SEQ ID NO: 343614 - DNA, 14 bp, Homo sapiens
ttctgattagaaat

SEQ ID NO: 343615 - DNA, 17 bp, Homo sapiens
ttctgattagaaatgac

SEQ ID NO: 343616 - DNA, 15 bp, Homo sapiens
ttctgcaacagcctg

SEQ ID NO: 343617 - DNA, 16 bp, Homo sapiens
ttctgcaacagcctgt

SEQ ID NO: 343618 - DNA, 19 bp, Homo sapiens
ttctgcaactagccaaggc

SEQ ID NO: 343619 - DNA, 14 bp, Homo sapiens
ttctgcagagactt

SEQ ID NO: 343620 - DNA, 18 bp, Homo sapiens
ttctgcagaggcagcagg

SEQ ID NO: 343621 - DNA, 19 bp, Homo sapiens
ttctgcagccactattgtt

SEQ ID NO: 343622 - DNA, 20 bp, Homo sapiens
ttctgcatcatctgtagata

SEQ ID NO: 343623 - DNA, 13 bp, Homo sapiens
ttctgcattacta

SEQ ID NO: 343624 - DNA, 23 bp, Homo sapiens
ttctgcattactattaactctgc

SEQ ID NO: 343625 - DNA, 21 bp, Homo sapiens
ttctgccacttgcactgtgct

SEQ ID NO: 343626 - DNA, 20 bp, Homo sapiens
ttctgcccatcctgtctgtt

SEQ ID NO: 343627 - DNA, 18 bp, Homo sapiens
ttctgcctgcctgggaac

SEQ ID NO: 343628 - DNA, 13 bp, Homo sapiens
ttctgcctgttat

SEQ ID NO: 343629 - DNA, 14 bp, Homo sapiens
ttctgcctgttata

SEQ ID NO: 343630 - DNA, 15 bp, Homo sapiens
ttctgcctgttataa

SEQ ID NO: 343631 - DNA, 20 bp, Homo sapiens
ttctgcctgttataactctg

SEQ ID NO: 343632 - DNA, 21 bp, Homo sapiens
ttctgcctgttataactctgc

SEQ ID NO: 343633 - DNA, 24 bp, Homo sapiens
ttctgcctgttataactctgcact

SEQ ID NO: 343634 - DNA, 12 bp, Homo sapiens
ttctgccttttc

SEQ ID NO: 343635 - DNA, 16 bp, Homo sapiens
ttctgccttttcactg

SEQ ID NO: 343636 - DNA, 15 bp, Homo sapiens
ttctgccttttttat

SEQ ID NO: 343637 - DNA, 20 bp, Homo sapiens
ttctgctaggtagaggcatt

SEQ ID NO: 343638 - DNA, 21 bp, Homo sapiens
ttctgctcacattccctctca

SEQ ID NO: 343639 - DNA, 20 bp, Homo sapiens
ttctgctccacccttggcct

SEQ ID NO: 343640 - DNA, 19 bp, Homo sapiens
ttctgctcctgaaaaatga

SEQ ID NO: 343641 - DNA, 13 bp, Homo sapiens
ttctgctggataa

SEQ ID NO: 343642 - DNA, 13 bp, Homo sapiens
ttctgctggcctg

SEQ ID NO: 343643 - DNA, 14 bp, Homo sapiens
ttctgctggcctgg

SEQ ID NO: 343644 - DNA, 18 bp, Homo sapiens
ttctgctggcctggatct

SEQ ID NO: 343645 - DNA, 17 bp, Homo sapiens
ttctgctgtacagatat

SEQ ID NO: 343646 - DNA, 15 bp, Homo sapiens
ttctgcttgtcatcc

SEQ ID NO: 343647 - DNA, 18 bp, Homo sapiens
ttctgcttgtgttaagta

SEQ ID NO: 343648 - DNA, 16 bp, Homo sapiens
ttctggaatgtaatca

SEQ ID NO: 343649 - DNA, 18 bp, Homo sapiens
ttctggactctgccccaa

SEQ ID NO: 343650 - DNA, 14 bp, Homo sapiens
ttctggcctgcctt

SEQ ID NO: 343651 - DNA, 21 bp, Homo sapiens
ttctggcctttcctctctcct

SEQ ID NO: 343652 - DNA, 12 bp, Homo sapiens
ttctggctcctg

SEQ ID NO: 343653 - DNA, 18 bp, Homo sapiens
ttctggctcctgtgtgga

SEQ ID NO: 343654 - DNA, 16 bp, Homo sapiens
ttctggctgaaaatgg

SEQ ID NO: 343655 - DNA, 14 bp, Homo sapiens
ttctgtccccagcc

SEQ ID NO: 343656 - DNA, 22 bp, Homo sapiens
ttctgtccccagccctgtcctg

SEQ ID NO: 343657 - DNA, 11 bp, Homo sapiens
ttctgtccctg

SEQ ID NO: 343658 - DNA, 15 bp, Homo sapiens
ttctgtccctgtccc

SEQ ID NO: 343659 - DNA, 16 bp, Homo sapiens
ttctgtccctgtccct

SEQ ID NO: 343660 - DNA, 21 bp, Homo sapiens
ttctgtcctcaggtgaataac

SEQ ID NO: 343661 - DNA, 19 bp, Homo sapiens
ttctgtctcccctaccagg

SEQ ID NO: 343662 - DNA, 17 bp, Homo sapiens
ttctgtcttccaggccc

SEQ ID NO: 343663 - DNA, 13 bp, Homo sapiens
ttctgtgaagaat

SEQ ID NO: 343664 - DNA, 21 bp, Homo sapiens
ttctgtgaagccctttgcctg

SEQ ID NO: 343665 - DNA, 13 bp, Homo sapiens
ttctgtgcccagc

SEQ ID NO: 343666 - DNA, 19 bp, Homo sapiens
ttctgtgcctccccccaga

SEQ ID NO: 343667 - DNA, 21 bp, Homo sapiens
ttctgtgcctccccccagacc

SEQ ID NO: 343668 - DNA, 22 bp, Homo sapiens
ttctgtgcctccccccagaccc

SEQ ID NO: 343669 - DNA, 15 bp, Homo sapiens
ttctgtggaaaacaa

SEQ ID NO: 343670 - DNA, 14 bp, Homo sapiens
ttctgtggattcta

SEQ ID NO: 343671 - DNA, 16 bp, Homo sapiens
ttctgtggattctata

SEQ ID NO: 343672 - DNA, 20 bp, Homo sapiens
ttctgtggttttcccctccc

SEQ ID NO: 343673 - DNA, 14 bp, Homo sapiens
ttctgtgtctgctg

SEQ ID NO: 343674 - DNA, 13 bp, Homo sapiens
ttctgtgtgaaga

SEQ ID NO: 343675 - DNA, 15 bp, Homo sapiens
ttctgttaaaatcag

SEQ ID NO: 343676 - DNA, 14 bp, Homo sapiens
ttctgttaaatatt

SEQ ID NO: 343677 - DNA, 13 bp, Homo sapiens
ttctgttctactt

SEQ ID NO: 343678 - DNA, 23 bp, Homo sapiens
ttctgtttctaatttgctgctga

SEQ ID NO: 343679 - DNA, 18 bp, Homo sapiens
ttctgtttgaattttcaa

SEQ ID NO: 343680 - DNA, 20 bp, Homo sapiens
ttctgtttgaattttcaaag

SEQ ID NO: 343681 - DNA, 17 bp, Homo sapiens
ttctgttttgcctgaag

SEQ ID NO: 343682 - DNA, 14 bp, Homo sapiens
ttctgtttttctca

SEQ ID NO: 343683 - DNA, 16 bp, Homo sapiens
ttctgtttttctcaaa

SEQ ID NO: 343684 - DNA, 14 bp, Homo sapiens
ttcttaaaaagtta

SEQ ID NO: 343685 - DNA, 19 bp, Homo sapiens
ttcttaaaattcaagaaaa

SEQ ID NO: 343686 - DNA, 15 bp, Homo sapiens
ttcttaaaggcctgg

SEQ ID NO: 343687 - DNA, 14 bp, Homo sapiens
ttcttaagcacttt

SEQ ID NO: 343688 - DNA, 22 bp, Homo sapiens
ttcttaagtatgttattttctg

SEQ ID NO: 343689 - DNA, 20 bp, Homo sapiens
ttcttacaattgcactgctg

SEQ ID NO: 343690 - DNA, 16 bp, Homo sapiens
ttcttacataattttt

SEQ ID NO: 343691 - DNA, 14 bp, Homo sapiens
ttcttacatgcatt

SEQ ID NO: 343692 - DNA, 17 bp, Homo sapiens
ttcttaccctctctttc

SEQ ID NO: 343693 - DNA, 20 bp, Homo sapiens
ttcttaccctctctttcaat

SEQ ID NO: 343694 - DNA, 17 bp, Homo sapiens
ttcttacctcatttgca

SEQ ID NO: 343695 - DNA, 15 bp, Homo sapiens
ttcttactaaacatt

SEQ ID NO: 343696 - DNA, 13 bp, Homo sapiens
ttcttagtgtcac

SEQ ID NO: 343697 - DNA, 21 bp, Homo sapiens
ttcttatacatttgataaagt

SEQ ID NO: 343698 - DNA, 12 bp, Homo sapiens
ttcttatggtat

SEQ ID NO: 343699 - DNA, 22 bp, Homo sapiens
ttcttattcatgctttctcctt

SEQ ID NO: 343700 - DNA, 15 bp, Homo sapiens
ttcttatttcccctt

SEQ ID NO: 343701 - DNA, 21 bp, Homo sapiens
ttcttcaaaaggtaaatacaa

SEQ ID NO: 343702 - DNA, 19 bp, Homo sapiens
ttcttcaagggaagaaaca

SEQ ID NO: 343703 - DNA, 21 bp, Homo sapiens
ttcttcacccagctaatctgt

SEQ ID NO: 343704 - DNA, 12 bp, Homo sapiens
ttcttcagaggg

SEQ ID NO: 343705 - DNA, 18 bp, Homo sapiens
ttcttcataacaatttta

SEQ ID NO: 343706 - DNA, 21 bp, Homo sapiens
ttcttcatccatagacacagt

SEQ ID NO: 343707 - DNA, 18 bp, Homo sapiens
ttcttcatctgtgactcc

SEQ ID NO: 343708 - DNA, 14 bp, Homo sapiens
ttcttcatgcaatg

SEQ ID NO: 343709 - DNA, 17 bp, Homo sapiens
ttcttcatgcaatgaca

SEQ ID NO: 343710 - DNA, 20 bp, Homo sapiens
ttcttcccatttgtaatgta

SEQ ID NO: 343711 - DNA, 13 bp, Homo sapiens
ttcttccctgggg

SEQ ID NO: 343712 - DNA, 21 bp, Homo sapiens
ttcttcctccagtctgttctc

SEQ ID NO: 343713 - DNA, 13 bp, Homo sapiens
ttcttcctctgct

SEQ ID NO: 343714 - DNA, 14 bp, Homo sapiens
ttcttcgctgctct

SEQ ID NO: 343715 - DNA, 17 bp, Homo sapiens
ttcttcgtatatacaca

SEQ ID NO: 343716 - DNA, 16 bp, Homo sapiens
ttcttctcaaggacac

SEQ ID NO: 343717 - DNA, 12 bp, Homo sapiens
ttcttcttggct

SEQ ID NO: 343718 - DNA, 13 bp, Homo sapiens
ttcttgaaagctg

SEQ ID NO: 343719 - DNA, 14 bp, Homo sapiens
ttcttgatgtaaaa

SEQ ID NO: 343720 - DNA, 20 bp, Homo sapiens
ttcttgcactgtatccaagt

SEQ ID NO: 343721 - DNA, 19 bp, Homo sapiens
ttcttgccacacagtgggc

SEQ ID NO: 343722 - DNA, 14 bp, Homo sapiens
ttcttgccctgagc

SEQ ID NO: 343723 - DNA, 19 bp, Homo sapiens
ttcttgcggcaccgcccac

SEQ ID NO: 343724 - DNA, 14 bp, Homo sapiens
ttcttgctaacttt

SEQ ID NO: 343725 - DNA, 17 bp, Homo sapiens
ttcttgctttcacaaat

SEQ ID NO: 343726 - DNA, 19 bp, Homo sapiens
ttcttggacacttaattct

SEQ ID NO: 343727 - DNA, 22 bp, Homo sapiens
ttcttggacacttaattctgtt

SEQ ID NO: 343728 - DNA, 19 bp, Homo sapiens
ttcttggcctcaagttcaa

SEQ ID NO: 343729 - DNA, 20 bp, Homo sapiens
ttcttggcctcaagttcaat

SEQ ID NO: 343730 - DNA, 16 bp, Homo sapiens
ttcttggcgttcctgc

SEQ ID NO: 343731 - DNA, 18 bp, Homo sapiens
ttcttggcgttcctgcca

SEQ ID NO: 343732 - DNA, 18 bp, Homo sapiens
ttcttggggtactcttga

SEQ ID NO: 343733 - DNA, 14 bp, Homo sapiens
ttcttggtagagat

SEQ ID NO: 343734 - DNA, 15 bp, Homo sapiens
ttcttggtagagatt

SEQ ID NO: 343735 - DNA, 14 bp, Homo sapiens
ttcttggtatgatc

SEQ ID NO: 343736 - DNA, 16 bp, Homo sapiens
ttcttggtatgatcat

SEQ ID NO: 343737 - DNA, 21 bp, Homo sapiens
ttcttggtatttggatatctg

SEQ ID NO: 343738 - DNA, 23 bp, Homo sapiens
ttcttggttttgtattgtttaaa

SEQ ID NO: 343739 - DNA, 22 bp, Homo sapiens
ttcttgtaaaactgtgacattc

SEQ ID NO: 343740 - DNA, 14 bp, Homo sapiens
ttcttgtcaaaaaa

SEQ ID NO: 343741 - DNA, 16 bp, Homo sapiens
ttcttgtcacaataaa

SEQ ID NO: 343742 - DNA, 17 bp, Homo sapiens
ttcttgtccacattcta

SEQ ID NO: 343743 - DNA, 23 bp, Homo sapiens
ttcttgtccacattctacttcag

SEQ ID NO: 343744 - DNA, 11 bp, Homo sapiens
ttcttgtgaaa

SEQ ID NO: 343745 - DNA, 17 bp, Homo sapiens
ttcttgtgtttgaaaca

SEQ ID NO: 343746 - DNA, 12 bp, Homo sapiens
ttcttgttcaaa

SEQ ID NO: 343747 - DNA, 15 bp, Homo sapiens
ttctttaaactactg

SEQ ID NO: 343748 - DNA, 15 bp, Homo sapiens
ttctttaagactttt

SEQ ID NO: 343749 - DNA, 22 bp, Homo sapiens
ttctttaaggaagaataaaaaa

SEQ ID NO: 343750 - DNA, 15 bp, Homo sapiens
ttctttaggagattt

SEQ ID NO: 343751 - DNA, 15 bp, Homo sapiens
ttctttccatgcagt

SEQ ID NO: 343752 - DNA, 14 bp, Homo sapiens
ttgaaaacttcaaa

SEQ ID NO: 343753 - DNA, 13 bp, Homo sapiens
ttgaaaagaagaa

SEQ ID NO: 343754 - DNA, 13 bp, Homo sapiens
ttgaaaagtgttc

SEQ ID NO: 343755 - DNA, 15 bp, Homo sapiens
ttgaaaattatttta

SEQ ID NO: 343756 - DNA, 20 bp, Homo sapiens
ttgaaaattattttaaacaa

SEQ ID NO: 343757 - DNA, 22 bp, Homo sapiens
ttgaaaattattttaaacaaaa

SEQ ID NO: 343758 - DNA, 21 bp, Homo sapiens
ttgaaaattcaaaaagtgttt

SEQ ID NO: 343759 - DNA, 14 bp, Homo sapiens
ttgaaaattttact

SEQ ID NO: 343760 - DNA, 14 bp, Homo sapiens
ttgaaacagcagtc

SEQ ID NO: 343761 - DNA, 13 bp, Homo sapiens
ttgaaagaccttc

SEQ ID NO: 343762 - DNA, 14 bp, Homo sapiens
ttgaaagagttaag

SEQ ID NO: 343763 - DNA, 16 bp, Homo sapiens
ttgaaagcatccatgt

SEQ ID NO: 343764 - DNA, 22 bp, Homo sapiens
ttgaaagctgtggccagcttgt

SEQ ID NO: 343765 - DNA, 23 bp, Homo sapiens
ttgaaaggagaaaaaaaaagcca

SEQ ID NO: 343766 - DNA, 17 bp, Homo sapiens
ttgaaagttttcagaac

SEQ ID NO: 343767 - DNA, 18 bp, Homo sapiens
ttgaaagtttttaatatt

SEQ ID NO: 343768 - DNA, 15 bp, Homo sapiens
ttgaaatatgcatgt

SEQ ID NO: 343769 - DNA, 16 bp, Homo sapiens
ttgaaatatgcatgta

SEQ ID NO: 343770 - DNA, 16 bp, Homo sapiens
ttgaaatcaaatgttt

SEQ ID NO: 343771 - DNA, 19 bp, Homo sapiens
ttgaaatcaccttttctaa

SEQ ID NO: 343772 - DNA, 13 bp, Homo sapiens
ttgaaatctttta

SEQ ID NO: 343773 - DNA, 19 bp, Homo sapiens
ttgaaattatgtatgttta

SEQ ID NO: 343774 - DNA, 21 bp, Homo sapiens
ttgaaattatgtatgtttaca

SEQ ID NO: 343775 - DNA, 19 bp, Homo sapiens
ttgaaattgtgaactcatt

SEQ ID NO: 343776 - DNA, 20 bp, Homo sapiens
ttgaacaagatttccctaaa

SEQ ID NO: 343777 - DNA, 18 bp, Homo sapiens
ttgaaccaaaacattccg

SEQ ID NO: 343778 - DNA, 18 bp, Homo sapiens
ttgaacctttttttttga

SEQ ID NO: 343779 - DNA, 21 bp, Homo sapiens
ttgaacctttttttttgaaac

SEQ ID NO: 343780 - DNA, 18 bp, Homo sapiens
ttgaactcacgagccttg

SEQ ID NO: 343781 - DNA, 19 bp, Homo sapiens
ttgaactcttcaatctctt

SEQ ID NO: 343782 - DNA, 21 bp, Homo sapiens
ttgaactgttctggcctcaga

SEQ ID NO: 343783 - DNA, 18 bp, Homo sapiens
ttgaagaacaaaaggctt

SEQ ID NO: 343784 - DNA, 19 bp, Homo sapiens
ttgaagaacaaaaggcttt

SEQ ID NO: 343785 - DNA, 13 bp, Homo sapiens
ttgaagatgtagc

SEQ ID NO: 343786 - DNA, 13 bp, Homo sapiens
ttgaagcacaagt

SEQ ID NO: 343787 - DNA, 18 bp, Homo sapiens
ttgaagcagtcttgctct

SEQ ID NO: 343788 - DNA, 14 bp, Homo sapiens
ttgaagtcatcata

SEQ ID NO: 343789 - DNA, 23 bp, Homo sapiens
ttgaataaaaaacatttgtacat

SEQ ID NO: 343790 - DNA, 21 bp, Homo sapiens
ttgaataaaaactttgctaaa

SEQ ID NO: 343791 - DNA, 12 bp, Homo sapiens
ttgaataaataa

SEQ ID NO: 343792 - DNA, 14 bp, Homo sapiens
ttgaataatgtagt

SEQ ID NO: 343793 - DNA, 19 bp, Homo sapiens
ttgaatcaatctggcttct

SEQ ID NO: 343794 - DNA, 17 bp, Homo sapiens
ttgaatcccacttcagt

SEQ ID NO: 343795 - DNA, 21 bp, Homo sapiens
ttgaatgaaaaatttaagcat

SEQ ID NO: 343796 - DNA, 17 bp, Homo sapiens
ttgaatgacaacagaag

SEQ ID NO: 343797 - DNA, 16 bp, Homo sapiens
ttgaatgatgccatga

SEQ ID NO: 343798 - DNA, 16 bp, Homo sapiens
ttgaatgcttcctgac

SEQ ID NO: 343799 - DNA, 15 bp, Homo sapiens
ttgaatgctttttga

SEQ ID NO: 343800 - DNA, 18 bp, Homo sapiens
ttgaatggattaaatggc

SEQ ID NO: 343801 - DNA, 14 bp, Homo sapiens
ttgaatgtacaaag

SEQ ID NO: 343802 - DNA, 15 bp, Homo sapiens
ttgaatgtacaaaga

SEQ ID NO: 343803 - DNA, 19 bp, Homo sapiens
ttgaatgtacaaagatact

SEQ ID NO: 343804 - DNA, 18 bp, Homo sapiens
ttgaatgtcaatatgaga

SEQ ID NO: 343805 - DNA, 12 bp, Homo sapiens
ttgaatgtgatc

SEQ ID NO: 343806 - DNA, 19 bp, Homo sapiens
ttgaattttttttaacatt

SEQ ID NO: 343807 - DNA, 21 bp, Homo sapiens
ttgacaagttgcgacggagag

SEQ ID NO: 343808 - DNA, 19 bp, Homo sapiens
ttgacaattcctagataaa

SEQ ID NO: 343809 - DNA, 21 bp, Homo sapiens
ttgacacactcaccatttaat

SEQ ID NO: 343810 - DNA, 13 bp, Homo sapiens
ttgacatcaactg

SEQ ID NO: 343811 - DNA, 16 bp, Homo sapiens
ttgacatccaaatcta

SEQ ID NO: 343812 - DNA, 22 bp, Homo sapiens
ttgacatgtggaaagtgaattt

SEQ ID NO: 343813 - DNA, 14 bp, Homo sapiens
ttgacattttgtag

SEQ ID NO: 343814 - DNA, 16 bp, Homo sapiens
ttgacattttgtagct

SEQ ID NO: 343815 - DNA, 16 bp, Homo sapiens
ttgaccaagaactgca

SEQ ID NO: 343816 - DNA, 21 bp, Homo sapiens
ttgaccaagaactgcatggac

SEQ ID NO: 343817 - DNA, 13 bp, Homo sapiens
ttgaccagaaaat

SEQ ID NO: 343818 - DNA, 14 bp, Homo sapiens
ttgaccccttcctg

SEQ ID NO: 343819 - DNA, 16 bp, Homo sapiens
ttgaccccttcctgtc

SEQ ID NO: 343820 - DNA, 18 bp, Homo sapiens
ttgacctaagatttattt

SEQ ID NO: 343821 - DNA, 18 bp, Homo sapiens
ttgacctcagctgcacat

SEQ ID NO: 343822 - DNA, 21 bp, Homo sapiens
ttgacctttatttattaaact

SEQ ID NO: 343823 - DNA, 20 bp, Homo sapiens
ttgacggatgattggattat

SEQ ID NO: 343824 - DNA, 21 bp, Homo sapiens
ttgactagggattcaggctgc

SEQ ID NO: 343825 - DNA, 19 bp, Homo sapiens
ttgactgaagcgaacatct

SEQ ID NO: 343826 - DNA, 16 bp, Homo sapiens
ttgactggctttcctc

SEQ ID NO: 343827 - DNA, 18 bp, Homo sapiens
ttgactggctttcctctc

SEQ ID NO: 343828 - DNA, 20 bp, Homo sapiens
ttgactgttatttgttgaga

SEQ ID NO: 343829 - DNA, 12 bp, Homo sapiens
ttgagaaagaaa

SEQ ID NO: 343830 - DNA, 22 bp, Homo sapiens
ttgagaaatgaataatttccca

SEQ ID NO: 343831 - DNA, 19 bp, Homo sapiens
ttgagaatattataaaaat

SEQ ID NO: 343832 - DNA, 13 bp, Homo sapiens
ttgagacaaaaat

SEQ ID NO: 343833 - DNA, 15 bp, Homo sapiens
ttgagacaaaaatta

SEQ ID NO: 343834 - DNA, 16 bp, Homo sapiens
ttgagacaaaaattat

SEQ ID NO: 343835 - DNA, 17 bp, Homo sapiens
ttgagacactgtcaaga

SEQ ID NO: 343836 - DNA, 14 bp, Homo sapiens
ttgagactagtttt

SEQ ID NO: 343837 - DNA, 19 bp, Homo sapiens
ttgagagagagaacctttc

SEQ ID NO: 343838 - DNA, 21 bp, Homo sapiens
ttgagagcgctggcctcttcc

SEQ ID NO: 343839 - DNA, 16 bp, Homo sapiens
ttgagagctgctgagg

SEQ ID NO: 343840 - DNA, 20 bp, Homo sapiens
ttgcctcctctctccctgcc

SEQ ID NO: 343841 - DNA, 22 bp, Homo sapiens
ttgcctcctctctccctgcctc

SEQ ID NO: 343842 - DNA, 23 bp, Homo sapiens
ttgcctcctctctccctgcctca

SEQ ID NO: 343843 - DNA, 15 bp, Homo sapiens
ttgcctgggcagtgc

SEQ ID NO: 343844 - DNA, 17 bp, Homo sapiens
ttgcctgggcagtgccc

SEQ ID NO: 343845 - DNA, 18 bp, Homo sapiens
ttgcctgggcagtgccca

SEQ ID NO: 343846 - DNA, 19 bp, Homo sapiens
ttgcctgtagagccagcct

SEQ ID NO: 343847 - DNA, 21 bp, Homo sapiens
ttgccttccacgctgtctcca

SEQ ID NO: 343848 - DNA, 17 bp, Homo sapiens
ttgccttctacttttaa

SEQ ID NO: 343849 - DNA, 16 bp, Homo sapiens
ttgcctttaggcagga

SEQ ID NO: 343850 - DNA, 18 bp, Homo sapiens
ttgcctttatctctgagg

SEQ ID NO: 343851 - DNA, 20 bp, Homo sapiens
ttgcctttatctctgaggct

SEQ ID NO: 343852 - DNA, 17 bp, Homo sapiens
ttgcctttgttttgatg

SEQ ID NO: 343853 - DNA, 24 bp, Homo sapiens
ttgccttttttatcatttctactg

SEQ ID NO: 343854 - DNA, 14 bp, Homo sapiens
ttgcgatgtgtttt

SEQ ID NO: 343855 - DNA, 16 bp, Homo sapiens
ttgcgtggatcaagct

SEQ ID NO: 343856 - DNA, 12 bp, Homo sapiens
ttgcgtgtctgt

SEQ ID NO: 343857 - DNA, 23 bp, Homo sapiens
ttgcgtgtctgtttccttctctt

SEQ ID NO: 343858 - DNA, 22 bp, Homo sapiens
ttgctaaaggaaaaaaccatcc

SEQ ID NO: 343859 - DNA, 23 bp, Homo sapiens
ttgctaagataattaaatgaaat

SEQ ID NO: 343860 - DNA, 20 bp, Homo sapiens
ttgctaagggaaataacagt

SEQ ID NO: 343861 - DNA, 20 bp, Homo sapiens
ttgctaagtgaggatgaaaa

SEQ ID NO: 343862 - DNA, 13 bp, Homo sapiens
ttgctacacacac

SEQ ID NO: 343863 - DNA, 14 bp, Homo sapiens
ttgctacacacaca

SEQ ID NO: 343864 - DNA, 20 bp, Homo sapiens
ttgctagccagcattccata

SEQ ID NO: 343865 - DNA, 19 bp, Homo sapiens
ttgctagctatgtgacctt

SEQ ID NO: 343866 - DNA, 13 bp, Homo sapiens
ttgctattggaat

SEQ ID NO: 343867 - DNA, 19 bp, Homo sapiens
ttgctcaaatctattcaga

SEQ ID NO: 343868 - DNA, 21 bp, Homo sapiens
ttgctcaagttcattgatgac

SEQ ID NO: 343869 - DNA, 22 bp, Homo sapiens
ttgctcaagttcattgatgacc

SEQ ID NO: 343870 - DNA, 13 bp, Homo sapiens
ttgctcactccct

SEQ ID NO: 343871 - DNA, 14 bp, Homo sapiens
ttgctcactcccta

SEQ ID NO: 343872 - DNA, 16 bp, Homo sapiens
ttgctcagaagagaat

SEQ ID NO: 343873 - DNA, 21 bp, Homo sapiens
ttgctcagacgagacacccta

SEQ ID NO: 343874 - DNA, 23 bp, Homo sapiens
ttgctcagagaaggaaaagactg

SEQ ID NO: 343875 - DNA, 17 bp, Homo sapiens
ttgctcagtgcctcctg

SEQ ID NO: 343876 - DNA, 20 bp, Homo sapiens
ttgctcagtgcctcctggcc

SEQ ID NO: 343877 - DNA, 14 bp, Homo sapiens
ttgctcataatctg

SEQ ID NO: 343878 - DNA, 17 bp, Homo sapiens
ttgctccaccccactca

SEQ ID NO: 343879 - DNA, 17 bp, Homo sapiens
ttgctcccagtgccaaa

SEQ ID NO: 343880 - DNA, 14 bp, Homo sapiens
ttgctcctaagcaa

SEQ ID NO: 343881 - DNA, 23 bp, Homo sapiens
ttgctcctcagggtccctcagga

SEQ ID NO: 343882 - DNA, 13 bp, Homo sapiens
ttgctctccctct

SEQ ID NO: 343883 - DNA, 18 bp, Homo sapiens
ttgctctccctcttctca

SEQ ID NO: 343884 - DNA, 20 bp, Homo sapiens
ttgctctggaagcctgctga

SEQ ID NO: 343885 - DNA, 16 bp, Homo sapiens
ttgctcttggaaagct

SEQ ID NO: 343886 - DNA, 20 bp, Homo sapiens
ttgctgaataacaacaattt

SEQ ID NO: 343887 - DNA, 21 bp, Homo sapiens
ttgctgaatgtcattatttga

SEQ ID NO: 343888 - DNA, 16 bp, Homo sapiens
ttgctgagaaatgggg

SEQ ID NO: 343889 - DNA, 16 bp, Homo sapiens
ttgctgagatgtttag

SEQ ID NO: 343890 - DNA, 22 bp, Homo sapiens
ttgctgatggcttgacatgtgc

SEQ ID NO: 343891 - DNA, 12 bp, Homo sapiens
ttgctgcagtgt

SEQ ID NO: 343892 - DNA, 20 bp, Homo sapiens
ttgctgccaagtcctgcctt

SEQ ID NO: 343893 - DNA, 13 bp, Homo sapiens
ttgctgcccctgt

SEQ ID NO: 343894 - DNA, 21 bp, Homo sapiens
ttgctgcccctgtctggaaga

SEQ ID NO: 343895 - DNA, 23 bp, Homo sapiens
ttgctgctataattctatactgt

SEQ ID NO: 343896 - DNA, 21 bp, Homo sapiens
ttgctgctatgaaaatgagca

SEQ ID NO: 343897 - DNA, 11 bp, Homo sapiens
ttgctggaaaa

SEQ ID NO: 343898 - DNA, 17 bp, Homo sapiens
ttgctggaaaatctgta

SEQ ID NO: 343899 - DNA, 17 bp, Homo sapiens
ttgctggagtgctggct

SEQ ID NO: 343900 - DNA, 16 bp, Homo sapiens
ttgctgggcctcattc

SEQ ID NO: 343901 - DNA, 22 bp, Homo sapiens
ttgctgggcctcattctagcac

SEQ ID NO: 343902 - DNA, 12 bp, Homo sapiens
ttgctgggcttt

SEQ ID NO: 343903 - DNA, 17 bp, Homo sapiens
ttgctgtgaaacagtgt

SEQ ID NO: 343904 - DNA, 17 bp, Homo sapiens
ttgctgtgaaatgactg

SEQ ID NO: 343905 - DNA, 18 bp, Homo sapiens
ttgctgtgaggctgtcct

SEQ ID NO: 343906 - DNA, 19 bp, Homo sapiens
ttgctgtgaggctgtcctg

SEQ ID NO: 343907 - DNA, 17 bp, Homo sapiens
ttgctgtgtcacactct

SEQ ID NO: 343908 - DNA, 12 bp, Homo sapiens
ttgcttaaacaa

SEQ ID NO: 343909 - DNA, 12 bp, Homo sapiens
ttgcttatgaat

SEQ ID NO: 343910 - DNA, 22 bp, Homo sapiens
ttgcttattgttccaagacatt

SEQ ID NO: 343911 - DNA, 17 bp, Homo sapiens
ttgcttccccttttgcc

SEQ ID NO: 343912 - DNA, 20 bp, Homo sapiens
ttgcttccccttttgccaat

SEQ ID NO: 343913 - DNA, 23 bp, Homo sapiens
ttgcttcttatggtataataaag

SEQ ID NO: 343914 - DNA, 19 bp, Homo sapiens
ttgcttcttgtgtttgaaa

SEQ ID NO: 343915 - DNA, 18 bp, Homo sapiens
ttgcttggactacctata

SEQ ID NO: 343916 - DNA, 21 bp, Homo sapiens
ttgctttgaaactagacttga

SEQ ID NO: 343917 - DNA, 16 bp, Homo sapiens
ttgctttgaagcagtt

SEQ ID NO: 343918 - DNA, 22 bp, Homo sapiens
ttgctttgaagcagttgtgtca

SEQ ID NO: 343919 - DNA, 23 bp, Homo sapiens
ttgctttgggctttgcaggctct

SEQ ID NO: 343920 - DNA, 19 bp, Homo sapiens
ttgcttttacggtgatatt

SEQ ID NO: 343921 - DNA, 22 bp, Homo sapiens
ttgcttttacggtgatattgtg

SEQ ID NO: 343922 - DNA, 12 bp, Homo sapiens
ttgcttttgtgc

SEQ ID NO: 343923 - DNA, 19 bp, Homo sapiens
ttggaaaacataaaaatca

SEQ ID NO: 343924 - DNA, 17 bp, Homo sapiens
ttggaaaccatgcacta

SEQ ID NO: 343925 - DNA, 21 bp, Homo sapiens
ttggaaacctgccctgcctga

SEQ ID NO: 343926 - DNA, 22 bp, Homo sapiens
ttggaaactgttggttgagata

SEQ ID NO: 343927 - DNA, 22 bp, Homo sapiens
ttggaaagcacaaacttctgta

SEQ ID NO: 343928 - DNA, 23 bp, Homo sapiens
ttggaacagacctcactgctttg

SEQ ID NO: 343929 - DNA, 18 bp, Homo sapiens
ttggaactctaccctggt

SEQ ID NO: 343930 - DNA, 18 bp, Homo sapiens
ttggaactctgtgcaggt

SEQ ID NO: 343931 - DNA, 20 bp, Homo sapiens
ttggaagaccccacccaagc

SEQ ID NO: 343932 - DNA, 18 bp, Homo sapiens
ttggaaggaaaggaatat

SEQ ID NO: 343933 - DNA, 21 bp, Homo sapiens
ttggaagggcgctgagggcag

SEQ ID NO: 343934 - DNA, 23 bp, Homo sapiens
ttggaagggcgctgagggcaggg

SEQ ID NO: 343935 - DNA, 16 bp, Homo sapiens
ttggaagtgaaattag

SEQ ID NO: 343936 - DNA, 18 bp, Homo sapiens
ttggaattaaaacaatgt

SEQ ID NO: 343937 - DNA, 18 bp, Homo sapiens
ttggaattaacctggtgc

SEQ ID NO: 343938 - DNA, 19 bp, Homo sapiens
ttggaatttgtaacctcag

SEQ ID NO: 343939 - DNA, 21 bp, Homo sapiens
ttggaatttgtaacctcagct

SEQ ID NO: 343940 - DNA, 14 bp, Homo sapiens
ttggacagcaaaac

SEQ ID NO: 343941 - DNA, 17 bp, Homo sapiens
ttggacctcgtgcttta

SEQ ID NO: 343942 - DNA, 15 bp, Homo sapiens
ttggactacctataa

SEQ ID NO: 343943 - DNA, 15 bp, Homo sapiens
ttggactctcaggga

SEQ ID NO: 343944 - DNA, 14 bp, Homo sapiens
ttggactgacattt

SEQ ID NO: 343945 - DNA, 19 bp, Homo sapiens
ttggactgtggcctcagga

SEQ ID NO: 343946 - DNA, 14 bp, Homo sapiens
ttggactttcaaaa

SEQ ID NO: 343947 - DNA, 23 bp, Homo sapiens
ttggactttcaaaattaaatctg

SEQ ID NO: 343948 - DNA, 16 bp, Homo sapiens
ttggagacaattacaa

SEQ ID NO: 343949 - DNA, 21 bp, Homo sapiens
ttggagagagcaatcttgctg

SEQ ID NO: 343950 - DNA, 20 bp, Homo sapiens
ttggagccactcctgtcccg

SEQ ID NO: 343951 - DNA, 14 bp, Homo sapiens
ttggagcccgtgca

SEQ ID NO: 343952 - DNA, 19 bp, Homo sapiens
ttggagctgagatgagccc

SEQ ID NO: 343953 - DNA, 20 bp, Homo sapiens
ttggagcttacatagtttta

SEQ ID NO: 343954 - DNA, 23 bp, Homo sapiens
ttggaggcccttttctggctcct

SEQ ID NO: 343955 - DNA, 20 bp, Homo sapiens
ttggaggtatcctgtgtgtc

SEQ ID NO: 343956 - DNA, 18 bp, Homo sapiens
ttggaggtgcttaagcag

SEQ ID NO: 343957 - DNA, 20 bp, Homo sapiens
ttggagtgagtgtggctccc

SEQ ID NO: 343958 - DNA, 22 bp, Homo sapiens
ttggagtgagtgtggctcccct

SEQ ID NO: 343959 - DNA, 17 bp, Homo sapiens
ttggatctatcacctgt

SEQ ID NO: 343960 - DNA, 14 bp, Homo sapiens
ttggatgggagtgg

SEQ ID NO: 343961 - DNA, 24 bp, Homo sapiens
ttggatgggagtgggcacctcaga

SEQ ID NO: 343962 - DNA, 14 bp, Homo sapiens
ttggatgtggagct

SEQ ID NO: 343963 - DNA, 18 bp, Homo sapiens
ttggattattcatttaaa

SEQ ID NO: 343964 - DNA, 15 bp, Homo sapiens
ttggatttgcatttt

SEQ ID NO: 343965 - DNA, 17 bp, Homo sapiens
ttggatttgcatttttg

SEQ ID NO: 343966 - DNA, 20 bp, Homo sapiens
ttggcaagaagactgtattt

SEQ ID NO: 343967 - DNA, 12 bp, Homo sapiens
ttggcaccaaag

SEQ ID NO: 343968 - DNA, 22 bp, Homo sapiens
ttggcaccccagctaccccttc

SEQ ID NO: 343969 - DNA, 18 bp, Homo sapiens
ttggcacccccatgctgc

SEQ ID NO: 343970 - DNA, 19 bp, Homo sapiens
ttggcacccccatgctgcc

SEQ ID NO: 343971 - DNA, 21 bp, Homo sapiens
ttggcacccccatgctgcctt

SEQ ID NO: 343972 - DNA, 22 bp, Homo sapiens
ttggcactgagatatttattgt

SEQ ID NO: 343973 - DNA, 22 bp, Homo sapiens
ttggcactgatgggcactggaa

SEQ ID NO: 343974 - DNA, 22 bp, Homo sapiens
ttggcatctctccccatatata

SEQ ID NO: 343975 - DNA, 13 bp, Homo sapiens
ttggcattatctc

SEQ ID NO: 343976 - DNA, 21 bp, Homo sapiens
ttggccacaacctgaaagaca

SEQ ID NO: 343977 - DNA, 19 bp, Homo sapiens
ttggccacggcctgggagg

SEQ ID NO: 343978 - DNA, 20 bp, Homo sapiens
ttggccactgggtctcactc

SEQ ID NO: 343979 - DNA, 21 bp, Homo sapiens
ttggccactttgcagacctgg

SEQ ID NO: 343980 - DNA, 22 bp, Homo sapiens
ttggccactttgcagacctggg

SEQ ID NO: 343981 - DNA, 15 bp, Homo sapiens
ttggcccccgagctg

SEQ ID NO: 343982 - DNA, 11 bp, Homo sapiens
ttggcccctct

SEQ ID NO: 343983 - DNA, 14 bp, Homo sapiens
ttggcccttccagt

SEQ ID NO: 343984 - DNA, 22 bp, Homo sapiens
ttggcctgtctcatccccaggg

SEQ ID NO: 343985 - DNA, 21 bp, Homo sapiens
ttggccttggggccagactgg

SEQ ID NO: 343986 - DNA, 15 bp, Homo sapiens
ttggcctttgtaaga

SEQ ID NO: 343987 - DNA, 17 bp, Homo sapiens
ttggcgctattacaaat

SEQ ID NO: 343988 - DNA, 23 bp, Homo sapiens
ttggcgtgtgtccctgtggtacc

SEQ ID NO: 343989 - DNA, 14 bp, Homo sapiens
ttggctcctttccc

SEQ ID NO: 343990 - DNA, 19 bp, Homo sapiens
ttggctcctttcccacagt

SEQ ID NO: 343991 - DNA, 17 bp, Homo sapiens
ttggctcgggacttcaa

SEQ ID NO: 343992 - DNA, 11 bp, Homo sapiens
ttggctctttc

SEQ ID NO: 343993 - DNA, 15 bp, Homo sapiens
ttggctgactggggc

SEQ ID NO: 343994 - DNA, 16 bp, Homo sapiens
ttggctgagccccctc

SEQ ID NO: 343995 - DNA, 13 bp, Homo sapiens
ttggctgctgcca

SEQ ID NO: 343996 - DNA, 14 bp, Homo sapiens
ttggctgctgccac

SEQ ID NO: 343997 - DNA, 13 bp, Homo sapiens
ttggctgggccca

SEQ ID NO: 343998 - DNA, 17 bp, Homo sapiens
ttggctgggcccagaag

SEQ ID NO: 343999 - DNA, 18 bp, Homo sapiens
ttggctgggcccagaagg

SEQ ID NO: 344000 - DNA, 14 bp, Homo sapiens
ttggctgttccaga

SEQ ID NO: 344001 - DNA, 17 bp, Homo sapiens
ttggcttactgcagcct

SEQ ID NO: 344002 - DNA, 17 bp, Homo sapiens
ttggcttgtgatctggg

SEQ ID NO: 344003 - DNA, 14 bp, Homo sapiens
ttggctttgtgctt

SEQ ID NO: 344004 - DNA, 20 bp, Homo sapiens
ttgggaaattcttgcactgt

SEQ ID NO: 344005 - DNA, 18 bp, Homo sapiens
ttgggaacactggcctgg

SEQ ID NO: 344006 - DNA, 22 bp, Homo sapiens
ttgggaccgccagatggggcct

SEQ ID NO: 344007 - DNA, 15 bp, Homo sapiens
ttgggacctgctgct

SEQ ID NO: 344008 - DNA, 17 bp, Homo sapiens
ttgggacctgctgctcc

SEQ ID NO: 344009 - DNA, 20 bp, Homo sapiens
ttgggacggaagtggcctga

SEQ ID NO: 344010 - DNA, 23 bp, Homo sapiens
ttgggagagacttgttttggatg

SEQ ID NO: 344011 - DNA, 15 bp, Homo sapiens
ttgggagagcccctg

SEQ ID NO: 344012 - DNA, 22 bp, Homo sapiens
ttgggagcactggagtgcaggg

SEQ ID NO: 344013 - DNA, 16 bp, Homo sapiens
ttgggaggccatttgt

SEQ ID NO: 344014 - DNA, 15 bp, Homo sapiens
ttgggaggctggagt

SEQ ID NO: 344015 - DNA, 21 bp, Homo sapiens
ttgggattgggggctggtgcc

SEQ ID NO: 344016 - DNA, 23 bp, Homo sapiens
ttgggcagtggagaggggacttg

SEQ ID NO: 344017 - DNA, 16 bp, Homo sapiens
ttgggcccagctgggc

SEQ ID NO: 344018 - DNA, 11 bp, Homo sapiens
ttgggcctctt

SEQ ID NO: 344019 - DNA, 18 bp, Homo sapiens
ttgggcggctgagagccc

SEQ ID NO: 344020 - DNA, 15 bp, Homo sapiens
ttgggctactggcag

SEQ ID NO: 344021 - DNA, 21 bp, Homo sapiens
ttgggctaggtagtggggacc

SEQ ID NO: 344022 - DNA, 15 bp, Homo sapiens
ttgggctcctggctg

SEQ ID NO: 344023 - DNA, 22 bp, Homo sapiens
ttgggctgacacctaccatgct

SEQ ID NO: 344024 - DNA, 20 bp, Homo sapiens
ttgggggaaaaaaaaaaaag

SEQ ID NO: 344025 - DNA, 11 bp, Homo sapiens
ttgggggaggc

SEQ ID NO: 344026 - DNA, 16 bp, Homo sapiens
ttgggggattcaaatg

SEQ ID NO: 344027 - DNA, 23 bp, Homo sapiens
ttggggggggcccgcctggcaga

SEQ ID NO: 344028 - DNA, 21 bp, Homo sapiens
ttggggtactcttgatgtgaa

SEQ ID NO: 344029 - DNA, 11 bp, Homo sapiens
ttggggtgggg

SEQ ID NO: 344030 - DNA, 21 bp, Homo sapiens
ttggggtggggcgggaggcca

SEQ ID NO: 344031 - DNA, 22 bp, Homo sapiens
ttgggtcctgcaatctccaggg

SEQ ID NO: 344032 - DNA, 20 bp, Homo sapiens
ttgggtgcaagagggagcac

SEQ ID NO: 344033 - DNA, 18 bp, Homo sapiens
ttgggtgtgccctggctc

SEQ ID NO: 344034 - DNA, 18 bp, Homo sapiens
ttgtcagactttaaagaa

SEQ ID NO: 344035 - DNA, 12 bp, Homo sapiens
ttgtcagctact

SEQ ID NO: 344036 - DNA, 14 bp, Homo sapiens
ttgtcagttgtgaa

SEQ ID NO: 344037 - DNA, 21 bp, Homo sapiens
ttgtcatcattgtatatatgt

SEQ ID NO: 344038 - DNA, 22 bp, Homo sapiens
ttgtcatccacacaacaccagg

SEQ ID NO: 344039 - DNA, 20 bp, Homo sapiens
ttgtcatcttttagagtaaa

SEQ ID NO: 344040 - DNA, 15 bp, Homo sapiens
ttgtcatgtgtatga

SEQ ID NO: 344041 - DNA, 18 bp, Homo sapiens
ttgtcattgctttactgg

SEQ ID NO: 344042 - DNA, 13 bp, Homo sapiens
ttgtcatttataa

SEQ ID NO: 344043 - DNA, 15 bp, Homo sapiens
ttgtccacaaatgtc

SEQ ID NO: 344044 - DNA, 17 bp, Homo sapiens
ttgtccacaaatgtcct

SEQ ID NO: 344045 - DNA, 14 bp, Homo sapiens
ttgtccacattcta

SEQ ID NO: 344046 - DNA, 18 bp, Homo sapiens
ttgtccaccattccttta

SEQ ID NO: 344047 - DNA, 22 bp, Homo sapiens
ttgtccacccacttagtccact

SEQ ID NO: 344048 - DNA, 23 bp, Homo sapiens
ttgtccagttcaggaatttttgt

SEQ ID NO: 344049 - DNA, 17 bp, Homo sapiens
ttgtccatgcctacaga

SEQ ID NO: 344050 - DNA, 20 bp, Homo sapiens
ttgtccatgcctacagataa

SEQ ID NO: 344051 - DNA, 15 bp, Homo sapiens
ttgtccccagggccc

SEQ ID NO: 344052 - DNA, 20 bp, Homo sapiens
ttgtccccagggcccctccc

SEQ ID NO: 344053 - DNA, 20 bp, Homo sapiens
ttgtccggtggaaggccttc

SEQ ID NO: 344054 - DNA, 23 bp, Homo sapiens
ttgtcctagagtgagagtttgga

SEQ ID NO: 344055 - DNA, 13 bp, Homo sapiens
ttgtcctcccctt

SEQ ID NO: 344056 - DNA, 23 bp, Homo sapiens
ttgtcctgatgcttttgtctaat

SEQ ID NO: 344057 - DNA, 11 bp, Homo sapiens
ttgtcctgcag

SEQ ID NO: 344058 - DNA, 13 bp, Homo sapiens
ttgtcctgcagag

SEQ ID NO: 344059 - DNA, 12 bp, Homo sapiens
ttgtcctgccag

SEQ ID NO: 344060 - DNA, 21 bp, Homo sapiens
ttgtcctgccagctgccttcc

SEQ ID NO: 344061 - DNA, 19 bp, Homo sapiens
ttgtcctttgagaaagaaa

SEQ ID NO: 344062 - DNA, 19 bp, Homo sapiens
ttgtctaaccccaggtttt

SEQ ID NO: 344063 - DNA, 14 bp, Homo sapiens
ttgtctcattgcca

SEQ ID NO: 344064 - DNA, 16 bp, Homo sapiens
ttgtctcattgccagt

SEQ ID NO: 344065 - DNA, 18 bp, Homo sapiens
ttgtctgaagtcactgca

SEQ ID NO: 344066 - DNA, 20 bp, Homo sapiens
ttgtctgaagtcactgcaca

SEQ ID NO: 344067 - DNA, 21 bp, Homo sapiens
ttgtctgaagtcactgcacag

SEQ ID NO: 344068 - DNA, 11 bp, Homo sapiens
ttgtctgctgc

SEQ ID NO: 344069 - DNA, 20 bp, Homo sapiens
ttgtctggctgtggcccctc

SEQ ID NO: 344070 - DNA, 21 bp, Homo sapiens
ttgtctggctgtggcccctcc

SEQ ID NO: 344071 - DNA, 15 bp, Homo sapiens
ttgtctgtgtgctgt

SEQ ID NO: 344072 - DNA, 17 bp, Homo sapiens
ttgtctgtgtgctgtaa

SEQ ID NO: 344073 - DNA, 16 bp, Homo sapiens
ttgtctttctttgctg

SEQ ID NO: 344074 - DNA, 14 bp, Homo sapiens
ttgtcttttcccct

SEQ ID NO: 344075 - DNA, 19 bp, Homo sapiens
ttgtgaaaagagtatgtag

SEQ ID NO: 344076 - DNA, 23 bp, Homo sapiens
ttgtgaaatgaaaacatgtaata

SEQ ID NO: 344077 - DNA, 19 bp, Homo sapiens
ttgtgaaatttgttaatat

SEQ ID NO: 344078 - DNA, 19 bp, Homo sapiens
ttgtgaagaaaaataaagt

SEQ ID NO: 344079 - DNA, 14 bp, Homo sapiens
ttgtgaagtacata

SEQ ID NO: 344080 - DNA, 17 bp, Homo sapiens
ttgtgaagtgattgaca

SEQ ID NO: 344081 - DNA, 20 bp, Homo sapiens
ttgtgaagtgattgacattt

SEQ ID NO: 344082 - DNA, 17 bp, Homo sapiens
ttgtgaatctattgttt

SEQ ID NO: 344083 - DNA, 16 bp, Homo sapiens
ttgtgaccaagttata

SEQ ID NO: 344084 - DNA, 21 bp, Homo sapiens
ttgtgactagtgctgaagctt

SEQ ID NO: 344085 - DNA, 22 bp, Homo sapiens
ttgtgactagtgctgaagctta

SEQ ID NO: 344086 - DNA, 21 bp, Homo sapiens
ttgtgactatatagagatgtt

SEQ ID NO: 344087 - DNA, 22 bp, Homo sapiens
ttgtgactatatagagatgttt

SEQ ID NO: 344088 - DNA, 16 bp, Homo sapiens
ttgtgagccaaagaga

SEQ ID NO: 344089 - DNA, 19 bp, Homo sapiens
ttgtgagccttgctgccaa

SEQ ID NO: 344090 - DNA, 16 bp, Homo sapiens
ttgtgagggacatgct

SEQ ID NO: 344091 - DNA, 18 bp, Homo sapiens
ttgtgaggtgaatgtctt

SEQ ID NO: 344092 - DNA, 13 bp, Homo sapiens
ttgtgagtatgtg

SEQ ID NO: 344093 - DNA, 16 bp, Homo sapiens
ttgtgagtatgtgtgg

SEQ ID NO: 344094 - DNA, 17 bp, Homo sapiens
ttgtgagtattctatgt

SEQ ID NO: 344095 - DNA, 17 bp, Homo sapiens
ttgtgatatggagccct

SEQ ID NO: 344096 - DNA, 17 bp, Homo sapiens
ttgtgatgatgctgtga

SEQ ID NO: 344097 - DNA, 19 bp, Homo sapiens
ttgtgatgatgctgtgaca

SEQ ID NO: 344098 - DNA, 18 bp, Homo sapiens
ttgtgatgtcccaacttg

SEQ ID NO: 344099 - DNA, 14 bp, Homo sapiens
ttgtgcaaaagcag

SEQ ID NO: 344100 - DNA, 20 bp, Homo sapiens
ttgtgctaatttctgtccag

SEQ ID NO: 344101 - DNA, 14 bp, Homo sapiens
ttgtgctagaatac

SEQ ID NO: 344102 - DNA, 16 bp, Homo sapiens
ttgtgcttttcctatt

SEQ ID NO: 344103 - DNA, 13 bp, Homo sapiens
ttgtggagaggag

SEQ ID NO: 344104 - DNA, 16 bp, Homo sapiens
ttgtggataagggaga

SEQ ID NO: 344105 - DNA, 19 bp, Homo sapiens
ttgtggcccccgccccctc

SEQ ID NO: 344106 - DNA, 11 bp, Homo sapiens
ttgtggcctca

SEQ ID NO: 344107 - DNA, 18 bp, Homo sapiens
ttgtggctcctatctgtg

SEQ ID NO: 344108 - DNA, 14 bp, Homo sapiens
ttgtggctgggggc

SEQ ID NO: 344109 - DNA, 18 bp, Homo sapiens
ttgtgggtttctctgtgc

SEQ ID NO: 344110 - DNA, 15 bp, Homo sapiens
ttgtggttctatttt

SEQ ID NO: 344111 - DNA, 13 bp, Homo sapiens
ttgtgtaaaggaa

SEQ ID NO: 344112 - DNA, 22 bp, Homo sapiens
ttgtgtaacaattttaatgcta

SEQ ID NO: 344113 - DNA, 23 bp, Homo sapiens
ttgtgtaataaaaatttgtttaa

SEQ ID NO: 344114 - DNA, 21 bp, Homo sapiens
tttcactttcacatagatgtc

SEQ ID NO: 344115 - DNA, 19 bp, Homo sapiens
tttcagaaaacagaaaaaa

SEQ ID NO: 344116 - DNA, 14 bp, Homo sapiens
tttcagaactgcta

SEQ ID NO: 344117 - DNA, 13 bp, Homo sapiens
tttcagagccagt

SEQ ID NO: 344118 - DNA, 22 bp, Homo sapiens
tttcagatgtcttctgcctgtt

SEQ ID NO: 344119 - DNA, 18 bp, Homo sapiens
tttcagattgtaaaggta

SEQ ID NO: 344120 - DNA, 17 bp, Homo sapiens
tttcagcacccccaccc

SEQ ID NO: 344121 - DNA, 18 bp, Homo sapiens
tttcagcacccccaccca

SEQ ID NO: 344122 - DNA, 18 bp, Homo sapiens
tttcagcatgaaaatgtg

SEQ ID NO: 344123 - DNA, 15 bp, Homo sapiens
tttcagccaatttgt

SEQ ID NO: 344124 - DNA, 20 bp, Homo sapiens
tttcagccaatttgtctcct

SEQ ID NO: 344125 - DNA, 18 bp, Homo sapiens
tttcagcttgtttctata

SEQ ID NO: 344126 - DNA, 18 bp, Homo sapiens
tttcaggaagggagagga

SEQ ID NO: 344127 - DNA, 11 bp, Homo sapiens
tttcaggacag

SEQ ID NO: 344128 - DNA, 21 bp, Homo sapiens
tttcaggacagctgcttctgt

SEQ ID NO: 344129 - DNA, 22 bp, Homo sapiens
tttcaggaggctggaggaaggg

SEQ ID NO: 344130 - DNA, 17 bp, Homo sapiens
tttcaggcaaggcagct

SEQ ID NO: 344131 - DNA, 23 bp, Homo sapiens
tttcagggggcctttaaagactt

SEQ ID NO: 344132 - DNA, 18 bp, Homo sapiens
tttcaggtgtttagttgc

SEQ ID NO: 344133 - DNA, 14 bp, Homo sapiens
tttcaggtttgtca

SEQ ID NO: 344134 - DNA, 18 bp, Homo sapiens
tttcagtaataaaacatc

SEQ ID NO: 344135 - DNA, 16 bp, Homo sapiens
tttctatctaaatgat

SEQ ID NO: 344136 - DNA, 22 bp, Homo sapiens
tttctatgtaaattattgtaaa

SEQ ID NO: 344137 - DNA, 22 bp, Homo sapiens
tttctcaaaagcatttatcatt

SEQ ID NO: 344138 - DNA, 13 bp, Homo sapiens
tttctcaaagttt

SEQ ID NO: 344139 - DNA, 14 bp, Homo sapiens
tttctcaaagtttt

SEQ ID NO: 344140 - DNA, 22 bp, Homo sapiens
tttctcaaagtttttacagtgt

SEQ ID NO: 344141 - DNA, 12 bp, Homo sapiens
tttctcaaataa

SEQ ID NO: 344142 - DNA, 13 bp, Homo sapiens
tttctcaaataaa

SEQ ID NO: 344143 - DNA, 24 bp, Homo sapiens
tttctcactccctttgtggacttt

SEQ ID NO: 344144 - DNA, 20 bp, Homo sapiens
tttctcatgtgctttgtagc

SEQ ID NO: 344145 - DNA, 14 bp, Homo sapiens
tttctcattcttgc

SEQ ID NO: 344146 - DNA, 23 bp, Homo sapiens
tttctccagaaccagtgtctgaa

SEQ ID NO: 344147 - DNA, 15 bp, Homo sapiens
tttctccaggccctc

SEQ ID NO: 344148 - DNA, 19 bp, Homo sapiens
tttctccatcccctccctg

SEQ ID NO: 344149 - DNA, 20 bp, Homo sapiens
tttctccccatccccttcct

SEQ ID NO: 344150 - DNA, 19 bp, Homo sapiens
tttctcccgaatcctgagg

SEQ ID NO: 344151 - DNA, 20 bp, Homo sapiens
tttctccttagtcttctcat

SEQ ID NO: 344152 - DNA, 19 bp, Homo sapiens
tttctcgagtccaaaatca

SEQ ID NO: 344153 - DNA, 14 bp, Homo sapiens
tttctctacactaa

SEQ ID NO: 344154 - DNA, 18 bp, Homo sapiens
tttctctgagagagatga

SEQ ID NO: 344155 - DNA, 19 bp, Homo sapiens
tttctctgagctttgttac

SEQ ID NO: 344156 - DNA, 14 bp, Homo sapiens
tttctctgcttcag

SEQ ID NO: 344157 - DNA, 18 bp, Homo sapiens
tttctctgcttcagcttg

SEQ ID NO: 344158 - DNA, 16 bp, Homo sapiens
tttctctgtgctctga

SEQ ID NO: 344159 - DNA, 17 bp, Homo sapiens
tttctctgtgtttgttc

SEQ ID NO: 344160 - DNA, 17 bp, Homo sapiens
tttctcttaacttaatt

SEQ ID NO: 344161 - DNA, 14 bp, Homo sapiens
tttctcttctgtcc

SEQ ID NO: 344162 - DNA, 16 bp, Homo sapiens
tttctctttctctcct

SEQ ID NO: 344163 - DNA, 18 bp, Homo sapiens
tttctgaaaattccagaa

SEQ ID NO: 344164 - DNA, 15 bp, Homo sapiens
tttctgaatagaaat

SEQ ID NO: 344165 - DNA, 22 bp, Homo sapiens
tttctgaattcataaaaataac

SEQ ID NO: 344166 - DNA, 16 bp, Homo sapiens
tttctgagcttttcat

SEQ ID NO: 344167 - DNA, 11 bp, Homo sapiens
tttctgaggag

SEQ ID NO: 344168 - DNA, 23 bp, Homo sapiens
tttctgataactagatggtgctg

SEQ ID NO: 344169 - DNA, 14 bp, Homo sapiens
tttctgatgtctcc

SEQ ID NO: 344170 - DNA, 22 bp, Homo sapiens
tttctgattcactattagagaa

SEQ ID NO: 344171 - DNA, 14 bp, Homo sapiens
tttctgcagaaaca

SEQ ID NO: 344172 - DNA, 20 bp, Homo sapiens
tttctgcccaactttcattg

SEQ ID NO: 344173 - DNA, 13 bp, Homo sapiens
tttctgccctgcc

SEQ ID NO: 344174 - DNA, 23 bp, Homo sapiens
tttctggaaattcttccctgggg

SEQ ID NO: 344175 - DNA, 21 bp, Homo sapiens
tttctggactgaagcctgcag

SEQ ID NO: 344176 - DNA, 15 bp, Homo sapiens
tttctggtagataga

SEQ ID NO: 344177 - DNA, 14 bp, Homo sapiens
tttctgtaaataac

SEQ ID NO: 344178 - DNA, 16 bp, Homo sapiens
tttctgtaaataacct

SEQ ID NO: 344179 - DNA, 14 bp, Homo sapiens
tttctgtaaatgaa

SEQ ID NO: 344180 - DNA, 23 bp, Homo sapiens
tttctgtccttttggcactgaga

SEQ ID NO: 344181 - DNA, 23 bp, Homo sapiens
tttctgtctctctctctttttct

SEQ ID NO: 344182 - DNA, 12 bp, Homo sapiens
tttctgtgaagc

SEQ ID NO: 344183 - DNA, 18 bp, Homo sapiens
tttctgtggaaaacaatt

SEQ ID NO: 344184 - DNA, 24 bp, Homo sapiens
tttctgtggagagtgagaataatt

SEQ ID NO: 344185 - DNA, 11 bp, Homo sapiens
tttctgtgtgc

SEQ ID NO: 344186 - DNA, 22 bp, Homo sapiens
tttctgtgtgcaccttaccaac

SEQ ID NO: 344187 - DNA, 14 bp, Homo sapiens
tttctgttctgccc

SEQ ID NO: 344188 - DNA, 15 bp, Homo sapiens
tttctgttggtgtat

SEQ ID NO: 344189 - DNA, 18 bp, Homo sapiens
tttctgttgtttctttta

SEQ ID NO: 344190 - DNA, 16 bp, Homo sapiens
tttctgtttgaatttt

SEQ ID NO: 344191 - DNA, 19 bp, Homo sapiens
tttctgtttgaattttcaa

SEQ ID NO: 344192 - DNA, 17 bp, Homo sapiens
tttcttacataattttt

SEQ ID NO: 344193 - DNA, 22 bp, Homo sapiens
tttcttcatgcaatgacatctt

SEQ ID NO: 344194 - DNA, 16 bp, Homo sapiens
tttcttccacgtaatt

SEQ ID NO: 344195 - DNA, 20 bp, Homo sapiens
tttcttccactaccctccct

SEQ ID NO: 344196 - DNA, 13 bp, Homo sapiens
tttcttcctccag

SEQ ID NO: 344197 - DNA, 15 bp, Homo sapiens
tttcttcctccagtc

SEQ ID NO: 344198 - DNA, 14 bp, Homo sapiens
tttcttcctctgct

SEQ ID NO: 344199 - DNA, 16 bp, Homo sapiens
tttcttcctctgctga

SEQ ID NO: 344200 - DNA, 13 bp, Homo sapiens
tttcttcgctgct

SEQ ID NO: 344201 - DNA, 11 bp, Homo sapiens
tttcttctttg

SEQ ID NO: 344202 - DNA, 16 bp, Homo sapiens
tttcttgccagctcag

SEQ ID NO: 344203 - DNA, 21 bp, Homo sapiens
tttcttggacacttaattctg

SEQ ID NO: 344204 - DNA, 22 bp, Homo sapiens
tttcttggggtactcttgatgt

SEQ ID NO: 344205 - DNA, 14 bp, Homo sapiens
tttctttaaactat

SEQ ID NO: 344206 - DNA, 17 bp, Homo sapiens
tttctttaatcaaaagt

SEQ ID NO: 344207 - DNA, 13 bp, Homo sapiens
tttctttatttct

SEQ ID NO: 344208 - DNA, 16 bp, Homo sapiens
tttctttcagatgttt

SEQ ID NO: 344209 - DNA, 15 bp, Homo sapiens
tttctttccttaaaa

SEQ ID NO: 344210 - DNA, 13 bp, Homo sapiens
tttctttctatgt

SEQ ID NO: 344211 - DNA, 14 bp, Homo sapiens
tttctttgctgctg

SEQ ID NO: 344212 - DNA, 19 bp, Homo sapiens
tttctttgctgctgtggaa

SEQ ID NO: 344213 - DNA, 14 bp, Homo sapiens
tttcttttatatat

SEQ ID NO: 344214 - DNA, 15 bp, Homo sapiens
tttcttttatatata

SEQ ID NO: 344215 - DNA, 16 bp, Homo sapiens
tttcttttatatctgt

SEQ ID NO: 344216 - DNA, 15 bp, Homo sapiens
tttctttttaaagct

SEQ ID NO: 344217 - DNA, 22 bp, Homo sapiens
tttctttttattttaaatctga

SEQ ID NO: 344218 - DNA, 14 bp, Homo sapiens
tttcttttttctct

SEQ ID NO: 344219 - DNA, 19 bp, Homo sapiens
tttcttttttttttcgtct

SEQ ID NO: 344220 - DNA, 19 bp, Homo sapiens
tttgaaaacacttatttta

SEQ ID NO: 344221 - DNA, 20 bp, Homo sapiens
tttgaaaaccaacaccatca

SEQ ID NO: 344222 - DNA, 20 bp, Homo sapiens
tttgaaaaggcggtactagt

SEQ ID NO: 344223 - DNA, 15 bp, Homo sapiens
tttgaaaatatttct

SEQ ID NO: 344224 - DNA, 19 bp, Homo sapiens
tttgaaagaagtcaaatga

SEQ ID NO: 344225 - DNA, 22 bp, Homo sapiens
tttgaaagtgggtttcaattta

SEQ ID NO: 344226 - DNA, 15 bp, Homo sapiens
tttgaaatatgcatg

SEQ ID NO: 344227 - DNA, 19 bp, Homo sapiens
tttgaaatatgcatgtact

SEQ ID NO: 344228 - DNA, 22 bp, Homo sapiens
tttgaaatttaaaaatctttca

SEQ ID NO: 344229 - DNA, 19 bp, Homo sapiens
tttgaagaacaaaaggctt

SEQ ID NO: 344230 - DNA, 21 bp, Homo sapiens
tttgaagaagggaaattcaca

SEQ ID NO: 344231 - DNA, 15 bp, Homo sapiens
tttgaagaattaatg

SEQ ID NO: 344232 - DNA, 20 bp, Homo sapiens
tttgaagcagtcttgctctg

SEQ ID NO: 344233 - DNA, 22 bp, Homo sapiens
tttgaagtaatcccgccaccta

SEQ ID NO: 344234 - DNA, 20 bp, Homo sapiens
tttgaataaaaaacatttgt

SEQ ID NO: 344235 - DNA, 21 bp, Homo sapiens
tttgaataaaaaacatttgta

SEQ ID NO: 344236 - DNA, 19 bp, Homo sapiens
tttgaatatattttatctt

SEQ ID NO: 344237 - DNA, 21 bp, Homo sapiens
tttgaatcctggctctgattt

SEQ ID NO: 344238 - DNA, 13 bp, Homo sapiens
tttgaatgaaaaa

SEQ ID NO: 344239 - DNA, 22 bp, Homo sapiens
tttgaatgaaaaatttaagcat

SEQ ID NO: 344240 - DNA, 23 bp, Homo sapiens
tttgaatgaaaaatttaagcatt

SEQ ID NO: 344241 - DNA, 16 bp, Homo sapiens
tttgaatgcttcctga

SEQ ID NO: 344242 - DNA, 20 bp, Homo sapiens
tttgacaattcctagataaa

SEQ ID NO: 344243 - DNA, 17 bp, Homo sapiens
tttgacatgtggaaagt

SEQ ID NO: 344244 - DNA, 18 bp, Homo sapiens
tttgacattcttcactgt

SEQ ID NO: 344245 - DNA, 20 bp, Homo sapiens
tttgacatttaataactttg

SEQ ID NO: 344246 - DNA, 13 bp, Homo sapiens
tttgaccagaaaa

SEQ ID NO: 344247 - DNA, 16 bp, Homo sapiens
tttgaccccttcctgt

SEQ ID NO: 344248 - DNA, 12 bp, Homo sapiens
tttgactctttt

SEQ ID NO: 344249 - DNA, 22 bp, Homo sapiens
tttgactgcttcacggactctt

SEQ ID NO: 344250 - DNA, 15 bp, Homo sapiens
tttgactgtgattta

SEQ ID NO: 344251 - DNA, 14 bp, Homo sapiens
tttgacttcagctg

SEQ ID NO: 344252 - DNA, 19 bp, Homo sapiens
tttgacttcagctgcctga

SEQ ID NO: 344253 - DNA, 22 bp, Homo sapiens
tttgactttcttctgaatattt

SEQ ID NO: 344254 - DNA, 15 bp, Homo sapiens
tttgagaaagaaata

SEQ ID NO: 344255 - DNA, 20 bp, Homo sapiens
tttgagaaagaaataattgt

SEQ ID NO: 344256 - DNA, 20 bp, Homo sapiens
aggctgtcaattacaggaag

SEQ ID NO: 344257 - DNA, 15 bp, Homo sapiens
aggctgtcctgtaca

SEQ ID NO: 344258 - DNA, 21 bp, Homo sapiens
aggctgtcctgtacattgtgg

SEQ ID NO: 344259 - DNA, 15 bp, Homo sapiens
aggctgtctggggcc

SEQ ID NO: 344260 - DNA, 15 bp, Homo sapiens
aggctgtgggcctca

SEQ ID NO: 344261 - DNA, 18 bp, Homo sapiens
aggctgtgggcctcaagg

SEQ ID NO: 344262 - DNA, 18 bp, Homo sapiens
aggctgttttaacggcct

SEQ ID NO: 344263 - DNA, 20 bp, Homo sapiens
aggcttaagcgattctcatg

SEQ ID NO: 344264 - DNA, 11 bp, Homo sapiens
aggcttaggac

SEQ ID NO: 344265 - DNA, 17 bp, Homo sapiens
aggcttaggacttcaaa

SEQ ID NO: 344266 - DNA, 16 bp, Homo sapiens
aggcttaggtgccagg

SEQ ID NO: 344267 - DNA, 12 bp, Homo sapiens
aggcttccaggc

SEQ ID NO: 344268 - DNA, 14 bp, Homo sapiens
aggcttccaggctc

SEQ ID NO: 344269 - DNA, 16 bp, Homo sapiens
aggcttccaggctctt

SEQ ID NO: 344270 - DNA, 20 bp, Homo sapiens
aggcttccaggctcttcctg

SEQ ID NO: 344271 - DNA, 21 bp, Homo sapiens
aggcttcctgcaattttctaa

SEQ ID NO: 344272 - DNA, 22 bp, Homo sapiens
aggcttcctgcaattttctaag

SEQ ID NO: 344273 - DNA, 19 bp, Homo sapiens
aggcttctgggacttgaaa

SEQ ID NO: 344274 - DNA, 20 bp, Homo sapiens
aggcttcttccttcttgtca

SEQ ID NO: 344275 - DNA, 16 bp, Homo sapiens
aggcttggaatgaatt

SEQ ID NO: 344276 - DNA, 22 bp, Homo sapiens
aggcttgggcccagtagcccca

SEQ ID NO: 344277 - DNA, 16 bp, Homo sapiens
aggcttggtcccatcg

SEQ ID NO: 344278 - DNA, 22 bp, Homo sapiens
aggctttgccatgggcctgctg

SEQ ID NO: 344279 - DNA, 23 bp, Homo sapiens
aggctttgggaacactggcctgg

SEQ ID NO: 344280 - DNA, 14 bp, Homo sapiens
agggaaaaaacaag

SEQ ID NO: 344281 - DNA, 13 bp, Homo sapiens
agggaaaatatag

SEQ ID NO: 344282 - DNA, 16 bp, Homo sapiens
agggaaacaaaatatt

SEQ ID NO: 344283 - DNA, 20 bp, Homo sapiens
agggaaacccggggaactgg

SEQ ID NO: 344284 - DNA, 14 bp, Homo sapiens
agggaaagcgggca

SEQ ID NO: 344285 - DNA, 15 bp, Homo sapiens
agggaaatatcattt

SEQ ID NO: 344286 - DNA, 19 bp, Homo sapiens
agggaaatccaactccagg

SEQ ID NO: 344287 - DNA, 18 bp, Homo sapiens
agggaacagacctcggct

SEQ ID NO: 344288 - DNA, 13 bp, Homo sapiens
agggaaccagccc

SEQ ID NO: 344289 - DNA, 15 bp, Homo sapiens
agggaactctggggt

SEQ ID NO: 344290 - DNA, 14 bp, Homo sapiens
agggaactgcttgc

SEQ ID NO: 344291 - DNA, 22 bp, Homo sapiens
agggaactgggaagatgctggc

SEQ ID NO: 344292 - DNA, 15 bp, Homo sapiens
agggaagagaaagtg

SEQ ID NO: 344293 - DNA, 14 bp, Homo sapiens
agggaagagggcag

SEQ ID NO: 344294 - DNA, 14 bp, Homo sapiens
agggaagcagggac

SEQ ID NO: 344295 - DNA, 15 bp, Homo sapiens
agggaagcccacccg

SEQ ID NO: 344296 - DNA, 16 bp, Homo sapiens
agggaagcccacccgc

SEQ ID NO: 344297 - DNA, 21 bp, Homo sapiens
agggaagcccacccgccccag

SEQ ID NO: 344298 - DNA, 22 bp, Homo sapiens
agggaagcccacccgccccaga

SEQ ID NO: 344299 - DNA, 23 bp, Homo sapiens
agggaagcccacccgccccagag

SEQ ID NO: 344300 - DNA, 13 bp, Homo sapiens
agggaagctggcc

SEQ ID NO: 344301 - DNA, 16 bp, Homo sapiens
agggaaggccccacag

SEQ ID NO: 344302 - DNA, 20 bp, Homo sapiens
agggaaggtgaccgcccagc

SEQ ID NO: 344303 - DNA, 15 bp, Homo sapiens
agggaatccagctcc

SEQ ID NO: 344304 - DNA, 14 bp, Homo sapiens
agggaatgtgaaat

SEQ ID NO: 344305 - DNA, 16 bp, Homo sapiens
agggaatgttccctgc

SEQ ID NO: 344306 - DNA, 19 bp, Homo sapiens
agggaatgttccctgcacc

SEQ ID NO: 344307 - DNA, 13 bp, Homo sapiens
agggaattgctca

SEQ ID NO: 344308 - DNA, 22 bp, Homo sapiens
agggaatttctatctaaatgat

SEQ ID NO: 344309 - DNA, 20 bp, Homo sapiens
agggacaaatttaaaacaaa

SEQ ID NO: 344310 - DNA, 13 bp, Homo sapiens
agggacaagggat

SEQ ID NO: 344311 - DNA, 14 bp, Homo sapiens
agggacaagggatt

SEQ ID NO: 344312 - DNA, 15 bp, Homo sapiens
agggacaagggattc

SEQ ID NO: 344313 - DNA, 13 bp, Homo sapiens
agggacagcagcc

SEQ ID NO: 344314 - DNA, 15 bp, Homo sapiens
agggacagcagcctc

SEQ ID NO: 344315 - DNA, 23 bp, Homo sapiens
agggacagcagcctccctgtcac

SEQ ID NO: 344316 - DNA, 21 bp, Homo sapiens
agggacagcgggtaaaaagag

SEQ ID NO: 344317 - DNA, 16 bp, Homo sapiens
agggacagtattctca

SEQ ID NO: 344318 - DNA, 19 bp, Homo sapiens
agggaccaaggacccctca

SEQ ID NO: 344319 - DNA, 14 bp, Homo sapiens
agggactgaagcca

SEQ ID NO: 344320 - DNA, 23 bp, Homo sapiens
agggactgccagtccccctgccc

SEQ ID NO: 344321 - DNA, 16 bp, Homo sapiens
agggactgcctctgcc

SEQ ID NO: 344322 - DNA, 18 bp, Homo sapiens
agggactgcctctgccac

SEQ ID NO: 344323 - DNA, 16 bp, Homo sapiens
agggactggtccaggc

SEQ ID NO: 344324 - DNA, 20 bp, Homo sapiens
agggactggtccaggcatgg

SEQ ID NO: 344325 - DNA, 14 bp, Homo sapiens
aggtagtgagtaat

SEQ ID NO: 344326 - DNA, 19 bp, Homo sapiens
aggtataaaaaataagtaa

SEQ ID NO: 344327 - DNA, 14 bp, Homo sapiens
aggtatacaaaaga

SEQ ID NO: 344328 - DNA, 20 bp, Homo sapiens
aggtatcacacactttctga

SEQ ID NO: 344329 - DNA, 15 bp, Homo sapiens
aggtatctggtatct

SEQ ID NO: 344330 - DNA, 18 bp, Homo sapiens
aggtatctggtatctgca

SEQ ID NO: 344331 - DNA, 18 bp, Homo sapiens
aggtatcttttttaaatg

SEQ ID NO: 344332 - DNA, 20 bp, Homo sapiens
aggtatggaagggtttgtgg

SEQ ID NO: 344333 - DNA, 16 bp, Homo sapiens
aggtcaagcccaggag

SEQ ID NO: 344334 - DNA, 20 bp, Homo sapiens
aggtcaaggcctgtccctgg

SEQ ID NO: 344335 - DNA, 21 bp, Homo sapiens
aggtcaaggcctgtccctggc

SEQ ID NO: 344336 - DNA, 20 bp, Homo sapiens
aggtcaccttagttcaccta

SEQ ID NO: 344337 - DNA, 14 bp, Homo sapiens
aggtcactcctggg

SEQ ID NO: 344338 - DNA, 18 bp, Homo sapiens
aggtcactcctggggcct

SEQ ID NO: 344339 - DNA, 20 bp, Homo sapiens
aggtcagctgttactttctt

SEQ ID NO: 344340 - DNA, 16 bp, Homo sapiens
aggtcagcttgctgcc

SEQ ID NO: 344341 - DNA, 15 bp, Homo sapiens
aggtggtgcttacat

SEQ ID NO: 344342 - DNA, 17 bp, Homo sapiens
aggtgtactatggctgt

SEQ ID NO: 344343 - DNA, 15 bp, Homo sapiens
aggtgtcaccctgca

SEQ ID NO: 344344 - DNA, 20 bp, Homo sapiens
aggtgtcaccctgcagagct

SEQ ID NO: 344345 - DNA, 14 bp, Homo sapiens
aggtgtccaaattt

SEQ ID NO: 344346 - DNA, 20 bp, Homo sapiens
aggtgtccccaacgtcccct

SEQ ID NO: 344347 - DNA, 22 bp, Homo sapiens
aggtgtccccaacgtcccctcc

SEQ ID NO: 344348 - DNA, 16 bp, Homo sapiens
aggtgtccccagccca

SEQ ID NO: 344349 - DNA, 17 bp, Homo sapiens
aggtgtctagaggcaac

SEQ ID NO: 344350 - DNA, 14 bp, Homo sapiens
aggtgtggagtgga

SEQ ID NO: 344351 - DNA, 16 bp, Homo sapiens
aggtgtggagtggagg

SEQ ID NO: 344352 - DNA, 17 bp, Homo sapiens
aggtgtggagtggaggg

SEQ ID NO: 344353 - DNA, 17 bp, Homo sapiens
aggtgtggtggctcatg

SEQ ID NO: 344354 - DNA, 16 bp, Homo sapiens
aggtgttgaaaatgag

SEQ ID NO: 344355 - DNA, 21 bp, Homo sapiens
aggtgttgccaaatatgtcct

SEQ ID NO: 344356 - DNA, 15 bp, Homo sapiens
aggtgttgggacctg

SEQ ID NO: 344357 - DNA, 13 bp, Homo sapiens
aggtgtttaaaga

SEQ ID NO: 344358 - DNA, 20 bp, Homo sapiens
aggtgtttaaagagaggtta

SEQ ID NO: 344359 - DNA, 13 bp, Homo sapiens
aggtgtttgggat

SEQ ID NO: 344360 - DNA, 15 bp, Homo sapiens
aggttaacagtaaaa

SEQ ID NO: 344361 - DNA, 13 bp, Homo sapiens
aggttaaggggat

SEQ ID NO: 344362 - DNA, 16 bp, Homo sapiens
aggttaaggtgggtcc

SEQ ID NO: 344363 - DNA, 18 bp, Homo sapiens
aggttaaggtgggtccag

SEQ ID NO: 344364 - DNA, 23 bp, Homo sapiens
aggttaataggaggacagaacca

SEQ ID NO: 344365 - DNA, 13 bp, Homo sapiens
aggttatctgcct

SEQ ID NO: 344366 - DNA, 17 bp, Homo sapiens
aggttatctgcctggcc

SEQ ID NO: 344367 - DNA, 22 bp, Homo sapiens
aggttatgcaagtcgccaggca

SEQ ID NO: 344368 - DNA, 23 bp, Homo sapiens
aggttattttctttatcattgct

SEQ ID NO: 344369 - DNA, 12 bp, Homo sapiens
aggttcattttt

SEQ ID NO: 344370 - DNA, 19 bp, Homo sapiens
aggttcccagggctggaga

SEQ ID NO: 344371 - DNA, 17 bp, Homo sapiens
aggttctatgatttgta

SEQ ID NO: 344372 - DNA, 15 bp, Homo sapiens
aggttctcagagcca

SEQ ID NO: 344373 - DNA, 17 bp, Homo sapiens
aggttctcagcaagtgt

SEQ ID NO: 344374 - DNA, 21 bp, Homo sapiens
aggttctcagcaagtgtacag

SEQ ID NO: 344375 - DNA, 22 bp, Homo sapiens
aggttctcagcaagtgtacagt

SEQ ID NO: 344376 - DNA, 14 bp, Homo sapiens
aggttctctcctgt

SEQ ID NO: 344377 - DNA, 20 bp, Homo sapiens
aggttctggttagctcagcc

SEQ ID NO: 344378 - DNA, 22 bp, Homo sapiens
aggttctggttagctcagcccc

SEQ ID NO: 344379 - DNA, 17 bp, Homo sapiens
aggttctgtctgtgcca

SEQ ID NO: 344380 - DNA, 12 bp, Homo sapiens
aggttgaaagac

SEQ ID NO: 344381 - DNA, 16 bp, Homo sapiens
aggttgatcagatctg

SEQ ID NO: 344382 - DNA, 18 bp, Homo sapiens
aggttgctggcatttgct

SEQ ID NO: 344383 - DNA, 11 bp, Homo sapiens
aggttgctgtt

SEQ ID NO: 344384 - DNA, 17 bp, Homo sapiens
aggttggaactgctgcc

SEQ ID NO: 344385 - DNA, 16 bp, Homo sapiens
aggttggaccccagag

SEQ ID NO: 344386 - DNA, 20 bp, Homo sapiens
aggttggcgactgtcatgtg

SEQ ID NO: 344387 - DNA, 19 bp, Homo sapiens
aggttgggagccaaatgtg

SEQ ID NO: 344388 - DNA, 20 bp, Homo sapiens
aggttgggttagcaatattt

SEQ ID NO: 344389 - DNA, 14 bp, Homo sapiens
aggttggtgactga

SEQ ID NO: 344390 - DNA, 14 bp, Homo sapiens
aggttgttctgtat

SEQ ID NO: 344391 - DNA, 23 bp, Homo sapiens
aggttgttctgtataaaatgcaa

SEQ ID NO: 344392 - DNA, 13 bp, Homo sapiens
aggtttaactcag

SEQ ID NO: 344393 - DNA, 20 bp, Homo sapiens
aggtttaactcagatcacta

SEQ ID NO: 344394 - DNA, 12 bp, Homo sapiens
aggtttagagat

SEQ ID NO: 344395 - DNA, 14 bp, Homo sapiens
aggtttcacctccg

SEQ ID NO: 344396 - DNA, 19 bp, Homo sapiens
aggtttcactattcctatg

SEQ ID NO: 344397 - DNA, 19 bp, Homo sapiens
aggtttcactgttcatgaa

SEQ ID NO: 344398 - DNA, 10 bp, Homo sapiens
aggtttgtga

SEQ ID NO: 344399 - DNA, 22 bp, Homo sapiens
aggtttgtgagagcgaggctga

SEQ ID NO: 344400 - DNA, 12 bp, Homo sapiens
agtaaaaacact

SEQ ID NO: 344401 - DNA, 20 bp, Homo sapiens
agtaaaaagaacaacacttg

SEQ ID NO: 344402 - DNA, 13 bp, Homo sapiens
agtaaaaattcat

SEQ ID NO: 344403 - DNA, 21 bp, Homo sapiens
agtaaaacagatttgttcatt

SEQ ID NO: 344404 - DNA, 16 bp, Homo sapiens
agtaaaattagaaaaa

SEQ ID NO: 344405 - DNA, 22 bp, Homo sapiens
agtaaaattagaaaaaaacaaa

SEQ ID NO: 344406 - DNA, 22 bp, Homo sapiens
agtaaaattattccctgaattg

SEQ ID NO: 344407 - DNA, 16 bp, Homo sapiens
agtaaagataaaagga

SEQ ID NO: 344408 - DNA, 19 bp, Homo sapiens
agtaaataaattgtttgac

SEQ ID NO: 344409 - DNA, 18 bp, Homo sapiens
agtaaatattatgatttt

SEQ ID NO: 344410 - DNA, 21 bp, Homo sapiens
agtaaatattatgattttatt

SEQ ID NO: 344411 - DNA, 23 bp, Homo sapiens
agtaaatattatgattttattta

SEQ ID NO: 344412 - DNA, 18 bp, Homo sapiens
agtaaatctaaattaact

SEQ ID NO: 344413 - DNA, 22 bp, Homo sapiens
agtaaatgctaggttaattcca

SEQ ID NO: 344414 - DNA, 16 bp, Homo sapiens
agtaaatgtatattga

SEQ ID NO: 344415 - DNA, 19 bp, Homo sapiens
agtaaattagtaatgtact

SEQ ID NO: 344416 - DNA, 19 bp, Homo sapiens
agtaacaatgaagataaaa

SEQ ID NO: 344417 - DNA, 16 bp, Homo sapiens
agtaacaatgcatgct

SEQ ID NO: 344418 - DNA, 19 bp, Homo sapiens
agtaacaatgcatgctttg

SEQ ID NO: 344419 - DNA, 20 bp, Homo sapiens
agtaagaaagtgaagcaaat

SEQ ID NO: 344420 - DNA, 21 bp, Homo sapiens
agtaagaaagtgaagcaaatc

SEQ ID NO: 344421 - DNA, 15 bp, Homo sapiens
agtaagaagacatga

SEQ ID NO: 344422 - DNA, 19 bp, Homo sapiens
agtaagagctaagttctaa

SEQ ID NO: 344423 - DNA, 19 bp, Homo sapiens
agtaagagctggtgtctga

SEQ ID NO: 344424 - DNA, 21 bp, Homo sapiens
agtaagattttatccctttct

SEQ ID NO: 344425 - DNA, 22 bp, Homo sapiens
agtaagattttatccctttctc

SEQ ID NO: 344426 - DNA, 18 bp, Homo sapiens
agtaagctgctctattgt

SEQ ID NO: 344427 - DNA, 16 bp, Homo sapiens
agtaagctgctgaatg

SEQ ID NO: 344428 - DNA, 21 bp, Homo sapiens
agtaagttctgaaaactgttt

SEQ ID NO: 344429 - DNA, 23 bp, Homo sapiens
agtaagtttatccaaatcttgaa

SEQ ID NO: 344430 - DNA, 13 bp, Homo sapiens
agtaataaaacat

SEQ ID NO: 344431 - DNA, 19 bp, Homo sapiens
agtaataggagcttccagc

SEQ ID NO: 344432 - DNA, 14 bp, Homo sapiens
agtaatcccgccac

SEQ ID NO: 344433 - DNA, 14 bp, Homo sapiens
agtaatgaatttta

SEQ ID NO: 344434 - DNA, 15 bp, Homo sapiens
agtaatgaattttat

SEQ ID NO: 344435 - DNA, 20 bp, Homo sapiens
agtaattatcgggaacagtg

SEQ ID NO: 344436 - DNA, 12 bp, Homo sapiens
agtaattgtgaa

SEQ ID NO: 344437 - DNA, 16 bp, Homo sapiens
agtaattgtgaaaaag

SEQ ID NO: 344438 - DNA, 19 bp, Homo sapiens
agtaattttgcacagacat

SEQ ID NO: 344439 - DNA, 15 bp, Homo sapiens
agtacaattctttgt

SEQ ID NO: 344440 - DNA, 19 bp, Homo sapiens
agtacacttggtgtactgg

SEQ ID NO: 344441 - DNA, 23 bp, Homo sapiens
agtacagtcccagcacatttcct

SEQ ID NO: 344442 - DNA, 20 bp, Homo sapiens
agtacagtgaggagggtgga

SEQ ID NO: 344443 - DNA, 18 bp, Homo sapiens
agtacatattaggaaaat

SEQ ID NO: 344444 - DNA, 13 bp, Homo sapiens
agtacatgcagaa

SEQ ID NO: 344445 - DNA, 17 bp, Homo sapiens
agtacatggaagaagta

SEQ ID NO: 344446 - DNA, 13 bp, Homo sapiens
agtacatttaata

SEQ ID NO: 344447 - DNA, 23 bp, Homo sapiens
agtacatttttgtctttatctca

SEQ ID NO: 344448 - DNA, 15 bp, Homo sapiens
agtaccaatcatttt

SEQ ID NO: 344449 - DNA, 16 bp, Homo sapiens
agtaccaatgctgttg

SEQ ID NO: 344450 - DNA, 17 bp, Homo sapiens
agtaccaatgctgttgt

SEQ ID NO: 344451 - DNA, 22 bp, Homo sapiens
agtaccagcgctctaaaagcac

SEQ ID NO: 344452 - DNA, 15 bp, Homo sapiens
agtaccatcccactg

SEQ ID NO: 344453 - DNA, 17 bp, Homo sapiens
agtaccatcccactgat

SEQ ID NO: 344454 - DNA, 13 bp, Homo sapiens
agtacccacctga

SEQ ID NO: 344455 - DNA, 17 bp, Homo sapiens
agtacccacctgagctt

SEQ ID NO: 344456 - DNA, 16 bp, Homo sapiens
agtacccccctgagag

SEQ ID NO: 344457 - DNA, 21 bp, Homo sapiens
agtacctataaagtaaagcta

SEQ ID NO: 344458 - DNA, 23 bp, Homo sapiens
agtacctataaagtaaagctaaa

SEQ ID NO: 344459 - DNA, 17 bp, Homo sapiens
agtacctccaagcaagt

SEQ ID NO: 344460 - DNA, 12 bp, Homo sapiens
agtacctgctgc

SEQ ID NO: 344461 - DNA, 20 bp, Homo sapiens
agtacctgggaaaggaccca

SEQ ID NO: 344462 - DNA, 18 bp, Homo sapiens
agtacctgtagtgagaaa

SEQ ID NO: 344463 - DNA, 17 bp, Homo sapiens
agtacctttgctcttgc

SEQ ID NO: 344464 - DNA, 18 bp, Homo sapiens
agtacgtcccgctgctgt

SEQ ID NO: 344465 - DNA, 18 bp, Homo sapiens
agtacgtgctaacaggct

SEQ ID NO: 344466 - DNA, 22 bp, Homo sapiens
agtactaaaactagataactta

SEQ ID NO: 344467 - DNA, 17 bp, Homo sapiens
agtactaagacccacaa

SEQ ID NO: 344468 - DNA, 23 bp, Homo sapiens
agtactaagacccacaaactgcc

SEQ ID NO: 344469 - DNA, 16 bp, Homo sapiens
agtactatatctgttt

SEQ ID NO: 344470 - DNA, 22 bp, Homo sapiens
agtactatatctgttttactgc

SEQ ID NO: 344471 - DNA, 22 bp, Homo sapiens
agtactatgtattaccagcccc

SEQ ID NO: 344472 - DNA, 22 bp, Homo sapiens
agtactattgctagtactagta

SEQ ID NO: 344473 - DNA, 16 bp, Homo sapiens
agtactcagaggctga

SEQ ID NO: 344474 - DNA, 20 bp, Homo sapiens
agtactcctgcaaaatttta

SEQ ID NO: 344475 - DNA, 20 bp, Homo sapiens
agtactctctgctctagcca

SEQ ID NO: 344476 - DNA, 22 bp, Homo sapiens
agtactctctgctctagccagg

SEQ ID NO: 344477 - DNA, 23 bp, Homo sapiens
agtactctctgctctagccagga

SEQ ID NO: 344478 - DNA, 15 bp, Homo sapiens
agtactgggaaggag

SEQ ID NO: 344479 - DNA, 18 bp, Homo sapiens
agtacttaatatactcag

SEQ ID NO: 344480 - DNA, 16 bp, Homo sapiens
agtacttgctcaataa

SEQ ID NO: 344481 - DNA, 21 bp, Homo sapiens
agtacttgctcaataaaggtc

SEQ ID NO: 344482 - DNA, 15 bp, Homo sapiens
agtactttatgaaaa

SEQ ID NO: 344483 - DNA, 13 bp, Homo sapiens
agtacttttaacg

SEQ ID NO: 344484 - DNA, 19 bp, Homo sapiens
agtagaaataatatgcatt

SEQ ID NO: 344485 - DNA, 13 bp, Homo sapiens
agtagaacagata

SEQ ID NO: 344486 - DNA, 13 bp, Homo sapiens
agtagaatctcag

SEQ ID NO: 344487 - DNA, 16 bp, Homo sapiens
agtagaatctcagcac

SEQ ID NO: 344488 - DNA, 13 bp, Homo sapiens
agtagacccctgg

SEQ ID NO: 344489 - DNA, 15 bp, Homo sapiens
agtagaggcttagag

SEQ ID NO: 344490 - DNA, 17 bp, Homo sapiens
agtagagtcatctccat

SEQ ID NO: 344491 - DNA, 15 bp, Homo sapiens
agtagatctgtggcg

SEQ ID NO: 344492 - DNA, 17 bp, Homo sapiens
agtagatggtgaaattt

SEQ ID NO: 344493 - DNA, 21 bp, Homo sapiens
agtagatggtgaaatttatta

SEQ ID NO: 344494 - DNA, 20 bp, Homo sapiens
agtagcatactgatgagaca

SEQ ID NO: 344495 - DNA, 18 bp, Homo sapiens
agtagcatggactctggg

SEQ ID NO: 344496 - DNA, 19 bp, Homo sapiens
agtagccattttgtaactg

SEQ ID NO: 344497 - DNA, 15 bp, Homo sapiens
agtagccctttctgt

SEQ ID NO: 344498 - DNA, 16 bp, Homo sapiens
agtagccctttctgtg

SEQ ID NO: 344499 - DNA, 19 bp, Homo sapiens
agtagccctttctgtgtgc

SEQ ID NO: 344500 - DNA, 15 bp, Homo sapiens
agtagctgataaaga

SEQ ID NO: 344501 - DNA, 17 bp, Homo sapiens
agtagctggattacagg

SEQ ID NO: 344502 - DNA, 14 bp, Homo sapiens
agtagctgggacta

SEQ ID NO: 344503 - DNA, 15 bp, Homo sapiens
agtagctttccacat

SEQ ID NO: 344504 - DNA, 14 bp, Homo sapiens
agtaggagacacag

SEQ ID NO: 344505 - DNA, 15 bp, Homo sapiens
agtaggagctgagct

SEQ ID NO: 344506 - DNA, 21 bp, Homo sapiens
agtaggcggcgatttttgtat

SEQ ID NO: 344507 - DNA, 21 bp, Homo sapiens
agtaggctgtattttctttta

SEQ ID NO: 344508 - DNA, 14 bp, Homo sapiens
agtaggtctgcaca

SEQ ID NO: 344509 - DNA, 23 bp, Homo sapiens
agtaggttgaggacaggagaggg

SEQ ID NO: 344510 - DNA, 19 bp, Homo sapiens
agtagtaaaattagaaaaa

SEQ ID NO: 344511 - DNA, 14 bp, Homo sapiens
agtagttcctgcta

SEQ ID NO: 344512 - DNA, 23 bp, Homo sapiens
agtagttgatgaccaatctctgt

SEQ ID NO: 344513 - DNA, 13 bp, Homo sapiens
agtataacaaact

SEQ ID NO: 344514 - DNA, 14 bp, Homo sapiens
agtataacaaacta

SEQ ID NO: 344515 - DNA, 17 bp, Homo sapiens
agtataacagcaaataa

SEQ ID NO: 344516 - DNA, 12 bp, Homo sapiens
agtatactgtgt

SEQ ID NO: 344517 - DNA, 17 bp, Homo sapiens
agtatacttttgtttca

SEQ ID NO: 344518 - DNA, 20 bp, Homo sapiens
agtatagaatgaactgtcta

SEQ ID NO: 344519 - DNA, 14 bp, Homo sapiens
agtatataagcttt

SEQ ID NO: 344520 - DNA, 17 bp, Homo sapiens
agtatataagctttttt

SEQ ID NO: 344521 - DNA, 12 bp, Homo sapiens
agtatatatgta

SEQ ID NO: 344522 - DNA, 18 bp, Homo sapiens
agtatatctggacaagcc

SEQ ID NO: 344523 - DNA, 17 bp, Homo sapiens
agtatatttatttctag

SEQ ID NO: 344524 - DNA, 18 bp, Homo sapiens
agtatattttcttttcct

SEQ ID NO: 344525 - DNA, 17 bp, Homo sapiens
agtatcaaaggcagaaa

SEQ ID NO: 344526 - DNA, 20 bp, Homo sapiens
agtatcaaaggcagaaagga

SEQ ID NO: 344527 - DNA, 17 bp, Homo sapiens
agtatcaaggctgcctg

SEQ ID NO: 344528 - DNA, 13 bp, Homo sapiens
agtatcactgtct

SEQ ID NO: 344529 - DNA, 14 bp, Homo sapiens
agtatcatgcattc

SEQ ID NO: 344530 - DNA, 12 bp, Homo sapiens
agtatctgtaac

SEQ ID NO: 344531 - DNA, 18 bp, Homo sapiens
agtatctgtaacccttga

SEQ ID NO: 344532 - DNA, 13 bp, Homo sapiens
agtatctgtacct

SEQ ID NO: 344533 - DNA, 17 bp, Homo sapiens
agtatctttaaatataa

SEQ ID NO: 344534 - DNA, 18 bp, Homo sapiens
agtatctttaaatataat

SEQ ID NO: 344535 - DNA, 14 bp, Homo sapiens
agtatgaatgatgt

SEQ ID NO: 344536 - DNA, 16 bp, Homo sapiens
agtatgagaaatacag

SEQ ID NO: 344537 - DNA, 17 bp, Homo sapiens
agtatgatggcaggaga

SEQ ID NO: 344538 - DNA, 17 bp, Homo sapiens
agtatgcaagaagaata

SEQ ID NO: 344539 - DNA, 23 bp, Homo sapiens
agtatgcaagaagaatataaata

SEQ ID NO: 344540 - DNA, 22 bp, Homo sapiens
agtatgtcagtccaataaatta

SEQ ID NO: 344541 - DNA, 14 bp, Homo sapiens
agtatgttcaaagt

SEQ ID NO: 344542 - DNA, 18 bp, Homo sapiens
agtatgttttagcatgtg

SEQ ID NO: 344543 - DNA, 19 bp, Homo sapiens
agtatgttttagcatgtgt

SEQ ID NO: 344544 - DNA, 14 bp, Homo sapiens
agtattatagatat

SEQ ID NO: 344545 - DNA, 23 bp, Homo sapiens
agtattccaccttaaattaaaca

SEQ ID NO: 344546 - DNA, 20 bp, Homo sapiens
agtattccattgtgtgagtg

SEQ ID NO: 344547 - DNA, 18 bp, Homo sapiens
agtattccttggcccagc

SEQ ID NO: 344548 - DNA, 21 bp, Homo sapiens
agtattcgtgaataagttgat

SEQ ID NO: 344549 - DNA, 16 bp, Homo sapiens
agtattctatgtaaaa

SEQ ID NO: 344550 - DNA, 16 bp, Homo sapiens
agtattctcagtgctc

SEQ ID NO: 344551 - DNA, 18 bp, Homo sapiens
agtattcttgtcaaaaaa

SEQ ID NO: 344552 - DNA, 18 bp, Homo sapiens
agtattgaaaacttcaaa

SEQ ID NO: 344553 - DNA, 19 bp, Homo sapiens
agtattgagacactgtcaa

SEQ ID NO: 344554 - DNA, 23 bp, Homo sapiens
agtattgttcttgtaaaactgtg

SEQ ID NO: 344555 - DNA, 17 bp, Homo sapiens
agtatttaaagaaactg

SEQ ID NO: 344556 - DNA, 14 bp, Homo sapiens
agtatttatatatt

SEQ ID NO: 344557 - DNA, 13 bp, Homo sapiens
agtatttgctgtt

SEQ ID NO: 344558 - DNA, 23 bp, Homo sapiens
agtattttggttcttagttctca

SEQ ID NO: 344559 - DNA, 17 bp, Homo sapiens
agtcaaacagtgtggct

SEQ ID NO: 344560 - DNA, 18 bp, Homo sapiens
agtcaaacatttcaaagt

SEQ ID NO: 344561 - DNA, 16 bp, Homo sapiens
agtcaactgctgtttt

SEQ ID NO: 344562 - DNA, 22 bp, Homo sapiens
agtcaagaagcaattatttaaa

SEQ ID NO: 344563 - DNA, 17 bp, Homo sapiens
agtcaagtgtgcctgct

SEQ ID NO: 344564 - DNA, 20 bp, Homo sapiens
agtcaagttccgtctcctct

SEQ ID NO: 344565 - DNA, 12 bp, Homo sapiens
agtcacacatta

SEQ ID NO: 344566 - DNA, 23 bp, Homo sapiens
agtcacacattatagaaattact

SEQ ID NO: 344567 - DNA, 21 bp, Homo sapiens
agtcacagaacaaatgtttgt

SEQ ID NO: 344568 - DNA, 11 bp, Homo sapiens
agtcacagcca

SEQ ID NO: 344569 - DNA, 12 bp, Homo sapiens
agtcacagctgc

SEQ ID NO: 344570 - DNA, 15 bp, Homo sapiens
agtcacagctgcagc

SEQ ID NO: 344571 - DNA, 16 bp, Homo sapiens
agtcacagctgcagct

SEQ ID NO: 344572 - DNA, 16 bp, Homo sapiens
agtcaccaggacttgg

SEQ ID NO: 344573 - DNA, 20 bp, Homo sapiens
agtcacctcctccactcact

SEQ ID NO: 344574 - DNA, 22 bp, Homo sapiens
agtcacctcctccactcactcc

SEQ ID NO: 344575 - DNA, 13 bp, Homo sapiens
agtcacctgcaag

SEQ ID NO: 344576 - DNA, 16 bp, Homo sapiens
agtcacctgcaagccc

SEQ ID NO: 344577 - DNA, 19 bp, Homo sapiens
agtcacctgcaagccccag

SEQ ID NO: 344578 - DNA, 11 bp, Homo sapiens
agtcacctgct

SEQ ID NO: 344579 - DNA, 22 bp, Homo sapiens
agtcaccttcattttggcaaga

SEQ ID NO: 344580 - DNA, 13 bp, Homo sapiens
agtcactgcacag

SEQ ID NO: 344581 - DNA, 17 bp, Homo sapiens
agtcagagaaaacactt

SEQ ID NO: 344582 - DNA, 19 bp, Homo sapiens
agtcagagaaaacactttc

SEQ ID NO: 344583 - DNA, 16 bp, Homo sapiens
agtcagagccctggct

SEQ ID NO: 344584 - DNA, 19 bp, Homo sapiens
agtcagagccctggctggg

SEQ ID NO: 344585 - DNA, 12 bp, Homo sapiens
agtcagccagct

SEQ ID NO: 344586 - DNA, 20 bp, Homo sapiens
agtcagccattcctgttctc

SEQ ID NO: 344587 - DNA, 13 bp, Homo sapiens
agtcaggagccag

SEQ ID NO: 344588 - DNA, 16 bp, Homo sapiens
agtcaggagccagcag

SEQ ID NO: 344589 - DNA, 18 bp, Homo sapiens
agtcaggcttctcttgct

SEQ ID NO: 344590 - DNA, 19 bp, Homo sapiens
agtcaggcttctcttgcta

SEQ ID NO: 344591 - DNA, 16 bp, Homo sapiens
agtcagggagccctgg

SEQ ID NO: 344592 - DNA, 19 bp, Homo sapiens
agtcagtacacccaatttt

SEQ ID NO: 344593 - DNA, 22 bp, Homo sapiens
agtcagtaggtccaagggccat

SEQ ID NO: 344594 - DNA, 12 bp, Homo sapiens
agtcagtattcc

SEQ ID NO: 344595 - DNA, 17 bp, Homo sapiens
agtcagtcttcacttgc

SEQ ID NO: 344596 - DNA, 22 bp, Homo sapiens
agtcagttcccggagcacagcc

SEQ ID NO: 344597 - DNA, 16 bp, Homo sapiens
agtcagttgaaattct

SEQ ID NO: 344598 - DNA, 14 bp, Homo sapiens
agtcatcaacaaaa

SEQ ID NO: 344599 - DNA, 17 bp, Homo sapiens
agtcatctccatcagct

SEQ ID NO: 344600 - DNA, 19 bp, Homo sapiens
agtcatgcgtccactttcc

SEQ ID NO: 344601 - DNA, 22 bp, Homo sapiens
agtcatggcattcgcagtgccc

SEQ ID NO: 344602 - DNA, 23 bp, Homo sapiens
agtcattattattactttttaaa

SEQ ID NO: 344603 - DNA, 17 bp, Homo sapiens
agtcattgtaacctcgt

SEQ ID NO: 344604 - DNA, 16 bp, Homo sapiens
agtcattgtaatcttt

SEQ ID NO: 344605 - DNA, 19 bp, Homo sapiens
agtcatttgctgagcatgt

SEQ ID NO: 344606 - DNA, 22 bp, Homo sapiens
agtcatttgctgagcatgtact

SEQ ID NO: 344607 - DNA, 16 bp, Homo sapiens
agtccaaaatcattcc

SEQ ID NO: 344608 - DNA, 16 bp, Homo sapiens
agtccaacctgcctgt

SEQ ID NO: 344609 - DNA, 18 bp, Homo sapiens
agtccaacctgcctgtgc

SEQ ID NO: 344610 - DNA, 20 bp, Homo sapiens
agtccaacgtggggcagcac

SEQ ID NO: 344611 - DNA, 22 bp, Homo sapiens
agtccaacgtggggcagcacag

SEQ ID NO: 344612 - DNA, 20 bp, Homo sapiens
agtccacccccattgtgaat

SEQ ID NO: 344613 - DNA, 15 bp, Homo sapiens
agtccactttcctct

SEQ ID NO: 344614 - DNA, 18 bp, Homo sapiens
agtccactttcctctctc

SEQ ID NO: 344615 - DNA, 19 bp, Homo sapiens
agtccactttcctctctct

SEQ ID NO: 344616 - DNA, 11 bp, Homo sapiens
agtccagctcc

SEQ ID NO: 344617 - DNA, 12 bp, Homo sapiens
agtccagctccc

SEQ ID NO: 344618 - DNA, 13 bp, Homo sapiens
agtccagctctcc

SEQ ID NO: 344619 - DNA, 16 bp, Homo sapiens
agtccagctctcccct

SEQ ID NO: 344620 - DNA, 17 bp, Homo sapiens
agtccagctctcccctg

SEQ ID NO: 344621 - DNA, 19 bp, Homo sapiens
agtccaggagccccagcca

SEQ ID NO: 344622 - DNA, 12 bp, Homo sapiens
agtccaggcccc

SEQ ID NO: 344623 - DNA, 13 bp, Homo sapiens
agtccaggcccca

SEQ ID NO: 344624 - DNA, 22 bp, Homo sapiens
agtccagggctcccggagaggg

SEQ ID NO: 344625 - DNA, 23 bp, Homo sapiens
agtccagggctcccggagaggga

SEQ ID NO: 344626 - DNA, 21 bp, Homo sapiens
agtccaggtcgggctcagctc

SEQ ID NO: 344627 - DNA, 17 bp, Homo sapiens
agtccagtgacctgctg

SEQ ID NO: 344628 - DNA, 15 bp, Homo sapiens
agtccatagctgagc

SEQ ID NO: 344629 - DNA, 17 bp, Homo sapiens
agtccattatttgagtt

SEQ ID NO: 344630 - DNA, 23 bp, Homo sapiens
agtcccagagcaggaggcccctg

SEQ ID NO: 344631 - DNA, 13 bp, Homo sapiens
agtcccagagccc

SEQ ID NO: 344632 - DNA, 14 bp, Homo sapiens
agtcccagcacatt

SEQ ID NO: 344633 - DNA, 17 bp, Homo sapiens
agtcccagcacatttcc

SEQ ID NO: 344634 - DNA, 17 bp, Homo sapiens
agtcccagcagcctccc

SEQ ID NO: 344635 - DNA, 22 bp, Homo sapiens
agtcccagcagcctccccacgt

SEQ ID NO: 344636 - DNA, 23 bp, Homo sapiens
agtcccagctacttgggagcctg

SEQ ID NO: 344637 - DNA, 16 bp, Homo sapiens
agtcccatcagcctat

SEQ ID NO: 344638 - DNA, 17 bp, Homo sapiens
agtcccatctcacctct

SEQ ID NO: 344639 - DNA, 15 bp, Homo sapiens
agtccccagcccttc

SEQ ID NO: 344640 - DNA, 18 bp, Homo sapiens
agtccccagcccttctgc

SEQ ID NO: 344641 - DNA, 18 bp, Homo sapiens
agtccccctatccttggc

SEQ ID NO: 344642 - DNA, 19 bp, Homo sapiens
agtccccctatccttggca

SEQ ID NO: 344643 - DNA, 22 bp, Homo sapiens
agtccccctatccttggcacca

SEQ ID NO: 344644 - DNA, 19 bp, Homo sapiens
agtccccgggaaaggccgg

SEQ ID NO: 344645 - DNA, 18 bp, Homo sapiens
agtcccctccccggccct

SEQ ID NO: 344646 - DNA, 15 bp, Homo sapiens
agtccctccctcctg

SEQ ID NO: 344647 - DNA, 17 bp, Homo sapiens
agtccctccctcctggc

SEQ ID NO: 344648 - DNA, 18 bp, Homo sapiens
agtccctccctcctggct

SEQ ID NO: 344649 - DNA, 21 bp, Homo sapiens
agtccctgccacactcagtcc

SEQ ID NO: 344650 - DNA, 12 bp, Homo sapiens
agtccctgcccc

SEQ ID NO: 344651 - DNA, 22 bp, Homo sapiens
agtcccttcccctccctggctc

SEQ ID NO: 344652 - DNA, 22 bp, Homo sapiens
agtcccttcctgtcctgctcac

SEQ ID NO: 344653 - DNA, 17 bp, Homo sapiens
agtcctagctgacgcca

SEQ ID NO: 344654 - DNA, 19 bp, Homo sapiens
agtcctcaccttctgtttt

SEQ ID NO: 344655 - DNA, 17 bp, Homo sapiens
agtcctcactcccagtc

SEQ ID NO: 344656 - DNA, 17 bp, Homo sapiens
agtcctccaaaacacaa

SEQ ID NO: 344657 - DNA, 14 bp, Homo sapiens
agtcctccctgctc

SEQ ID NO: 344658 - DNA, 15 bp, Homo sapiens
agtcctccctgctca

SEQ ID NO: 344659 - DNA, 18 bp, Homo sapiens
agtcctccctgctcagct

SEQ ID NO: 344660 - DNA, 20 bp, Homo sapiens
agtcctgaggcagaacctgg

SEQ ID NO: 344661 - DNA, 17 bp, Homo sapiens
agtcctgcagaggattt

SEQ ID NO: 344662 - DNA, 18 bp, Homo sapiens
agtcctgccaagtggttt

SEQ ID NO: 344663 - DNA, 13 bp, Homo sapiens
agtcctgcctggc

SEQ ID NO: 344664 - DNA, 13 bp, Homo sapiens
agtcctggctaca

SEQ ID NO: 344665 - DNA, 19 bp, Homo sapiens
agtcctggctacatcccag

SEQ ID NO: 344666 - DNA, 18 bp, Homo sapiens
agtcctggttcagtggga

SEQ ID NO: 344667 - DNA, 14 bp, Homo sapiens
agtcctgtgaattt

SEQ ID NO: 344668 - DNA, 11 bp, Homo sapiens
agtcctgttct

SEQ ID NO: 344669 - DNA, 12 bp, Homo sapiens
agtcctgttctc

SEQ ID NO: 344670 - DNA, 17 bp, Homo sapiens
agtccttaaacagggca

SEQ ID NO: 344671 - DNA, 21 bp, Homo sapiens
agtccttacctcttccggaga

SEQ ID NO: 344672 - DNA, 23 bp, Homo sapiens
agtccttacctcttccggagatg

SEQ ID NO: 344673 - DNA, 17 bp, Homo sapiens
agtcgcagaccagagct

SEQ ID NO: 344674 - DNA, 14 bp, Homo sapiens
agtcgccctctgtg

SEQ ID NO: 344675 - DNA, 16 bp, Homo sapiens
agtcgccctctgtgcc

SEQ ID NO: 344676 - DNA, 19 bp, Homo sapiens
agtcgccctctgtgcctaa

SEQ ID NO: 344677 - DNA, 20 bp, Homo sapiens
agtcgccctctgtgcctaat

SEQ ID NO: 344678 - DNA, 21 bp, Homo sapiens
agtcgccctctgtgcctaata

SEQ ID NO: 344679 - DNA, 22 bp, Homo sapiens
agtcgccctctgtgcctaataa

SEQ ID NO: 344680 - DNA, 19 bp, Homo sapiens
agtcgctgaacaattacct

SEQ ID NO: 344681 - DNA, 15 bp, Homo sapiens
agtcgctgaggaaaa

SEQ ID NO: 344682 - DNA, 14 bp, Homo sapiens
agtcggctgggcag

SEQ ID NO: 344683 - DNA, 15 bp, Homo sapiens
agtcggctgggcagg

SEQ ID NO: 344684 - DNA, 19 bp, Homo sapiens
agtcggctgggcagggccg

SEQ ID NO: 344685 - DNA, 19 bp, Homo sapiens
agtcgtggagatgtcttcg

SEQ ID NO: 344686 - DNA, 13 bp, Homo sapiens
agtctaaagttta

SEQ ID NO: 344687 - DNA, 17 bp, Homo sapiens
agtctaaagtttacagt

SEQ ID NO: 344688 - DNA, 20 bp, Homo sapiens
agtctaaagtttacagtaaa

SEQ ID NO: 344689 - DNA, 23 bp, Homo sapiens
agtctaaatatttccttaaactg

SEQ ID NO: 344690 - DNA, 13 bp, Homo sapiens
agtctacaggcct

SEQ ID NO: 344691 - DNA, 17 bp, Homo sapiens
agtctacaggcctttca

SEQ ID NO: 344692 - DNA, 14 bp, Homo sapiens
agtctacttctgtg

SEQ ID NO: 344693 - DNA, 16 bp, Homo sapiens
agtctagtttcattat

SEQ ID NO: 344694 - DNA, 21 bp, Homo sapiens
agtctatttttttaactgaaa

SEQ ID NO: 344695 - DNA, 23 bp, Homo sapiens
agtctatttttttaactgaaaat

SEQ ID NO: 344696 - DNA, 17 bp, Homo sapiens
agtctcaaaaatacaaa

SEQ ID NO: 344697 - DNA, 20 bp, Homo sapiens
agtctcaagcactaaaaagt

SEQ ID NO: 344698 - DNA, 17 bp, Homo sapiens
agtctcaattttgtatt

SEQ ID NO: 344699 - DNA, 19 bp, Homo sapiens
agtctcacaatagcgtgag

SEQ ID NO: 344700 - DNA, 16 bp, Homo sapiens
agtctcactcccctcc

SEQ ID NO: 344701 - DNA, 21 bp, Homo sapiens
agtctcactcccctcctttcc

SEQ ID NO: 344702 - DNA, 15 bp, Homo sapiens
agtctcaggaggagg

SEQ ID NO: 344703 - DNA, 16 bp, Homo sapiens
agtctcattacagatt

SEQ ID NO: 344704 - DNA, 17 bp, Homo sapiens
agtctcattacttttga

SEQ ID NO: 344705 - DNA, 18 bp, Homo sapiens
agtctcattcctctgtcc

SEQ ID NO: 344706 - DNA, 21 bp, Homo sapiens
agtctcattctgttgcccagg

SEQ ID NO: 344707 - DNA, 16 bp, Homo sapiens
agtctccaccaggaac

SEQ ID NO: 344708 - DNA, 20 bp, Homo sapiens
agtctccctccgactccaga

SEQ ID NO: 344709 - DNA, 16 bp, Homo sapiens
agtctcctgtatcatt

SEQ ID NO: 344710 - DNA, 17 bp, Homo sapiens
agtctcctttgcactga

SEQ ID NO: 344711 - DNA, 19 bp, Homo sapiens
agtctcctttgcactgagg

SEQ ID NO: 344712 - DNA, 15 bp, Homo sapiens
agtctcgctctgtcg

SEQ ID NO: 344713 - DNA, 18 bp, Homo sapiens
agtctctacctatagaaa

SEQ ID NO: 344714 - DNA, 21 bp, Homo sapiens
agtctctccctggggtttttt

SEQ ID NO: 344715 - DNA, 13 bp, Homo sapiens
agtctctctgtga

SEQ ID NO: 344716 - DNA, 15 bp, Homo sapiens
agtctctctgtgaat

SEQ ID NO: 344717 - DNA, 18 bp, Homo sapiens
agtctctctgtgaataca

SEQ ID NO: 344718 - DNA, 20 bp, Homo sapiens
agtctctctgtgaatacaat

SEQ ID NO: 344719 - DNA, 12 bp, Homo sapiens
agtctctgaaca

SEQ ID NO: 344720 - DNA, 23 bp, Homo sapiens
agtctctgatttgcaaatgcaca

SEQ ID NO: 344721 - DNA, 14 bp, Homo sapiens
agtctctgcagtgt

SEQ ID NO: 344722 - DNA, 14 bp, Homo sapiens
agtctctgccaccc

SEQ ID NO: 344723 - DNA, 21 bp, Homo sapiens
agtctctgccacccactcagg

SEQ ID NO: 344724 - DNA, 14 bp, Homo sapiens
ataaattggctcct

SEQ ID NO: 344725 - DNA, 19 bp, Homo sapiens
ataaattggctcctttccc

SEQ ID NO: 344726 - DNA, 18 bp, Homo sapiens
ataaattggtgataagtg

SEQ ID NO: 344727 - DNA, 20 bp, Homo sapiens
ataaattggtgataagtgga

SEQ ID NO: 344728 - DNA, 17 bp, Homo sapiens
ataaatttaagtttttc

SEQ ID NO: 344729 - DNA, 12 bp, Homo sapiens
ataaatttctgg

SEQ ID NO: 344730 - DNA, 20 bp, Homo sapiens
ataaatttctgggatattta

SEQ ID NO: 344731 - DNA, 20 bp, Homo sapiens
ataaatttgaactccatggg

SEQ ID NO: 344732 - DNA, 20 bp, Homo sapiens
ataaatttgtgtaatattac

SEQ ID NO: 344733 - DNA, 16 bp, Homo sapiens
ataaatttgttgtcat

SEQ ID NO: 344734 - DNA, 20 bp, Homo sapiens
ataacaacactaatacacta

SEQ ID NO: 344735 - DNA, 13 bp, Homo sapiens
ataacaactctat

SEQ ID NO: 344736 - DNA, 15 bp, Homo sapiens
ataacaactctattt

SEQ ID NO: 344737 - DNA, 19 bp, Homo sapiens
ataacaatatatgatatat

SEQ ID NO: 344738 - DNA, 14 bp, Homo sapiens
ataacaatgtatgt

SEQ ID NO: 344739 - DNA, 17 bp, Homo sapiens
ataacaatgtatgtgaa

SEQ ID NO: 344740 - DNA, 18 bp, Homo sapiens
ataacaatgtatgtgaaa

SEQ ID NO: 344741 - DNA, 14 bp, Homo sapiens
ataacacaatatga

SEQ ID NO: 344742 - DNA, 18 bp, Homo sapiens
ataacaccaccattcaca

SEQ ID NO: 344743 - DNA, 20 bp, Homo sapiens
ataacactgcagccctctcc

SEQ ID NO: 344744 - DNA, 17 bp, Homo sapiens
ataacagagtagttttg

SEQ ID NO: 344745 - DNA, 23 bp, Homo sapiens
ataacatagttgaaaaaagaagt

SEQ ID NO: 344746 - DNA, 17 bp, Homo sapiens
ataacatctgaaaagaa

SEQ ID NO: 344747 - DNA, 12 bp, Homo sapiens
ataacattgtaa

SEQ ID NO: 344748 - DNA, 17 bp, Homo sapiens
ataacattttgtttatg

SEQ ID NO: 344749 - DNA, 12 bp, Homo sapiens
ataaccactgct

SEQ ID NO: 344750 - DNA, 14 bp, Homo sapiens
ataaccactgcttc

SEQ ID NO: 344751 - DNA, 12 bp, Homo sapiens
ataaccagcggg

SEQ ID NO: 344752 - DNA, 19 bp, Homo sapiens
ataaccagctgtaacacag

SEQ ID NO: 344753 - DNA, 16 bp, Homo sapiens
ataaccatcagttact

SEQ ID NO: 344754 - DNA, 13 bp, Homo sapiens
ataaccccacctt

SEQ ID NO: 344755 - DNA, 21 bp, Homo sapiens
ataaccccaccttgccaagct

SEQ ID NO: 344756 - DNA, 15 bp, Homo sapiens
ataaccccagcctga

SEQ ID NO: 344757 - DNA, 13 bp, Homo sapiens
ataacctatatga

SEQ ID NO: 344758 - DNA, 21 bp, Homo sapiens
ataacgccccagataccagcc

SEQ ID NO: 344759 - DNA, 21 bp, Homo sapiens
ataactacagagtctgacagg

SEQ ID NO: 344760 - DNA, 16 bp, Homo sapiens
ataactagatctcctg

SEQ ID NO: 344761 - DNA, 18 bp, Homo sapiens
ataactagatctcctgta

SEQ ID NO: 344762 - DNA, 20 bp, Homo sapiens
ataactagatctcctgtaat

SEQ ID NO: 344763 - DNA, 21 bp, Homo sapiens
ataactagatctcctgtaatt

SEQ ID NO: 344764 - DNA, 19 bp, Homo sapiens
ataactagatggtgctgag

SEQ ID NO: 344765 - DNA, 13 bp, Homo sapiens
ataactattgctg

SEQ ID NO: 344766 - DNA, 18 bp, Homo sapiens
ataactcatcataaaata

SEQ ID NO: 344767 - DNA, 19 bp, Homo sapiens
ataactctgcactactcct

SEQ ID NO: 344768 - DNA, 18 bp, Homo sapiens
ataactgccttaaaactt

SEQ ID NO: 344769 - DNA, 18 bp, Homo sapiens
ataactgctcttttacta

SEQ ID NO: 344770 - DNA, 18 bp, Homo sapiens
ataactggatattcttta

SEQ ID NO: 344771 - DNA, 13 bp, Homo sapiens
ataactgtaacat

SEQ ID NO: 344772 - DNA, 20 bp, Homo sapiens
ataactgtacaaaaattgtt

SEQ ID NO: 344773 - DNA, 12 bp, Homo sapiens
ataactgtgaag

SEQ ID NO: 344774 - DNA, 20 bp, Homo sapiens
ataacttaaaaatgtaaata

SEQ ID NO: 344775 - DNA, 21 bp, Homo sapiens
ataacttaaaaatgtaaatat

SEQ ID NO: 344776 - DNA, 14 bp, Homo sapiens
ataacttaaataat

SEQ ID NO: 344777 - DNA, 16 bp, Homo sapiens
ataacttaaataattt

SEQ ID NO: 344778 - DNA, 21 bp, Homo sapiens
atagcatatattcatacctgt

SEQ ID NO: 344779 - DNA, 22 bp, Homo sapiens
atagcatatattcatacctgtt

SEQ ID NO: 344780 - DNA, 13 bp, Homo sapiens
atagcattaacta

SEQ ID NO: 344781 - DNA, 15 bp, Homo sapiens
atagccagagaggag

SEQ ID NO: 344782 - DNA, 16 bp, Homo sapiens
atagccagagaggagc

SEQ ID NO: 344783 - DNA, 21 bp, Homo sapiens
atagccaggcctgacctcaag

SEQ ID NO: 344784 - DNA, 19 bp, Homo sapiens
atagccatttgaagaagga

SEQ ID NO: 344785 - DNA, 13 bp, Homo sapiens
atagccatttgcc

SEQ ID NO: 344786 - DNA, 14 bp, Homo sapiens
atagccatttgccc

SEQ ID NO: 344787 - DNA, 17 bp, Homo sapiens
atagccatttgccccaa

SEQ ID NO: 344788 - DNA, 19 bp, Homo sapiens
atagccctccccctcaacc

SEQ ID NO: 344789 - DNA, 17 bp, Homo sapiens
atagcctcaccttccct

SEQ ID NO: 344790 - DNA, 13 bp, Homo sapiens
atagcctttgtag

SEQ ID NO: 344791 - DNA, 17 bp, Homo sapiens
atagcgcataataaggg

SEQ ID NO: 344792 - DNA, 13 bp, Homo sapiens
atagcgttggaat

SEQ ID NO: 344793 - DNA, 20 bp, Homo sapiens
atagcgttggaattaaaaca

SEQ ID NO: 344794 - DNA, 22 bp, Homo sapiens
atagcgttggaattaaaacaat

SEQ ID NO: 344795 - DNA, 15 bp, Homo sapiens
atagctaacatttta

SEQ ID NO: 344796 - DNA, 22 bp, Homo sapiens
atagctaacattttaaataaaa

SEQ ID NO: 344797 - DNA, 23 bp, Homo sapiens
atagctaacattttaaataaaag

SEQ ID NO: 344798 - DNA, 18 bp, Homo sapiens
atagctacccacagagca

SEQ ID NO: 344799 - DNA, 16 bp, Homo sapiens
atagctatatccatgt

SEQ ID NO: 344800 - DNA, 20 bp, Homo sapiens
atagctatatccatgtactg

SEQ ID NO: 344801 - DNA, 14 bp, Homo sapiens
atagctattactgt

SEQ ID NO: 344802 - DNA, 17 bp, Homo sapiens
atagctctacacaacat

SEQ ID NO: 344803 - DNA, 23 bp, Homo sapiens
atagctctacacaacatgtatgt

SEQ ID NO: 344804 - DNA, 17 bp, Homo sapiens
atagctctattttaaag

SEQ ID NO: 344805 - DNA, 19 bp, Homo sapiens
atagcttaactaatttgaa

SEQ ID NO: 344806 - DNA, 23 bp, Homo sapiens
atagcttaactaatttgaatgtg

SEQ ID NO: 344807 - DNA, 14 bp, Homo sapiens
atagcttgtatagt

SEQ ID NO: 344808 - DNA, 19 bp, Homo sapiens
atagctttattttttaagt

SEQ ID NO: 344809 - DNA, 18 bp, Homo sapiens
ataggaacatatgaaaat

SEQ ID NO: 344810 - DNA, 15 bp, Homo sapiens
ataggaagaacagta

SEQ ID NO: 344811 - DNA, 17 bp, Homo sapiens
ataggagaaaatgaaag

SEQ ID NO: 344812 - DNA, 15 bp, Homo sapiens
ataggagcagcctta

SEQ ID NO: 344813 - DNA, 20 bp, Homo sapiens
ataggagcttccagatgggt

SEQ ID NO: 344814 - DNA, 17 bp, Homo sapiens
ataggataaattaatga

SEQ ID NO: 344815 - DNA, 17 bp, Homo sapiens
ataggcaaagttttcca

SEQ ID NO: 344816 - DNA, 18 bp, Homo sapiens
ataggcaaagttttccat

SEQ ID NO: 344817 - DNA, 20 bp, Homo sapiens
ataggcaaggatgaaagaca

SEQ ID NO: 344818 - DNA, 14 bp, Homo sapiens
ataggcccaaggtc

SEQ ID NO: 344819 - DNA, 20 bp, Homo sapiens
ataggcccaaggtcccctcc

SEQ ID NO: 344820 - DNA, 13 bp, Homo sapiens
ataggctctgcac

SEQ ID NO: 344821 - DNA, 14 bp, Homo sapiens
ataggctctgcaca

SEQ ID NO: 344822 - DNA, 19 bp, Homo sapiens
ataggggcacactacagag

SEQ ID NO: 344823 - DNA, 16 bp, Homo sapiens
atagggtggacagaag

SEQ ID NO: 344824 - DNA, 16 bp, Homo sapiens
ataggtcactcctggg

SEQ ID NO: 344825 - DNA, 23 bp, Homo sapiens
ataggtcagtgaggcccagggag

SEQ ID NO: 344826 - DNA, 17 bp, Homo sapiens
atagtaaaaagattctc

SEQ ID NO: 344827 - DNA, 14 bp, Homo sapiens
atagtacctttgct

SEQ ID NO: 344828 - DNA, 13 bp, Homo sapiens
atagtactattac

SEQ ID NO: 344829 - DNA, 16 bp, Homo sapiens
atagtagcagagtcat

SEQ ID NO: 344830 - DNA, 15 bp, Homo sapiens
atagtagcatacatt

SEQ ID NO: 344831 - DNA, 18 bp, Homo sapiens
atagtaggaccaatgttg

SEQ ID NO: 344832 - DNA, 20 bp, Homo sapiens
atagtagtaaaattagaaaa

SEQ ID NO: 344833 - DNA, 16 bp, Homo sapiens
atagtatagaatgaac

SEQ ID NO: 344834 - DNA, 17 bp, Homo sapiens
atagtatagaatgaact

SEQ ID NO: 344835 - DNA, 21 bp, Homo sapiens
atagtattccattgtgtgagt

SEQ ID NO: 344836 - DNA, 21 bp, Homo sapiens
atagtatttgagagttctaaa

SEQ ID NO: 344837 - DNA, 18 bp, Homo sapiens
atagtatttttatattta

SEQ ID NO: 344838 - DNA, 16 bp, Homo sapiens
atagtcaatcaaacag

SEQ ID NO: 344839 - DNA, 14 bp, Homo sapiens
atagtcatatgtga

SEQ ID NO: 344840 - DNA, 16 bp, Homo sapiens
atagtcatatgtgaag

SEQ ID NO: 344841 - DNA, 16 bp, Homo sapiens
atagtcattccaaata

SEQ ID NO: 344842 - DNA, 13 bp, Homo sapiens
atagtctgtgtga

SEQ ID NO: 344843 - DNA, 15 bp, Homo sapiens
atagtgcaactatga

SEQ ID NO: 344844 - DNA, 17 bp, Homo sapiens
atagtgcctaaaattgt

SEQ ID NO: 344845 - DNA, 19 bp, Homo sapiens
atagtgcctcagcgctgcc

SEQ ID NO: 344846 - DNA, 20 bp, Homo sapiens
atagtgcctcagcgctgccc

SEQ ID NO: 344847 - DNA, 10 bp, Homo sapiens
atagtgctgg

SEQ ID NO: 344848 - DNA, 16 bp, Homo sapiens
atatccagctgagtga

SEQ ID NO: 344849 - DNA, 16 bp, Homo sapiens
atatccagtcaaagac

SEQ ID NO: 344850 - DNA, 14 bp, Homo sapiens
atatccatgtactg

SEQ ID NO: 344851 - DNA, 17 bp, Homo sapiens
atatccattctttctga

SEQ ID NO: 344852 - DNA, 13 bp, Homo sapiens
atatcccagagaa

SEQ ID NO: 344853 - DNA, 13 bp, Homo sapiens
atatcctgagcca

SEQ ID NO: 344854 - DNA, 14 bp, Homo sapiens
atatcctgagccat

SEQ ID NO: 344855 - DNA, 17 bp, Homo sapiens
atatcctggtgtctagt

SEQ ID NO: 344856 - DNA, 20 bp, Homo sapiens
atatctaattattttgcagt

SEQ ID NO: 344857 - DNA, 19 bp, Homo sapiens
atatctatttatctgtctg

SEQ ID NO: 344858 - DNA, 13 bp, Homo sapiens
atatctcagaggc

SEQ ID NO: 344859 - DNA, 15 bp, Homo sapiens
atatctggacaagcc

SEQ ID NO: 344860 - DNA, 23 bp, Homo sapiens
atatctgtaaatttaactgcata

SEQ ID NO: 344861 - DNA, 17 bp, Homo sapiens
atatcttgaagaatatt

SEQ ID NO: 344862 - DNA, 14 bp, Homo sapiens
atatctttaataag

SEQ ID NO: 344863 - DNA, 13 bp, Homo sapiens
atatctttcagtt

SEQ ID NO: 344864 - DNA, 16 bp, Homo sapiens
atatcttttcttctcc

SEQ ID NO: 344865 - DNA, 18 bp, Homo sapiens
atatgaaatgataaagat

SEQ ID NO: 344866 - DNA, 22 bp, Homo sapiens
atatgaaatgataaagatgtca

SEQ ID NO: 344867 - DNA, 20 bp, Homo sapiens
atatgaagtaagttctgaaa

SEQ ID NO: 344868 - DNA, 21 bp, Homo sapiens
atatgaatttaaatataattc

SEQ ID NO: 344869 - DNA, 21 bp, Homo sapiens
atatgacaatttcaaaatgca

SEQ ID NO: 344870 - DNA, 16 bp, Homo sapiens
atatgacggaagaaca

SEQ ID NO: 344871 - DNA, 18 bp, Homo sapiens
atatgacggaagaacata

SEQ ID NO: 344872 - DNA, 20 bp, Homo sapiens
atatgacggaagaacataga

SEQ ID NO: 344873 - DNA, 13 bp, Homo sapiens
atatgactcacat

SEQ ID NO: 344874 - DNA, 15 bp, Homo sapiens
atatgacttcttgtt

SEQ ID NO: 344875 - DNA, 18 bp, Homo sapiens
atatgacttcttgttcat

SEQ ID NO: 344876 - DNA, 15 bp, Homo sapiens
atatgatatataaac

SEQ ID NO: 344877 - DNA, 18 bp, Homo sapiens
atatgatatatatgtata

SEQ ID NO: 344878 - DNA, 15 bp, Homo sapiens
atatgatatgcatgt

SEQ ID NO: 344879 - DNA, 16 bp, Homo sapiens
atatgatctgtggaga

SEQ ID NO: 344880 - DNA, 20 bp, Homo sapiens
atatgatctgtggagaatgt

SEQ ID NO: 344881 - DNA, 17 bp, Homo sapiens
atatgattctcctctcc

SEQ ID NO: 344882 - DNA, 18 bp, Homo sapiens
atatgattctcctctccc

SEQ ID NO: 344883 - DNA, 22 bp, Homo sapiens
atatgattctcctctcccaaat

SEQ ID NO: 344884 - DNA, 14 bp, Homo sapiens
atatgattgtaaca

SEQ ID NO: 344885 - DNA, 18 bp, Homo sapiens
atatgattgtaacatatt

SEQ ID NO: 344886 - DNA, 20 bp, Homo sapiens
atatgattgtaacatatttc

SEQ ID NO: 344887 - DNA, 14 bp, Homo sapiens
atatgatttatagt

SEQ ID NO: 344888 - DNA, 15 bp, Homo sapiens
atatgcacaatagca

SEQ ID NO: 344889 - DNA, 18 bp, Homo sapiens
atatgcactttccctaga

SEQ ID NO: 344890 - DNA, 13 bp, Homo sapiens
atatgcaggctgt

SEQ ID NO: 344891 - DNA, 16 bp, Homo sapiens
atatgcagttttcctt

SEQ ID NO: 344892 - DNA, 16 bp, Homo sapiens
atatgcataaacaaca

SEQ ID NO: 344893 - DNA, 15 bp, Homo sapiens
atatgcatgccaggc

SEQ ID NO: 344894 - DNA, 14 bp, Homo sapiens
atatgcatgtagca

SEQ ID NO: 344895 - DNA, 15 bp, Homo sapiens
atatgcatgtagcat

SEQ ID NO: 344896 - DNA, 21 bp, Homo sapiens
atatgcatgtagcatataaat

SEQ ID NO: 344897 - DNA, 21 bp, Homo sapiens
atatgccccttcttgggcccc

SEQ ID NO: 344898 - DNA, 11 bp, Homo sapiens
atatgctcttt

SEQ ID NO: 344899 - DNA, 21 bp, Homo sapiens
atatgcttatacacttacact

SEQ ID NO: 344900 - DNA, 16 bp, Homo sapiens
atatggaaatcctgtt

SEQ ID NO: 344901 - DNA, 19 bp, Homo sapiens
atatggaaatcctgttact

SEQ ID NO: 344902 - DNA, 20 bp, Homo sapiens
atatggaacatatgcacagg

SEQ ID NO: 344903 - DNA, 15 bp, Homo sapiens
atatggaggattctt

SEQ ID NO: 344904 - DNA, 22 bp, Homo sapiens
atatggaggattctttccccag

SEQ ID NO: 344905 - DNA, 23 bp, Homo sapiens
atatggattttctattgttactc

SEQ ID NO: 344906 - DNA, 17 bp, Homo sapiens
atatggcaagaaagctg

SEQ ID NO: 344907 - DNA, 16 bp, Homo sapiens
atatggcccagccttg

SEQ ID NO: 344908 - DNA, 17 bp, Homo sapiens
atatggtggccctgggg

SEQ ID NO: 344909 - DNA, 22 bp, Homo sapiens
atatgtaacagttggtgatttt

SEQ ID NO: 344910 - DNA, 20 bp, Homo sapiens
atatgtagatattgttttct

SEQ ID NO: 344911 - DNA, 16 bp, Homo sapiens
atatgtatataaaata

SEQ ID NO: 344912 - DNA, 14 bp, Homo sapiens
atatgtatatcttt

SEQ ID NO: 344913 - DNA, 23 bp, Homo sapiens
atatgtccccccctaactttctt

SEQ ID NO: 344914 - DNA, 19 bp, Homo sapiens
atatgtcttactactttaa

SEQ ID NO: 344915 - DNA, 22 bp, Homo sapiens
atatgtcttgcaaagcctttaa

SEQ ID NO: 344916 - DNA, 14 bp, Homo sapiens
atatgtctttaaaa

SEQ ID NO: 344917 - DNA, 16 bp, Homo sapiens
atatgtgcggcttttc

SEQ ID NO: 344918 - DNA, 23 bp, Homo sapiens
atattggtgtgaatgctgtacct

SEQ ID NO: 344919 - DNA, 14 bp, Homo sapiens
atattgtatgtacc

SEQ ID NO: 344920 - DNA, 22 bp, Homo sapiens
atattgtcacctagcagatatg

SEQ ID NO: 344921 - DNA, 12 bp, Homo sapiens
atattgtgccaa

SEQ ID NO: 344922 - DNA, 18 bp, Homo sapiens
atattgtgccaatatgta

SEQ ID NO: 344923 - DNA, 20 bp, Homo sapiens
atattgtgccaatatgtatt

SEQ ID NO: 344924 - DNA, 16 bp, Homo sapiens
atattgttataaataa

SEQ ID NO: 344925 - DNA, 23 bp, Homo sapiens
atattgttttctgtaaataacct

SEQ ID NO: 344926 - DNA, 21 bp, Homo sapiens
atatttaaaagacaaacacct

SEQ ID NO: 344927 - DNA, 13 bp, Homo sapiens
atatttaaatcat

SEQ ID NO: 344928 - DNA, 14 bp, Homo sapiens
atatttaaatcatt

SEQ ID NO: 344929 - DNA, 21 bp, Homo sapiens
atatttaaatgtaaagacaaa

SEQ ID NO: 344930 - DNA, 14 bp, Homo sapiens
atatttaagaaaat

SEQ ID NO: 344931 - DNA, 22 bp, Homo sapiens
atatttaagaaaatacaataaa

SEQ ID NO: 344932 - DNA, 21 bp, Homo sapiens
atatttaagagattaagaata

SEQ ID NO: 344933 - DNA, 18 bp, Homo sapiens
atatttaagcaacatctt

SEQ ID NO: 344934 - DNA, 14 bp, Homo sapiens
atatttaattatta

SEQ ID NO: 344935 - DNA, 15 bp, Homo sapiens
atatttaattattaa

SEQ ID NO: 344936 - DNA, 21 bp, Homo sapiens
atatttacatgaattgcattt

SEQ ID NO: 344937 - DNA, 19 bp, Homo sapiens
atatttacttcttatacat

SEQ ID NO: 344938 - DNA, 21 bp, Homo sapiens
atatttagttatagtttcaga

SEQ ID NO: 344939 - DNA, 17 bp, Homo sapiens
atatttataactcatca

SEQ ID NO: 344940 - DNA, 18 bp, Homo sapiens
atatttatagggctttta

SEQ ID NO: 344941 - DNA, 15 bp, Homo sapiens
atatttatatatatt

SEQ ID NO: 344942 - DNA, 14 bp, Homo sapiens
atatttattacctc

SEQ ID NO: 344943 - DNA, 16 bp, Homo sapiens
atatttattacctctg

SEQ ID NO: 344944 - DNA, 23 bp, Homo sapiens
atatttattattttcacctgttt

SEQ ID NO: 344945 - DNA, 17 bp, Homo sapiens
atatttattcatctgca

SEQ ID NO: 344946 - DNA, 20 bp, Homo sapiens
atatttattttcagtatact

SEQ ID NO: 344947 - DNA, 19 bp, Homo sapiens
atatttcacttaaactttg

SEQ ID NO: 344948 - DNA, 18 bp, Homo sapiens
atatttccatatggattt

SEQ ID NO: 344949 - DNA, 20 bp, Homo sapiens
atatttccctaaaatacatt

SEQ ID NO: 344950 - DNA, 22 bp, Homo sapiens
atatttccctaaaatacattta

SEQ ID NO: 344951 - DNA, 23 bp, Homo sapiens
atatttccttcaccacctcatgt

SEQ ID NO: 344952 - DNA, 15 bp, Homo sapiens
atatttcgaaagctg

SEQ ID NO: 344953 - DNA, 16 bp, Homo sapiens
atatttctatgtaaat

SEQ ID NO: 344954 - DNA, 18 bp, Homo sapiens
atatttcttgagtaattt

SEQ ID NO: 344955 - DNA, 11 bp, Homo sapiens
atatttgaaag

SEQ ID NO: 344956 - DNA, 15 bp, Homo sapiens
atatttgaaagaagt

SEQ ID NO: 344957 - DNA, 22 bp, Homo sapiens
atatttgctggagtgctggctc

SEQ ID NO: 344958 - DNA, 18 bp, Homo sapiens
atatttgcttatttatat

SEQ ID NO: 344959 - DNA, 19 bp, Homo sapiens
atatttgcttatttatatt

SEQ ID NO: 344960 - DNA, 13 bp, Homo sapiens
atatttgtaactt

SEQ ID NO: 344961 - DNA, 20 bp, Homo sapiens
atatttgtaactttgcatgt

SEQ ID NO: 344962 - DNA, 22 bp, Homo sapiens
atatttgtaactttgcatgttc

SEQ ID NO: 344963 - DNA, 14 bp, Homo sapiens
atatttgtccagat

SEQ ID NO: 344964 - DNA, 17 bp, Homo sapiens
atatttgtctcattttg

SEQ ID NO: 344965 - DNA, 24 bp, Homo sapiens
atatttgtctcattttgtatgtat

SEQ ID NO: 344966 - DNA, 12 bp, Homo sapiens
atattttacttg

SEQ ID NO: 344967 - DNA, 13 bp, Homo sapiens
atattttatactg

SEQ ID NO: 344968 - DNA, 15 bp, Homo sapiens
atattttattttcat

SEQ ID NO: 344969 - DNA, 20 bp, Homo sapiens
atattttattttcatacttt

SEQ ID NO: 344970 - DNA, 17 bp, Homo sapiens
atattttcaaattgtat

SEQ ID NO: 344971 - DNA, 24 bp, Homo sapiens
atattttcaaattgtatctagtgc

SEQ ID NO: 344972 - DNA, 19 bp, Homo sapiens
atattttcaacgcagccct

SEQ ID NO: 344973 - DNA, 16 bp, Homo sapiens
atattttcccatggaa

SEQ ID NO: 344974 - DNA, 12 bp, Homo sapiens
atattttctcta

SEQ ID NO: 344975 - DNA, 19 bp, Homo sapiens
atattttctgagtagcata

SEQ ID NO: 344976 - DNA, 14 bp, Homo sapiens
atattttgtatata

SEQ ID NO: 344977 - DNA, 21 bp, Homo sapiens
atattttgttgccttcatctt

SEQ ID NO: 344978 - DNA, 15 bp, Homo sapiens
atatttttaataaaa

SEQ ID NO: 344979 - DNA, 17 bp, Homo sapiens
atatttttaatttatga

SEQ ID NO: 344980 - DNA, 16 bp, Homo sapiens
atatttttatatttag

SEQ ID NO: 344981 - DNA, 20 bp, Homo sapiens
atatttttgtttgttttgtg

SEQ ID NO: 344982 - DNA, 20 bp, Homo sapiens
atattttttaatttgatgaa

SEQ ID NO: 344983 - DNA, 12 bp, Homo sapiens
atattttttaca

SEQ ID NO: 344984 - DNA, 13 bp, Homo sapiens
atattttttacaa

SEQ ID NO: 344985 - DNA, 20 bp, Homo sapiens
atcaaaaaaagactcagcca

SEQ ID NO: 344986 - DNA, 23 bp, Homo sapiens
atcaaaaagagtcttaattttct

SEQ ID NO: 344987 - DNA, 21 bp, Homo sapiens
atcaaaactttcttttctgga

SEQ ID NO: 344988 - DNA, 23 bp, Homo sapiens
atcaaaagtccttagaatgaggg

SEQ ID NO: 344989 - DNA, 18 bp, Homo sapiens
atcaaaataaaaagtgac

SEQ ID NO: 344990 - DNA, 15 bp, Homo sapiens
atcaaagcaagggct

SEQ ID NO: 344991 - DNA, 11 bp, Homo sapiens
atcaaagcagt

SEQ ID NO: 344992 - DNA, 15 bp, Homo sapiens
atcaaagctaggaaa

SEQ ID NO: 344993 - DNA, 16 bp, Homo sapiens
atcaaaggcagaaagg

SEQ ID NO: 344994 - DNA, 21 bp, Homo sapiens
atcaaaggcagaaaggagatc

SEQ ID NO: 344995 - DNA, 14 bp, Homo sapiens
atcaaataaatttc

SEQ ID NO: 344996 - DNA, 17 bp, Homo sapiens
atcaaataaatttctgg

SEQ ID NO: 344997 - DNA, 14 bp, Homo sapiens
atcaaataatacat

SEQ ID NO: 344998 - DNA, 16 bp, Homo sapiens
atcaaatcattcaaaa

SEQ ID NO: 344999 - DNA, 17 bp, Homo sapiens
atcaaatcattcaaaac

SEQ ID NO: 345000 - DNA, 21 bp, Homo sapiens
atcaaatctgtatatgttgta

SEQ ID NO: 345001 - DNA, 21 bp, Homo sapiens
atcaaatttgtagggtttcta

SEQ ID NO: 345002 - DNA, 21 bp, Homo sapiens
atcaacaaaagggagaacatg

SEQ ID NO: 345003 - DNA, 20 bp, Homo sapiens
atcaacagcatgtctactgc

SEQ ID NO: 345004 - DNA, 16 bp, Homo sapiens
atcaacctgcacttca

SEQ ID NO: 345005 - DNA, 20 bp, Homo sapiens
atcaacttaattctgttaca

SEQ ID NO: 345006 - DNA, 16 bp, Homo sapiens
atcaacttgtgtactg

SEQ ID NO: 345007 - DNA, 15 bp, Homo sapiens
atcaacttttgaaat

SEQ ID NO: 345008 - DNA, 23 bp, Homo sapiens
atcaacttttgaaatttaaaaat

SEQ ID NO: 345009 - DNA, 15 bp, Homo sapiens
atcaagctaataaaa

SEQ ID NO: 345010 - DNA, 12 bp, Homo sapiens
atcaagcttgtg

SEQ ID NO: 345011 - DNA, 15 bp, Homo sapiens
atcaaggatgttctg

SEQ ID NO: 345012 - DNA, 19 bp, Homo sapiens
atcaaggcaaaaatatcag

SEQ ID NO: 345013 - DNA, 17 bp, Homo sapiens
atcaaggctgcctggag

SEQ ID NO: 345014 - DNA, 18 bp, Homo sapiens
atcaagtcaatcatttct

SEQ ID NO: 345015 - DNA, 16 bp, Homo sapiens
atcaagtcccgaggca

SEQ ID NO: 345016 - DNA, 22 bp, Homo sapiens
atcaagtcccgaggcagcaaca

SEQ ID NO: 345017 - DNA, 13 bp, Homo sapiens
atcaagtctgtga

SEQ ID NO: 345018 - DNA, 15 bp, Homo sapiens
atcaataaaatgtga

SEQ ID NO: 345019 - DNA, 16 bp, Homo sapiens
atcaataaatacttta

SEQ ID NO: 345020 - DNA, 15 bp, Homo sapiens
atcaatacccttggc

SEQ ID NO: 345021 - DNA, 19 bp, Homo sapiens
atcaatccaggatgttatt

SEQ ID NO: 345022 - DNA, 15 bp, Homo sapiens
atcaatctggcttct

SEQ ID NO: 345023 - DNA, 15 bp, Homo sapiens
atcaatgaatattga

SEQ ID NO: 345024 - DNA, 16 bp, Homo sapiens
atcaatgttcattgta

SEQ ID NO: 345025 - DNA, 14 bp, Homo sapiens
atcaattaattctt

SEQ ID NO: 345026 - DNA, 17 bp, Homo sapiens
atcaattattacattta

SEQ ID NO: 345027 - DNA, 14 bp, Homo sapiens
atcaattttaacat

SEQ ID NO: 345028 - DNA, 19 bp, Homo sapiens
atcaattttaacatttgat

SEQ ID NO: 345029 - DNA, 19 bp, Homo sapiens
atcaattttttaaaccact

SEQ ID NO: 345030 - DNA, 19 bp, Homo sapiens
atcacaaaagctgtgtctc

SEQ ID NO: 345031 - DNA, 21 bp, Homo sapiens
atcacaaaagctgtgtctctg

SEQ ID NO: 345032 - DNA, 22 bp, Homo sapiens
atcacaaagctgtgaaatgtgc

SEQ ID NO: 345033 - DNA, 14 bp, Homo sapiens
atcacaatacagat

SEQ ID NO: 345034 - DNA, 17 bp, Homo sapiens
atcacaatgtactatat

SEQ ID NO: 345035 - DNA, 21 bp, Homo sapiens
atcacacactttctgactgca

SEQ ID NO: 345036 - DNA, 18 bp, Homo sapiens
atcacacttctgtgagac

SEQ ID NO: 345037 - DNA, 21 bp, Homo sapiens
atcacagatgtgcccagagta

SEQ ID NO: 345038 - DNA, 17 bp, Homo sapiens
atcacagccagcccagc

SEQ ID NO: 345039 - DNA, 14 bp, Homo sapiens
atcacagcctccag

SEQ ID NO: 345040 - DNA, 16 bp, Homo sapiens
atcacagcctccaggg

SEQ ID NO: 345041 - DNA, 18 bp, Homo sapiens
atcacagcttgttttgga

SEQ ID NO: 345042 - DNA, 20 bp, Homo sapiens
atcaccaccacacccctgcc

SEQ ID NO: 345043 - DNA, 14 bp, Homo sapiens
atcaccccttcccc

SEQ ID NO: 345044 - DNA, 14 bp, Homo sapiens
atcaccctcagctg

SEQ ID NO: 345045 - DNA, 17 bp, Homo sapiens
atcacctaattaatttc

SEQ ID NO: 345046 - DNA, 19 bp, Homo sapiens
atccaaatcttgaatttct

SEQ ID NO: 345047 - DNA, 20 bp, Homo sapiens
atccaaatgctgtgcaaaca

SEQ ID NO: 345048 - DNA, 22 bp, Homo sapiens
atccaaatgctgtgcaaacagt

SEQ ID NO: 345049 - DNA, 18 bp, Homo sapiens
atccaacccatgcatggc

SEQ ID NO: 345050 - DNA, 22 bp, Homo sapiens
atccaacctctttcctctctgg

SEQ ID NO: 345051 - DNA, 15 bp, Homo sapiens
atccaactattaaga

SEQ ID NO: 345052 - DNA, 13 bp, Homo sapiens
atccaaggcaaac

SEQ ID NO: 345053 - DNA, 20 bp, Homo sapiens
atccaagtaccaatgctgtt

SEQ ID NO: 345054 - DNA, 23 bp, Homo sapiens
atccaagtaccaatgctgttgta

SEQ ID NO: 345055 - DNA, 17 bp, Homo sapiens
atccaattatgtgacaa

SEQ ID NO: 345056 - DNA, 22 bp, Homo sapiens
atccaattatgtgacaaccttt

SEQ ID NO: 345057 - DNA, 23 bp, Homo sapiens
atccaattatgtgacaacctttg

SEQ ID NO: 345058 - DNA, 18 bp, Homo sapiens
atccacagaggccaggca

SEQ ID NO: 345059 - DNA, 14 bp, Homo sapiens
atccacaggattcc

SEQ ID NO: 345060 - DNA, 15 bp, Homo sapiens
atccacaggattcca

SEQ ID NO: 345061 - DNA, 13 bp, Homo sapiens
atccacagtattg

SEQ ID NO: 345062 - DNA, 17 bp, Homo sapiens
atccacagtattgttct

SEQ ID NO: 345063 - DNA, 16 bp, Homo sapiens
atccacattttaacag

SEQ ID NO: 345064 - DNA, 14 bp, Homo sapiens
atccaccaccttgc

SEQ ID NO: 345065 - DNA, 17 bp, Homo sapiens
atccacccacctcagcc

SEQ ID NO: 345066 - DNA, 20 bp, Homo sapiens
atccacccagtgctgccatg

SEQ ID NO: 345067 - DNA, 22 bp, Homo sapiens
atccacccagtgctgccatgcc

SEQ ID NO: 345068 - DNA, 23 bp, Homo sapiens
atccaccccggctccccctgcca

SEQ ID NO: 345069 - DNA, 22 bp, Homo sapiens
atccacctgcagcccttttagt

SEQ ID NO: 345070 - DNA, 13 bp, Homo sapiens
atccacctgtctc

SEQ ID NO: 345071 - DNA, 21 bp, Homo sapiens
atccacctgtctcagcctccc

SEQ ID NO: 345072 - DNA, 23 bp, Homo sapiens
atccactaatattcagtcctgta

SEQ ID NO: 345073 - DNA, 23 bp, Homo sapiens
atccactaggtgcccagtcttga

SEQ ID NO: 345074 - DNA, 21 bp, Homo sapiens
atccactctaccctcccaccc

SEQ ID NO: 345075 - DNA, 14 bp, Homo sapiens
atccagaaggaagc

SEQ ID NO: 345076 - DNA, 13 bp, Homo sapiens
atccagaagtttt

SEQ ID NO: 345077 - DNA, 19 bp, Homo sapiens
atccagaagttttaacttc

SEQ ID NO: 345078 - DNA, 16 bp, Homo sapiens
atccagacatcatgaa

SEQ ID NO: 345079 - DNA, 18 bp, Homo sapiens
atccagacatcatgaatt

SEQ ID NO: 345080 - DNA, 12 bp, Homo sapiens
atccagactgta

SEQ ID NO: 345081 - DNA, 20 bp, Homo sapiens
atccagactgtaagatgttg

SEQ ID NO: 345082 - DNA, 20 bp, Homo sapiens
atccagagagaagcacccca

SEQ ID NO: 345083 - DNA, 21 bp, Homo sapiens
atccagagagaagcaccccac

SEQ ID NO: 345084 - DNA, 12 bp, Homo sapiens
atccagcatgtg

SEQ ID NO: 345085 - DNA, 15 bp, Homo sapiens
atccagcatgtgtgt

SEQ ID NO: 345086 - DNA, 14 bp, Homo sapiens
atccagccaggggt

SEQ ID NO: 345087 - DNA, 15 bp, Homo sapiens
atccagccaggggtg

SEQ ID NO: 345088 - DNA, 21 bp, Homo sapiens
atccagccccatagaaaacaa

SEQ ID NO: 345089 - DNA, 14 bp, Homo sapiens
atccagctgagtga

SEQ ID NO: 345090 - DNA, 15 bp, Homo sapiens
atccagctgtgtgtt

SEQ ID NO: 345091 - DNA, 12 bp, Homo sapiens
atccaggcgtgg

SEQ ID NO: 345092 - DNA, 16 bp, Homo sapiens
atccaggtcctttcct

SEQ ID NO: 345093 - DNA, 15 bp, Homo sapiens
atccagtatcttgaa

SEQ ID NO: 345094 - DNA, 17 bp, Homo sapiens
atccagtgcttccacag

SEQ ID NO: 345095 - DNA, 16 bp, Homo sapiens
atccatacaaaactat

SEQ ID NO: 345096 - DNA, 17 bp, Homo sapiens
atccataccccctgccc

SEQ ID NO: 345097 - DNA, 14 bp, Homo sapiens
atccatcagctccc

SEQ ID NO: 345098 - DNA, 16 bp, Homo sapiens
atccatccatctccag

SEQ ID NO: 345099 - DNA, 12 bp, Homo sapiens
atccatctccag

SEQ ID NO: 345100 - DNA, 13 bp, Homo sapiens
atccatctttgta

SEQ ID NO: 345101 - DNA, 21 bp, Homo sapiens
atccatgcggagtccattatt

SEQ ID NO: 345102 - DNA, 23 bp, Homo sapiens
atccatgcggagtccattatttg

SEQ ID NO: 345103 - DNA, 20 bp, Homo sapiens
atccatgcggccggcctggg

SEQ ID NO: 345104 - DNA, 21 bp, Homo sapiens
atccatgcggccggcctgggg

SEQ ID NO: 345105 - DNA, 23 bp, Homo sapiens
atccatgcggccggcctggggcc

SEQ ID NO: 345106 - DNA, 16 bp, Homo sapiens
atccatgtttgtaaaa

SEQ ID NO: 345107 - DNA, 16 bp, Homo sapiens
atccattctttctgat

SEQ ID NO: 345108 - DNA, 14 bp, Homo sapiens
atccatttaaacta

SEQ ID NO: 345109 - DNA, 12 bp, Homo sapiens
atccattttcta

SEQ ID NO: 345110 - DNA, 21 bp, Homo sapiens
atccattttctaaactgtttt

SEQ ID NO: 345111 - DNA, 19 bp, Homo sapiens
atcccaaacccttcagtgc

SEQ ID NO: 345112 - DNA, 13 bp, Homo sapiens
atcccaagatcat

SEQ ID NO: 345113 - DNA, 18 bp, Homo sapiens
atcccaagtcaaacagtg

SEQ ID NO: 345114 - DNA, 17 bp, Homo sapiens
atcccaataaagtcctc

SEQ ID NO: 345115 - DNA, 22 bp, Homo sapiens
atcccaataaagtcctcttccc

SEQ ID NO: 345116 - DNA, 23 bp, Homo sapiens
atcccaataaagtcctcttccct

SEQ ID NO: 345117 - DNA, 16 bp, Homo sapiens
atcccaatctttctat

SEQ ID NO: 345118 - DNA, 15 bp, Homo sapiens
atcccaattctgtcc

SEQ ID NO: 345119 - DNA, 15 bp, Homo sapiens
atcccacaattgaaa

SEQ ID NO: 345120 - DNA, 10 bp, Homo sapiens
atcccacctc

SEQ ID NO: 345121 - DNA, 12 bp, Homo sapiens
atcccacctcca

SEQ ID NO: 345122 - DNA, 14 bp, Homo sapiens
atcccacctccagc

SEQ ID NO: 345123 - DNA, 16 bp, Homo sapiens
atcccacgcactccat

SEQ ID NO: 345124 - DNA, 21 bp, Homo sapiens
atcccactgatatcacgggcc

SEQ ID NO: 345125 - DNA, 14 bp, Homo sapiens
atcccactggatct

SEQ ID NO: 345126 - DNA, 16 bp, Homo sapiens
atcccactggatctgg

SEQ ID NO: 345127 - DNA, 22 bp, Homo sapiens
atcccagagaacaatcactatt

SEQ ID NO: 345128 - DNA, 17 bp, Homo sapiens
atcccagcacctgccag

SEQ ID NO: 345129 - DNA, 18 bp, Homo sapiens
atcccagcagcccaagct

SEQ ID NO: 345130 - DNA, 21 bp, Homo sapiens
atcccagccctacccttgtta

SEQ ID NO: 345131 - DNA, 16 bp, Homo sapiens
atcccagcctgtggtt

SEQ ID NO: 345132 - DNA, 18 bp, Homo sapiens
atcccagctacttgggaa

SEQ ID NO: 345133 - DNA, 13 bp, Homo sapiens
atcccaggagggg

SEQ ID NO: 345134 - DNA, 19 bp, Homo sapiens
atcccaggcttcaccctga

SEQ ID NO: 345135 - DNA, 17 bp, Homo sapiens
atcccagggaaggactt

SEQ ID NO: 345136 - DNA, 21 bp, Homo sapiens
atcccatctcagaagatgggt

SEQ ID NO: 345137 - DNA, 20 bp, Homo sapiens
atcccatggatgtttcttct

SEQ ID NO: 345138 - DNA, 21 bp, Homo sapiens
atccccaactccatggggttc

SEQ ID NO: 345139 - DNA, 16 bp, Homo sapiens
atccccaccagctcgt

SEQ ID NO: 345140 - DNA, 14 bp, Homo sapiens
atccccaggccagg

SEQ ID NO: 345141 - DNA, 12 bp, Homo sapiens
atcccccagcct

SEQ ID NO: 345142 - DNA, 22 bp, Homo sapiens
atcccccgtgtattcaggaccc

SEQ ID NO: 345143 - DNA, 14 bp, Homo sapiens
atccccctccttgc

SEQ ID NO: 345144 - DNA, 17 bp, Homo sapiens
atccccgacagtggctc

SEQ ID NO: 345145 - DNA, 16 bp, Homo sapiens
atcccctccctgcctg

SEQ ID NO: 345146 - DNA, 19 bp, Homo sapiens
atcccctccctgcctgctc

SEQ ID NO: 345147 - DNA, 15 bp, Homo sapiens
atcccctccctgtca

SEQ ID NO: 345148 - DNA, 15 bp, Homo sapiens
atcccctcctagcac

SEQ ID NO: 345149 - DNA, 23 bp, Homo sapiens
atcccctcgcttcataggcagag

SEQ ID NO: 345150 - DNA, 19 bp, Homo sapiens
atcccctcgtcctgtccca

SEQ ID NO: 345151 - DNA, 20 bp, Homo sapiens
atcccctctgtctacaaata

SEQ ID NO: 345152 - DNA, 13 bp, Homo sapiens
atccccttctccc

SEQ ID NO: 345153 - DNA, 20 bp, Homo sapiens
atccccttctcccctgcact

SEQ ID NO: 345154 - DNA, 18 bp, Homo sapiens
atcccctttggttttact

SEQ ID NO: 345155 - DNA, 17 bp, Homo sapiens
atcccgaagccatcact

SEQ ID NO: 345156 - DNA, 23 bp, Homo sapiens
atcccgaagccatcacttctccc

SEQ ID NO: 345157 - DNA, 16 bp, Homo sapiens
atcccgccacctatct

SEQ ID NO: 345158 - DNA, 15 bp, Homo sapiens
atcccggggccatgg

SEQ ID NO: 345159 - DNA, 21 bp, Homo sapiens
atcccggggccatggaagctg

SEQ ID NO: 345160 - DNA, 16 bp, Homo sapiens
atcccggtttcagaag

SEQ ID NO: 345161 - DNA, 16 bp, Homo sapiens
atccctaagaattccc

SEQ ID NO: 345162 - DNA, 14 bp, Homo sapiens
atccctatgctgcc

SEQ ID NO: 345163 - DNA, 17 bp, Homo sapiens
atccctccaccccagtc

SEQ ID NO: 345164 - DNA, 18 bp, Homo sapiens
atccctccaccccagtcc

SEQ ID NO: 345165 - DNA, 22 bp, Homo sapiens
atccctccaccccagtccccgg

SEQ ID NO: 345166 - DNA, 19 bp, Homo sapiens
atccctcggaagccgtctg

SEQ ID NO: 345167 - DNA, 22 bp, Homo sapiens
atccctcggaagccgtctgact

SEQ ID NO: 345168 - DNA, 21 bp, Homo sapiens
atccctcggtcagcaccgtgg

SEQ ID NO: 345169 - DNA, 18 bp, Homo sapiens
atccctcttcctccaaag

SEQ ID NO: 345170 - DNA, 19 bp, Homo sapiens
atccctcttcctccaaagc

SEQ ID NO: 345171 - DNA, 22 bp, Homo sapiens
atccctcttcctccaaagcctg

SEQ ID NO: 345172 - DNA, 11 bp, Homo sapiens
atccctgccaa

SEQ ID NO: 345173 - DNA, 17 bp, Homo sapiens
atccctgccaagaactc

SEQ ID NO: 345174 - DNA, 19 bp, Homo sapiens
atccctgggggccttgggt

SEQ ID NO: 345175 - DNA, 19 bp, Homo sapiens
atccctgttacccagagaa

SEQ ID NO: 345176 - DNA, 13 bp, Homo sapiens
atccctgttcatt

SEQ ID NO: 345177 - DNA, 23 bp, Homo sapiens
atcccttcaaggaagtgataaca

SEQ ID NO: 345178 - DNA, 23 bp, Homo sapiens
atcccttctaggcatctcctctc

SEQ ID NO: 345179 - DNA, 17 bp, Homo sapiens
atcccttctcacagcac

SEQ ID NO: 345180 - DNA, 13 bp, Homo sapiens
atcccttggcccc

SEQ ID NO: 345181 - DNA, 16 bp, Homo sapiens
atcccttggcccctct

SEQ ID NO: 345182 - DNA, 18 bp, Homo sapiens
atcccttggcccctctct

SEQ ID NO: 345183 - DNA, 21 bp, Homo sapiens
atccgagcgacggctcctccc

SEQ ID NO: 345184 - DNA, 17 bp, Homo sapiens
atccgccctgggctctg

SEQ ID NO: 345185 - DNA, 18 bp, Homo sapiens
atccgccctgggctctgg

SEQ ID NO: 345186 - DNA, 19 bp, Homo sapiens
atccgccctgggctctggg

SEQ ID NO: 345187 - DNA, 20 bp, Homo sapiens
atccgccctgggctctgggt

SEQ ID NO: 345188 - DNA, 16 bp, Homo sapiens
atccgcctctgagcca

SEQ ID NO: 345189 - DNA, 22 bp, Homo sapiens
atccgtgagcagtgtgtctcct

SEQ ID NO: 345190 - DNA, 14 bp, Homo sapiens
atcctaaaacaaat

SEQ ID NO: 345191 - DNA, 13 bp, Homo sapiens
atcctaccaaagt

SEQ ID NO: 345192 - DNA, 14 bp, Homo sapiens
atcctaccaaagta

SEQ ID NO: 345193 - DNA, 14 bp, Homo sapiens
atcctaccaatgca

SEQ ID NO: 345194 - DNA, 14 bp, Homo sapiens
atcctaccttttga

SEQ ID NO: 345195 - DNA, 22 bp, Homo sapiens
atcctaccttttgataaaatgt

SEQ ID NO: 345196 - DNA, 17 bp, Homo sapiens
atcctactcctacctgg

SEQ ID NO: 345197 - DNA, 13 bp, Homo sapiens
atcctagacttga

SEQ ID NO: 345198 - DNA, 19 bp, Homo sapiens
atcctagctgtgtgcagtc

SEQ ID NO: 345199 - DNA, 15 bp, Homo sapiens
atcctagctttttcc

SEQ ID NO: 345200 - DNA, 14 bp, Homo sapiens
atcctataaatgtg

SEQ ID NO: 345201 - DNA, 16 bp, Homo sapiens
atcctattgttgatgg

SEQ ID NO: 345202 - DNA, 14 bp, Homo sapiens
atcctcactgggtg

SEQ ID NO: 345203 - DNA, 22 bp, Homo sapiens
atcctcagccccagggccctgc

SEQ ID NO: 345204 - DNA, 13 bp, Homo sapiens
atcctccagcttc

SEQ ID NO: 345205 - DNA, 12 bp, Homo sapiens
atcctccagggg

SEQ ID NO: 345206 - DNA, 15 bp, Homo sapiens
atcctccccttccct

SEQ ID NO: 345207 - DNA, 18 bp, Homo sapiens
atcctccccttccctgca

SEQ ID NO: 345208 - DNA, 17 bp, Homo sapiens
atcctccgccctttttg

SEQ ID NO: 345209 - DNA, 15 bp, Homo sapiens
atcctccgtccagcc

SEQ ID NO: 345210 - DNA, 10 bp, Homo sapiens
atcctcctgc

SEQ ID NO: 345211 - DNA, 16 bp, Homo sapiens
atcctcctggacccag

SEQ ID NO: 345212 - DNA, 14 bp, Homo sapiens
atcctctattttgt

SEQ ID NO: 345213 - DNA, 16 bp, Homo sapiens
atcctctattttgtga

SEQ ID NO: 345214 - DNA, 15 bp, Homo sapiens
atcctctccactcca

SEQ ID NO: 345215 - DNA, 18 bp, Homo sapiens
atcctctgagtgtgacca

SEQ ID NO: 345216 - DNA, 23 bp, Homo sapiens
atcctctgatatacaattagaga

SEQ ID NO: 345217 - DNA, 19 bp, Homo sapiens
atcctctggttcttcattt

SEQ ID NO: 345218 - DNA, 12 bp, Homo sapiens
atcctgaataac

SEQ ID NO: 345219 - DNA, 23 bp, Homo sapiens
atcctgacttctaatatcattca

SEQ ID NO: 345220 - DNA, 24 bp, Homo sapiens
atcctgagccatcggtgaaactaa

SEQ ID NO: 345221 - DNA, 22 bp, Homo sapiens
atcctgaggggatatccctatg

SEQ ID NO: 345222 - DNA, 15 bp, Homo sapiens
atcctgcaccccagc

SEQ ID NO: 345223 - DNA, 17 bp, Homo sapiens
atcctgcaccccagcat

SEQ ID NO: 345224 - DNA, 16 bp, Homo sapiens
atcctgcaccctctgc

SEQ ID NO: 345225 - DNA, 11 bp, Homo sapiens
atcctgcactc

SEQ ID NO: 345226 - DNA, 13 bp, Homo sapiens
atcctgccaggag

SEQ ID NO: 345227 - DNA, 18 bp, Homo sapiens
atcctgccaggagcagcc

SEQ ID NO: 345228 - DNA, 22 bp, Homo sapiens
atcctgcccagtgttgtttgta

SEQ ID NO: 345229 - DNA, 12 bp, Homo sapiens
atcctgcctctc

SEQ ID NO: 345230 - DNA, 14 bp, Homo sapiens
atcctgcctctccc

SEQ ID NO: 345231 - DNA, 18 bp, Homo sapiens
atcctgcctctccccaaa

SEQ ID NO: 345232 - DNA, 18 bp, Homo sapiens
atcctgctagctgtagaa

SEQ ID NO: 345233 - DNA, 21 bp, Homo sapiens
atcctgcttctgatatgcagt

SEQ ID NO: 345234 - DNA, 15 bp, Homo sapiens
atcctgctttacagg

SEQ ID NO: 345235 - DNA, 14 bp, Homo sapiens
atcctggagcccct

SEQ ID NO: 345236 - DNA, 14 bp, Homo sapiens
atcctggccctctg

SEQ ID NO: 345237 - DNA, 22 bp, Homo sapiens
atcctggctctgtggcttgcta

SEQ ID NO: 345238 - DNA, 15 bp, Homo sapiens
atcctggctttgccc

SEQ ID NO: 345239 - DNA, 16 bp, Homo sapiens
atcctggctttgccca

SEQ ID NO: 345240 - DNA, 17 bp, Homo sapiens
atcctgggcatccccag

SEQ ID NO: 345241 - DNA, 22 bp, Homo sapiens
atcctgggcatccccagccccc

SEQ ID NO: 345242 - DNA, 15 bp, Homo sapiens
atcctggggctccct

SEQ ID NO: 345243 - DNA, 16 bp, Homo sapiens
atcctggggctccctt

SEQ ID NO: 345244 - DNA, 17 bp, Homo sapiens
atcctgtcctcagcttc

SEQ ID NO: 345245 - DNA, 13 bp, Homo sapiens
atcctgtgggtga

SEQ ID NO: 345246 - DNA, 13 bp, Homo sapiens
atcctgtgtcccc

SEQ ID NO: 345247 - DNA, 16 bp, Homo sapiens
atcctgtgtggagagg

SEQ ID NO: 345248 - DNA, 21 bp, Homo sapiens
atcctgtgtggagagggaatg

SEQ ID NO: 345249 - DNA, 17 bp, Homo sapiens
atcctgttggctgctgc

SEQ ID NO: 345250 - DNA, 14 bp, Homo sapiens
atccttaaaagcat

SEQ ID NO: 345251 - DNA, 17 bp, Homo sapiens
atccttatgatgtccaa

SEQ ID NO: 345252 - DNA, 21 bp, Homo sapiens
atccttcacaggcagtgcatg

SEQ ID NO: 345253 - DNA, 23 bp, Homo sapiens
atccttcacaggcagtgcatgtg

SEQ ID NO: 345254 - DNA, 18 bp, Homo sapiens
atccttccaaaaaattaa

SEQ ID NO: 345255 - DNA, 20 bp, Homo sapiens
atccttccaaagaattctta

SEQ ID NO: 345256 - DNA, 14 bp, Homo sapiens
atccttcccgcagc

SEQ ID NO: 345257 - DNA, 19 bp, Homo sapiens
atccttcccgcagcaccag

SEQ ID NO: 345258 - DNA, 22 bp, Homo sapiens
atccttcccgcagcaccagcct

SEQ ID NO: 345259 - DNA, 21 bp, Homo sapiens
atccttgactgaagcgaacat

SEQ ID NO: 345260 - DNA, 14 bp, Homo sapiens
atccttggagagca

SEQ ID NO: 345261 - DNA, 16 bp, Homo sapiens
atccttggagagcagc

SEQ ID NO: 345262 - DNA, 18 bp, Homo sapiens
atccttggagagcagctg

SEQ ID NO: 345263 - DNA, 20 bp, Homo sapiens
atccttggagagcagctggc

SEQ ID NO: 345264 - DNA, 15 bp, Homo sapiens
atccttgtcagttgt

SEQ ID NO: 345265 - DNA, 23 bp, Homo sapiens
atccttgtctttactgacaagaa

SEQ ID NO: 345266 - DNA, 13 bp, Homo sapiens
atcctttctaaca

SEQ ID NO: 345267 - DNA, 14 bp, Homo sapiens
atccttttttctct

SEQ ID NO: 345268 - DNA, 17 bp, Homo sapiens
atccttttttctcttct

SEQ ID NO: 345269 - DNA, 22 bp, Homo sapiens
atccttttttctcttctgtcca

SEQ ID NO: 345270 - DNA, 17 bp, Homo sapiens
atcgaacgcgtgtgtgc

SEQ ID NO: 345271 - DNA, 17 bp, Homo sapiens
atgatttaagcatttta

SEQ ID NO: 345272 - DNA, 20 bp, Homo sapiens
atgatttagggaagcaggga

SEQ ID NO: 345273 - DNA, 20 bp, Homo sapiens
atgatttcaatgattgttta

SEQ ID NO: 345274 - DNA, 16 bp, Homo sapiens
atgatttcagaaacaa

SEQ ID NO: 345275 - DNA, 13 bp, Homo sapiens
atgatttcatgat

SEQ ID NO: 345276 - DNA, 19 bp, Homo sapiens
atgatttgggggaggcttt

SEQ ID NO: 345277 - DNA, 20 bp, Homo sapiens
atgattttatttaaactatt

SEQ ID NO: 345278 - DNA, 16 bp, Homo sapiens
atgattttatttgaca

SEQ ID NO: 345279 - DNA, 22 bp, Homo sapiens
atgttctttcctttcatcctca

SEQ ID NO: 345280 - DNA, 23 bp, Homo sapiens
atgttctttcctttcatcctcag

SEQ ID NO: 345281 - DNA, 16 bp, Homo sapiens
atgttgaagtcaaatt

SEQ ID NO: 345282 - DNA, 22 bp, Homo sapiens
atgttgaatgtatctagtggtc

SEQ ID NO: 345283 - DNA, 18 bp, Homo sapiens
atgttgagccaggcctgg

SEQ ID NO: 345284 - DNA, 21 bp, Homo sapiens
atgttgagtgttcattttagt

SEQ ID NO: 345285 - DNA, 22 bp, Homo sapiens
atgttgatcgatgttaaacgtc

SEQ ID NO: 345286 - DNA, 14 bp, Homo sapiens
atgttgcactgaaa

SEQ ID NO: 345287 - DNA, 19 bp, Homo sapiens
atgttgctcagtctccctt

SEQ ID NO: 345288 - DNA, 20 bp, Homo sapiens
atgttgctcagtctcccttt

SEQ ID NO: 345289 - DNA, 13 bp, Homo sapiens
atgttgggaaaaa

SEQ ID NO: 345290 - DNA, 22 bp, Homo sapiens
atgttgtagatacaatcagctg

SEQ ID NO: 345291 - DNA, 11 bp, Homo sapiens
atgttgtattg

SEQ ID NO: 345292 - DNA, 23 bp, Homo sapiens
atgttgtcctgtgtcatctgtca

SEQ ID NO: 345293 - DNA, 15 bp, Homo sapiens
atgttgtgatgtatt

SEQ ID NO: 345294 - DNA, 17 bp, Homo sapiens
atgttgttatgctatta

SEQ ID NO: 345295 - DNA, 17 bp, Homo sapiens
atgttgttatttaaaga

SEQ ID NO: 345296 - DNA, 17 bp, Homo sapiens
atgttgttttttcatag

SEQ ID NO: 345297 - DNA, 19 bp, Homo sapiens
atgtttaaaagcaaaactg

SEQ ID NO: 345298 - DNA, 20 bp, Homo sapiens
atgtttaatatctgactgaa

SEQ ID NO: 345299 - DNA, 23 bp, Homo sapiens
atgtttacctcactggtgcattt

SEQ ID NO: 345300 - DNA, 20 bp, Homo sapiens
atgtttagaaataaatgaaa

SEQ ID NO: 345301 - DNA, 16 bp, Homo sapiens
atgtttagtagctgat

SEQ ID NO: 345302 - DNA, 19 bp, Homo sapiens
atgtttagtagctgataaa

SEQ ID NO: 345303 - DNA, 14 bp, Homo sapiens
atgtttatattgtt

SEQ ID NO: 345304 - DNA, 18 bp, Homo sapiens
atgtttattcctgataat

SEQ ID NO: 345305 - DNA, 23 bp, Homo sapiens
atgtttccaggcatgaccctgga

SEQ ID NO: 345306 - DNA, 21 bp, Homo sapiens
atgtttccatagctactatat

SEQ ID NO: 345307 - DNA, 18 bp, Homo sapiens
atgtttccatcatttctg

SEQ ID NO: 345308 - DNA, 22 bp, Homo sapiens
atgtttcttctaggttctaaaa

SEQ ID NO: 345309 - DNA, 18 bp, Homo sapiens
atgtttgaggttaaaata

SEQ ID NO: 345310 - DNA, 21 bp, Homo sapiens
atgtttgccctgttcaaagta

SEQ ID NO: 345311 - DNA, 16 bp, Homo sapiens
atgtttgctcagaaca

SEQ ID NO: 345312 - DNA, 16 bp, Homo sapiens
atgtttggctgaaatt

SEQ ID NO: 345313 - DNA, 13 bp, Homo sapiens
atgtttgtcattt

SEQ ID NO: 345314 - DNA, 21 bp, Homo sapiens
atgtttgtctgtgtgctgtaa

SEQ ID NO: 345315 - DNA, 13 bp, Homo sapiens
atgtttgtggcct

SEQ ID NO: 345316 - DNA, 20 bp, Homo sapiens
atgtttgttttcaaaatact

SEQ ID NO: 345317 - DNA, 12 bp, Homo sapiens
atgttttagcat

SEQ ID NO: 345318 - DNA, 19 bp, Homo sapiens
atgttttgtacaattacta

SEQ ID NO: 345319 - DNA, 16 bp, Homo sapiens
atgttttgtttctgaa

SEQ ID NO: 345320 - DNA, 18 bp, Homo sapiens
atgtttttaaaagtttca

SEQ ID NO: 345321 - DNA, 16 bp, Homo sapiens
atgtttttaaatatat

SEQ ID NO: 345322 - DNA, 17 bp, Homo sapiens
atgtttttaaatatatt

SEQ ID NO: 345323 - DNA, 17 bp, Homo sapiens
atgtttttgtgtagagt

SEQ ID NO: 345324 - DNA, 17 bp, Homo sapiens
attaaaaaaaaaaacta

SEQ ID NO: 345325 - DNA, 15 bp, Homo sapiens
attaaaaacacctaa

SEQ ID NO: 345326 - DNA, 14 bp, Homo sapiens
attaaaaatataaa

SEQ ID NO: 345327 - DNA, 16 bp, Homo sapiens
attaaaaatataaaca

SEQ ID NO: 345328 - DNA, 22 bp, Homo sapiens
attaaaaatatacaatttcttg

SEQ ID NO: 345329 - DNA, 16 bp, Homo sapiens
attaaaacaaaatcct

SEQ ID NO: 345330 - DNA, 13 bp, Homo sapiens
attaaaactgctt

SEQ ID NO: 345331 - DNA, 16 bp, Homo sapiens
attaaaactgcttttt

SEQ ID NO: 345332 - DNA, 18 bp, Homo sapiens
attaaaagaagactggaa

SEQ ID NO: 345333 - DNA, 19 bp, Homo sapiens
attaaaatgattgtaaaat

SEQ ID NO: 345334 - DNA, 12 bp, Homo sapiens
attaaaattaag

SEQ ID NO: 345335 - DNA, 15 bp, Homo sapiens
attaaacaatttatt

SEQ ID NO: 345336 - DNA, 16 bp, Homo sapiens
attaaacaatttattt

SEQ ID NO: 345337 - DNA, 17 bp, Homo sapiens
attaaacaatttatttt

SEQ ID NO: 345338 - DNA, 20 bp, Homo sapiens
attaaacacctgacacatct

SEQ ID NO: 345339 - DNA, 15 bp, Homo sapiens
attaaacactgtaat

SEQ ID NO: 345340 - DNA, 17 bp, Homo sapiens
attaaacagaaggtaat

SEQ ID NO: 345341 - DNA, 21 bp, Homo sapiens
attaaacagaaggtaatagga

SEQ ID NO: 345342 - DNA, 21 bp, Homo sapiens
attaaacgaggcaatgactgt

SEQ ID NO: 345343 - DNA, 18 bp, Homo sapiens
attaaactgtatgtctta

SEQ ID NO: 345344 - DNA, 14 bp, Homo sapiens
attaaacttcagca

SEQ ID NO: 345345 - DNA, 18 bp, Homo sapiens
attaaaggaattaaacta

SEQ ID NO: 345346 - DNA, 20 bp, Homo sapiens
attaaaggaattaaactaaa

SEQ ID NO: 345347 - DNA, 15 bp, Homo sapiens
attaaataaatcttt

SEQ ID NO: 345348 - DNA, 16 bp, Homo sapiens
attaaataattttaca

SEQ ID NO: 345349 - DNA, 19 bp, Homo sapiens
attaaataattttacatgt

SEQ ID NO: 345350 - DNA, 17 bp, Homo sapiens
attaaatacagacacta

SEQ ID NO: 345351 - DNA, 15 bp, Homo sapiens
attaaatatatgtat

SEQ ID NO: 345352 - DNA, 16 bp, Homo sapiens
attaaatatatgtatg

SEQ ID NO: 345353 - DNA, 17 bp, Homo sapiens
attaaatatatgtatgt

SEQ ID NO: 345354 - DNA, 21 bp, Homo sapiens
attaaatatatgtatgtaaaa

SEQ ID NO: 345355 - DNA, 15 bp, Homo sapiens
attaaatatttaatg

SEQ ID NO: 345356 - DNA, 15 bp, Homo sapiens
attaaatcagttttg

SEQ ID NO: 345357 - DNA, 11 bp, Homo sapiens
attaaatctgt

SEQ ID NO: 345358 - DNA, 23 bp, Homo sapiens
attaaatgaaatacttgacaaca

SEQ ID NO: 345359 - DNA, 18 bp, Homo sapiens
attaaattaggaataaat

SEQ ID NO: 345360 - DNA, 21 bp, Homo sapiens
attaaattctctctaacataa

SEQ ID NO: 345361 - DNA, 17 bp, Homo sapiens
attaaatttcacaatat

SEQ ID NO: 345362 - DNA, 16 bp, Homo sapiens
attaaattttaatgta

SEQ ID NO: 345363 - DNA, 19 bp, Homo sapiens
attaaattttaatgtaaaa

SEQ ID NO: 345364 - DNA, 18 bp, Homo sapiens
attaacaacaataacact

SEQ ID NO: 345365 - DNA, 12 bp, Homo sapiens
attaacagtttt

SEQ ID NO: 345366 - DNA, 19 bp, Homo sapiens
attaacagttttccatgaa

SEQ ID NO: 345367 - DNA, 23 bp, Homo sapiens
attaacctgcatgcagcaacacc

SEQ ID NO: 345368 - DNA, 16 bp, Homo sapiens
attaacctggtgctgg

SEQ ID NO: 345369 - DNA, 17 bp, Homo sapiens
attaacctggtgctgga

SEQ ID NO: 345370 - DNA, 15 bp, Homo sapiens
attaactattagtat

SEQ ID NO: 345371 - DNA, 23 bp, Homo sapiens
attaactctggacctctcttgtg

SEQ ID NO: 345372 - DNA, 19 bp, Homo sapiens
attaactgaattctgaact

SEQ ID NO: 345373 - DNA, 13 bp, Homo sapiens
attaagaaacaat

SEQ ID NO: 345374 - DNA, 17 bp, Homo sapiens
attaagaaacaatttaa

SEQ ID NO: 345375 - DNA, 17 bp, Homo sapiens
atgtcttcgtacagttc

SEQ ID NO: 345376 - DNA, 16 bp, Homo sapiens
atgtcttgagatgtat

SEQ ID NO: 345377 - DNA, 19 bp, Homo sapiens
atgtcttggccactatgga

SEQ ID NO: 345378 - DNA, 18 bp, Homo sapiens
atgtcttgtaagcaaaag

SEQ ID NO: 345379 - DNA, 13 bp, Homo sapiens
atgtctttaaaat

SEQ ID NO: 345380 - DNA, 16 bp, Homo sapiens
atgtctttaaaatgat

SEQ ID NO: 345381 - DNA, 22 bp, Homo sapiens
atgtctttggcttcagaattgt

SEQ ID NO: 345382 - DNA, 16 bp, Homo sapiens
atgtcttttcaaaagg

SEQ ID NO: 345383 - DNA, 18 bp, Homo sapiens
atgtgaaaagtaaaacag

SEQ ID NO: 345384 - DNA, 16 bp, Homo sapiens
atgtgaacccgggacg

SEQ ID NO: 345385 - DNA, 23 bp, Homo sapiens
atgtgaagacagagcagatcagt

SEQ ID NO: 345386 - DNA, 18 bp, Homo sapiens
atgtgaagataatttgca

SEQ ID NO: 345387 - DNA, 20 bp, Homo sapiens
atgtgaagataatttgcata

SEQ ID NO: 345388 - DNA, 13 bp, Homo sapiens
atgtgaagcatgc

SEQ ID NO: 345389 - DNA, 21 bp, Homo sapiens
atgtgaagctgaaccccctcc

SEQ ID NO: 345390 - DNA, 14 bp, Homo sapiens
atgtgaaggcccaa

SEQ ID NO: 345391 - DNA, 18 bp, Homo sapiens
atgtgaattctgtgaaga

SEQ ID NO: 345392 - DNA, 14 bp, Homo sapiens
atgtgacaaccttt

SEQ ID NO: 345393 - DNA, 23 bp, Homo sapiens
atgtgacaacctttgtgtaataa

SEQ ID NO: 345394 - DNA, 19 bp, Homo sapiens
atgtgacatgcgggctggg

SEQ ID NO: 345395 - DNA, 16 bp, Homo sapiens
atgtgacccaccagtg

SEQ ID NO: 345396 - DNA, 18 bp, Homo sapiens
atgtgacccaccagtgcc

SEQ ID NO: 345397 - DNA, 18 bp, Homo sapiens
atgtgagaacttttcata

SEQ ID NO: 345398 - DNA, 19 bp, Homo sapiens
atgtgagaacttttcatag

SEQ ID NO: 345399 - DNA, 14 bp, Homo sapiens
atgtgagacagcaa

SEQ ID NO: 345400 - DNA, 16 bp, Homo sapiens
atgtgagacagcaagt

SEQ ID NO: 345401 - DNA, 21 bp, Homo sapiens
atgtgagattactttgtcccg

SEQ ID NO: 345402 - DNA, 16 bp, Homo sapiens
atgtgagcatgaaact

SEQ ID NO: 345403 - DNA, 21 bp, Homo sapiens
atgtgagccaccgctgccagc

SEQ ID NO: 345404 - DNA, 19 bp, Homo sapiens
atgtgagctataatgtttc

SEQ ID NO: 345405 - DNA, 23 bp, Homo sapiens
atgtgagtacccaggatgatttc

SEQ ID NO: 345406 - DNA, 21 bp, Homo sapiens
atggaagtactataatttacc

SEQ ID NO: 345407 - DNA, 18 bp, Homo sapiens
atggaagtatttgagaga

SEQ ID NO: 345408 - DNA, 16 bp, Homo sapiens
atggaataattagctt

SEQ ID NO: 345409 - DNA, 23 bp, Homo sapiens
atggaattattttgaatgtcaca

SEQ ID NO: 345410 - DNA, 21 bp, Homo sapiens
atggaatttgtaagtttatgt

SEQ ID NO: 345411 - DNA, 13 bp, Homo sapiens
atggacagggcca

SEQ ID NO: 345412 - DNA, 18 bp, Homo sapiens
atggacagggccagggtt

SEQ ID NO: 345413 - DNA, 18 bp, Homo sapiens
atggacagttcacaccct

SEQ ID NO: 345414 - DNA, 23 bp, Homo sapiens
atggacagttcacaccctgcaag

SEQ ID NO: 345415 - DNA, 19 bp, Homo sapiens
atggacatgatcttcttta

SEQ ID NO: 345416 - DNA, 23 bp, Homo sapiens
attcaaaatagttctatttctat

SEQ ID NO: 345417 - DNA, 15 bp, Homo sapiens
attcaaacacacagt

SEQ ID NO: 345418 - DNA, 15 bp, Homo sapiens
attcaaacctaagtt

SEQ ID NO: 345419 - DNA, 14 bp, Homo sapiens
attcaaatgcatga

SEQ ID NO: 345420 - DNA, 18 bp, Homo sapiens
attcaaatgcatgatatt

SEQ ID NO: 345421 - DNA, 13 bp, Homo sapiens
attcaacaaatga

SEQ ID NO: 345422 - DNA, 15 bp, Homo sapiens
attcaacacttattt

SEQ ID NO: 345423 - DNA, 19 bp, Homo sapiens
attcaactaatacatggtt

SEQ ID NO: 345424 - DNA, 20 bp, Homo sapiens
attcaactaatacatggttt

SEQ ID NO: 345425 - DNA, 15 bp, Homo sapiens
attcaagaaaataaa

SEQ ID NO: 345426 - DNA, 18 bp, Homo sapiens
attcaagaaaataaaact

SEQ ID NO: 345427 - DNA, 13 bp, Homo sapiens
attcaagaaagat

SEQ ID NO: 345428 - DNA, 13 bp, Homo sapiens
attcaagaaagga

SEQ ID NO: 345429 - DNA, 18 bp, Homo sapiens
attcaaggagaatatgat

SEQ ID NO: 345430 - DNA, 20 bp, Homo sapiens
attcaaggagatataaaatc

SEQ ID NO: 345431 - DNA, 15 bp, Homo sapiens
attcaaggtggccaa

SEQ ID NO: 345432 - DNA, 20 bp, Homo sapiens
attcaagtattaggggtaat

SEQ ID NO: 345433 - DNA, 16 bp, Homo sapiens
attcaagtgtacagtg

SEQ ID NO: 345434 - DNA, 14 bp, Homo sapiens
attcaagttattgt

SEQ ID NO: 345435 - DNA, 12 bp, Homo sapiens
attcaataaagc

SEQ ID NO: 345436 - DNA, 13 bp, Homo sapiens
attcaataaagct

SEQ ID NO: 345437 - DNA, 15 bp, Homo sapiens
attcaatatctgaca

SEQ ID NO: 345438 - DNA, 14 bp, Homo sapiens
attcacaagctgcc

SEQ ID NO: 345439 - DNA, 12 bp, Homo sapiens
attcacacacac

SEQ ID NO: 345440 - DNA, 16 bp, Homo sapiens
attcacacacagcctg

SEQ ID NO: 345441 - DNA, 21 bp, Homo sapiens
attcacacacagcctggcctc

SEQ ID NO: 345442 - DNA, 19 bp, Homo sapiens
attcacacctcacgctctg

SEQ ID NO: 345443 - DNA, 15 bp, Homo sapiens
attcacatatgtctt

SEQ ID NO: 345444 - DNA, 11 bp, Homo sapiens
attcaccccca

SEQ ID NO: 345445 - DNA, 12 bp, Homo sapiens
attcacccccat

SEQ ID NO: 345446 - DNA, 14 bp, Homo sapiens
attcacccccatcc

SEQ ID NO: 345447 - DNA, 23 bp, Homo sapiens
attcacccccatccacagttgtc

SEQ ID NO: 345448 - DNA, 12 bp, Homo sapiens
attcacctgtaa

SEQ ID NO: 345449 - DNA, 19 bp, Homo sapiens
attcacctgtaaaacttta

SEQ ID NO: 345450 - DNA, 16 bp, Homo sapiens
attcactattagagaa

SEQ ID NO: 345451 - DNA, 16 bp, Homo sapiens
attcacttctatttat

SEQ ID NO: 345452 - DNA, 18 bp, Homo sapiens
attcacttgtgtttgtat

SEQ ID NO: 345453 - DNA, 14 bp, Homo sapiens
attcacttttattg

SEQ ID NO: 345454 - DNA, 18 bp, Homo sapiens
attcacttttattgtata

SEQ ID NO: 345455 - DNA, 18 bp, Homo sapiens
attcagaatcaaaccttt

SEQ ID NO: 345456 - DNA, 17 bp, Homo sapiens
attcagaattatacaga

SEQ ID NO: 345457 - DNA, 20 bp, Homo sapiens
attcagagatgtaccatgtt

SEQ ID NO: 345458 - DNA, 21 bp, Homo sapiens
attcagagatgtaccatgtta

SEQ ID NO: 345459 - DNA, 21 bp, Homo sapiens
attcagaggaaaaacagagga

SEQ ID NO: 345460 - DNA, 22 bp, Homo sapiens
attcagagtggtttcattgcct

SEQ ID NO: 345461 - DNA, 17 bp, Homo sapiens
attcagcaccctgggtg

SEQ ID NO: 345462 - DNA, 20 bp, Homo sapiens
attcagcactgatttcacaa

SEQ ID NO: 345463 - DNA, 11 bp, Homo sapiens
attcagctgcc

SEQ ID NO: 345464 - DNA, 13 bp, Homo sapiens
attcagctgcccc

SEQ ID NO: 345465 - DNA, 14 bp, Homo sapiens
attcaggaatgggc

SEQ ID NO: 345466 - DNA, 20 bp, Homo sapiens
attcaggaccccatctgctg

SEQ ID NO: 345467 - DNA, 17 bp, Homo sapiens
attcaggtgttctcttc

SEQ ID NO: 345468 - DNA, 14 bp, Homo sapiens
attcagtcctgtat

SEQ ID NO: 345469 - DNA, 18 bp, Homo sapiens
attcagttaagaaaaaaa

SEQ ID NO: 345470 - DNA, 20 bp, Homo sapiens
attcagttaagaaaaaaata

SEQ ID NO: 345471 - DNA, 21 bp, Homo sapiens
attcagttgttagtgtgtctt

SEQ ID NO: 345472 - DNA, 23 bp, Homo sapiens
attcataaaaataaccaaaaaat

SEQ ID NO: 345473 - DNA, 14 bp, Homo sapiens
attcataacaatgt

SEQ ID NO: 345474 - DNA, 15 bp, Homo sapiens
attcataatgactta

SEQ ID NO: 345475 - DNA, 14 bp, Homo sapiens
attcatacctgttg

SEQ ID NO: 345476 - DNA, 20 bp, Homo sapiens
attcatactctgttgcctcc

SEQ ID NO: 345477 - DNA, 16 bp, Homo sapiens
attcatatcctccgcc

SEQ ID NO: 345478 - DNA, 19 bp, Homo sapiens
attcatatttgcaataaaa

SEQ ID NO: 345479 - DNA, 14 bp, Homo sapiens
attcatcaaataaa

SEQ ID NO: 345480 - DNA, 20 bp, Homo sapiens
attcatcaaataaaccttgt

SEQ ID NO: 345481 - DNA, 17 bp, Homo sapiens
attcatctagttaagtc

SEQ ID NO: 345482 - DNA, 15 bp, Homo sapiens
attcatctgggctgg

SEQ ID NO: 345483 - DNA, 20 bp, Homo sapiens
attcatctgtttttcttttt

SEQ ID NO: 345484 - DNA, 14 bp, Homo sapiens
attcatgctttctc

SEQ ID NO: 345485 - DNA, 16 bp, Homo sapiens
attcatgctttctcct

SEQ ID NO: 345486 - DNA, 15 bp, Homo sapiens
attcatggctttgta

SEQ ID NO: 345487 - DNA, 21 bp, Homo sapiens
attcatgttttaaaagtttgt

SEQ ID NO: 345488 - DNA, 14 bp, Homo sapiens
attcattaaagaaa

SEQ ID NO: 345489 - DNA, 15 bp, Homo sapiens
attcattaaagaaaa

SEQ ID NO: 345490 - DNA, 14 bp, Homo sapiens
attcattaatagga

SEQ ID NO: 345491 - DNA, 10 bp, Homo sapiens
attcatttaa

SEQ ID NO: 345492 - DNA, 18 bp, Homo sapiens
attccaagggcccagagg

SEQ ID NO: 345493 - DNA, 19 bp, Homo sapiens
attccaagtcaacactctt

SEQ ID NO: 345494 - DNA, 18 bp, Homo sapiens
attccaatatgatgactc

SEQ ID NO: 345495 - DNA, 23 bp, Homo sapiens
attccaccaggattaatctctaa

SEQ ID NO: 345496 - DNA, 17 bp, Homo sapiens
attccaccttaaattaa

SEQ ID NO: 345497 - DNA, 22 bp, Homo sapiens
attccaccttaaattaaacaat

SEQ ID NO: 345498 - DNA, 23 bp, Homo sapiens
attccaccttaaattaaacaatt

SEQ ID NO: 345499 - DNA, 16 bp, Homo sapiens
attccagaaaggatat

SEQ ID NO: 345500 - DNA, 12 bp, Homo sapiens
attccagaatat

SEQ ID NO: 345501 - DNA, 23 bp, Homo sapiens
attccagaccaaaataatacaac

SEQ ID NO: 345502 - DNA, 18 bp, Homo sapiens
attccagagagtggctcc

SEQ ID NO: 345503 - DNA, 12 bp, Homo sapiens
attccagagctg

SEQ ID NO: 345504 - DNA, 16 bp, Homo sapiens
attccagtgtattttc

SEQ ID NO: 345505 - DNA, 16 bp, Homo sapiens
attccatcacagccag

SEQ ID NO: 345506 - DNA, 17 bp, Homo sapiens
attccatcacagccagc

SEQ ID NO: 345507 - DNA, 21 bp, Homo sapiens
attccatcacagccagcccag

SEQ ID NO: 345508 - DNA, 14 bp, Homo sapiens
attccatccatata

SEQ ID NO: 345509 - DNA, 21 bp, Homo sapiens
attccatccctaagaattccc

SEQ ID NO: 345510 - DNA, 12 bp, Homo sapiens
attccatctcct

SEQ ID NO: 345511 - DNA, 14 bp, Homo sapiens
attccatgtgccca

SEQ ID NO: 345512 - DNA, 15 bp, Homo sapiens
attccatgtgcccag

SEQ ID NO: 345513 - DNA, 16 bp, Homo sapiens
attccatgtgcccagt

SEQ ID NO: 345514 - DNA, 13 bp, Homo sapiens
attccattttgga

SEQ ID NO: 345515 - DNA, 21 bp, Homo sapiens
attccatttttactaaagcag

SEQ ID NO: 345516 - DNA, 22 bp, Homo sapiens
attcccaagagtggtggcagct

SEQ ID NO: 345517 - DNA, 23 bp, Homo sapiens
attcccaagagtggtggcagctc

SEQ ID NO: 345518 - DNA, 20 bp, Homo sapiens
attcccactaagctttctcc

SEQ ID NO: 345519 - DNA, 12 bp, Homo sapiens
attcccactgca

SEQ ID NO: 345520 - DNA, 14 bp, Homo sapiens
attcccactgcact

SEQ ID NO: 345521 - DNA, 16 bp, Homo sapiens
attcccactgcacttg

SEQ ID NO: 345522 - DNA, 13 bp, Homo sapiens
attcccaggcagg

SEQ ID NO: 345523 - DNA, 14 bp, Homo sapiens
attcccaggcaggg

SEQ ID NO: 345524 - DNA, 22 bp, Homo sapiens
attcccatcactgctgtccctc

SEQ ID NO: 345525 - DNA, 22 bp, Homo sapiens
attcccatggtagactgtgaca

SEQ ID NO: 345526 - DNA, 14 bp, Homo sapiens
attcccattgaaaa

SEQ ID NO: 345527 - DNA, 18 bp, Homo sapiens
attcccattgaaaatgta

SEQ ID NO: 345528 - DNA, 15 bp, Homo sapiens
attcccattttgcaa

SEQ ID NO: 345529 - DNA, 18 bp, Homo sapiens
attcccattttgcaaaat

SEQ ID NO: 345530 - DNA, 20 bp, Homo sapiens
attcccattttgcaaaattt

SEQ ID NO: 345531 - DNA, 20 bp, Homo sapiens
attccccatatttgtgttca

SEQ ID NO: 345532 - DNA, 21 bp, Homo sapiens
attcccctcccacctctcctt

SEQ ID NO: 345533 - DNA, 15 bp, Homo sapiens
attcccgggcccttc

SEQ ID NO: 345534 - DNA, 21 bp, Homo sapiens
attccctatcttttagtttta

SEQ ID NO: 345535 - DNA, 13 bp, Homo sapiens
attccctctcatc

SEQ ID NO: 345536 - DNA, 14 bp, Homo sapiens
attccctctcatcc

SEQ ID NO: 345537 - DNA, 13 bp, Homo sapiens
attccctctcctg

SEQ ID NO: 345538 - DNA, 14 bp, Homo sapiens
attccctcttgcta

SEQ ID NO: 345539 - DNA, 13 bp, Homo sapiens
attccctggagac

SEQ ID NO: 345540 - DNA, 17 bp, Homo sapiens
attccgatcgactgcca

SEQ ID NO: 345541 - DNA, 22 bp, Homo sapiens
attcctacaatatatattctgg

SEQ ID NO: 345542 - DNA, 15 bp, Homo sapiens
attcctacttaaaca

SEQ ID NO: 345543 - DNA, 19 bp, Homo sapiens
attcctacttaaacaaaaa

SEQ ID NO: 345544 - DNA, 19 bp, Homo sapiens
attcctagataaaaagatg

SEQ ID NO: 345545 - DNA, 14 bp, Homo sapiens
attcctaggcctca

SEQ ID NO: 345546 - DNA, 20 bp, Homo sapiens
attcctatgctgcaatacat

SEQ ID NO: 345547 - DNA, 23 bp, Homo sapiens
attcctcacctaccctcaaagta

SEQ ID NO: 345548 - DNA, 17 bp, Homo sapiens
attcctcagctgccaag

SEQ ID NO: 345549 - DNA, 16 bp, Homo sapiens
attcctcatgaatgta

SEQ ID NO: 345550 - DNA, 17 bp, Homo sapiens
attcctcatgaatgtaa

SEQ ID NO: 345551 - DNA, 22 bp, Homo sapiens
attcctcatgaatgtaaatttg

SEQ ID NO: 345552 - DNA, 13 bp, Homo sapiens
attcctcatttgt

SEQ ID NO: 345553 - DNA, 19 bp, Homo sapiens
attcctcatttgttcatta

SEQ ID NO: 345554 - DNA, 13 bp, Homo sapiens
attcctccagcct

SEQ ID NO: 345555 - DNA, 16 bp, Homo sapiens
attcctccagcctccc

SEQ ID NO: 345556 - DNA, 18 bp, Homo sapiens
attcctccagcctcccct

SEQ ID NO: 345557 - DNA, 19 bp, Homo sapiens
attcctccagcctcccctc

SEQ ID NO: 345558 - DNA, 17 bp, Homo sapiens
attcctcccccagagcc

SEQ ID NO: 345559 - DNA, 16 bp, Homo sapiens
attcctccctccggcc

SEQ ID NO: 345560 - DNA, 14 bp, Homo sapiens
attcctctgtcccc

SEQ ID NO: 345561 - DNA, 17 bp, Homo sapiens
attcctcttgcctctct

SEQ ID NO: 345562 - DNA, 17 bp, Homo sapiens
attcctgaatgaaatat

SEQ ID NO: 345563 - DNA, 16 bp, Homo sapiens
attcctgagattctgg

SEQ ID NO: 345564 - DNA, 17 bp, Homo sapiens
attcctgcagcctggag

SEQ ID NO: 345565 - DNA, 19 bp, Homo sapiens
attcctggcatgacactct

SEQ ID NO: 345566 - DNA, 20 bp, Homo sapiens
attcctggcatgacactcta

SEQ ID NO: 345567 - DNA, 13 bp, Homo sapiens
attcctgggcctg

SEQ ID NO: 345568 - DNA, 14 bp, Homo sapiens
attcctgttctctt

SEQ ID NO: 345569 - DNA, 19 bp, Homo sapiens
attccttagcagctcaggc

SEQ ID NO: 345570 - DNA, 22 bp, Homo sapiens
attccttagcagctcaggcgca

SEQ ID NO: 345571 - DNA, 13 bp, Homo sapiens
attccttgataat

SEQ ID NO: 345572 - DNA, 17 bp, Homo sapiens
attccttggcccagcag

SEQ ID NO: 345573 - DNA, 16 bp, Homo sapiens
attcctttaaattctc

SEQ ID NO: 345574 - DNA, 20 bp, Homo sapiens
attcctttacaactaaataa

SEQ ID NO: 345575 - DNA, 22 bp, Homo sapiens
attcctttacaactaaataaca

SEQ ID NO: 345576 - DNA, 15 bp, Homo sapiens
attcctttctcatcc

SEQ ID NO: 345577 - DNA, 15 bp, Homo sapiens
attcctttctttaaa

SEQ ID NO: 345578 - DNA, 21 bp, Homo sapiens
attcgcagtgcccagtgatgg

SEQ ID NO: 345579 - DNA, 19 bp, Homo sapiens
attctaaaacattctttaa

SEQ ID NO: 345580 - DNA, 17 bp, Homo sapiens
attctaaatgaatgttt

SEQ ID NO: 345581 - DNA, 15 bp, Homo sapiens
attctaagattgtac

SEQ ID NO: 345582 - DNA, 17 bp, Homo sapiens
attctaagattgtacat

SEQ ID NO: 345583 - DNA, 23 bp, Homo sapiens
attctaagattgtacatatggaa

SEQ ID NO: 345584 - DNA, 21 bp, Homo sapiens
attctaagccagttttcattt

SEQ ID NO: 345585 - DNA, 22 bp, Homo sapiens
attctaagccagttttcatttt

SEQ ID NO: 345586 - DNA, 13 bp, Homo sapiens
attctaagttatt

SEQ ID NO: 345587 - DNA, 17 bp, Homo sapiens
attctaagttatttact

SEQ ID NO: 345588 - DNA, 18 bp, Homo sapiens
attctaagttatttactt

SEQ ID NO: 345589 - DNA, 18 bp, Homo sapiens
attctaataaatatacta

SEQ ID NO: 345590 - DNA, 12 bp, Homo sapiens
attctaatgtct

SEQ ID NO: 345591 - DNA, 13 bp, Homo sapiens
attctaatgtctt

SEQ ID NO: 345592 - DNA, 18 bp, Homo sapiens
attctaatgtcttcattt

SEQ ID NO: 345593 - DNA, 22 bp, Homo sapiens
attctactcttgtcatttttaa

SEQ ID NO: 345594 - DNA, 14 bp, Homo sapiens
attctacttcagct

SEQ ID NO: 345595 - DNA, 22 bp, Homo sapiens
attctagatcctgcaccccagc

SEQ ID NO: 345596 - DNA, 19 bp, Homo sapiens
attctagcacatcatggca

SEQ ID NO: 345597 - DNA, 18 bp, Homo sapiens
attctagctaatgtaata

SEQ ID NO: 345598 - DNA, 14 bp, Homo sapiens
attctagtcaactg

SEQ ID NO: 345599 - DNA, 21 bp, Homo sapiens
attctagtcaactgctgtttt

SEQ ID NO: 345600 - DNA, 17 bp, Homo sapiens
attctagttttgtcaaa

SEQ ID NO: 345601 - DNA, 16 bp, Homo sapiens
attctatatgaattta

SEQ ID NO: 345602 - DNA, 19 bp, Homo sapiens
attctatatgaatttaaat

SEQ ID NO: 345603 - DNA, 16 bp, Homo sapiens
attctatatttcatat

SEQ ID NO: 345604 - DNA, 16 bp, Homo sapiens
attctatctctcttta

SEQ ID NO: 345605 - DNA, 16 bp, Homo sapiens
attctatgacaataaa

SEQ ID NO: 345606 - DNA, 21 bp, Homo sapiens
attctatgacaataaatttta

SEQ ID NO: 345607 - DNA, 21 bp, Homo sapiens
attctatgcctgtatttccaa

SEQ ID NO: 345608 - DNA, 12 bp, Homo sapiens
attctatttcaa

SEQ ID NO: 345609 - DNA, 19 bp, Homo sapiens
attctcaaagtttcctaat

SEQ ID NO: 345610 - DNA, 12 bp, Homo sapiens
attctcaagtga

SEQ ID NO: 345611 - DNA, 16 bp, Homo sapiens
attctcagatatttat

SEQ ID NO: 345612 - DNA, 17 bp, Homo sapiens
attctcattttgctttt

SEQ ID NO: 345613 - DNA, 18 bp, Homo sapiens
attctccactcactgcat

SEQ ID NO: 345614 - DNA, 13 bp, Homo sapiens
attctcctctccc

SEQ ID NO: 345615 - DNA, 12 bp, Homo sapiens
attctctattgg

SEQ ID NO: 345616 - DNA, 17 bp, Homo sapiens
attctctctaacataac

SEQ ID NO: 345617 - DNA, 17 bp, Homo sapiens
attctctgcgagcaaca

SEQ ID NO: 345618 - DNA, 14 bp, Homo sapiens
attctctgtccagg

SEQ ID NO: 345619 - DNA, 16 bp, Homo sapiens
attctctgtccagggc

SEQ ID NO: 345620 - DNA, 18 bp, Homo sapiens
attctctgtccagggctt

SEQ ID NO: 345621 - DNA, 14 bp, Homo sapiens
attctcttatccaa

SEQ ID NO: 345622 - DNA, 15 bp, Homo sapiens
attctcttcgctgtg

SEQ ID NO: 345623 - DNA, 20 bp, Homo sapiens
attctgaccacccttctcat

SEQ ID NO: 345624 - DNA, 21 bp, Homo sapiens
attctgagcacgggcaaagaa

SEQ ID NO: 345625 - DNA, 18 bp, Homo sapiens
attctgataatgtattgc

SEQ ID NO: 345626 - DNA, 15 bp, Homo sapiens
attctgcagcatgac

SEQ ID NO: 345627 - DNA, 22 bp, Homo sapiens
attctgcagcatgacctgtgac

SEQ ID NO: 345628 - DNA, 18 bp, Homo sapiens
attctgcctgcctgggaa

SEQ ID NO: 345629 - DNA, 13 bp, Homo sapiens
attctgctgcttg

SEQ ID NO: 345630 - DNA, 17 bp, Homo sapiens
attctggatggccgggc

SEQ ID NO: 345631 - DNA, 18 bp, Homo sapiens
attctggctgataaaaga

SEQ ID NO: 345632 - DNA, 18 bp, Homo sapiens
attctgggaaaggtgctc

SEQ ID NO: 345633 - DNA, 19 bp, Homo sapiens
attctgggaaaggtgctca

SEQ ID NO: 345634 - DNA, 23 bp, Homo sapiens
attctgggaaaggtgctcaaaga

SEQ ID NO: 345635 - DNA, 14 bp, Homo sapiens
attctgggaaggga

SEQ ID NO: 345636 - DNA, 16 bp, Homo sapiens
attctggggtggggct

SEQ ID NO: 345637 - DNA, 20 bp, Homo sapiens
attctggggtggggcttgga

SEQ ID NO: 345638 - DNA, 15 bp, Homo sapiens
attctgtccctgtcc

SEQ ID NO: 345639 - DNA, 16 bp, Homo sapiens
attctgtgcataaaag

SEQ ID NO: 345640 - DNA, 20 bp, Homo sapiens
attctgtgcataaaagttaa

SEQ ID NO: 345641 - DNA, 22 bp, Homo sapiens
attctgtgtgttttcataataa

SEQ ID NO: 345642 - DNA, 13 bp, Homo sapiens
attctgttctgat

SEQ ID NO: 345643 - DNA, 14 bp, Homo sapiens
attcttaaatatgt

SEQ ID NO: 345644 - DNA, 13 bp, Homo sapiens
attcttaagcact

SEQ ID NO: 345645 - DNA, 15 bp, Homo sapiens
attcttaagcacttt

SEQ ID NO: 345646 - DNA, 17 bp, Homo sapiens
attcttaagcactttga

SEQ ID NO: 345647 - DNA, 22 bp, Homo sapiens
attcttacaattgcactgctgt

SEQ ID NO: 345648 - DNA, 17 bp, Homo sapiens
attcttacctcatttgc

SEQ ID NO: 345649 - DNA, 18 bp, Homo sapiens
attcttacctcatttgca

SEQ ID NO: 345650 - DNA, 19 bp, Homo sapiens
attcttacctcatttgcat

SEQ ID NO: 345651 - DNA, 17 bp, Homo sapiens
attcttaggctttcagt

SEQ ID NO: 345652 - DNA, 15 bp, Homo sapiens
attcttatttcccct

SEQ ID NO: 345653 - DNA, 23 bp, Homo sapiens
attcttatttcccctttccaatt

SEQ ID NO: 345654 - DNA, 17 bp, Homo sapiens
attcttattttataatt

SEQ ID NO: 345655 - DNA, 20 bp, Homo sapiens
attcttattttataatttta

SEQ ID NO: 345656 - DNA, 22 bp, Homo sapiens
attcttcaggcttcctgcaatt

SEQ ID NO: 345657 - DNA, 15 bp, Homo sapiens
attcttccctggggg

SEQ ID NO: 345658 - DNA, 16 bp, Homo sapiens
attcttgaaagctgtg

SEQ ID NO: 345659 - DNA, 13 bp, Homo sapiens
attcttgaataaa

SEQ ID NO: 345660 - DNA, 12 bp, Homo sapiens
attcttgcactg

SEQ ID NO: 345661 - DNA, 13 bp, Homo sapiens
attcttgcactgt

SEQ ID NO: 345662 - DNA, 20 bp, Homo sapiens
attcttgcactgtatccaag

SEQ ID NO: 345663 - DNA, 19 bp, Homo sapiens
attcttgctgggcatactt

SEQ ID NO: 345664 - DNA, 22 bp, Homo sapiens
attcttgctgggcatactttct

SEQ ID NO: 345665 - DNA, 22 bp, Homo sapiens
attcttggtcaagtttttctct

SEQ ID NO: 345666 - DNA, 18 bp, Homo sapiens
attcttgtcacaataaat

SEQ ID NO: 345667 - DNA, 15 bp, Homo sapiens
attcttgtccacatt

SEQ ID NO: 345668 - DNA, 17 bp, Homo sapiens
attcttgtccacattct

SEQ ID NO: 345669 - DNA, 18 bp, Homo sapiens
attcttgtccacattcta

SEQ ID NO: 345670 - DNA, 14 bp, Homo sapiens
attctttaaactac

SEQ ID NO: 345671 - DNA, 16 bp, Homo sapiens
attctttaaactactg

SEQ ID NO: 345672 - DNA, 17 bp, Homo sapiens
attctttaaactactga

SEQ ID NO: 345673 - DNA, 20 bp, Homo sapiens
attctttaacatacatctaa

SEQ ID NO: 345674 - DNA, 17 bp, Homo sapiens
attctttaattgttgct

SEQ ID NO: 345675 - DNA, 20 bp, Homo sapiens
attctttacaaactgaagat

SEQ ID NO: 345676 - DNA, 23 bp, Homo sapiens
attctttacaaactgaagataat

SEQ ID NO: 345677 - DNA, 17 bp, Homo sapiens
attctttagtctacata

SEQ ID NO: 345678 - DNA, 18 bp, Homo sapiens
attctttcaatccacagt

SEQ ID NO: 345679 - DNA, 17 bp, Homo sapiens
attctttccattatgat

SEQ ID NO: 345680 - DNA, 22 bp, Homo sapiens
attctttccattatgattcttt

SEQ ID NO: 345681 - DNA, 13 bp, Homo sapiens
attctttcttcct

SEQ ID NO: 345682 - DNA, 15 bp, Homo sapiens
attctttcttcctcc

SEQ ID NO: 345683 - DNA, 20 bp, Homo sapiens
attctttcttggtgcattcg

SEQ ID NO: 345684 - DNA, 16 bp, Homo sapiens
attctttgtatcttaa

SEQ ID NO: 345685 - DNA, 14 bp, Homo sapiens
attctttgttgctt

SEQ ID NO: 345686 - DNA, 19 bp, Homo sapiens
attcttttattaatggcat

SEQ ID NO: 345687 - DNA, 18 bp, Homo sapiens
attcttttcagcttgttt

SEQ ID NO: 345688 - DNA, 23 bp, Homo sapiens
attcttttcagcttgtttctata

SEQ ID NO: 345689 - DNA, 20 bp, Homo sapiens
attcttttcccatcaccaga

SEQ ID NO: 345690 - DNA, 23 bp, Homo sapiens
attcttttttcttccccctccat

SEQ ID NO: 345691 - DNA, 16 bp, Homo sapiens
attgaaaaaagagaaa

SEQ ID NO: 345692 - DNA, 19 bp, Homo sapiens
attgaaaaaagagaaaggg

SEQ ID NO: 345693 - DNA, 15 bp, Homo sapiens
attgaaaacttcaaa

SEQ ID NO: 345694 - DNA, 16 bp, Homo sapiens
attgaaaatgtaagta

SEQ ID NO: 345695 - DNA, 19 bp, Homo sapiens
attgaaattgtgaactcat

SEQ ID NO: 345696 - DNA, 23 bp, Homo sapiens
attgaacacaggcaaagaggtgc

SEQ ID NO: 345697 - DNA, 15 bp, Homo sapiens
attgaaccagctcat

SEQ ID NO: 345698 - DNA, 14 bp, Homo sapiens
attgaagtcatcat

SEQ ID NO: 345699 - DNA, 17 bp, Homo sapiens
attgaagtcatcataaa

SEQ ID NO: 345700 - DNA, 19 bp, Homo sapiens
attgaataaagttgaagct

SEQ ID NO: 345701 - DNA, 21 bp, Homo sapiens
attgaataatgttttttgaag

SEQ ID NO: 345702 - DNA, 14 bp, Homo sapiens
attgaatctgattg

SEQ ID NO: 345703 - DNA, 23 bp, Homo sapiens
attgaatctgattggacattttc

SEQ ID NO: 345704 - DNA, 16 bp, Homo sapiens
attgaatgttatatca

SEQ ID NO: 345705 - DNA, 19 bp, Homo sapiens
attgaattattttgttact

SEQ ID NO: 345706 - DNA, 20 bp, Homo sapiens
attgaattattttgttactg

SEQ ID NO: 345707 - DNA, 16 bp, Homo sapiens
attgaatttagtcatt

SEQ ID NO: 345708 - DNA, 16 bp, Homo sapiens
attgacaactgaagag

SEQ ID NO: 345709 - DNA, 15 bp, Homo sapiens
attgacaagtcattt

SEQ ID NO: 345710 - DNA, 18 bp, Homo sapiens
attgacaggattattgga

SEQ ID NO: 345711 - DNA, 17 bp, Homo sapiens
attgaccatgtgattat

SEQ ID NO: 345712 - DNA, 13 bp, Homo sapiens
attgacctcagct

SEQ ID NO: 345713 - DNA, 16 bp, Homo sapiens
attgacctcagctgca

SEQ ID NO: 345714 - DNA, 23 bp, Homo sapiens
attgacctcagctgcacattcct

SEQ ID NO: 345715 - DNA, 20 bp, Homo sapiens
attgaccttctccctcactc

SEQ ID NO: 345716 - DNA, 17 bp, Homo sapiens
attgactatttatacaa

SEQ ID NO: 345717 - DNA, 21 bp, Homo sapiens
attgactatttatacaaatgg

SEQ ID NO: 345718 - DNA, 22 bp, Homo sapiens
attgactattttcgttcattac

SEQ ID NO: 345719 - DNA, 16 bp, Homo sapiens
attgagacaaaaatta

SEQ ID NO: 345720 - DNA, 23 bp, Homo sapiens
attgaggtgtatggagagaaaac

SEQ ID NO: 345721 - DNA, 13 bp, Homo sapiens
attgagtgtacat

SEQ ID NO: 345722 - DNA, 12 bp, Homo sapiens
attgataataaa

SEQ ID NO: 345723 - DNA, 13 bp, Homo sapiens
attgataataaac

SEQ ID NO: 345724 - DNA, 18 bp, Homo sapiens
attgatagagtgttatca

SEQ ID NO: 345725 - DNA, 18 bp, Homo sapiens
attgatcattttcccccc

SEQ ID NO: 345726 - DNA, 19 bp, Homo sapiens
attgatcattttcccccca

SEQ ID NO: 345727 - DNA, 17 bp, Homo sapiens
attgatctaaggcatgc

SEQ ID NO: 345728 - DNA, 14 bp, Homo sapiens
attgatgggtgggc

SEQ ID NO: 345729 - DNA, 13 bp, Homo sapiens
attgatgtgaaat

SEQ ID NO: 345730 - DNA, 20 bp, Homo sapiens
attgatgtgaaattaaattc

SEQ ID NO: 345731 - DNA, 18 bp, Homo sapiens
attgattaagtatatcta

SEQ ID NO: 345732 - DNA, 18 bp, Homo sapiens
attgattgaaaaaagaga

SEQ ID NO: 345733 - DNA, 19 bp, Homo sapiens
attgattttccccctaatt

SEQ ID NO: 345734 - DNA, 19 bp, Homo sapiens
attgcaaaaggttaagcca

SEQ ID NO: 345735 - DNA, 21 bp, Homo sapiens
attgcaaagaaaattctcaag

SEQ ID NO: 345736 - DNA, 16 bp, Homo sapiens
attgcaaggaaggaaa

SEQ ID NO: 345737 - DNA, 13 bp, Homo sapiens
attgcaagggaag

SEQ ID NO: 345738 - DNA, 14 bp, Homo sapiens
attgcacaaataca

SEQ ID NO: 345739 - DNA, 15 bp, Homo sapiens
attgcacaaatacaa

SEQ ID NO: 345740 - DNA, 23 bp, Homo sapiens
attgcacgtggcctcttgagcag

SEQ ID NO: 345741 - DNA, 19 bp, Homo sapiens
attgcactttataaacact

SEQ ID NO: 345742 - DNA, 20 bp, Homo sapiens
attgcactttataaacactg

SEQ ID NO: 345743 - DNA, 12 bp, Homo sapiens
atttatgtagat

SEQ ID NO: 345744 - DNA, 22 bp, Homo sapiens
atttatgtgcaaggtgatagga

SEQ ID NO: 345745 - DNA, 15 bp, Homo sapiens
atttatgtgtgaagc

SEQ ID NO: 345746 - DNA, 18 bp, Homo sapiens
atttatgttgtatagatt

SEQ ID NO: 345747 - DNA, 19 bp, Homo sapiens
atttattaaacttcagcaa

SEQ ID NO: 345748 - DNA, 15 bp, Homo sapiens
atttattaagatgga

SEQ ID NO: 345749 - DNA, 21 bp, Homo sapiens
atttattaagatggattctca

SEQ ID NO: 345750 - DNA, 14 bp, Homo sapiens
atttattagctgta

SEQ ID NO: 345751 - DNA, 16 bp, Homo sapiens
atttattagttaatat

SEQ ID NO: 345752 - DNA, 14 bp, Homo sapiens
atttattattttca

SEQ ID NO: 345753 - DNA, 18 bp, Homo sapiens
atttattcagcttcattt

SEQ ID NO: 345754 - DNA, 14 bp, Homo sapiens
atttattctaatta

SEQ ID NO: 345755 - DNA, 14 bp, Homo sapiens
atttattgaagatg

SEQ ID NO: 345756 - DNA, 13 bp, Homo sapiens
atttattgtatat

SEQ ID NO: 345757 - DNA, 20 bp, Homo sapiens
atttattgtatatatggata

SEQ ID NO: 345758 - DNA, 21 bp, Homo sapiens
atttattgtttatttatcagt

SEQ ID NO: 345759 - DNA, 22 bp, Homo sapiens
atttattgtttatttatcagtg

SEQ ID NO: 345760 - DNA, 15 bp, Homo sapiens
atttatttatgtgca

SEQ ID NO: 345761 - DNA, 16 bp, Homo sapiens
atttatttattaagat

SEQ ID NO: 345762 - DNA, 17 bp, Homo sapiens
atttatttattaagatg

SEQ ID NO: 345763 - DNA, 14 bp, Homo sapiens
atttatttccagag

SEQ ID NO: 345764 - DNA, 12 bp, Homo sapiens
atttatttctag

SEQ ID NO: 345765 - DNA, 13 bp, Homo sapiens
atttatttggagt

SEQ ID NO: 345766 - DNA, 14 bp, Homo sapiens
atttattttaagca

SEQ ID NO: 345767 - DNA, 22 bp, Homo sapiens
atttattttgtatttttgaata

SEQ ID NO: 345768 - DNA, 23 bp, Homo sapiens
atttattttgtatttttgaataa

SEQ ID NO: 345769 - DNA, 14 bp, Homo sapiens
atttattttttaca

SEQ ID NO: 345770 - DNA, 14 bp, Homo sapiens
atttcaaaaatata

SEQ ID NO: 345771 - DNA, 17 bp, Homo sapiens
atttcaaaaatataact

SEQ ID NO: 345772 - DNA, 16 bp, Homo sapiens
atttcaaaatgcatgt

SEQ ID NO: 345773 - DNA, 14 bp, Homo sapiens
atttcaacataatt

SEQ ID NO: 345774 - DNA, 16 bp, Homo sapiens
atttcaagatccaaat

SEQ ID NO: 345775 - DNA, 18 bp, Homo sapiens
atttcaatgattgtttaa

SEQ ID NO: 345776 - DNA, 23 bp, Homo sapiens
atttcaatgattgtttaattgta

SEQ ID NO: 345777 - DNA, 15 bp, Homo sapiens
atttcacaacagatc

SEQ ID NO: 345778 - DNA, 23 bp, Homo sapiens
atttcacctgtgacaaaggatga

SEQ ID NO: 345779 - DNA, 17 bp, Homo sapiens
atttcactagagacaaa

SEQ ID NO: 345780 - DNA, 22 bp, Homo sapiens
atttcactagagacaaatcttt

SEQ ID NO: 345781 - DNA, 22 bp, Homo sapiens
atttcactatttttatttatat

SEQ ID NO: 345782 - DNA, 21 bp, Homo sapiens
atttcacttaaactttgtcac

SEQ ID NO: 345783 - DNA, 17 bp, Homo sapiens
atttcagcacatgcact

SEQ ID NO: 345784 - DNA, 11 bp, Homo sapiens
atttcataaat

SEQ ID NO: 345785 - DNA, 15 bp, Homo sapiens
atttcataaattggc

SEQ ID NO: 345786 - DNA, 18 bp, Homo sapiens
atttcataaattggctcc

SEQ ID NO: 345787 - DNA, 20 bp, Homo sapiens
atttcataaattggctcctt

SEQ ID NO: 345788 - DNA, 20 bp, Homo sapiens
atttcataaggcctgccctc

SEQ ID NO: 345789 - DNA, 21 bp, Homo sapiens
atttcataaggcctgccctcc

SEQ ID NO: 345790 - DNA, 16 bp, Homo sapiens
atttcatatgctgtat

SEQ ID NO: 345791 - DNA, 17 bp, Homo sapiens
atttcatgattagacaa

SEQ ID NO: 345792 - DNA, 14 bp, Homo sapiens
atttcatgtaacca

SEQ ID NO: 345793 - DNA, 14 bp, Homo sapiens
atttcatgtgatct

SEQ ID NO: 345794 - DNA, 19 bp, Homo sapiens
atttcattgagggaaaaca

SEQ ID NO: 345795 - DNA, 12 bp, Homo sapiens
atttcattgtat

SEQ ID NO: 345796 - DNA, 19 bp, Homo sapiens
atttcattgtatgatgtgt

SEQ ID NO: 345797 - DNA, 18 bp, Homo sapiens
atttccaaataaaatgag

SEQ ID NO: 345798 - DNA, 19 bp, Homo sapiens
atttccaacaccacagaca

SEQ ID NO: 345799 - DNA, 20 bp, Homo sapiens
atttccaacaccacagacac

SEQ ID NO: 345800 - DNA, 16 bp, Homo sapiens
atttccaactcaggtt

SEQ ID NO: 345801 - DNA, 20 bp, Homo sapiens
atttccagagtccggaggca

SEQ ID NO: 345802 - DNA, 13 bp, Homo sapiens
atttccagcaaaa

SEQ ID NO: 345803 - DNA, 14 bp, Homo sapiens
atttccaggcccct

SEQ ID NO: 345804 - DNA, 19 bp, Homo sapiens
atttccaggcccctgagga

SEQ ID NO: 345805 - DNA, 19 bp, Homo sapiens
atttccagggcagcagccg

SEQ ID NO: 345806 - DNA, 17 bp, Homo sapiens
atttccagtctccacca

SEQ ID NO: 345807 - DNA, 13 bp, Homo sapiens
atttccatttctg

SEQ ID NO: 345808 - DNA, 16 bp, Homo sapiens
atttcccaaagcagtg

SEQ ID NO: 345809 - DNA, 17 bp, Homo sapiens
atttcccaattaggaag

SEQ ID NO: 345810 - DNA, 13 bp, Homo sapiens
atttcccacaccc

SEQ ID NO: 345811 - DNA, 16 bp, Homo sapiens
atttcccctgtggttt

SEQ ID NO: 345812 - DNA, 22 bp, Homo sapiens
atttccgaagaccttctgaaga

SEQ ID NO: 345813 - DNA, 14 bp, Homo sapiens
atttcctcttcctt

SEQ ID NO: 345814 - DNA, 18 bp, Homo sapiens
atttcctttggagctttt

SEQ ID NO: 345815 - DNA, 15 bp, Homo sapiens
atttcgatgtacagt

SEQ ID NO: 345816 - DNA, 13 bp, Homo sapiens
atttctaaatttg

SEQ ID NO: 345817 - DNA, 17 bp, Homo sapiens
atttctaaatttgcagg

SEQ ID NO: 345818 - DNA, 18 bp, Homo sapiens
atttctaactaaggacag

SEQ ID NO: 345819 - DNA, 19 bp, Homo sapiens
atttctaagcttatttcta

SEQ ID NO: 345820 - DNA, 20 bp, Homo sapiens
atttctaagcttatttctaa

SEQ ID NO: 345821 - DNA, 18 bp, Homo sapiens
atttctaatttgaatgaa

SEQ ID NO: 345822 - DNA, 13 bp, Homo sapiens
atttctactgaag

SEQ ID NO: 345823 - DNA, 15 bp, Homo sapiens
atttctactgaagtt

SEQ ID NO: 345824 - DNA, 14 bp, Homo sapiens
atttctatatttat

SEQ ID NO: 345825 - DNA, 16 bp, Homo sapiens
atttctatctgcaaat

SEQ ID NO: 345826 - DNA, 21 bp, Homo sapiens
atttctatgtaaattattgta

SEQ ID NO: 345827 - DNA, 22 bp, Homo sapiens
atttctatgtaaattattgtaa

SEQ ID NO: 345828 - DNA, 12 bp, Homo sapiens
atttctatttat

SEQ ID NO: 345829 - DNA, 16 bp, Homo sapiens
atttctatttatttac

SEQ ID NO: 345830 - DNA, 17 bp, Homo sapiens
atttctatttatttact

SEQ ID NO: 345831 - DNA, 14 bp, Homo sapiens
atttctcaaagttt

SEQ ID NO: 345832 - DNA, 23 bp, Homo sapiens
atttctcaaagtttttacagtgt

SEQ ID NO: 345833 - DNA, 21 bp, Homo sapiens
atttctcacaatagacagaaa

SEQ ID NO: 345834 - DNA, 22 bp, Homo sapiens
atttctcatcaattctctatca

SEQ ID NO: 345835 - DNA, 22 bp, Homo sapiens
atttctcatgtgctttgtagct

SEQ ID NO: 345836 - DNA, 17 bp, Homo sapiens
atttctccatcccctcc

SEQ ID NO: 345837 - DNA, 20 bp, Homo sapiens
atttctccatcccctccctg

SEQ ID NO: 345838 - DNA, 23 bp, Homo sapiens
atttctccatcccctccctgcct

SEQ ID NO: 345839 - DNA, 19 bp, Homo sapiens
atttctctcaatttgggtc

SEQ ID NO: 345840 - DNA, 14 bp, Homo sapiens
atttctctccccac

SEQ ID NO: 345841 - DNA, 23 bp, Homo sapiens
atttctgagagtgaaaccatgac

SEQ ID NO: 345842 - DNA, 13 bp, Homo sapiens
atttctgccagcg

SEQ ID NO: 345843 - DNA, 17 bp, Homo sapiens
atttctggccatttaac

SEQ ID NO: 345844 - DNA, 10 bp, Homo sapiens
atttctgtag

SEQ ID NO: 345845 - DNA, 13 bp, Homo sapiens
atttctgtagaat

SEQ ID NO: 345846 - DNA, 21 bp, Homo sapiens
atttctgtctcataattgtca

SEQ ID NO: 345847 - DNA, 18 bp, Homo sapiens
atttctgtggaaaacaat

SEQ ID NO: 345848 - DNA, 18 bp, Homo sapiens
atttctgtgtcctgtttt

SEQ ID NO: 345849 - DNA, 12 bp, Homo sapiens
atttcttcccaa

SEQ ID NO: 345850 - DNA, 15 bp, Homo sapiens
atttcttgagtaatt

SEQ ID NO: 345851 - DNA, 19 bp, Homo sapiens
atttcttgagtaatttaaa

SEQ ID NO: 345852 - DNA, 21 bp, Homo sapiens
atttcttgctctatctctcaa

SEQ ID NO: 345853 - DNA, 13 bp, Homo sapiens
atttcttgtttgt

SEQ ID NO: 345854 - DNA, 15 bp, Homo sapiens
caagtcaatcatttc

SEQ ID NO: 345855 - DNA, 12 bp, Homo sapiens
caagtcacagct

SEQ ID NO: 345856 - DNA, 19 bp, Homo sapiens
caagtcacagctgcagctg

SEQ ID NO: 345857 - DNA, 15 bp, Homo sapiens
caagtcactaaattt

SEQ ID NO: 345858 - DNA, 19 bp, Homo sapiens
caagtcactaaatttctca

SEQ ID NO: 345859 - DNA, 19 bp, Homo sapiens
caagtcagctttgccttcc

SEQ ID NO: 345860 - DNA, 20 bp, Homo sapiens
caagtcagctttgccttcca

SEQ ID NO: 345861 - DNA, 17 bp, Homo sapiens
caagtcattttaacttt

SEQ ID NO: 345862 - DNA, 16 bp, Homo sapiens
caagtccacctgccta

SEQ ID NO: 345863 - DNA, 18 bp, Homo sapiens
cacacgccggggctggcc

SEQ ID NO: 345864 - DNA, 21 bp, Homo sapiens
cacacgccggggctggccctg

SEQ ID NO: 345865 - DNA, 14 bp, Homo sapiens
cacacgctgcccag

SEQ ID NO: 345866 - DNA, 20 bp, Homo sapiens
cacacgctgcccaggctctg

SEQ ID NO: 345867 - DNA, 20 bp, Homo sapiens
cacacggactcccgggccac

SEQ ID NO: 345868 - DNA, 23 bp, Homo sapiens
cacacggactcccgggccacgcc

SEQ ID NO: 345869 - DNA, 20 bp, Homo sapiens
cacacggggcacccagccca

SEQ ID NO: 345870 - DNA, 24 bp, Homo sapiens
cacacgtctgaccctctccacccc

SEQ ID NO: 345871 - DNA, 20 bp, Homo sapiens
cacacgtgtgatgtatgttg

SEQ ID NO: 345872 - DNA, 21 bp, Homo sapiens
cacactacagagcagctcccc

SEQ ID NO: 345873 - DNA, 17 bp, Homo sapiens
cacactattaccatgag

SEQ ID NO: 345874 - DNA, 18 bp, Homo sapiens
cacactattaccatgaga

SEQ ID NO: 345875 - DNA, 12 bp, Homo sapiens
cacactcagcag

SEQ ID NO: 345876 - DNA, 20 bp, Homo sapiens
cacactcagtcccccaccac

SEQ ID NO: 345877 - DNA, 17 bp, Homo sapiens
cacactgaccacactgt

SEQ ID NO: 345878 - DNA, 14 bp, Homo sapiens
cacactgcaacagg

SEQ ID NO: 345879 - DNA, 17 bp, Homo sapiens
cacactgtaaacccctg

SEQ ID NO: 345880 - DNA, 17 bp, Homo sapiens
cacactgtggaacacta

SEQ ID NO: 345881 - DNA, 17 bp, Homo sapiens
cacacttcaggctcttc

SEQ ID NO: 345882 - DNA, 22 bp, Homo sapiens
cacacttcaggctcttctcctt

SEQ ID NO: 345883 - DNA, 14 bp, Homo sapiens
cacacttcctgtcc

SEQ ID NO: 345884 - DNA, 16 bp, Homo sapiens
cacacttcctgtccag

SEQ ID NO: 345885 - DNA, 19 bp, Homo sapiens
cacacttcctgtccagaga

SEQ ID NO: 345886 - DNA, 14 bp, Homo sapiens
cacacttgctgggg

SEQ ID NO: 345887 - DNA, 19 bp, Homo sapiens
cacacttgtgtgtgggctg

SEQ ID NO: 345888 - DNA, 16 bp, Homo sapiens
cacacttgttccagct

SEQ ID NO: 345889 - DNA, 13 bp, Homo sapiens
cacactttctgac

SEQ ID NO: 345890 - DNA, 21 bp, Homo sapiens
cacacttttgcacatatattt

SEQ ID NO: 345891 - DNA, 16 bp, Homo sapiens
cacagaaagggcagct

SEQ ID NO: 345892 - DNA, 17 bp, Homo sapiens
cacagaaagggcagctt

SEQ ID NO: 345893 - DNA, 17 bp, Homo sapiens
cacagaaatcagaggag

SEQ ID NO: 345894 - DNA, 14 bp, Homo sapiens
cacagaagacacgt

SEQ ID NO: 345895 - DNA, 12 bp, Homo sapiens
cacagacacaca

SEQ ID NO: 345896 - DNA, 17 bp, Homo sapiens
cacagacacacacacgc

SEQ ID NO: 345897 - DNA, 22 bp, Homo sapiens
cacagacacacacacgcacgca

SEQ ID NO: 345898 - DNA, 23 bp, Homo sapiens
cacagaccggccgcatgtctgca

SEQ ID NO: 345899 - DNA, 17 bp, Homo sapiens
cacagacgccacctggc

SEQ ID NO: 345900 - DNA, 20 bp, Homo sapiens
cacagactggagacaatgca

SEQ ID NO: 345901 - DNA, 21 bp, Homo sapiens
cacagactgttccctccaagg

SEQ ID NO: 345902 - DNA, 17 bp, Homo sapiens
cacagacttctggaagg

SEQ ID NO: 345903 - DNA, 10 bp, Homo sapiens
cacagagacc

SEQ ID NO: 345904 - DNA, 18 bp, Homo sapiens
cacagagagacagacttg

SEQ ID NO: 345905 - DNA, 20 bp, Homo sapiens
cacagagccaaattggtaga

SEQ ID NO: 345906 - DNA, 16 bp, Homo sapiens
cacagaggacagtgct

SEQ ID NO: 345907 - DNA, 12 bp, Homo sapiens
cacagaggcagt

SEQ ID NO: 345908 - DNA, 18 bp, Homo sapiens
cacagaggcagtggcagc

SEQ ID NO: 345909 - DNA, 19 bp, Homo sapiens
cacagaggcagtggcagca

SEQ ID NO: 345910 - DNA, 15 bp, Homo sapiens
cacagaggccaggca

SEQ ID NO: 345911 - DNA, 16 bp, Homo sapiens
cacagagtctgtgtgt

SEQ ID NO: 345912 - DNA, 17 bp, Homo sapiens
cacagatcagttttcct

SEQ ID NO: 345913 - DNA, 18 bp, Homo sapiens
cacagatctggaggacgt

SEQ ID NO: 345914 - DNA, 15 bp, Homo sapiens
cacagatgccatggc

SEQ ID NO: 345915 - DNA, 19 bp, Homo sapiens
cacagatggatttgcctgt

SEQ ID NO: 345916 - DNA, 18 bp, Homo sapiens
cacagatgtgcccagagt

SEQ ID NO: 345917 - DNA, 23 bp, Homo sapiens
cacagatgtgcccagagtagccc

SEQ ID NO: 345918 - DNA, 21 bp, Homo sapiens
cacagattaaacttcacctac

SEQ ID NO: 345919 - DNA, 22 bp, Homo sapiens
cacagcaagccggccccccctc

SEQ ID NO: 345920 - DNA, 17 bp, Homo sapiens
cacagcaattttgtatc

SEQ ID NO: 345921 - DNA, 20 bp, Homo sapiens
cacagcacatgctggccagc

SEQ ID NO: 345922 - DNA, 16 bp, Homo sapiens
cacagcacctcctctc

SEQ ID NO: 345923 - DNA, 21 bp, Homo sapiens
cacagcacctcctctctgctg

SEQ ID NO: 345924 - DNA, 18 bp, Homo sapiens
cacagcagcatcttcaaa

SEQ ID NO: 345925 - DNA, 18 bp, Homo sapiens
cacagcagcctctgaagt

SEQ ID NO: 345926 - DNA, 12 bp, Homo sapiens
cacagcagcctg

SEQ ID NO: 345927 - DNA, 14 bp, Homo sapiens
cacagcagcctgct

SEQ ID NO: 345928 - DNA, 19 bp, Homo sapiens
cacagcagcctgcttccca

SEQ ID NO: 345929 - DNA, 13 bp, Homo sapiens
cacagcagcttca

SEQ ID NO: 345930 - DNA, 18 bp, Homo sapiens
cacagcagcttcaccaga

SEQ ID NO: 345931 - DNA, 21 bp, Homo sapiens
cacagcagcttcaccagagca

SEQ ID NO: 345932 - DNA, 17 bp, Homo sapiens
cacagcagtatgaatga

SEQ ID NO: 345933 - DNA, 15 bp, Homo sapiens
cacagcatgtgccaa

SEQ ID NO: 345934 - DNA, 16 bp, Homo sapiens
cacagcatgtgccaag

SEQ ID NO: 345935 - DNA, 13 bp, Homo sapiens
cacagcatgtgta

SEQ ID NO: 345936 - DNA, 15 bp, Homo sapiens
cacagccaccacctg

SEQ ID NO: 345937 - DNA, 16 bp, Homo sapiens
cacagccaccacctgg

SEQ ID NO: 345938 - DNA, 17 bp, Homo sapiens
cacagccaccacctgga

SEQ ID NO: 345939 - DNA, 19 bp, Homo sapiens
cacagccaccacctggatg

SEQ ID NO: 345940 - DNA, 16 bp, Homo sapiens
cacagccacctccacc

SEQ ID NO: 345941 - DNA, 16 bp, Homo sapiens
cacagccagaaccccg

SEQ ID NO: 345942 - DNA, 13 bp, Homo sapiens
cacagccagccca

SEQ ID NO: 345943 - DNA, 15 bp, Homo sapiens
cacagccagcccagc

SEQ ID NO: 345944 - DNA, 17 bp, Homo sapiens
cacagcccaaccaggag

SEQ ID NO: 345945 - DNA, 23 bp, Homo sapiens
cacagcccaaccaggaggggtct

SEQ ID NO: 345946 - DNA, 12 bp, Homo sapiens
cacagcccagcc

SEQ ID NO: 345947 - DNA, 17 bp, Homo sapiens
cacagcccgcatgcagc

SEQ ID NO: 345948 - DNA, 18 bp, Homo sapiens
cacagcccgcatgcagca

SEQ ID NO: 345949 - DNA, 10 bp, Homo sapiens
cacagccctg

SEQ ID NO: 345950 - DNA, 11 bp, Homo sapiens
cacagccctgg

SEQ ID NO: 345951 - DNA, 14 bp, Homo sapiens
cacagccctgggag

SEQ ID NO: 345952 - DNA, 12 bp, Homo sapiens
cacagccctgtc

SEQ ID NO: 345953 - DNA, 14 bp, Homo sapiens
cacagccctgtcag

SEQ ID NO: 345954 - DNA, 18 bp, Homo sapiens
cacagccggggcctgcct

SEQ ID NO: 345955 - DNA, 15 bp, Homo sapiens
cacagcctaggacca

SEQ ID NO: 345956 - DNA, 23 bp, Homo sapiens
cacagcctaggaccagttttgta

SEQ ID NO: 345957 - DNA, 19 bp, Homo sapiens
cacagcctcacccctgcag

SEQ ID NO: 345958 - DNA, 13 bp, Homo sapiens
cacagcctccagg

SEQ ID NO: 345959 - DNA, 15 bp, Homo sapiens
cacagcctccagggc

SEQ ID NO: 345960 - DNA, 14 bp, Homo sapiens
cacagcctctccct

SEQ ID NO: 345961 - DNA, 12 bp, Homo sapiens
cacagcctggcc

SEQ ID NO: 345962 - DNA, 19 bp, Homo sapiens
cacagcctggcctcccctg

SEQ ID NO: 345963 - DNA, 20 bp, Homo sapiens
cacagcctggcctcccctgc

SEQ ID NO: 345964 - DNA, 22 bp, Homo sapiens
cacagcctggcctcccctgcgg

SEQ ID NO: 345965 - DNA, 14 bp, Homo sapiens
cacagcctgtcttc

SEQ ID NO: 345966 - DNA, 14 bp, Homo sapiens
cacagcctttctgt

SEQ ID NO: 345967 - DNA, 23 bp, Homo sapiens
cacagcgacgctcccctgagagg

SEQ ID NO: 345968 - DNA, 16 bp, Homo sapiens
cacagctaacatggaa

SEQ ID NO: 345969 - DNA, 16 bp, Homo sapiens
cacagctcaggaacta

SEQ ID NO: 345970 - DNA, 14 bp, Homo sapiens
cacagctctcactg

SEQ ID NO: 345971 - DNA, 13 bp, Homo sapiens
cacagctcttgtt

SEQ ID NO: 345972 - DNA, 19 bp, Homo sapiens
cacagctgcagagacagag

SEQ ID NO: 345973 - DNA, 19 bp, Homo sapiens
cacagctgcagctgggccc

SEQ ID NO: 345974 - DNA, 15 bp, Homo sapiens
cacagctgctggcca

SEQ ID NO: 345975 - DNA, 18 bp, Homo sapiens
cacagctgctggccaggg

SEQ ID NO: 345976 - DNA, 16 bp, Homo sapiens
cacagctgctgtgcca

SEQ ID NO: 345977 - DNA, 12 bp, Homo sapiens
cacagctgggca

SEQ ID NO: 345978 - DNA, 13 bp, Homo sapiens
cacagctgggcaa

SEQ ID NO: 345979 - DNA, 18 bp, Homo sapiens
cacagctgtgaggacaga

SEQ ID NO: 345980 - DNA, 12 bp, Homo sapiens
cacagctgtggt

SEQ ID NO: 345981 - DNA, 12 bp, Homo sapiens
cacagcttgggg

SEQ ID NO: 345982 - DNA, 18 bp, Homo sapiens
cacagcttggggccatcg

SEQ ID NO: 345983 - DNA, 20 bp, Homo sapiens
cacagcttgttttggacttt

SEQ ID NO: 345984 - DNA, 19 bp, Homo sapiens
cacaggacacagtcagatt

SEQ ID NO: 345985 - DNA, 19 bp, Homo sapiens
cacaggaggcaagcaagct

SEQ ID NO: 345986 - DNA, 18 bp, Homo sapiens
cacaggcaaagaggtgct

SEQ ID NO: 345987 - DNA, 19 bp, Homo sapiens
cacaggcaaagaggtgctg

SEQ ID NO: 345988 - DNA, 14 bp, Homo sapiens
cacaggcaacatta

SEQ ID NO: 345989 - DNA, 21 bp, Homo sapiens
cacaggcagctggatgagact

SEQ ID NO: 345990 - DNA, 15 bp, Homo sapiens
cacaggcaggggtag

SEQ ID NO: 345991 - DNA, 13 bp, Homo sapiens
cacaggcagtgca

SEQ ID NO: 345992 - DNA, 20 bp, Homo sapiens
cacaggccacacgctgccca

SEQ ID NO: 345993 - DNA, 19 bp, Homo sapiens
cacaggccacttgctcaga

SEQ ID NO: 345994 - DNA, 13 bp, Homo sapiens
cacaggccagatg

SEQ ID NO: 345995 - DNA, 20 bp, Homo sapiens
cacaggccaggggatctggg

SEQ ID NO: 345996 - DNA, 15 bp, Homo sapiens
cacaggcccttcctc

SEQ ID NO: 345997 - DNA, 17 bp, Homo sapiens
cacaggcctggcccagc

SEQ ID NO: 345998 - DNA, 14 bp, Homo sapiens
cacatagtttcttt

SEQ ID NO: 345999 - DNA, 23 bp, Homo sapiens
cacatatacatctagcacagctg

SEQ ID NO: 346000 - DNA, 21 bp, Homo sapiens
cacatatcaagtcccgaggca

SEQ ID NO: 346001 - DNA, 21 bp, Homo sapiens
cacatatgtcttactacttta

SEQ ID NO: 346002 - DNA, 14 bp, Homo sapiens
cacatcacaccact

SEQ ID NO: 346003 - DNA, 10 bp, Homo sapiens
cacatcagat

SEQ ID NO: 346004 - DNA, 13 bp, Homo sapiens
cacatcattggaa

SEQ ID NO: 346005 - DNA, 13 bp, Homo sapiens
cacatccaaacat

SEQ ID NO: 346006 - DNA, 22 bp, Homo sapiens
cacatccaccccggctccccct

SEQ ID NO: 346007 - DNA, 13 bp, Homo sapiens
cacatcccactgg

SEQ ID NO: 346008 - DNA, 14 bp, Homo sapiens
cacatcccagcagc

SEQ ID NO: 346009 - DNA, 17 bp, Homo sapiens
cacatcccagcagccca

SEQ ID NO: 346010 - DNA, 23 bp, Homo sapiens
cacatccccaccctcccctctcc

SEQ ID NO: 346011 - DNA, 13 bp, Homo sapiens
cacatccccacct

SEQ ID NO: 346012 - DNA, 14 bp, Homo sapiens
cacatccccacctt

SEQ ID NO: 346013 - DNA, 15 bp, Homo sapiens
cacatcccggcctct

SEQ ID NO: 346014 - DNA, 19 bp, Homo sapiens
cacatctcttagtccctct

SEQ ID NO: 346015 - DNA, 21 bp, Homo sapiens
cacatctgcattttcacccca

SEQ ID NO: 346016 - DNA, 13 bp, Homo sapiens
cacatcttgtctt

SEQ ID NO: 346017 - DNA, 21 bp, Homo sapiens
cacatgacatttgtcctgcag

SEQ ID NO: 346018 - DNA, 15 bp, Homo sapiens
cacatgagtcccagt

SEQ ID NO: 346019 - DNA, 18 bp, Homo sapiens
cacatgagtcccagtggg

SEQ ID NO: 346020 - DNA, 14 bp, Homo sapiens
cacatgctggacag

SEQ ID NO: 346021 - DNA, 19 bp, Homo sapiens
cacatgctggacaggtctg

SEQ ID NO: 346022 - DNA, 23 bp, Homo sapiens
cacatgctggacaggtctgggag

SEQ ID NO: 346023 - DNA, 19 bp, Homo sapiens
cacatgctggccagcctgg

SEQ ID NO: 346024 - DNA, 20 bp, Homo sapiens
cacatgctgttggcctcaag

SEQ ID NO: 346025 - DNA, 11 bp, Homo sapiens
cacatggcaga

SEQ ID NO: 346026 - DNA, 20 bp, Homo sapiens
cacatggggcctggcccacg

SEQ ID NO: 346027 - DNA, 22 bp, Homo sapiens
cacatggtccatttcatgtgat

SEQ ID NO: 346028 - DNA, 12 bp, Homo sapiens
cacatgtccagt

SEQ ID NO: 346029 - DNA, 19 bp, Homo sapiens
cacatgtggcaaaatatgg

SEQ ID NO: 346030 - DNA, 20 bp, Homo sapiens
cacattagagggacagccaa

SEQ ID NO: 346031 - DNA, 21 bp, Homo sapiens
cacattaggaacagagtatat

SEQ ID NO: 346032 - DNA, 17 bp, Homo sapiens
cacattccctctcatcc

SEQ ID NO: 346033 - DNA, 12 bp, Homo sapiens
cacattctactt

SEQ ID NO: 346034 - DNA, 17 bp, Homo sapiens
cacattctacttcagct

SEQ ID NO: 346035 - DNA, 16 bp, Homo sapiens
cacattctgctgcccc

SEQ ID NO: 346036 - DNA, 17 bp, Homo sapiens
cacattgcccacacctg

SEQ ID NO: 346037 - DNA, 22 bp, Homo sapiens
cacattgcccacacctgcctct

SEQ ID NO: 346038 - DNA, 23 bp, Homo sapiens
cacattgtgaatattagattgct

SEQ ID NO: 346039 - DNA, 21 bp, Homo sapiens
cacatttccagggcagcagcc

SEQ ID NO: 346040 - DNA, 18 bp, Homo sapiens
cacatttccccagacctg

SEQ ID NO: 346041 - DNA, 12 bp, Homo sapiens
cacatttcctct

SEQ ID NO: 346042 - DNA, 14 bp, Homo sapiens
cacatttcctctct

SEQ ID NO: 346043 - DNA, 17 bp, Homo sapiens
cacatttgattctgtgt

SEQ ID NO: 346044 - DNA, 14 bp, Homo sapiens
cacattttgacaca

SEQ ID NO: 346045 - DNA, 23 bp, Homo sapiens
cacattttgctttataatttcta

SEQ ID NO: 346046 - DNA, 21 bp, Homo sapiens
caccaaactgcacacacagct

SEQ ID NO: 346047 - DNA, 14 bp, Homo sapiens
caccaaagatgcag

SEQ ID NO: 346048 - DNA, 19 bp, Homo sapiens
caccaaatctgtctagaat

SEQ ID NO: 346049 - DNA, 15 bp, Homo sapiens
caccaaattgctgag

SEQ ID NO: 346050 - DNA, 23 bp, Homo sapiens
caccaaattgctgagatgtttag

SEQ ID NO: 346051 - DNA, 19 bp, Homo sapiens
caccaactctgcactccat

SEQ ID NO: 346052 - DNA, 13 bp, Homo sapiens
caccaagaaacca

SEQ ID NO: 346053 - DNA, 18 bp, Homo sapiens
caccaagaaggggctcga

SEQ ID NO: 346054 - DNA, 14 bp, Homo sapiens
caccaagcccacag

SEQ ID NO: 346055 - DNA, 19 bp, Homo sapiens
caccaagtacagccttcac

SEQ ID NO: 346056 - DNA, 12 bp, Homo sapiens
caccaataaaaa

SEQ ID NO: 346057 - DNA, 13 bp, Homo sapiens
caccaataaaaat

SEQ ID NO: 346058 - DNA, 18 bp, Homo sapiens
caccaataacttcagaga

SEQ ID NO: 346059 - DNA, 14 bp, Homo sapiens
caccaatacaaatt

SEQ ID NO: 346060 - DNA, 19 bp, Homo sapiens
caccacaactaacaatgcc

SEQ ID NO: 346061 - DNA, 15 bp, Homo sapiens
caccacacacaccct

SEQ ID NO: 346062 - DNA, 20 bp, Homo sapiens
caccacacacacccttcccc

SEQ ID NO: 346063 - DNA, 17 bp, Homo sapiens
caccacagaagcttgta

SEQ ID NO: 346064 - DNA, 13 bp, Homo sapiens
caccacagacaca

SEQ ID NO: 346065 - DNA, 14 bp, Homo sapiens
caccacagacacac

SEQ ID NO: 346066 - DNA, 16 bp, Homo sapiens
caccacagacacacac

SEQ ID NO: 346067 - DNA, 20 bp, Homo sapiens
caccacagacacacacacgc

SEQ ID NO: 346068 - DNA, 18 bp, Homo sapiens
caccacatcctccgtcca

SEQ ID NO: 346069 - DNA, 15 bp, Homo sapiens
caccacatcttgtct

SEQ ID NO: 346070 - DNA, 15 bp, Homo sapiens
caccaccactgtccc

SEQ ID NO: 346071 - DNA, 16 bp, Homo sapiens
caccaccactgtccct

SEQ ID NO: 346072 - DNA, 21 bp, Homo sapiens
caccaccagatgagaagttaa

SEQ ID NO: 346073 - DNA, 18 bp, Homo sapiens
caccacccctccctctgc

SEQ ID NO: 346074 - DNA, 23 bp, Homo sapiens
caccacccgctttcttgctggtt

SEQ ID NO: 346075 - DNA, 22 bp, Homo sapiens
caccaccggggcactggctgct

SEQ ID NO: 346076 - DNA, 17 bp, Homo sapiens
caccacctcactcctgt

SEQ ID NO: 346077 - DNA, 14 bp, Homo sapiens
caccacctctttgg

SEQ ID NO: 346078 - DNA, 14 bp, Homo sapiens
caccacgtctgcca

SEQ ID NO: 346079 - DNA, 18 bp, Homo sapiens
caccacgtctgccaggcc

SEQ ID NO: 346080 - DNA, 16 bp, Homo sapiens
caccactaaccatccc

SEQ ID NO: 346081 - DNA, 20 bp, Homo sapiens
caccactaaccatccccaac

SEQ ID NO: 346082 - DNA, 22 bp, Homo sapiens
caccactaaccatccccaactc

SEQ ID NO: 346083 - DNA, 21 bp, Homo sapiens
caccactaggaatcccagagg

SEQ ID NO: 346084 - DNA, 13 bp, Homo sapiens
caccactagggtc

SEQ ID NO: 346085 - DNA, 21 bp, Homo sapiens
caccactagggtcctggccct

SEQ ID NO: 346086 - DNA, 14 bp, Homo sapiens
caccactgccctgc

SEQ ID NO: 346087 - DNA, 20 bp, Homo sapiens
caccactgccctgcctgccc

SEQ ID NO: 346088 - DNA, 16 bp, Homo sapiens
caccagaagtgccatg

SEQ ID NO: 346089 - DNA, 20 bp, Homo sapiens
caccatagaagaacagcaga

SEQ ID NO: 346090 - DNA, 21 bp, Homo sapiens
caccatagaagaacagcagat

SEQ ID NO: 346091 - DNA, 14 bp, Homo sapiens
caccatagtcaatc

SEQ ID NO: 346092 - DNA, 16 bp, Homo sapiens
caccatcacagcttgt

SEQ ID NO: 346093 - DNA, 22 bp, Homo sapiens
caccatctcaggccacctgccc

SEQ ID NO: 346094 - DNA, 21 bp, Homo sapiens
caccatctgtaccctgcttcc

SEQ ID NO: 346095 - DNA, 16 bp, Homo sapiens
caccatggccagccaa

SEQ ID NO: 346096 - DNA, 20 bp, Homo sapiens
caccatggctaaggcaccag

SEQ ID NO: 346097 - DNA, 22 bp, Homo sapiens
caccatggctaaggcaccagcc

SEQ ID NO: 346098 - DNA, 23 bp, Homo sapiens
caccatgggaaactgttgtgggc

SEQ ID NO: 346099 - DNA, 15 bp, Homo sapiens
caccatgtaaaacaa

SEQ ID NO: 346100 - DNA, 21 bp, Homo sapiens
caccatgtaaaacaaaaaaca

SEQ ID NO: 346101 - DNA, 15 bp, Homo sapiens
caccatgtgccatct

SEQ ID NO: 346102 - DNA, 14 bp, Homo sapiens
caccattccacatc

SEQ ID NO: 346103 - DNA, 21 bp, Homo sapiens
caccattccacatccccacct

SEQ ID NO: 346104 - DNA, 21 bp, Homo sapiens
caccattgtgaagcacctact

SEQ ID NO: 346105 - DNA, 23 bp, Homo sapiens
caccatttaatcatttccagcaa

SEQ ID NO: 346106 - DNA, 16 bp, Homo sapiens
caccatttcatccata

SEQ ID NO: 346107 - DNA, 17 bp, Homo sapiens
caccatttcccctgtgg

SEQ ID NO: 346108 - DNA, 16 bp, Homo sapiens
cacccaaaccccttcc

SEQ ID NO: 346109 - DNA, 21 bp, Homo sapiens
cacccaaaccccttcccacga

SEQ ID NO: 346110 - DNA, 15 bp, Homo sapiens
cacccaagcttggca

SEQ ID NO: 346111 - DNA, 17 bp, Homo sapiens
cacccacacactcgccc

SEQ ID NO: 346112 - DNA, 13 bp, Homo sapiens
cacccacaccccg

SEQ ID NO: 346113 - DNA, 15 bp, Homo sapiens
cacccaccaaatgcc

SEQ ID NO: 346114 - DNA, 15 bp, Homo sapiens
cacccaccagggctc

SEQ ID NO: 346115 - DNA, 11 bp, Homo sapiens
cacccacccct

SEQ ID NO: 346116 - DNA, 12 bp, Homo sapiens
cacccacccctg

SEQ ID NO: 346117 - DNA, 13 bp, Homo sapiens
cacccacccctgc

SEQ ID NO: 346118 - DNA, 14 bp, Homo sapiens
cacccacctcagcc

SEQ ID NO: 346119 - DNA, 12 bp, Homo sapiens
cacccacctcca

SEQ ID NO: 346120 - DNA, 22 bp, Homo sapiens
cacccacctccacccagcccct

SEQ ID NO: 346121 - DNA, 22 bp, Homo sapiens
cacccactagccctctttctct

SEQ ID NO: 346122 - DNA, 13 bp, Homo sapiens
cacccactcacca

SEQ ID NO: 346123 - DNA, 20 bp, Homo sapiens
cacccactgtggggcaagcc

SEQ ID NO: 346124 - DNA, 17 bp, Homo sapiens
cacccacttagtccact

SEQ ID NO: 346125 - DNA, 22 bp, Homo sapiens
cacccacttagtccactctgag

SEQ ID NO: 346126 - DNA, 13 bp, Homo sapiens
cacccagaaggaa

SEQ ID NO: 346127 - DNA, 22 bp, Homo sapiens
cacccagacctgaatgcttctg

SEQ ID NO: 346128 - DNA, 21 bp, Homo sapiens
cacccagcaaggcacaggctc

SEQ ID NO: 346129 - DNA, 18 bp, Homo sapiens
cacccagcatcaccagct

SEQ ID NO: 346130 - DNA, 15 bp, Homo sapiens
cacccagcccctggc

SEQ ID NO: 346131 - DNA, 14 bp, Homo sapiens
cacccagctccagg

SEQ ID NO: 346132 - DNA, 20 bp, Homo sapiens
cacccaggcaggccctgcct

SEQ ID NO: 346133 - DNA, 12 bp, Homo sapiens
cacccagggccc

SEQ ID NO: 346134 - DNA, 16 bp, Homo sapiens
cacccagggcccggca

SEQ ID NO: 346135 - DNA, 15 bp, Homo sapiens
cacccagggctccct

SEQ ID NO: 346136 - DNA, 22 bp, Homo sapiens
cacccagggctccctcctggag

SEQ ID NO: 346137 - DNA, 24 bp, Homo sapiens
cacccagggctccctcctggagca

SEQ ID NO: 346138 - DNA, 15 bp, Homo sapiens
cacccagtgctgcca

SEQ ID NO: 346139 - DNA, 16 bp, Homo sapiens
cacccagtgctgccat

SEQ ID NO: 346140 - DNA, 18 bp, Homo sapiens
cacccagtgctgccatgc

SEQ ID NO: 346141 - DNA, 21 bp, Homo sapiens
cacccagtgctgccatgccac

SEQ ID NO: 346142 - DNA, 23 bp, Homo sapiens
cacccagtgctgccatgccactg

SEQ ID NO: 346143 - DNA, 18 bp, Homo sapiens
cacccatcttcctgctgc

SEQ ID NO: 346144 - DNA, 22 bp, Homo sapiens
cacccatcttcctgctgctgta

SEQ ID NO: 346145 - DNA, 16 bp, Homo sapiens
cacccatgactgcccc

SEQ ID NO: 346146 - DNA, 21 bp, Homo sapiens
cacccatgactgccccttgct

SEQ ID NO: 346147 - DNA, 22 bp, Homo sapiens
cacccattcccccatgtggctg

SEQ ID NO: 346148 - DNA, 19 bp, Homo sapiens
caccccaaagctttcctgc

SEQ ID NO: 346149 - DNA, 15 bp, Homo sapiens
caccccaactctccc

SEQ ID NO: 346150 - DNA, 19 bp, Homo sapiens
caccccaactctccccagt

SEQ ID NO: 346151 - DNA, 22 bp, Homo sapiens
caccccaactctccccagtgcc

SEQ ID NO: 346152 - DNA, 15 bp, Homo sapiens
caccccacaccccag

SEQ ID NO: 346153 - DNA, 23 bp, Homo sapiens
caccccagcattccagctctgcc

SEQ ID NO: 346154 - DNA, 11 bp, Homo sapiens
caccccagccc

SEQ ID NO: 346155 - DNA, 12 bp, Homo sapiens
caccccagccca

SEQ ID NO: 346156 - DNA, 13 bp, Homo sapiens
caccccagctgct

SEQ ID NO: 346157 - DNA, 16 bp, Homo sapiens
caccccagctgctccc

SEQ ID NO: 346158 - DNA, 20 bp, Homo sapiens
caccccagtgcacccactct

SEQ ID NO: 346159 - DNA, 22 bp, Homo sapiens
caccccatagtgaccggctgct

SEQ ID NO: 346160 - DNA, 17 bp, Homo sapiens
caccccatgccaaagct

SEQ ID NO: 346161 - DNA, 14 bp, Homo sapiens
cacccccaacttca

SEQ ID NO: 346162 - DNA, 22 bp, Homo sapiens
cacccccaattaaacccagaac

SEQ ID NO: 346163 - DNA, 16 bp, Homo sapiens
cacccccacccctgta

SEQ ID NO: 346164 - DNA, 11 bp, Homo sapiens
cacccccagcc

SEQ ID NO: 346165 - DNA, 13 bp, Homo sapiens
cacccccagcctc

SEQ ID NO: 346166 - DNA, 16 bp, Homo sapiens
cacccccagcctcccc

SEQ ID NO: 346167 - DNA, 13 bp, Homo sapiens
cacccccatccac

SEQ ID NO: 346168 - DNA, 21 bp, Homo sapiens
caccccccgccggcaggggcc

SEQ ID NO: 346169 - DNA, 12 bp, Homo sapiens
cacccccctcat

SEQ ID NO: 346170 - DNA, 15 bp, Homo sapiens
cacccccgggtgcct

SEQ ID NO: 346171 - DNA, 16 bp, Homo sapiens
caccccctccctggcc

SEQ ID NO: 346172 - DNA, 23 bp, Homo sapiens
caccccctccctggcctgttctg

SEQ ID NO: 346173 - DNA, 14 bp, Homo sapiens
caccccgctctggc

SEQ ID NO: 346174 - DNA, 16 bp, Homo sapiens
caccccgctgcctggc

SEQ ID NO: 346175 - DNA, 15 bp, Homo sapiens
caccccggcaggccc

SEQ ID NO: 346176 - DNA, 16 bp, Homo sapiens
caccccggcaggccct

SEQ ID NO: 346177 - DNA, 19 bp, Homo sapiens
caccccggcaggccctgca

SEQ ID NO: 346178 - DNA, 14 bp, Homo sapiens
caccccggcctcca

SEQ ID NO: 346179 - DNA, 21 bp, Homo sapiens
caccccggctccccctgccag

SEQ ID NO: 346180 - DNA, 19 bp, Homo sapiens
caccccgtcccggccccgc

SEQ ID NO: 346181 - DNA, 15 bp, Homo sapiens
caccccgtgccaccc

SEQ ID NO: 346182 - DNA, 15 bp, Homo sapiens
cacccctaagtgccc

SEQ ID NO: 346183 - DNA, 16 bp, Homo sapiens
cacccctacagcctgc

SEQ ID NO: 346184 - DNA, 20 bp, Homo sapiens
cacccctacagcctgcacac

SEQ ID NO: 346185 - DNA, 21 bp, Homo sapiens
cacccctacagcctgcacaca

SEQ ID NO: 346186 - DNA, 22 bp, Homo sapiens
cacccctcagcgctccctgtcg

SEQ ID NO: 346187 - DNA, 19 bp, Homo sapiens
cacccgcctcccgcctccc

SEQ ID NO: 346188 - DNA, 14 bp, Homo sapiens
cacccgctgcccag

SEQ ID NO: 346189 - DNA, 22 bp, Homo sapiens
cacccgctgcccagccctccca

SEQ ID NO: 346190 - DNA, 16 bp, Homo sapiens
cacccggatctccagg

SEQ ID NO: 346191 - DNA, 19 bp, Homo sapiens
cacccggatctccaggccc

SEQ ID NO: 346192 - DNA, 23 bp, Homo sapiens
cacccggatctccaggcccagcc

SEQ ID NO: 346193 - DNA, 17 bp, Homo sapiens
cacccggccacagctgc

SEQ ID NO: 346194 - DNA, 16 bp, Homo sapiens
cacccgtaggcagcct

SEQ ID NO: 346195 - DNA, 22 bp, Homo sapiens
cacccgtcttcaatctctgttc

SEQ ID NO: 346196 - DNA, 20 bp, Homo sapiens
cacccgtcttggggctcgcc

SEQ ID NO: 346197 - DNA, 17 bp, Homo sapiens
cacccgtggagatggga

SEQ ID NO: 346198 - DNA, 16 bp, Homo sapiens
cacccgttaatttaaa

SEQ ID NO: 346199 - DNA, 20 bp, Homo sapiens
cacccgttctgctggcctgg

SEQ ID NO: 346200 - DNA, 16 bp, Homo sapiens
cacccgtttccaagcc

SEQ ID NO: 346201 - DNA, 22 bp, Homo sapiens
cacccgtttccaagcctgggcc

SEQ ID NO: 346202 - DNA, 15 bp, Homo sapiens
caccctaactcttgc

SEQ ID NO: 346203 - DNA, 18 bp, Homo sapiens
caccctaactcttgctca

SEQ ID NO: 346204 - DNA, 19 bp, Homo sapiens
caccctaatttgcccttca

SEQ ID NO: 346205 - DNA, 16 bp, Homo sapiens
caccctacctgttcag

SEQ ID NO: 346206 - DNA, 16 bp, Homo sapiens
caccctagtcccttcc

SEQ ID NO: 346207 - DNA, 18 bp, Homo sapiens
caccctcaaaccctgtgg

SEQ ID NO: 346208 - DNA, 20 bp, Homo sapiens
caccctcacacacacagctg

SEQ ID NO: 346209 - DNA, 22 bp, Homo sapiens
caccctcactctgccagggcag

SEQ ID NO: 346210 - DNA, 19 bp, Homo sapiens
caccctcatttctgccagc

SEQ ID NO: 346211 - DNA, 21 bp, Homo sapiens
caccctccatgctcctcacct

SEQ ID NO: 346212 - DNA, 13 bp, Homo sapiens
caccctcccctct

SEQ ID NO: 346213 - DNA, 13 bp, Homo sapiens
caccctctgcagg

SEQ ID NO: 346214 - DNA, 15 bp, Homo sapiens
caccctctgcagggc

SEQ ID NO: 346215 - DNA, 19 bp, Homo sapiens
caccctctgcagggcagcc

SEQ ID NO: 346216 - DNA, 13 bp, Homo sapiens
caccctctggtcc

SEQ ID NO: 346217 - DNA, 18 bp, Homo sapiens
caccctgaatggttccat

SEQ ID NO: 346218 - DNA, 11 bp, Homo sapiens
caccctgaggg

SEQ ID NO: 346219 - DNA, 14 bp, Homo sapiens
caccctgcaaggcc

SEQ ID NO: 346220 - DNA, 23 bp, Homo sapiens
caccctgcaaggcccacaggagg

SEQ ID NO: 346221 - DNA, 13 bp, Homo sapiens
caccctgcagagc

SEQ ID NO: 346222 - DNA, 14 bp, Homo sapiens
caccctgcagagct

SEQ ID NO: 346223 - DNA, 19 bp, Homo sapiens
caccctgcagagctatggt

SEQ ID NO: 346224 - DNA, 16 bp, Homo sapiens
caccctgctcctcctg

SEQ ID NO: 346225 - DNA, 21 bp, Homo sapiens
caccctgctcctcctgccctg

SEQ ID NO: 346226 - DNA, 20 bp, Homo sapiens
caccctgcttggggcctggc

SEQ ID NO: 346227 - DNA, 12 bp, Homo sapiens
caccctggcccg

SEQ ID NO: 346228 - DNA, 20 bp, Homo sapiens
caccctgggatgggccaccc

SEQ ID NO: 346229 - DNA, 13 bp, Homo sapiens
caccctgggcctc

SEQ ID NO: 346230 - DNA, 14 bp, Homo sapiens
caccctggggcctg

SEQ ID NO: 346231 - DNA, 17 bp, Homo sapiens
caccctgtatggagcta

SEQ ID NO: 346232 - DNA, 22 bp, Homo sapiens
caccctgtgaccctctcacttt

SEQ ID NO: 346233 - DNA, 22 bp, Homo sapiens
cacccttcacgctggcttccag

SEQ ID NO: 346234 - DNA, 12 bp, Homo sapiens
cacccttctggg

SEQ ID NO: 346235 - DNA, 18 bp, Homo sapiens
cacccttggcctgtctca

SEQ ID NO: 346236 - DNA, 20 bp, Homo sapiens
cacccttggtagagtttatt

SEQ ID NO: 346237 - DNA, 19 bp, Homo sapiens
caccctttcttgacaaaac

SEQ ID NO: 346238 - DNA, 20 bp, Homo sapiens
caccctttgctgtgaggctg

SEQ ID NO: 346239 - DNA, 15 bp, Homo sapiens
caccgaatgaccagg

SEQ ID NO: 346240 - DNA, 13 bp, Homo sapiens
caccgagaatgtt

SEQ ID NO: 346241 - DNA, 22 bp, Homo sapiens
caccgagaggaaaaaggcttct

SEQ ID NO: 346242 - DNA, 14 bp, Homo sapiens
caccgaggccagcg

SEQ ID NO: 346243 - DNA, 14 bp, Homo sapiens
caccgcagcatgtg

SEQ ID NO: 346244 - DNA, 17 bp, Homo sapiens
caccgcatatgcatgcc

SEQ ID NO: 346245 - DNA, 20 bp, Homo sapiens
caccgcatatgcatgccagg

SEQ ID NO: 346246 - DNA, 13 bp, Homo sapiens
caccgccatgcaa

SEQ ID NO: 346247 - DNA, 22 bp, Homo sapiens
caccgccatgcaactccatgcc

SEQ ID NO: 346248 - DNA, 14 bp, Homo sapiens
caccgcccacccac

SEQ ID NO: 346249 - DNA, 20 bp, Homo sapiens
caccgccctcctcgctgtgc

SEQ ID NO: 346250 - DNA, 21 bp, Homo sapiens
caccgctccccagcccagggt

SEQ ID NO: 346251 - DNA, 18 bp, Homo sapiens
caccgcttctgccttttc

SEQ ID NO: 346252 - DNA, 16 bp, Homo sapiens
caccggggcaagaggg

SEQ ID NO: 346253 - DNA, 17 bp, Homo sapiens
caccggttgcttctggg

SEQ ID NO: 346254 - DNA, 21 bp, Homo sapiens
caccggttgcttctgggaagg

SEQ ID NO: 346255 - DNA, 19 bp, Homo sapiens
caccgtagtaacacataaa

SEQ ID NO: 346256 - DNA, 23 bp, Homo sapiens
caccgtagtaacacataaagtaa

SEQ ID NO: 346257 - DNA, 17 bp, Homo sapiens
caccgtggtgtgaggcc

SEQ ID NO: 346258 - DNA, 21 bp, Homo sapiens
caccgtggtgtgaggcccccg

SEQ ID NO: 346259 - DNA, 19 bp, Homo sapiens
cacctaagggctaaggcct

SEQ ID NO: 346260 - DNA, 14 bp, Homo sapiens
cacctaccatgctg

SEQ ID NO: 346261 - DNA, 17 bp, Homo sapiens
cacctaccatgctgctt

SEQ ID NO: 346262 - DNA, 12 bp, Homo sapiens
cacctactgagt

SEQ ID NO: 346263 - DNA, 16 bp, Homo sapiens
cacctacttcctcctc

SEQ ID NO: 346264 - DNA, 19 bp, Homo sapiens
cacctacttgtgactgaag

SEQ ID NO: 346265 - DNA, 14 bp, Homo sapiens
cacctcacaactcc

SEQ ID NO: 346266 - DNA, 14 bp, Homo sapiens
cacctcacgctctg

SEQ ID NO: 346267 - DNA, 21 bp, Homo sapiens
cacctcactcatactgtcata

SEQ ID NO: 346268 - DNA, 12 bp, Homo sapiens
cacctcagagcc

SEQ ID NO: 346269 - DNA, 15 bp, Homo sapiens
cacctcagagccccg

SEQ ID NO: 346270 - DNA, 13 bp, Homo sapiens
cacctcagcctcc

SEQ ID NO: 346271 - DNA, 11 bp, Homo sapiens
cacctcaggac

SEQ ID NO: 346272 - DNA, 17 bp, Homo sapiens
cacctcaggaccccaga

SEQ ID NO: 346273 - DNA, 11 bp, Homo sapiens
cacctcagttc

SEQ ID NO: 346274 - DNA, 20 bp, Homo sapiens
cacctcagttcccttggcct

SEQ ID NO: 346275 - DNA, 21 bp, Homo sapiens
cacctcatggactccaggatc

SEQ ID NO: 346276 - DNA, 12 bp, Homo sapiens
cacctccaccca

SEQ ID NO: 346277 - DNA, 13 bp, Homo sapiens
cacctccacccag

SEQ ID NO: 346278 - DNA, 19 bp, Homo sapiens
cacctccacccccaagaaa

SEQ ID NO: 346279 - DNA, 21 bp, Homo sapiens
cacctccacccccaagaaacc

SEQ ID NO: 346280 - DNA, 19 bp, Homo sapiens
cacctccacccccgccacg

SEQ ID NO: 346281 - DNA, 12 bp, Homo sapiens
cacctccagccc

SEQ ID NO: 346282 - DNA, 13 bp, Homo sapiens
cacctccagccca

SEQ ID NO: 346283 - DNA, 14 bp, Homo sapiens
cacctccccaggcc

SEQ ID NO: 346284 - DNA, 16 bp, Homo sapiens
cacctcccccaaaccc

SEQ ID NO: 346285 - DNA, 23 bp, Homo sapiens
cacctcccctccttgcctcctgt

SEQ ID NO: 346286 - DNA, 23 bp, Homo sapiens
cacctcccggtgtatgcagtggt

SEQ ID NO: 346287 - DNA, 16 bp, Homo sapiens
cacctccctcccggca

SEQ ID NO: 346288 - DNA, 16 bp, Homo sapiens
cacctccctgcccagg

SEQ ID NO: 346289 - DNA, 12 bp, Homo sapiens
cacctccgtggt

SEQ ID NO: 346290 - DNA, 13 bp, Homo sapiens
cacctcctaccct

SEQ ID NO: 346291 - DNA, 22 bp, Homo sapiens
cacctcctagaggtgggcagct

SEQ ID NO: 346292 - DNA, 11 bp, Homo sapiens
cacctcctcca

SEQ ID NO: 346293 - DNA, 13 bp, Homo sapiens
cacctcctccaag

SEQ ID NO: 346294 - DNA, 17 bp, Homo sapiens
cacctcctccactcact

SEQ ID NO: 346295 - DNA, 20 bp, Homo sapiens
cacctcctccactcactcca

SEQ ID NO: 346296 - DNA, 22 bp, Homo sapiens
cacctctgctgcccacggccac

SEQ ID NO: 346297 - DNA, 13 bp, Homo sapiens
cacctctggactg

SEQ ID NO: 346298 - DNA, 13 bp, Homo sapiens
cacctctggccaa

SEQ ID NO: 346299 - DNA, 13 bp, Homo sapiens
cacctctggccct

SEQ ID NO: 346300 - DNA, 20 bp, Homo sapiens
cacctctgggccaggttgga

SEQ ID NO: 346301 - DNA, 20 bp, Homo sapiens
cacctctgggccctgcagga

SEQ ID NO: 346302 - DNA, 17 bp, Homo sapiens
cacctcttgtgctgagt

SEQ ID NO: 346303 - DNA, 12 bp, Homo sapiens
cacctcttttcc

SEQ ID NO: 346304 - DNA, 19 bp, Homo sapiens
cacctgacaatggcagcta

SEQ ID NO: 346305 - DNA, 20 bp, Homo sapiens
cacctgacaatggcagctag

SEQ ID NO: 346306 - DNA, 21 bp, Homo sapiens
cacctgacaatggcagctaga

SEQ ID NO: 346307 - DNA, 13 bp, Homo sapiens
cacctgacacatc

SEQ ID NO: 346308 - DNA, 22 bp, Homo sapiens
cacctgacctctgaagagctga

SEQ ID NO: 346309 - DNA, 21 bp, Homo sapiens
cacctgagcccggatgcttct

SEQ ID NO: 346310 - DNA, 16 bp, Homo sapiens
cacctgagctttggac

SEQ ID NO: 346311 - DNA, 13 bp, Homo sapiens
cacctgcaagccc

SEQ ID NO: 346312 - DNA, 14 bp, Homo sapiens
cacctgcaagcccc

SEQ ID NO: 346313 - DNA, 16 bp, Homo sapiens
cacctgcaagccccag

SEQ ID NO: 346314 - DNA, 20 bp, Homo sapiens
cacctgcaagccccagggcc

SEQ ID NO: 346315 - DNA, 21 bp, Homo sapiens
cacctgcaagccccagggcct

SEQ ID NO: 346316 - DNA, 14 bp, Homo sapiens
cacctgcatcagcc

SEQ ID NO: 346317 - DNA, 20 bp, Homo sapiens
cacctgcatcagcctctggc

SEQ ID NO: 346318 - DNA, 11 bp, Homo sapiens
cacctgcccag

SEQ ID NO: 346319 - DNA, 22 bp, Homo sapiens
cacctgcccatcacagggttgg

SEQ ID NO: 346320 - DNA, 19 bp, Homo sapiens
cacctgcccccttctccca

SEQ ID NO: 346321 - DNA, 21 bp, Homo sapiens
cacctgcccccttctcccaca

SEQ ID NO: 346322 - DNA, 12 bp, Homo sapiens
cacctgccctgc

SEQ ID NO: 346323 - DNA, 16 bp, Homo sapiens
cacctgccctgccctg

SEQ ID NO: 346324 - DNA, 20 bp, Homo sapiens
cacctgcctctgaactgctg

SEQ ID NO: 346325 - DNA, 21 bp, Homo sapiens
cacctgcctctgaactgctgc

SEQ ID NO: 346326 - DNA, 11 bp, Homo sapiens
cacctgcctga

SEQ ID NO: 346327 - DNA, 17 bp, Homo sapiens
cacctgcctgccccaca

SEQ ID NO: 346328 - DNA, 20 bp, Homo sapiens
cacctgctggcccctcacct

SEQ ID NO: 346329 - DNA, 21 bp, Homo sapiens
cacctgctggttgttgccagg

SEQ ID NO: 346330 - DNA, 22 bp, Homo sapiens
cacctgctggttgttgccaggt

SEQ ID NO: 346331 - DNA, 23 bp, Homo sapiens
cacctgctggttgttgccaggtt

SEQ ID NO: 346332 - DNA, 21 bp, Homo sapiens
cacctggatggatctgctcca

SEQ ID NO: 346333 - DNA, 23 bp, Homo sapiens
cacctggatggatctgctccatg

SEQ ID NO: 346334 - DNA, 19 bp, Homo sapiens
cacctggcacaccagaagt

SEQ ID NO: 346335 - DNA, 22 bp, Homo sapiens
cacctggccgggtcaccctgtg

SEQ ID NO: 346336 - DNA, 23 bp, Homo sapiens
cacctggccgggtcaccctgtga

SEQ ID NO: 346337 - DNA, 13 bp, Homo sapiens
cacctggcctgct

SEQ ID NO: 346338 - DNA, 15 bp, Homo sapiens
cacctggcctgctgg

SEQ ID NO: 346339 - DNA, 16 bp, Homo sapiens
cacctggcctgctggg

SEQ ID NO: 346340 - DNA, 17 bp, Homo sapiens
cacctggcctgctggga

SEQ ID NO: 346341 - DNA, 19 bp, Homo sapiens
cacctggcctgctgggaac

SEQ ID NO: 346342 - DNA, 17 bp, Homo sapiens
cacctggcttcccagga

SEQ ID NO: 346343 - DNA, 22 bp, Homo sapiens
cacctggcttcccaggaccctg

SEQ ID NO: 346344 - DNA, 23 bp, Homo sapiens
cacctggcttcccaggaccctgg

SEQ ID NO: 346345 - DNA, 18 bp, Homo sapiens
cacctgggagatgctggg

SEQ ID NO: 346346 - DNA, 19 bp, Homo sapiens
cacctgggagatgctggga

SEQ ID NO: 346347 - DNA, 11 bp, Homo sapiens
cacctgggcac

SEQ ID NO: 346348 - DNA, 19 bp, Homo sapiens
cacctgggcacctggggag

SEQ ID NO: 346349 - DNA, 21 bp, Homo sapiens
cacctgggcccgggcaggcca

SEQ ID NO: 346350 - DNA, 16 bp, Homo sapiens
cacctgggccctaggc

SEQ ID NO: 346351 - DNA, 12 bp, Homo sapiens
cacctgggcctt

SEQ ID NO: 346352 - DNA, 11 bp, Homo sapiens
cacctgggctg

SEQ ID NO: 346353 - DNA, 14 bp, Homo sapiens
cacctgggctggga

SEQ ID NO: 346354 - DNA, 14 bp, Homo sapiens
cacctggggagtgg

SEQ ID NO: 346355 - DNA, 14 bp, Homo sapiens
cacctggggcagtc

SEQ ID NO: 346356 - DNA, 19 bp, Homo sapiens
cacctggggcagtcacctg

SEQ ID NO: 346357 - DNA, 15 bp, Homo sapiens
cacctggtggcctct

SEQ ID NO: 346358 - DNA, 16 bp, Homo sapiens
cacctggttccggaat

SEQ ID NO: 346359 - DNA, 20 bp, Homo sapiens
cacctggttccggaatcctg

SEQ ID NO: 346360 - DNA, 15 bp, Homo sapiens
cacctgtaaaacttt

SEQ ID NO: 346361 - DNA, 17 bp, Homo sapiens
cacctgtaaaactttat

SEQ ID NO: 346362 - DNA, 23 bp, Homo sapiens
cacctgtaaaactttattttata

SEQ ID NO: 346363 - DNA, 14 bp, Homo sapiens
cacctgtaagaaac

SEQ ID NO: 346364 - DNA, 12 bp, Homo sapiens
cacctgtacata

SEQ ID NO: 346365 - DNA, 15 bp, Homo sapiens
cacctgtagtcccag

SEQ ID NO: 346366 - DNA, 17 bp, Homo sapiens
cacctgtagtcccagct

SEQ ID NO: 346367 - DNA, 15 bp, Homo sapiens
cacctgtcccacctc

SEQ ID NO: 346368 - DNA, 14 bp, Homo sapiens
cacctgtctgtctg

SEQ ID NO: 346369 - DNA, 16 bp, Homo sapiens
cacctgtctgtctgtc

SEQ ID NO: 346370 - DNA, 22 bp, Homo sapiens
cacctgtctgtctgtctgtccc

SEQ ID NO: 346371 - DNA, 14 bp, Homo sapiens
cacctgtgacaaag

SEQ ID NO: 346372 - DNA, 21 bp, Homo sapiens
caccttaaaattagcatctgg

SEQ ID NO: 346373 - DNA, 14 bp, Homo sapiens
caccttaaattaaa

SEQ ID NO: 346374 - DNA, 15 bp, Homo sapiens
caccttaaattaaac

SEQ ID NO: 346375 - DNA, 16 bp, Homo sapiens
caccttaaattaaaca

SEQ ID NO: 346376 - DNA, 13 bp, Homo sapiens
caccttcccatgc

SEQ ID NO: 346377 - DNA, 14 bp, Homo sapiens
caccttcccatgcc

SEQ ID NO: 346378 - DNA, 13 bp, Homo sapiens
caccttcccccaa

SEQ ID NO: 346379 - DNA, 24 bp, Homo sapiens
caccttcccctgaggacctttctg

SEQ ID NO: 346380 - DNA, 13 bp, Homo sapiens
caccttcctcact

SEQ ID NO: 346381 - DNA, 18 bp, Homo sapiens
caccttcctgactgggaa

SEQ ID NO: 346382 - DNA, 15 bp, Homo sapiens
caccttcctgggcag

SEQ ID NO: 346383 - DNA, 20 bp, Homo sapiens
caccttcctgggcagcccag

SEQ ID NO: 346384 - DNA, 21 bp, Homo sapiens
caccttcctgggcagcccaga

SEQ ID NO: 346385 - DNA, 22 bp, Homo sapiens
caccttcctgggcagcccagag

SEQ ID NO: 346386 - DNA, 17 bp, Homo sapiens
caccttctgtccccagc

SEQ ID NO: 346387 - DNA, 13 bp, Homo sapiens
caccttctgtttt

SEQ ID NO: 346388 - DNA, 21 bp, Homo sapiens
caccttcttggcttctgggac

SEQ ID NO: 346389 - DNA, 22 bp, Homo sapiens
caccttcttggcttctgggacc

SEQ ID NO: 346390 - DNA, 18 bp, Homo sapiens
caccttgccaagctttct

SEQ ID NO: 346391 - DNA, 17 bp, Homo sapiens
caccttgccgagagagg

SEQ ID NO: 346392 - DNA, 21 bp, Homo sapiens
caccttgctaacctaaaagac

SEQ ID NO: 346393 - DNA, 18 bp, Homo sapiens
caccttgtacagaaccag

SEQ ID NO: 346394 - DNA, 13 bp, Homo sapiens
caccttgtcatgt

SEQ ID NO: 346395 - DNA, 22 bp, Homo sapiens
caccttgtcatgtaccatcaat

SEQ ID NO: 346396 - DNA, 23 bp, Homo sapiens
caccttgtcatgtaccatcaata

SEQ ID NO: 346397 - DNA, 13 bp, Homo sapiens
cacctttcttctt

SEQ ID NO: 346398 - DNA, 14 bp, Homo sapiens
cacctttgggatca

SEQ ID NO: 346399 - DNA, 19 bp, Homo sapiens
cacctttgggatcagcctc

SEQ ID NO: 346400 - DNA, 20 bp, Homo sapiens
cacctttgggatcagcctcc

SEQ ID NO: 346401 - DNA, 23 bp, Homo sapiens
cacctttgggatcagcctccgcc

SEQ ID NO: 346402 - DNA, 13 bp, Homo sapiens
cacgaaatgttat

SEQ ID NO: 346403 - DNA, 15 bp, Homo sapiens
cacgaaatgttattt

SEQ ID NO: 346404 - DNA, 12 bp, Homo sapiens
cacgaagcctta

SEQ ID NO: 346405 - DNA, 18 bp, Homo sapiens
cacgaagccttaagccat

SEQ ID NO: 346406 - DNA, 16 bp, Homo sapiens
cacgaagctatgagaa

SEQ ID NO: 346407 - DNA, 17 bp, Homo sapiens
cacgactcttcctgcaa

SEQ ID NO: 346408 - DNA, 14 bp, Homo sapiens
cacgagccttgcgc

SEQ ID NO: 346409 - DNA, 15 bp, Homo sapiens
cacgatctcagctca

SEQ ID NO: 346410 - DNA, 16 bp, Homo sapiens
cacgattttaaaatga

SEQ ID NO: 346411 - DNA, 18 bp, Homo sapiens
cacgcaagggcatcaggc

SEQ ID NO: 346412 - DNA, 15 bp, Homo sapiens
cacgcacacacacaa

SEQ ID NO: 346413 - DNA, 15 bp, Homo sapiens
cacgcacacacacac

SEQ ID NO: 346414 - DNA, 21 bp, Homo sapiens
cacgcacatgcgaccccgagg

SEQ ID NO: 346415 - DNA, 12 bp, Homo sapiens
cacgcacctgta

SEQ ID NO: 346416 - DNA, 19 bp, Homo sapiens
cacgcacctgtagtcccag

SEQ ID NO: 346417 - DNA, 16 bp, Homo sapiens
cacgcagacacacaca

SEQ ID NO: 346418 - DNA, 14 bp, Homo sapiens
cacgcagagccccg

SEQ ID NO: 346419 - DNA, 15 bp, Homo sapiens
cacgcagagccccgg

SEQ ID NO: 346420 - DNA, 13 bp, Homo sapiens
cacgcagccagga

SEQ ID NO: 346421 - DNA, 16 bp, Homo sapiens
cacgcagccaggacac

SEQ ID NO: 346422 - DNA, 19 bp, Homo sapiens
cacgcagccaggacaccgg

SEQ ID NO: 346423 - DNA, 21 bp, Homo sapiens
cacgcagccaggacaccgggc

SEQ ID NO: 346424 - DNA, 16 bp, Homo sapiens
cacgccaacagccccc

SEQ ID NO: 346425 - DNA, 15 bp, Homo sapiens
cacgccattctcctg

SEQ ID NO: 346426 - DNA, 23 bp, Homo sapiens
cacgccattctcctgcctcagcc

SEQ ID NO: 346427 - DNA, 23 bp, Homo sapiens
cacgcccatgtgtgagtgtgtgc

SEQ ID NO: 346428 - DNA, 16 bp, Homo sapiens
cacgccccgtgtctgg

SEQ ID NO: 346429 - DNA, 14 bp, Homo sapiens
cacgccctccctct

SEQ ID NO: 346430 - DNA, 20 bp, Homo sapiens
cacgccctgcctactctttg

SEQ ID NO: 346431 - DNA, 12 bp, Homo sapiens
cacgccctgggg

SEQ ID NO: 346432 - DNA, 17 bp, Homo sapiens
cacgccggggctggccc

SEQ ID NO: 346433 - DNA, 22 bp, Homo sapiens
cacgccggggctggccctgccc

SEQ ID NO: 346434 - DNA, 18 bp, Homo sapiens
cacgcctgtaatcccagc

SEQ ID NO: 346435 - DNA, 16 bp, Homo sapiens
cacgcgtgattgaccc

SEQ ID NO: 346436 - DNA, 17 bp, Homo sapiens
cacgcgtgattgaccct

SEQ ID NO: 346437 - DNA, 19 bp, Homo sapiens
cacgctcccccgcagtccc

SEQ ID NO: 346438 - DNA, 12 bp, Homo sapiens
cacgctcctctg

SEQ ID NO: 346439 - DNA, 14 bp, Homo sapiens
cacgctctggacat

SEQ ID NO: 346440 - DNA, 13 bp, Homo sapiens
cacgctctggtgc

SEQ ID NO: 346441 - DNA, 19 bp, Homo sapiens
cacgctgcccaggctctgc

SEQ ID NO: 346442 - DNA, 21 bp, Homo sapiens
cacgctgcccaggctctgctg

SEQ ID NO: 346443 - DNA, 18 bp, Homo sapiens
cacgctgggacacagacc

SEQ ID NO: 346444 - DNA, 14 bp, Homo sapiens
cacgctgtctccag

SEQ ID NO: 346445 - DNA, 15 bp, Homo sapiens
cacgctgtctccaga

SEQ ID NO: 346446 - DNA, 20 bp, Homo sapiens
cacgctgtctccagaccccc

SEQ ID NO: 346447 - DNA, 13 bp, Homo sapiens
cacggaaacagaa

SEQ ID NO: 346448 - DNA, 18 bp, Homo sapiens
cacggaccgcatcctcca

SEQ ID NO: 346449 - DNA, 20 bp, Homo sapiens
cacggaccgcatcctccagg

SEQ ID NO: 346450 - DNA, 14 bp, Homo sapiens
cacggactcccggg

SEQ ID NO: 346451 - DNA, 12 bp, Homo sapiens
cacggcagctgt

SEQ ID NO: 346452 - DNA, 12 bp, Homo sapiens
cacggccaccct

SEQ ID NO: 346453 - DNA, 14 bp, Homo sapiens
cacggccaccctcc

SEQ ID NO: 346454 - DNA, 15 bp, Homo sapiens
cacggccaccctcct

SEQ ID NO: 346455 - DNA, 14 bp, Homo sapiens
cacggccatgacca

SEQ ID NO: 346456 - DNA, 16 bp, Homo sapiens
cacggccctgtcagag

SEQ ID NO: 346457 - DNA, 23 bp, Homo sapiens
cacggccgtccctgacttcccag

SEQ ID NO: 346458 - DNA, 13 bp, Homo sapiens
cacggcctgggag

SEQ ID NO: 346459 - DNA, 21 bp, Homo sapiens
cacggccttcgacctggacgt

SEQ ID NO: 346460 - DNA, 12 bp, Homo sapiens
cacggctccgag

SEQ ID NO: 346461 - DNA, 23 bp, Homo sapiens
cacggctccgagggcggccaggg

SEQ ID NO: 346462 - DNA, 15 bp, Homo sapiens
cacgggagagcgcca

SEQ ID NO: 346463 - DNA, 19 bp, Homo sapiens
cacgggagagcgccacccg

SEQ ID NO: 346464 - DNA, 13 bp, Homo sapiens
cacgggaggaatc

SEQ ID NO: 346465 - DNA, 23 bp, Homo sapiens
cacgggaggaatcttttactgtg

SEQ ID NO: 346466 - DNA, 21 bp, Homo sapiens
cacgggcacagctgctgtgcc

SEQ ID NO: 346467 - DNA, 12 bp, Homo sapiens
cacgggcccgct

SEQ ID NO: 346468 - DNA, 20 bp, Homo sapiens
cacgggcccgctcaacctct

SEQ ID NO: 346469 - DNA, 23 bp, Homo sapiens
cacgggcccgctcaacctctcag

SEQ ID NO: 346470 - DNA, 16 bp, Homo sapiens
cacggggcacccagcc

SEQ ID NO: 346471 - DNA, 22 bp, Homo sapiens
cacggggtcgggggaggagcac

SEQ ID NO: 346472 - DNA, 22 bp, Homo sapiens
cacggggttggctgttccagac

SEQ ID NO: 346473 - DNA, 23 bp, Homo sapiens
cacggggttggctgttccagact

SEQ ID NO: 346474 - DNA, 20 bp, Homo sapiens
cacggtattcccaagagtgg

SEQ ID NO: 346475 - DNA, 15 bp, Homo sapiens
cacggtgcgtggctg

SEQ ID NO: 346476 - DNA, 17 bp, Homo sapiens
cacggtgcgtggctgtg

SEQ ID NO: 346477 - DNA, 20 bp, Homo sapiens
cacggtgcgtggctgtggca

SEQ ID NO: 346478 - DNA, 21 bp, Homo sapiens
cacggtgcgtggctgtggcac

SEQ ID NO: 346479 - DNA, 22 bp, Homo sapiens
cacgtaagatacaagtttcaga

SEQ ID NO: 346480 - DNA, 16 bp, Homo sapiens
cacgtacttaaatgaa

SEQ ID NO: 346481 - DNA, 17 bp, Homo sapiens
cacgtagtagggtcagg

SEQ ID NO: 346482 - DNA, 19 bp, Homo sapiens
cacgtagtagggtcaggcc

SEQ ID NO: 346483 - DNA, 21 bp, Homo sapiens
cacgtagtagggtcaggccac

SEQ ID NO: 346484 - DNA, 16 bp, Homo sapiens
cacgtcactgccagag

SEQ ID NO: 346485 - DNA, 17 bp, Homo sapiens
cacgtccccctggggct

SEQ ID NO: 346486 - DNA, 12 bp, Homo sapiens
cacgtcctccac

SEQ ID NO: 346487 - DNA, 13 bp, Homo sapiens
cacgtctgccagg

SEQ ID NO: 346488 - DNA, 15 bp, Homo sapiens
cacgtctgccaggcc

SEQ ID NO: 346489 - DNA, 22 bp, Homo sapiens
cacgtctgccaggcccatctca

SEQ ID NO: 346490 - DNA, 22 bp, Homo sapiens
cacgtctggccaggcactgcct

SEQ ID NO: 346491 - DNA, 16 bp, Homo sapiens
cacgtcttggtgcctt

SEQ ID NO: 346492 - DNA, 12 bp, Homo sapiens
cacgtgaatggc

SEQ ID NO: 346493 - DNA, 18 bp, Homo sapiens
cacgtgacagtgcctggg

SEQ ID NO: 346494 - DNA, 14 bp, Homo sapiens
cacgtgcagccacg

SEQ ID NO: 346495 - DNA, 23 bp, Homo sapiens
cacgtgccattgtctttcctccc

SEQ ID NO: 346496 - DNA, 21 bp, Homo sapiens
cacgtgcctgtagtcccagct

SEQ ID NO: 346497 - DNA, 18 bp, Homo sapiens
cacgtgctggagagtaga

SEQ ID NO: 346498 - DNA, 19 bp, Homo sapiens
cacgtggactctgtgctca

SEQ ID NO: 346499 - DNA, 23 bp, Homo sapiens
cacgtggagagctggtgcccgga

SEQ ID NO: 346500 - DNA, 12 bp, Homo sapiens
cacgtggcctct

SEQ ID NO: 346501 - DNA, 23 bp, Homo sapiens
cacgtggcctcttgagcagtggc

SEQ ID NO: 346502 - DNA, 14 bp, Homo sapiens
cacgtgtatgcaag

SEQ ID NO: 346503 - DNA, 16 bp, Homo sapiens
cacgtgtttttgtatc

SEQ ID NO: 346504 - DNA, 23 bp, Homo sapiens
cacgtttgatttcttcctgcaga

SEQ ID NO: 346505 - DNA, 13 bp, Homo sapiens
cactaaaaagtgg

SEQ ID NO: 346506 - DNA, 22 bp, Homo sapiens
cactaaagagctaggaaagagt

SEQ ID NO: 346507 - DNA, 21 bp, Homo sapiens
cactaaagcaggccttttgat

SEQ ID NO: 346508 - DNA, 14 bp, Homo sapiens
cactaaccatcccc

SEQ ID NO: 346509 - DNA, 16 bp, Homo sapiens
cactaaccatccccaa

SEQ ID NO: 346510 - DNA, 20 bp, Homo sapiens
cactaaccatccccaactcc

SEQ ID NO: 346511 - DNA, 14 bp, Homo sapiens
cactaagttatagt

SEQ ID NO: 346512 - DNA, 17 bp, Homo sapiens
cactaagttatagtata

SEQ ID NO: 346513 - DNA, 18 bp, Homo sapiens
cactaatattcagtcctg

SEQ ID NO: 346514 - DNA, 15 bp, Homo sapiens
cactaatgttagaat

SEQ ID NO: 346515 - DNA, 12 bp, Homo sapiens
cactaattctgt

SEQ ID NO: 346516 - DNA, 23 bp, Homo sapiens
cactacaacctccaccttccagg

SEQ ID NO: 346517 - DNA, 17 bp, Homo sapiens
cactacacgcacccaat

SEQ ID NO: 346518 - DNA, 21 bp, Homo sapiens
cactacaggtgaaggctctca

SEQ ID NO: 346519 - DNA, 15 bp, Homo sapiens
cactacatgcagccc

SEQ ID NO: 346520 - DNA, 21 bp, Homo sapiens
cactacctttgtccaggcctg

SEQ ID NO: 346521 - DNA, 15 bp, Homo sapiens
cactagccctctttc

SEQ ID NO: 346522 - DNA, 21 bp, Homo sapiens
cactaggataggaactgggcc

SEQ ID NO: 346523 - DNA, 14 bp, Homo sapiens
cactaggatcccac

SEQ ID NO: 346524 - DNA, 18 bp, Homo sapiens
cactaggatcccactggc

SEQ ID NO: 346525 - DNA, 15 bp, Homo sapiens
cactaggctgggtgc

SEQ ID NO: 346526 - DNA, 21 bp, Homo sapiens
cactaggctgggtgcccacag

SEQ ID NO: 346527 - DNA, 16 bp, Homo sapiens
cactaggtgcccagtc

SEQ ID NO: 346528 - DNA, 20 bp, Homo sapiens
cactaggtgcccagtcttga

SEQ ID NO: 346529 - DNA, 21 bp, Homo sapiens
cactaggtgcccagtcttgag

SEQ ID NO: 346530 - DNA, 16 bp, Homo sapiens
cactagtagagcaaag

SEQ ID NO: 346531 - DNA, 20 bp, Homo sapiens
cactagtctgtgtgctgtgg

SEQ ID NO: 346532 - DNA, 21 bp, Homo sapiens
cactagtctgtgtgctgtggt

SEQ ID NO: 346533 - DNA, 19 bp, Homo sapiens
cactataaatggtgttttt

SEQ ID NO: 346534 - DNA, 17 bp, Homo sapiens
cactatagtttaaaaca

SEQ ID NO: 346535 - DNA, 18 bp, Homo sapiens
cactatccatgcaccaaa

SEQ ID NO: 346536 - DNA, 12 bp, Homo sapiens
cactatgcattt

SEQ ID NO: 346537 - DNA, 23 bp, Homo sapiens
cactatggaccagggagcttatt

SEQ ID NO: 346538 - DNA, 21 bp, Homo sapiens
cactatgggaagctctgtgtg

SEQ ID NO: 346539 - DNA, 13 bp, Homo sapiens
cactatgtttctc

SEQ ID NO: 346540 - DNA, 12 bp, Homo sapiens
cactattagaga

SEQ ID NO: 346541 - DNA, 20 bp, Homo sapiens
cactattcttaagcactttg

SEQ ID NO: 346542 - DNA, 14 bp, Homo sapiens
cactattggacttt

SEQ ID NO: 346543 - DNA, 22 bp, Homo sapiens
cactatttttatttatattttt

SEQ ID NO: 346544 - DNA, 23 bp, Homo sapiens
cactatttttatttatatttttg

SEQ ID NO: 346545 - DNA, 15 bp, Homo sapiens
cacttgcgtcctgca

SEQ ID NO: 346546 - DNA, 15 bp, Homo sapiens
cacttgctggggctc

SEQ ID NO: 346547 - DNA, 18 bp, Homo sapiens
cacttggagatctttgct

SEQ ID NO: 346548 - DNA, 20 bp, Homo sapiens
cacttggagatctttgcttc

SEQ ID NO: 346549 - DNA, 15 bp, Homo sapiens
cacttggagcccgtg

SEQ ID NO: 346550 - DNA, 18 bp, Homo sapiens
cacttggagcccgtgcag

SEQ ID NO: 346551 - DNA, 16 bp, Homo sapiens
cacttgggtcttccct

SEQ ID NO: 346552 - DNA, 14 bp, Homo sapiens
cacttggtgctgct

SEQ ID NO: 346553 - DNA, 17 bp, Homo sapiens
cacttggtgctgctttg

SEQ ID NO: 346554 - DNA, 16 bp, Homo sapiens
cacttgtgttgctttc

SEQ ID NO: 346555 - DNA, 22 bp, Homo sapiens
cacttgtgttgctttctgactg

SEQ ID NO: 346556 - DNA, 22 bp, Homo sapiens
cacttgtgtttgtatataaatg

SEQ ID NO: 346557 - DNA, 17 bp, Homo sapiens
cacttgtttttcttttt

SEQ ID NO: 346558 - DNA, 19 bp, Homo sapiens
cactttaaatggaataatt

SEQ ID NO: 346559 - DNA, 21 bp, Homo sapiens
cactttagtgattgcttttat

SEQ ID NO: 346560 - DNA, 20 bp, Homo sapiens
cactttagtgtattttctgt

SEQ ID NO: 346561 - DNA, 23 bp, Homo sapiens
cactttcctggataaaaaagaaa

SEQ ID NO: 346562 - DNA, 21 bp, Homo sapiens
cactttgaaaatatttctatg

SEQ ID NO: 346563 - DNA, 20 bp, Homo sapiens
cactttgcagacctgggact

SEQ ID NO: 346564 - DNA, 21 bp, Homo sapiens
cactttgccaaggctctcccc

SEQ ID NO: 346565 - DNA, 18 bp, Homo sapiens
cactttgttctttaggag

SEQ ID NO: 346566 - DNA, 19 bp, Homo sapiens
cactttgttggcccttcca

SEQ ID NO: 346567 - DNA, 22 bp, Homo sapiens
cactttgtttcatattctcaga

SEQ ID NO: 346568 - DNA, 21 bp, Homo sapiens
cacttttcacttgtcttgctc

SEQ ID NO: 346569 - DNA, 21 bp, Homo sapiens
cacttttgaactcacgagcct

SEQ ID NO: 346570 - DNA, 15 bp, Homo sapiens
cactttttcacataa

SEQ ID NO: 346571 - DNA, 14 bp, Homo sapiens
cactttttgcagct

SEQ ID NO: 346572 - DNA, 16 bp, Homo sapiens
cacttttttcctgtca

SEQ ID NO: 346573 - DNA, 18 bp, Homo sapiens
cagaaaacaacaaaaaat

SEQ ID NO: 346574 - DNA, 19 bp, Homo sapiens
cagaaaacaacaaaaaata

SEQ ID NO: 346575 - DNA, 18 bp, Homo sapiens
cagaaaacaattgttctg

SEQ ID NO: 346576 - DNA, 10 bp, Homo sapiens
cagaaaacag

SEQ ID NO: 346577 - DNA, 14 bp, Homo sapiens
cagaaaacagaaaa

SEQ ID NO: 346578 - DNA, 15 bp, Homo sapiens
cagaaaacctcaagg

SEQ ID NO: 346579 - DNA, 19 bp, Homo sapiens
cagaaaacggttaaaactg

SEQ ID NO: 346580 - DNA, 13 bp, Homo sapiens
cagaaaagacact

SEQ ID NO: 346581 - DNA, 11 bp, Homo sapiens
cagaaaagaga

SEQ ID NO: 346582 - DNA, 15 bp, Homo sapiens
cagaaaagagaagaa

SEQ ID NO: 346583 - DNA, 19 bp, Homo sapiens
cagaaaagaggagaccctg

SEQ ID NO: 346584 - DNA, 20 bp, Homo sapiens
cagaaaatagggtggacaga

SEQ ID NO: 346585 - DNA, 22 bp, Homo sapiens
cagaaacacaaccactcaccag

SEQ ID NO: 346586 - DNA, 23 bp, Homo sapiens
cagaaacagggggaaaatgtttg

SEQ ID NO: 346587 - DNA, 15 bp, Homo sapiens
cagaaacagtgggag

SEQ ID NO: 346588 - DNA, 15 bp, Homo sapiens
cagaaaccagttatg

SEQ ID NO: 346589 - DNA, 20 bp, Homo sapiens
cagaaaccccacttccattg

SEQ ID NO: 346590 - DNA, 11 bp, Homo sapiens
cagaaaccttg

SEQ ID NO: 346591 - DNA, 14 bp, Homo sapiens
cagaaaccttgttt

SEQ ID NO: 346592 - DNA, 20 bp, Homo sapiens
cagaaaccttgtttgtttta

SEQ ID NO: 346593 - DNA, 23 bp, Homo sapiens
cagaaacttttttctctaaagga

SEQ ID NO: 346594 - DNA, 16 bp, Homo sapiens
cagaaagaaaatgaat

SEQ ID NO: 346595 - DNA, 19 bp, Homo sapiens
cagaaagaaaatgaatttg

SEQ ID NO: 346596 - DNA, 20 bp, Homo sapiens
cagaaagagctctccagaag

SEQ ID NO: 346597 - DNA, 18 bp, Homo sapiens
cagaaagcaaatcagaca

SEQ ID NO: 346598 - DNA, 15 bp, Homo sapiens
cagaaagcagaggct

SEQ ID NO: 346599 - DNA, 16 bp, Homo sapiens
cagaaagcagaggctg

SEQ ID NO: 346600 - DNA, 20 bp, Homo sapiens
cagaaagcaggagcagctgt

SEQ ID NO: 346601 - DNA, 21 bp, Homo sapiens
cagaaagcaggagcagctgtg

SEQ ID NO: 346602 - DNA, 19 bp, Homo sapiens
cagaaagccccaagcaatt

SEQ ID NO: 346603 - DNA, 13 bp, Homo sapiens
cagaaagcctcct

SEQ ID NO: 346604 - DNA, 21 bp, Homo sapiens
cagaaagcctcctgccccctg

SEQ ID NO: 346605 - DNA, 22 bp, Homo sapiens
cagaaaggatatttaagaaaat

SEQ ID NO: 346606 - DNA, 22 bp, Homo sapiens
cagaaagggcagcccctcccca

SEQ ID NO: 346607 - DNA, 18 bp, Homo sapiens
cagaaagggcagcttcag

SEQ ID NO: 346608 - DNA, 23 bp, Homo sapiens
cagaaagggcagcttcagtctct

SEQ ID NO: 346609 - DNA, 15 bp, Homo sapiens
cagaaagtcaccagg

SEQ ID NO: 346610 - DNA, 22 bp, Homo sapiens
cagaaagtgtgctttatgctga

SEQ ID NO: 346611 - DNA, 14 bp, Homo sapiens
cagaaatcagagga

SEQ ID NO: 346612 - DNA, 15 bp, Homo sapiens
cagaaatcagaggag

SEQ ID NO: 346613 - DNA, 17 bp, Homo sapiens
cagaaatcccagttcat

SEQ ID NO: 346614 - DNA, 23 bp, Homo sapiens
cagaaatcccagttcatgttgct

SEQ ID NO: 346615 - DNA, 23 bp, Homo sapiens
cagaaatgccgctgtgtccccgc

SEQ ID NO: 346616 - DNA, 14 bp, Homo sapiens
cagaaatgctgcct

SEQ ID NO: 346617 - DNA, 17 bp, Homo sapiens
cagaaatgctgcctgcc

SEQ ID NO: 346618 - DNA, 19 bp, Homo sapiens
cagaaatgtggatgctctt

SEQ ID NO: 346619 - DNA, 12 bp, Homo sapiens
cagaaattcttc

SEQ ID NO: 346620 - DNA, 21 bp, Homo sapiens
cagaaattcttcaatttgaaa

SEQ ID NO: 346621 - DNA, 15 bp, Homo sapiens
cagaaatttttattt

SEQ ID NO: 346622 - DNA, 18 bp, Homo sapiens
cagaaatttttatttttc

SEQ ID NO: 346623 - DNA, 21 bp, Homo sapiens
cagaacaccccgctctggcag

SEQ ID NO: 346624 - DNA, 23 bp, Homo sapiens
cagaacaccccgctctggcagta

SEQ ID NO: 346625 - DNA, 15 bp, Homo sapiens
cagaacacctggccg

SEQ ID NO: 346626 - DNA, 16 bp, Homo sapiens
cagaacactgtaatag

SEQ ID NO: 346627 - DNA, 13 bp, Homo sapiens
cagaacagccctc

SEQ ID NO: 346628 - DNA, 15 bp, Homo sapiens
cagaacatgagtgct

SEQ ID NO: 346629 - DNA, 20 bp, Homo sapiens
cagaacatttctcatgtgct

SEQ ID NO: 346630 - DNA, 14 bp, Homo sapiens
cagaaccagcactc

SEQ ID NO: 346631 - DNA, 17 bp, Homo sapiens
cagaaccagcactccca

SEQ ID NO: 346632 - DNA, 19 bp, Homo sapiens
cagaaccagcactcccagg

SEQ ID NO: 346633 - DNA, 23 bp, Homo sapiens
cagaaccagcactcccagggccc

SEQ ID NO: 346634 - DNA, 15 bp, Homo sapiens
cagaaccccaactcc

SEQ ID NO: 346635 - DNA, 20 bp, Homo sapiens
cagaaccccaactcccagcc

SEQ ID NO: 346636 - DNA, 22 bp, Homo sapiens
cagaacccttggagccaatgga

SEQ ID NO: 346637 - DNA, 12 bp, Homo sapiens
cagaacctcttc

SEQ ID NO: 346638 - DNA, 16 bp, Homo sapiens
cagaacctcttcccca

SEQ ID NO: 346639 - DNA, 13 bp, Homo sapiens
cagaacctggtgg

SEQ ID NO: 346640 - DNA, 18 bp, Homo sapiens
cagaacctggtggctgga

SEQ ID NO: 346641 - DNA, 18 bp, Homo sapiens
cagaacgcaccccactgg

SEQ ID NO: 346642 - DNA, 17 bp, Homo sapiens
cagaacgggcctccccg

SEQ ID NO: 346643 - DNA, 20 bp, Homo sapiens
cagaactcctgtgtgtggaa

SEQ ID NO: 346644 - DNA, 13 bp, Homo sapiens
cagaactcgatgc

SEQ ID NO: 346645 - DNA, 15 bp, Homo sapiens
cagaactctctgtct

SEQ ID NO: 346646 - DNA, 13 bp, Homo sapiens
cagaactgccccc

SEQ ID NO: 346647 - DNA, 14 bp, Homo sapiens
cagaactgccccca

SEQ ID NO: 346648 - DNA, 17 bp, Homo sapiens
cagaactgcccccactg

SEQ ID NO: 346649 - DNA, 23 bp, Homo sapiens
cagaactgctaccatgaagtgaa

SEQ ID NO: 346650 - DNA, 21 bp, Homo sapiens
cagaactgggaaaacagtgaa

SEQ ID NO: 346651 - DNA, 17 bp, Homo sapiens
cagaactgttggctgct

SEQ ID NO: 346652 - DNA, 23 bp, Homo sapiens
cagaacttcgaccctttctctga

SEQ ID NO: 346653 - DNA, 22 bp, Homo sapiens
cagaagaaataattgtgtcatg

SEQ ID NO: 346654 - DNA, 12 bp, Homo sapiens
cagaagaatatt

SEQ ID NO: 346655 - DNA, 16 bp, Homo sapiens
cagaagaatattcagg

SEQ ID NO: 346656 - DNA, 17 bp, Homo sapiens
cagaagacacgtgtttt

SEQ ID NO: 346657 - DNA, 20 bp, Homo sapiens
cagaagacacgtgtttttgt

SEQ ID NO: 346658 - DNA, 21 bp, Homo sapiens
cagaagaccacaaaaattgac

SEQ ID NO: 346659 - DNA, 22 bp, Homo sapiens
cagaagacctccctgtgagaga

SEQ ID NO: 346660 - DNA, 12 bp, Homo sapiens
cagaagagaatc

SEQ ID NO: 346661 - DNA, 13 bp, Homo sapiens
cagaagatgccct

SEQ ID NO: 346662 - DNA, 16 bp, Homo sapiens
cagaagatgccctcca

SEQ ID NO: 346663 - DNA, 20 bp, Homo sapiens
cagaagatgtattcagagcc

SEQ ID NO: 346664 - DNA, 21 bp, Homo sapiens
cagaagatgtattcagagcca

SEQ ID NO: 346665 - DNA, 14 bp, Homo sapiens
cagaagcaggatag

SEQ ID NO: 346666 - DNA, 23 bp, Homo sapiens
cagaagcagttgagtcgtcatca

SEQ ID NO: 346667 - DNA, 14 bp, Homo sapiens
cagaagcattaact

SEQ ID NO: 346668 - DNA, 13 bp, Homo sapiens
cagaagcctctgg

SEQ ID NO: 346669 - DNA, 14 bp, Homo sapiens
cagaagcctctggc

SEQ ID NO: 346670 - DNA, 13 bp, Homo sapiens
cagcaccctgggt

SEQ ID NO: 346671 - DNA, 17 bp, Homo sapiens
cagcaccctgggtgcca

SEQ ID NO: 346672 - DNA, 14 bp, Homo sapiens
cagcaccctttcac

SEQ ID NO: 346673 - DNA, 17 bp, Homo sapiens
cagcacctcctctctgc

SEQ ID NO: 346674 - DNA, 11 bp, Homo sapiens
cagcacctgcc

SEQ ID NO: 346675 - DNA, 14 bp, Homo sapiens
cagcacctgccagg

SEQ ID NO: 346676 - DNA, 15 bp, Homo sapiens
cagcacctgccaggg

SEQ ID NO: 346677 - DNA, 13 bp, Homo sapiens
cagcacctggagc

SEQ ID NO: 346678 - DNA, 20 bp, Homo sapiens
cagcacctgtaagaaacaga

SEQ ID NO: 346679 - DNA, 11 bp, Homo sapiens
cagcactactc

SEQ ID NO: 346680 - DNA, 22 bp, Homo sapiens
cagcactacttacttagagatg

SEQ ID NO: 346681 - DNA, 15 bp, Homo sapiens
cagcactcccagggc

SEQ ID NO: 346682 - DNA, 17 bp, Homo sapiens
cagcactggctctctcc

SEQ ID NO: 346683 - DNA, 20 bp, Homo sapiens
cagcactgggaagctggagt

SEQ ID NO: 346684 - DNA, 21 bp, Homo sapiens
cagcactgggaagctggagtg

SEQ ID NO: 346685 - DNA, 22 bp, Homo sapiens
cagcactgggaagctggagtgc

SEQ ID NO: 346686 - DNA, 20 bp, Homo sapiens
cagcactgtcccttgcctca

SEQ ID NO: 346687 - DNA, 20 bp, Homo sapiens
cagcagaaacccccaggagg

SEQ ID NO: 346688 - DNA, 23 bp, Homo sapiens
cagcagcaatgcaatgtggaaat

SEQ ID NO: 346689 - DNA, 16 bp, Homo sapiens
cagcagcccagcttcc

SEQ ID NO: 346690 - DNA, 16 bp, Homo sapiens
cagcagccccctgccc

SEQ ID NO: 346691 - DNA, 17 bp, Homo sapiens
cagcagccccctgcccg

SEQ ID NO: 346692 - DNA, 16 bp, Homo sapiens
cagcagcccctgcaca

SEQ ID NO: 346693 - DNA, 16 bp, Homo sapiens
cagcagccctaaggat

SEQ ID NO: 346694 - DNA, 20 bp, Homo sapiens
cagcagccctaaggatctct

SEQ ID NO: 346695 - DNA, 24 bp, Homo sapiens
cagcagccctaaggatctctcagg

SEQ ID NO: 346696 - DNA, 14 bp, Homo sapiens
cagcagcctccctg

SEQ ID NO: 346697 - DNA, 13 bp, Homo sapiens
cagcagcctctga

SEQ ID NO: 346698 - DNA, 23 bp, Homo sapiens
cagcagcctctgaagttggacag

SEQ ID NO: 346699 - DNA, 15 bp, Homo sapiens
cagcagcctgcttcc

SEQ ID NO: 346700 - DNA, 12 bp, Homo sapiens
cagcagcctgtg

SEQ ID NO: 346701 - DNA, 14 bp, Homo sapiens
cagcagcctgtgag

SEQ ID NO: 346702 - DNA, 16 bp, Homo sapiens
cagcagcggcccagat

SEQ ID NO: 346703 - DNA, 18 bp, Homo sapiens
cagcagctagagctcagt

SEQ ID NO: 346704 - DNA, 16 bp, Homo sapiens
cagcagctaggactga

SEQ ID NO: 346705 - DNA, 22 bp, Homo sapiens
cagcagctaggactgaggagtg

SEQ ID NO: 346706 - DNA, 23 bp, Homo sapiens
cagcagctaggactgaggagtgg

SEQ ID NO: 346707 - DNA, 12 bp, Homo sapiens
cagcagctctga

SEQ ID NO: 346708 - DNA, 13 bp, Homo sapiens
cagcagctctgag

SEQ ID NO: 346709 - DNA, 22 bp, Homo sapiens
cagcagctgcgggtctgaagga

SEQ ID NO: 346710 - DNA, 16 bp, Homo sapiens
cagcagcttcaccaga

SEQ ID NO: 346711 - DNA, 12 bp, Homo sapiens
cagcaggcagag

SEQ ID NO: 346712 - DNA, 15 bp, Homo sapiens
cagcaggcagaggag

SEQ ID NO: 346713 - DNA, 13 bp, Homo sapiens
cagcaggcccacc

SEQ ID NO: 346714 - DNA, 14 bp, Homo sapiens
cagcaggcccacct

SEQ ID NO: 346715 - DNA, 16 bp, Homo sapiens
cagcaggcgtgcctcg

SEQ ID NO: 346716 - DNA, 17 bp, Homo sapiens
cagcaggcgtgcctcgt

SEQ ID NO: 346717 - DNA, 20 bp, Homo sapiens
cagcagggcgggccaggaga

SEQ ID NO: 346718 - DNA, 21 bp, Homo sapiens
cagcagggcgggccaggagaa

SEQ ID NO: 346719 - DNA, 19 bp, Homo sapiens
cagcaggggggttgggttc

SEQ ID NO: 346720 - DNA, 18 bp, Homo sapiens
cagcaggggtgggaggct

SEQ ID NO: 346721 - DNA, 23 bp, Homo sapiens
cagcaggggtgggaggctcccag

SEQ ID NO: 346722 - DNA, 17 bp, Homo sapiens
cagcagggtcttgctgt

SEQ ID NO: 346723 - DNA, 16 bp, Homo sapiens
cagcaggtgtggtggc

SEQ ID NO: 346724 - DNA, 21 bp, Homo sapiens
cagcaggttctctcctgtgag

SEQ ID NO: 346725 - DNA, 18 bp, Homo sapiens
cagcagtaccatcccact

SEQ ID NO: 346726 - DNA, 20 bp, Homo sapiens
cagcagtaccatcccactga

SEQ ID NO: 346727 - DNA, 22 bp, Homo sapiens
cagcagtaccatcccactgata

SEQ ID NO: 346728 - DNA, 22 bp, Homo sapiens
cagcagtacttgctcaataaag

SEQ ID NO: 346729 - DNA, 17 bp, Homo sapiens
cagcagtatgaatgatg

SEQ ID NO: 346730 - DNA, 14 bp, Homo sapiens
cagcagtgctgggc

SEQ ID NO: 346731 - DNA, 15 bp, Homo sapiens
cagcagtgctgggcc

SEQ ID NO: 346732 - DNA, 17 bp, Homo sapiens
cagcagtgctgggccca

SEQ ID NO: 346733 - DNA, 14 bp, Homo sapiens
cagcatcaaaatac

SEQ ID NO: 346734 - DNA, 16 bp, Homo sapiens
cagcatcaaaatacaa

SEQ ID NO: 346735 - DNA, 13 bp, Homo sapiens
cagcatcaaacat

SEQ ID NO: 346736 - DNA, 21 bp, Homo sapiens
cagcatcaaacatgaaaacat

SEQ ID NO: 346737 - DNA, 18 bp, Homo sapiens
cagcatccagcctgtgtg

SEQ ID NO: 346738 - DNA, 12 bp, Homo sapiens
cagcatgaaaat

SEQ ID NO: 346739 - DNA, 21 bp, Homo sapiens
cagcatgacctgtgaccagca

SEQ ID NO: 346740 - DNA, 23 bp, Homo sapiens
cagcatgacctgtgaccagcact

SEQ ID NO: 346741 - DNA, 15 bp, Homo sapiens
cagcatgccccttgg

SEQ ID NO: 346742 - DNA, 16 bp, Homo sapiens
cagcatggtgcatgcc

SEQ ID NO: 346743 - DNA, 12 bp, Homo sapiens
cagcatgtctac

SEQ ID NO: 346744 - DNA, 19 bp, Homo sapiens
cagcatgtgtgtgtctcta

SEQ ID NO: 346745 - DNA, 21 bp, Homo sapiens
cagcatgtgtgtgtctctatc

SEQ ID NO: 346746 - DNA, 21 bp, Homo sapiens
cagcattaggcttttaagaaa

SEQ ID NO: 346747 - DNA, 18 bp, Homo sapiens
cagcattattcctccagg

SEQ ID NO: 346748 - DNA, 22 bp, Homo sapiens
cagcattcaaaatagttctatt

SEQ ID NO: 346749 - DNA, 16 bp, Homo sapiens
cagcattccagctctg

SEQ ID NO: 346750 - DNA, 17 bp, Homo sapiens
cagcattccagctctgc

SEQ ID NO: 346751 - DNA, 20 bp, Homo sapiens
cagcattccagctctgcccc

SEQ ID NO: 346752 - DNA, 19 bp, Homo sapiens
cagcattcttgtcacaata

SEQ ID NO: 346753 - DNA, 17 bp, Homo sapiens
cagccaaaccctgtctg

SEQ ID NO: 346754 - DNA, 19 bp, Homo sapiens
cagccaaacctttcctgta

SEQ ID NO: 346755 - DNA, 16 bp, Homo sapiens
cagccaacattgcctt

SEQ ID NO: 346756 - DNA, 16 bp, Homo sapiens
cagccaacccctgtgg

SEQ ID NO: 346757 - DNA, 17 bp, Homo sapiens
cagccaagcccaccctg

SEQ ID NO: 346758 - DNA, 20 bp, Homo sapiens
cagccaaggtgctaaaagga

SEQ ID NO: 346759 - DNA, 16 bp, Homo sapiens
cagccaagtgccttcc

SEQ ID NO: 346760 - DNA, 17 bp, Homo sapiens
cagccaatttgtctcct

SEQ ID NO: 346761 - DNA, 18 bp, Homo sapiens
cagccaatttgtctccta

SEQ ID NO: 346762 - DNA, 20 bp, Homo sapiens
cagccaccaccactgtccct

SEQ ID NO: 346763 - DNA, 15 bp, Homo sapiens
cagccaccacctgga

SEQ ID NO: 346764 - DNA, 20 bp, Homo sapiens
cagccacccggatctccagg

SEQ ID NO: 346765 - DNA, 21 bp, Homo sapiens
cagccacccggatctccaggc

SEQ ID NO: 346766 - DNA, 20 bp, Homo sapiens
cagccaccctaactgagctg

SEQ ID NO: 346767 - DNA, 23 bp, Homo sapiens
cagccacctccacccccaagaaa

SEQ ID NO: 346768 - DNA, 23 bp, Homo sapiens
cagccaccttcctgactgggaag

SEQ ID NO: 346769 - DNA, 23 bp, Homo sapiens
cagccagaaactgaactggccgc

SEQ ID NO: 346770 - DNA, 13 bp, Homo sapiens
cagccagagctgg

SEQ ID NO: 346771 - DNA, 17 bp, Homo sapiens
cagccagagctgggtgg

SEQ ID NO: 346772 - DNA, 13 bp, Homo sapiens
cagccagcaatga

SEQ ID NO: 346773 - DNA, 11 bp, Homo sapiens
cagccagcagg

SEQ ID NO: 346774 - DNA, 12 bp, Homo sapiens
cagccagcaggt

SEQ ID NO: 346775 - DNA, 10 bp, Homo sapiens
cagccagccc

SEQ ID NO: 346776 - DNA, 12 bp, Homo sapiens
cagccagccctt

SEQ ID NO: 346777 - DNA, 13 bp, Homo sapiens
cagccagcccttc

SEQ ID NO: 346778 - DNA, 16 bp, Homo sapiens
cagccagctgcccaca

SEQ ID NO: 346779 - DNA, 11 bp, Homo sapiens
cagccaggaca

SEQ ID NO: 346780 - DNA, 12 bp, Homo sapiens
cagccaggacac

SEQ ID NO: 346781 - DNA, 16 bp, Homo sapiens
cagccaggacaccggg

SEQ ID NO: 346782 - DNA, 20 bp, Homo sapiens
cagccaggacaccgggcagg

SEQ ID NO: 346783 - DNA, 20 bp, Homo sapiens
cagccaggaggggctgtcca

SEQ ID NO: 346784 - DNA, 19 bp, Homo sapiens
cagccaggctcaggccatg

SEQ ID NO: 346785 - DNA, 22 bp, Homo sapiens
cagccaggctgccaaggccaga

SEQ ID NO: 346786 - DNA, 16 bp, Homo sapiens
cagccagggagcccgg

SEQ ID NO: 346787 - DNA, 21 bp, Homo sapiens
cagccagggagcccggggcag

SEQ ID NO: 346788 - DNA, 12 bp, Homo sapiens
cagcccacagtg

SEQ ID NO: 346789 - DNA, 17 bp, Homo sapiens
cagcccacccccctcat

SEQ ID NO: 346790 - DNA, 14 bp, Homo sapiens
cagcccactgagaa

SEQ ID NO: 346791 - DNA, 20 bp, Homo sapiens
cagcccactggatcagaaag

SEQ ID NO: 346792 - DNA, 21 bp, Homo sapiens
cagcccagaacgggcctcccc

SEQ ID NO: 346793 - DNA, 23 bp, Homo sapiens
cagcccagaacgggcctccccgg

SEQ ID NO: 346794 - DNA, 21 bp, Homo sapiens
cagcccagagagaccctgcca

SEQ ID NO: 346795 - DNA, 11 bp, Homo sapiens
cagcccagctc

SEQ ID NO: 346796 - DNA, 21 bp, Homo sapiens
cagcccagctccactcagggc

SEQ ID NO: 346797 - DNA, 23 bp, Homo sapiens
cagcccagctccactcagggctg

SEQ ID NO: 346798 - DNA, 16 bp, Homo sapiens
cagcccagctgctctg

SEQ ID NO: 346799 - DNA, 19 bp, Homo sapiens
cagcccagctgctctgccc

SEQ ID NO: 346800 - DNA, 23 bp, Homo sapiens
cagcccagctgctctgcccagag

SEQ ID NO: 346801 - DNA, 15 bp, Homo sapiens
cagcccagcttcctg

SEQ ID NO: 346802 - DNA, 17 bp, Homo sapiens
cagcccaggtcccagtg

SEQ ID NO: 346803 - DNA, 16 bp, Homo sapiens
cagcccatgcccacct

SEQ ID NO: 346804 - DNA, 11 bp, Homo sapiens
cagccccaccc

SEQ ID NO: 346805 - DNA, 15 bp, Homo sapiens
cagccccacccagga

SEQ ID NO: 346806 - DNA, 16 bp, Homo sapiens
cagccccacccaggag

SEQ ID NO: 346807 - DNA, 13 bp, Homo sapiens
cagccccacttca

SEQ ID NO: 346808 - DNA, 19 bp, Homo sapiens
cagccccacttcaccccca

SEQ ID NO: 346809 - DNA, 12 bp, Homo sapiens
cagccccagccc

SEQ ID NO: 346810 - DNA, 14 bp, Homo sapiens
cagccccagcccag

SEQ ID NO: 346811 - DNA, 16 bp, Homo sapiens
cagccccagcccagcc

SEQ ID NO: 346812 - DNA, 18 bp, Homo sapiens
cagccccagggccctgct

SEQ ID NO: 346813 - DNA, 19 bp, Homo sapiens
cagccccagggccctgctc

SEQ ID NO: 346814 - DNA, 20 bp, Homo sapiens
cagccccagggccctgctca

SEQ ID NO: 346815 - DNA, 22 bp, Homo sapiens
cagccccagggccctgctcagg

SEQ ID NO: 346816 - DNA, 15 bp, Homo sapiens
cagccccatagaaaa

SEQ ID NO: 346817 - DNA, 17 bp, Homo sapiens
cagccccatccttcccg

SEQ ID NO: 346818 - DNA, 13 bp, Homo sapiens
cagccccccaccc

SEQ ID NO: 346819 - DNA, 18 bp, Homo sapiens
cagccccccaccccacag

SEQ ID NO: 346820 - DNA, 16 bp, Homo sapiens
cagccccccagtgtcc

SEQ ID NO: 346821 - DNA, 11 bp, Homo sapiens
cagccccctcc

SEQ ID NO: 346822 - DNA, 16 bp, Homo sapiens
cagccccctccacacc

SEQ ID NO: 346823 - DNA, 22 bp, Homo sapiens
cagccccctggatgggcattgg

SEQ ID NO: 346824 - DNA, 16 bp, Homo sapiens
cagccccctggcccct

SEQ ID NO: 346825 - DNA, 23 bp, Homo sapiens
cagccccggccactccctgccaa

SEQ ID NO: 346826 - DNA, 16 bp, Homo sapiens
cagcccctagcagagc

SEQ ID NO: 346827 - DNA, 13 bp, Homo sapiens
cagcccctcccac

SEQ ID NO: 346828 - DNA, 14 bp, Homo sapiens
cagcccctcccacc

SEQ ID NO: 346829 - DNA, 15 bp, Homo sapiens
cagcccctcccacca

SEQ ID NO: 346830 - DNA, 22 bp, Homo sapiens
cagcccctcccaccacagcagg

SEQ ID NO: 346831 - DNA, 14 bp, Homo sapiens
cagcccctccccat

SEQ ID NO: 346832 - DNA, 11 bp, Homo sapiens
cagcccctctt

SEQ ID NO: 346833 - DNA, 15 bp, Homo sapiens
cagcccctcttgccc

SEQ ID NO: 346834 - DNA, 23 bp, Homo sapiens
cagcccctcttgccccccacccc

SEQ ID NO: 346835 - DNA, 13 bp, Homo sapiens
cagcccctgctgc

SEQ ID NO: 346836 - DNA, 14 bp, Homo sapiens
cagcccctgctgct

SEQ ID NO: 346837 - DNA, 15 bp, Homo sapiens
cagcccctgctgctc

SEQ ID NO: 346838 - DNA, 13 bp, Homo sapiens
cagcccctgctgg

SEQ ID NO: 346839 - DNA, 17 bp, Homo sapiens
cagcccctggagctcct

SEQ ID NO: 346840 - DNA, 22 bp, Homo sapiens
cagcccctggggtacttctgtg

SEQ ID NO: 346841 - DNA, 13 bp, Homo sapiens
cagccccttctcc

SEQ ID NO: 346842 - DNA, 21 bp, Homo sapiens
cagccccttctcccagcacac

SEQ ID NO: 346843 - DNA, 19 bp, Homo sapiens
cagcccgacaatgtcgagt

SEQ ID NO: 346844 - DNA, 24 bp, Homo sapiens
cagcccgagtggtctcctctcagc

SEQ ID NO: 346845 - DNA, 21 bp, Homo sapiens
cagcccgcatgcagcagcttg

SEQ ID NO: 346846 - DNA, 23 bp, Homo sapiens
cagcccgcatgcagcagcttgct

SEQ ID NO: 346847 - DNA, 14 bp, Homo sapiens
cagcccgcctgccg

SEQ ID NO: 346848 - DNA, 23 bp, Homo sapiens
cagcccgcctgccgtgcatggct

SEQ ID NO: 346849 - DNA, 15 bp, Homo sapiens
cagcccggaccttgg

SEQ ID NO: 346850 - DNA, 14 bp, Homo sapiens
cagcccggcctgct

SEQ ID NO: 346851 - DNA, 17 bp, Homo sapiens
cagcccgtgtggcccct

SEQ ID NO: 346852 - DNA, 18 bp, Homo sapiens
cagcccgtgtggcccctt

SEQ ID NO: 346853 - DNA, 20 bp, Homo sapiens
cagcccgtgtggccccttca

SEQ ID NO: 346854 - DNA, 22 bp, Homo sapiens
cagccctaaggatctctcagga

SEQ ID NO: 346855 - DNA, 12 bp, Homo sapiens
cagccctaggct

SEQ ID NO: 346856 - DNA, 19 bp, Homo sapiens
cagccctagtgggagccca

SEQ ID NO: 346857 - DNA, 13 bp, Homo sapiens
cagccctcagttt

SEQ ID NO: 346858 - DNA, 15 bp, Homo sapiens
cagccctccagagca

SEQ ID NO: 346859 - DNA, 18 bp, Homo sapiens
cagccctccagagcagga

SEQ ID NO: 346860 - DNA, 13 bp, Homo sapiens
cagccctccctgc

SEQ ID NO: 346861 - DNA, 15 bp, Homo sapiens
cagccctccctgccc

SEQ ID NO: 346862 - DNA, 15 bp, Homo sapiens
cagccctctcactgt

SEQ ID NO: 346863 - DNA, 18 bp, Homo sapiens
cagccctctcactgtgtc

SEQ ID NO: 346864 - DNA, 13 bp, Homo sapiens
cagccctgccctt

SEQ ID NO: 346865 - DNA, 18 bp, Homo sapiens
cagccctgctgcttccta

SEQ ID NO: 346866 - DNA, 21 bp, Homo sapiens
cagccctgctttgggctgccc

SEQ ID NO: 346867 - DNA, 22 bp, Homo sapiens
cagccctgctttgggctgccct

SEQ ID NO: 346868 - DNA, 18 bp, Homo sapiens
cagccctggggctgggcc

SEQ ID NO: 346869 - DNA, 12 bp, Homo sapiens
cagccctgtcag

SEQ ID NO: 346870 - DNA, 18 bp, Homo sapiens
cagccctgtcagtgcagc

SEQ ID NO: 346871 - DNA, 21 bp, Homo sapiens
cagccctgtcagtgcagcccg

SEQ ID NO: 346872 - DNA, 13 bp, Homo sapiens
cagccctgtcctg

SEQ ID NO: 346873 - DNA, 15 bp, Homo sapiens
cagccctgtcctggt

SEQ ID NO: 346874 - DNA, 11 bp, Homo sapiens
cagccctgtgg

SEQ ID NO: 346875 - DNA, 19 bp, Homo sapiens
cagcccttcccaggccagc

SEQ ID NO: 346876 - DNA, 20 bp, Homo sapiens
cagcccttcccaggccagcg

SEQ ID NO: 346877 - DNA, 21 bp, Homo sapiens
cagcccttcccaggccagcga

SEQ ID NO: 346878 - DNA, 15 bp, Homo sapiens
cagcccttccctgct

SEQ ID NO: 346879 - DNA, 16 bp, Homo sapiens
cagcccttccctgctt

SEQ ID NO: 346880 - DNA, 15 bp, Homo sapiens
cagcccttccctggc

SEQ ID NO: 346881 - DNA, 15 bp, Homo sapiens
cagcccttcctcctg

SEQ ID NO: 346882 - DNA, 18 bp, Homo sapiens
cagcccttcctcctgaag

SEQ ID NO: 346883 - DNA, 23 bp, Homo sapiens
cagcccttcctcctgaagcctct

SEQ ID NO: 346884 - DNA, 21 bp, Homo sapiens
cagcccttgcccccatccctc

SEQ ID NO: 346885 - DNA, 14 bp, Homo sapiens
cagcccttgggcag

SEQ ID NO: 346886 - DNA, 12 bp, Homo sapiens
cagccgagccgg

SEQ ID NO: 346887 - DNA, 14 bp, Homo sapiens
cagccgagccgggc

SEQ ID NO: 346888 - DNA, 18 bp, Homo sapiens
cagccgagccgggcctgg

SEQ ID NO: 346889 - DNA, 23 bp, Homo sapiens
cagccgagctcgtgtatcctggg

SEQ ID NO: 346890 - DNA, 22 bp, Homo sapiens
cagccgcaaatccataccccct

SEQ ID NO: 346891 - DNA, 18 bp, Homo sapiens
cagccgccatcagcccaa

SEQ ID NO: 346892 - DNA, 17 bp, Homo sapiens
cagccgccattgccacc

SEQ ID NO: 346893 - DNA, 18 bp, Homo sapiens
cagcctccaggcccccaa

SEQ ID NO: 346894 - DNA, 13 bp, Homo sapiens
cagcctccagggc

SEQ ID NO: 346895 - DNA, 14 bp, Homo sapiens
cagcctccatgctg

SEQ ID NO: 346896 - DNA, 22 bp, Homo sapiens
cagcctcccccaggctgcgcct

SEQ ID NO: 346897 - DNA, 15 bp, Homo sapiens
cagcctcctcctgac

SEQ ID NO: 346898 - DNA, 15 bp, Homo sapiens
cagcctcctgagcct

SEQ ID NO: 346899 - DNA, 17 bp, Homo sapiens
cagcctcctgagcctgt

SEQ ID NO: 346900 - DNA, 18 bp, Homo sapiens
cagcctcctgagcctgtg

SEQ ID NO: 346901 - DNA, 20 bp, Homo sapiens
cagcctcctgagcctgtggg

SEQ ID NO: 346902 - DNA, 20 bp, Homo sapiens
cagcctcctgagtagctgga

SEQ ID NO: 346903 - DNA, 19 bp, Homo sapiens
cagcctcctgtttgcaggc

SEQ ID NO: 346904 - DNA, 17 bp, Homo sapiens
cagcctcgaactcctgg

SEQ ID NO: 346905 - DNA, 23 bp, Homo sapiens
cagcctcgaactcctgggctcaa

SEQ ID NO: 346906 - DNA, 14 bp, Homo sapiens
cagcctctcccggc

SEQ ID NO: 346907 - DNA, 15 bp, Homo sapiens
cagcctctcccggct

SEQ ID NO: 346908 - DNA, 14 bp, Homo sapiens
cagcctctctgcta

SEQ ID NO: 346909 - DNA, 15 bp, Homo sapiens
cagcctctctgctat

SEQ ID NO: 346910 - DNA, 21 bp, Homo sapiens
cagcctctgaagttggacagc

SEQ ID NO: 346911 - DNA, 18 bp, Homo sapiens
cagcctctgagcccctgg

SEQ ID NO: 346912 - DNA, 13 bp, Homo sapiens
cagcctctggcca

SEQ ID NO: 346913 - DNA, 16 bp, Homo sapiens
cagcctctggccagac

SEQ ID NO: 346914 - DNA, 11 bp, Homo sapiens
cagcctcttaa

SEQ ID NO: 346915 - DNA, 22 bp, Homo sapiens
cagcctgacctgagactgtcgg

SEQ ID NO: 346916 - DNA, 20 bp, Homo sapiens
cagcctgagccacagtgggg

SEQ ID NO: 346917 - DNA, 18 bp, Homo sapiens
cagcctgagctccaccct

SEQ ID NO: 346918 - DNA, 10 bp, Homo sapiens
cagcctgagt

SEQ ID NO: 346919 - DNA, 14 bp, Homo sapiens
cagcctgagtctcc

SEQ ID NO: 346920 - DNA, 15 bp, Homo sapiens
cagcctgagtctcct

SEQ ID NO: 346921 - DNA, 17 bp, Homo sapiens
cagcctgagtctcctgt

SEQ ID NO: 346922 - DNA, 20 bp, Homo sapiens
cagcctgagtctcctgtgcc

SEQ ID NO: 346923 - DNA, 23 bp, Homo sapiens
cagcctgcacacacctgcctgca

SEQ ID NO: 346924 - DNA, 20 bp, Homo sapiens
cagcctgccgccgtctctgt

SEQ ID NO: 346925 - DNA, 11 bp, Homo sapiens
cagcctgctga

SEQ ID NO: 346926 - DNA, 13 bp, Homo sapiens
cagcctggagccg

SEQ ID NO: 346927 - DNA, 16 bp, Homo sapiens
cagcctggagccgtgg

SEQ ID NO: 346928 - DNA, 12 bp, Homo sapiens
cagcctggaggc

SEQ ID NO: 346929 - DNA, 17 bp, Homo sapiens
cagcctggccacgcagc

SEQ ID NO: 346930 - DNA, 20 bp, Homo sapiens
cagcctggcctcccctgcgg

SEQ ID NO: 346931 - DNA, 13 bp, Homo sapiens
cagcctggctccc

SEQ ID NO: 346932 - DNA, 17 bp, Homo sapiens
cagcctgggcagccagg

SEQ ID NO: 346933 - DNA, 20 bp, Homo sapiens
cagcctggggcctggcaggg

SEQ ID NO: 346934 - DNA, 18 bp, Homo sapiens
cagcctgggtgacagagc

SEQ ID NO: 346935 - DNA, 19 bp, Homo sapiens
cagcctgggtgacagagcg

SEQ ID NO: 346936 - DNA, 14 bp, Homo sapiens
cagcctggttccct

SEQ ID NO: 346937 - DNA, 22 bp, Homo sapiens
cagcctggttccctctttcctg

SEQ ID NO: 346938 - DNA, 12 bp, Homo sapiens
cagcctgtcagc

SEQ ID NO: 346939 - DNA, 18 bp, Homo sapiens
cagcctgtcctggtacag

SEQ ID NO: 346940 - DNA, 22 bp, Homo sapiens
cagcctgtcctggtacagcagg

SEQ ID NO: 346941 - DNA, 15 bp, Homo sapiens
cagcctgtcttcaga

SEQ ID NO: 346942 - DNA, 23 bp, Homo sapiens
cagcctgtcttcagatcctgctg

SEQ ID NO: 346943 - DNA, 14 bp, Homo sapiens
cagcctgtgaggga

SEQ ID NO: 346944 - DNA, 12 bp, Homo sapiens
cagcctgtggca

SEQ ID NO: 346945 - DNA, 17 bp, Homo sapiens
cagccttactattcata

SEQ ID NO: 346946 - DNA, 17 bp, Homo sapiens
cagccttagctgccagt

SEQ ID NO: 346947 - DNA, 21 bp, Homo sapiens
cagccttagctgccagtgctg

SEQ ID NO: 346948 - DNA, 17 bp, Homo sapiens
cagccttcactggagac

SEQ ID NO: 346949 - DNA, 14 bp, Homo sapiens
cagccttcccctcc

SEQ ID NO: 346950 - DNA, 19 bp, Homo sapiens
cagccttcccctccctgta

SEQ ID NO: 346951 - DNA, 15 bp, Homo sapiens
cagccttcctctgca

SEQ ID NO: 346952 - DNA, 23 bp, Homo sapiens
cagccttcctctgcagctgacct

SEQ ID NO: 346953 - DNA, 14 bp, Homo sapiens
cagccttgggcctt

SEQ ID NO: 346954 - DNA, 12 bp, Homo sapiens
cagcctttctgt

SEQ ID NO: 346955 - DNA, 13 bp, Homo sapiens
cagcctttctgtg

SEQ ID NO: 346956 - DNA, 14 bp, Homo sapiens
cagcctttctgtgg

SEQ ID NO: 346957 - DNA, 13 bp, Homo sapiens
cagcctttcttcc

SEQ ID NO: 346958 - DNA, 16 bp, Homo sapiens
cagcgacagaaaacct

SEQ ID NO: 346959 - DNA, 24 bp, Homo sapiens
cagcgacagaaaacctcaagggct

SEQ ID NO: 346960 - DNA, 14 bp, Homo sapiens
cagcgaggcgaggc

SEQ ID NO: 346961 - DNA, 24 bp, Homo sapiens
cagcgaggcgaggctgcctctggg

SEQ ID NO: 346962 - DNA, 14 bp, Homo sapiens
cagcgcaggccctg

SEQ ID NO: 346963 - DNA, 12 bp, Homo sapiens
cagcgcctcccg

SEQ ID NO: 346964 - DNA, 14 bp, Homo sapiens
cagcgcctcccgcc

SEQ ID NO: 346965 - DNA, 16 bp, Homo sapiens
cagcgcctcctggaca

SEQ ID NO: 346966 - DNA, 20 bp, Homo sapiens
cagcgctccctgtcgcctgc

SEQ ID NO: 346967 - DNA, 13 bp, Homo sapiens
cagcggcccggcc

SEQ ID NO: 346968 - DNA, 23 bp, Homo sapiens
cagcggcccggcccacgcagagc

SEQ ID NO: 346969 - DNA, 17 bp, Homo sapiens
cagcggtggaaggagcc

SEQ ID NO: 346970 - DNA, 19 bp, Homo sapiens
cagcggtggaaggagcctg

SEQ ID NO: 346971 - DNA, 21 bp, Homo sapiens
cagcggtggaaggagcctgcg

SEQ ID NO: 346972 - DNA, 17 bp, Homo sapiens
cagcgtagcctctccgg

SEQ ID NO: 346973 - DNA, 19 bp, Homo sapiens
cagcgtctgagcggccgcc

SEQ ID NO: 346974 - DNA, 20 bp, Homo sapiens
cagcgtctgagcggccgcct

SEQ ID NO: 346975 - DNA, 16 bp, Homo sapiens
cagcgtgaaggacctg

SEQ ID NO: 346976 - DNA, 17 bp, Homo sapiens
cagcgtggcctccgtga

SEQ ID NO: 346977 - DNA, 15 bp, Homo sapiens
cagcgtgtcaacttt

SEQ ID NO: 346978 - DNA, 15 bp, Homo sapiens
cagcgttcttcagga

SEQ ID NO: 346979 - DNA, 20 bp, Homo sapiens
cagcgtttgaggggctggcc

SEQ ID NO: 346980 - DNA, 19 bp, Homo sapiens
cagctaacatggaagtact

SEQ ID NO: 346981 - DNA, 18 bp, Homo sapiens
cagctaagctcaaatgta

SEQ ID NO: 346982 - DNA, 17 bp, Homo sapiens
cagctaaggggcaggaa

SEQ ID NO: 346983 - DNA, 19 bp, Homo sapiens
cagctaatcagcattctca

SEQ ID NO: 346984 - DNA, 12 bp, Homo sapiens
cagctaatctgt

SEQ ID NO: 346985 - DNA, 16 bp, Homo sapiens
cagctaatctgtaggg

SEQ ID NO: 346986 - DNA, 19 bp, Homo sapiens
cagctaatctgtagggctg

SEQ ID NO: 346987 - DNA, 21 bp, Homo sapiens
cagctaatctgtagggctgga

SEQ ID NO: 346988 - DNA, 13 bp, Homo sapiens
cagctacattcct

SEQ ID NO: 346989 - DNA, 17 bp, Homo sapiens
cagctacattcctcagc

SEQ ID NO: 346990 - DNA, 20 bp, Homo sapiens
cagctacattcctcagctgc

SEQ ID NO: 346991 - DNA, 21 bp, Homo sapiens
cagctacattcctcagctgcc

SEQ ID NO: 346992 - DNA, 22 bp, Homo sapiens
cagctaccccttctttgcaggg

SEQ ID NO: 346993 - DNA, 12 bp, Homo sapiens
cagctacctgag

SEQ ID NO: 346994 - DNA, 18 bp, Homo sapiens
cagctactaacctggaga

SEQ ID NO: 346995 - DNA, 17 bp, Homo sapiens
cagctactaatgatgtt

SEQ ID NO: 346996 - DNA, 13 bp, Homo sapiens
cagctactcagga

SEQ ID NO: 346997 - DNA, 14 bp, Homo sapiens
cagctactctgtcc

SEQ ID NO: 346998 - DNA, 22 bp, Homo sapiens
cagctactctgtccaggccact

SEQ ID NO: 346999 - DNA, 23 bp, Homo sapiens
cagctactctgtccaggccactg

SEQ ID NO: 347000 - DNA, 16 bp, Homo sapiens
cagctactgatttttg

SEQ ID NO: 347001 - DNA, 20 bp, Homo sapiens
cagctacttgggagcctgag

SEQ ID NO: 347002 - DNA, 14 bp, Homo sapiens
cagctagactggag

SEQ ID NO: 347003 - DNA, 15 bp, Homo sapiens
cagctagactggagt

SEQ ID NO: 347004 - DNA, 16 bp, Homo sapiens
cagctaggctgagatg

SEQ ID NO: 347005 - DNA, 19 bp, Homo sapiens
cagctaggctgagatgcac

SEQ ID NO: 347006 - DNA, 21 bp, Homo sapiens
cagctaggctgagatgcacca

SEQ ID NO: 347007 - DNA, 16 bp, Homo sapiens
cagctagttaataatt

SEQ ID NO: 347008 - DNA, 15 bp, Homo sapiens
cagctatgggagccc

SEQ ID NO: 347009 - DNA, 18 bp, Homo sapiens
cagctatgggagccccag

SEQ ID NO: 347010 - DNA, 21 bp, Homo sapiens
cagctatgggagccccagggt

SEQ ID NO: 347011 - DNA, 19 bp, Homo sapiens
cagctattaagaaaatcac

SEQ ID NO: 347012 - DNA, 14 bp, Homo sapiens
cagctatttctcat

SEQ ID NO: 347013 - DNA, 16 bp, Homo sapiens
cagctcaaagagtaaa

SEQ ID NO: 347014 - DNA, 16 bp, Homo sapiens
cagctcacccctgggc

SEQ ID NO: 347015 - DNA, 18 bp, Homo sapiens
cagctcacccctgggcag

SEQ ID NO: 347016 - DNA, 22 bp, Homo sapiens
cagctcagcagttcacttccta

SEQ ID NO: 347017 - DNA, 22 bp, Homo sapiens
cagctcagccccggccactccc

SEQ ID NO: 347018 - DNA, 13 bp, Homo sapiens
cagctcaggatct

SEQ ID NO: 347019 - DNA, 17 bp, Homo sapiens
cagctcaggcgcagccc

SEQ ID NO: 347020 - DNA, 19 bp, Homo sapiens
cagctcaggcgcagcccta

SEQ ID NO: 347021 - DNA, 20 bp, Homo sapiens
cagctcaggcgcagccctag

SEQ ID NO: 347022 - DNA, 17 bp, Homo sapiens
cagctcaggggcagctc

SEQ ID NO: 347023 - DNA, 16 bp, Homo sapiens
cagctcagtcttccct

SEQ ID NO: 347024 - DNA, 17 bp, Homo sapiens
cagctcatctccaagga

SEQ ID NO: 347025 - DNA, 19 bp, Homo sapiens
cagctccactcagggctgg

SEQ ID NO: 347026 - DNA, 20 bp, Homo sapiens
cagctccactcagggctggc

SEQ ID NO: 347027 - DNA, 17 bp, Homo sapiens
cagctccactctgaagt

SEQ ID NO: 347028 - DNA, 21 bp, Homo sapiens
cagctcccaacagaggcctcc

SEQ ID NO: 347029 - DNA, 22 bp, Homo sapiens
cagctcccaacagaggcctccc

SEQ ID NO: 347030 - DNA, 13 bp, Homo sapiens
cagctccctagac

SEQ ID NO: 347031 - DNA, 22 bp, Homo sapiens
cagctcccttcccctgcctggt

SEQ ID NO: 347032 - DNA, 19 bp, Homo sapiens
cagctcctctccttgggct

SEQ ID NO: 347033 - DNA, 15 bp, Homo sapiens
cagctccttttctgt

SEQ ID NO: 347034 - DNA, 16 bp, Homo sapiens
cagctccttttctgtg

SEQ ID NO: 347035 - DNA, 20 bp, Homo sapiens
cagctccttttctgtgaagc

SEQ ID NO: 347036 - DNA, 21 bp, Homo sapiens
cagctccttttgtccccaggg

SEQ ID NO: 347037 - DNA, 15 bp, Homo sapiens
cagctctaataaaac

SEQ ID NO: 347038 - DNA, 17 bp, Homo sapiens
cagctctcactggccag

SEQ ID NO: 347039 - DNA, 22 bp, Homo sapiens
cagctctcccacatcccactgg

SEQ ID NO: 347040 - DNA, 18 bp, Homo sapiens
cagctctcccctgcgcag

SEQ ID NO: 347041 - DNA, 19 bp, Homo sapiens
cagctctcccctgcgcagg

SEQ ID NO: 347042 - DNA, 13 bp, Homo sapiens
cagctctctggga

SEQ ID NO: 347043 - DNA, 12 bp, Homo sapiens
cagctctgcccc

SEQ ID NO: 347044 - DNA, 13 bp, Homo sapiens
cagctctgccccc

SEQ ID NO: 347045 - DNA, 13 bp, Homo sapiens
cagctctggctca

SEQ ID NO: 347046 - DNA, 20 bp, Homo sapiens
cagctctggctcacagactg

SEQ ID NO: 347047 - DNA, 22 bp, Homo sapiens
cagctctggctcagggcccacc

SEQ ID NO: 347048 - DNA, 16 bp, Homo sapiens
cagctctgtggcctgt

SEQ ID NO: 347049 - DNA, 24 bp, Homo sapiens
cagctctgtggcctgtgtccagca

SEQ ID NO: 347050 - DNA, 17 bp, Homo sapiens
cagctctgtgttgccat

SEQ ID NO: 347051 - DNA, 21 bp, Homo sapiens
cagctctgtgttgccatgtgt

SEQ ID NO: 347052 - DNA, 17 bp, Homo sapiens
cagctcttctgggcaga

SEQ ID NO: 347053 - DNA, 18 bp, Homo sapiens
cagctcttctgggcagag

SEQ ID NO: 347054 - DNA, 21 bp, Homo sapiens
cagctcttctgggcagagcct

SEQ ID NO: 347055 - DNA, 15 bp, Homo sapiens
cagctcttggcattt

SEQ ID NO: 347056 - DNA, 17 bp, Homo sapiens
cagctctttcctccttc

SEQ ID NO: 347057 - DNA, 21 bp, Homo sapiens
cagctctttcctccttccatg

SEQ ID NO: 347058 - DNA, 12 bp, Homo sapiens
tttctgttctgc

SEQ ID NO: 347059 - DNA, 20 bp, Homo sapiens
tttctgttctgccccctcag

SEQ ID NO: 347060 - DNA, 21 bp, Homo sapiens
tttctgttggttagtagacac

SEQ ID NO: 347061 - DNA, 22 bp, Homo sapiens
tttctgtttctaatttgctgct

SEQ ID NO: 347062 - DNA, 21 bp, Homo sapiens
tttcttcaacatcaatgttca

SEQ ID NO: 347063 - DNA, 18 bp, Homo sapiens
tttcttcatgcaatgaca

SEQ ID NO: 347064 - DNA, 19 bp, Homo sapiens
tttcttcatgcaatgacat

SEQ ID NO: 347065 - DNA, 19 bp, Homo sapiens
tttcttccatcagctctct

SEQ ID NO: 347066 - DNA, 15 bp, Homo sapiens
tttcttcccatttgt

SEQ ID NO: 347067 - DNA, 20 bp, Homo sapiens
tttcttcccatttgtaatgt

SEQ ID NO: 347068 - DNA, 22 bp, Homo sapiens
tttcttcccatttgtaatgtat

SEQ ID NO: 347069 - DNA, 14 bp, Homo sapiens
tttcttccctcatg

SEQ ID NO: 347070 - DNA, 22 bp, Homo sapiens
tttcttcctccagtctgttctc

SEQ ID NO: 347071 - DNA, 11 bp, Homo sapiens
tttcttcctct

SEQ ID NO: 347072 - DNA, 21 bp, Homo sapiens
tttcttctacaaccagagccc

SEQ ID NO: 347073 - DNA, 12 bp, Homo sapiens
tttcttcttccc

SEQ ID NO: 347074 - DNA, 20 bp, Homo sapiens
tttcttgacaaaacctaact

SEQ ID NO: 347075 - DNA, 21 bp, Homo sapiens
tttcttgacaaaacctaactt

SEQ ID NO: 347076 - DNA, 17 bp, Homo sapiens
tttcttgagatctgctg

SEQ ID NO: 347077 - DNA, 17 bp, Homo sapiens
tttcttgcactattcca

SEQ ID NO: 347078 - DNA, 21 bp, Homo sapiens
tttcttgctggttgtcatttt

SEQ ID NO: 347079 - DNA, 17 bp, Homo sapiens
tttcttgcttcaaaaat

SEQ ID NO: 347080 - DNA, 23 bp, Homo sapiens
tttcttggacacttaattctgtt

SEQ ID NO: 347081 - DNA, 19 bp, Homo sapiens
tttcttggcctcaagttca

SEQ ID NO: 347082 - DNA, 17 bp, Homo sapiens
tttcttggtatgatcat

SEQ ID NO: 347083 - DNA, 19 bp, Homo sapiens
tttcttgtgtgtttattgt

SEQ ID NO: 347084 - DNA, 16 bp, Homo sapiens
tttctttgctgtgcca

SEQ ID NO: 347085 - DNA, 16 bp, Homo sapiens
tttctttgttatcaaa

SEQ ID NO: 347086 - DNA, 16 bp, Homo sapiens
tttcttttatatataa

SEQ ID NO: 347087 - DNA, 18 bp, Homo sapiens
tttctttttattttaaat

SEQ ID NO: 347088 - DNA, 14 bp, Homo sapiens
tttctttttcttct

SEQ ID NO: 347089 - DNA, 16 bp, Homo sapiens
tttcttttttaaatta

SEQ ID NO: 347090 - DNA, 20 bp, Homo sapiens
tttgaaaaagcagacagaag

SEQ ID NO: 347091 - DNA, 19 bp, Homo sapiens
tttgaaaaattacagcttc

SEQ ID NO: 347092 - DNA, 17 bp, Homo sapiens
tttgaaaatatttctat

SEQ ID NO: 347093 - DNA, 18 bp, Homo sapiens
tttgaaaatatttctatg

SEQ ID NO: 347094 - DNA, 17 bp, Homo sapiens
tttgaaaattttacttc

SEQ ID NO: 347095 - DNA, 24 bp, Homo sapiens
tttgaaacaactttctcttgtaaa

SEQ ID NO: 347096 - DNA, 20 bp, Homo sapiens
tttgaaactgctaattacac

SEQ ID NO: 347097 - DNA, 19 bp, Homo sapiens
tttgaaagaaggaagactt

SEQ ID NO: 347098 - DNA, 21 bp, Homo sapiens
tttgaaagtgtttttctttaa

SEQ ID NO: 347099 - DNA, 20 bp, Homo sapiens
tttgaaatagtctgtgtgaa

SEQ ID NO: 347100 - DNA, 14 bp, Homo sapiens
tttgaactcttcaa

SEQ ID NO: 347101 - DNA, 19 bp, Homo sapiens
tttgaactgttagatgctg

SEQ ID NO: 347102 - DNA, 20 bp, Homo sapiens
tttgaactgttagatgctga

SEQ ID NO: 347103 - DNA, 18 bp, Homo sapiens
tttgaagaattaatgaca

SEQ ID NO: 347104 - DNA, 23 bp, Homo sapiens
tttgaagtagtttgtataacttc

SEQ ID NO: 347105 - DNA, 22 bp, Homo sapiens
tttgaataccattaaaactgct

SEQ ID NO: 347106 - DNA, 23 bp, Homo sapiens
tttgaataccattaaaactgctt

SEQ ID NO: 347107 - DNA, 14 bp, Homo sapiens
tttgaatgaaaaat

SEQ ID NO: 347108 - DNA, 21 bp, Homo sapiens
tttgaatggattaaatggcac

SEQ ID NO: 347109 - DNA, 15 bp, Homo sapiens
tttgaatttaaataa

SEQ ID NO: 347110 - DNA, 16 bp, Homo sapiens
tttgaatttaaataaa

SEQ ID NO: 347111 - DNA, 23 bp, Homo sapiens
tttgacacaatgttgcactgaaa

SEQ ID NO: 347112 - DNA, 18 bp, Homo sapiens
tttgacataatgagtaat

SEQ ID NO: 347113 - DNA, 14 bp, Homo sapiens
tttgaccagaaaat

SEQ ID NO: 347114 - DNA, 16 bp, Homo sapiens
tttgacgaagaaacaa

SEQ ID NO: 347115 - DNA, 19 bp, Homo sapiens
tttgacgaagaaacaaaaa

SEQ ID NO: 347116 - DNA, 17 bp, Homo sapiens
tttgactttcttctgaa

SEQ ID NO: 347117 - DNA, 10 bp, Homo sapiens
tttgagaaaa

SEQ ID NO: 347118 - DNA, 14 bp, Homo sapiens
tttgagaaagaaat

SEQ ID NO: 347119 - DNA, 16 bp, Homo sapiens
tttgagacaagccctg

SEQ ID NO: 347120 - DNA, 18 bp, Homo sapiens
tttgagacaagccctggc

SEQ ID NO: 347121 - DNA, 21 bp, Homo sapiens
tttgagcgcagagtaaaataa

SEQ ID NO: 347122 - DNA, 11 bp, Homo sapiens
tttgaggggct

SEQ ID NO: 347123 - DNA, 20 bp, Homo sapiens
tttgaggtcaagtaagaaga

SEQ ID NO: 347124 - DNA, 12 bp, Homo sapiens
tttgaggtcttt

SEQ ID NO: 347125 - DNA, 15 bp, Homo sapiens
tttgagtaattttct

SEQ ID NO: 347126 - DNA, 16 bp, Homo sapiens
tttgagtgattatttg

SEQ ID NO: 347127 - DNA, 13 bp, Homo sapiens
tttgagttctaca

SEQ ID NO: 347128 - DNA, 15 bp, Homo sapiens
tttgagtttgacatt

SEQ ID NO: 347129 - DNA, 17 bp, Homo sapiens
tttgagtttgacattta

SEQ ID NO: 347130 - DNA, 23 bp, Homo sapiens
tttgataagatgaggaaataatg

SEQ ID NO: 347131 - DNA, 23 bp, Homo sapiens
tttgataatagataactgctctt

SEQ ID NO: 347132 - DNA, 13 bp, Homo sapiens
tttgatacattta

SEQ ID NO: 347133 - DNA, 14 bp, Homo sapiens
tttgatacatttat

SEQ ID NO: 347134 - DNA, 16 bp, Homo sapiens
tttgatacatttatct

SEQ ID NO: 347135 - DNA, 17 bp, Homo sapiens
tttgatacatttatctt

SEQ ID NO: 347136 - DNA, 16 bp, Homo sapiens
tttgatagtgcttctt

SEQ ID NO: 347137 - DNA, 22 bp, Homo sapiens
tttgatatgattgtaacatatt

SEQ ID NO: 347138 - DNA, 13 bp, Homo sapiens
tttgatctggtgc

SEQ ID NO: 347139 - DNA, 21 bp, Homo sapiens
tttgatctggtgcgtgtggcc

SEQ ID NO: 347140 - DNA, 15 bp, Homo sapiens
tttgatcttcaggat

SEQ ID NO: 347141 - DNA, 16 bp, Homo sapiens
tttgatgaaagctgat

SEQ ID NO: 347142 - DNA, 14 bp, Homo sapiens
tttgatgagaaaaa

SEQ ID NO: 347143 - DNA, 21 bp, Homo sapiens
tttgatggtgaatattacatt

SEQ ID NO: 347144 - DNA, 15 bp, Homo sapiens
tttgatgtcagcctt

SEQ ID NO: 347145 - DNA, 21 bp, Homo sapiens
tttgatgtgcgtgctgtctgt

SEQ ID NO: 347146 - DNA, 15 bp, Homo sapiens
tttgatgtgtttttg

SEQ ID NO: 347147 - DNA, 22 bp, Homo sapiens
tttgatgttctttcaccctttt

SEQ ID NO: 347148 - DNA, 14 bp, Homo sapiens
tttgatttcattaa

SEQ ID NO: 347149 - DNA, 20 bp, Homo sapiens
tttgattttaaaaagaagaa

SEQ ID NO: 347150 - DNA, 20 bp, Homo sapiens
tttgattttttgctgcagac

SEQ ID NO: 347151 - DNA, 12 bp, Homo sapiens
tttgcaaaattt

SEQ ID NO: 347152 - DNA, 20 bp, Homo sapiens
tttgcaagggaatgaatcca

SEQ ID NO: 347153 - DNA, 21 bp, Homo sapiens
tttgcaagggaatgaatccat

SEQ ID NO: 347154 - DNA, 19 bp, Homo sapiens
tttgcaatcttatgttgat

SEQ ID NO: 347155 - DNA, 21 bp, Homo sapiens
tttgcacatatattttttaca

SEQ ID NO: 347156 - DNA, 22 bp, Homo sapiens
tttgcacgaattttaaaacatg

SEQ ID NO: 347157 - DNA, 14 bp, Homo sapiens
tttgcactgagggc

SEQ ID NO: 347158 - DNA, 16 bp, Homo sapiens
tttgcactgagggcca

SEQ ID NO: 347159 - DNA, 17 bp, Homo sapiens
tttgcactgagggccac

SEQ ID NO: 347160 - DNA, 18 bp, Homo sapiens
tttgcagccaaggtgcta

SEQ ID NO: 347161 - DNA, 16 bp, Homo sapiens
tttgcaggctctgggc

SEQ ID NO: 347162 - DNA, 21 bp, Homo sapiens
tttgcagtagagtcatctcca

SEQ ID NO: 347163 - DNA, 22 bp, Homo sapiens
tttgcagttggactctcaggga

SEQ ID NO: 347164 - DNA, 16 bp, Homo sapiens
tttgcataatactaat

SEQ ID NO: 347165 - DNA, 17 bp, Homo sapiens
tttgcatattctattgt

SEQ ID NO: 347166 - DNA, 21 bp, Homo sapiens
tttgcatcccccaaacttctt

SEQ ID NO: 347167 - DNA, 23 bp, Homo sapiens
tttgcatcccccaaacttcttgt

SEQ ID NO: 347168 - DNA, 22 bp, Homo sapiens
tttgcatgttcttgttttgtta

SEQ ID NO: 347169 - DNA, 13 bp, Homo sapiens
tttgcatttttgt

SEQ ID NO: 347170 - DNA, 16 bp, Homo sapiens
tttgccacctttcctg

SEQ ID NO: 347171 - DNA, 20 bp, Homo sapiens
tttgccacctttcctgttca

SEQ ID NO: 347172 - DNA, 15 bp, Homo sapiens
tttgccactgcaaac

SEQ ID NO: 347173 - DNA, 16 bp, Homo sapiens
tttgccagacttaaat

SEQ ID NO: 347174 - DNA, 10 bp, Homo sapiens
tttgccagca

SEQ ID NO: 347175 - DNA, 22 bp, Homo sapiens
tttgccatgacaacttctaatt

SEQ ID NO: 347176 - DNA, 16 bp, Homo sapiens
tttgcccaacctcagc

SEQ ID NO: 347177 - DNA, 21 bp, Homo sapiens
tttgcccagggtcctgtgcct

SEQ ID NO: 347178 - DNA, 13 bp, Homo sapiens
ccagcattccagc

SEQ ID NO: 347179 - DNA, 20 bp, Homo sapiens
ccagcattccagctctgccc

SEQ ID NO: 347180 - DNA, 21 bp, Homo sapiens
ccagcattccagctctgcccc

SEQ ID NO: 347181 - DNA, 16 bp, Homo sapiens
tctcccacccggccac

SEQ ID NO: 347182 - DNA, 20 bp, Homo sapiens
tctcccacccggccacagct

SEQ ID NO: 347183 - DNA, 23 bp, Homo sapiens
tctcccacccggccacagctgct

SEQ ID NO: 347184 - DNA, 15 bp, Homo sapiens
tctcccagacttgtt

SEQ ID NO: 347185 - DNA, 17 bp, Homo sapiens
tctcccagacttgtttc

SEQ ID NO: 347186 - DNA, 22 bp, Homo sapiens
tctcccagacttgtttcctgtg

SEQ ID NO: 347187 - DNA, 14 bp, Homo sapiens
tctcccagaggctc

SEQ ID NO: 347188 - DNA, 18 bp, Homo sapiens
tctcccagaggctcctgg

SEQ ID NO: 347189 - DNA, 22 bp, Homo sapiens
tctcccagaggctcctggagcc

SEQ ID NO: 347190 - DNA, 12 bp, Homo sapiens
tctcccagcaca

SEQ ID NO: 347191 - DNA, 13 bp, Homo sapiens
tctcccaggcccg

SEQ ID NO: 347192 - DNA, 11 bp, Homo sapiens
tctcccagttg

SEQ ID NO: 347193 - DNA, 13 bp, Homo sapiens
tctcccagttgtc

SEQ ID NO: 347194 - DNA, 19 bp, Homo sapiens
tctcccatgggggctccag

SEQ ID NO: 347195 - DNA, 11 bp, Homo sapiens
tctccccacac

SEQ ID NO: 347196 - DNA, 13 bp, Homo sapiens
tctccccacacta

SEQ ID NO: 347197 - DNA, 22 bp, Homo sapiens
tctccccacactaacctgggtt

SEQ ID NO: 347198 - DNA, 19 bp, Homo sapiens
tctccccaggcctccagcc

SEQ ID NO: 347199 - DNA, 10 bp, Homo sapiens
tctccccagt

SEQ ID NO: 347200 - DNA, 14 bp, Homo sapiens
tctccccagtgcct

SEQ ID NO: 347201 - DNA, 17 bp, Homo sapiens
tctccccatatataaat

SEQ ID NO: 347202 - DNA, 16 bp, Homo sapiens
tctccccgctctggat

SEQ ID NO: 347203 - DNA, 22 bp, Homo sapiens
tctccccgctctggatcctgca

SEQ ID NO: 347204 - DNA, 23 bp, Homo sapiens
tctcccctaccaggctgtaaatg

SEQ ID NO: 347205 - DNA, 13 bp, Homo sapiens
tctcccctgcact

SEQ ID NO: 347206 - DNA, 15 bp, Homo sapiens
tctcccctgcactgt

SEQ ID NO: 347207 - DNA, 14 bp, Homo sapiens
tctcccctgccccg

SEQ ID NO: 347208 - DNA, 15 bp, Homo sapiens
tctcccctgccccgt

SEQ ID NO: 347209 - DNA, 12 bp, Homo sapiens
tctccccttttc

SEQ ID NO: 347210 - DNA, 16 bp, Homo sapiens
tctcccgaatcctgag

SEQ ID NO: 347211 - DNA, 15 bp, Homo sapiens
tctcccgctgctgct

SEQ ID NO: 347212 - DNA, 16 bp, Homo sapiens
tctcccgctgctgctg

SEQ ID NO: 347213 - DNA, 15 bp, Homo sapiens
tctcccggctgcctg

SEQ ID NO: 347214 - DNA, 16 bp, Homo sapiens
tctcccggctgcctgc

SEQ ID NO: 347215 - DNA, 15 bp, Homo sapiens
tctccctaccctctt

SEQ ID NO: 347216 - DNA, 21 bp, Homo sapiens
tctccctataatgctggagcg

SEQ ID NO: 347217 - DNA, 19 bp, Homo sapiens
tctcggagtatctgggaac

SEQ ID NO: 347218 - DNA, 20 bp, Homo sapiens
tctcggggcccttggggcct

SEQ ID NO: 347219 - DNA, 12 bp, Homo sapiens
tctcgtgaccca

SEQ ID NO: 347220 - DNA, 19 bp, Homo sapiens
tctcgtggtagaagccagt

SEQ ID NO: 347221 - DNA, 17 bp, Homo sapiens
tctctaaaattctagtc

SEQ ID NO: 347222 - DNA, 23 bp, Homo sapiens
tctctaaaattctagtctctgat

SEQ ID NO: 347223 - DNA, 23 bp, Homo sapiens
tctctaaagcactaccgattctt

SEQ ID NO: 347224 - DNA, 20 bp, Homo sapiens
tctctaatagaagtccatga

SEQ ID NO: 347225 - DNA, 11 bp, Homo sapiens
tctctaatatg

SEQ ID NO: 347226 - DNA, 17 bp, Homo sapiens
tctctactaccacaagg

SEQ ID NO: 347227 - DNA, 22 bp, Homo sapiens
tctctagaattttaagtgcttt

SEQ ID NO: 347228 - DNA, 20 bp, Homo sapiens
tctctagggaaggccacctg

SEQ ID NO: 347229 - DNA, 17 bp, Homo sapiens
tctctagttccctcagt

SEQ ID NO: 347230 - DNA, 17 bp, Homo sapiens
tctctattggaggtgag

SEQ ID NO: 347231 - DNA, 14 bp, Homo sapiens
tctctcaaaatgtg

SEQ ID NO: 347232 - DNA, 16 bp, Homo sapiens
tctctcacctacttcc

SEQ ID NO: 347233 - DNA, 18 bp, Homo sapiens
tctctcacctagaccttg

SEQ ID NO: 347234 - DNA, 17 bp, Homo sapiens
tctctcaggagcacagg

SEQ ID NO: 347235 - DNA, 21 bp, Homo sapiens
tctctcaggagcacaggcagc

SEQ ID NO: 347236 - DNA, 16 bp, Homo sapiens
tctctcaggagtatct

SEQ ID NO: 347237 - DNA, 17 bp, Homo sapiens
tctctcaggagtatctt

SEQ ID NO: 347238 - DNA, 12 bp, Homo sapiens
tctctcatgtgg

SEQ ID NO: 347239 - DNA, 14 bp, Homo sapiens
tctctcccaccccg

SEQ ID NO: 347240 - DNA, 20 bp, Homo sapiens
tctctccccaatgctctcct

SEQ ID NO: 347241 - DNA, 20 bp, Homo sapiens
tctctccccatatataaatt

SEQ ID NO: 347242 - DNA, 23 bp, Homo sapiens
tctctccccatatataaattatt

SEQ ID NO: 347243 - DNA, 13 bp, Homo sapiens
tctctccctccac

SEQ ID NO: 347244 - DNA, 16 bp, Homo sapiens
tctctccctccactcc

SEQ ID NO: 347245 - DNA, 21 bp, Homo sapiens
tctctccctccactcctccca

SEQ ID NO: 347246 - DNA, 12 bp, Homo sapiens
tctctccctgcc

SEQ ID NO: 347247 - DNA, 13 bp, Homo sapiens
tctctccctgcct

SEQ ID NO: 347248 - DNA, 13 bp, Homo sapiens
tctctcccttctt

SEQ ID NO: 347249 - DNA, 17 bp, Homo sapiens
tctctcctctctctccc

SEQ ID NO: 347250 - DNA, 22 bp, Homo sapiens
tctctcctgtataaccccacct

SEQ ID NO: 347251 - DNA, 22 bp, Homo sapiens
tctctcctttctttttcttctt

SEQ ID NO: 347252 - DNA, 14 bp, Homo sapiens
tctctcctttgctg

SEQ ID NO: 347253 - DNA, 14 bp, Homo sapiens
tctctctaaaaata

SEQ ID NO: 347254 - DNA, 16 bp, Homo sapiens
tctctctaacataaca

SEQ ID NO: 347255 - DNA, 17 bp, Homo sapiens
tctctctaacataacaa

SEQ ID NO: 347256 - DNA, 10 bp, Homo sapiens
tctctctctc

SEQ ID NO: 347257 - DNA, 16 bp, Homo sapiens
tctctctctctcaaaa

SEQ ID NO: 347258 - DNA, 16 bp, Homo sapiens
tctctctctctctctg

SEQ ID NO: 347259 - DNA, 14 bp, Homo sapiens
tctctctctctctg

SEQ ID NO: 347260 - DNA, 15 bp, Homo sapiens
tctctctctctgttc

SEQ ID NO: 347261 - DNA, 12 bp, Homo sapiens
tctctctctgtt

SEQ ID NO: 347262 - DNA, 15 bp, Homo sapiens
tctctctctgttcca

SEQ ID NO: 347263 - DNA, 15 bp, Homo sapiens
tctctctctttttct

SEQ ID NO: 347264 - DNA, 11 bp, Homo sapiens
tctctctgggc

SEQ ID NO: 347265 - DNA, 17 bp, Homo sapiens
tctctctgggcccaggg

SEQ ID NO: 347266 - DNA, 12 bp, Homo sapiens
tctctctgtgaa

SEQ ID NO: 347267 - DNA, 14 bp, Homo sapiens
tctctctgtgaata

SEQ ID NO: 347268 - DNA, 20 bp, Homo sapiens
tctctctgtgaatacaatta

SEQ ID NO: 347269 - DNA, 13 bp, Homo sapiens
tctctctgtgtgg

SEQ ID NO: 347270 - DNA, 16 bp, Homo sapiens
tctctctgtgtggcaa

SEQ ID NO: 347271 - DNA, 17 bp, Homo sapiens
tctctctgtgtggcaaa

SEQ ID NO: 347272 - DNA, 11 bp, Homo sapiens
tctctcttctg

SEQ ID NO: 347273 - DNA, 14 bp, Homo sapiens
tctctcttctgctc

SEQ ID NO: 347274 - DNA, 16 bp, Homo sapiens
tctctcttctgctcca

SEQ ID NO: 347275 - DNA, 14 bp, Homo sapiens
tctctcttggtctc

SEQ ID NO: 347276 - DNA, 17 bp, Homo sapiens
tctctcttggtctcttt

SEQ ID NO: 347277 - DNA, 22 bp, Homo sapiens
tctctcttggtctctttctttc

SEQ ID NO: 347278 - DNA, 14 bp, Homo sapiens
tctctctttttctt

SEQ ID NO: 347279 - DNA, 14 bp, Homo sapiens
tctctgaagcatgt

SEQ ID NO: 347280 - DNA, 19 bp, Homo sapiens
tctctgaagcatgtttcat

SEQ ID NO: 347281 - DNA, 14 bp, Homo sapiens
tctctgagccccct

SEQ ID NO: 347282 - DNA, 20 bp, Homo sapiens
tctctgagccccctgtgccc

SEQ ID NO: 347283 - DNA, 22 bp, Homo sapiens
tctctgagccccctgtgcccac

SEQ ID NO: 347284 - DNA, 24 bp, Homo sapiens
tctctgagccccctgtgcccaccc

SEQ ID NO: 347285 - DNA, 19 bp, Homo sapiens
tctctgagctccagtggaa

SEQ ID NO: 347286 - DNA, 16 bp, Homo sapiens
tctctgagctttgtta

SEQ ID NO: 347287 - DNA, 14 bp, Homo sapiens
tctctgatcttgtg

SEQ ID NO: 347288 - DNA, 19 bp, Homo sapiens
tctctgatcttgtgctcag

SEQ ID NO: 347289 - DNA, 23 bp, Homo sapiens
tctctgatcttgtgctcagcatg

SEQ ID NO: 347290 - DNA, 13 bp, Homo sapiens
tctctgccaccca

SEQ ID NO: 347291 - DNA, 14 bp, Homo sapiens
tctctgccacccac

SEQ ID NO: 347292 - DNA, 14 bp, Homo sapiens
tctctgccagctcc

SEQ ID NO: 347293 - DNA, 14 bp, Homo sapiens
tctctgccagtgac

SEQ ID NO: 347294 - DNA, 16 bp, Homo sapiens
tctctgccatgtggca

SEQ ID NO: 347295 - DNA, 18 bp, Homo sapiens
tctctgccatgtggcaga

SEQ ID NO: 347296 - DNA, 19 bp, Homo sapiens
tctctgccggctctttcct

SEQ ID NO: 347297 - DNA, 17 bp, Homo sapiens
tctctgctccaccacat

SEQ ID NO: 347298 - DNA, 14 bp, Homo sapiens
tctctgctcctcac

SEQ ID NO: 347299 - DNA, 17 bp, Homo sapiens
tctctgctctagccagg

SEQ ID NO: 347300 - DNA, 13 bp, Homo sapiens
tctctgctgaagg

SEQ ID NO: 347301 - DNA, 14 bp, Homo sapiens
tctctgctggccca

SEQ ID NO: 347302 - DNA, 15 bp, Homo sapiens
tctctgctggcccag

SEQ ID NO: 347303 - DNA, 11 bp, Homo sapiens
tctctgcttca

SEQ ID NO: 347304 - DNA, 14 bp, Homo sapiens
tctctgcttcagct

SEQ ID NO: 347305 - DNA, 12 bp, Homo sapiens
tctctgcttcca

SEQ ID NO: 347306 - DNA, 16 bp, Homo sapiens
tctctggccactctgc

SEQ ID NO: 347307 - DNA, 16 bp, Homo sapiens
tctctgggcccagaga

SEQ ID NO: 347308 - DNA, 21 bp, Homo sapiens
tctctgggcttggggcttcct

SEQ ID NO: 347309 - DNA, 21 bp, Homo sapiens
tctctgggtttacaacaaaca

SEQ ID NO: 347310 - DNA, 22 bp, Homo sapiens
tctctgggtttacaacaaacac

SEQ ID NO: 347311 - DNA, 20 bp, Homo sapiens
tctctgtaaaaagcaggtga

SEQ ID NO: 347312 - DNA, 19 bp, Homo sapiens
tctctgtagggaactctgg

SEQ ID NO: 347313 - DNA, 14 bp, Homo sapiens
tctctgtcttctct

SEQ ID NO: 347314 - DNA, 14 bp, Homo sapiens
tctctgtgaataca

SEQ ID NO: 347315 - DNA, 18 bp, Homo sapiens
tctctgtgaatacaatta

SEQ ID NO: 347316 - DNA, 19 bp, Homo sapiens
tctctgtgcttcaattaat

SEQ ID NO: 347317 - DNA, 15 bp, Homo sapiens
tctctgtgtggcaaa

SEQ ID NO: 347318 - DNA, 19 bp, Homo sapiens
tctctgtgtggcaaacatt

SEQ ID NO: 347319 - DNA, 21 bp, Homo sapiens
tctctgtgtggcaaacattta

SEQ ID NO: 347320 - DNA, 21 bp, Homo sapiens
tctctgttcagatgtgcattt

SEQ ID NO: 347321 - DNA, 22 bp, Homo sapiens
tctctgttccaagtgtgtgtgc

SEQ ID NO: 347322 - DNA, 17 bp, Homo sapiens
tctctgtttaccctccc

SEQ ID NO: 347323 - DNA, 20 bp, Homo sapiens
tctcttaccccgtccctttc

SEQ ID NO: 347324 - DNA, 21 bp, Homo sapiens
tctcttaccccgtccctttcc

SEQ ID NO: 347325 - DNA, 15 bp, Homo sapiens
tctcttagaaatact

SEQ ID NO: 347326 - DNA, 16 bp, Homo sapiens
tctcttaggtctaatg

SEQ ID NO: 347327 - DNA, 14 bp, Homo sapiens
tctcttattctaat

SEQ ID NO: 347328 - DNA, 15 bp, Homo sapiens
tctcttattctaata

SEQ ID NO: 347329 - DNA, 15 bp, Homo sapiens
tctcttcaggttctt

SEQ ID NO: 347330 - DNA, 17 bp, Homo sapiens
tctcttcagtgtgttga

SEQ ID NO: 347331 - DNA, 22 bp, Homo sapiens
tctcttccagaagatgccctcc

SEQ ID NO: 347332 - DNA, 23 bp, Homo sapiens
tctcttccagaagatgccctcca

SEQ ID NO: 347333 - DNA, 11 bp, Homo sapiens
tctcttcctac

SEQ ID NO: 347334 - DNA, 14 bp, Homo sapiens
tctcttctccactg

SEQ ID NO: 347335 - DNA, 14 bp, Homo sapiens
tctcttctgctcca

SEQ ID NO: 347336 - DNA, 17 bp, Homo sapiens
tctcttctgctccaccc

SEQ ID NO: 347337 - DNA, 13 bp, Homo sapiens
tctcttctgtcca

SEQ ID NO: 347338 - DNA, 16 bp, Homo sapiens
tctcttgattcataat

SEQ ID NO: 347339 - DNA, 20 bp, Homo sapiens
tctcttgattgatttttaaa

SEQ ID NO: 347340 - DNA, 22 bp, Homo sapiens
tctcttgcctaagtattccttt

SEQ ID NO: 347341 - DNA, 13 bp, Homo sapiens
tctcttggtctct

SEQ ID NO: 347342 - DNA, 16 bp, Homo sapiens
tctcttggtctctttc

SEQ ID NO: 347343 - DNA, 17 bp, Homo sapiens
tctcttggtctctttct

SEQ ID NO: 347344 - DNA, 20 bp, Homo sapiens
tctctttctccgtatttatt

SEQ ID NO: 347345 - DNA, 13 bp, Homo sapiens
tctctttctttcc

SEQ ID NO: 347346 - DNA, 19 bp, Homo sapiens
tctctttgaaaattcttgt

SEQ ID NO: 347347 - DNA, 13 bp, Homo sapiens
tctctttgtaagg

SEQ ID NO: 347348 - DNA, 20 bp, Homo sapiens
tctctttgtggggcttggcg

SEQ ID NO: 347349 - DNA, 21 bp, Homo sapiens
tctctttgtggggcttggcgt

SEQ ID NO: 347350 - DNA, 17 bp, Homo sapiens
tctcttttcctcgcaga

SEQ ID NO: 347351 - DNA, 21 bp, Homo sapiens
tctcttttcctgttgtattga

SEQ ID NO: 347352 - DNA, 14 bp, Homo sapiens
tctctttttcttcc

SEQ ID NO: 347353 - DNA, 23 bp, Homo sapiens
tctctttttcttgtaaacctgga

SEQ ID NO: 347354 - DNA, 20 bp, Homo sapiens
tctctttttggaggtgctta

SEQ ID NO: 347355 - DNA, 22 bp, Homo sapiens
tctctttttttaaaaagttgat

SEQ ID NO: 347356 - DNA, 24 bp, Homo sapiens
tctctttttttaaaaagttgatag

SEQ ID NO: 347357 - DNA, 13 bp, Homo sapiens
tctgaaaactgtt

SEQ ID NO: 347358 - DNA, 15 bp, Homo sapiens
tctgaaaactgttta

SEQ ID NO: 347359 - DNA, 11 bp, Homo sapiens
tctgaaaagaa

SEQ ID NO: 347360 - DNA, 17 bp, Homo sapiens
tctgaaaagaaatgcta

SEQ ID NO: 347361 - DNA, 18 bp, Homo sapiens
tctgaaaagaaatgctaa

SEQ ID NO: 347362 - DNA, 13 bp, Homo sapiens
tctgaaaatattt

SEQ ID NO: 347363 - DNA, 14 bp, Homo sapiens
tctgaaaatatttt

SEQ ID NO: 347364 - DNA, 22 bp, Homo sapiens
tctgaaaatatttttttctagc

SEQ ID NO: 347365 - DNA, 22 bp, Homo sapiens
tctgaaaattccagaaaggata

SEQ ID NO: 347366 - DNA, 23 bp, Homo sapiens
tctgaaaattccagaaaggatat

SEQ ID NO: 347367 - DNA, 20 bp, Homo sapiens
tctgaaacttcccaacttcc

SEQ ID NO: 347368 - DNA, 22 bp, Homo sapiens
tctgaaaggaaaagtctttgct

SEQ ID NO: 347369 - DNA, 18 bp, Homo sapiens
tctgaaatacctttgcct

SEQ ID NO: 347370 - DNA, 16 bp, Homo sapiens
tctgaaatttcccaca

SEQ ID NO: 347371 - DNA, 22 bp, Homo sapiens
tctgaacacagtttagtgcttt

SEQ ID NO: 347372 - DNA, 15 bp, Homo sapiens
tctgaacacgaagct

SEQ ID NO: 347373 - DNA, 14 bp, Homo sapiens
tctgaactctcaaa

SEQ ID NO: 347374 - DNA, 14 bp, Homo sapiens
tctgaactgctgct

SEQ ID NO: 347375 - DNA, 16 bp, Homo sapiens
tctgaactgctgctgg

SEQ ID NO: 347376 - DNA, 17 bp, Homo sapiens
tctgaactgctgctggt

SEQ ID NO: 347377 - DNA, 15 bp, Homo sapiens
tctgaacttcagcta

SEQ ID NO: 347378 - DNA, 15 bp, Homo sapiens
tctgaactttggaag

SEQ ID NO: 347379 - DNA, 20 bp, Homo sapiens
tctgaactttgtttccagaa

SEQ ID NO: 347380 - DNA, 13 bp, Homo sapiens
tctgaagagctga

SEQ ID NO: 347381 - DNA, 13 bp, Homo sapiens
tctgaagatctca

SEQ ID NO: 347382 - DNA, 15 bp, Homo sapiens
tctgaagatctcaga

SEQ ID NO: 347383 - DNA, 15 bp, Homo sapiens
tctgaagcatgtttc

SEQ ID NO: 347384 - DNA, 21 bp, Homo sapiens
tctgaagcatgtttcatgttt

SEQ ID NO: 347385 - DNA, 14 bp, Homo sapiens
tctgaaggagagga

SEQ ID NO: 347386 - DNA, 15 bp, Homo sapiens
tctgaaggagaggag

SEQ ID NO: 347387 - DNA, 17 bp, Homo sapiens
tctgaaggccttgttaa

SEQ ID NO: 347388 - DNA, 18 bp, Homo sapiens
tctgaaggtaatactata

SEQ ID NO: 347389 - DNA, 16 bp, Homo sapiens
tctgaagtcactgcac

SEQ ID NO: 347390 - DNA, 21 bp, Homo sapiens
tctgaagtcccttcctgtcct

SEQ ID NO: 347391 - DNA, 17 bp, Homo sapiens
tctgaatacctctttga

SEQ ID NO: 347392 - DNA, 19 bp, Homo sapiens
tctgaatattaagaaacaa

SEQ ID NO: 347393 - DNA, 13 bp, Homo sapiens
tctgaatcctaag

SEQ ID NO: 347394 - DNA, 17 bp, Homo sapiens
tctgaatctctcaaaat

SEQ ID NO: 347395 - DNA, 16 bp, Homo sapiens
tctgaatgctgctact

SEQ ID NO: 347396 - DNA, 17 bp, Homo sapiens
tctgaatgctgctactt

SEQ ID NO: 347397 - DNA, 16 bp, Homo sapiens
tctgaatgggagccag

SEQ ID NO: 347398 - DNA, 13 bp, Homo sapiens
tctgaatgttctg

SEQ ID NO: 347399 - DNA, 14 bp, Homo sapiens
tctgaatgttctga

SEQ ID NO: 347400 - DNA, 17 bp, Homo sapiens
tctgaatgttctgacat

SEQ ID NO: 347401 - DNA, 22 bp, Homo sapiens
tctgaatgttctgacattaaca

SEQ ID NO: 347402 - DNA, 18 bp, Homo sapiens
tctgaattgttgaaacta

SEQ ID NO: 347403 - DNA, 16 bp, Homo sapiens
tctgacaaagtcatga

SEQ ID NO: 347404 - DNA, 19 bp, Homo sapiens
tctgacaatgcgtggcaca

SEQ ID NO: 347405 - DNA, 13 bp, Homo sapiens
tctgacacaaaaa

SEQ ID NO: 347406 - DNA, 14 bp, Homo sapiens
tctgacacaaaaaa

SEQ ID NO: 347407 - DNA, 16 bp, Homo sapiens
tctgacagcagcctgt

SEQ ID NO: 347408 - DNA, 22 bp, Homo sapiens
tctgacagttactcttcagttt

SEQ ID NO: 347409 - DNA, 18 bp, Homo sapiens
tctgacatgattccttcc

SEQ ID NO: 347410 - DNA, 19 bp, Homo sapiens
tctgacatgattccttcct

SEQ ID NO: 347411 - DNA, 22 bp, Homo sapiens
tctgacatgattccttcctgtt

SEQ ID NO: 347412 - DNA, 13 bp, Homo sapiens
tctgaccacactt

SEQ ID NO: 347413 - DNA, 22 bp, Homo sapiens
tctgacccaagtggggcctcct

SEQ ID NO: 347414 - DNA, 15 bp, Homo sapiens
tctgacccagtgaga

SEQ ID NO: 347415 - DNA, 21 bp, Homo sapiens
tctgacccagtgagattacag

SEQ ID NO: 347416 - DNA, 18 bp, Homo sapiens
tctgaccccacttatgct

SEQ ID NO: 347417 - DNA, 12 bp, Homo sapiens
tctgacctcagc

SEQ ID NO: 347418 - DNA, 16 bp, Homo sapiens
tctgacctgcccccgc

SEQ ID NO: 347419 - DNA, 17 bp, Homo sapiens
tctgacggccctgcaat

SEQ ID NO: 347420 - DNA, 20 bp, Homo sapiens
tctgactccagagtctgagc

SEQ ID NO: 347421 - DNA, 13 bp, Homo sapiens
tctgactctgagt

SEQ ID NO: 347422 - DNA, 19 bp, Homo sapiens
tctgactgcaacttctgtc

SEQ ID NO: 347423 - DNA, 19 bp, Homo sapiens
tctgagaaggccctgtgcc

SEQ ID NO: 347424 - DNA, 15 bp, Homo sapiens
tctgagaccagcctg

SEQ ID NO: 347425 - DNA, 20 bp, Homo sapiens
tctgagagaccatctcctat

SEQ ID NO: 347426 - DNA, 15 bp, Homo sapiens
tctgagagagatgat

SEQ ID NO: 347427 - DNA, 13 bp, Homo sapiens
tctgagcagcctc

SEQ ID NO: 347428 - DNA, 22 bp, Homo sapiens
tctgagccaccgcgagggcctg

SEQ ID NO: 347429 - DNA, 15 bp, Homo sapiens
tctgagccaggagcc

SEQ ID NO: 347430 - DNA, 12 bp, Homo sapiens
tctgagcccagg

SEQ ID NO: 347431 - DNA, 16 bp, Homo sapiens
tctgagcccccacctg

SEQ ID NO: 347432 - DNA, 17 bp, Homo sapiens
tctgagcccccacctgc

SEQ ID NO: 347433 - DNA, 21 bp, Homo sapiens
tctgagcccccacctgcctga

SEQ ID NO: 347434 - DNA, 23 bp, Homo sapiens
tctgagcccccggctagtaccct

SEQ ID NO: 347435 - DNA, 12 bp, Homo sapiens
tctgagccccct

SEQ ID NO: 347436 - DNA, 15 bp, Homo sapiens
tctgagccccctgtg

SEQ ID NO: 347437 - DNA, 20 bp, Homo sapiens
tctgagccccctgtgcccac

SEQ ID NO: 347438 - DNA, 22 bp, Homo sapiens
tctgagccccctgtgcccaccc

SEQ ID NO: 347439 - DNA, 15 bp, Homo sapiens
tctgagcccctggga

SEQ ID NO: 347440 - DNA, 23 bp, Homo sapiens
tctgagccctccttcttgccctg

SEQ ID NO: 347441 - DNA, 20 bp, Homo sapiens
tctgagccctgccctcactc

SEQ ID NO: 347442 - DNA, 22 bp, Homo sapiens
tctgagccctgccctcactcca

SEQ ID NO: 347443 - DNA, 16 bp, Homo sapiens
tctgagcggccgcctg

SEQ ID NO: 347444 - DNA, 18 bp, Homo sapiens
tctgagcggccgcctgtc

SEQ ID NO: 347445 - DNA, 15 bp, Homo sapiens
tctgagctgttatct

SEQ ID NO: 347446 - DNA, 22 bp, Homo sapiens
tctgagctgttatcttgtgtat

SEQ ID NO: 347447 - DNA, 15 bp, Homo sapiens
tctgagcttcagtat

SEQ ID NO: 347448 - DNA, 14 bp, Homo sapiens
tctgagctttgtta

SEQ ID NO: 347449 - DNA, 13 bp, Homo sapiens
tctgaggagtcca

SEQ ID NO: 347450 - DNA, 18 bp, Homo sapiens
tctgaggcaaccccctcg

SEQ ID NO: 347451 - DNA, 17 bp, Homo sapiens
tctgaggccccaggccc

SEQ ID NO: 347452 - DNA, 22 bp, Homo sapiens
tctgagggcactctctgccagc

SEQ ID NO: 347453 - DNA, 19 bp, Homo sapiens
tctgagtcatcaaaaagag

SEQ ID NO: 347454 - DNA, 15 bp, Homo sapiens
tctgagtccactgct

SEQ ID NO: 347455 - DNA, 16 bp, Homo sapiens
tctgagtccagctccc

SEQ ID NO: 347456 - DNA, 15 bp, Homo sapiens
tctgataaacacaga

SEQ ID NO: 347457 - DNA, 15 bp, Homo sapiens
tctgataatgtattg

SEQ ID NO: 347458 - DNA, 20 bp, Homo sapiens
tctgataatgtattgcagtg

SEQ ID NO: 347459 - DNA, 19 bp, Homo sapiens
tctgatattccatgaatgt

SEQ ID NO: 347460 - DNA, 19 bp, Homo sapiens
tctgatatttgctggagtg

SEQ ID NO: 347461 - DNA, 13 bp, Homo sapiens
tctgatcaaagca

SEQ ID NO: 347462 - DNA, 20 bp, Homo sapiens
tctgatcacccccctgctta

SEQ ID NO: 347463 - DNA, 20 bp, Homo sapiens
tctgatcccataaagaaagt

SEQ ID NO: 347464 - DNA, 18 bp, Homo sapiens
tctgatcccctttggttt

SEQ ID NO: 347465 - DNA, 23 bp, Homo sapiens
tctgatccctcgcccccacaccc

SEQ ID NO: 347466 - DNA, 13 bp, Homo sapiens
tctgatctataca

SEQ ID NO: 347467 - DNA, 16 bp, Homo sapiens
tctgccgaccgcctgc

SEQ ID NO: 347468 - DNA, 20 bp, Homo sapiens
tctgccgaccgcctgcttca

SEQ ID NO: 347469 - DNA, 22 bp, Homo sapiens
tctgccgaccgcctgcttcaca

SEQ ID NO: 347470 - DNA, 13 bp, Homo sapiens
tctgccgcggtgg

SEQ ID NO: 347471 - DNA, 23 bp, Homo sapiens
tctgccggctctttccttgctca

SEQ ID NO: 347472 - DNA, 14 bp, Homo sapiens
tctgcctaggagct

SEQ ID NO: 347473 - DNA, 20 bp, Homo sapiens
tctgcctcacatagcttaca

SEQ ID NO: 347474 - DNA, 19 bp, Homo sapiens
tctgcctcccacgctggga

SEQ ID NO: 347475 - DNA, 15 bp, Homo sapiens
tctgcctcctcttca

SEQ ID NO: 347476 - DNA, 13 bp, Homo sapiens
tctgcctgcctca

SEQ ID NO: 347477 - DNA, 12 bp, Homo sapiens
tctgcctggcct

SEQ ID NO: 347478 - DNA, 13 bp, Homo sapiens
tctgcctggcctg

SEQ ID NO: 347479 - DNA, 20 bp, Homo sapiens
tctgcctggcctggctcccc

SEQ ID NO: 347480 - DNA, 17 bp, Homo sapiens
tctgcctgggcctgtgc

SEQ ID NO: 347481 - DNA, 22 bp, Homo sapiens
tctgcctgggcctgtgcagcag

SEQ ID NO: 347482 - DNA, 14 bp, Homo sapiens
tctgcctgtggcct

SEQ ID NO: 347483 - DNA, 19 bp, Homo sapiens
tctgcctgtggccttgccc

SEQ ID NO: 347484 - DNA, 21 bp, Homo sapiens
tctgcctgtggccttgcccgc

SEQ ID NO: 347485 - DNA, 15 bp, Homo sapiens
tctgcctgttataac

SEQ ID NO: 347486 - DNA, 21 bp, Homo sapiens
tctgcctgttataactctgca

SEQ ID NO: 347487 - DNA, 16 bp, Homo sapiens
tctgccttagaggagc

SEQ ID NO: 347488 - DNA, 12 bp, Homo sapiens
tctgccttgctg

SEQ ID NO: 347489 - DNA, 14 bp, Homo sapiens
tctgccttgctgca

SEQ ID NO: 347490 - DNA, 16 bp, Homo sapiens
tctgccttggacacca

SEQ ID NO: 347491 - DNA, 15 bp, Homo sapiens
tctgcctttgagtgt

SEQ ID NO: 347492 - DNA, 11 bp, Homo sapiens
tctgccttttc

SEQ ID NO: 347493 - DNA, 13 bp, Homo sapiens
tctgcctttttta

SEQ ID NO: 347494 - DNA, 17 bp, Homo sapiens
tctgcgattttatctgt

SEQ ID NO: 347495 - DNA, 18 bp, Homo sapiens
tctgcgcggatgtagcat

SEQ ID NO: 347496 - DNA, 19 bp, Homo sapiens
tctgcgcggatgtagcatg

SEQ ID NO: 347497 - DNA, 20 bp, Homo sapiens
tctgcggtgaggcaggggag

SEQ ID NO: 347498 - DNA, 20 bp, Homo sapiens
tctgctaggcgctggggaga

SEQ ID NO: 347499 - DNA, 16 bp, Homo sapiens
tctgctatgtctgtga

SEQ ID NO: 347500 - DNA, 17 bp, Homo sapiens
tctgctcacattccctc

SEQ ID NO: 347501 - DNA, 18 bp, Homo sapiens
tctgctcacattccctct

SEQ ID NO: 347502 - DNA, 23 bp, Homo sapiens
tctgctcacattccctctcatcc

SEQ ID NO: 347503 - DNA, 20 bp, Homo sapiens
tctgctccaccacatcctcc

SEQ ID NO: 347504 - DNA, 12 bp, Homo sapiens
tctgctccaccc

SEQ ID NO: 347505 - DNA, 17 bp, Homo sapiens
tctgctccacccttggc

SEQ ID NO: 347506 - DNA, 18 bp, Homo sapiens
tctgctccatgcagatct

SEQ ID NO: 347507 - DNA, 20 bp, Homo sapiens
tctgctcccagatgccttct

SEQ ID NO: 347508 - DNA, 21 bp, Homo sapiens
tctgctccgtgtgtctcatgc

SEQ ID NO: 347509 - DNA, 15 bp, Homo sapiens
tctgctcctgaaaaa

SEQ ID NO: 347510 - DNA, 12 bp, Homo sapiens
tctgctctagcc

SEQ ID NO: 347511 - DNA, 13 bp, Homo sapiens
tctgctctagcca

SEQ ID NO: 347512 - DNA, 11 bp, Homo sapiens
tctgctctgag

SEQ ID NO: 347513 - DNA, 12 bp, Homo sapiens
tctgctctgcac

SEQ ID NO: 347514 - DNA, 19 bp, Homo sapiens
tctgctctgtgcctgggat

SEQ ID NO: 347515 - DNA, 23 bp, Homo sapiens
tctgctctttcttcttccacaca

SEQ ID NO: 347516 - DNA, 20 bp, Homo sapiens
tctgctgagctctgacctgc

SEQ ID NO: 347517 - DNA, 16 bp, Homo sapiens
tctgctgcccacggcc

SEQ ID NO: 347518 - DNA, 18 bp, Homo sapiens
tctgctgcccacggccac

SEQ ID NO: 347519 - DNA, 14 bp, Homo sapiens
tctgctgccctcca

SEQ ID NO: 347520 - DNA, 15 bp, Homo sapiens
tctgctgccctccat

SEQ ID NO: 347521 - DNA, 17 bp, Homo sapiens
tctgctgcctctgaaaa

SEQ ID NO: 347522 - DNA, 21 bp, Homo sapiens
tctgctgcctctgaaaatatt

SEQ ID NO: 347523 - DNA, 17 bp, Homo sapiens
tctgctgcctgcccgca

SEQ ID NO: 347524 - DNA, 17 bp, Homo sapiens
tctgctgcttctgggcc

SEQ ID NO: 347525 - DNA, 16 bp, Homo sapiens
tctgctgctttccaac

SEQ ID NO: 347526 - DNA, 12 bp, Homo sapiens
tctgctggccca

SEQ ID NO: 347527 - DNA, 20 bp, Homo sapiens
tctgctggcccagccaaacc

SEQ ID NO: 347528 - DNA, 23 bp, Homo sapiens
tctgctggccgggcacagctgtg

SEQ ID NO: 347529 - DNA, 17 bp, Homo sapiens
tctgctggcctggatct

SEQ ID NO: 347530 - DNA, 16 bp, Homo sapiens
tcttgttctgttttgt

SEQ ID NO: 347531 - DNA, 14 bp, Homo sapiens
tcttgtttcaattc

SEQ ID NO: 347532 - DNA, 18 bp, Homo sapiens
tcttgttttttttttcca

SEQ ID NO: 347533 - DNA, 14 bp, Homo sapiens
tctttaaactactg

SEQ ID NO: 347534 - DNA, 19 bp, Homo sapiens
tctttaaactataggtaat

SEQ ID NO: 347535 - DNA, 17 bp, Homo sapiens
tctttaacagctttctc

SEQ ID NO: 347536 - DNA, 13 bp, Homo sapiens
tgaagaaatggaa

SEQ ID NO: 347537 - DNA, 17 bp, Homo sapiens
tgaagaacacagcatgt

SEQ ID NO: 347538 - DNA, 18 bp, Homo sapiens
tgaagaacacagcatgtg

SEQ ID NO: 347539 - DNA, 19 bp, Homo sapiens
tgaagaacacagcatgtgc

SEQ ID NO: 347540 - DNA, 21 bp, Homo sapiens
tgaagaagaccagtcacagcc

SEQ ID NO: 347541 - DNA, 22 bp, Homo sapiens
tgaagaagaccagtcacagcca

SEQ ID NO: 347542 - DNA, 22 bp, Homo sapiens
tgaagaagctaaatcctttact

SEQ ID NO: 347543 - DNA, 21 bp, Homo sapiens
tgaagaaggaggaattttaga

SEQ ID NO: 347544 - DNA, 15 bp, Homo sapiens
tgaagaagggaaatt

SEQ ID NO: 347545 - DNA, 20 bp, Homo sapiens
tgaagaatacagttaggcac

SEQ ID NO: 347546 - DNA, 18 bp, Homo sapiens
tgaagaatggacttaatt

SEQ ID NO: 347547 - DNA, 20 bp, Homo sapiens
tgaagaattattttttttct

SEQ ID NO: 347548 - DNA, 15 bp, Homo sapiens
tgaagaatttgttct

SEQ ID NO: 347549 - DNA, 17 bp, Homo sapiens
tgaagacttttctttca

SEQ ID NO: 347550 - DNA, 23 bp, Homo sapiens
tgaagagaaccgagcaaagatca

SEQ ID NO: 347551 - DNA, 24 bp, Homo sapiens
tgaagagaaccgagcaaagatcaa

SEQ ID NO: 347552 - DNA, 21 bp, Homo sapiens
tgaagagatttcaacaagaat

SEQ ID NO: 347553 - DNA, 22 bp, Homo sapiens
tgaagagccagaagtgaagagt

SEQ ID NO: 347554 - DNA, 19 bp, Homo sapiens
tgaagagcgctcctctgcc

SEQ ID NO: 347555 - DNA, 20 bp, Homo sapiens
tgaagagcgctcctctgcct

SEQ ID NO: 347556 - DNA, 21 bp, Homo sapiens
tgaagagcgctcctctgcctt

SEQ ID NO: 347557 - DNA, 22 bp, Homo sapiens
tgaagagcgctcctctgccttg

SEQ ID NO: 347558 - DNA, 22 bp, Homo sapiens
tgaagagctgagtactcaggcc

SEQ ID NO: 347559 - DNA, 22 bp, Homo sapiens
tgaagaggaccctgagtcccca

SEQ ID NO: 347560 - DNA, 21 bp, Homo sapiens
tgaagagggagaagcatgaaa

SEQ ID NO: 347561 - DNA, 23 bp, Homo sapiens
tgaagataaatccaactctgact

SEQ ID NO: 347562 - DNA, 17 bp, Homo sapiens
tgaagataatttgcata

SEQ ID NO: 347563 - DNA, 21 bp, Homo sapiens
tgaagatctcagataaagtga

SEQ ID NO: 347564 - DNA, 16 bp, Homo sapiens
tgaagatgtagcttcc

SEQ ID NO: 347565 - DNA, 13 bp, Homo sapiens
tgaagatgtttgc

SEQ ID NO: 347566 - DNA, 15 bp, Homo sapiens
tgaagatgtttgcaa

SEQ ID NO: 347567 - DNA, 17 bp, Homo sapiens
tgaagatgtttgcaata

SEQ ID NO: 347568 - DNA, 13 bp, Homo sapiens
tgaagattttctt

SEQ ID NO: 347569 - DNA, 13 bp, Homo sapiens
tgaagcaaacaca

SEQ ID NO: 347570 - DNA, 14 bp, Homo sapiens
tgaagcaaacacac

SEQ ID NO: 347571 - DNA, 22 bp, Homo sapiens
tgaagcaaacacacagactctg

SEQ ID NO: 347572 - DNA, 23 bp, Homo sapiens
tgaagcaaacacacagactctgt

SEQ ID NO: 347573 - DNA, 17 bp, Homo sapiens
tgaagcacgtgagagac

SEQ ID NO: 347574 - DNA, 16 bp, Homo sapiens
tgaagcagtcttgctc

SEQ ID NO: 347575 - DNA, 17 bp, Homo sapiens
tgaagcagtcttgctct

SEQ ID NO: 347576 - DNA, 21 bp, Homo sapiens
tgaagcagtgcctcgaggcac

SEQ ID NO: 347577 - DNA, 12 bp, Homo sapiens
tgaagcatgctt

SEQ ID NO: 347578 - DNA, 14 bp, Homo sapiens
tgaagcccaggagg

SEQ ID NO: 347579 - DNA, 16 bp, Homo sapiens
tgaagcccaggaggac

SEQ ID NO: 347580 - DNA, 15 bp, Homo sapiens
tgaagccctttgcct

SEQ ID NO: 347581 - DNA, 22 bp, Homo sapiens
tgaagcctctgccctgcctccc

SEQ ID NO: 347582 - DNA, 15 bp, Homo sapiens
tgaagcgaacatctt

SEQ ID NO: 347583 - DNA, 23 bp, Homo sapiens
tgaagcgaacatcttcatataaa

SEQ ID NO: 347584 - DNA, 20 bp, Homo sapiens
tgaaggaataaattgctcct

SEQ ID NO: 347585 - DNA, 15 bp, Homo sapiens
tgaaggaattacatt

SEQ ID NO: 347586 - DNA, 22 bp, Homo sapiens
tgaaggcccaagagcagagtct

SEQ ID NO: 347587 - DNA, 23 bp, Homo sapiens
tgaaggctctcacccccatccct

SEQ ID NO: 347588 - DNA, 19 bp, Homo sapiens
tgaaggctttcagggcctc

SEQ ID NO: 347589 - DNA, 13 bp, Homo sapiens
tgaagggcccagg

SEQ ID NO: 347590 - DNA, 14 bp, Homo sapiens
tgaagggcccagga

SEQ ID NO: 347591 - DNA, 18 bp, Homo sapiens
tgaagggtgacatcccag

SEQ ID NO: 347592 - DNA, 19 bp, Homo sapiens
tgaagggtgacatcccagg

SEQ ID NO: 347593 - DNA, 23 bp, Homo sapiens
tgaaggtaatactataaatatat

SEQ ID NO: 347594 - DNA, 15 bp, Homo sapiens
tgaaggtgacagcag

SEQ ID NO: 347595 - DNA, 14 bp, Homo sapiens
tgaaggttctggta

SEQ ID NO: 347596 - DNA, 14 bp, Homo sapiens
tgaagtaaattgaa

SEQ ID NO: 347597 - DNA, 11 bp, Homo sapiens
tgaagtaacct

SEQ ID NO: 347598 - DNA, 23 bp, Homo sapiens
tgaagtaagttctgaaaactgtt

SEQ ID NO: 347599 - DNA, 16 bp, Homo sapiens
tgaagtacagtcccag

SEQ ID NO: 347600 - DNA, 13 bp, Homo sapiens
tgaagtacatatt

SEQ ID NO: 347601 - DNA, 17 bp, Homo sapiens
tgaagtatctgtacctg

SEQ ID NO: 347602 - DNA, 16 bp, Homo sapiens
tgaagtcactgcacag

SEQ ID NO: 347603 - DNA, 21 bp, Homo sapiens
tgaagtcactgcacagtgcat

SEQ ID NO: 347604 - DNA, 14 bp, Homo sapiens
tgaagtcccttcct

SEQ ID NO: 347605 - DNA, 19 bp, Homo sapiens
tgaagtcccttcctgtcct

SEQ ID NO: 347606 - DNA, 21 bp, Homo sapiens
tgaagtctgatattgcagtaa

SEQ ID NO: 347607 - DNA, 20 bp, Homo sapiens
tgaagtctttgtacagacaa

SEQ ID NO: 347608 - DNA, 22 bp, Homo sapiens
tgaagtctttgtacagacaaca

SEQ ID NO: 347609 - DNA, 17 bp, Homo sapiens
tgaagtcttttctgtca

SEQ ID NO: 347610 - DNA, 17 bp, Homo sapiens
tgaagtgaatacatggt

SEQ ID NO: 347611 - DNA, 17 bp, Homo sapiens
tgacagggaaaatatag

SEQ ID NO: 347612 - DNA, 16 bp, Homo sapiens
tgacagtagcatactg

SEQ ID NO: 347613 - DNA, 21 bp, Homo sapiens
tgacagtagcatactgatgag

SEQ ID NO: 347614 - DNA, 23 bp, Homo sapiens
tgacagtattaacatcaaagact

SEQ ID NO: 347615 - DNA, 23 bp, Homo sapiens
tgacagtcttgtgcttttcctat

SEQ ID NO: 347616 - DNA, 14 bp, Homo sapiens
tgacagtgccttct

SEQ ID NO: 347617 - DNA, 22 bp, Homo sapiens
tgacataaacccatctgtaata

SEQ ID NO: 347618 - DNA, 23 bp, Homo sapiens
tgacataaacccatctgtaatat

SEQ ID NO: 347619 - DNA, 22 bp, Homo sapiens
tgacatcaggtgatccacctgc

SEQ ID NO: 347620 - DNA, 17 bp, Homo sapiens
tgacatcagtggcatgg

SEQ ID NO: 347621 - DNA, 23 bp, Homo sapiens
tgacatcagtggcatggctccag

SEQ ID NO: 347622 - DNA, 17 bp, Homo sapiens
tgacatccaagcttcct

SEQ ID NO: 347623 - DNA, 13 bp, Homo sapiens
tgacatcccagga

SEQ ID NO: 347624 - DNA, 14 bp, Homo sapiens
tgacatcccaggag

SEQ ID NO: 347625 - DNA, 16 bp, Homo sapiens
tgacatcttcaaagct

SEQ ID NO: 347626 - DNA, 14 bp, Homo sapiens
tgacatgatcgctt

SEQ ID NO: 347627 - DNA, 15 bp, Homo sapiens
tgacatgatcgcttt

SEQ ID NO: 347628 - DNA, 15 bp, Homo sapiens
tgacatgattccttc

SEQ ID NO: 347629 - DNA, 18 bp, Homo sapiens
tgacatgcgggctgggca

SEQ ID NO: 347630 - DNA, 21 bp, Homo sapiens
tgacatgcgggctgggcagct

SEQ ID NO: 347631 - DNA, 22 bp, Homo sapiens
tgacatgtggaaagtgaatttg

SEQ ID NO: 347632 - DNA, 18 bp, Homo sapiens
tgacatgtggggccaggt

SEQ ID NO: 347633 - DNA, 19 bp, Homo sapiens
tgacatgtggggccaggtc

SEQ ID NO: 347634 - DNA, 20 bp, Homo sapiens
tgacatgtggggccaggtca

SEQ ID NO: 347635 - DNA, 13 bp, Homo sapiens
tgacattaacagt

SEQ ID NO: 347636 - DNA, 17 bp, Homo sapiens
tgacattaacagttttc

SEQ ID NO: 347637 - DNA, 22 bp, Homo sapiens
tgacattaacagttttccatga

SEQ ID NO: 347638 - DNA, 15 bp, Homo sapiens
tgacattcaaggcat

SEQ ID NO: 347639 - DNA, 14 bp, Homo sapiens
tgacattcttcact

SEQ ID NO: 347640 - DNA, 14 bp, Homo sapiens
tgacatttcacttc

SEQ ID NO: 347641 - DNA, 16 bp, Homo sapiens
tgacatttctcaaagt

SEQ ID NO: 347642 - DNA, 17 bp, Homo sapiens
tgacatttgtcctgcag

SEQ ID NO: 347643 - DNA, 21 bp, Homo sapiens
tgacatttgtcctgcagagct

SEQ ID NO: 347644 - DNA, 16 bp, Homo sapiens
tgacattttgtagcta

SEQ ID NO: 347645 - DNA, 22 bp, Homo sapiens
tgaccaaaagtgagatgggaag

SEQ ID NO: 347646 - DNA, 14 bp, Homo sapiens
tgaccaagaactgc

SEQ ID NO: 347647 - DNA, 18 bp, Homo sapiens
tgaccaagaactgcatgg

SEQ ID NO: 347648 - DNA, 13 bp, Homo sapiens
tgaccaagttata

SEQ ID NO: 347649 - DNA, 16 bp, Homo sapiens
tgaccaagttataaat

SEQ ID NO: 347650 - DNA, 23 bp, Homo sapiens
tgaccaatattatactaagaaaa

SEQ ID NO: 347651 - DNA, 14 bp, Homo sapiens
tgaccaatctctgt

SEQ ID NO: 347652 - DNA, 16 bp, Homo sapiens
tgaccaatctctgtga

SEQ ID NO: 347653 - DNA, 17 bp, Homo sapiens
tgaccaatctctgtgac

SEQ ID NO: 347654 - DNA, 19 bp, Homo sapiens
tgaccaatctctgtgactc

SEQ ID NO: 347655 - DNA, 20 bp, Homo sapiens
tgaccaatgcattaccttct

SEQ ID NO: 347656 - DNA, 18 bp, Homo sapiens
tgaccaattgccctgcca

SEQ ID NO: 347657 - DNA, 12 bp, Homo sapiens
tgaccacactgt

SEQ ID NO: 347658 - DNA, 20 bp, Homo sapiens
tgaccacacttcctgtccag

SEQ ID NO: 347659 - DNA, 22 bp, Homo sapiens
tgaccacgctttctagctgttg

SEQ ID NO: 347660 - DNA, 22 bp, Homo sapiens
tgaccacggacgtttccatcag

SEQ ID NO: 347661 - DNA, 23 bp, Homo sapiens
tgaccacggacgtttccatcagg

SEQ ID NO: 347662 - DNA, 17 bp, Homo sapiens
tgaccactgggcctgct

SEQ ID NO: 347663 - DNA, 22 bp, Homo sapiens
tgaccagcctccatgctgcctc

SEQ ID NO: 347664 - DNA, 23 bp, Homo sapiens
tgaccagcctccatgctgcctcc

SEQ ID NO: 347665 - DNA, 16 bp, Homo sapiens
tgaccaggcatcctcc

SEQ ID NO: 347666 - DNA, 13 bp, Homo sapiens
tgaccaggccacc

SEQ ID NO: 347667 - DNA, 16 bp, Homo sapiens
tgaccaggccaccatc

SEQ ID NO: 347668 - DNA, 20 bp, Homo sapiens
tgaccaggctcacaactgtt

SEQ ID NO: 347669 - DNA, 21 bp, Homo sapiens
tgaccaggctcacaactgttt

SEQ ID NO: 347670 - DNA, 18 bp, Homo sapiens
tgaccagtataaaattac

SEQ ID NO: 347671 - DNA, 20 bp, Homo sapiens
tgaccagttgcacttggcct

SEQ ID NO: 347672 - DNA, 12 bp, Homo sapiens
tgaccagtttac

SEQ ID NO: 347673 - DNA, 13 bp, Homo sapiens
tgaccatcccatg

SEQ ID NO: 347674 - DNA, 15 bp, Homo sapiens
tgaccatcccatgag

SEQ ID NO: 347675 - DNA, 12 bp, Homo sapiens
tgaccatgtgat

SEQ ID NO: 347676 - DNA, 18 bp, Homo sapiens
tgacccagccccttgaga

SEQ ID NO: 347677 - DNA, 14 bp, Homo sapiens
tgacccagtggcat

SEQ ID NO: 347678 - DNA, 13 bp, Homo sapiens
tgaccccacacgc

SEQ ID NO: 347679 - DNA, 20 bp, Homo sapiens
tgaccccacttatgctgctg

SEQ ID NO: 347680 - DNA, 14 bp, Homo sapiens
tgaccccaggaagt

SEQ ID NO: 347681 - DNA, 15 bp, Homo sapiens
tgaccccctcccctg

SEQ ID NO: 347682 - DNA, 21 bp, Homo sapiens
tgaccccgacgccacagccca

SEQ ID NO: 347683 - DNA, 14 bp, Homo sapiens
tgaccccttcctgt

SEQ ID NO: 347684 - DNA, 18 bp, Homo sapiens
tgaccccttcctgtctgg

SEQ ID NO: 347685 - DNA, 22 bp, Homo sapiens
tgacccggcccccgccctctgc

SEQ ID NO: 347686 - DNA, 16 bp, Homo sapiens
tgacccggcccctacc

SEQ ID NO: 347687 - DNA, 21 bp, Homo sapiens
tgacccggctgggtcggccct

SEQ ID NO: 347688 - DNA, 16 bp, Homo sapiens
tgacccgttccatatc

SEQ ID NO: 347689 - DNA, 13 bp, Homo sapiens
tgaccctcccttc

SEQ ID NO: 347690 - DNA, 12 bp, Homo sapiens
tgaccctctcac

SEQ ID NO: 347691 - DNA, 15 bp, Homo sapiens
tgaccctctccaccc

SEQ ID NO: 347692 - DNA, 18 bp, Homo sapiens
tgaccctctccaccccat

SEQ ID NO: 347693 - DNA, 16 bp, Homo sapiens
tgaccctgcagagatg

SEQ ID NO: 347694 - DNA, 18 bp, Homo sapiens
tgaccctgtgatgcctga

SEQ ID NO: 347695 - DNA, 12 bp, Homo sapiens
tgacccttcagg

SEQ ID NO: 347696 - DNA, 18 bp, Homo sapiens
tgacccttctgtctgtaa

SEQ ID NO: 347697 - DNA, 18 bp, Homo sapiens
tgaccgcccagctctccc

SEQ ID NO: 347698 - DNA, 17 bp, Homo sapiens
tgaccggcccgccacct

SEQ ID NO: 347699 - DNA, 18 bp, Homo sapiens
tgaccgttttcatcctgg

SEQ ID NO: 347700 - DNA, 22 bp, Homo sapiens
tgaccgttttcatcctggcctc

SEQ ID NO: 347701 - DNA, 18 bp, Homo sapiens
tgacctaaatccattttc

SEQ ID NO: 347702 - DNA, 13 bp, Homo sapiens
tgacctcagctgc

SEQ ID NO: 347703 - DNA, 22 bp, Homo sapiens
tgacctcagctgcacattcctg

SEQ ID NO: 347704 - DNA, 13 bp, Homo sapiens
tgacctccctcta

SEQ ID NO: 347705 - DNA, 19 bp, Homo sapiens
tgacctcctggactgtagg

SEQ ID NO: 347706 - DNA, 18 bp, Homo sapiens
tgacctcgtgatccaccc

SEQ ID NO: 347707 - DNA, 21 bp, Homo sapiens
tgagaagtactttgtgctgat

SEQ ID NO: 347708 - DNA, 23 bp, Homo sapiens
tgagaagttaagcagcctttctg

SEQ ID NO: 347709 - DNA, 12 bp, Homo sapiens
tgagaataattg

SEQ ID NO: 347710 - DNA, 18 bp, Homo sapiens
tgagaataattgtgtaca

SEQ ID NO: 347711 - DNA, 20 bp, Homo sapiens
tgagaatctgtgcagtcatc

SEQ ID NO: 347712 - DNA, 13 bp, Homo sapiens
tgagaatgtcatt

SEQ ID NO: 347713 - DNA, 20 bp, Homo sapiens
tgagaatgtcatttgctaat

SEQ ID NO: 347714 - DNA, 14 bp, Homo sapiens
tgagaattaaaata

SEQ ID NO: 347715 - DNA, 12 bp, Homo sapiens
tgagacaaaaat

SEQ ID NO: 347716 - DNA, 14 bp, Homo sapiens
tgagacaacacaca

SEQ ID NO: 347717 - DNA, 15 bp, Homo sapiens
tgagacaacacacac

SEQ ID NO: 347718 - DNA, 13 bp, Homo sapiens
tgagacaagccct

SEQ ID NO: 347719 - DNA, 20 bp, Homo sapiens
tgagacaagccctggcaaca

SEQ ID NO: 347720 - DNA, 15 bp, Homo sapiens
tgagacaatgccttg

SEQ ID NO: 347721 - DNA, 16 bp, Homo sapiens
tgagacaatgccttgt

SEQ ID NO: 347722 - DNA, 13 bp, Homo sapiens
tgagacagcaagt

SEQ ID NO: 347723 - DNA, 16 bp, Homo sapiens
tgagacagggtttttt

SEQ ID NO: 347724 - DNA, 18 bp, Homo sapiens
tgagacagggttttttca

SEQ ID NO: 347725 - DNA, 22 bp, Homo sapiens
tgagacagggttttttcatttt

SEQ ID NO: 347726 - DNA, 17 bp, Homo sapiens
tgagaccaagccggtgc

SEQ ID NO: 347727 - DNA, 19 bp, Homo sapiens
tgagaccacctctcaatat

SEQ ID NO: 347728 - DNA, 23 bp, Homo sapiens
tgagaccagttgggagcactgga

SEQ ID NO: 347729 - DNA, 17 bp, Homo sapiens
tgatcacccccctgctt

SEQ ID NO: 347730 - DNA, 16 bp, Homo sapiens
tgatcagatctgacat

SEQ ID NO: 347731 - DNA, 17 bp, Homo sapiens
tgatcagatctgacatg

SEQ ID NO: 347732 - DNA, 12 bp, Homo sapiens
tgatcagcagag

SEQ ID NO: 347733 - DNA, 13 bp, Homo sapiens
tgatcagcagaga

SEQ ID NO: 347734 - DNA, 13 bp, Homo sapiens
tgatcatctttgc

SEQ ID NO: 347735 - DNA, 22 bp, Homo sapiens
tgatcattacatggctgtggtt

SEQ ID NO: 347736 - DNA, 22 bp, Homo sapiens
tgatcattcataattttatcta

SEQ ID NO: 347737 - DNA, 13 bp, Homo sapiens
tgatcatttattt

SEQ ID NO: 347738 - DNA, 20 bp, Homo sapiens
tgatcatttattttaagcac

SEQ ID NO: 347739 - DNA, 18 bp, Homo sapiens
tgatcatttgcagctgct

SEQ ID NO: 347740 - DNA, 20 bp, Homo sapiens
tgatcatttgcagctgctgg

SEQ ID NO: 347741 - DNA, 21 bp, Homo sapiens
tgatcatttgcagctgctggt

SEQ ID NO: 347742 - DNA, 21 bp, Homo sapiens
tgatcattttccccccactct

SEQ ID NO: 347743 - DNA, 14 bp, Homo sapiens
tgatccacccacct

SEQ ID NO: 347744 - DNA, 15 bp, Homo sapiens
tgatccacccacctg

SEQ ID NO: 347745 - DNA, 18 bp, Homo sapiens
tgatccatccatctccag

SEQ ID NO: 347746 - DNA, 15 bp, Homo sapiens
tgatcccataaagaa

SEQ ID NO: 347747 - DNA, 22 bp, Homo sapiens
tgatcccctttggttttactac

SEQ ID NO: 347748 - DNA, 22 bp, Homo sapiens
tgatcgccttatttatattcat

SEQ ID NO: 347749 - DNA, 18 bp, Homo sapiens
tgatcggagcctcctctc

SEQ ID NO: 347750 - DNA, 22 bp, Homo sapiens
tgatcgtgctaaattttcagta

SEQ ID NO: 347751 - DNA, 21 bp, Homo sapiens
tgatctaaggcatgctcccag

SEQ ID NO: 347752 - DNA, 23 bp, Homo sapiens
tgatctacttcatagctccttgg

SEQ ID NO: 347753 - DNA, 13 bp, Homo sapiens
tgatctaggttta

SEQ ID NO: 347754 - DNA, 18 bp, Homo sapiens
tgatctaggtttaactca

SEQ ID NO: 347755 - DNA, 16 bp, Homo sapiens
tgatctccatatgtta

SEQ ID NO: 347756 - DNA, 19 bp, Homo sapiens
tgatctccatatgttacac

SEQ ID NO: 347757 - DNA, 15 bp, Homo sapiens
tgatctcctggtagc

SEQ ID NO: 347758 - DNA, 11 bp, Homo sapiens
tgatctgggaa

SEQ ID NO: 347759 - DNA, 17 bp, Homo sapiens
tgatcttacctttatga

SEQ ID NO: 347760 - DNA, 21 bp, Homo sapiens
tgatcttggcttactgcagcc

SEQ ID NO: 347761 - DNA, 14 bp, Homo sapiens
tgatgaaaagattt

SEQ ID NO: 347762 - DNA, 11 bp, Homo sapiens
tgatgaaagct

SEQ ID NO: 347763 - DNA, 15 bp, Homo sapiens
tgatgaaagctgatt

SEQ ID NO: 347764 - DNA, 17 bp, Homo sapiens
tgatgaaattcttgaag

SEQ ID NO: 347765 - DNA, 14 bp, Homo sapiens
tgatgaactttctc

SEQ ID NO: 347766 - DNA, 17 bp, Homo sapiens
tgatgagacaacacaca

SEQ ID NO: 347767 - DNA, 20 bp, Homo sapiens
tgatgagttgatttataaag

SEQ ID NO: 347768 - DNA, 23 bp, Homo sapiens
tgatgatagacttcgaaaacaga

SEQ ID NO: 347769 - DNA, 14 bp, Homo sapiens
tgatgatggaaggg

SEQ ID NO: 347770 - DNA, 18 bp, Homo sapiens
tgatgatgggaattgtgt

SEQ ID NO: 347771 - DNA, 15 bp, Homo sapiens
tgatgattaaacacc

SEQ ID NO: 347772 - DNA, 17 bp, Homo sapiens
tgatgattaaacacctg

SEQ ID NO: 347773 - DNA, 14 bp, Homo sapiens
tgatgatttggggg

SEQ ID NO: 347774 - DNA, 16 bp, Homo sapiens
tgatgcaagtcactaa

SEQ ID NO: 347775 - DNA, 14 bp, Homo sapiens
tgatgccatgagga

SEQ ID NO: 347776 - DNA, 24 bp, Homo sapiens
tgatgccctataacccctgcctgg

SEQ ID NO: 347777 - DNA, 14 bp, Homo sapiens
tgatgctcaggctt

SEQ ID NO: 347778 - DNA, 16 bp, Homo sapiens
tgatgctccctcccct

SEQ ID NO: 347779 - DNA, 22 bp, Homo sapiens
tgatgctccctcccctgccctg

SEQ ID NO: 347780 - DNA, 13 bp, Homo sapiens
tgatgctgaaata

SEQ ID NO: 347781 - DNA, 11 bp, Homo sapiens
tgatgctgccc

SEQ ID NO: 347782 - DNA, 22 bp, Homo sapiens
tgatgctgccccgttccctgtc

SEQ ID NO: 347783 - DNA, 14 bp, Homo sapiens
tgatgctggagagg

SEQ ID NO: 347784 - DNA, 17 bp, Homo sapiens
tgatgctggagaggtta

SEQ ID NO: 347785 - DNA, 23 bp, Homo sapiens
tgatgcttgtaacaagaaaacat

SEQ ID NO: 347786 - DNA, 15 bp, Homo sapiens
tgatggaacacacac

SEQ ID NO: 347787 - DNA, 15 bp, Homo sapiens
tgatggaagggcctt

SEQ ID NO: 347788 - DNA, 23 bp, Homo sapiens
tgatggaccgggtgggcctggcc

SEQ ID NO: 347789 - DNA, 12 bp, Homo sapiens
tgatggagagga

SEQ ID NO: 347790 - DNA, 22 bp, Homo sapiens
tgatggcacttagctatcagaa

SEQ ID NO: 347791 - DNA, 12 bp, Homo sapiens
tgatggccacaa

SEQ ID NO: 347792 - DNA, 20 bp, Homo sapiens
tgatggcgcgggaggcacca

SEQ ID NO: 347793 - DNA, 21 bp, Homo sapiens
tgatggcgcgggaggcaccag

SEQ ID NO: 347794 - DNA, 10 bp, Homo sapiens
tgatggctaa

SEQ ID NO: 347795 - DNA, 14 bp, Homo sapiens
tgatggctatgttt

SEQ ID NO: 347796 - DNA, 17 bp, Homo sapiens
tgatggctatgttttgg

SEQ ID NO: 347797 - DNA, 18 bp, Homo sapiens
tgatggcttgacatgtgc

SEQ ID NO: 347798 - DNA, 18 bp, Homo sapiens
tgatgggccaccggggca

SEQ ID NO: 347799 - DNA, 16 bp, Homo sapiens
tgatggggtttagcaa

SEQ ID NO: 347800 - DNA, 16 bp, Homo sapiens
tgatggtcagctccct

SEQ ID NO: 347801 - DNA, 21 bp, Homo sapiens
tgatggtcagctcccttctct

SEQ ID NO: 347802 - DNA, 13 bp, Homo sapiens
tgatggtgagctg

SEQ ID NO: 347803 - DNA, 14 bp, Homo sapiens
tgatggtgagctgg

SEQ ID NO: 347804 - DNA, 19 bp, Homo sapiens
tgatgtaaaatcttgtcat

SEQ ID NO: 347805 - DNA, 15 bp, Homo sapiens
tgatgtacctgatgc

SEQ ID NO: 347806 - DNA, 14 bp, Homo sapiens
tgatgtatatgttt

SEQ ID NO: 347807 - DNA, 21 bp, Homo sapiens
tgatgtattctagctaatgta

SEQ ID NO: 347808 - DNA, 12 bp, Homo sapiens
tgatgtcagcct

SEQ ID NO: 347809 - DNA, 16 bp, Homo sapiens
tgatgtcatcttgagc

SEQ ID NO: 347810 - DNA, 16 bp, Homo sapiens
tgatgtcgttcatttt

SEQ ID NO: 347811 - DNA, 17 bp, Homo sapiens
tgatgtctcttgtagaa

SEQ ID NO: 347812 - DNA, 12 bp, Homo sapiens
tgatgtctgcaa

SEQ ID NO: 347813 - DNA, 23 bp, Homo sapiens
tgatgtctttgttaagactgctg

SEQ ID NO: 347814 - DNA, 21 bp, Homo sapiens
tgatgtgaagataatttgcat

SEQ ID NO: 347815 - DNA, 16 bp, Homo sapiens
tgatgtgatttatgca

SEQ ID NO: 347816 - DNA, 17 bp, Homo sapiens
tgatgtgatttatgcat

SEQ ID NO: 347817 - DNA, 23 bp, Homo sapiens
tgatgtgcacatatcaagaagtc

SEQ ID NO: 347818 - DNA, 12 bp, Homo sapiens
tgatgtgcctgt

SEQ ID NO: 347819 - DNA, 18 bp, Homo sapiens
tgatgtgctcatcagaaa

SEQ ID NO: 347820 - DNA, 14 bp, Homo sapiens
tgatgtgtatgtgt

SEQ ID NO: 347821 - DNA, 22 bp, Homo sapiens
tgatgtgtcatatgagtcctca

SEQ ID NO: 347822 - DNA, 17 bp, Homo sapiens
tgatgtgtgcccagatc

SEQ ID NO: 347823 - DNA, 14 bp, Homo sapiens
tgatgtgtttattt

SEQ ID NO: 347824 - DNA, 16 bp, Homo sapiens
tgatgtgtttttgtat

SEQ ID NO: 347825 - DNA, 17 bp, Homo sapiens
tgatgttgtgttgttat

SEQ ID NO: 347826 - DNA, 16 bp, Homo sapiens
tgatgtttccagctgc

SEQ ID NO: 347827 - DNA, 17 bp, Homo sapiens
tgatgtttccagctgcc

SEQ ID NO: 347828 - DNA, 17 bp, Homo sapiens
tgatgtttgtggcctca

SEQ ID NO: 347829 - DNA, 16 bp, Homo sapiens
tgatgttttgatgcca

SEQ ID NO: 347830 - DNA, 18 bp, Homo sapiens
tgatgttttgatgccatt

SEQ ID NO: 347831 - DNA, 22 bp, Homo sapiens
tgattaaccccttctttcatgt

SEQ ID NO: 347832 - DNA, 17 bp, Homo sapiens
tgattaactcagtcctg

SEQ ID NO: 347833 - DNA, 15 bp, Homo sapiens
tgattaattaaaaca

SEQ ID NO: 347834 - DNA, 21 bp, Homo sapiens
tgattaattcaccttccagtg

SEQ ID NO: 347835 - DNA, 13 bp, Homo sapiens
tgattactgtcaa

SEQ ID NO: 347836 - DNA, 23 bp, Homo sapiens
tgattataccactgcactccagc

SEQ ID NO: 347837 - DNA, 12 bp, Homo sapiens
tgattatcttga

SEQ ID NO: 347838 - DNA, 15 bp, Homo sapiens
tgattatcttgaaaa

SEQ ID NO: 347839 - DNA, 17 bp, Homo sapiens
tgattatggacatcgat

SEQ ID NO: 347840 - DNA, 15 bp, Homo sapiens
tgattatgtaccttt

SEQ ID NO: 347841 - DNA, 14 bp, Homo sapiens
tgattattgaatgt

SEQ ID NO: 347842 - DNA, 16 bp, Homo sapiens
tgattatttatcacat

SEQ ID NO: 347843 - DNA, 17 bp, Homo sapiens
tgattatttatcacata

SEQ ID NO: 347844 - DNA, 19 bp, Homo sapiens
tgattcaataaaatgcact

SEQ ID NO: 347845 - DNA, 17 bp, Homo sapiens
tgattcactattagaga

SEQ ID NO: 347846 - DNA, 23 bp, Homo sapiens
tgattcataacaatgtatgtgaa

SEQ ID NO: 347847 - DNA, 16 bp, Homo sapiens
tgattccaagggccca

SEQ ID NO: 347848 - DNA, 20 bp, Homo sapiens
tgattccaagggcccagagg

SEQ ID NO: 347849 - DNA, 15 bp, Homo sapiens
tgattcccagagcag

SEQ ID NO: 347850 - DNA, 22 bp, Homo sapiens
tgattgaaaagaagaaagtcta

SEQ ID NO: 347851 - DNA, 14 bp, Homo sapiens
tgattgaaccagct

SEQ ID NO: 347852 - DNA, 19 bp, Homo sapiens
tgattgaagtatctgtacc

SEQ ID NO: 347853 - DNA, 20 bp, Homo sapiens
tgattgaagtatctgtacct

SEQ ID NO: 347854 - DNA, 20 bp, Homo sapiens
tgattgacattttgtagcta

SEQ ID NO: 347855 - DNA, 17 bp, Homo sapiens
tgattgccatttcttcc

SEQ ID NO: 347856 - DNA, 22 bp, Homo sapiens
tgattgctctggaagcctgctg

SEQ ID NO: 347857 - DNA, 20 bp, Homo sapiens
tgattgctgccataattcta

SEQ ID NO: 347858 - DNA, 15 bp, Homo sapiens
tgattggattattca

SEQ ID NO: 347859 - DNA, 16 bp, Homo sapiens
tgattggattattcat

SEQ ID NO: 347860 - DNA, 18 bp, Homo sapiens
tgattggattattcattt

SEQ ID NO: 347861 - DNA, 23 bp, Homo sapiens
tgattggcagcttcaaaacagaa

SEQ ID NO: 347862 - DNA, 20 bp, Homo sapiens
tgattggggcctcacccaga

SEQ ID NO: 347863 - DNA, 22 bp, Homo sapiens
tgattggggcctcacccagaag

SEQ ID NO: 347864 - DNA, 20 bp, Homo sapiens
tgattggtccaacagtttga

SEQ ID NO: 347865 - DNA, 17 bp, Homo sapiens
tgattggtgcaaccctt

SEQ ID NO: 347866 - DNA, 14 bp, Homo sapiens
tgattgtaaaatag

SEQ ID NO: 347867 - DNA, 23 bp, Homo sapiens
tgattgtaaaatagcttgtatag

SEQ ID NO: 347868 - DNA, 15 bp, Homo sapiens
tgattgtaacatatt

SEQ ID NO: 347869 - DNA, 19 bp, Homo sapiens
tgattgtacagaatcattg

SEQ ID NO: 347870 - DNA, 15 bp, Homo sapiens
tgattgtttaattgt

SEQ ID NO: 347871 - DNA, 16 bp, Homo sapiens
tgattgtttaattgta

SEQ ID NO: 347872 - DNA, 20 bp, Homo sapiens
tgatttaactgacttaacaa

SEQ ID NO: 347873 - DNA, 16 bp, Homo sapiens
tgatttaagcatttta

SEQ ID NO: 347874 - DNA, 15 bp, Homo sapiens
tgatttacatgctga

SEQ ID NO: 347875 - DNA, 16 bp, Homo sapiens
tgatttataaatttga

SEQ ID NO: 347876 - DNA, 20 bp, Homo sapiens
tgatttatgatcacttggaa

SEQ ID NO: 347877 - DNA, 13 bp, Homo sapiens
tgatttatgcatt

SEQ ID NO: 347878 - DNA, 14 bp, Homo sapiens
tgatttatgcattt

SEQ ID NO: 347879 - DNA, 19 bp, Homo sapiens
tgatttatttggagtggag

SEQ ID NO: 347880 - DNA, 19 bp, Homo sapiens
tgatttcacaacagatcaa

SEQ ID NO: 347881 - DNA, 22 bp, Homo sapiens
tgatttcatgattagacaatgt

SEQ ID NO: 347882 - DNA, 15 bp, Homo sapiens
tgatttccatttctg

SEQ ID NO: 347883 - DNA, 16 bp, Homo sapiens
tgatttccatttctga

SEQ ID NO: 347884 - DNA, 23 bp, Homo sapiens
tgatttcccttttttcttccccc

SEQ ID NO: 347885 - DNA, 19 bp, Homo sapiens
tgatttcgatgtacagtct

SEQ ID NO: 347886 - DNA, 18 bp, Homo sapiens
tgatttctagaatggttt

SEQ ID NO: 347887 - DNA, 21 bp, Homo sapiens
tgatttctagcaggcaggaag

SEQ ID NO: 347888 - DNA, 12 bp, Homo sapiens
tgatttcttgct

SEQ ID NO: 347889 - DNA, 22 bp, Homo sapiens
tgatttcttgctaagctccagc

SEQ ID NO: 347890 - DNA, 17 bp, Homo sapiens
tgatttgcatggatttt

SEQ ID NO: 347891 - DNA, 16 bp, Homo sapiens
tgatttgctgttttct

SEQ ID NO: 347892 - DNA, 22 bp, Homo sapiens
tgatttggaagagaggcacctg

SEQ ID NO: 347893 - DNA, 16 bp, Homo sapiens
tgatttgtaatatgat

SEQ ID NO: 347894 - DNA, 16 bp, Homo sapiens
tgatttgtctctgagc

SEQ ID NO: 347895 - DNA, 21 bp, Homo sapiens
tgatttgtctctgagccccct

SEQ ID NO: 347896 - DNA, 14 bp, Homo sapiens
tgattttaacaata

SEQ ID NO: 347897 - DNA, 16 bp, Homo sapiens
tgattttaacaataac

SEQ ID NO: 347898 - DNA, 15 bp, Homo sapiens
tgattttaatttgac

SEQ ID NO: 347899 - DNA, 19 bp, Homo sapiens
tgattttagatttctttga

SEQ ID NO: 347900 - DNA, 15 bp, Homo sapiens
tgattttatctgtga

SEQ ID NO: 347901 - DNA, 16 bp, Homo sapiens
tgattttatctgtgaa

SEQ ID NO: 347902 - DNA, 14 bp, Homo sapiens
tgattttcatcaat

SEQ ID NO: 347903 - DNA, 20 bp, Homo sapiens
tgattttccccctaattctt

SEQ ID NO: 347904 - DNA, 13 bp, Homo sapiens
tgattttctgttg

SEQ ID NO: 347905 - DNA, 13 bp, Homo sapiens
tgattttctttct

SEQ ID NO: 347906 - DNA, 23 bp, Homo sapiens
tgatttttaaagtttaaatacca

SEQ ID NO: 347907 - DNA, 20 bp, Homo sapiens
tgatttttagatgagattgt

SEQ ID NO: 347908 - DNA, 13 bp, Homo sapiens
tgatttttgtgta

SEQ ID NO: 347909 - DNA, 12 bp, Homo sapiens
tgcaaaacaaac

SEQ ID NO: 347910 - DNA, 18 bp, Homo sapiens
tgcaaaacatgctacctg

SEQ ID NO: 347911 - DNA, 20 bp, Homo sapiens
tgcaaaaccggcaacctgta

SEQ ID NO: 347912 - DNA, 18 bp, Homo sapiens
tgcaaaaggttaagccat

SEQ ID NO: 347913 - DNA, 15 bp, Homo sapiens
tgcaaaataaatgtt

SEQ ID NO: 347914 - DNA, 14 bp, Homo sapiens
tgcaaaatttccag

SEQ ID NO: 347915 - DNA, 19 bp, Homo sapiens
tgcaaaatttttttaatct

SEQ ID NO: 347916 - DNA, 17 bp, Homo sapiens
tgcaaacagttcttgga

SEQ ID NO: 347917 - DNA, 22 bp, Homo sapiens
tgcaaacatggggttggctggg

SEQ ID NO: 347918 - DNA, 13 bp, Homo sapiens
tgcaaagaaaaga

SEQ ID NO: 347919 - DNA, 12 bp, Homo sapiens
tgcaaagaaaat

SEQ ID NO: 347920 - DNA, 16 bp, Homo sapiens
tgcaaagaaaatcaga

SEQ ID NO: 347921 - DNA, 13 bp, Homo sapiens
tgcaaagaactca

SEQ ID NO: 347922 - DNA, 13 bp, Homo sapiens
tgcaaaggacaga

SEQ ID NO: 347923 - DNA, 20 bp, Homo sapiens
tgcaaaggagggcctcagag

SEQ ID NO: 347924 - DNA, 20 bp, Homo sapiens
tgcaaatacttccaaagagt

SEQ ID NO: 347925 - DNA, 22 bp, Homo sapiens
tgcaaatacttccaaagagtca

SEQ ID NO: 347926 - DNA, 15 bp, Homo sapiens
tgcaaatagaaaaca

SEQ ID NO: 347927 - DNA, 17 bp, Homo sapiens
tgcaaatagtttcaaat

SEQ ID NO: 347928 - DNA, 19 bp, Homo sapiens
tgcaaatagtttcaaatga

SEQ ID NO: 347929 - DNA, 14 bp, Homo sapiens
tgcaaattctcagg

SEQ ID NO: 347930 - DNA, 18 bp, Homo sapiens
tgcaacaataataaatgt

SEQ ID NO: 347931 - DNA, 13 bp, Homo sapiens
tgcaacacacaga

SEQ ID NO: 347932 - DNA, 14 bp, Homo sapiens
tgcaacacacagac

SEQ ID NO: 347933 - DNA, 20 bp, Homo sapiens
tgcaacaggttgaggctaaa

SEQ ID NO: 347934 - DNA, 22 bp, Homo sapiens
tgcaacatggattccaaagcat

SEQ ID NO: 347935 - DNA, 16 bp, Homo sapiens
tgcaacctctgcctcc

SEQ ID NO: 347936 - DNA, 15 bp, Homo sapiens
tgcaacgtgtaactt

SEQ ID NO: 347937 - DNA, 16 bp, Homo sapiens
tgcaactagccaaggc

SEQ ID NO: 347938 - DNA, 13 bp, Homo sapiens
tgcaactccatgc

SEQ ID NO: 347939 - DNA, 16 bp, Homo sapiens
tgcaactccatgccta

SEQ ID NO: 347940 - DNA, 22 bp, Homo sapiens
tgcaactccatgcctatttact

SEQ ID NO: 347941 - DNA, 14 bp, Homo sapiens
tgcaactcttgtat

SEQ ID NO: 347942 - DNA, 18 bp, Homo sapiens
tgcaactcttgtattgct

SEQ ID NO: 347943 - DNA, 16 bp, Homo sapiens
tgcaactgaatacttg

SEQ ID NO: 347944 - DNA, 22 bp, Homo sapiens
tgcaacttcatgtcaacttctg

SEQ ID NO: 347945 - DNA, 13 bp, Homo sapiens
tgcaacttctgcc

SEQ ID NO: 347946 - DNA, 14 bp, Homo sapiens
tgcaagaagaatat

SEQ ID NO: 347947 - DNA, 21 bp, Homo sapiens
tgcaagagtgggctttccagg

SEQ ID NO: 347948 - DNA, 21 bp, Homo sapiens
tgcaagcccactggccagctc

SEQ ID NO: 347949 - DNA, 14 bp, Homo sapiens
tgcaagccccaggg

SEQ ID NO: 347950 - DNA, 15 bp, Homo sapiens
tgcaagccccagggc

SEQ ID NO: 347951 - DNA, 20 bp, Homo sapiens
tgcaagccccagggcctggg

SEQ ID NO: 347952 - DNA, 19 bp, Homo sapiens
tgcaagctccaactcccgg

SEQ ID NO: 347953 - DNA, 17 bp, Homo sapiens
tgcaaggaccaggactc

SEQ ID NO: 347954 - DNA, 14 bp, Homo sapiens
tgcaaggcccacag

SEQ ID NO: 347955 - DNA, 16 bp, Homo sapiens
tgcaagggactgtgtg

SEQ ID NO: 347956 - DNA, 21 bp, Homo sapiens
tgcaagggactgtgtgttgcc

SEQ ID NO: 347957 - DNA, 18 bp, Homo sapiens
tgcaaggtgataggaaaa

SEQ ID NO: 347958 - DNA, 20 bp, Homo sapiens
tgcaagtgagcaaacctgcc

SEQ ID NO: 347959 - DNA, 22 bp, Homo sapiens
tgcaagtgagcaaacctgcccc

SEQ ID NO: 347960 - DNA, 20 bp, Homo sapiens
tgcaagtgggagatgaaaac

SEQ ID NO: 347961 - DNA, 21 bp, Homo sapiens
tgcaagtgtatgcacgtgtgc

SEQ ID NO: 347962 - DNA, 16 bp, Homo sapiens
tgcaagtgtctgtgtg

SEQ ID NO: 347963 - DNA, 22 bp, Homo sapiens
tgcaagtgtgtatgtgcgtgtg

SEQ ID NO: 347964 - DNA, 15 bp, Homo sapiens
tgcacaactctccaa

SEQ ID NO: 347965 - DNA, 16 bp, Homo sapiens
tgcacaactctccaaa

SEQ ID NO: 347966 - DNA, 14 bp, Homo sapiens
tgcacaagccaggg

SEQ ID NO: 347967 - DNA, 22 bp, Homo sapiens
tgcacaaggaaagttattttca

SEQ ID NO: 347968 - DNA, 15 bp, Homo sapiens
tgcacacaaacacct

SEQ ID NO: 347969 - DNA, 17 bp, Homo sapiens
tgcacacacagctcctc

SEQ ID NO: 347970 - DNA, 17 bp, Homo sapiens
tgcacaccaaattgctg

SEQ ID NO: 347971 - DNA, 18 bp, Homo sapiens
tgcacaccaaattgctga

SEQ ID NO: 347972 - DNA, 20 bp, Homo sapiens
tgcacaccaaattgctgaga

SEQ ID NO: 347973 - DNA, 23 bp, Homo sapiens
tgcacaccagttactgttcatgg

SEQ ID NO: 347974 - DNA, 21 bp, Homo sapiens
tgcacacttgtgtgtgggctg

SEQ ID NO: 347975 - DNA, 15 bp, Homo sapiens
tgcacagatacacat

SEQ ID NO: 347976 - DNA, 16 bp, Homo sapiens
tgcacagatacacata

SEQ ID NO: 347977 - DNA, 15 bp, Homo sapiens
tgcacagatgccatg

SEQ ID NO: 347978 - DNA, 20 bp, Homo sapiens
tgcacagatgccatggcctg

SEQ ID NO: 347979 - DNA, 19 bp, Homo sapiens
tgcacagatggatttgcct

SEQ ID NO: 347980 - DNA, 19 bp, Homo sapiens
tgcacagattaaacttcac

SEQ ID NO: 347981 - DNA, 12 bp, Homo sapiens
tgcacagcccaa

SEQ ID NO: 347982 - DNA, 17 bp, Homo sapiens
tgcacagcccaaccagg

SEQ ID NO: 347983 - DNA, 19 bp, Homo sapiens
tgcacagcccaaccaggag

SEQ ID NO: 347984 - DNA, 20 bp, Homo sapiens
tgcacagctaacatggaagt

SEQ ID NO: 347985 - DNA, 16 bp, Homo sapiens
tgcacagtccctcctg

SEQ ID NO: 347986 - DNA, 20 bp, Homo sapiens
tgcacagtgcatctcagccc

SEQ ID NO: 347987 - DNA, 22 bp, Homo sapiens
tgcacatagctatcaagtgtgc

SEQ ID NO: 347988 - DNA, 13 bp, Homo sapiens
tgcacatgtgtgc

SEQ ID NO: 347989 - DNA, 20 bp, Homo sapiens
tgcacattaggaacagagta

SEQ ID NO: 347990 - DNA, 16 bp, Homo sapiens
tgcacattcctggccc

SEQ ID NO: 347991 - DNA, 17 bp, Homo sapiens
tgcacattcctggcccc

SEQ ID NO: 347992 - DNA, 17 bp, Homo sapiens
tgcacattgttgttttt

SEQ ID NO: 347993 - DNA, 20 bp, Homo sapiens
tgcacattttccacggaaac

SEQ ID NO: 347994 - DNA, 17 bp, Homo sapiens
tgcaccaacctcactgc

SEQ ID NO: 347995 - DNA, 21 bp, Homo sapiens
tgcaccagagtgaaagggcta

SEQ ID NO: 347996 - DNA, 23 bp, Homo sapiens
tgcaccagcccttccctgctttg

SEQ ID NO: 347997 - DNA, 13 bp, Homo sapiens
tgcaccaggagac

SEQ ID NO: 347998 - DNA, 16 bp, Homo sapiens
tgcaccattctttctt

SEQ ID NO: 347999 - DNA, 17 bp, Homo sapiens
tgcacccacccaggagt

SEQ ID NO: 348000 - DNA, 16 bp, Homo sapiens
tgcacccacccctgcc

SEQ ID NO: 348001 - DNA, 15 bp, Homo sapiens
tgcacccactcacca

SEQ ID NO: 348002 - DNA, 16 bp, Homo sapiens
tgcacccagctccagg

SEQ ID NO: 348003 - DNA, 18 bp, Homo sapiens
tgcaccccaaagctttcc

SEQ ID NO: 348004 - DNA, 15 bp, Homo sapiens
tgcaccccagcattc

SEQ ID NO: 348005 - DNA, 22 bp, Homo sapiens
tgcaccccagcattccagctct

SEQ ID NO: 348006 - DNA, 22 bp, Homo sapiens
tgcaccccatgtgggtgaccag

SEQ ID NO: 348007 - DNA, 12 bp, Homo sapiens
tgcaccctggaa

SEQ ID NO: 348008 - DNA, 19 bp, Homo sapiens
tgcacctcctaccctccca

SEQ ID NO: 348009 - DNA, 18 bp, Homo sapiens
tgcacctgcgcctggctc

SEQ ID NO: 348010 - DNA, 21 bp, Homo sapiens
tgcacctgcgcctggctctgt

SEQ ID NO: 348011 - DNA, 13 bp, Homo sapiens
tgcacctgtctca

SEQ ID NO: 348012 - DNA, 20 bp, Homo sapiens
tgcacctgtggcctctcagt

SEQ ID NO: 348013 - DNA, 22 bp, Homo sapiens
tgcacctgtggcctctcagtca

SEQ ID NO: 348014 - DNA, 19 bp, Homo sapiens
tgcaccttaccaactttct

SEQ ID NO: 348015 - DNA, 21 bp, Homo sapiens
tgcaccttaccaactttctgt

SEQ ID NO: 348016 - DNA, 15 bp, Homo sapiens
tgcacgcccatgtgt

SEQ ID NO: 348017 - DNA, 22 bp, Homo sapiens
tgcacgcccatgtgtgagtgtg

SEQ ID NO: 348018 - DNA, 22 bp, Homo sapiens
tgcacgtagtagggtcaggcca

SEQ ID NO: 348019 - DNA, 20 bp, Homo sapiens
tgcacgtggagagctggtgc

SEQ ID NO: 348020 - DNA, 17 bp, Homo sapiens
tgcacgtggcctcttga

SEQ ID NO: 348021 - DNA, 12 bp, Homo sapiens
tgcacgtgtgca

SEQ ID NO: 348022 - DNA, 22 bp, Homo sapiens
tgcactaaaacccatcttcccc

SEQ ID NO: 348023 - DNA, 22 bp, Homo sapiens
tgcactaaaagtgatgtgattt

SEQ ID NO: 348024 - DNA, 16 bp, Homo sapiens
tgcactactgaaattt

SEQ ID NO: 348025 - DNA, 19 bp, Homo sapiens
tgcactagcattttcttga

SEQ ID NO: 348026 - DNA, 15 bp, Homo sapiens
tgcactatgaggaat

SEQ ID NO: 348027 - DNA, 20 bp, Homo sapiens
tgcactccagcctgggcgac

SEQ ID NO: 348028 - DNA, 17 bp, Homo sapiens
tgcactccatggccacc

SEQ ID NO: 348029 - DNA, 16 bp, Homo sapiens
tgcactcgcactgcaa

SEQ ID NO: 348030 - DNA, 18 bp, Homo sapiens
tgcactcgcactgcaaat

SEQ ID NO: 348031 - DNA, 18 bp, Homo sapiens
tgcactcttttgagcagt

SEQ ID NO: 348032 - DNA, 16 bp, Homo sapiens
tgcactgagggccaca

SEQ ID NO: 348033 - DNA, 13 bp, Homo sapiens
tgcactgctgttc

SEQ ID NO: 348034 - DNA, 18 bp, Homo sapiens
tgcactgctgttcctgct

SEQ ID NO: 348035 - DNA, 15 bp, Homo sapiens
tgcactggccccacc

SEQ ID NO: 348036 - DNA, 16 bp, Homo sapiens
tgcactggccccaccc

SEQ ID NO: 348037 - DNA, 16 bp, Homo sapiens
tgcactgggggaacag

SEQ ID NO: 348038 - DNA, 19 bp, Homo sapiens
tgcactggggtaccacatg

SEQ ID NO: 348039 - DNA, 20 bp, Homo sapiens
tgcactggggtaccacatgg

SEQ ID NO: 348040 - DNA, 12 bp, Homo sapiens
tgcactgtaaaa

SEQ ID NO: 348041 - DNA, 13 bp, Homo sapiens
tgcactgtaaaat

SEQ ID NO: 348042 - DNA, 15 bp, Homo sapiens
tgcactgtaaaatgt

SEQ ID NO: 348043 - DNA, 16 bp, Homo sapiens
tgcacttcatatctag

SEQ ID NO: 348044 - DNA, 14 bp, Homo sapiens
tgcacttggcctct

SEQ ID NO: 348045 - DNA, 15 bp, Homo sapiens
tgcacttggcctctg

SEQ ID NO: 348046 - DNA, 16 bp, Homo sapiens
tgcactttataaacac

SEQ ID NO: 348047 - DNA, 17 bp, Homo sapiens
tgcactttataaacact

SEQ ID NO: 348048 - DNA, 12 bp, Homo sapiens
tgcactttccct

SEQ ID NO: 348049 - DNA, 15 bp, Homo sapiens
tgcacttttctgtgt

SEQ ID NO: 348050 - DNA, 19 bp, Homo sapiens
tgcagaaaaaaaaaaagaa

SEQ ID NO: 348051 - DNA, 14 bp, Homo sapiens
tgcagaacacctgg

SEQ ID NO: 348052 - DNA, 20 bp, Homo sapiens
tgcagaacatgagtgctgat

SEQ ID NO: 348053 - DNA, 19 bp, Homo sapiens
tgcagacaaaaagaacaaa

SEQ ID NO: 348054 - DNA, 11 bp, Homo sapiens
tgcagacacac

SEQ ID NO: 348055 - DNA, 13 bp, Homo sapiens
tgcagacacacaa

SEQ ID NO: 348056 - DNA, 14 bp, Homo sapiens
tgcagacacacaac

SEQ ID NO: 348057 - DNA, 17 bp, Homo sapiens
tgcagacatttacatgt

SEQ ID NO: 348058 - DNA, 19 bp, Homo sapiens
tgcagaccccttggccagc

SEQ ID NO: 348059 - DNA, 14 bp, Homo sapiens
tgcagaccctcaga

SEQ ID NO: 348060 - DNA, 11 bp, Homo sapiens
tgcagacctgg

SEQ ID NO: 348061 - DNA, 17 bp, Homo sapiens
tgcagacctgggacttt

SEQ ID NO: 348062 - DNA, 20 bp, Homo sapiens
tgcagactcagtttgtcaga

SEQ ID NO: 348063 - DNA, 24 bp, Homo sapiens
tgcagactcgttctcgtgacccag

SEQ ID NO: 348064 - DNA, 13 bp, Homo sapiens
tgcagactggagg

SEQ ID NO: 348065 - DNA, 22 bp, Homo sapiens
tgcagccctctccaccctccgg

SEQ ID NO: 348066 - DNA, 15 bp, Homo sapiens
tgcagcccttcctcc

SEQ ID NO: 348067 - DNA, 13 bp, Homo sapiens
tgcagcccttggg

SEQ ID NO: 348068 - DNA, 14 bp, Homo sapiens
tgcagcccttgggc

SEQ ID NO: 348069 - DNA, 17 bp, Homo sapiens
tgcagccggcacagggt

SEQ ID NO: 348070 - DNA, 19 bp, Homo sapiens
tgcagccggcacagggtct

SEQ ID NO: 348071 - DNA, 16 bp, Homo sapiens
tgcagcctcctcctga

SEQ ID NO: 348072 - DNA, 17 bp, Homo sapiens
tgcagcctcctcctgac

SEQ ID NO: 348073 - DNA, 19 bp, Homo sapiens
tgcagcctcgaactcctgg

SEQ ID NO: 348074 - DNA, 21 bp, Homo sapiens
tgcagcctcgaactcctgggc

SEQ ID NO: 348075 - DNA, 16 bp, Homo sapiens
tgcagcctgagctcca

SEQ ID NO: 348076 - DNA, 20 bp, Homo sapiens
tgcagcctgagctccaccct

SEQ ID NO: 348077 - DNA, 12 bp, Homo sapiens
tgcagccttccc

SEQ ID NO: 348078 - DNA, 20 bp, Homo sapiens
tgcagcggtggaaggagcct

SEQ ID NO: 348079 - DNA, 19 bp, Homo sapiens
tgcagctaagctcaaatgt

SEQ ID NO: 348080 - DNA, 21 bp, Homo sapiens
tgcagctaagctcaaatgtat

SEQ ID NO: 348081 - DNA, 18 bp, Homo sapiens
tgcagctattcacacaca

SEQ ID NO: 348082 - DNA, 20 bp, Homo sapiens
tgcagctctttcttctttga

SEQ ID NO: 348083 - DNA, 15 bp, Homo sapiens
tgcagctgacctctg

SEQ ID NO: 348084 - DNA, 14 bp, Homo sapiens
tgcagctgatttta

SEQ ID NO: 348085 - DNA, 20 bp, Homo sapiens
tgcagctgattttaacaata

SEQ ID NO: 348086 - DNA, 22 bp, Homo sapiens
tgcagctgattttaacaataac

SEQ ID NO: 348087 - DNA, 18 bp, Homo sapiens
tgcagctgggccccatgc

SEQ ID NO: 348088 - DNA, 23 bp, Homo sapiens
tgcagctgggccccatgctctgc

SEQ ID NO: 348089 - DNA, 17 bp, Homo sapiens
tgcagcttccttccaag

SEQ ID NO: 348090 - DNA, 16 bp, Homo sapiens
tgcagcttgggagagc

SEQ ID NO: 348091 - DNA, 22 bp, Homo sapiens
tgcagcttgggagagcccctgg

SEQ ID NO: 348092 - DNA, 23 bp, Homo sapiens
tgcagcttgggagagcccctggg

SEQ ID NO: 348093 - DNA, 18 bp, Homo sapiens
tgcaggaacgagcactgg

SEQ ID NO: 348094 - DNA, 22 bp, Homo sapiens
tgcaggaacgagcactggccag

SEQ ID NO: 348095 - DNA, 13 bp, Homo sapiens
tgcaggaggcctg

SEQ ID NO: 348096 - DNA, 19 bp, Homo sapiens
tgcaggatgattgtacaga

SEQ ID NO: 348097 - DNA, 13 bp, Homo sapiens
tgcaggcagcctt

SEQ ID NO: 348098 - DNA, 14 bp, Homo sapiens
tgcaggcagccttg

SEQ ID NO: 348099 - DNA, 12 bp, Homo sapiens
tgcaggccacca

SEQ ID NO: 348100 - DNA, 22 bp, Homo sapiens
tgcaggccaccagctgctggat

SEQ ID NO: 348101 - DNA, 18 bp, Homo sapiens
tgcaggccagtggacaga

SEQ ID NO: 348102 - DNA, 23 bp, Homo sapiens
tgcaggccagtggacagagggag

SEQ ID NO: 348103 - DNA, 17 bp, Homo sapiens
tgcaggcccagaggagc

SEQ ID NO: 348104 - DNA, 14 bp, Homo sapiens
tgcaggcccagcag

SEQ ID NO: 348105 - DNA, 19 bp, Homo sapiens
tgcaggcggtatccagagg

SEQ ID NO: 348106 - DNA, 23 bp, Homo sapiens
tgcaggcggtatccagaggtgag

SEQ ID NO: 348107 - DNA, 22 bp, Homo sapiens
tgcaggctcctcctctctggac

SEQ ID NO: 348108 - DNA, 13 bp, Homo sapiens
tgcaggctctggg

SEQ ID NO: 348109 - DNA, 15 bp, Homo sapiens
tgcaggctctgggct

SEQ ID NO: 348110 - DNA, 21 bp, Homo sapiens
tgcaggctctgggctcagggc

SEQ ID NO: 348111 - DNA, 23 bp, Homo sapiens
tgcaggctggcaccgccttctct

SEQ ID NO: 348112 - DNA, 19 bp, Homo sapiens
tgcaggctgtctcatttat

SEQ ID NO: 348113 - DNA, 16 bp, Homo sapiens
tgcagggaagagggca

SEQ ID NO: 348114 - DNA, 17 bp, Homo sapiens
tgcagggaagagggcag

SEQ ID NO: 348115 - DNA, 22 bp, Homo sapiens
tgcagggcagcctgtgggagaa

SEQ ID NO: 348116 - DNA, 14 bp, Homo sapiens
tgcaggggagggtc

SEQ ID NO: 348117 - DNA, 22 bp, Homo sapiens
tgcaggggattgaagccctcca

SEQ ID NO: 348118 - DNA, 18 bp, Homo sapiens
tgcagggtggtgctggga

SEQ ID NO: 348119 - DNA, 20 bp, Homo sapiens
tgcaggtacttcctcctgat

SEQ ID NO: 348120 - DNA, 20 bp, Homo sapiens
tgcaggttggaccccagaga

SEQ ID NO: 348121 - DNA, 16 bp, Homo sapiens
tgcaggtttgttacat

SEQ ID NO: 348122 - DNA, 13 bp, Homo sapiens
tgcagtacaggca

SEQ ID NO: 348123 - DNA, 13 bp, Homo sapiens
tgcagtcctggtg

SEQ ID NO: 348124 - DNA, 23 bp, Homo sapiens
tgcagtgccttggggaatttcct

SEQ ID NO: 348125 - DNA, 17 bp, Homo sapiens
tgcagtgcctttcccca

SEQ ID NO: 348126 - DNA, 16 bp, Homo sapiens
tgcagtgctgctttgc

SEQ ID NO: 348127 - DNA, 18 bp, Homo sapiens
tgcagtgggtggggctgt

SEQ ID NO: 348128 - DNA, 23 bp, Homo sapiens
tgcagtgtccattatctgctgtt

SEQ ID NO: 348129 - DNA, 18 bp, Homo sapiens
tgcagtgttcgcttggct

SEQ ID NO: 348130 - DNA, 15 bp, Homo sapiens
tgcagttcagcacca

SEQ ID NO: 348131 - DNA, 20 bp, Homo sapiens
tgcagttcccccaacctcag

SEQ ID NO: 348132 - DNA, 14 bp, Homo sapiens
tgcagttctgcagc

SEQ ID NO: 348133 - DNA, 17 bp, Homo sapiens
tgcagttgtgaaagcac

SEQ ID NO: 348134 - DNA, 16 bp, Homo sapiens
tgcagttttaagaatt

SEQ ID NO: 348135 - DNA, 15 bp, Homo sapiens
tgcataatactaatt

SEQ ID NO: 348136 - DNA, 20 bp, Homo sapiens
tgcataatactaatttattg

SEQ ID NO: 348137 - DNA, 16 bp, Homo sapiens
tgcatacacatgcact

SEQ ID NO: 348138 - DNA, 22 bp, Homo sapiens
tgcatacacatgcactcagtgt

SEQ ID NO: 348139 - DNA, 12 bp, Homo sapiens
tgcatagacaaa

SEQ ID NO: 348140 - DNA, 22 bp, Homo sapiens
tgcatagtaccaatcattttaa

SEQ ID NO: 348141 - DNA, 13 bp, Homo sapiens
tgcatatcctgag

SEQ ID NO: 348142 - DNA, 17 bp, Homo sapiens
tgcatatcctgagccat

SEQ ID NO: 348143 - DNA, 18 bp, Homo sapiens
tcccagaaccacactgtt

SEQ ID NO: 348144 - DNA, 17 bp, Homo sapiens
tcccagaatggaaaaaa

SEQ ID NO: 348145 - DNA, 19 bp, Homo sapiens
tcccagacaaggagagcgg

SEQ ID NO: 348146 - DNA, 16 bp, Homo sapiens
tcccagacaggccctc

SEQ ID NO: 348147 - DNA, 18 bp, Homo sapiens
tcccagacaggccctccc

SEQ ID NO: 348148 - DNA, 14 bp, Homo sapiens
tccccagcccactg

SEQ ID NO: 348149 - DNA, 12 bp, Homo sapiens
tccccagcccag

SEQ ID NO: 348150 - DNA, 14 bp, Homo sapiens
tccccagcccaggg

SEQ ID NO: 348151 - DNA, 18 bp, Homo sapiens
tccccagccctgtcctgg

SEQ ID NO: 348152 - DNA, 13 bp, Homo sapiens
tccccagcccttc

SEQ ID NO: 348153 - DNA, 22 bp, Homo sapiens
tccccagcccttctgcctttct

SEQ ID NO: 348154 - DNA, 22 bp, Homo sapiens
tccccagcgtcccagtctctgg

SEQ ID NO: 348155 - DNA, 16 bp, Homo sapiens
tccccaggagctcagg

SEQ ID NO: 348156 - DNA, 14 bp, Homo sapiens
tccccaggccaggt

SEQ ID NO: 348157 - DNA, 19 bp, Homo sapiens
tccccaggccaggtccctg

SEQ ID NO: 348158 - DNA, 21 bp, Homo sapiens
tccccaggccgtggctgccca

SEQ ID NO: 348159 - DNA, 12 bp, Homo sapiens
tccccaggcctc

SEQ ID NO: 348160 - DNA, 18 bp, Homo sapiens
tccccaggcctccagcct

SEQ ID NO: 348161 - DNA, 19 bp, Homo sapiens
tccccaggcctccagcctc

SEQ ID NO: 348162 - DNA, 20 bp, Homo sapiens
tccccaggcctccagcctct

SEQ ID NO: 348163 - DNA, 22 bp, Homo sapiens
tccccaggcctccagcctctcc

SEQ ID NO: 348164 - DNA, 14 bp, Homo sapiens
tccccagggcccct

SEQ ID NO: 348165 - DNA, 16 bp, Homo sapiens
tccccagggcccctcc

SEQ ID NO: 348166 - DNA, 20 bp, Homo sapiens
tccccaggggtcccagccac

SEQ ID NO: 348167 - DNA, 17 bp, Homo sapiens
tccccagggttctgtat

SEQ ID NO: 348168 - DNA, 15 bp, Homo sapiens
tccccagtgaaaact

SEQ ID NO: 348169 - DNA, 10 bp, Homo sapiens
tccccagtgc

SEQ ID NO: 348170 - DNA, 18 bp, Homo sapiens
tccccagtgcctgccact

SEQ ID NO: 348171 - DNA, 22 bp, Homo sapiens
tccccagtgcctgccactctct

SEQ ID NO: 348172 - DNA, 15 bp, Homo sapiens
tccccatatttgtgt

SEQ ID NO: 348173 - DNA, 17 bp, Homo sapiens
tccccatatttgtgttc

SEQ ID NO: 348174 - DNA, 18 bp, Homo sapiens
tccccatccccaccagct

SEQ ID NO: 348175 - DNA, 14 bp, Homo sapiens
tccccatcctccag

SEQ ID NO: 348176 - DNA, 15 bp, Homo sapiens
tccccatcctccagc

SEQ ID NO: 348177 - DNA, 19 bp, Homo sapiens
tcctaaatatccaaagact

SEQ ID NO: 348178 - DNA, 20 bp, Homo sapiens
tcctaacaaaagatgaaagc

SEQ ID NO: 348179 - DNA, 16 bp, Homo sapiens
tcctaacaggatgaaa

SEQ ID NO: 348180 - DNA, 23 bp, Homo sapiens
tcctaaccccctaagctccaggt

SEQ ID NO: 348181 - DNA, 16 bp, Homo sapiens
tcctaaggacacacta

SEQ ID NO: 348182 - DNA, 22 bp, Homo sapiens
tcctacaagagcagcctgtggc

SEQ ID NO: 348183 - DNA, 19 bp, Homo sapiens
tcctacaagatttagaaaa

SEQ ID NO: 348184 - DNA, 20 bp, Homo sapiens
tcctacaagatttagaaaaa

SEQ ID NO: 348185 - DNA, 23 bp, Homo sapiens
tcctacaatatcattttcctggg

SEQ ID NO: 348186 - DNA, 18 bp, Homo sapiens
tcctacacccttggactt

SEQ ID NO: 348187 - DNA, 20 bp, Homo sapiens
tcctacacccttggacttga

SEQ ID NO: 348188 - DNA, 12 bp, Homo sapiens
tcctaccaaagt

SEQ ID NO: 348189 - DNA, 14 bp, Homo sapiens
tcctaccaacctct

SEQ ID NO: 348190 - DNA, 15 bp, Homo sapiens
tcctaccaatgcatg

SEQ ID NO: 348191 - DNA, 21 bp, Homo sapiens
tcctaccaatgcatgcagcca

SEQ ID NO: 348192 - DNA, 15 bp, Homo sapiens
tcctacccaaccact

SEQ ID NO: 348193 - DNA, 18 bp, Homo sapiens
tcctacccgcccgcgtcc

SEQ ID NO: 348194 - DNA, 22 bp, Homo sapiens
tcctacccgcccgcgtccaacc

SEQ ID NO: 348195 - DNA, 15 bp, Homo sapiens
tcctaccctcccacc

SEQ ID NO: 348196 - DNA, 16 bp, Homo sapiens
tattgtaaaagtgaca

SEQ ID NO: 348197 - DNA, 15 bp, Homo sapiens
tattgtaaacatgtg

SEQ ID NO: 348198 - DNA, 16 bp, Homo sapiens
tattgtaaacatgtgt

SEQ ID NO: 348199 - DNA, 18 bp, Homo sapiens
tattgtaaactttttcaa

SEQ ID NO: 348200 - DNA, 20 bp, Homo sapiens
tattgtaaactttttcaatg

SEQ ID NO: 348201 - DNA, 20 bp, Homo sapiens
tattgtacagctgtttaaga

SEQ ID NO: 348202 - DNA, 18 bp, Homo sapiens
tattgtatatatggatat

SEQ ID NO: 348203 - DNA, 17 bp, Homo sapiens
tattgtgaagtacatat

SEQ ID NO: 348204 - DNA, 21 bp, Homo sapiens
tattgttcccagtgacacttc

SEQ ID NO: 348205 - DNA, 14 bp, Homo sapiens
tattgttcttgtaa

SEQ ID NO: 348206 - DNA, 15 bp, Homo sapiens
tattgttcttgtaaa

SEQ ID NO: 348207 - DNA, 16 bp, Homo sapiens
tattgttcttgtaaaa

SEQ ID NO: 348208 - DNA, 22 bp, Homo sapiens
tattgttcttgtaaaactgtga

SEQ ID NO: 348209 - DNA, 18 bp, Homo sapiens
tattgttttctgtaaata

SEQ ID NO: 348210 - DNA, 14 bp, Homo sapiens
tatttaaaattggc

SEQ ID NO: 348211 - DNA, 13 bp, Homo sapiens
tatttaaactatt

SEQ ID NO: 348212 - DNA, 12 bp, Homo sapiens
tatttaaagaaa

SEQ ID NO: 348213 - DNA, 14 bp, Homo sapiens
tatttaaagcacat

SEQ ID NO: 348214 - DNA, 21 bp, Homo sapiens
tatttaacttgagggtaataa

SEQ ID NO: 348215 - DNA, 23 bp, Homo sapiens
tatttaagaaaaacaaaatgtta

SEQ ID NO: 348216 - DNA, 14 bp, Homo sapiens
tatttaagaaaata

SEQ ID NO: 348217 - DNA, 19 bp, Homo sapiens
tatttaagaaaatacaata

SEQ ID NO: 348218 - DNA, 21 bp, Homo sapiens
tatttaagaaaatacaataaa

SEQ ID NO: 348219 - DNA, 21 bp, Homo sapiens
tcaaaaatgattttattacct

SEQ ID NO: 348220 - DNA, 20 bp, Homo sapiens
tcaaaaatgccacttaacag

SEQ ID NO: 348221 - DNA, 20 bp, Homo sapiens
tcaaaaattaaaatccagca

SEQ ID NO: 348222 - DNA, 24 bp, Homo sapiens
tcaaaacacttgtaattttgtatc

SEQ ID NO: 348223 - DNA, 21 bp, Homo sapiens
tcaaaagcacaaaccctgggg

SEQ ID NO: 348224 - DNA, 20 bp, Homo sapiens
tcaaaaggatttactttttg

SEQ ID NO: 348225 - DNA, 16 bp, Homo sapiens
tcaaaagtccttagaa

SEQ ID NO: 348226 - DNA, 12 bp, Homo sapiens
tcaaaataaaaa

SEQ ID NO: 348227 - DNA, 21 bp, Homo sapiens
tcaaaataaaaagtgacacag

SEQ ID NO: 348228 - DNA, 12 bp, Homo sapiens
tcaaaatacttc

SEQ ID NO: 348229 - DNA, 21 bp, Homo sapiens
tcaaaatacttctttttcatt

SEQ ID NO: 348230 - DNA, 18 bp, Homo sapiens
tcaaaatagttctatttc

SEQ ID NO: 348231 - DNA, 20 bp, Homo sapiens
tcaaaatagttctatttcta

SEQ ID NO: 348232 - DNA, 23 bp, Homo sapiens
tcaaaatagttctatttctatct

SEQ ID NO: 348233 - DNA, 18 bp, Homo sapiens
tcaaaatccttccaaaga

SEQ ID NO: 348234 - DNA, 13 bp, Homo sapiens
tcaaaatcttcac

SEQ ID NO: 348235 - DNA, 12 bp, Homo sapiens
tcaaaatgcatg

SEQ ID NO: 348236 - DNA, 14 bp, Homo sapiens
tcaaaatgcatgtg

SEQ ID NO: 348237 - DNA, 15 bp, Homo sapiens
tcaaaatgcatgtga

SEQ ID NO: 348238 - DNA, 14 bp, Homo sapiens
tcaaaatgtctaag

SEQ ID NO: 348239 - DNA, 21 bp, Homo sapiens
tcaaaatgttaataaaggttt

SEQ ID NO: 348240 - DNA, 15 bp, Homo sapiens
tcaaaattaaatctg

SEQ ID NO: 348241 - DNA, 12 bp, Homo sapiens
tcaaacacacag

SEQ ID NO: 348242 - DNA, 14 bp, Homo sapiens
tcaaacacacagta

SEQ ID NO: 348243 - DNA, 23 bp, Homo sapiens
tcaaacagcatcaaaatacaact

SEQ ID NO: 348244 - DNA, 15 bp, Homo sapiens
tcaaacagtaggttg

SEQ ID NO: 348245 - DNA, 16 bp, Homo sapiens
tcaaacatgaaaacat

SEQ ID NO: 348246 - DNA, 15 bp, Homo sapiens
tcaaacgaaatggct

SEQ ID NO: 348247 - DNA, 17 bp, Homo sapiens
tcaaacgtgccccccag

SEQ ID NO: 348248 - DNA, 22 bp, Homo sapiens
tcaaactacattgagcccctga

SEQ ID NO: 348249 - DNA, 17 bp, Homo sapiens
tcaaactgtagaaatga

SEQ ID NO: 348250 - DNA, 14 bp, Homo sapiens
tcaaacttccagtc

SEQ ID NO: 348251 - DNA, 22 bp, Homo sapiens
tcaaactttactctaagtctcc

SEQ ID NO: 348252 - DNA, 17 bp, Homo sapiens
tcaaactttcacctcag

SEQ ID NO: 348253 - DNA, 14 bp, Homo sapiens
tcaaactttcactt

SEQ ID NO: 348254 - DNA, 17 bp, Homo sapiens
tcaaagaacccccctcc

SEQ ID NO: 348255 - DNA, 20 bp, Homo sapiens
tcaaagaacccccctcccca

SEQ ID NO: 348256 - DNA, 16 bp, Homo sapiens
tcaaagatctttcgtt

SEQ ID NO: 348257 - DNA, 17 bp, Homo sapiens
tcaaagatgtaatgtag

SEQ ID NO: 348258 - DNA, 20 bp, Homo sapiens
tcaaagatgtaatgtagttc

SEQ ID NO: 348259 - DNA, 17 bp, Homo sapiens
tcaaagatgtactgaga

SEQ ID NO: 348260 - DNA, 16 bp, Homo sapiens
tcaaagcaaccacctg

SEQ ID NO: 348261 - DNA, 13 bp, Homo sapiens
tcaaagcaagggc

SEQ ID NO: 348262 - DNA, 17 bp, Homo sapiens
tcaaagcaagggctcca

SEQ ID NO: 348263 - DNA, 15 bp, Homo sapiens
tcaaagcatcaaata

SEQ ID NO: 348264 - DNA, 18 bp, Homo sapiens
tcaaagcatcaaataata

SEQ ID NO: 348265 - DNA, 19 bp, Homo sapiens
tcaaagcatcaaataatac

SEQ ID NO: 348266 - DNA, 20 bp, Homo sapiens
tcaaagctaggaaaggcaga

SEQ ID NO: 348267 - DNA, 17 bp, Homo sapiens
tcaaagctgaagccgcc

SEQ ID NO: 348268 - DNA, 16 bp, Homo sapiens
tcaaagctgaatattt

SEQ ID NO: 348269 - DNA, 14 bp, Homo sapiens
tcaaagcttgaaga

SEQ ID NO: 348270 - DNA, 15 bp, Homo sapiens
tcaaaggactgacct

SEQ ID NO: 348271 - DNA, 13 bp, Homo sapiens
tcaaaggcagaaa

SEQ ID NO: 348272 - DNA, 19 bp, Homo sapiens
tcaaaggcagaaaggagat

SEQ ID NO: 348273 - DNA, 21 bp, Homo sapiens
tcaaagtaggtatacaaaaga

SEQ ID NO: 348274 - DNA, 18 bp, Homo sapiens
tcaaagtgaaagacattt

SEQ ID NO: 348275 - DNA, 19 bp, Homo sapiens
tcaaagtggtacaggaagg

SEQ ID NO: 348276 - DNA, 18 bp, Homo sapiens
tcaaagtttttacagtgt

SEQ ID NO: 348277 - DNA, 18 bp, Homo sapiens
tcaaataaagttcaaagc

SEQ ID NO: 348278 - DNA, 14 bp, Homo sapiens
tcaaataaatttct

SEQ ID NO: 348279 - DNA, 16 bp, Homo sapiens
tcaaataaatttctgg

SEQ ID NO: 348280 - DNA, 20 bp, Homo sapiens
tcaaataaatttctgggata

SEQ ID NO: 348281 - DNA, 19 bp, Homo sapiens
tcaaataatacatctttat

SEQ ID NO: 348282 - DNA, 12 bp, Homo sapiens
tcaaatcattca

SEQ ID NO: 348283 - DNA, 13 bp, Homo sapiens
tcaaatcattcaa

SEQ ID NO: 348284 - DNA, 16 bp, Homo sapiens
tcaaatctattcagac

SEQ ID NO: 348285 - DNA, 16 bp, Homo sapiens
tcaaatctccagtatt

SEQ ID NO: 348286 - DNA, 17 bp, Homo sapiens
tcaaatgagtttaaaaa

SEQ ID NO: 348287 - DNA, 24 bp, Homo sapiens
tcaaatgcattttctacatgtatt

SEQ ID NO: 348288 - DNA, 13 bp, Homo sapiens
tcaaatgtatatt

SEQ ID NO: 348289 - DNA, 19 bp, Homo sapiens
tcaaatgtatatttaactt

SEQ ID NO: 348290 - DNA, 18 bp, Homo sapiens
tcaaatgttattcaataa

SEQ ID NO: 348291 - DNA, 14 bp, Homo sapiens
tcaaattgtatcta

SEQ ID NO: 348292 - DNA, 20 bp, Homo sapiens
tcaaattttgcattgtgtga

SEQ ID NO: 348293 - DNA, 16 bp, Homo sapiens
tcaaatttttctggga

SEQ ID NO: 348294 - DNA, 20 bp, Homo sapiens
tcaacaaagaagaaccatct

SEQ ID NO: 348295 - DNA, 15 bp, Homo sapiens
tcaacaaagcacagt

SEQ ID NO: 348296 - DNA, 23 bp, Homo sapiens
tcaacaaagcacagtgttaaatg

SEQ ID NO: 348297 - DNA, 20 bp, Homo sapiens
tcaacaagaatattgtatgt

SEQ ID NO: 348298 - DNA, 16 bp, Homo sapiens
tcaacaagggagagac

SEQ ID NO: 348299 - DNA, 17 bp, Homo sapiens
tcaacacccgccccccc

SEQ ID NO: 348300 - DNA, 16 bp, Homo sapiens
tcaacaggttttcctg

SEQ ID NO: 348301 - DNA, 14 bp, Homo sapiens
tcaacatcaatgtt

SEQ ID NO: 348302 - DNA, 20 bp, Homo sapiens
tcaacatcaatgttcattgt

SEQ ID NO: 348303 - DNA, 22 bp, Homo sapiens
tcaacatgttactgaccagcaa

SEQ ID NO: 348304 - DNA, 22 bp, Homo sapiens
tcaaccatgaggtaaaagagcc

SEQ ID NO: 348305 - DNA, 18 bp, Homo sapiens
tcaaccattccccatggg

SEQ ID NO: 348306 - DNA, 14 bp, Homo sapiens
tcaacccccctccc

SEQ ID NO: 348307 - DNA, 15 bp, Homo sapiens
tcaacccccctccca

SEQ ID NO: 348308 - DNA, 21 bp, Homo sapiens
tcaacccccctcccagacagg

SEQ ID NO: 348309 - DNA, 17 bp, Homo sapiens
tcaacccgctgcttcca

SEQ ID NO: 348310 - DNA, 14 bp, Homo sapiens
tcaaccctccctca

SEQ ID NO: 348311 - DNA, 15 bp, Homo sapiens
tcaaccctccctcag

SEQ ID NO: 348312 - DNA, 18 bp, Homo sapiens
tcaaccctccctcagccc

SEQ ID NO: 348313 - DNA, 20 bp, Homo sapiens
tcaaccctccctcagcccct

SEQ ID NO: 348314 - DNA, 18 bp, Homo sapiens
tcaacctgtaaattattt

SEQ ID NO: 348315 - DNA, 20 bp, Homo sapiens
tcaacctgtgatgaggggag

SEQ ID NO: 348316 - DNA, 18 bp, Homo sapiens
tcaaccttgacttctgcc

SEQ ID NO: 348317 - DNA, 17 bp, Homo sapiens
tcaaccttgagacagct

SEQ ID NO: 348318 - DNA, 23 bp, Homo sapiens
tcaactaaagaatagtgcctcag

SEQ ID NO: 348319 - DNA, 14 bp, Homo sapiens
tcaactccaaggca

SEQ ID NO: 348320 - DNA, 15 bp, Homo sapiens
tcaactccaaggcaa

SEQ ID NO: 348321 - DNA, 17 bp, Homo sapiens
tcaactccaaggcaaat

SEQ ID NO: 348322 - DNA, 22 bp, Homo sapiens
tcaactccaaggcaaatgtcca

SEQ ID NO: 348323 - DNA, 14 bp, Homo sapiens
tcaactctacccct

SEQ ID NO: 348324 - DNA, 20 bp, Homo sapiens
tcaactctccaatgttctat

SEQ ID NO: 348325 - DNA, 21 bp, Homo sapiens
tcaactctgtgtcccagcacc

SEQ ID NO: 348326 - DNA, 20 bp, Homo sapiens
tcaactgcatcaagatgtga

SEQ ID NO: 348327 - DNA, 17 bp, Homo sapiens
tcaactgctgttttatg

SEQ ID NO: 348328 - DNA, 22 bp, Homo sapiens
tcaactgctgttttatgtcata

SEQ ID NO: 348329 - DNA, 14 bp, Homo sapiens
tcaacttcaggaaa

SEQ ID NO: 348330 - DNA, 14 bp, Homo sapiens
tcaactttatgcag

SEQ ID NO: 348331 - DNA, 15 bp, Homo sapiens
tcaactttcatttga

SEQ ID NO: 348332 - DNA, 13 bp, Homo sapiens
tcaagaaaggaaa

SEQ ID NO: 348333 - DNA, 19 bp, Homo sapiens
tcaagaagacatggagact

SEQ ID NO: 348334 - DNA, 17 bp, Homo sapiens
tcaagaagtaagagcta

SEQ ID NO: 348335 - DNA, 16 bp, Homo sapiens
tcaagaatgtgtagga

SEQ ID NO: 348336 - DNA, 20 bp, Homo sapiens
tcaagactgaaatggcttct

SEQ ID NO: 348337 - DNA, 20 bp, Homo sapiens
taggacatgttcccttctcc

SEQ ID NO: 348338 - DNA, 18 bp, Homo sapiens
taggactatataaagtac

SEQ ID NO: 348339 - DNA, 18 bp, Homo sapiens
taggacttcaaaaggtga

SEQ ID NO: 348340 - DNA, 19 bp, Homo sapiens
taggactttagggatctgg

SEQ ID NO: 348341 - DNA, 14 bp, Homo sapiens
taggagacacagat

SEQ ID NO: 348342 - DNA, 11 bp, Homo sapiens
taggagacttt

SEQ ID NO: 348343 - DNA, 16 bp, Homo sapiens
taggagataccaggtt

SEQ ID NO: 348344 - DNA, 15 bp, Homo sapiens
taggagcttccagat

SEQ ID NO: 348345 - DNA, 18 bp, Homo sapiens
taggagcttccagatggg

SEQ ID NO: 348346 - DNA, 22 bp, Homo sapiens
taggaggaatgtgcttttccat

SEQ ID NO: 348347 - DNA, 20 bp, Homo sapiens
taggagtaaagataaaagga

SEQ ID NO: 348348 - DNA, 20 bp, Homo sapiens
taggagtgtctaagttttgt

SEQ ID NO: 348349 - DNA, 13 bp, Homo sapiens
taggatagcattt

SEQ ID NO: 348350 - DNA, 17 bp, Homo sapiens
taggattatagatactt

SEQ ID NO: 348351 - DNA, 12 bp, Homo sapiens
taggatttaaca

SEQ ID NO: 348352 - DNA, 21 bp, Homo sapiens
taggatttaacagtcatttaa

SEQ ID NO: 348353 - DNA, 16 bp, Homo sapiens
taggcaaagttttcca

SEQ ID NO: 348354 - DNA, 15 bp, Homo sapiens
taggcaaggatgaaa

SEQ ID NO: 348355 - DNA, 20 bp, Homo sapiens
taggcaaggatgaaagacaa

SEQ ID NO: 348356 - DNA, 23 bp, Homo sapiens
taggcagagcccgcccacctggg

SEQ ID NO: 348357 - DNA, 21 bp, Homo sapiens
taggcaggaagtcaggagcca

SEQ ID NO: 348358 - DNA, 17 bp, Homo sapiens
taggcagggatttgagg

SEQ ID NO: 348359 - DNA, 19 bp, Homo sapiens
taggcagggatttgaggag

SEQ ID NO: 348360 - DNA, 22 bp, Homo sapiens
taggcagttagagatgcctccc

SEQ ID NO: 348361 - DNA, 18 bp, Homo sapiens
taggcatctcctctcccc

SEQ ID NO: 348362 - DNA, 12 bp, Homo sapiens
taggcatttgta

SEQ ID NO: 348363 - DNA, 14 bp, Homo sapiens
taggccatctgtaa

SEQ ID NO: 348364 - DNA, 19 bp, Homo sapiens
taggccatctgtaaatatc

SEQ ID NO: 348365 - DNA, 23 bp, Homo sapiens
taggcccaaggtcccctccacat

SEQ ID NO: 348366 - DNA, 12 bp, Homo sapiens
taggcccaggat

SEQ ID NO: 348367 - DNA, 17 bp, Homo sapiens
taggcccgggcccctgg

SEQ ID NO: 348368 - DNA, 15 bp, Homo sapiens
taggcccttgtcctg

SEQ ID NO: 348369 - DNA, 18 bp, Homo sapiens
taggcccttgtcctgcca

SEQ ID NO: 348370 - DNA, 21 bp, Homo sapiens
taggcccttgtcctgccagct

SEQ ID NO: 348371 - DNA, 18 bp, Homo sapiens
taggcctcagtgtcctca

SEQ ID NO: 348372 - DNA, 22 bp, Homo sapiens
taggcctgtgaggtaactggga

SEQ ID NO: 348373 - DNA, 15 bp, Homo sapiens
taggcgcccctgggg

SEQ ID NO: 348374 - DNA, 20 bp, Homo sapiens
taggcggcgatttttgtatg

SEQ ID NO: 348375 - DNA, 15 bp, Homo sapiens
taggctaaaaacatt

SEQ ID NO: 348376 - DNA, 19 bp, Homo sapiens
taggctacccttgccaagg

SEQ ID NO: 348377 - DNA, 16 bp, Homo sapiens
taggctcactctttcc

SEQ ID NO: 348378 - DNA, 15 bp, Homo sapiens
taggctctgcacaga

SEQ ID NO: 348379 - DNA, 17 bp, Homo sapiens
taggctgagatgcacca

SEQ ID NO: 348380 - DNA, 12 bp, Homo sapiens
taggctgggtgc

SEQ ID NO: 348381 - DNA, 12 bp, Homo sapiens
taggctgtattt

SEQ ID NO: 348382 - DNA, 23 bp, Homo sapiens
taggctgtggtgcagtaaccatt

SEQ ID NO: 348383 - DNA, 21 bp, Homo sapiens
taggcttaagagagagagcct

SEQ ID NO: 348384 - DNA, 19 bp, Homo sapiens
tagggaaaatagggtcctt

SEQ ID NO: 348385 - DNA, 17 bp, Homo sapiens
tagggaaatccaactcc

SEQ ID NO: 348386 - DNA, 17 bp, Homo sapiens
tagggaaggccacctgc

SEQ ID NO: 348387 - DNA, 18 bp, Homo sapiens
tagggatctggggaagga

SEQ ID NO: 348388 - DNA, 23 bp, Homo sapiens
tagggatctggggaaggaccaac

SEQ ID NO: 348389 - DNA, 18 bp, Homo sapiens
tagggcaaagaatcaaca

SEQ ID NO: 348390 - DNA, 23 bp, Homo sapiens
tagggctacaaaacctgatgtta

SEQ ID NO: 348391 - DNA, 12 bp, Homo sapiens
tagggctgggtg

SEQ ID NO: 348392 - DNA, 20 bp, Homo sapiens
tagggctgtagacttacttt

SEQ ID NO: 348393 - DNA, 17 bp, Homo sapiens
taggggccgagtccagg

SEQ ID NO: 348394 - DNA, 13 bp, Homo sapiens
taggggttgctaa

SEQ ID NO: 348395 - DNA, 13 bp, Homo sapiens
tagggtaaaaatt

SEQ ID NO: 348396 - DNA, 19 bp, Homo sapiens
tagggtaagtgagagaggg

SEQ ID NO: 348397 - DNA, 20 bp, Homo sapiens
tagggtccttgaaacagaaa

SEQ ID NO: 348398 - DNA, 14 bp, Homo sapiens
tagggtgaggcgtg

SEQ ID NO: 348399 - DNA, 13 bp, Homo sapiens
tagggtggacaga

SEQ ID NO: 348400 - DNA, 16 bp, Homo sapiens
tagggtggacagaagc

SEQ ID NO: 348401 - DNA, 12 bp, Homo sapiens
tagggtggccct

SEQ ID NO: 348402 - DNA, 12 bp, Homo sapiens
taggtaagggcc

SEQ ID NO: 348403 - DNA, 12 bp, Homo sapiens
taggtaggagac

SEQ ID NO: 348404 - DNA, 21 bp, Homo sapiens
taggtagtggggaccaagttc

SEQ ID NO: 348405 - DNA, 21 bp, Homo sapiens
taggtataaaaaataagtaaa

SEQ ID NO: 348406 - DNA, 22 bp, Homo sapiens
taggtcagtacccacctgagct

SEQ ID NO: 348407 - DNA, 15 bp, Homo sapiens
taggtccaagggcca

SEQ ID NO: 348408 - DNA, 19 bp, Homo sapiens
taggtcgggtgttaaagtt

SEQ ID NO: 348409 - DNA, 13 bp, Homo sapiens
taggtctccaccc

SEQ ID NO: 348410 - DNA, 21 bp, Homo sapiens
taggtctcctcagggtggggg

SEQ ID NO: 348411 - DNA, 16 bp, Homo sapiens
taggtctgcacacata

SEQ ID NO: 348412 - DNA, 14 bp, Homo sapiens
taggtctgcatttt

SEQ ID NO: 348413 - DNA, 19 bp, Homo sapiens
taggtgatgtttccagctg

SEQ ID NO: 348414 - DNA, 19 bp, Homo sapiens
taggtgcccagtcttgagt

SEQ ID NO: 348415 - DNA, 23 bp, Homo sapiens
taggtgtcttttaatgatactgt

SEQ ID NO: 348416 - DNA, 16 bp, Homo sapiens
taggttaataggagga

SEQ ID NO: 348417 - DNA, 19 bp, Homo sapiens
taggttaataggaggacag

SEQ ID NO: 348418 - DNA, 22 bp, Homo sapiens
taggttaattccaattatatga

SEQ ID NO: 348419 - DNA, 18 bp, Homo sapiens
taggttgaggacaggaga

SEQ ID NO: 348420 - DNA, 19 bp, Homo sapiens
taggtttaactcagatcac

SEQ ID NO: 348421 - DNA, 23 bp, Homo sapiens
taggtttagaatcaagtctgtga

SEQ ID NO: 348422 - DNA, 12 bp, Homo sapiens
tagtaaatatta

SEQ ID NO: 348423 - DNA, 22 bp, Homo sapiens
tagtaaatattatgattttatt

SEQ ID NO: 348424 - DNA, 15 bp, Homo sapiens
tagtaatgttttata

SEQ ID NO: 348425 - DNA, 16 bp, Homo sapiens
tagtacaaattataaa

SEQ ID NO: 348426 - DNA, 17 bp, Homo sapiens
tagtacccacctgagct

SEQ ID NO: 348427 - DNA, 20 bp, Homo sapiens
tagtaccttcagatcctacc

SEQ ID NO: 348428 - DNA, 16 bp, Homo sapiens
tagtactatatctgtt

SEQ ID NO: 348429 - DNA, 19 bp, Homo sapiens
tagtactcctgcaaaattt

SEQ ID NO: 348430 - DNA, 17 bp, Homo sapiens
tagtactctctgctcta

SEQ ID NO: 348431 - DNA, 19 bp, Homo sapiens
tagtagaaattttacaata

SEQ ID NO: 348432 - DNA, 17 bp, Homo sapiens
tagtagatctgtggcga

SEQ ID NO: 348433 - DNA, 19 bp, Homo sapiens
tagtagccctttctgtgtg

SEQ ID NO: 348434 - DNA, 15 bp, Homo sapiens
tagtagctgataaag

SEQ ID NO: 348435 - DNA, 19 bp, Homo sapiens
tagtagctgataaagaaac

SEQ ID NO: 348436 - DNA, 17 bp, Homo sapiens
tagtagttgatgaccaa

SEQ ID NO: 348437 - DNA, 19 bp, Homo sapiens
tagtatatctggacaagcc

SEQ ID NO: 348438 - DNA, 18 bp, Homo sapiens
tagtatatttatataatt

SEQ ID NO: 348439 - DNA, 19 bp, Homo sapiens
tagtatatttatataatta

SEQ ID NO: 348440 - DNA, 15 bp, Homo sapiens
tcctctgtgctccct

SEQ ID NO: 348441 - DNA, 16 bp, Homo sapiens
tcctctgtgctccctc

SEQ ID NO: 348442 - DNA, 17 bp, Homo sapiens
tcctctgtgctccctcg

SEQ ID NO: 348443 - DNA, 13 bp, Homo sapiens
tcctctgttcagt

SEQ ID NO: 348444 - DNA, 19 bp, Homo sapiens
tcctcttaccgtagcctcc

SEQ ID NO: 348445 - DNA, 14 bp, Homo sapiens
tcctcttacctgta

SEQ ID NO: 348446 - DNA, 23 bp, Homo sapiens
tcctcttacctgtaatagcctca

SEQ ID NO: 348447 - DNA, 17 bp, Homo sapiens
tcctcttaggtcccggg

SEQ ID NO: 348448 - DNA, 18 bp, Homo sapiens
tcctcttaggtcccggga

SEQ ID NO: 348449 - DNA, 19 bp, Homo sapiens
tcctcttaggtcccgggag

SEQ ID NO: 348450 - DNA, 13 bp, Homo sapiens
tcctcttccttct

SEQ ID NO: 348451 - DNA, 15 bp, Homo sapiens
tcctcttccttctct

SEQ ID NO: 348452 - DNA, 22 bp, Homo sapiens
tcctcttctgtaaaatgggtat

SEQ ID NO: 348453 - DNA, 22 bp, Homo sapiens
tcctcttgagggtcattttcct

SEQ ID NO: 348454 - DNA, 18 bp, Homo sapiens
tcctctttcagaaaacag

SEQ ID NO: 348455 - DNA, 21 bp, Homo sapiens
tcctctttcagaaaacagaaa

SEQ ID NO: 348456 - DNA, 16 bp, Homo sapiens
tcctctttcccctcct

SEQ ID NO: 348457 - DNA, 14 bp, Homo sapiens
tcctctttgcatgg

SEQ ID NO: 348458 - DNA, 15 bp, Homo sapiens
tcctctttgttttgt

SEQ ID NO: 348459 - DNA, 18 bp, Homo sapiens
tcctgaaagaaacagtta

SEQ ID NO: 348460 - DNA, 11 bp, Homo sapiens
tcctgaataac

SEQ ID NO: 348461 - DNA, 16 bp, Homo sapiens
tcctgaatattaatcc

SEQ ID NO: 348462 - DNA, 16 bp, Homo sapiens
tcctgacccagtcccc

SEQ ID NO: 348463 - DNA, 15 bp, Homo sapiens
tcctgacgccctgcg

SEQ ID NO: 348464 - DNA, 13 bp, Homo sapiens
tcctgactgggaa

SEQ ID NO: 348465 - DNA, 13 bp, Homo sapiens
tcctgacttttaa

SEQ ID NO: 348466 - DNA, 20 bp, Homo sapiens
tcctgagaaacgtccatctc

SEQ ID NO: 348467 - DNA, 22 bp, Homo sapiens
tcctgagaaacgtccatctctc

SEQ ID NO: 348468 - DNA, 20 bp, Homo sapiens
tcctgagaaagcccacctgg

SEQ ID NO: 348469 - DNA, 20 bp, Homo sapiens
tcctgagaaggcgaggagag

SEQ ID NO: 348470 - DNA, 21 bp, Homo sapiens
tcctgagattctgggaaaggt

SEQ ID NO: 348471 - DNA, 23 bp, Homo sapiens
tcctgagattctgggaaaggtgc

SEQ ID NO: 348472 - DNA, 15 bp, Homo sapiens
tcctgagcacccgct

SEQ ID NO: 348473 - DNA, 16 bp, Homo sapiens
tcctgagccccctgca

SEQ ID NO: 348474 - DNA, 14 bp, Homo sapiens
tcctgagcctgtct

SEQ ID NO: 348475 - DNA, 16 bp, Homo sapiens
tcctgagcctgtgggt

SEQ ID NO: 348476 - DNA, 16 bp, Homo sapiens
tcctgagcttggccag

SEQ ID NO: 348477 - DNA, 23 bp, Homo sapiens
tcctgaggcagaacctggtggct

SEQ ID NO: 348478 - DNA, 21 bp, Homo sapiens
tcctgaggggatatccctatg

SEQ ID NO: 348479 - DNA, 16 bp, Homo sapiens
tcctgaggggcatctg

SEQ ID NO: 348480 - DNA, 21 bp, Homo sapiens
tcctgaggggcatctgcccct

SEQ ID NO: 348481 - DNA, 18 bp, Homo sapiens
tcctgataataattgatc

SEQ ID NO: 348482 - DNA, 17 bp, Homo sapiens
tcctgatactgggtaca

SEQ ID NO: 348483 - DNA, 17 bp, Homo sapiens
tcctgatagtcacctgc

SEQ ID NO: 348484 - DNA, 18 bp, Homo sapiens
tcctgatagtcacctgct

SEQ ID NO: 348485 - DNA, 14 bp, Homo sapiens
tcctgatggccaag

SEQ ID NO: 348486 - DNA, 18 bp, Homo sapiens
tcctgatggtcagctccc

SEQ ID NO: 348487 - DNA, 21 bp, Homo sapiens
tcctgatggtcagctcccttc

SEQ ID NO: 348488 - DNA, 16 bp, Homo sapiens
tcctgattctccctgg

SEQ ID NO: 348489 - DNA, 19 bp, Homo sapiens
tcctgattgctctggaagc

SEQ ID NO: 348490 - DNA, 14 bp, Homo sapiens
tcctgatttgagtt

SEQ ID NO: 348491 - DNA, 18 bp, Homo sapiens
tcctgcaactcaaggact

SEQ ID NO: 348492 - DNA, 15 bp, Homo sapiens
tcctgcaatctccag

SEQ ID NO: 348493 - DNA, 16 bp, Homo sapiens
tcctgcaatttctccc

SEQ ID NO: 348494 - DNA, 16 bp, Homo sapiens
tcctgcaattttctaa

SEQ ID NO: 348495 - DNA, 21 bp, Homo sapiens
tcctgcaccccagcattccag

SEQ ID NO: 348496 - DNA, 14 bp, Homo sapiens
tcctgcaccctctg

SEQ ID NO: 348497 - DNA, 21 bp, Homo sapiens
tcctgcaccctctgctatgtc

SEQ ID NO: 348498 - DNA, 13 bp, Homo sapiens
tcctgcagagctg

SEQ ID NO: 348499 - DNA, 15 bp, Homo sapiens
tcctgcagagctggg

SEQ ID NO: 348500 - DNA, 17 bp, Homo sapiens
tcctgcagagctggggg

SEQ ID NO: 348501 - DNA, 23 bp, Homo sapiens
tcctgcagagctggggggaaggc

SEQ ID NO: 348502 - DNA, 15 bp, Homo sapiens
tcctgcagcagagcc

SEQ ID NO: 348503 - DNA, 12 bp, Homo sapiens
tcctgcagcctc

SEQ ID NO: 348504 - DNA, 16 bp, Homo sapiens
tcctgcagcctcctcc

SEQ ID NO: 348505 - DNA, 17 bp, Homo sapiens
tcctgcaggctggctgt

SEQ ID NO: 348506 - DNA, 14 bp, Homo sapiens
tcctgcatctttca

SEQ ID NO: 348507 - DNA, 16 bp, Homo sapiens
tcctgccagctgcctt

SEQ ID NO: 348508 - DNA, 18 bp, Homo sapiens
tcctgccagctgccttcc

SEQ ID NO: 348509 - DNA, 21 bp, Homo sapiens
tcctgccaggagcagcctcca

SEQ ID NO: 348510 - DNA, 19 bp, Homo sapiens
tcctgccaggctctccctc

SEQ ID NO: 348511 - DNA, 15 bp, Homo sapiens
tcctgcccagctctg

SEQ ID NO: 348512 - DNA, 21 bp, Homo sapiens
tcctgcccagctctgaccctg

SEQ ID NO: 348513 - DNA, 22 bp, Homo sapiens
tcctgcccagtgttgtttgtaa

SEQ ID NO: 348514 - DNA, 19 bp, Homo sapiens
tcctgcccccgccctgctg

SEQ ID NO: 348515 - DNA, 12 bp, Homo sapiens
tcctgccccctg

SEQ ID NO: 348516 - DNA, 13 bp, Homo sapiens
tcctgccccctgc

SEQ ID NO: 348517 - DNA, 12 bp, Homo sapiens
tcctgccctaca

SEQ ID NO: 348518 - DNA, 12 bp, Homo sapiens
tcctgccctccc

SEQ ID NO: 348519 - DNA, 20 bp, Homo sapiens
tcctgccctcgtctccctgg

SEQ ID NO: 348520 - DNA, 13 bp, Homo sapiens
tcctgccctgtac

SEQ ID NO: 348521 - DNA, 15 bp, Homo sapiens
tcctgccctgtacct

SEQ ID NO: 348522 - DNA, 19 bp, Homo sapiens
tcctgccctgtacctctct

SEQ ID NO: 348523 - DNA, 18 bp, Homo sapiens
tcctgccctgtccctgtc

SEQ ID NO: 348524 - DNA, 16 bp, Homo sapiens
tcctgcctcagccttc

SEQ ID NO: 348525 - DNA, 21 bp, Homo sapiens
tcctgccttctcttctatcct

SEQ ID NO: 348526 - DNA, 17 bp, Homo sapiens
tcctgcctttcttccat

SEQ ID NO: 348527 - DNA, 11 bp, Homo sapiens
tcctgcctttg

SEQ ID NO: 348528 - DNA, 19 bp, Homo sapiens
tcctgctacaacttcagca

SEQ ID NO: 348529 - DNA, 21 bp, Homo sapiens
tcctgctacaacttcagcagt

SEQ ID NO: 348530 - DNA, 20 bp, Homo sapiens
tcctgctacagtagctgtgg

SEQ ID NO: 348531 - DNA, 16 bp, Homo sapiens
tcctgctagctgtaga

SEQ ID NO: 348532 - DNA, 18 bp, Homo sapiens
tcctgctagctgtagaaa

SEQ ID NO: 348533 - DNA, 22 bp, Homo sapiens
tcctgctcaactctacccctgc

SEQ ID NO: 348534 - DNA, 23 bp, Homo sapiens
tcctgctcaactctacccctgct

SEQ ID NO: 348535 - DNA, 16 bp, Homo sapiens
tcctgctcctcaggaa

SEQ ID NO: 348536 - DNA, 19 bp, Homo sapiens
tcctgctctctacccagcc

SEQ ID NO: 348537 - DNA, 21 bp, Homo sapiens
tcctgctctctacccagccca

SEQ ID NO: 348538 - DNA, 20 bp, Homo sapiens
tcctgctgagtggtccacat

SEQ ID NO: 348539 - DNA, 19 bp, Homo sapiens
tcctgctgctcgggaaggc

SEQ ID NO: 348540 - DNA, 21 bp, Homo sapiens
tcctgctgctcgggaaggcct

SEQ ID NO: 348541 - DNA, 11 bp, Homo sapiens
tcctgctgtgc

SEQ ID NO: 348542 - DNA, 19 bp, Homo sapiens
tcctgcttgtactaagcca

SEQ ID NO: 348543 - DNA, 13 bp, Homo sapiens
tcctgctttctct

SEQ ID NO: 348544 - DNA, 21 bp, Homo sapiens
tcctggacatcctcttctgct

SEQ ID NO: 348545 - DNA, 22 bp, Homo sapiens
tcctggacatcctcttctgctt

SEQ ID NO: 348546 - DNA, 18 bp, Homo sapiens
tcctggacccagcagggg

SEQ ID NO: 348547 - DNA, 22 bp, Homo sapiens
tcctggacctgagtcggcccca

SEQ ID NO: 348548 - DNA, 21 bp, Homo sapiens
tcctggactggcccttgccca

SEQ ID NO: 348549 - DNA, 19 bp, Homo sapiens
tcctggagcatcccaggcg

SEQ ID NO: 348550 - DNA, 18 bp, Homo sapiens
tcctggagccccagaacc

SEQ ID NO: 348551 - DNA, 23 bp, Homo sapiens
tcgaggtgtcaccctgcagagct

SEQ ID NO: 348552 - DNA, 18 bp, Homo sapiens
tcgagtgcccctgcaggg

SEQ ID NO: 348553 - DNA, 13 bp, Homo sapiens
tcgatatgaaaaa

SEQ ID NO: 348554 - DNA, 14 bp, Homo sapiens
tcgatgcaagtgtt

SEQ ID NO: 348555 - DNA, 12 bp, Homo sapiens
tcgatgcactga

SEQ ID NO: 348556 - DNA, 18 bp, Homo sapiens
tcgatgcctttgctgttt

SEQ ID NO: 348557 - DNA, 23 bp, Homo sapiens
tcgattgaaggtgacctctgccc

SEQ ID NO: 348558 - DNA, 16 bp, Homo sapiens
tcgcaaaatgatgtga

SEQ ID NO: 348559 - DNA, 16 bp, Homo sapiens
tcgcaaggcctgtgct

SEQ ID NO: 348560 - DNA, 21 bp, Homo sapiens
tcgcagaccagagctgtctga

SEQ ID NO: 348561 - DNA, 22 bp, Homo sapiens
tcgcaggatccgctgccaccac

SEQ ID NO: 348562 - DNA, 14 bp, Homo sapiens
tcgcagtcgcagga

SEQ ID NO: 348563 - DNA, 21 bp, Homo sapiens
tcgcagtgcccagtgatggca

SEQ ID NO: 348564 - DNA, 13 bp, Homo sapiens
tcgccaagccatc

SEQ ID NO: 348565 - DNA, 15 bp, Homo sapiens
tcgccattcactgat

SEQ ID NO: 348566 - DNA, 19 bp, Homo sapiens
tcgcccaggctggagtgca

SEQ ID NO: 348567 - DNA, 20 bp, Homo sapiens
tcgccccagatcaccagccc

SEQ ID NO: 348568 - DNA, 12 bp, Homo sapiens
tcgcccctcctc

SEQ ID NO: 348569 - DNA, 11 bp, Homo sapiens
tcgcccgccca

SEQ ID NO: 348570 - DNA, 15 bp, Homo sapiens
tcgcccgcccactgt

SEQ ID NO: 348571 - DNA, 18 bp, Homo sapiens
tcgcccgcccactgtcct

SEQ ID NO: 348572 - DNA, 19 bp, Homo sapiens
tcgcccgcccactgtcctg

SEQ ID NO: 348573 - DNA, 21 bp, Homo sapiens
tcgcccgcccactgtcctggg

SEQ ID NO: 348574 - DNA, 13 bp, Homo sapiens
tcgccctctgtgc

SEQ ID NO: 348575 - DNA, 14 bp, Homo sapiens
tcgccctctgtgcc

SEQ ID NO: 348576 - DNA, 15 bp, Homo sapiens
tcgccctctgtgcct

SEQ ID NO: 348577 - DNA, 14 bp, Homo sapiens
tcgcctaggcctgt

SEQ ID NO: 348578 - DNA, 21 bp, Homo sapiens
tcgcctgacaaccactggtct

SEQ ID NO: 348579 - DNA, 20 bp, Homo sapiens
tcgcctgcggactccatggc

SEQ ID NO: 348580 - DNA, 16 bp, Homo sapiens
tcgcggcgcagcccct

SEQ ID NO: 348581 - DNA, 14 bp, Homo sapiens
tcgcggctgggagc

SEQ ID NO: 348582 - DNA, 18 bp, Homo sapiens
tcgctcaatcaagaaaat

SEQ ID NO: 348583 - DNA, 23 bp, Homo sapiens
tcgctcccatgcacaactctcca

SEQ ID NO: 348584 - DNA, 18 bp, Homo sapiens
tcgctgaacaattacctg

SEQ ID NO: 348585 - DNA, 17 bp, Homo sapiens
tcgctgtgatgcatgag

SEQ ID NO: 348586 - DNA, 11 bp, Homo sapiens
tcgctgtgcca

SEQ ID NO: 348587 - DNA, 16 bp, Homo sapiens
tcgctgtgccaccacc

SEQ ID NO: 348588 - DNA, 17 bp, Homo sapiens
tcgctgtgccaccaccc

SEQ ID NO: 348589 - DNA, 22 bp, Homo sapiens
tcgcttggctccatgctcctca

SEQ ID NO: 348590 - DNA, 20 bp, Homo sapiens
tcggaaatacactacaaatg

SEQ ID NO: 348591 - DNA, 21 bp, Homo sapiens
tcggaaatacactacaaatgt

SEQ ID NO: 348592 - DNA, 22 bp, Homo sapiens
tcggaactgcatgctgctggac

SEQ ID NO: 348593 - DNA, 16 bp, Homo sapiens
tcggaagcagtgcctt

SEQ ID NO: 348594 - DNA, 13 bp, Homo sapiens
tcggaagcctgtc

SEQ ID NO: 348595 - DNA, 13 bp, Homo sapiens
tcggaatggtaac

SEQ ID NO: 348596 - DNA, 22 bp, Homo sapiens
tcggacccaccccaactctccc

SEQ ID NO: 348597 - DNA, 21 bp, Homo sapiens
tcggagccaatgaacagctcc

SEQ ID NO: 348598 - DNA, 14 bp, Homo sapiens
tcggaggccaggcc

SEQ ID NO: 348599 - DNA, 22 bp, Homo sapiens
tcggaggcttgtcagagctggg

SEQ ID NO: 348600 - DNA, 20 bp, Homo sapiens
tcggagggaattgaggtctg

SEQ ID NO: 348601 - DNA, 12 bp, Homo sapiens
tcggaggtggca

SEQ ID NO: 348602 - DNA, 14 bp, Homo sapiens
tcggaggtggcagc

SEQ ID NO: 348603 - DNA, 10 bp, Homo sapiens
tcggattaga

SEQ ID NO: 348604 - DNA, 18 bp, Homo sapiens
tcggcagaactctctgtc

SEQ ID NO: 348605 - DNA, 18 bp, Homo sapiens
tcggcattcacacacagc

SEQ ID NO: 348606 - DNA, 23 bp, Homo sapiens
tcggcattcacacacagcctggc

SEQ ID NO: 348607 - DNA, 16 bp, Homo sapiens
tctaccaaatgtgtaa

SEQ ID NO: 348608 - DNA, 15 bp, Homo sapiens
tctaccatctccctc

SEQ ID NO: 348609 - DNA, 17 bp, Homo sapiens
tctacccccaacaccac

SEQ ID NO: 348610 - DNA, 12 bp, Homo sapiens
tctacccctgct

SEQ ID NO: 348611 - DNA, 16 bp, Homo sapiens
tctaccctcccacccc

SEQ ID NO: 348612 - DNA, 14 bp, Homo sapiens
tctacctcttccag

SEQ ID NO: 348613 - DNA, 16 bp, Homo sapiens
tctacctgaggccagg

SEQ ID NO: 348614 - DNA, 17 bp, Homo sapiens
tctaccttgaggtcttt

SEQ ID NO: 348615 - DNA, 19 bp, Homo sapiens
tctacctttttttctctcc

SEQ ID NO: 348616 - DNA, 22 bp, Homo sapiens
tctactaaaaacacaaaaatta

SEQ ID NO: 348617 - DNA, 15 bp, Homo sapiens
tctactaaaaatgca

SEQ ID NO: 348618 - DNA, 14 bp, Homo sapiens
tctactcagaaatt

SEQ ID NO: 348619 - DNA, 21 bp, Homo sapiens
tctactcagaaatttttattt

SEQ ID NO: 348620 - DNA, 16 bp, Homo sapiens
tctactcttgtcattt

SEQ ID NO: 348621 - DNA, 14 bp, Homo sapiens
tctacttcatagct

SEQ ID NO: 348622 - DNA, 15 bp, Homo sapiens
tctacttctgtgtct

SEQ ID NO: 348623 - DNA, 19 bp, Homo sapiens
tctactttgtcccctcacc

SEQ ID NO: 348624 - DNA, 14 bp, Homo sapiens
tctactttttcctt

SEQ ID NO: 348625 - DNA, 16 bp, Homo sapiens
tctactttttccttcc

SEQ ID NO: 348626 - DNA, 18 bp, Homo sapiens
tctactttttccttcctg

SEQ ID NO: 348627 - DNA, 21 bp, Homo sapiens
tctagaaagaaaagaccctga

SEQ ID NO: 348628 - DNA, 14 bp, Homo sapiens
tctagaaagcccct

SEQ ID NO: 348629 - DNA, 18 bp, Homo sapiens
tctagaacttgaccccct

SEQ ID NO: 348630 - DNA, 16 bp, Homo sapiens
tctagaatcctgcttt

SEQ ID NO: 348631 - DNA, 17 bp, Homo sapiens
tctagacactgaaggca

SEQ ID NO: 348632 - DNA, 13 bp, Homo sapiens
tctagacagtatt

SEQ ID NO: 348633 - DNA, 17 bp, Homo sapiens
tctagacagtattgcca

SEQ ID NO: 348634 - DNA, 16 bp, Homo sapiens
tctagacgcccctccc

SEQ ID NO: 348635 - DNA, 18 bp, Homo sapiens
tctagacttccccatccc

SEQ ID NO: 348636 - DNA, 15 bp, Homo sapiens
tctagactttctgtt

SEQ ID NO: 348637 - DNA, 16 bp, Homo sapiens
tctagagatatatata

SEQ ID NO: 348638 - DNA, 20 bp, Homo sapiens
tctagagctatgcacaccaa

SEQ ID NO: 348639 - DNA, 12 bp, Homo sapiens
tctagaggcctc

SEQ ID NO: 348640 - DNA, 14 bp, Homo sapiens
tctagaggcctcag

SEQ ID NO: 348641 - DNA, 16 bp, Homo sapiens
tctagaggcctcagtt

SEQ ID NO: 348642 - DNA, 15 bp, Homo sapiens
tctagatcctgcacc

SEQ ID NO: 348643 - DNA, 15 bp, Homo sapiens
tctagatggatgaat

SEQ ID NO: 348644 - DNA, 15 bp, Homo sapiens
tctagcacagctgtg

SEQ ID NO: 348645 - DNA, 22 bp, Homo sapiens
tctagcacagctgtgaggacag

SEQ ID NO: 348646 - DNA, 12 bp, Homo sapiens
tctagcaggcag

SEQ ID NO: 348647 - DNA, 13 bp, Homo sapiens
tctagcaggcagg

SEQ ID NO: 348648 - DNA, 14 bp, Homo sapiens
tctagcaggcagga

SEQ ID NO: 348649 - DNA, 16 bp, Homo sapiens
tctagccaaatggttt

SEQ ID NO: 348650 - DNA, 12 bp, Homo sapiens
tctagcctgggc

SEQ ID NO: 348651 - DNA, 14 bp, Homo sapiens
tctagcctgggcca

SEQ ID NO: 348652 - DNA, 23 bp, Homo sapiens
tctagctagaaatatgattttat

SEQ ID NO: 348653 - DNA, 12 bp, Homo sapiens
tctagctataac

SEQ ID NO: 348654 - DNA, 23 bp, Homo sapiens
tctagctataacaactctatttt

SEQ ID NO: 348655 - DNA, 17 bp, Homo sapiens
tctagctggcaggacac

SEQ ID NO: 348656 - DNA, 11 bp, Homo sapiens
tctagctgttg

SEQ ID NO: 348657 - DNA, 18 bp, Homo sapiens
tctagctgttgagctgtt

SEQ ID NO: 348658 - DNA, 15 bp, Homo sapiens
tctaggaggatgctg

SEQ ID NO: 348659 - DNA, 18 bp, Homo sapiens
tctaggaggatgctgtgc

SEQ ID NO: 348660 - DNA, 19 bp, Homo sapiens
tctaggaggatgctgtgcc

SEQ ID NO: 348661 - DNA, 18 bp, Homo sapiens
tctaggcatctcctctcc

SEQ ID NO: 348662 - DNA, 19 bp, Homo sapiens
tctagggaaggccacctgc

SEQ ID NO: 348663 - DNA, 22 bp, Homo sapiens
tctagggaaggccacctgcagg

SEQ ID NO: 348664 - DNA, 16 bp, Homo sapiens
tctaggtctcctcagg

SEQ ID NO: 348665 - DNA, 15 bp, Homo sapiens
tctattttgcagcag

SEQ ID NO: 348666 - DNA, 12 bp, Homo sapiens
tctattttgtga

SEQ ID NO: 348667 - DNA, 15 bp, Homo sapiens
tctattttgtgatga

SEQ ID NO: 348668 - DNA, 16 bp, Homo sapiens
tctattttttactaca

SEQ ID NO: 348669 - DNA, 16 bp, Homo sapiens
tctatttttttaactg

SEQ ID NO: 348670 - DNA, 18 bp, Homo sapiens
tctatttttttaactgaa

SEQ ID NO: 348671 - DNA, 21 bp, Homo sapiens
tctatttttttaactgaaaat

SEQ ID NO: 348672 - DNA, 14 bp, Homo sapiens
tctcaaaaatacaa

SEQ ID NO: 348673 - DNA, 15 bp, Homo sapiens
tctcaaaaatacaaa

SEQ ID NO: 348674 - DNA, 18 bp, Homo sapiens
tctcaaaagtctattttt

SEQ ID NO: 348675 - DNA, 18 bp, Homo sapiens
tctcaaacctccaaaagc

SEQ ID NO: 348676 - DNA, 17 bp, Homo sapiens
tctcaaactaaaagaca

SEQ ID NO: 348677 - DNA, 13 bp, Homo sapiens
tctcaaagcatca

SEQ ID NO: 348678 - DNA, 21 bp, Homo sapiens
tctcaaagcatcaaataatac

SEQ ID NO: 348679 - DNA, 21 bp, Homo sapiens
tctcaaagtttttacagtgta

SEQ ID NO: 348680 - DNA, 21 bp, Homo sapiens
tctcaaatttggattgctaat

SEQ ID NO: 348681 - DNA, 19 bp, Homo sapiens
tctcaacaaagcacagtgt

SEQ ID NO: 348682 - DNA, 21 bp, Homo sapiens
tctcaactaaagaatagtgcc

SEQ ID NO: 348683 - DNA, 22 bp, Homo sapiens
tctcaagcgctatccacagaac

SEQ ID NO: 348684 - DNA, 15 bp, Homo sapiens
tctcaatgcttttct

SEQ ID NO: 348685 - DNA, 12 bp, Homo sapiens
tctcaatgtgaa

SEQ ID NO: 348686 - DNA, 15 bp, Homo sapiens
tctcaatgttccatt

SEQ ID NO: 348687 - DNA, 20 bp, Homo sapiens
tctcacaatagacagaaaca

SEQ ID NO: 348688 - DNA, 16 bp, Homo sapiens
tctcacacagctgggg

SEQ ID NO: 348689 - DNA, 17 bp, Homo sapiens
tctcacagcacatgctg

SEQ ID NO: 348690 - DNA, 20 bp, Homo sapiens
tctcacagcacatgctggcc

SEQ ID NO: 348691 - DNA, 13 bp, Homo sapiens
tctcaccagctca

SEQ ID NO: 348692 - DNA, 18 bp, Homo sapiens
tctcaccagctcagcccc

SEQ ID NO: 348693 - DNA, 23 bp, Homo sapiens
tctcaccagctcagccccggcca

SEQ ID NO: 348694 - DNA, 19 bp, Homo sapiens
tctcacccactaggatagg

SEQ ID NO: 348695 - DNA, 19 bp, Homo sapiens
tctcaccccatcccacacc

SEQ ID NO: 348696 - DNA, 21 bp, Homo sapiens
tctcacctacttcctcctcct

SEQ ID NO: 348697 - DNA, 15 bp, Homo sapiens
tctcactaaacttta

SEQ ID NO: 348698 - DNA, 12 bp, Homo sapiens
tctcactcccct

SEQ ID NO: 348699 - DNA, 15 bp, Homo sapiens
tctcactcccctcct

SEQ ID NO: 348700 - DNA, 15 bp, Homo sapiens
tctcactcctaggag

SEQ ID NO: 348701 - DNA, 22 bp, Homo sapiens
tctcactgttccctctgctcct

SEQ ID NO: 348702 - DNA, 18 bp, Homo sapiens
tctcacttataccaaagg

SEQ ID NO: 348703 - DNA, 17 bp, Homo sapiens
tctcacttttctccatg

SEQ ID NO: 348704 - DNA, 14 bp, Homo sapiens
tctcagaactcctg

SEQ ID NO: 348705 - DNA, 15 bp, Homo sapiens
tctcagaactcctgt

SEQ ID NO: 348706 - DNA, 22 bp, Homo sapiens
tctcagaactcctgtgtgtgga

SEQ ID NO: 348707 - DNA, 17 bp, Homo sapiens
tctcagacccttgaaga

SEQ ID NO: 348708 - DNA, 19 bp, Homo sapiens
tctcagacccttgaagatg

SEQ ID NO: 348709 - DNA, 14 bp, Homo sapiens
tctcagacgacacc

SEQ ID NO: 348710 - DNA, 15 bp, Homo sapiens
tctcagactctaaac

SEQ ID NO: 348711 - DNA, 20 bp, Homo sapiens
tctcagacttctcttattct

SEQ ID NO: 348712 - DNA, 21 bp, Homo sapiens
tctcagacttctcttattctt

SEQ ID NO: 348713 - DNA, 17 bp, Homo sapiens
tctcagagcatgtgtca

SEQ ID NO: 348714 - DNA, 13 bp, Homo sapiens
tctcagagccaag

SEQ ID NO: 348715 - DNA, 20 bp, Homo sapiens
tcccctccacatcccagcag

SEQ ID NO: 348716 - DNA, 13 bp, Homo sapiens
tcccctccagacc

SEQ ID NO: 348717 - DNA, 14 bp, Homo sapiens
tcccctccagaccc

SEQ ID NO: 348718 - DNA, 21 bp, Homo sapiens
tcccctccagacccctaccct

SEQ ID NO: 348719 - DNA, 15 bp, Homo sapiens
tcccctcccagtcct

SEQ ID NO: 348720 - DNA, 16 bp, Homo sapiens
tcccctccctcctctg

SEQ ID NO: 348721 - DNA, 16 bp, Homo sapiens
tcccctccctgcctgc

SEQ ID NO: 348722 - DNA, 21 bp, Homo sapiens
tcccctccctggctcccatga

SEQ ID NO: 348723 - DNA, 15 bp, Homo sapiens
tcccctcctagcaca

SEQ ID NO: 348724 - DNA, 13 bp, Homo sapiens
tcccctcctctcc

SEQ ID NO: 348725 - DNA, 15 bp, Homo sapiens
tcccctcctcttccc

SEQ ID NO: 348726 - DNA, 16 bp, Homo sapiens
tcccctcctcttccct

SEQ ID NO: 348727 - DNA, 19 bp, Homo sapiens
tcccctcctcttcccttag

SEQ ID NO: 348728 - DNA, 20 bp, Homo sapiens
tcccctcctcttcccttagc

SEQ ID NO: 348729 - DNA, 16 bp, Homo sapiens
tcccctccttccagcc

SEQ ID NO: 348730 - DNA, 12 bp, Homo sapiens
tcccctccttgc

SEQ ID NO: 348731 - DNA, 18 bp, Homo sapiens
tcccctccttgcctcctg

SEQ ID NO: 348732 - DNA, 22 bp, Homo sapiens
tcccctccttgcctcctgtgta

SEQ ID NO: 348733 - DNA, 14 bp, Homo sapiens
tcccctctcctgag

SEQ ID NO: 348734 - DNA, 15 bp, Homo sapiens
tcccctctcctgagc

SEQ ID NO: 348735 - DNA, 20 bp, Homo sapiens
tcccctctcctgcatccctc

SEQ ID NO: 348736 - DNA, 23 bp, Homo sapiens
tcccctctcgccccatccctgct

SEQ ID NO: 348737 - DNA, 14 bp, Homo sapiens
tcccctctgctggc

SEQ ID NO: 348738 - DNA, 15 bp, Homo sapiens
tcccctctgctggcc

SEQ ID NO: 348739 - DNA, 15 bp, Homo sapiens
tcccctcttcctgga

SEQ ID NO: 348740 - DNA, 17 bp, Homo sapiens
tcccctgacctgtccag

SEQ ID NO: 348741 - DNA, 11 bp, Homo sapiens
tcccctgaggt

SEQ ID NO: 348742 - DNA, 19 bp, Homo sapiens
tcccctgcactgtaaaatg

SEQ ID NO: 348743 - DNA, 16 bp, Homo sapiens
tcccctgcccctgccc

SEQ ID NO: 348744 - DNA, 15 bp, Homo sapiens
tcccctgcccgcccc

SEQ ID NO: 348745 - DNA, 15 bp, Homo sapiens
tcccctgccctgctg

SEQ ID NO: 348746 - DNA, 13 bp, Homo sapiens
tcccctgccctgg

SEQ ID NO: 348747 - DNA, 24 bp, Homo sapiens
tcccctgccctggtccagggaagc

SEQ ID NO: 348748 - DNA, 11 bp, Homo sapiens
tcccctgcctc

SEQ ID NO: 348749 - DNA, 20 bp, Homo sapiens
tcccctgcggagctgcatgg

SEQ ID NO: 348750 - DNA, 14 bp, Homo sapiens
tcccctgctgacct

SEQ ID NO: 348751 - DNA, 15 bp, Homo sapiens
tcccctgctgacctt

SEQ ID NO: 348752 - DNA, 20 bp, Homo sapiens
tcccctggaccacacctccg

SEQ ID NO: 348753 - DNA, 15 bp, Homo sapiens
tcccctggagccagc

SEQ ID NO: 348754 - DNA, 18 bp, Homo sapiens
tcccctggagccagcagg

SEQ ID NO: 348755 - DNA, 21 bp, Homo sapiens
tcccctggagccagcagggct

SEQ ID NO: 348756 - DNA, 15 bp, Homo sapiens
tcccctgggccaccc

SEQ ID NO: 348757 - DNA, 19 bp, Homo sapiens
tcccctgggccacccttca

SEQ ID NO: 348758 - DNA, 14 bp, Homo sapiens
tcccctggggacgc

SEQ ID NO: 348759 - DNA, 14 bp, Homo sapiens
tcccctgtcccacc

SEQ ID NO: 348760 - DNA, 15 bp, Homo sapiens
tcccctgtcccacca

SEQ ID NO: 348761 - DNA, 16 bp, Homo sapiens
tcccctgtcccaccaa

SEQ ID NO: 348762 - DNA, 17 bp, Homo sapiens
tcccctgtcccaccaac

SEQ ID NO: 348763 - DNA, 22 bp, Homo sapiens
tcccctgtggtgatgtgcctgt

SEQ ID NO: 348764 - DNA, 15 bp, Homo sapiens
tcccctgttcactct

SEQ ID NO: 348765 - DNA, 12 bp, Homo sapiens
tccccttcccct

SEQ ID NO: 348766 - DNA, 19 bp, Homo sapiens
tccccttgggatgggcaca

SEQ ID NO: 348767 - DNA, 20 bp, Homo sapiens
tccccttgggatgggcacag

SEQ ID NO: 348768 - DNA, 16 bp, Homo sapiens
tccccttgttctaatg

SEQ ID NO: 348769 - DNA, 14 bp, Homo sapiens
tcccctttattaat

SEQ ID NO: 348770 - DNA, 13 bp, Homo sapiens
tcccctttccaat

SEQ ID NO: 348771 - DNA, 17 bp, Homo sapiens
tcccctttcccatcacc

SEQ ID NO: 348772 - DNA, 23 bp, Homo sapiens
tcccctttcccatcaccccttcc

SEQ ID NO: 348773 - DNA, 16 bp, Homo sapiens
tccccttttccttcag

SEQ ID NO: 348774 - DNA, 24 bp, Homo sapiens
tccccttttgcctggctgtggagg

SEQ ID NO: 348775 - DNA, 21 bp, Homo sapiens
tcccgaatctttttaggccac

SEQ ID NO: 348776 - DNA, 16 bp, Homo sapiens
tcccgaatggagtcca

SEQ ID NO: 348777 - DNA, 23 bp, Homo sapiens
tcccgaatggagtccagacctgg

SEQ ID NO: 348778 - DNA, 21 bp, Homo sapiens
tcccgacctaccaccccactg

SEQ ID NO: 348779 - DNA, 19 bp, Homo sapiens
tcccgagccccctgtcctt

SEQ ID NO: 348780 - DNA, 20 bp, Homo sapiens
tcccgagccccctgtccttc

SEQ ID NO: 348781 - DNA, 19 bp, Homo sapiens
tcccgaggaagggccagag

SEQ ID NO: 348782 - DNA, 20 bp, Homo sapiens
tcccgaggaagggccagagc

SEQ ID NO: 348783 - DNA, 22 bp, Homo sapiens
tcccgaggcagcaacaggacca

SEQ ID NO: 348784 - DNA, 14 bp, Homo sapiens
tcccgcagcaccag

SEQ ID NO: 348785 - DNA, 18 bp, Homo sapiens
tcccgcatgctgcctgcc

SEQ ID NO: 348786 - DNA, 20 bp, Homo sapiens
tcccgcatgctgcctgcctc

SEQ ID NO: 348787 - DNA, 21 bp, Homo sapiens
tcccgcatgctgcctgcctcc

SEQ ID NO: 348788 - DNA, 18 bp, Homo sapiens
tcccgcctcagcctctca

SEQ ID NO: 348789 - DNA, 19 bp, Homo sapiens
tcccgcctgattggggcct

SEQ ID NO: 348790 - DNA, 22 bp, Homo sapiens
tcccgcctgattggggcctcac

SEQ ID NO: 348791 - DNA, 15 bp, Homo sapiens
tcccgctgctgtgct

SEQ ID NO: 348792 - DNA, 17 bp, Homo sapiens
tcccggagcacagccct

SEQ ID NO: 348793 - DNA, 23 bp, Homo sapiens
tcccggcatgggaaagccacctc

SEQ ID NO: 348794 - DNA, 14 bp, Homo sapiens
tgccagtcctgcaa

SEQ ID NO: 348795 - DNA, 13 bp, Homo sapiens
tgccagtcctggg

SEQ ID NO: 348796 - DNA, 19 bp, Homo sapiens
tgccagtgacagacaggct

SEQ ID NO: 348797 - DNA, 22 bp, Homo sapiens
tgccatacatcagttattcatt

SEQ ID NO: 348798 - DNA, 13 bp, Homo sapiens
tgccatacatgtt

SEQ ID NO: 348799 - DNA, 16 bp, Homo sapiens
tgccataccttgagac

SEQ ID NO: 348800 - DNA, 20 bp, Homo sapiens
tgccatagagtttaacacaa

SEQ ID NO: 348801 - DNA, 15 bp, Homo sapiens
tgccatcagcccctg

SEQ ID NO: 348802 - DNA, 16 bp, Homo sapiens
tgccatcagcccctgc

SEQ ID NO: 348803 - DNA, 18 bp, Homo sapiens
tgccatcagcccctgctg

SEQ ID NO: 348804 - DNA, 21 bp, Homo sapiens
tgccatccacattttaacagt

SEQ ID NO: 348805 - DNA, 17 bp, Homo sapiens
tgccatcgggtgccaaa

SEQ ID NO: 348806 - DNA, 18 bp, Homo sapiens
tgccatcgggtgccaaat

SEQ ID NO: 348807 - DNA, 16 bp, Homo sapiens
tgccatctgtgggcac

SEQ ID NO: 348808 - DNA, 16 bp, Homo sapiens
tgccatctgtgtcctg

SEQ ID NO: 348809 - DNA, 21 bp, Homo sapiens
tgccatgccactgccaggcac

SEQ ID NO: 348810 - DNA, 17 bp, Homo sapiens
tgccatgctgctatgaa

SEQ ID NO: 348811 - DNA, 17 bp, Homo sapiens
tgccatggaggcacaca

SEQ ID NO: 348812 - DNA, 15 bp, Homo sapiens
tgccatgggcctgct

SEQ ID NO: 348813 - DNA, 16 bp, Homo sapiens
tgccatgggcctgctg

SEQ ID NO: 348814 - DNA, 17 bp, Homo sapiens
tgccatgggcctgctgc

SEQ ID NO: 348815 - DNA, 16 bp, Homo sapiens
tgccatgtagacccct

SEQ ID NO: 348816 - DNA, 12 bp, Homo sapiens
tgccattcccac

SEQ ID NO: 348817 - DNA, 19 bp, Homo sapiens
tgccattgtactccagcct

SEQ ID NO: 348818 - DNA, 16 bp, Homo sapiens
tgccattgtctttcct

SEQ ID NO: 348819 - DNA, 13 bp, Homo sapiens
tgccatttccctt

SEQ ID NO: 348820 - DNA, 17 bp, Homo sapiens
tgccatttcctcctggg

SEQ ID NO: 348821 - DNA, 13 bp, Homo sapiens
tgccatttcttcc

SEQ ID NO: 348822 - DNA, 14 bp, Homo sapiens
tgccatttcttccc

SEQ ID NO: 348823 - DNA, 14 bp, Homo sapiens
tgccatttgtcttt

SEQ ID NO: 348824 - DNA, 19 bp, Homo sapiens
tgccatttgtcttttgtaa

SEQ ID NO: 348825 - DNA, 20 bp, Homo sapiens
tgccattttgtctggctgtg

SEQ ID NO: 348826 - DNA, 22 bp, Homo sapiens
tgccattttgtctggctgtggc

SEQ ID NO: 348827 - DNA, 19 bp, Homo sapiens
tgcccaaatcccctccctg

SEQ ID NO: 348828 - DNA, 13 bp, Homo sapiens
tgcccaacctcag

SEQ ID NO: 348829 - DNA, 14 bp, Homo sapiens
tgcccaacctcagc

SEQ ID NO: 348830 - DNA, 23 bp, Homo sapiens
tgcccaacctgctctcctcttgc

SEQ ID NO: 348831 - DNA, 24 bp, Homo sapiens
tgcccaacctgctctcctcttgcc

SEQ ID NO: 348832 - DNA, 13 bp, Homo sapiens
tgcccaactccca

SEQ ID NO: 348833 - DNA, 21 bp, Homo sapiens
tgcccaactcccagccaccac

SEQ ID NO: 348834 - DNA, 23 bp, Homo sapiens
tgcccaagaatagatgctgactg

SEQ ID NO: 348835 - DNA, 22 bp, Homo sapiens
tgcccaatatgcagttctgcag

SEQ ID NO: 348836 - DNA, 21 bp, Homo sapiens
tgcccacaccaccgccctcct

SEQ ID NO: 348837 - DNA, 19 bp, Homo sapiens
tgcccacacctgcctctga

SEQ ID NO: 348838 - DNA, 11 bp, Homo sapiens
tgcccacagcc

SEQ ID NO: 348839 - DNA, 12 bp, Homo sapiens
tgcccacagccc

SEQ ID NO: 348840 - DNA, 21 bp, Homo sapiens
tgcccacagcccgcatgcagc

SEQ ID NO: 348841 - DNA, 23 bp, Homo sapiens
tgcccacatcccaggcttcaccc

SEQ ID NO: 348842 - DNA, 20 bp, Homo sapiens
tgcccaccacaactaacaat

SEQ ID NO: 348843 - DNA, 13 bp, Homo sapiens
tgcccacccctgc

SEQ ID NO: 348844 - DNA, 21 bp, Homo sapiens
tgcccacccgtgttctcctcc

SEQ ID NO: 348845 - DNA, 12 bp, Homo sapiens
tgcccaccctgg

SEQ ID NO: 348846 - DNA, 14 bp, Homo sapiens
tgcccacctgccca

SEQ ID NO: 348847 - DNA, 19 bp, Homo sapiens
tgcccacctgcccatcaca

SEQ ID NO: 348848 - DNA, 13 bp, Homo sapiens
tgcccacggccac

SEQ ID NO: 348849 - DNA, 21 bp, Homo sapiens
tgcccactacctatgcttcta

SEQ ID NO: 348850 - DNA, 22 bp, Homo sapiens
tgcccactaggatcccactggc

SEQ ID NO: 348851 - DNA, 22 bp, Homo sapiens
tgcccacttagccgtccatggc

SEQ ID NO: 348852 - DNA, 15 bp, Homo sapiens
tgcccagaccacacg

SEQ ID NO: 348853 - DNA, 18 bp, Homo sapiens
tgcccagacccctctggc

SEQ ID NO: 348854 - DNA, 22 bp, Homo sapiens
tgcccagacccctctggccagg

SEQ ID NO: 348855 - DNA, 17 bp, Homo sapiens
tgcccagatcgttctgc

SEQ ID NO: 348856 - DNA, 20 bp, Homo sapiens
tgcccagatcgttctgccac

SEQ ID NO: 348857 - DNA, 21 bp, Homo sapiens
tgcccagatcgttctgccact

SEQ ID NO: 348858 - DNA, 20 bp, Homo sapiens
tgcccagcccggaccttggc

SEQ ID NO: 348859 - DNA, 13 bp, Homo sapiens
tgcccagccctcc

SEQ ID NO: 348860 - DNA, 15 bp, Homo sapiens
tgcccagctctgacc

SEQ ID NO: 348861 - DNA, 16 bp, Homo sapiens
tgcccagcttgggccc

SEQ ID NO: 348862 - DNA, 18 bp, Homo sapiens
tgcccagcttgggcccag

SEQ ID NO: 348863 - DNA, 21 bp, Homo sapiens
tgcccagcttgggcccagctg

SEQ ID NO: 348864 - DNA, 23 bp, Homo sapiens
tgcccagcttgggcccagctggg

SEQ ID NO: 348865 - DNA, 19 bp, Homo sapiens
tgcccaggcagtctttgct

SEQ ID NO: 348866 - DNA, 15 bp, Homo sapiens
tgcccaggccggcca

SEQ ID NO: 348867 - DNA, 21 bp, Homo sapiens
tgcccaggccggccagcctca

SEQ ID NO: 348868 - DNA, 15 bp, Homo sapiens
tgcccaggcctgcct

SEQ ID NO: 348869 - DNA, 20 bp, Homo sapiens
tgcccaggctggagtgcaat

SEQ ID NO: 348870 - DNA, 20 bp, Homo sapiens
tgcccaggctggagtgcagt

SEQ ID NO: 348871 - DNA, 17 bp, Homo sapiens
tgcccaggctggtctca

SEQ ID NO: 348872 - DNA, 20 bp, Homo sapiens
tgcccagggtcctgtgcctg

SEQ ID NO: 348873 - DNA, 19 bp, Homo sapiens
tgcccagggtgcagtgtga

SEQ ID NO: 348874 - DNA, 19 bp, Homo sapiens
tgcccaggtaccacccttc

SEQ ID NO: 348875 - DNA, 20 bp, Homo sapiens
tgcccaggtaccacccttca

SEQ ID NO: 348876 - DNA, 22 bp, Homo sapiens
tgcccagtcatgacatttctca

SEQ ID NO: 348877 - DNA, 15 bp, Homo sapiens
tgcccagtcttgagt

SEQ ID NO: 348878 - DNA, 16 bp, Homo sapiens
tgcccagtgatggcat

SEQ ID NO: 348879 - DNA, 18 bp, Homo sapiens
tgcccagtgatggcatta

SEQ ID NO: 348880 - DNA, 22 bp, Homo sapiens
tgcccagtgatggcattactct

SEQ ID NO: 348881 - DNA, 19 bp, Homo sapiens
tgcccagtgttgtttgtaa

SEQ ID NO: 348882 - DNA, 14 bp, Homo sapiens
tgcccagttaatct

SEQ ID NO: 348883 - DNA, 16 bp, Homo sapiens
tgcccagttagcccgg

SEQ ID NO: 348884 - DNA, 17 bp, Homo sapiens
tgcccagttcatcccaa

SEQ ID NO: 348885 - DNA, 16 bp, Homo sapiens
tgcccatcatctctgc

SEQ ID NO: 348886 - DNA, 22 bp, Homo sapiens
tgcccatcatctctgcctttga

SEQ ID NO: 348887 - DNA, 21 bp, Homo sapiens
tgccccaaaggaagctttctc

SEQ ID NO: 348888 - DNA, 19 bp, Homo sapiens
tgccccaacttaagtttag

SEQ ID NO: 348889 - DNA, 22 bp, Homo sapiens
tgccccaacttaagtttagaaa

SEQ ID NO: 348890 - DNA, 21 bp, Homo sapiens
tgccccaagaggctagcccca

SEQ ID NO: 348891 - DNA, 22 bp, Homo sapiens
tgccccaagaggctagccccag

SEQ ID NO: 348892 - DNA, 23 bp, Homo sapiens
tgccccaagaggctagccccagg

SEQ ID NO: 348893 - DNA, 15 bp, Homo sapiens
tgccccaagcagcca

SEQ ID NO: 348894 - DNA, 16 bp, Homo sapiens
tgccccaagcagccag

SEQ ID NO: 348895 - DNA, 19 bp, Homo sapiens
tgccccaagcagccagcca

SEQ ID NO: 348896 - DNA, 20 bp, Homo sapiens
tgccccaatcgggtccagag

SEQ ID NO: 348897 - DNA, 22 bp, Homo sapiens
tgccccacacaggcctggccca

SEQ ID NO: 348898 - DNA, 22 bp, Homo sapiens
tgccccacacggactcccgggc

SEQ ID NO: 348899 - DNA, 13 bp, Homo sapiens
tgccccacaggcc

SEQ ID NO: 348900 - DNA, 19 bp, Homo sapiens
tgccccacaggccacacgc

SEQ ID NO: 348901 - DNA, 13 bp, Homo sapiens
tgccccacccacc

SEQ ID NO: 348902 - DNA, 16 bp, Homo sapiens
tgccccacccacccct

SEQ ID NO: 348903 - DNA, 13 bp, Homo sapiens
tgccccacccctc

SEQ ID NO: 348904 - DNA, 16 bp, Homo sapiens
tgccccacccctccat

SEQ ID NO: 348905 - DNA, 16 bp, Homo sapiens
tgccccacctgccact

SEQ ID NO: 348906 - DNA, 16 bp, Homo sapiens
tgccccagaaagggga

SEQ ID NO: 348907 - DNA, 12 bp, Homo sapiens
tgccccagagaa

SEQ ID NO: 348908 - DNA, 15 bp, Homo sapiens
tgccccagagctgtt

SEQ ID NO: 348909 - DNA, 16 bp, Homo sapiens
tgccccagctgggctg

SEQ ID NO: 348910 - DNA, 15 bp, Homo sapiens
tgccccagggctccc

SEQ ID NO: 348911 - DNA, 19 bp, Homo sapiens
tgccccagtcctggttcag

SEQ ID NO: 348912 - DNA, 15 bp, Homo sapiens
tgccccatcagcagc

SEQ ID NO: 348913 - DNA, 20 bp, Homo sapiens
tgccccatcagcagcttgac

SEQ ID NO: 348914 - DNA, 17 bp, Homo sapiens
tgccccatctcctccca

SEQ ID NO: 348915 - DNA, 22 bp, Homo sapiens
tgccccatctcctcccatggcc

SEQ ID NO: 348916 - DNA, 20 bp, Homo sapiens
tgccccatgataaaataagt

SEQ ID NO: 348917 - DNA, 12 bp, Homo sapiens
tgccccatgcct

SEQ ID NO: 348918 - DNA, 15 bp, Homo sapiens
tgccccatgcctgtc

SEQ ID NO: 348919 - DNA, 23 bp, Homo sapiens
tgccccatgcctgtccagcctgg

SEQ ID NO: 348920 - DNA, 17 bp, Homo sapiens
tgcccccagctgctcct

SEQ ID NO: 348921 - DNA, 18 bp, Homo sapiens
tgcccccatctccccagg

SEQ ID NO: 348922 - DNA, 22 bp, Homo sapiens
tgcccccatctccccaggcctc

SEQ ID NO: 348923 - DNA, 12 bp, Homo sapiens
tgccccccaccc

SEQ ID NO: 348924 - DNA, 13 bp, Homo sapiens
tgccccccacccc

SEQ ID NO: 348925 - DNA, 18 bp, Homo sapiens
tgccccccaccccagcct

SEQ ID NO: 348926 - DNA, 16 bp, Homo sapiens
tgcccccctcctccag

SEQ ID NO: 348927 - DNA, 16 bp, Homo sapiens
tgccccctcccccgca

SEQ ID NO: 348928 - DNA, 12 bp, Homo sapiens
tgccccctgcca

SEQ ID NO: 348929 - DNA, 18 bp, Homo sapiens
tgccccctgccagtgaag

SEQ ID NO: 348930 - DNA, 22 bp, Homo sapiens
tgccccctggggggcacagcca

SEQ ID NO: 348931 - DNA, 12 bp, Homo sapiens
tgcccccttctc

SEQ ID NO: 348932 - DNA, 18 bp, Homo sapiens
tgcccccttctcccacac

SEQ ID NO: 348933 - DNA, 19 bp, Homo sapiens
tgcccccttctcccacact

SEQ ID NO: 348934 - DNA, 22 bp, Homo sapiens
tgccccctttcagatgtcttct

SEQ ID NO: 348935 - DNA, 15 bp, Homo sapiens
tgccccgccccccag

SEQ ID NO: 348936 - DNA, 22 bp, Homo sapiens
tgccccgccccccagagccagg

SEQ ID NO: 348937 - DNA, 15 bp, Homo sapiens
tgccccgcctccccg

SEQ ID NO: 348938 - DNA, 20 bp, Homo sapiens
tgccccgtcaccatctcagg

SEQ ID NO: 348939 - DNA, 22 bp, Homo sapiens
tgccccgtcccctgggccaccc

SEQ ID NO: 348940 - DNA, 23 bp, Homo sapiens
tgccccgtcggactgcccccaga

SEQ ID NO: 348941 - DNA, 16 bp, Homo sapiens
tgccccgtgcagactg

SEQ ID NO: 348942 - DNA, 18 bp, Homo sapiens
tgccccgtgcagactgga

SEQ ID NO: 348943 - DNA, 21 bp, Homo sapiens
tgccccgtgcagactggaggg

SEQ ID NO: 348944 - DNA, 21 bp, Homo sapiens
tgcccctcatttatcactctg

SEQ ID NO: 348945 - DNA, 13 bp, Homo sapiens
tgcccctcccatg

SEQ ID NO: 348946 - DNA, 15 bp, Homo sapiens
tgcccctcccatggc

SEQ ID NO: 348947 - DNA, 16 bp, Homo sapiens
tgcccctcccttcaac

SEQ ID NO: 348948 - DNA, 18 bp, Homo sapiens
tgcccctccgtccccagg

SEQ ID NO: 348949 - DNA, 13 bp, Homo sapiens
tgcccctgcaggg

SEQ ID NO: 348950 - DNA, 17 bp, Homo sapiens
tgcccctgctgcctccc

SEQ ID NO: 348951 - DNA, 21 bp, Homo sapiens
tgcccctggcccatctcagcc

SEQ ID NO: 348952 - DNA, 22 bp, Homo sapiens
tgcccctggcccatctcagcct

SEQ ID NO: 348953 - DNA, 21 bp, Homo sapiens
tgcccctgtaggttgcttaaa

SEQ ID NO: 348954 - DNA, 12 bp, Homo sapiens
tgcccctgtctg

SEQ ID NO: 348955 - DNA, 16 bp, Homo sapiens
tgcccctgtctggaag

SEQ ID NO: 348956 - DNA, 23 bp, Homo sapiens
tgcccctgtctggaagacgtggc

SEQ ID NO: 348957 - DNA, 23 bp, Homo sapiens
tgccccttaagggttgaaggcag

SEQ ID NO: 348958 - DNA, 12 bp, Homo sapiens
tgccccttccac

SEQ ID NO: 348959 - DNA, 21 bp, Homo sapiens
tgccccttcccatctcttcct

SEQ ID NO: 348960 - DNA, 20 bp, Homo sapiens
tgccccttgaccccacacgc

SEQ ID NO: 348961 - DNA, 15 bp, Homo sapiens
tgccccttgcttctc

SEQ ID NO: 348962 - DNA, 12 bp, Homo sapiens
tgccccttggct

SEQ ID NO: 348963 - DNA, 13 bp, Homo sapiens
tgccccttgggca

SEQ ID NO: 348964 - DNA, 18 bp, Homo sapiens
tgcccgagagctcttagt

SEQ ID NO: 348965 - DNA, 14 bp, Homo sapiens
tgcccgagctggtg

SEQ ID NO: 348966 - DNA, 17 bp, Homo sapiens
tgcccgcacagcagcct

SEQ ID NO: 348967 - DNA, 13 bp, Homo sapiens
tgcccgcagagcc

SEQ ID NO: 348968 - DNA, 14 bp, Homo sapiens
tgcccgcagagccc

SEQ ID NO: 348969 - DNA, 19 bp, Homo sapiens
tgcccgcagagcccacgcc

SEQ ID NO: 348970 - DNA, 15 bp, Homo sapiens
tgcccgccagccagt

SEQ ID NO: 348971 - DNA, 15 bp, Homo sapiens
tgcccgccagcctca

SEQ ID NO: 348972 - DNA, 22 bp, Homo sapiens
tgcccgccagcctcagtgccac

SEQ ID NO: 348973 - DNA, 23 bp, Homo sapiens
tgcccgccagcctcagtgccact

SEQ ID NO: 348974 - DNA, 14 bp, Homo sapiens
tgcccgcccacctc

SEQ ID NO: 348975 - DNA, 22 bp, Homo sapiens
tgcccgcccacctctgctgccc

SEQ ID NO: 348976 - DNA, 14 bp, Homo sapiens
tgcccgctcccaca

SEQ ID NO: 348977 - DNA, 22 bp, Homo sapiens
tgcccgctgcaatgcctagact

SEQ ID NO: 348978 - DNA, 17 bp, Homo sapiens
tgcccgctgtcccaggg

SEQ ID NO: 348979 - DNA, 21 bp, Homo sapiens
tgcccgttgccgggcctggac

SEQ ID NO: 348980 - DNA, 24 bp, Homo sapiens
tgcccgttgccgggcctggactgt

SEQ ID NO: 348981 - DNA, 16 bp, Homo sapiens
tgccctagatgagccc

SEQ ID NO: 348982 - DNA, 14 bp, Homo sapiens
tgccctaggctccg

SEQ ID NO: 348983 - DNA, 17 bp, Homo sapiens
tgccctcacgctctcca

SEQ ID NO: 348984 - DNA, 16 bp, Homo sapiens
tgccctcactccactc

SEQ ID NO: 348985 - DNA, 20 bp, Homo sapiens
tgccctcactccactcccct

SEQ ID NO: 348986 - DNA, 15 bp, Homo sapiens
tgccctccactgccc

SEQ ID NO: 348987 - DNA, 21 bp, Homo sapiens
tgccctccagctctttcctcc

SEQ ID NO: 348988 - DNA, 13 bp, Homo sapiens
tgccctccatccc

SEQ ID NO: 348989 - DNA, 14 bp, Homo sapiens
tgccctccatcccg

SEQ ID NO: 348990 - DNA, 20 bp, Homo sapiens
tgccctccccagagcactgg

SEQ ID NO: 348991 - DNA, 17 bp, Homo sapiens
tgccctccgtcctggca

SEQ ID NO: 348992 - DNA, 15 bp, Homo sapiens
tgccctcgctgcttc

SEQ ID NO: 348993 - DNA, 17 bp, Homo sapiens
tgccctcgctgcttctg

SEQ ID NO: 348994 - DNA, 15 bp, Homo sapiens
tgccctctgtttccc

SEQ ID NO: 348995 - DNA, 12 bp, Homo sapiens
tgccctgagctt

SEQ ID NO: 348996 - DNA, 14 bp, Homo sapiens
tgccctgcaccttg

SEQ ID NO: 348997 - DNA, 15 bp, Homo sapiens
tgccctgccaagcct

SEQ ID NO: 348998 - DNA, 20 bp, Homo sapiens
tgccctgccacctgtctgtc

SEQ ID NO: 348999 - DNA, 12 bp, Homo sapiens
tgccctgccagg

SEQ ID NO: 349000 - DNA, 14 bp, Homo sapiens
tgccctgccaggct

SEQ ID NO: 349001 - DNA, 16 bp, Homo sapiens
tgccctgccaggctgt

SEQ ID NO: 349002 - DNA, 15 bp, Homo sapiens
tgccctgccctgcca

SEQ ID NO: 349003 - DNA, 13 bp, Homo sapiens
tgccctgcctgcc

SEQ ID NO: 349004 - DNA, 14 bp, Homo sapiens
tgccctgcctgccc

SEQ ID NO: 349005 - DNA, 15 bp, Homo sapiens
tgccctgcctgccca

SEQ ID NO: 349006 - DNA, 18 bp, Homo sapiens
tgccctggatccatcagg

SEQ ID NO: 349007 - DNA, 11 bp, Homo sapiens
tgccctgggcc

SEQ ID NO: 349008 - DNA, 16 bp, Homo sapiens
tgccctgggccagccc

SEQ ID NO: 349009 - DNA, 17 bp, Homo sapiens
tgccctgggggccgtgc

SEQ ID NO: 349010 - DNA, 18 bp, Homo sapiens
tgccctggtccagggaag

SEQ ID NO: 349011 - DNA, 21 bp, Homo sapiens
tgccctggtccagggaagctg

SEQ ID NO: 349012 - DNA, 17 bp, Homo sapiens
tgccctggtgctgccac

SEQ ID NO: 349013 - DNA, 22 bp, Homo sapiens
tgccctggtttcactggcccaa

SEQ ID NO: 349014 - DNA, 20 bp, Homo sapiens
tgccctgtacctctctctgc

SEQ ID NO: 349015 - DNA, 18 bp, Homo sapiens
tgccctgtccctgtcccc

SEQ ID NO: 349016 - DNA, 15 bp, Homo sapiens
tgccctgtgggagag

SEQ ID NO: 349017 - DNA, 13 bp, Homo sapiens
tgcccttgctggg

SEQ ID NO: 349018 - DNA, 18 bp, Homo sapiens
tgcccttttaaatggcat

SEQ ID NO: 349019 - DNA, 19 bp, Homo sapiens
tgcccttttcctgggcctt

SEQ ID NO: 349020 - DNA, 21 bp, Homo sapiens
tgcccttttcctgggccttct

SEQ ID NO: 349021 - DNA, 22 bp, Homo sapiens
tgcccttttcctgggccttctc

SEQ ID NO: 349022 - DNA, 19 bp, Homo sapiens
tgccgaatgtgcaggtttg

SEQ ID NO: 349023 - DNA, 22 bp, Homo sapiens
tgccgaccgaggctggagctgg

SEQ ID NO: 349024 - DNA, 23 bp, Homo sapiens
tgccgaccgaggctggagctggc

SEQ ID NO: 349025 - DNA, 13 bp, Homo sapiens
tgccgagagaggc

SEQ ID NO: 349026 - DNA, 14 bp, Homo sapiens
tgccgaggagccag

SEQ ID NO: 349027 - DNA, 20 bp, Homo sapiens
tgccgagggggctgtcatgc

SEQ ID NO: 349028 - DNA, 17 bp, Homo sapiens
tgccgatttcctaagct

SEQ ID NO: 349029 - DNA, 19 bp, Homo sapiens
tgccgccgtctctgtcccg

SEQ ID NO: 349030 - DNA, 19 bp, Homo sapiens
tgccgcctggggctccggt

SEQ ID NO: 349031 - DNA, 23 bp, Homo sapiens
tgccgcgtgcgaccagaggtggg

SEQ ID NO: 349032 - DNA, 22 bp, Homo sapiens
tgccgctgggagagccaaggcc

SEQ ID NO: 349033 - DNA, 19 bp, Homo sapiens
tgccggccttggccttggg

SEQ ID NO: 349034 - DNA, 21 bp, Homo sapiens
tgccggccttggccttggggc

SEQ ID NO: 349035 - DNA, 17 bp, Homo sapiens
tgccggcggcagcccca

SEQ ID NO: 349036 - DNA, 20 bp, Homo sapiens
tgccggcggcagccccactt

SEQ ID NO: 349037 - DNA, 22 bp, Homo sapiens
tgccggcggcagccccacttca

SEQ ID NO: 349038 - DNA, 20 bp, Homo sapiens
tgccggctctttccttgctc

SEQ ID NO: 349039 - DNA, 16 bp, Homo sapiens
tgccggctgtggagca

SEQ ID NO: 349040 - DNA, 15 bp, Homo sapiens
tgccgggcctggact

SEQ ID NO: 349041 - DNA, 21 bp, Homo sapiens
tgccgggcctggactgtccta

SEQ ID NO: 349042 - DNA, 21 bp, Homo sapiens
tgccgggcctgggcctcctgg

SEQ ID NO: 349043 - DNA, 17 bp, Homo sapiens
tgccgtctttggttcct

SEQ ID NO: 349044 - DNA, 16 bp, Homo sapiens
tgccgtgcatggctcc

SEQ ID NO: 349045 - DNA, 16 bp, Homo sapiens
tgccgtgggaatttta

SEQ ID NO: 349046 - DNA, 18 bp, Homo sapiens
tgcctaaaattgtatgaa

SEQ ID NO: 349047 - DNA, 17 bp, Homo sapiens
tgcctaccagtcgccct

SEQ ID NO: 349048 - DNA, 23 bp, Homo sapiens
tgcctaccagtcgccctctgtgc

SEQ ID NO: 349049 - DNA, 22 bp, Homo sapiens
tgcctaccgggttctcctgatt

SEQ ID NO: 349050 - DNA, 22 bp, Homo sapiens
tgcctagcactcacatgctgga

SEQ ID NO: 349051 - DNA, 15 bp, Homo sapiens
tgcctaggagctggc

SEQ ID NO: 349052 - DNA, 17 bp, Homo sapiens
tgcctaggagctggctg

SEQ ID NO: 349053 - DNA, 13 bp, Homo sapiens
tgcctaggccaaa

SEQ ID NO: 349054 - DNA, 23 bp, Homo sapiens
tgcctaggccaaatgcacaagct

SEQ ID NO: 349055 - DNA, 19 bp, Homo sapiens
tgctaggtataaaaaataa

SEQ ID NO: 349056 - DNA, 20 bp, Homo sapiens
tgctaggtataaaaaataag

SEQ ID NO: 349057 - DNA, 14 bp, Homo sapiens
tgctaggtgggcca

SEQ ID NO: 349058 - DNA, 15 bp, Homo sapiens
tgctaggtgggccag

SEQ ID NO: 349059 - DNA, 20 bp, Homo sapiens
tgctaggtgggccagcccct

SEQ ID NO: 349060 - DNA, 16 bp, Homo sapiens
tgctaggttaattcca

SEQ ID NO: 349061 - DNA, 17 bp, Homo sapiens
tgctagtacctgtaagc

SEQ ID NO: 349062 - DNA, 16 bp, Homo sapiens
tgctagtgagctgggc

SEQ ID NO: 349063 - DNA, 16 bp, Homo sapiens
tgctatactgtgtcat

SEQ ID NO: 349064 - DNA, 21 bp, Homo sapiens
tgctatagtgtataccacctg

SEQ ID NO: 349065 - DNA, 23 bp, Homo sapiens
tgctatagtgtataccacctgta

SEQ ID NO: 349066 - DNA, 16 bp, Homo sapiens
tgctatattaggcctg

SEQ ID NO: 349067 - DNA, 23 bp, Homo sapiens
tgctatcatatattataagattt

SEQ ID NO: 349068 - DNA, 16 bp, Homo sapiens
tgctatccagccgcaa

SEQ ID NO: 349069 - DNA, 20 bp, Homo sapiens
tgctatcctgccaaaatcat

SEQ ID NO: 349070 - DNA, 17 bp, Homo sapiens
tgctatctcgctagcca

SEQ ID NO: 349071 - DNA, 20 bp, Homo sapiens
tgctatgaaaatgagcatca

SEQ ID NO: 349072 - DNA, 14 bp, Homo sapiens
tgctatgtctgtga

SEQ ID NO: 349073 - DNA, 14 bp, Homo sapiens
tgctcaaagatgta

SEQ ID NO: 349074 - DNA, 18 bp, Homo sapiens
tgctcaaagatgtactga

SEQ ID NO: 349075 - DNA, 18 bp, Homo sapiens
tgctcaaatctattcaga

SEQ ID NO: 349076 - DNA, 23 bp, Homo sapiens
tgctcaacccccctcccagacag

SEQ ID NO: 349077 - DNA, 15 bp, Homo sapiens
tgctcaatgaaacct

SEQ ID NO: 349078 - DNA, 23 bp, Homo sapiens
tgctcaatgaaaccttcctcttg

SEQ ID NO: 349079 - DNA, 12 bp, Homo sapiens
tgctcaatgtgc

SEQ ID NO: 349080 - DNA, 14 bp, Homo sapiens
tgctcaatgtgctg

SEQ ID NO: 349081 - DNA, 16 bp, Homo sapiens
tgctcaatgtgctgtt

SEQ ID NO: 349082 - DNA, 17 bp, Homo sapiens
tgctcaatgtgctgttg

SEQ ID NO: 349083 - DNA, 18 bp, Homo sapiens
tgctcaatgtgctgttga

SEQ ID NO: 349084 - DNA, 22 bp, Homo sapiens
tgctcaatgtgctgttgattct

SEQ ID NO: 349085 - DNA, 13 bp, Homo sapiens
tgctcagaacaca

SEQ ID NO: 349086 - DNA, 22 bp, Homo sapiens
tgctcagaagagaatcaaggcc

SEQ ID NO: 349087 - DNA, 21 bp, Homo sapiens
tgctcagacgagacaccctaa

SEQ ID NO: 349088 - DNA, 15 bp, Homo sapiens
tgctcagctggccgg

SEQ ID NO: 349089 - DNA, 14 bp, Homo sapiens
tgctcagggctgac

SEQ ID NO: 349090 - DNA, 19 bp, Homo sapiens
tgctcaggggcgtgtggct

SEQ ID NO: 349091 - DNA, 22 bp, Homo sapiens
tgctcagtattgagacactgtc

SEQ ID NO: 349092 - DNA, 16 bp, Homo sapiens
tgctcagtctcccttt

SEQ ID NO: 349093 - DNA, 20 bp, Homo sapiens
tgctcagttccaatgtgccc

SEQ ID NO: 349094 - DNA, 14 bp, Homo sapiens
tgctcagttgtact

SEQ ID NO: 349095 - DNA, 19 bp, Homo sapiens
tgctcagttgtacttttta

SEQ ID NO: 349096 - DNA, 14 bp, Homo sapiens
tgctcatcggagac

SEQ ID NO: 349097 - DNA, 17 bp, Homo sapiens
tgctcatcggagactgc

SEQ ID NO: 349098 - DNA, 16 bp, Homo sapiens
tgctcatgggaagaac

SEQ ID NO: 349099 - DNA, 20 bp, Homo sapiens
tgctcattcatattcctgcc

SEQ ID NO: 349100 - DNA, 16 bp, Homo sapiens
tgctccacccttggcc

SEQ ID NO: 349101 - DNA, 19 bp, Homo sapiens
tgctccacccttggcctgt

SEQ ID NO: 349102 - DNA, 22 bp, Homo sapiens
tgctccacccttggcctgtctc

SEQ ID NO: 349103 - DNA, 18 bp, Homo sapiens
tgctccacgaagccttaa

SEQ ID NO: 349104 - DNA, 16 bp, Homo sapiens
tgctccagcagtgctg

SEQ ID NO: 349105 - DNA, 19 bp, Homo sapiens
tgctccagcagtgctgggc

SEQ ID NO: 349106 - DNA, 20 bp, Homo sapiens
tgctccagcagtgctgggcc

SEQ ID NO: 349107 - DNA, 22 bp, Homo sapiens
tgctccagcagtgctgggccca

SEQ ID NO: 349108 - DNA, 15 bp, Homo sapiens
tgctccagccaaccc

SEQ ID NO: 349109 - DNA, 17 bp, Homo sapiens
tgctccagccaacccct

SEQ ID NO: 349110 - DNA, 18 bp, Homo sapiens
tgctccagccaacccctg

SEQ ID NO: 349111 - DNA, 20 bp, Homo sapiens
tgctccagccaacccctgtg

SEQ ID NO: 349112 - DNA, 16 bp, Homo sapiens
tgctccagggtcttgg

SEQ ID NO: 349113 - DNA, 20 bp, Homo sapiens
tgctccatgactggctgtct

SEQ ID NO: 349114 - DNA, 17 bp, Homo sapiens
tgctccattttcttgtc

SEQ ID NO: 349115 - DNA, 13 bp, Homo sapiens
tgctcccagcagc

SEQ ID NO: 349116 - DNA, 14 bp, Homo sapiens
tgctcccagcagcc

SEQ ID NO: 349117 - DNA, 13 bp, Homo sapiens
tgctcccagcctg

SEQ ID NO: 349118 - DNA, 15 bp, Homo sapiens
tgctcccagcctgct

SEQ ID NO: 349119 - DNA, 17 bp, Homo sapiens
tgctcccagcctgctga

SEQ ID NO: 349120 - DNA, 22 bp, Homo sapiens
tgctcccagcctgctgagagcc

SEQ ID NO: 349121 - DNA, 17 bp, Homo sapiens
tgctcccagtttcttga

SEQ ID NO: 349122 - DNA, 19 bp, Homo sapiens
tgctcccattcctccctcc

SEQ ID NO: 349123 - DNA, 13 bp, Homo sapiens
tgctcccccatcc

SEQ ID NO: 349124 - DNA, 17 bp, Homo sapiens
tgctccctcccctgccc

SEQ ID NO: 349125 - DNA, 14 bp, Homo sapiens
tgctccgccaggaa

SEQ ID NO: 349126 - DNA, 16 bp, Homo sapiens
tgctccgtgtgtctca

SEQ ID NO: 349127 - DNA, 19 bp, Homo sapiens
tgctccgtgtgtctcatgc

SEQ ID NO: 349128 - DNA, 19 bp, Homo sapiens
tgctcctcacccccacccc

SEQ ID NO: 349129 - DNA, 11 bp, Homo sapiens
tgctcctcctg

SEQ ID NO: 349130 - DNA, 16 bp, Homo sapiens
tgctcctcggccagag

SEQ ID NO: 349131 - DNA, 19 bp, Homo sapiens
tgctcctcggccagagctc

SEQ ID NO: 349132 - DNA, 17 bp, Homo sapiens
tgctcctgtttaactcc

SEQ ID NO: 349133 - DNA, 16 bp, Homo sapiens
tgctccttggcacccc

SEQ ID NO: 349134 - DNA, 18 bp, Homo sapiens
tgctccttggcaccccca

SEQ ID NO: 349135 - DNA, 23 bp, Homo sapiens
tgctccttggcacccccatgctg

SEQ ID NO: 349136 - DNA, 21 bp, Homo sapiens
tgctccttggcctagtcagat

SEQ ID NO: 349137 - DNA, 14 bp, Homo sapiens
tgctccttgttcct

SEQ ID NO: 349138 - DNA, 16 bp, Homo sapiens
tgctccttgttcctag

SEQ ID NO: 349139 - DNA, 15 bp, Homo sapiens
tgctccttttctctt

SEQ ID NO: 349140 - DNA, 16 bp, Homo sapiens
tgctcggacacagttt

SEQ ID NO: 349141 - DNA, 21 bp, Homo sapiens
tgctcgtatctccttgattac

SEQ ID NO: 349142 - DNA, 15 bp, Homo sapiens
tgctctaagcacacg

SEQ ID NO: 349143 - DNA, 23 bp, Homo sapiens
tgctctacccatgagcctgcccg

SEQ ID NO: 349144 - DNA, 17 bp, Homo sapiens
tgctctatctctcaaaa

SEQ ID NO: 349145 - DNA, 12 bp, Homo sapiens
tgctctattgta

SEQ ID NO: 349146 - DNA, 12 bp, Homo sapiens
tgctctcccctg

SEQ ID NO: 349147 - DNA, 14 bp, Homo sapiens
tgctctcccctgcc

SEQ ID NO: 349148 - DNA, 15 bp, Homo sapiens
tgctctcccctgccc

SEQ ID NO: 349149 - DNA, 22 bp, Homo sapiens
tgctctccctcttctcaagtgc

SEQ ID NO: 349150 - DNA, 12 bp, Homo sapiens
tgctctcctctt

SEQ ID NO: 349151 - DNA, 14 bp, Homo sapiens
tgctctcctcttgc

SEQ ID NO: 349152 - DNA, 20 bp, Homo sapiens
tgctctccttcactctgaca

SEQ ID NO: 349153 - DNA, 15 bp, Homo sapiens
tgctctccttgccct

SEQ ID NO: 349154 - DNA, 17 bp, Homo sapiens
tgctctccttgccctgg

SEQ ID NO: 349155 - DNA, 20 bp, Homo sapiens
tgctctccttgccctgggcc

SEQ ID NO: 349156 - DNA, 17 bp, Homo sapiens
tgctctctacccagccc

SEQ ID NO: 349157 - DNA, 18 bp, Homo sapiens
tgctctgaacacgaagct

SEQ ID NO: 349158 - DNA, 22 bp, Homo sapiens
tgctctgagaagaggagccctc

SEQ ID NO: 349159 - DNA, 17 bp, Homo sapiens
tgctctgcagcccacag

SEQ ID NO: 349160 - DNA, 20 bp, Homo sapiens
tgctctgcagcccacagagg

SEQ ID NO: 349161 - DNA, 23 bp, Homo sapiens
tgctctgcagcccacagaggaca

SEQ ID NO: 349162 - DNA, 13 bp, Homo sapiens
tgctctgcccaga

SEQ ID NO: 349163 - DNA, 14 bp, Homo sapiens
tgctctgcccagag

SEQ ID NO: 349164 - DNA, 18 bp, Homo sapiens
tgctctgccccaagcccc

SEQ ID NO: 349165 - DNA, 20 bp, Homo sapiens
tgctctgccccttgggcatc

SEQ ID NO: 349166 - DNA, 14 bp, Homo sapiens
tgctctggaagcct

SEQ ID NO: 349167 - DNA, 19 bp, Homo sapiens
tgctctggaagcctgctga

SEQ ID NO: 349168 - DNA, 21 bp, Homo sapiens
tgctctggcggcttcctgtcc

SEQ ID NO: 349169 - DNA, 14 bp, Homo sapiens
tgctctggtcatac

SEQ ID NO: 349170 - DNA, 20 bp, Homo sapiens
tgctctgtccaattccagag

SEQ ID NO: 349171 - DNA, 18 bp, Homo sapiens
tgctctgtgcctgggatc

SEQ ID NO: 349172 - DNA, 17 bp, Homo sapiens
tgctctgttacccaggc

SEQ ID NO: 349173 - DNA, 20 bp, Homo sapiens
tgctcttagattgggccatg

SEQ ID NO: 349174 - DNA, 22 bp, Homo sapiens
tgctcttagattgggccatggc

SEQ ID NO: 349175 - DNA, 13 bp, Homo sapiens
tgctctttctctg

SEQ ID NO: 349176 - DNA, 16 bp, Homo sapiens
tgctctttctctgcca

SEQ ID NO: 349177 - DNA, 21 bp, Homo sapiens
tgctctttctctgccagtgac

SEQ ID NO: 349178 - DNA, 17 bp, Homo sapiens
tgctgaaacaggagaga

SEQ ID NO: 349179 - DNA, 22 bp, Homo sapiens
tgctgaaagagaaaagaggggt

SEQ ID NO: 349180 - DNA, 16 bp, Homo sapiens
tgctgaaataaactag

SEQ ID NO: 349181 - DNA, 17 bp, Homo sapiens
tgctgaactgtgcatca

SEQ ID NO: 349182 - DNA, 20 bp, Homo sapiens
tgctgaagcttattaatgct

SEQ ID NO: 349183 - DNA, 23 bp, Homo sapiens
tgctgaaggaataaattgctcct

SEQ ID NO: 349184 - DNA, 20 bp, Homo sapiens
tgctgaaggattatatgtat

SEQ ID NO: 349185 - DNA, 21 bp, Homo sapiens
tgctgaagtacagtcccagca

SEQ ID NO: 349186 - DNA, 17 bp, Homo sapiens
tgctgaatatctgttca

SEQ ID NO: 349187 - DNA, 13 bp, Homo sapiens
tgctgaattcctt

SEQ ID NO: 349188 - DNA, 17 bp, Homo sapiens
tgctgaccccaggaagt

SEQ ID NO: 349189 - DNA, 19 bp, Homo sapiens
tgctgactgtactcctccc

SEQ ID NO: 349190 - DNA, 21 bp, Homo sapiens
tgctgactgtactcctcccag

SEQ ID NO: 349191 - DNA, 13 bp, Homo sapiens
tgctgagaaatgg

SEQ ID NO: 349192 - DNA, 19 bp, Homo sapiens
tgctgagatgtttagtagc

SEQ ID NO: 349193 - DNA, 15 bp, Homo sapiens
tgctgagcaccctct

SEQ ID NO: 349194 - DNA, 17 bp, Homo sapiens
tgctgagcaccctctcc

SEQ ID NO: 349195 - DNA, 17 bp, Homo sapiens
tgctgagcttagccttg

SEQ ID NO: 349196 - DNA, 24 bp, Homo sapiens
tgctgagcttagccttgtgccctg

SEQ ID NO: 349197 - DNA, 18 bp, Homo sapiens
tgctgaggactccctcca

SEQ ID NO: 349198 - DNA, 22 bp, Homo sapiens
tgctgaggactccctccatgtg

SEQ ID NO: 349199 - DNA, 19 bp, Homo sapiens
tgctgatagctaagtgagt

SEQ ID NO: 349200 - DNA, 22 bp, Homo sapiens
tgctgatagctaagtgagtttt

SEQ ID NO: 349201 - DNA, 16 bp, Homo sapiens
tgctgatgtaggagct

SEQ ID NO: 349202 - DNA, 15 bp, Homo sapiens
tgctgattgctaagg

SEQ ID NO: 349203 - DNA, 16 bp, Homo sapiens
tgctgcaatacattaa

SEQ ID NO: 349204 - DNA, 19 bp, Homo sapiens
tgctgcaatacattaaaat

SEQ ID NO: 349205 - DNA, 13 bp, Homo sapiens
tgctgcaccagag

SEQ ID NO: 349206 - DNA, 17 bp, Homo sapiens
tgctgcaccccatgtgg

SEQ ID NO: 349207 - DNA, 15 bp, Homo sapiens
tgctgcacctgaggc

SEQ ID NO: 349208 - DNA, 14 bp, Homo sapiens
tgctgcagacaaaa

SEQ ID NO: 349209 - DNA, 21 bp, Homo sapiens
tgctgcatagctctattttaa

SEQ ID NO: 349210 - DNA, 17 bp, Homo sapiens
tgctgccaagtcctgcc

SEQ ID NO: 349211 - DNA, 19 bp, Homo sapiens
tgctgccaagtcctgcctt

SEQ ID NO: 349212 - DNA, 16 bp, Homo sapiens
tgctgccacacttcag

SEQ ID NO: 349213 - DNA, 16 bp, Homo sapiens
tgctgccatgccactg

SEQ ID NO: 349214 - DNA, 18 bp, Homo sapiens
tgctgccatgccactgcc

SEQ ID NO: 349215 - DNA, 20 bp, Homo sapiens
tgctgccatgccactgccag

SEQ ID NO: 349216 - DNA, 14 bp, Homo sapiens
tgctgcccagcctc

SEQ ID NO: 349217 - DNA, 16 bp, Homo sapiens
tgctgcccagcctcca

SEQ ID NO: 349218 - DNA, 13 bp, Homo sapiens
tgctgccccagct

SEQ ID NO: 349219 - DNA, 15 bp, Homo sapiens
tgctgccccagctga

SEQ ID NO: 349220 - DNA, 20 bp, Homo sapiens
tgctgccccgttccctgtca

SEQ ID NO: 349221 - DNA, 19 bp, Homo sapiens
tgctgcccctgtctggaag

SEQ ID NO: 349222 - DNA, 19 bp, Homo sapiens
tgctgccgcctcccagcct

SEQ ID NO: 349223 - DNA, 21 bp, Homo sapiens
tgctgccgcctcccagcctgg

SEQ ID NO: 349224 - DNA, 13 bp, Homo sapiens
tgctgcctcagga

SEQ ID NO: 349225 - DNA, 17 bp, Homo sapiens
tgctgcctccccaaccc

SEQ ID NO: 349226 - DNA, 19 bp, Homo sapiens
tgctgcctccccaaccctg

SEQ ID NO: 349227 - DNA, 21 bp, Homo sapiens
tgctgcctgcccgcacagcag

SEQ ID NO: 349228 - DNA, 13 bp, Homo sapiens
tgctgcctgcctg

SEQ ID NO: 349229 - DNA, 14 bp, Homo sapiens
tgctgccttgagac

SEQ ID NO: 349230 - DNA, 15 bp, Homo sapiens
tgctgcgtcagacca

SEQ ID NO: 349231 - DNA, 13 bp, Homo sapiens
tgctgctactacc

SEQ ID NO: 349232 - DNA, 15 bp, Homo sapiens
tgctgctacttaatt

SEQ ID NO: 349233 - DNA, 14 bp, Homo sapiens
tgctgctatgaaaa

SEQ ID NO: 349234 - DNA, 20 bp, Homo sapiens
tgctgctatgaaaatgagca

SEQ ID NO: 349235 - DNA, 19 bp, Homo sapiens
tgctgctccatggatgcat

SEQ ID NO: 349236 - DNA, 13 bp, Homo sapiens
tgctgctcccagc

SEQ ID NO: 349237 - DNA, 13 bp, Homo sapiens
tgctgctcctcgg

SEQ ID NO: 349238 - DNA, 19 bp, Homo sapiens
tgctgctcctcggccagag

SEQ ID NO: 349239 - DNA, 20 bp, Homo sapiens
tgctgctcctcggccagagc

SEQ ID NO: 349240 - DNA, 19 bp, Homo sapiens
tgctgctcctctttcccct

SEQ ID NO: 349241 - DNA, 16 bp, Homo sapiens
tgctgctcgggaaggc

SEQ ID NO: 349242 - DNA, 17 bp, Homo sapiens
tgctgctcgggaaggcc

SEQ ID NO: 349243 - DNA, 13 bp, Homo sapiens
tgctgctgcctgc

SEQ ID NO: 349244 - DNA, 12 bp, Homo sapiens
tgctgctgctgc

SEQ ID NO: 349245 - DNA, 17 bp, Homo sapiens
tgctgctgctgcgccct

SEQ ID NO: 349246 - DNA, 23 bp, Homo sapiens
tgctgctggacagtatcactgtc

SEQ ID NO: 349247 - DNA, 19 bp, Homo sapiens
tgctgctgtaactgctgag

SEQ ID NO: 349248 - DNA, 23 bp, Homo sapiens
tgctgctgtaactgctgagccac

SEQ ID NO: 349249 - DNA, 24 bp, Homo sapiens
tgctgctgtaactgctgagccact

SEQ ID NO: 349250 - DNA, 14 bp, Homo sapiens
tgctgctgtgaatt

SEQ ID NO: 349251 - DNA, 15 bp, Homo sapiens
tgctgctgtgcctgc

SEQ ID NO: 349252 - DNA, 13 bp, Homo sapiens
tgctgctgtggca

SEQ ID NO: 349253 - DNA, 20 bp, Homo sapiens
tgctgcttccctctgcctgt

SEQ ID NO: 349254 - DNA, 13 bp, Homo sapiens
tgctgcttcctaa

SEQ ID NO: 349255 - DNA, 14 bp, Homo sapiens
tgctgcttcctaac

SEQ ID NO: 349256 - DNA, 16 bp, Homo sapiens
tgctgcttcctaactt

SEQ ID NO: 349257 - DNA, 15 bp, Homo sapiens
tgctgcttctgggcc

SEQ ID NO: 349258 - DNA, 18 bp, Homo sapiens
tgctgcttgtgcctccct

SEQ ID NO: 349259 - DNA, 23 bp, Homo sapiens
tgctgcttgtgcctcccttccca

SEQ ID NO: 349260 - DNA, 14 bp, Homo sapiens
tgctgctttccaac

SEQ ID NO: 349261 - DNA, 12 bp, Homo sapiens
tgctgctttgct

SEQ ID NO: 349262 - DNA, 20 bp, Homo sapiens
tgctgcttttgatggctatg

SEQ ID NO: 349263 - DNA, 17 bp, Homo sapiens
tgctggaaaccacactt

SEQ ID NO: 349264 - DNA, 18 bp, Homo sapiens
tgctggaaaccacacttc

SEQ ID NO: 349265 - DNA, 13 bp, Homo sapiens
tgctggagaggtt

SEQ ID NO: 349266 - DNA, 14 bp, Homo sapiens
tgctggagaggtta

SEQ ID NO: 349267 - DNA, 23 bp, Homo sapiens
tgctggagtcctgttctcagagc

SEQ ID NO: 349268 - DNA, 22 bp, Homo sapiens
tgctggatattttcaaattgta

SEQ ID NO: 349269 - DNA, 15 bp, Homo sapiens
tgctggcacagactt

SEQ ID NO: 349270 - DNA, 18 bp, Homo sapiens
tgctggcacatttcccca

SEQ ID NO: 349271 - DNA, 18 bp, Homo sapiens
tgctggccagcctggggc

SEQ ID NO: 349272 - DNA, 22 bp, Homo sapiens
tgctggccagcctggggcctgg

SEQ ID NO: 349273 - DNA, 12 bp, Homo sapiens
tgctggcccctc

SEQ ID NO: 349274 - DNA, 15 bp, Homo sapiens
tgctggcccctcacc

SEQ ID NO: 349275 - DNA, 20 bp, Homo sapiens
tgctggcccctcacctgggc

SEQ ID NO: 349276 - DNA, 16 bp, Homo sapiens
tgctggccgggcacag

SEQ ID NO: 349277 - DNA, 17 bp, Homo sapiens
tgctggccgggcacagc

SEQ ID NO: 349278 - DNA, 23 bp, Homo sapiens
tgctggcctcccaataaagctgg

SEQ ID NO: 349279 - DNA, 15 bp, Homo sapiens
tgctggcctggatct

SEQ ID NO: 349280 - DNA, 19 bp, Homo sapiens
tgctggctccacgccctgg

SEQ ID NO: 349281 - DNA, 20 bp, Homo sapiens
tgctggctccacgccctggg

SEQ ID NO: 349282 - DNA, 21 bp, Homo sapiens
tgctggctccacgccctgggg

SEQ ID NO: 349283 - DNA, 19 bp, Homo sapiens
tgctggctgaggcttgggc

SEQ ID NO: 349284 - DNA, 14 bp, Homo sapiens
tgctggctgcccag

SEQ ID NO: 349285 - DNA, 14 bp, Homo sapiens
tgctggctgcctta

SEQ ID NO: 349286 - DNA, 14 bp, Homo sapiens
tgctgggaagtggc

SEQ ID NO: 349287 - DNA, 14 bp, Homo sapiens
tgctgggacagcta

SEQ ID NO: 349288 - DNA, 16 bp, Homo sapiens
tgctgggacagctagg

SEQ ID NO: 349289 - DNA, 15 bp, Homo sapiens
tgctgggaccctcgg

SEQ ID NO: 349290 - DNA, 17 bp, Homo sapiens
tgctgggactgagccag

SEQ ID NO: 349291 - DNA, 13 bp, Homo sapiens
tgctgggcccagc

SEQ ID NO: 349292 - DNA, 18 bp, Homo sapiens
tgctttctctttcagtat

SEQ ID NO: 349293 - DNA, 14 bp, Homo sapiens
tgctttctgactga

SEQ ID NO: 349294 - DNA, 23 bp, Homo sapiens
tgctttcttgccacacagtgggc

SEQ ID NO: 349295 - DNA, 18 bp, Homo sapiens
tgctttctttgtttggct

SEQ ID NO: 349296 - DNA, 22 bp, Homo sapiens
tgctttgactgagcagactggt

SEQ ID NO: 349297 - DNA, 17 bp, Homo sapiens
tgctttgcacaggaaag

SEQ ID NO: 349298 - DNA, 15 bp, Homo sapiens
tgctttgctgctatg

SEQ ID NO: 349299 - DNA, 14 bp, Homo sapiens
tgctttgggctgcc

SEQ ID NO: 349300 - DNA, 20 bp, Homo sapiens
tgctttgggctgccctggtg

SEQ ID NO: 349301 - DNA, 18 bp, Homo sapiens
tgctttgggctttgcagg

SEQ ID NO: 349302 - DNA, 12 bp, Homo sapiens
tgctttgtagct

SEQ ID NO: 349303 - DNA, 21 bp, Homo sapiens
tgctttgtagcttaaaaaaag

SEQ ID NO: 349304 - DNA, 18 bp, Homo sapiens
tgctttgttaccttaaaa

SEQ ID NO: 349305 - DNA, 20 bp, Homo sapiens
tgctttgttaccttaaaact

SEQ ID NO: 349306 - DNA, 15 bp, Homo sapiens
tgcttttatccactg

SEQ ID NO: 349307 - DNA, 19 bp, Homo sapiens
tgcttttcatgtagaactc

SEQ ID NO: 349308 - DNA, 23 bp, Homo sapiens
tgcttttcatgtagaactcagca

SEQ ID NO: 349309 - DNA, 23 bp, Homo sapiens
tgcttttccaggatcctgcagga

SEQ ID NO: 349310 - DNA, 18 bp, Homo sapiens
tgcttttccatctaaaat

SEQ ID NO: 349311 - DNA, 14 bp, Homo sapiens
tgcttttctcatgg

SEQ ID NO: 349312 - DNA, 23 bp, Homo sapiens
tgctttttaatattgatatgctt

SEQ ID NO: 349313 - DNA, 15 bp, Homo sapiens
tgctttttggcacag

SEQ ID NO: 349314 - DNA, 17 bp, Homo sapiens
tggaaaaaaaaaaatat

SEQ ID NO: 349315 - DNA, 15 bp, Homo sapiens
tggaaaaaaaaagaa

SEQ ID NO: 349316 - DNA, 15 bp, Homo sapiens
tggaaaaaagagaaa

SEQ ID NO: 349317 - DNA, 23 bp, Homo sapiens
tggaaaaaagagaaaaaccaatg

SEQ ID NO: 349318 - DNA, 15 bp, Homo sapiens
tggaaaaagaaattc

SEQ ID NO: 349319 - DNA, 19 bp, Homo sapiens
tggaaaacaatttgcataa

SEQ ID NO: 349320 - DNA, 14 bp, Homo sapiens
tggaaaacctcctt

SEQ ID NO: 349321 - DNA, 14 bp, Homo sapiens
tggaaaactcacag

SEQ ID NO: 349322 - DNA, 15 bp, Homo sapiens
tggaaaactcacaga

SEQ ID NO: 349323 - DNA, 14 bp, Homo sapiens
tggaaaacttagtt

SEQ ID NO: 349324 - DNA, 20 bp, Homo sapiens
tggaaaacttagtttgtgaa

SEQ ID NO: 349325 - DNA, 15 bp, Homo sapiens
tggaaaaggaagact

SEQ ID NO: 349326 - DNA, 14 bp, Homo sapiens
tgccttagaacctt

SEQ ID NO: 349327 - DNA, 14 bp, Homo sapiens
tgccttagaggagc

SEQ ID NO: 349328 - DNA, 16 bp, Homo sapiens
tgccttagaggagccc

SEQ ID NO: 349329 - DNA, 13 bp, Homo sapiens
tgccttaggaagt

SEQ ID NO: 349330 - DNA, 21 bp, Homo sapiens
tgccttaggaagtgacttgaa

SEQ ID NO: 349331 - DNA, 15 bp, Homo sapiens
tgccttattatttct

SEQ ID NO: 349332 - DNA, 18 bp, Homo sapiens
tggaaaaggaagactaga

SEQ ID NO: 349333 - DNA, 17 bp, Homo sapiens
tggaaaatgtcctgtgg

SEQ ID NO: 349334 - DNA, 19 bp, Homo sapiens
tggaaaccacacttcttga

SEQ ID NO: 349335 - DNA, 20 bp, Homo sapiens
tggaaaccacacttcttgaa

SEQ ID NO: 349336 - DNA, 21 bp, Homo sapiens
tggaaaccagaatgattttga

SEQ ID NO: 349337 - DNA, 14 bp, Homo sapiens
tggaaacctgttat

SEQ ID NO: 349338 - DNA, 19 bp, Homo sapiens
tggaaactaccagtgggca

SEQ ID NO: 349339 - DNA, 18 bp, Homo sapiens
tggaaactctttaacttc

SEQ ID NO: 349340 - DNA, 19 bp, Homo sapiens
tggaaactctttaacttct

SEQ ID NO: 349341 - DNA, 17 bp, Homo sapiens
tggaaactgttgccaga

SEQ ID NO: 349342 - DNA, 21 bp, Homo sapiens
tggaaagagctgttttggatg

SEQ ID NO: 349343 - DNA, 15 bp, Homo sapiens
tggaaagattgtgtc

SEQ ID NO: 349344 - DNA, 20 bp, Homo sapiens
tggaaaggaagaatgcagag

SEQ ID NO: 349345 - DNA, 21 bp, Homo sapiens
tggaaaggattctaaacagat

SEQ ID NO: 349346 - DNA, 17 bp, Homo sapiens
tggaaaggggggagctg

SEQ ID NO: 349347 - DNA, 22 bp, Homo sapiens
tggaaagggtgtggcttggaac

SEQ ID NO: 349348 - DNA, 22 bp, Homo sapiens
tggaaaggtcctgctgtggaaa

SEQ ID NO: 349349 - DNA, 14 bp, Homo sapiens
tggaaagtgaattt

SEQ ID NO: 349350 - DNA, 23 bp, Homo sapiens
tggaaagtgaatttgaatgaaaa

SEQ ID NO: 349351 - DNA, 20 bp, Homo sapiens
tggaaagtgatttgtaatat

SEQ ID NO: 349352 - DNA, 22 bp, Homo sapiens
tggaaagttcttaggcaccata

SEQ ID NO: 349353 - DNA, 12 bp, Homo sapiens
tggaaataataa

SEQ ID NO: 349354 - DNA, 16 bp, Homo sapiens
tggaaataataaatta

SEQ ID NO: 349355 - DNA, 20 bp, Homo sapiens
tggaaataataaattaacat

SEQ ID NO: 349356 - DNA, 22 bp, Homo sapiens
tggaaatacagttgttggcctc

SEQ ID NO: 349357 - DNA, 17 bp, Homo sapiens
tggaaatattttgataa

SEQ ID NO: 349358 - DNA, 16 bp, Homo sapiens
tggaaatcattgtgtg

SEQ ID NO: 349359 - DNA, 17 bp, Homo sapiens
tggaaattcttccctgg

SEQ ID NO: 349360 - DNA, 22 bp, Homo sapiens
tggaaattgggtgtgccctggc

SEQ ID NO: 349361 - DNA, 21 bp, Homo sapiens
tggaaatttgttataatgaat

SEQ ID NO: 349362 - DNA, 21 bp, Homo sapiens
tggaacaaaagttcgaaagaa

SEQ ID NO: 349363 - DNA, 12 bp, Homo sapiens
tggaacacacac

SEQ ID NO: 349364 - DNA, 15 bp, Homo sapiens
tggaacacacacaca

SEQ ID NO: 349365 - DNA, 15 bp, Homo sapiens
tggaacactgtactg

SEQ ID NO: 349366 - DNA, 13 bp, Homo sapiens
tggaacagcggga

SEQ ID NO: 349367 - DNA, 16 bp, Homo sapiens
tggaacagcgggagac

SEQ ID NO: 349368 - DNA, 16 bp, Homo sapiens
tggaacaggaggaact

SEQ ID NO: 349369 - DNA, 21 bp, Homo sapiens
tggaacaggaggaactggtcc

SEQ ID NO: 349370 - DNA, 23 bp, Homo sapiens
tggaacaggaggaactggtccag

SEQ ID NO: 349371 - DNA, 20 bp, Homo sapiens
tggaacagtcacccttctgg

SEQ ID NO: 349372 - DNA, 21 bp, Homo sapiens
tggaacatgtcggagtagaaa

SEQ ID NO: 349373 - DNA, 18 bp, Homo sapiens
tggaaccagggaggagag

SEQ ID NO: 349374 - DNA, 19 bp, Homo sapiens
tggaaccagggaggagagg

SEQ ID NO: 349375 - DNA, 20 bp, Homo sapiens
tggaacggtgaaggtgacag

SEQ ID NO: 349376 - DNA, 14 bp, Homo sapiens
tggaactctgtgca

SEQ ID NO: 349377 - DNA, 23 bp, Homo sapiens
tggaactgctgccatgattttgg

SEQ ID NO: 349378 - DNA, 18 bp, Homo sapiens
tggaactttagggggtgg

SEQ ID NO: 349379 - DNA, 17 bp, Homo sapiens
tggaagaacatcaagat

SEQ ID NO: 349380 - DNA, 15 bp, Homo sapiens
tggaagaccccaccc

SEQ ID NO: 349381 - DNA, 17 bp, Homo sapiens
tggaagagaggcacctg

SEQ ID NO: 349382 - DNA, 18 bp, Homo sapiens
tggaagagaggcacctgc

SEQ ID NO: 349383 - DNA, 20 bp, Homo sapiens
tggaagagaggcacctgctg

SEQ ID NO: 349384 - DNA, 17 bp, Homo sapiens
tggaagagcagcctgat

SEQ ID NO: 349385 - DNA, 17 bp, Homo sapiens
tggaagccggagggtgt

SEQ ID NO: 349386 - DNA, 14 bp, Homo sapiens
tggaagcctgctga

SEQ ID NO: 349387 - DNA, 19 bp, Homo sapiens
tggaagcctgctgatttct

SEQ ID NO: 349388 - DNA, 12 bp, Homo sapiens
tggaagctctgt

SEQ ID NO: 349389 - DNA, 19 bp, Homo sapiens
tggaagctgattcccagag

SEQ ID NO: 349390 - DNA, 20 bp, Homo sapiens
tggaagctgattcccagagc

SEQ ID NO: 349391 - DNA, 15 bp, Homo sapiens
tggaagctggcagga

SEQ ID NO: 349392 - DNA, 16 bp, Homo sapiens
tggaaggcacccgccc

SEQ ID NO: 349393 - DNA, 23 bp, Homo sapiens
tggaaggcacccgccctttcctt

SEQ ID NO: 349394 - DNA, 14 bp, Homo sapiens
tggaaggcagggca

SEQ ID NO: 349395 - DNA, 15 bp, Homo sapiens
tggaaggcagggcag

SEQ ID NO: 349396 - DNA, 17 bp, Homo sapiens
tggaaggcagggcagag

SEQ ID NO: 349397 - DNA, 20 bp, Homo sapiens
tggaagggcgctgagggcag

SEQ ID NO: 349398 - DNA, 19 bp, Homo sapiens
tggaagggttctggctgcc

SEQ ID NO: 349399 - DNA, 17 bp, Homo sapiens
tggaagggtttgtggct

SEQ ID NO: 349400 - DNA, 19 bp, Homo sapiens
tggaaggtctattggccaa

SEQ ID NO: 349401 - DNA, 23 bp, Homo sapiens
tggaaggtgaggcgttctcctgc

SEQ ID NO: 349402 - DNA, 15 bp, Homo sapiens
tggaaggtgatgggg

SEQ ID NO: 349403 - DNA, 20 bp, Homo sapiens
tggaagtactataatttacc

SEQ ID NO: 349404 - DNA, 13 bp, Homo sapiens
tggaagtatttga

SEQ ID NO: 349405 - DNA, 14 bp, Homo sapiens
tggaataggaataa

SEQ ID NO: 349406 - DNA, 23 bp, Homo sapiens
tggaatattcccctatctctaga

SEQ ID NO: 349407 - DNA, 15 bp, Homo sapiens
tggaatccagaagga

SEQ ID NO: 349408 - DNA, 20 bp, Homo sapiens
tggaatcccacttatcaaat

SEQ ID NO: 349409 - DNA, 18 bp, Homo sapiens
tggaatctactagaacct

SEQ ID NO: 349410 - DNA, 19 bp, Homo sapiens
tggaatgactataaacatt

SEQ ID NO: 349411 - DNA, 14 bp, Homo sapiens
tggaatgactgaaa

SEQ ID NO: 349412 - DNA, 21 bp, Homo sapiens
tggaatgcattcactcagcat

SEQ ID NO: 349413 - DNA, 13 bp, Homo sapiens
tggaatggagctg

SEQ ID NO: 349414 - DNA, 16 bp, Homo sapiens
tggaattaacctggtg

SEQ ID NO: 349415 - DNA, 18 bp, Homo sapiens
tggaattaacctggtgct

SEQ ID NO: 349416 - DNA, 20 bp, Homo sapiens
tggaattaacctggtgctgg

SEQ ID NO: 349417 - DNA, 13 bp, Homo sapiens
tggaattacataa

SEQ ID NO: 349418 - DNA, 16 bp, Homo sapiens
tggaattatgtataac

SEQ ID NO: 349419 - DNA, 22 bp, Homo sapiens
tggaattattttgaatgtcaca

SEQ ID NO: 349420 - DNA, 23 bp, Homo sapiens
tggaattattttgaatgtcacaa

SEQ ID NO: 349421 - DNA, 18 bp, Homo sapiens
tggaattcagcaccctgg

SEQ ID NO: 349422 - DNA, 21 bp, Homo sapiens
tggaattcagcaccctgggtg

SEQ ID NO: 349423 - DNA, 19 bp, Homo sapiens
tggaattccttggagccac

SEQ ID NO: 349424 - DNA, 17 bp, Homo sapiens
tggaattggtgtatatc

SEQ ID NO: 349425 - DNA, 19 bp, Homo sapiens
tggacaaacccttctttta

SEQ ID NO: 349426 - DNA, 15 bp, Homo sapiens
tggacgcacacagct

SEQ ID NO: 349427 - DNA, 19 bp, Homo sapiens
tggacggggacacggcctc

SEQ ID NO: 349428 - DNA, 21 bp, Homo sapiens
tggacggggacacggcctctg

SEQ ID NO: 349429 - DNA, 19 bp, Homo sapiens
tggacgtgttatgactcca

SEQ ID NO: 349430 - DNA, 16 bp, Homo sapiens
tggactatagcagggc

SEQ ID NO: 349431 - DNA, 18 bp, Homo sapiens
tggactatagcagggctg

SEQ ID NO: 349432 - DNA, 13 bp, Homo sapiens
tggactcctctgt

SEQ ID NO: 349433 - DNA, 19 bp, Homo sapiens
tggactctgccccaatcgg

SEQ ID NO: 349434 - DNA, 15 bp, Homo sapiens
tggactctgtgctca

SEQ ID NO: 349435 - DNA, 14 bp, Homo sapiens
tggactcttccctc

SEQ ID NO: 349436 - DNA, 19 bp, Homo sapiens
tggactgcaatatcaacaa

SEQ ID NO: 349437 - DNA, 20 bp, Homo sapiens
tggactgcacaaaagtctca

SEQ ID NO: 349438 - DNA, 20 bp, Homo sapiens
tggactgtgatgccacacag

SEQ ID NO: 349439 - DNA, 21 bp, Homo sapiens
tggactgtggcctcaggaggc

SEQ ID NO: 349440 - DNA, 17 bp, Homo sapiens
tggacttatttcttcaa

SEQ ID NO: 349441 - DNA, 14 bp, Homo sapiens
tggacttcctgggg

SEQ ID NO: 349442 - DNA, 12 bp, Homo sapiens
tggactttattt

SEQ ID NO: 349443 - DNA, 16 bp, Homo sapiens
tggactttatttaatt

SEQ ID NO: 349444 - DNA, 20 bp, Homo sapiens
tggactttccaccccctccc

SEQ ID NO: 349445 - DNA, 13 bp, Homo sapiens
tggactttcctgc

SEQ ID NO: 349446 - DNA, 18 bp, Homo sapiens
tggactttcctgcaactc

SEQ ID NO: 349447 - DNA, 12 bp, Homo sapiens
tggactttgtta

SEQ ID NO: 349448 - DNA, 21 bp, Homo sapiens
tggacttttcgttaacattga

SEQ ID NO: 349449 - DNA, 19 bp, Homo sapiens
tggacttttgcagcttcct

SEQ ID NO: 349450 - DNA, 15 bp, Homo sapiens
tggagaaaatgaaga

SEQ ID NO: 349451 - DNA, 17 bp, Homo sapiens
tggagaaaatgaagaaa

SEQ ID NO: 349452 - DNA, 14 bp, Homo sapiens
tggagaaaatgctt

SEQ ID NO: 349453 - DNA, 19 bp, Homo sapiens
tggagaaattatttaataa

SEQ ID NO: 349454 - DNA, 20 bp, Homo sapiens
tggagaacgccagtctccca

SEQ ID NO: 349455 - DNA, 14 bp, Homo sapiens
tggagaaggaaaag

SEQ ID NO: 349456 - DNA, 18 bp, Homo sapiens
tggagaaggaaaaggctg

SEQ ID NO: 349457 - DNA, 20 bp, Homo sapiens
tggagaaggaaaaggctggc

SEQ ID NO: 349458 - DNA, 23 bp, Homo sapiens
tggagaaggaaaaggctggcaag

SEQ ID NO: 349459 - DNA, 17 bp, Homo sapiens
tggagaatgccagccca

SEQ ID NO: 349460 - DNA, 18 bp, Homo sapiens
tggagaatgccagcccaa

SEQ ID NO: 349461 - DNA, 15 bp, Homo sapiens
tggagaatgtacaca

SEQ ID NO: 349462 - DNA, 14 bp, Homo sapiens
tggagaattatata

SEQ ID NO: 349463 - DNA, 13 bp, Homo sapiens
tggagacaatgca

SEQ ID NO: 349464 - DNA, 15 bp, Homo sapiens
tggagaccaggactc

SEQ ID NO: 349465 - DNA, 20 bp, Homo sapiens
tggagaccgcttcacccctg

SEQ ID NO: 349466 - DNA, 20 bp, Homo sapiens
tggagaccggaattgagagg

SEQ ID NO: 349467 - DNA, 22 bp, Homo sapiens
tggagaccggaattgagaggtg

SEQ ID NO: 349468 - DNA, 18 bp, Homo sapiens
tggagactcctgccctgt

SEQ ID NO: 349469 - DNA, 19 bp, Homo sapiens
tggagactcctgccctgtt

SEQ ID NO: 349470 - DNA, 17 bp, Homo sapiens
tggagactgtctcaaga

SEQ ID NO: 349471 - DNA, 15 bp, Homo sapiens
tggagacttcctctg

SEQ ID NO: 349472 - DNA, 23 bp, Homo sapiens
tggagagaccagcctttcttcct

SEQ ID NO: 349473 - DNA, 16 bp, Homo sapiens
tggagagcagctggct

SEQ ID NO: 349474 - DNA, 20 bp, Homo sapiens
tggagagggacagcccactg

SEQ ID NO: 349475 - DNA, 13 bp, Homo sapiens
tggagagggatga

SEQ ID NO: 349476 - DNA, 21 bp, Homo sapiens
tggagagggatgaggtgctgg

SEQ ID NO: 349477 - DNA, 22 bp, Homo sapiens
tggagaggttataggtcactcc

SEQ ID NO: 349478 - DNA, 17 bp, Homo sapiens
tggagatagtgccaggt

SEQ ID NO: 349479 - DNA, 13 bp, Homo sapiens
tggagatgtcttc

SEQ ID NO: 349480 - DNA, 13 bp, Homo sapiens
tggagcaaaacaa

SEQ ID NO: 349481 - DNA, 23 bp, Homo sapiens
tggagcaaaacaaagctgatttc

SEQ ID NO: 349482 - DNA, 16 bp, Homo sapiens
tggagcaaaaggcagc

SEQ ID NO: 349483 - DNA, 18 bp, Homo sapiens
tggagcaaaaggcagctc

SEQ ID NO: 349484 - DNA, 21 bp, Homo sapiens
tggagcaccgaggccagcgaa

SEQ ID NO: 349485 - DNA, 23 bp, Homo sapiens
tggagcacgaggccttcagaaaa

SEQ ID NO: 349486 - DNA, 17 bp, Homo sapiens
tggagcagagacggcag

SEQ ID NO: 349487 - DNA, 22 bp, Homo sapiens
tggagcagagacggcagcccca

SEQ ID NO: 349488 - DNA, 17 bp, Homo sapiens
tggagcagcagctgagg

SEQ ID NO: 349489 - DNA, 18 bp, Homo sapiens
tggagcaggcggtgggga

SEQ ID NO: 349490 - DNA, 17 bp, Homo sapiens
tggagccaatggagact

SEQ ID NO: 349491 - DNA, 18 bp, Homo sapiens
tggagccaatggtgaggg

SEQ ID NO: 349492 - DNA, 14 bp, Homo sapiens
tggagccacaggca

SEQ ID NO: 349493 - DNA, 17 bp, Homo sapiens
tggagccacaggcagac

SEQ ID NO: 349494 - DNA, 17 bp, Homo sapiens
tggagccacctgtccca

SEQ ID NO: 349495 - DNA, 11 bp, Homo sapiens
tggagccactc

SEQ ID NO: 349496 - DNA, 14 bp, Homo sapiens
tggagccactcctg

SEQ ID NO: 349497 - DNA, 13 bp, Homo sapiens
tggagccagcagg

SEQ ID NO: 349498 - DNA, 14 bp, Homo sapiens
tggagccagggagc

SEQ ID NO: 349499 - DNA, 23 bp, Homo sapiens
tggagccagggagcggccgcctg

SEQ ID NO: 349500 - DNA, 18 bp, Homo sapiens
tggagcccacagagtctg

SEQ ID NO: 349501 - DNA, 12 bp, Homo sapiens
tggagcccccag

SEQ ID NO: 349502 - DNA, 15 bp, Homo sapiens
tggagcccctgtgtc

SEQ ID NO: 349503 - DNA, 16 bp, Homo sapiens
tggagcccgcaccccc

SEQ ID NO: 349504 - DNA, 17 bp, Homo sapiens
tggagcccgcaccccca

SEQ ID NO: 349505 - DNA, 18 bp, Homo sapiens
tggagcccgcacccccac

SEQ ID NO: 349506 - DNA, 20 bp, Homo sapiens
tggagccggactttcggagt

SEQ ID NO: 349507 - DNA, 23 bp, Homo sapiens
tggagcctgcagggtggtgctgg

SEQ ID NO: 349508 - DNA, 23 bp, Homo sapiens
tggagcgagcatcccccaaagtt

SEQ ID NO: 349509 - DNA, 17 bp, Homo sapiens
tggagctcctgggaagg

SEQ ID NO: 349510 - DNA, 22 bp, Homo sapiens
tggagctttagcttctctgcca

SEQ ID NO: 349511 - DNA, 21 bp, Homo sapiens
tggagctttgcagccaaggtg

SEQ ID NO: 349512 - DNA, 15 bp, Homo sapiens
tggaggaaggtgctg

SEQ ID NO: 349513 - DNA, 16 bp, Homo sapiens
tggaggaaggtgctga

SEQ ID NO: 349514 - DNA, 17 bp, Homo sapiens
tggaggaaggtgctgag

SEQ ID NO: 349515 - DNA, 22 bp, Homo sapiens
tggccaggagctcttcaggcct

SEQ ID NO: 349516 - DNA, 23 bp, Homo sapiens
tggccaggagctcttcaggcctc

SEQ ID NO: 349517 - DNA, 14 bp, Homo sapiens
tggccaggatggag

SEQ ID NO: 349518 - DNA, 19 bp, Homo sapiens
tggccaggcagatctgtgc

SEQ ID NO: 349519 - DNA, 22 bp, Homo sapiens
tggccaggcagggagtgtctgc

SEQ ID NO: 349520 - DNA, 17 bp, Homo sapiens
tggccaggcctgccagc

SEQ ID NO: 349521 - DNA, 22 bp, Homo sapiens
tggccaggcctgccagcccctc

SEQ ID NO: 349522 - DNA, 20 bp, Homo sapiens
tggccaggctggtctcgaac

SEQ ID NO: 349523 - DNA, 11 bp, Homo sapiens
tggccaggtgg

SEQ ID NO: 349524 - DNA, 16 bp, Homo sapiens
tggccaggtggccact

SEQ ID NO: 349525 - DNA, 16 bp, Homo sapiens
tggccagtagctgcca

SEQ ID NO: 349526 - DNA, 16 bp, Homo sapiens
tggccagttggaacca

SEQ ID NO: 349527 - DNA, 11 bp, Homo sapiens
tggccatctct

SEQ ID NO: 349528 - DNA, 13 bp, Homo sapiens
tggccatgcaagt

SEQ ID NO: 349529 - DNA, 21 bp, Homo sapiens
tggccatggaataaaccattt

SEQ ID NO: 349530 - DNA, 22 bp, Homo sapiens
tggcccacccctcttccccctt

SEQ ID NO: 349531 - DNA, 12 bp, Homo sapiens
tggcccacgccc

SEQ ID NO: 349532 - DNA, 19 bp, Homo sapiens
tggcccacgccctccctct

SEQ ID NO: 349533 - DNA, 19 bp, Homo sapiens
tggcccagcagcggcccag

SEQ ID NO: 349534 - DNA, 14 bp, Homo sapiens
tggcccagcagctt

SEQ ID NO: 349535 - DNA, 15 bp, Homo sapiens
tggcccagcagcttg

SEQ ID NO: 349536 - DNA, 21 bp, Homo sapiens
tggcccagcagcttggctgag

SEQ ID NO: 349537 - DNA, 10 bp, Homo sapiens
tggcccagcc

SEQ ID NO: 349538 - DNA, 22 bp, Homo sapiens
tggcccagccaaaccctgtctg

SEQ ID NO: 349539 - DNA, 13 bp, Homo sapiens
tggcccagccagc

SEQ ID NO: 349540 - DNA, 13 bp, Homo sapiens
tggcccagcctgg

SEQ ID NO: 349541 - DNA, 19 bp, Homo sapiens
tggcccagcggcccctccc

SEQ ID NO: 349542 - DNA, 21 bp, Homo sapiens
tggcccagcggcccctcccac

SEQ ID NO: 349543 - DNA, 15 bp, Homo sapiens
tggcccaggaaaaac

SEQ ID NO: 349544 - DNA, 14 bp, Homo sapiens
tggcccagggagga

SEQ ID NO: 349545 - DNA, 22 bp, Homo sapiens
tggcccatcactcggctgtgga

SEQ ID NO: 349546 - DNA, 19 bp, Homo sapiens
tggcccatctcagcctcct

SEQ ID NO: 349547 - DNA, 20 bp, Homo sapiens
tggcccatctcagcctcctg

SEQ ID NO: 349548 - DNA, 16 bp, Homo sapiens
tggccccacctgagcc

SEQ ID NO: 349549 - DNA, 14 bp, Homo sapiens
tggccccagctggc

SEQ ID NO: 349550 - DNA, 16 bp, Homo sapiens
tggccccagctggctg

SEQ ID NO: 349551 - DNA, 20 bp, Homo sapiens
tggccccagctggctgggtc

SEQ ID NO: 349552 - DNA, 16 bp, Homo sapiens
tggccccaggtgccac

SEQ ID NO: 349553 - DNA, 18 bp, Homo sapiens
tggccccaggtgccacca

SEQ ID NO: 349554 - DNA, 17 bp, Homo sapiens
tggcccccgagctgggg

SEQ ID NO: 349555 - DNA, 15 bp, Homo sapiens
tggccccctccgtga

SEQ ID NO: 349556 - DNA, 17 bp, Homo sapiens
tggccccgccctcaggc

SEQ ID NO: 349557 - DNA, 18 bp, Homo sapiens
tggccccgggctctggcc

SEQ ID NO: 349558 - DNA, 23 bp, Homo sapiens
tggccccgggctctggccaccct

SEQ ID NO: 349559 - DNA, 19 bp, Homo sapiens
tggcccctagaatcagcct

SEQ ID NO: 349560 - DNA, 12 bp, Homo sapiens
tggcccctcacc

SEQ ID NO: 349561 - DNA, 18 bp, Homo sapiens
tggcccctcacctgggcc

SEQ ID NO: 349562 - DNA, 20 bp, Homo sapiens
tggcccctcacctgggcctt

SEQ ID NO: 349563 - DNA, 14 bp, Homo sapiens
tggcccctccagga

SEQ ID NO: 349564 - DNA, 12 bp, Homo sapiens
tggcccctccca

SEQ ID NO: 349565 - DNA, 19 bp, Homo sapiens
tggcccctcccacatcccc

SEQ ID NO: 349566 - DNA, 20 bp, Homo sapiens
tggcccctcccacatccccc

SEQ ID NO: 349567 - DNA, 18 bp, Homo sapiens
tggcccctccttctcccc

SEQ ID NO: 349568 - DNA, 14 bp, Homo sapiens
tggcccctctctgt

SEQ ID NO: 349569 - DNA, 22 bp, Homo sapiens
tggcccctctgctgtcctgcag

SEQ ID NO: 349570 - DNA, 17 bp, Homo sapiens
tggccccttttactttt

SEQ ID NO: 349571 - DNA, 17 bp, Homo sapiens
tggcccgacagcctggc

SEQ ID NO: 349572 - DNA, 15 bp, Homo sapiens
tggccctctgtgttg

SEQ ID NO: 349573 - DNA, 16 bp, Homo sapiens
tggccctgcaagggcg

SEQ ID NO: 349574 - DNA, 22 bp, Homo sapiens
tggccctgccctcccccacggc

SEQ ID NO: 349575 - DNA, 21 bp, Homo sapiens
tggccctggggaagaggcctt

SEQ ID NO: 349576 - DNA, 21 bp, Homo sapiens
tggccctgtgggagtccactt

SEQ ID NO: 349577 - DNA, 22 bp, Homo sapiens
tggcccttgcagttcagcacca

SEQ ID NO: 349578 - DNA, 23 bp, Homo sapiens
tggcccttgcagttcagcaccac

SEQ ID NO: 349579 - DNA, 22 bp, Homo sapiens
tggccgaaccccccactccctg

SEQ ID NO: 349580 - DNA, 18 bp, Homo sapiens
tggccgagggtcctggct

SEQ ID NO: 349581 - DNA, 15 bp, Homo sapiens
tggccgatggggccc

SEQ ID NO: 349582 - DNA, 19 bp, Homo sapiens
tggccgatggggcccacat

SEQ ID NO: 349583 - DNA, 12 bp, Homo sapiens
tggccggctggc

SEQ ID NO: 349584 - DNA, 14 bp, Homo sapiens
tggccggctggccg

SEQ ID NO: 349585 - DNA, 16 bp, Homo sapiens
tggccgggcacagctg

SEQ ID NO: 349586 - DNA, 19 bp, Homo sapiens
tggccgggctgctgctgat

SEQ ID NO: 349587 - DNA, 20 bp, Homo sapiens
tggccgggttggaggcctca

SEQ ID NO: 349588 - DNA, 21 bp, Homo sapiens
tggccgggttggaggcctcac

SEQ ID NO: 349589 - DNA, 15 bp, Homo sapiens
tggccggtccacccc

SEQ ID NO: 349590 - DNA, 19 bp, Homo sapiens
tggccggtgtggccctgca

SEQ ID NO: 349591 - DNA, 15 bp, Homo sapiens
tggccgtctcctccc

SEQ ID NO: 349592 - DNA, 17 bp, Homo sapiens
tggccgtctcctccctc

SEQ ID NO: 349593 - DNA, 17 bp, Homo sapiens
tggcctaaggctgctgt

SEQ ID NO: 349594 - DNA, 15 bp, Homo sapiens
tggcctaatttacaa

SEQ ID NO: 349595 - DNA, 16 bp, Homo sapiens
tggcctaatttacaag

SEQ ID NO: 349596 - DNA, 23 bp, Homo sapiens
tggcctagtggggaggggcctgg

SEQ ID NO: 349597 - DNA, 14 bp, Homo sapiens
tggcctatttaagc

SEQ ID NO: 349598 - DNA, 13 bp, Homo sapiens
tggcctcaaccct

SEQ ID NO: 349599 - DNA, 14 bp, Homo sapiens
tggcctcaaccctc

SEQ ID NO: 349600 - DNA, 15 bp, Homo sapiens
tggcctcaaccctcc

SEQ ID NO: 349601 - DNA, 21 bp, Homo sapiens
tggcctcaaccctccctcagc

SEQ ID NO: 349602 - DNA, 23 bp, Homo sapiens
tggcctcaaccctccctcagccc

SEQ ID NO: 349603 - DNA, 18 bp, Homo sapiens
tgagcctgccccagctgg

SEQ ID NO: 349604 - DNA, 15 bp, Homo sapiens
tgagcctgcccgctg

SEQ ID NO: 349605 - DNA, 20 bp, Homo sapiens
tgagcctgcccgctgcaatg

SEQ ID NO: 349606 - DNA, 19 bp, Homo sapiens
tgagcctgtaatcctcagc

SEQ ID NO: 349607 - DNA, 20 bp, Homo sapiens
tgagcctgtgggtccccact

SEQ ID NO: 349608 - DNA, 18 bp, Homo sapiens
tgagccttcgtgcccccc

SEQ ID NO: 349609 - DNA, 15 bp, Homo sapiens
tgagccttgagagaa

SEQ ID NO: 349610 - DNA, 20 bp, Homo sapiens
tgagcgccccgcccccaccc

SEQ ID NO: 349611 - DNA, 15 bp, Homo sapiens
tgagcgggtggggtg

SEQ ID NO: 349612 - DNA, 15 bp, Homo sapiens
tgagcgtgtccacag

SEQ ID NO: 349613 - DNA, 13 bp, Homo sapiens
tgagctccaccct

SEQ ID NO: 349614 - DNA, 15 bp, Homo sapiens
tgagctccaccctcc

SEQ ID NO: 349615 - DNA, 12 bp, Homo sapiens
tgagctccagac

SEQ ID NO: 349616 - DNA, 13 bp, Homo sapiens
tgagctccagacc

SEQ ID NO: 349617 - DNA, 16 bp, Homo sapiens
tgagctccagaccccc

SEQ ID NO: 349618 - DNA, 14 bp, Homo sapiens
gacagcggcccggc

SEQ ID NO: 349619 - DNA, 23 bp, Homo sapiens
gacagctactaacctggagacag

SEQ ID NO: 349620 - DNA, 11 bp, Homo sapiens
gacagctgcag

SEQ ID NO: 349621 - DNA, 14 bp, Homo sapiens
gacagctgcaggtg

SEQ ID NO: 349622 - DNA, 15 bp, Homo sapiens
gacagctgtgctgta

SEQ ID NO: 349623 - DNA, 14 bp, Homo sapiens
gacagctgttccac

SEQ ID NO: 349624 - DNA, 15 bp, Homo sapiens
tggcctcactggctg

SEQ ID NO: 349625 - DNA, 20 bp, Homo sapiens
tggcctcactggctggggca

SEQ ID NO: 349626 - DNA, 18 bp, Homo sapiens
tggcctcagctgcctcac

SEQ ID NO: 349627 - DNA, 14 bp, Homo sapiens
tggcctcaggaggc

SEQ ID NO: 349628 - DNA, 15 bp, Homo sapiens
tggcctcccagccac

SEQ ID NO: 349629 - DNA, 16 bp, Homo sapiens
tggcctcccctgcgga

SEQ ID NO: 349630 - DNA, 12 bp, Homo sapiens
tggcctccggcc

SEQ ID NO: 349631 - DNA, 14 bp, Homo sapiens
tggcctctcagtca

SEQ ID NO: 349632 - DNA, 21 bp, Homo sapiens
tggcctcttcctccctccctg

SEQ ID NO: 349633 - DNA, 12 bp, Homo sapiens
tggcctgagctg

SEQ ID NO: 349634 - DNA, 16 bp, Homo sapiens
tggcctgagctggggc

SEQ ID NO: 349635 - DNA, 17 bp, Homo sapiens
tggcctgccaggctcct

SEQ ID NO: 349636 - DNA, 17 bp, Homo sapiens
tggcctgcgcctgcacc

SEQ ID NO: 349637 - DNA, 13 bp, Homo sapiens
tggcctgctggga

SEQ ID NO: 349638 - DNA, 18 bp, Homo sapiens
tggcctggaggtggggtt

SEQ ID NO: 349639 - DNA, 14 bp, Homo sapiens
tggcctggatctcc

SEQ ID NO: 349640 - DNA, 15 bp, Homo sapiens
tggcctggccaggag

SEQ ID NO: 349641 - DNA, 14 bp, Homo sapiens
tggcctggcctggc

SEQ ID NO: 349642 - DNA, 16 bp, Homo sapiens
tggcctggcctggccc

SEQ ID NO: 349643 - DNA, 18 bp, Homo sapiens
tggcctgggtggggcagg

SEQ ID NO: 349644 - DNA, 18 bp, Homo sapiens
tggcctgtcagagcttga

SEQ ID NO: 349645 - DNA, 12 bp, Homo sapiens
tggcctgtctca

SEQ ID NO: 349646 - DNA, 13 bp, Homo sapiens
tggcctgtgtcca

SEQ ID NO: 349647 - DNA, 16 bp, Homo sapiens
tggcctgtgtccagca

SEQ ID NO: 349648 - DNA, 19 bp, Homo sapiens
tggcctgtgtccagcagct

SEQ ID NO: 349649 - DNA, 13 bp, Homo sapiens
tggcctgttctgt

SEQ ID NO: 349650 - DNA, 18 bp, Homo sapiens
tggcctgtttcaacacag

SEQ ID NO: 349651 - DNA, 22 bp, Homo sapiens
tggcctgtttctgcagcccttg

SEQ ID NO: 349652 - DNA, 18 bp, Homo sapiens
tggccttacaataccgta

SEQ ID NO: 349653 - DNA, 14 bp, Homo sapiens
tggccttcctgccc

SEQ ID NO: 349654 - DNA, 19 bp, Homo sapiens
tggccttgagcaagtccca

SEQ ID NO: 349655 - DNA, 20 bp, Homo sapiens
tggccttggggccagactgg

SEQ ID NO: 349656 - DNA, 18 bp, Homo sapiens
tggccttggttcctccag

SEQ ID NO: 349657 - DNA, 18 bp, Homo sapiens
tggccttgtgtcagagct

SEQ ID NO: 349658 - DNA, 14 bp, Homo sapiens
tggcctttcctctc

SEQ ID NO: 349659 - DNA, 23 bp, Homo sapiens
tggcctttgtaagacacacagcc

SEQ ID NO: 349660 - DNA, 18 bp, Homo sapiens
tggcgcagtgcctctggt

SEQ ID NO: 349661 - DNA, 22 bp, Homo sapiens
tggcgcatagtgtgctcggaca

SEQ ID NO: 349662 - DNA, 17 bp, Homo sapiens
tggcgcctccgagggac

SEQ ID NO: 349663 - DNA, 17 bp, Homo sapiens
tggcgctattacaaata

SEQ ID NO: 349664 - DNA, 12 bp, Homo sapiens
tggcgggcagcc

SEQ ID NO: 349665 - DNA, 14 bp, Homo sapiens
tggcgggcagcccc

SEQ ID NO: 349666 - DNA, 17 bp, Homo sapiens
tggcgggcagcccctgc

SEQ ID NO: 349667 - DNA, 18 bp, Homo sapiens
tggcgggcagcccctgct

SEQ ID NO: 349668 - DNA, 13 bp, Homo sapiens
tggcgggccaagg

SEQ ID NO: 349669 - DNA, 15 bp, Homo sapiens
tggcggggcagcagg

SEQ ID NO: 349670 - DNA, 16 bp, Homo sapiens
tggcgtaatgggcctg

SEQ ID NO: 349671 - DNA, 19 bp, Homo sapiens
tggcgtctgcctaggagct

SEQ ID NO: 349672 - DNA, 13 bp, Homo sapiens
tggcgtctgtctt

SEQ ID NO: 349673 - DNA, 15 bp, Homo sapiens
tggcgtctgtcttca

SEQ ID NO: 349674 - DNA, 22 bp, Homo sapiens
tggcgtctgtcttcaagggctt

SEQ ID NO: 349675 - DNA, 14 bp, Homo sapiens
tggcgtggagcagg

SEQ ID NO: 349676 - DNA, 17 bp, Homo sapiens
tggctaaggcaccagcc

SEQ ID NO: 349677 - DNA, 14 bp, Homo sapiens
tggctaaggcatca

SEQ ID NO: 349678 - DNA, 15 bp, Homo sapiens
tggctacatcccagc

SEQ ID NO: 349679 - DNA, 18 bp, Homo sapiens
tggctacatcccagcctg

SEQ ID NO: 349680 - DNA, 16 bp, Homo sapiens
tggctaccgatttcag

SEQ ID NO: 349681 - DNA, 15 bp, Homo sapiens
tggctagaagaaagt

SEQ ID NO: 349682 - DNA, 19 bp, Homo sapiens
tggctagaggccagcccca

SEQ ID NO: 349683 - DNA, 22 bp, Homo sapiens
tggctagaggccagccccaccc

SEQ ID NO: 349684 - DNA, 17 bp, Homo sapiens
tggctaggggccgagtc

SEQ ID NO: 349685 - DNA, 14 bp, Homo sapiens
tggctagtactgta

SEQ ID NO: 349686 - DNA, 19 bp, Homo sapiens
tggctagtactgtattggc

SEQ ID NO: 349687 - DNA, 14 bp, Homo sapiens
tggctatggccacc

SEQ ID NO: 349688 - DNA, 13 bp, Homo sapiens
tggctattaaaaa

SEQ ID NO: 349689 - DNA, 12 bp, Homo sapiens
tggctcacagcc

SEQ ID NO: 349690 - DNA, 13 bp, Homo sapiens
tggctcacagcca

SEQ ID NO: 349691 - DNA, 15 bp, Homo sapiens
tggctcacagccacc

SEQ ID NO: 349692 - DNA, 13 bp, Homo sapiens
tggctcacgcctg

SEQ ID NO: 349693 - DNA, 13 bp, Homo sapiens
tggctcactgcag

SEQ ID NO: 349694 - DNA, 13 bp, Homo sapiens
tggctcaggcaag

SEQ ID NO: 349695 - DNA, 19 bp, Homo sapiens
tggctcagggcccacctcc

SEQ ID NO: 349696 - DNA, 23 bp, Homo sapiens
tggctcagtgccacctatgcctg

SEQ ID NO: 349697 - DNA, 19 bp, Homo sapiens
tggctcatattcctgcagc

SEQ ID NO: 349698 - DNA, 19 bp, Homo sapiens
tggctccacgccctgggga

SEQ ID NO: 349699 - DNA, 18 bp, Homo sapiens
tggctccaggctccaggc

SEQ ID NO: 349700 - DNA, 20 bp, Homo sapiens
tggctccagtctgctgccct

SEQ ID NO: 349701 - DNA, 14 bp, Homo sapiens
tggctcccaaggga

SEQ ID NO: 349702 - DNA, 15 bp, Homo sapiens
tggctcccaggacac

SEQ ID NO: 349703 - DNA, 17 bp, Homo sapiens
tggctcccagggccatg

SEQ ID NO: 349704 - DNA, 23 bp, Homo sapiens
tggctcccatgaccatactgagg

SEQ ID NO: 349705 - DNA, 14 bp, Homo sapiens
tggctccccaaagg

SEQ ID NO: 349706 - DNA, 15 bp, Homo sapiens
tggctccccaaaggg

SEQ ID NO: 349707 - DNA, 23 bp, Homo sapiens
tggctccccacgagtcacctgca

SEQ ID NO: 349708 - DNA, 14 bp, Homo sapiens
tggctcccctctat

SEQ ID NO: 349709 - DNA, 16 bp, Homo sapiens
tggctccgctgtgtgg

SEQ ID NO: 349710 - DNA, 14 bp, Homo sapiens
tggctcctcccggt

SEQ ID NO: 349711 - DNA, 19 bp, Homo sapiens
tggctcctcccggtgccca

SEQ ID NO: 349712 - DNA, 21 bp, Homo sapiens
tggctcctgaggggcatctgc

SEQ ID NO: 349713 - DNA, 19 bp, Homo sapiens
tggctcctttcccacagtc

SEQ ID NO: 349714 - DNA, 21 bp, Homo sapiens
tggctcggacccaccccaact

SEQ ID NO: 349715 - DNA, 15 bp, Homo sapiens
tggctcgggacttca

SEQ ID NO: 349716 - DNA, 12 bp, Homo sapiens
tggctcgtgggc

SEQ ID NO: 349717 - DNA, 19 bp, Homo sapiens
tggctcgtgggctctggct

SEQ ID NO: 349718 - DNA, 22 bp, Homo sapiens
tggctctaacattactgccttc

SEQ ID NO: 349719 - DNA, 17 bp, Homo sapiens
tggctctaactccttga

SEQ ID NO: 349720 - DNA, 13 bp, Homo sapiens
tggctctctccag

SEQ ID NO: 349721 - DNA, 13 bp, Homo sapiens
tggctctgagaag

SEQ ID NO: 349722 - DNA, 15 bp, Homo sapiens
tggctctgagaaggg

SEQ ID NO: 349723 - DNA, 19 bp, Homo sapiens
tggctgaaattatgtcaaa

SEQ ID NO: 349724 - DNA, 14 bp, Homo sapiens
tggctgactgggaa

SEQ ID NO: 349725 - DNA, 18 bp, Homo sapiens
tggctgagccccctctcc

SEQ ID NO: 349726 - DNA, 21 bp, Homo sapiens
tggctgaggcttgggcccagt

SEQ ID NO: 349727 - DNA, 14 bp, Homo sapiens
tggctgcacagccc

SEQ ID NO: 349728 - DNA, 13 bp, Homo sapiens
tggctgccaggcg

SEQ ID NO: 349729 - DNA, 22 bp, Homo sapiens
tggctgccaggcgttggtgcca

SEQ ID NO: 349730 - DNA, 13 bp, Homo sapiens
tggctgcccacac

SEQ ID NO: 349731 - DNA, 20 bp, Homo sapiens
tggctgcccagacccctctg

SEQ ID NO: 349732 - DNA, 20 bp, Homo sapiens
tggctgccccaacctgctga

SEQ ID NO: 349733 - DNA, 19 bp, Homo sapiens
tggctgccccacaggccac

SEQ ID NO: 349734 - DNA, 20 bp, Homo sapiens
tggctgccccacaggccaca

SEQ ID NO: 349735 - DNA, 16 bp, Homo sapiens
tggctgcggcaccctt

SEQ ID NO: 349736 - DNA, 12 bp, Homo sapiens
tggctgggccca

SEQ ID NO: 349737 - DNA, 21 bp, Homo sapiens
tggctggggacttggccgctt

SEQ ID NO: 349738 - DNA, 19 bp, Homo sapiens
tgggagggggcgttggatt

SEQ ID NO: 349739 - DNA, 22 bp, Homo sapiens
tgggagggtggttcctgttctc

SEQ ID NO: 349740 - DNA, 19 bp, Homo sapiens
tgggaggtgagaccacctc

SEQ ID NO: 349741 - DNA, 21 bp, Homo sapiens
tgggaggtggccaggcctgcc

SEQ ID NO: 349742 - DNA, 20 bp, Homo sapiens
tgggagtaggagttgctcct

SEQ ID NO: 349743 - DNA, 17 bp, Homo sapiens
tgggagtcagagccctg

SEQ ID NO: 349744 - DNA, 18 bp, Homo sapiens
tgggagtcagagccctgg

SEQ ID NO: 349745 - DNA, 14 bp, Homo sapiens
tgggagtcagggag

SEQ ID NO: 349746 - DNA, 15 bp, Homo sapiens
tgggagtcagggagc

SEQ ID NO: 349747 - DNA, 23 bp, Homo sapiens
tgggagtccactttcctctctct

SEQ ID NO: 349748 - DNA, 17 bp, Homo sapiens
tgggagtgaacatttct

SEQ ID NO: 349749 - DNA, 12 bp, Homo sapiens
tgggagtgggag

SEQ ID NO: 349750 - DNA, 16 bp, Homo sapiens
tgggagtgggagagga

SEQ ID NO: 349751 - DNA, 21 bp, Homo sapiens
tgggagtgttctgtgggcttg

SEQ ID NO: 349752 - DNA, 23 bp, Homo sapiens
tgggataaagatgcaaggaccag

SEQ ID NO: 349753 - DNA, 16 bp, Homo sapiens
tgggataacagaggca

SEQ ID NO: 349754 - DNA, 14 bp, Homo sapiens
tgggatatttaact

SEQ ID NO: 349755 - DNA, 19 bp, Homo sapiens
tgggatcagtggggcccca

SEQ ID NO: 349756 - DNA, 22 bp, Homo sapiens
tgggatcagtggggccccaaag

SEQ ID NO: 349757 - DNA, 14 bp, Homo sapiens
tgggatccagagag

SEQ ID NO: 349758 - DNA, 17 bp, Homo sapiens
tgggatccagagagaag

SEQ ID NO: 349759 - DNA, 19 bp, Homo sapiens
tgggatccagagagaagca

SEQ ID NO: 349760 - DNA, 14 bp, Homo sapiens
tgggatgagcctct

SEQ ID NO: 349761 - DNA, 15 bp, Homo sapiens
tgggatgagcctctc

SEQ ID NO: 349762 - DNA, 19 bp, Homo sapiens
tgggatgcttgcctagggc

SEQ ID NO: 349763 - DNA, 14 bp, Homo sapiens
tgggatgggcacag

SEQ ID NO: 349764 - DNA, 16 bp, Homo sapiens
tgggatgggcacaggc

SEQ ID NO: 349765 - DNA, 18 bp, Homo sapiens
tgggatgggcacaggctg

SEQ ID NO: 349766 - DNA, 19 bp, Homo sapiens
tgggatgggcacaggctgc

SEQ ID NO: 349767 - DNA, 22 bp, Homo sapiens
tgggatgtcctctttactccct

SEQ ID NO: 349768 - DNA, 19 bp, Homo sapiens
tgggattacaggtgtgtgc

SEQ ID NO: 349769 - DNA, 15 bp, Homo sapiens
tgggattatgggtca

SEQ ID NO: 349770 - DNA, 18 bp, Homo sapiens
tgggattatgggtcacag

SEQ ID NO: 349771 - DNA, 21 bp, Homo sapiens
tgggattatgggtcacaggaa

SEQ ID NO: 349772 - DNA, 22 bp, Homo sapiens
tgggattctactttaagcacta

SEQ ID NO: 349773 - DNA, 14 bp, Homo sapiens
tgggattgggggct

SEQ ID NO: 349774 - DNA, 18 bp, Homo sapiens
tgggattgggggctggtg

SEQ ID NO: 349775 - DNA, 15 bp, Homo sapiens
tgggatttcttcgct

SEQ ID NO: 349776 - DNA, 17 bp, Homo sapiens
tgggcaagtgaggcaag

SEQ ID NO: 349777 - DNA, 21 bp, Homo sapiens
tgggcacaggctgccccaccc

SEQ ID NO: 349778 - DNA, 19 bp, Homo sapiens
tgggcacccacctccaccc

SEQ ID NO: 349779 - DNA, 15 bp, Homo sapiens
tgggcacctcagaaa

SEQ ID NO: 349780 - DNA, 15 bp, Homo sapiens
tgggcacgggagagc

SEQ ID NO: 349781 - DNA, 14 bp, Homo sapiens
tgggcactgggccg

SEQ ID NO: 349782 - DNA, 23 bp, Homo sapiens
tgggcactgggccggcagcctgg

SEQ ID NO: 349783 - DNA, 13 bp, Homo sapiens
tgggcacttgaga

SEQ ID NO: 349784 - DNA, 15 bp, Homo sapiens
tgggcagagcctgtc

SEQ ID NO: 349785 - DNA, 16 bp, Homo sapiens
tgggcagagcctgtcc

SEQ ID NO: 349786 - DNA, 14 bp, Homo sapiens
tgggcagaggggag

SEQ ID NO: 349787 - DNA, 17 bp, Homo sapiens
tgggcagaggggagagg

SEQ ID NO: 349788 - DNA, 22 bp, Homo sapiens
tgggcagaggggagaggaagca

SEQ ID NO: 349789 - DNA, 15 bp, Homo sapiens
tgggcagccaggctg

SEQ ID NO: 349790 - DNA, 12 bp, Homo sapiens
tgggcagcccag

SEQ ID NO: 349791 - DNA, 14 bp, Homo sapiens
tgggcagctgggcc

SEQ ID NO: 349792 - DNA, 21 bp, Homo sapiens
tgggcagctggggggctgtcc

SEQ ID NO: 349793 - DNA, 22 bp, Homo sapiens
tgggcaggcggtccccatcccc

SEQ ID NO: 349794 - DNA, 23 bp, Homo sapiens
tgggcaggcggtccccatcccca

SEQ ID NO: 349795 - DNA, 17 bp, Homo sapiens
tgggcagggaggcacca

SEQ ID NO: 349796 - DNA, 16 bp, Homo sapiens
tgggcaggtcctgggg

SEQ ID NO: 349797 - DNA, 18 bp, Homo sapiens
tgggcaggtcctggggag

SEQ ID NO: 349798 - DNA, 19 bp, Homo sapiens
tgggcaggtcctggggagg

SEQ ID NO: 349799 - DNA, 12 bp, Homo sapiens
tgggcagtgccc

SEQ ID NO: 349800 - DNA, 13 bp, Homo sapiens
tgggcagtggaga

SEQ ID NO: 349801 - DNA, 14 bp, Homo sapiens
tgggcagtggagag

SEQ ID NO: 349802 - DNA, 18 bp, Homo sapiens
tgggcagtggagagggga

SEQ ID NO: 349803 - DNA, 19 bp, Homo sapiens
tgggcatactttctctcta

SEQ ID NO: 349804 - DNA, 19 bp, Homo sapiens
tgggcatccacccagtgct

SEQ ID NO: 349805 - DNA, 20 bp, Homo sapiens
tgggcatccccagccccctg

SEQ ID NO: 349806 - DNA, 15 bp, Homo sapiens
tgggcatgccaccct

SEQ ID NO: 349807 - DNA, 14 bp, Homo sapiens
tgggcattgggctg

SEQ ID NO: 349808 - DNA, 19 bp, Homo sapiens
tgggcattgggctgacacc

SEQ ID NO: 349809 - DNA, 15 bp, Homo sapiens
tgggcatttgtgagg

SEQ ID NO: 349810 - DNA, 13 bp, Homo sapiens
tgggccaagccag

SEQ ID NO: 349811 - DNA, 20 bp, Homo sapiens
tgggccacacccaggaaggg

SEQ ID NO: 349812 - DNA, 21 bp, Homo sapiens
tgggccacacccaggaaggga

SEQ ID NO: 349813 - DNA, 23 bp, Homo sapiens
tgggccaccatgcactcaataaa

SEQ ID NO: 349814 - DNA, 12 bp, Homo sapiens
tgggccacccac

SEQ ID NO: 349815 - DNA, 18 bp, Homo sapiens
tgggccacccaccagggc

SEQ ID NO: 349816 - DNA, 19 bp, Homo sapiens
tgggccacccaccagggct

SEQ ID NO: 349817 - DNA, 17 bp, Homo sapiens
tgggccaccggggcaag

SEQ ID NO: 349818 - DNA, 19 bp, Homo sapiens
tgggccactggcatctctg

SEQ ID NO: 349819 - DNA, 18 bp, Homo sapiens
tgggccagcccctcccac

SEQ ID NO: 349820 - DNA, 14 bp, Homo sapiens
tgggccagggtctc

SEQ ID NO: 349821 - DNA, 21 bp, Homo sapiens
tgggcccagaactgcccccac

SEQ ID NO: 349822 - DNA, 19 bp, Homo sapiens
tgggcccagaggcacagcc

SEQ ID NO: 349823 - DNA, 16 bp, Homo sapiens
tgggcccagccggggt

SEQ ID NO: 349824 - DNA, 20 bp, Homo sapiens
tgggcccagccggggtgggg

SEQ ID NO: 349825 - DNA, 14 bp, Homo sapiens
tgggcccagctggg

SEQ ID NO: 349826 - DNA, 16 bp, Homo sapiens
tgggcccagctgggct

SEQ ID NO: 349827 - DNA, 22 bp, Homo sapiens
tgggcccagctgggctctgcca

SEQ ID NO: 349828 - DNA, 11 bp, Homo sapiens
tgggcccaggc

SEQ ID NO: 349829 - DNA, 13 bp, Homo sapiens
tgggcccaggcag

SEQ ID NO: 349830 - DNA, 22 bp, Homo sapiens
tgggcccataatagttagccct

SEQ ID NO: 349831 - DNA, 17 bp, Homo sapiens
tgggccccagggaacta

SEQ ID NO: 349832 - DNA, 13 bp, Homo sapiens
tgggccccatgct

SEQ ID NO: 349833 - DNA, 14 bp, Homo sapiens
tgggccccatgctc

SEQ ID NO: 349834 - DNA, 19 bp, Homo sapiens
tgggccccatgctctgccc

SEQ ID NO: 349835 - DNA, 15 bp, Homo sapiens
tgggcccctcagagc

SEQ ID NO: 349836 - DNA, 18 bp, Homo sapiens
tgggcccctccctacctc

SEQ ID NO: 349837 - DNA, 19 bp, Homo sapiens
tgggcccctccctacctca

SEQ ID NO: 349838 - DNA, 14 bp, Homo sapiens
tgggccctaggcat

SEQ ID NO: 349839 - DNA, 16 bp, Homo sapiens
tgggccctctctctgg

SEQ ID NO: 349840 - DNA, 18 bp, Homo sapiens
tgggccctctctctgggc

SEQ ID NO: 349841 - DNA, 13 bp, Homo sapiens
tgggccctgcagg

SEQ ID NO: 349842 - DNA, 21 bp, Homo sapiens
tgggccctgcaggaggcctgg

SEQ ID NO: 349843 - DNA, 20 bp, Homo sapiens
tgggccctggttcccccagg

SEQ ID NO: 349844 - DNA, 23 bp, Homo sapiens
tgggccctggttcccccaggacc

SEQ ID NO: 349845 - DNA, 15 bp, Homo sapiens
tgggccgaggccgct

SEQ ID NO: 349846 - DNA, 14 bp, Homo sapiens
tgggccggcagcct

SEQ ID NO: 349847 - DNA, 15 bp, Homo sapiens
tgggccggcagcctg

SEQ ID NO: 349848 - DNA, 16 bp, Homo sapiens
tgggccggcagcctgg

SEQ ID NO: 349849 - DNA, 15 bp, Homo sapiens
tgggccggccccagg

SEQ ID NO: 349850 - DNA, 21 bp, Homo sapiens
tgggccggtcggggaggggga

SEQ ID NO: 349851 - DNA, 23 bp, Homo sapiens
tgggcctcaaggacttgaaagca

SEQ ID NO: 349852 - DNA, 21 bp, Homo sapiens
tgggcctctggtttggggcga

SEQ ID NO: 349853 - DNA, 14 bp, Homo sapiens
tgggcctgatggag

SEQ ID NO: 349854 - DNA, 20 bp, Homo sapiens
tgggcctgcccaatgctttg

SEQ ID NO: 349855 - DNA, 18 bp, Homo sapiens
tgggcctggcctgagctg

SEQ ID NO: 349856 - DNA, 14 bp, Homo sapiens
tgggcctggctccc

SEQ ID NO: 349857 - DNA, 13 bp, Homo sapiens
tgggcctgggcct

SEQ ID NO: 349858 - DNA, 13 bp, Homo sapiens
tgggcctgtcccc

SEQ ID NO: 349859 - DNA, 14 bp, Homo sapiens
tgggcctgtccccc

SEQ ID NO: 349860 - DNA, 15 bp, Homo sapiens
tgggcctgtctcaga

SEQ ID NO: 349861 - DNA, 13 bp, Homo sapiens
tgggcctgtgcag

SEQ ID NO: 349862 - DNA, 15 bp, Homo sapiens
tgggcctgtgcagca

SEQ ID NO: 349863 - DNA, 17 bp, Homo sapiens
tgggcctgtgcagcagc

SEQ ID NO: 349864 - DNA, 21 bp, Homo sapiens
tgggcctgtgcagcagcccag

SEQ ID NO: 349865 - DNA, 23 bp, Homo sapiens
tgggcctgtgcagcagcccagct

SEQ ID NO: 349866 - DNA, 16 bp, Homo sapiens
tgggccttctcagctc

SEQ ID NO: 349867 - DNA, 17 bp, Homo sapiens
tgggccttgctttgggc

SEQ ID NO: 349868 - DNA, 14 bp, Homo sapiens
tgggcctttcagtc

SEQ ID NO: 349869 - DNA, 20 bp, Homo sapiens
tgggcgagtcccggagcccc

SEQ ID NO: 349870 - DNA, 17 bp, Homo sapiens
tgggcgccctggaagcc

SEQ ID NO: 349871 - DNA, 17 bp, Homo sapiens
tgggcgctgcttccagg

SEQ ID NO: 349872 - DNA, 18 bp, Homo sapiens
tgggctggtattctctct

SEQ ID NO: 349873 - DNA, 14 bp, Homo sapiens
tgggctggtgcccc

SEQ ID NO: 349874 - DNA, 22 bp, Homo sapiens
tgggcttacaggcatgagccac

SEQ ID NO: 349875 - DNA, 19 bp, Homo sapiens
tgggcttccatttgtgtgt

SEQ ID NO: 349876 - DNA, 15 bp, Homo sapiens
tgggctttgcaggct

SEQ ID NO: 349877 - DNA, 18 bp, Homo sapiens
tgggctttgcaggctctg

SEQ ID NO: 349878 - DNA, 22 bp, Homo sapiens
tgggctttttttttctctttct

SEQ ID NO: 349879 - DNA, 15 bp, Homo sapiens
tggggaaggaccaac

SEQ ID NO: 349880 - DNA, 14 bp, Homo sapiens
tggggaatttcctc

SEQ ID NO: 349881 - DNA, 19 bp, Homo sapiens
tggggacagctttcctggg

SEQ ID NO: 349882 - DNA, 21 bp, Homo sapiens
tggggacagctttcctgggtg

SEQ ID NO: 349883 - DNA, 19 bp, Homo sapiens
tggggacagttggcagaga

SEQ ID NO: 349884 - DNA, 22 bp, Homo sapiens
tggggacctggggtggggaggc

SEQ ID NO: 349885 - DNA, 20 bp, Homo sapiens
tggggacgccaaggaggtgg

SEQ ID NO: 349886 - DNA, 20 bp, Homo sapiens
tggggacgggggctgcttct

SEQ ID NO: 349887 - DNA, 21 bp, Homo sapiens
tggggacgggggctgcttctc

SEQ ID NO: 349888 - DNA, 19 bp, Homo sapiens
tggggacgtgaacgtttta

SEQ ID NO: 349889 - DNA, 14 bp, Homo sapiens
tggggactctgctt

SEQ ID NO: 349890 - DNA, 17 bp, Homo sapiens
tggggagacacctcaga

SEQ ID NO: 349891 - DNA, 22 bp, Homo sapiens
tggggagaggaactccttggcc

SEQ ID NO: 349892 - DNA, 20 bp, Homo sapiens
tggggagcacttgcgtcctg

SEQ ID NO: 349893 - DNA, 15 bp, Homo sapiens
tggggagcagagaca

SEQ ID NO: 349894 - DNA, 17 bp, Homo sapiens
tggggagcagagacact

SEQ ID NO: 349895 - DNA, 17 bp, Homo sapiens
tggggagcccaggcctg

SEQ ID NO: 349896 - DNA, 19 bp, Homo sapiens
tggggaggagactcaggcc

SEQ ID NO: 349897 - DNA, 21 bp, Homo sapiens
tggggaggagactcaggccca

SEQ ID NO: 349898 - DNA, 17 bp, Homo sapiens
tggggaggctgagactg

SEQ ID NO: 349899 - DNA, 17 bp, Homo sapiens
tggggaggggcctggcc

SEQ ID NO: 349900 - DNA, 20 bp, Homo sapiens
tggggaggggtcagctctgg

SEQ ID NO: 349901 - DNA, 19 bp, Homo sapiens
tggggagtaggacatacca

SEQ ID NO: 349902 - DNA, 13 bp, Homo sapiens
tggggagtgggac

SEQ ID NO: 349903 - DNA, 16 bp, Homo sapiens
tggggagtgggacaga

SEQ ID NO: 349904 - DNA, 18 bp, Homo sapiens
tggggatggagaatgcca

SEQ ID NO: 349905 - DNA, 23 bp, Homo sapiens
tggggatggagaatgccagccca

SEQ ID NO: 349906 - DNA, 20 bp, Homo sapiens
tggggatggggttgggctct

SEQ ID NO: 349907 - DNA, 14 bp, Homo sapiens
tggggcagaggggc

SEQ ID NO: 349908 - DNA, 16 bp, Homo sapiens
tggggcagaggggcag

SEQ ID NO: 349909 - DNA, 13 bp, Homo sapiens
tggggcagcacag

SEQ ID NO: 349910 - DNA, 14 bp, Homo sapiens
tggggcagcacaga

SEQ ID NO: 349911 - DNA, 18 bp, Homo sapiens
tggggcagcacagagagg

SEQ ID NO: 349912 - DNA, 17 bp, Homo sapiens
tggggcagggcctggcc

SEQ ID NO: 349913 - DNA, 22 bp, Homo sapiens
tggggcagtcacctgcccagat

SEQ ID NO: 349914 - DNA, 23 bp, Homo sapiens
tggggcatggttccttccctggg

SEQ ID NO: 349915 - DNA, 12 bp, Homo sapiens
tggggccacagc

SEQ ID NO: 349916 - DNA, 16 bp, Homo sapiens
tggggccacagccaga

SEQ ID NO: 349917 - DNA, 20 bp, Homo sapiens
tggggccagactggctgcac

SEQ ID NO: 349918 - DNA, 15 bp, Homo sapiens
tggggcccaggggct

SEQ ID NO: 349919 - DNA, 15 bp, Homo sapiens
tggggcccatggccc

SEQ ID NO: 349920 - DNA, 18 bp, Homo sapiens
tggggcccatggccccag

SEQ ID NO: 349921 - DNA, 19 bp, Homo sapiens
tggggcccatggccccagc

SEQ ID NO: 349922 - DNA, 23 bp, Homo sapiens
tggggcccatggccccagctggc

SEQ ID NO: 349923 - DNA, 16 bp, Homo sapiens
tggggccccgctggga

SEQ ID NO: 349924 - DNA, 15 bp, Homo sapiens
tggggccggagcctt

SEQ ID NO: 349925 - DNA, 15 bp, Homo sapiens
tggggcctcacccag

SEQ ID NO: 349926 - DNA, 17 bp, Homo sapiens
tggggcctcacccagaa

SEQ ID NO: 349927 - DNA, 11 bp, Homo sapiens
tggggcctctg

SEQ ID NO: 349928 - DNA, 17 bp, Homo sapiens
tggggcctggacctgcc

SEQ ID NO: 349929 - DNA, 11 bp, Homo sapiens
tggggcctggc

SEQ ID NO: 349930 - DNA, 23 bp, Homo sapiens
tggggcctggcccacgccctccc

SEQ ID NO: 349931 - DNA, 22 bp, Homo sapiens
tggggcctggcctatttaagcc

SEQ ID NO: 349932 - DNA, 14 bp, Homo sapiens
tggggcctggcgtg

SEQ ID NO: 349933 - DNA, 12 bp, Homo sapiens
tggggcctggct

SEQ ID NO: 349934 - DNA, 11 bp, Homo sapiens
tggggctcctt

SEQ ID NO: 349935 - DNA, 21 bp, Homo sapiens
tggggctcctttctccagcca

SEQ ID NO: 349936 - DNA, 23 bp, Homo sapiens
tggggctcctttctccagccagc

SEQ ID NO: 349937 - DNA, 15 bp, Homo sapiens
tggggctcgtggcct

SEQ ID NO: 349938 - DNA, 23 bp, Homo sapiens
tggggctctagggttgctggagc

SEQ ID NO: 349939 - DNA, 19 bp, Homo sapiens
tggggctgagcctgaggcc

SEQ ID NO: 349940 - DNA, 13 bp, Homo sapiens
tggggctgggccc

SEQ ID NO: 349941 - DNA, 20 bp, Homo sapiens
tggggcttagaatggggctt

SEQ ID NO: 349942 - DNA, 21 bp, Homo sapiens
tggggcttagaatggggcttc

SEQ ID NO: 349943 - DNA, 20 bp, Homo sapiens
tggggcttcaccagtctgtc

SEQ ID NO: 349944 - DNA, 22 bp, Homo sapiens
tggggcttcaccagtctgtcta

SEQ ID NO: 349945 - DNA, 16 bp, Homo sapiens
tggggcttctcctgac

SEQ ID NO: 349946 - DNA, 12 bp, Homo sapiens
tggggcttggcg

SEQ ID NO: 349947 - DNA, 16 bp, Homo sapiens
tggggcttggcgtgga

SEQ ID NO: 349948 - DNA, 15 bp, Homo sapiens
tgggggactgggagt

SEQ ID NO: 349949 - DNA, 21 bp, Homo sapiens
tgggggactgggagtcagagc

SEQ ID NO: 349950 - DNA, 13 bp, Homo sapiens
tgggggaggctct

SEQ ID NO: 349951 - DNA, 18 bp, Homo sapiens
tgggggattcaaatgcat

SEQ ID NO: 349952 - DNA, 14 bp, Homo sapiens
tgggggcccctcgg

SEQ ID NO: 349953 - DNA, 17 bp, Homo sapiens
tgggggcctctgcctcc

SEQ ID NO: 349954 - DNA, 18 bp, Homo sapiens
tgggggcctgctgtgggt

SEQ ID NO: 349955 - DNA, 18 bp, Homo sapiens
tgggggcggctggaaaga

SEQ ID NO: 349956 - DNA, 20 bp, Homo sapiens
tgggggcggctggaaagagg

SEQ ID NO: 349957 - DNA, 16 bp, Homo sapiens
tgggggctggtgccag

SEQ ID NO: 349958 - DNA, 16 bp, Homo sapiens
tggggggcacagccag

SEQ ID NO: 349959 - DNA, 15 bp, Homo sapiens
tggggggccaacacc

SEQ ID NO: 349960 - DNA, 14 bp, Homo sapiens
tggggggctgtcct

SEQ ID NO: 349961 - DNA, 18 bp, Homo sapiens
tgggggtagagctgatcc

SEQ ID NO: 349962 - DNA, 12 bp, Homo sapiens
tgggggtctgct

SEQ ID NO: 349963 - DNA, 19 bp, Homo sapiens
tgggggtctgggaggcagg

SEQ ID NO: 349964 - DNA, 20 bp, Homo sapiens
tgggggttctttcttcctct

SEQ ID NO: 349965 - DNA, 14 bp, Homo sapiens
tggggtaaggagga

SEQ ID NO: 349966 - DNA, 13 bp, Homo sapiens
tggggtaccacat

SEQ ID NO: 349967 - DNA, 15 bp, Homo sapiens
tggggtactactctc

SEQ ID NO: 349968 - DNA, 17 bp, Homo sapiens
tggggtactcttgatgt

SEQ ID NO: 349969 - DNA, 19 bp, Homo sapiens
tggggtactcttgatgtga

SEQ ID NO: 349970 - DNA, 21 bp, Homo sapiens
tggggtaggaaaccaccctga

SEQ ID NO: 349971 - DNA, 16 bp, Homo sapiens
tggggtagggctgact

SEQ ID NO: 349972 - DNA, 15 bp, Homo sapiens
tggggtccccactcc

SEQ ID NO: 349973 - DNA, 16 bp, Homo sapiens
tggggtccccactccc

SEQ ID NO: 349974 - DNA, 13 bp, Homo sapiens
tggggtgaagctg

SEQ ID NO: 349975 - DNA, 14 bp, Homo sapiens
tggggtgaggacca

SEQ ID NO: 349976 - DNA, 19 bp, Homo sapiens
tggggtgccctccactgcc

SEQ ID NO: 349977 - DNA, 15 bp, Homo sapiens
tggggtgcctgagcc

SEQ ID NO: 349978 - DNA, 14 bp, Homo sapiens
tggggtgcttgctg

SEQ ID NO: 349979 - DNA, 15 bp, Homo sapiens
tggggtgtgcatgcc

SEQ ID NO: 349980 - DNA, 21 bp, Homo sapiens
tggggtgtgttccaactgccc

SEQ ID NO: 349981 - DNA, 15 bp, Homo sapiens
tggggtgttgaagac

SEQ ID NO: 349982 - DNA, 18 bp, Homo sapiens
tggggtttccacacaggc

SEQ ID NO: 349983 - DNA, 21 bp, Homo sapiens
tggggtttccacacaggccca

SEQ ID NO: 349984 - DNA, 23 bp, Homo sapiens
tggggtttgggcccctcagagcc

SEQ ID NO: 349985 - DNA, 12 bp, Homo sapiens
tgggtaaatata

SEQ ID NO: 349986 - DNA, 14 bp, Homo sapiens
tgggtaacactgat

SEQ ID NO: 349987 - DNA, 15 bp, Homo sapiens
tgggtaactgtcaag

SEQ ID NO: 349988 - DNA, 15 bp, Homo sapiens
tgggtaccaggccac

SEQ ID NO: 349989 - DNA, 14 bp, Homo sapiens
tgggtatcccacct

SEQ ID NO: 349990 - DNA, 13 bp, Homo sapiens
tgggtatgtgttg

SEQ ID NO: 349991 - DNA, 19 bp, Homo sapiens
tgggtatgtgttgccaaag

SEQ ID NO: 349992 - DNA, 21 bp, Homo sapiens
tgggtatttcttatttgaaag

SEQ ID NO: 349993 - DNA, 13 bp, Homo sapiens
tgggtcacaggaa

SEQ ID NO: 349994 - DNA, 16 bp, Homo sapiens
tgggtcagtgtgccac

SEQ ID NO: 349995 - DNA, 17 bp, Homo sapiens
tgggtcagtgtgccacc

SEQ ID NO: 349996 - DNA, 22 bp, Homo sapiens
tgggtcagtgtgccaccctctg

SEQ ID NO: 349997 - DNA, 17 bp, Homo sapiens
tgggtcatcccagcacc

SEQ ID NO: 349998 - DNA, 12 bp, Homo sapiens
tgggtccaggaa

SEQ ID NO: 349999 - DNA, 19 bp, Homo sapiens
tgggtccaggaaggcagct

SEQ ID NO: 350000 - DNA, 20 bp, Homo sapiens
tgggtccaggaaggcagctg

SEQ ID NO: 350001 - DNA, 22 bp, Homo sapiens
tgggtccgccttaatctggaag

SEQ ID NO: 350002 - DNA, 11 bp, Homo sapiens
tgggtcctgct

SEQ ID NO: 350003 - DNA, 14 bp, Homo sapiens
tgggtcctgctgct

SEQ ID NO: 350004 - DNA, 15 bp, Homo sapiens
tgggtcctgctgctc

SEQ ID NO: 350005 - DNA, 16 bp, Homo sapiens
tgggtcctgctgctcg

SEQ ID NO: 350006 - DNA, 15 bp, Homo sapiens
tgggtcggccctgcc

SEQ ID NO: 350007 - DNA, 16 bp, Homo sapiens
tgggtcgtggtggaga

SEQ ID NO: 350008 - DNA, 14 bp, Homo sapiens
tgggtctgaaagga

SEQ ID NO: 350009 - DNA, 20 bp, Homo sapiens
tgggtctgtgtctcttttct

SEQ ID NO: 350010 - DNA, 15 bp, Homo sapiens
tgggtgaaagtgact

SEQ ID NO: 350011 - DNA, 15 bp, Homo sapiens
tgggtgaagacagag

SEQ ID NO: 350012 - DNA, 12 bp, Homo sapiens
tgggtgagccag

SEQ ID NO: 350013 - DNA, 18 bp, Homo sapiens
tgggtgagcgggtggggt

SEQ ID NO: 350014 - DNA, 15 bp, Homo sapiens
tgggtgagtttttct

SEQ ID NO: 350015 - DNA, 20 bp, Homo sapiens
tgggtgatttctagaatggt

SEQ ID NO: 350016 - DNA, 17 bp, Homo sapiens
tgggtgccattcccagc

SEQ ID NO: 350017 - DNA, 16 bp, Homo sapiens
tgggtgcccacagccc

SEQ ID NO: 350018 - DNA, 23 bp, Homo sapiens
tgggtgcccacagcccgcatgca

SEQ ID NO: 350019 - DNA, 14 bp, Homo sapiens
tgggtggcacctcc

SEQ ID NO: 350020 - DNA, 13 bp, Homo sapiens
tgggtgggacaca

SEQ ID NO: 350021 - DNA, 18 bp, Homo sapiens
tgggtgggcaggaaaagg

SEQ ID NO: 350022 - DNA, 14 bp, Homo sapiens
tgggtggggacagt

SEQ ID NO: 350023 - DNA, 19 bp, Homo sapiens
tgggtggtaactgccagcc

SEQ ID NO: 350024 - DNA, 14 bp, Homo sapiens
tgggtggtttgtga

SEQ ID NO: 350025 - DNA, 21 bp, Homo sapiens
tgggtggtttgtgagccttgc

SEQ ID NO: 350026 - DNA, 22 bp, Homo sapiens
tgggtgtatttattttcctccc

SEQ ID NO: 350027 - DNA, 18 bp, Homo sapiens
tgggtgtgtttcaggaca

SEQ ID NO: 350028 - DNA, 22 bp, Homo sapiens
tgggtgtgtttcaggacagctg

SEQ ID NO: 350029 - DNA, 14 bp, Homo sapiens
tgggttaatggcta

SEQ ID NO: 350030 - DNA, 16 bp, Homo sapiens
tgggttaatggctagt

SEQ ID NO: 350031 - DNA, 15 bp, Homo sapiens
tgggttagcaatatt

SEQ ID NO: 350032 - DNA, 21 bp, Homo sapiens
tgggttagcaatatttatagg

SEQ ID NO: 350033 - DNA, 14 bp, Homo sapiens
tgggttccagacag

SEQ ID NO: 350034 - DNA, 15 bp, Homo sapiens
tgggttccagacaga

SEQ ID NO: 350035 - DNA, 21 bp, Homo sapiens
tgggttccagacagagtggat

SEQ ID NO: 350036 - DNA, 16 bp, Homo sapiens
tgggttcttcctctgt

SEQ ID NO: 350037 - DNA, 23 bp, Homo sapiens
tgggttgttaatactatattgct

SEQ ID NO: 350038 - DNA, 22 bp, Homo sapiens
tgggtttcggggtgaagcaagt

SEQ ID NO: 350039 - DNA, 17 bp, Homo sapiens
tgggtttctctgtgctc

SEQ ID NO: 350040 - DNA, 15 bp, Homo sapiens
tgggtttgggcagtg

SEQ ID NO: 350041 - DNA, 18 bp, Homo sapiens
tggtaaacattcctccag

SEQ ID NO: 350042 - DNA, 21 bp, Homo sapiens
tggtaaacattcctccagcct

SEQ ID NO: 350043 - DNA, 13 bp, Homo sapiens
tggtaaagatatt

SEQ ID NO: 350044 - DNA, 22 bp, Homo sapiens
tggtaaagatattattcaccat

SEQ ID NO: 350045 - DNA, 14 bp, Homo sapiens
tggtaacctgtggt

SEQ ID NO: 350046 - DNA, 14 bp, Homo sapiens
tggtaactgccagc

SEQ ID NO: 350047 - DNA, 18 bp, Homo sapiens
tggtaactgccagccttg

SEQ ID NO: 350048 - DNA, 22 bp, Homo sapiens
tggtaatttaagattccagaga

SEQ ID NO: 350049 - DNA, 13 bp, Homo sapiens
tggtaccagccct

SEQ ID NO: 350050 - DNA, 16 bp, Homo sapiens
tggtaccagccctggg

SEQ ID NO: 350051 - DNA, 18 bp, Homo sapiens
tggtaccagccctggggc

SEQ ID NO: 350052 - DNA, 21 bp, Homo sapiens
tggtaccagccctggggctgg

SEQ ID NO: 350053 - DNA, 15 bp, Homo sapiens
tggtactaaggagaa

SEQ ID NO: 350054 - DNA, 19 bp, Homo sapiens
tggtactcccccagccctc

SEQ ID NO: 350055 - DNA, 16 bp, Homo sapiens
tggtactttattcttg

SEQ ID NO: 350056 - DNA, 19 bp, Homo sapiens
tggtagacaatttgcctta

SEQ ID NO: 350057 - DNA, 12 bp, Homo sapiens
tggtagagacta

SEQ ID NO: 350058 - DNA, 11 bp, Homo sapiens
tggtagagttt

SEQ ID NO: 350059 - DNA, 16 bp, Homo sapiens
tggtagctctgagccc

SEQ ID NO: 350060 - DNA, 18 bp, Homo sapiens
tggtagctctgagccctc

SEQ ID NO: 350061 - DNA, 17 bp, Homo sapiens
tggtaggaatagcatgt

SEQ ID NO: 350062 - DNA, 14 bp, Homo sapiens
tggtaggctacttt

SEQ ID NO: 350063 - DNA, 20 bp, Homo sapiens
tggtagttagtagcatgttg

SEQ ID NO: 350064 - DNA, 14 bp, Homo sapiens
tggtagttctgtgc

SEQ ID NO: 350065 - DNA, 18 bp, Homo sapiens
tggtatctttaattgtat

SEQ ID NO: 350066 - DNA, 14 bp, Homo sapiens
tggtatgggtttct

SEQ ID NO: 350067 - DNA, 20 bp, Homo sapiens
tggtattcaactaatacatg

SEQ ID NO: 350068 - DNA, 19 bp, Homo sapiens
tggtattcaggattacatg

SEQ ID NO: 350069 - DNA, 14 bp, Homo sapiens
tggtattctctcta

SEQ ID NO: 350070 - DNA, 20 bp, Homo sapiens
tggtattggccgatgagctg

SEQ ID NO: 350071 - DNA, 18 bp, Homo sapiens
tggtatttggatatctgt

SEQ ID NO: 350072 - DNA, 17 bp, Homo sapiens
tggtattttcgtgcatt

SEQ ID NO: 350073 - DNA, 18 bp, Homo sapiens
tggtcaaacttgttttct

SEQ ID NO: 350074 - DNA, 18 bp, Homo sapiens
tggtcaacccgctgcttc

SEQ ID NO: 350075 - DNA, 22 bp, Homo sapiens
tggtcaagattttgaatgcttc

SEQ ID NO: 350076 - DNA, 23 bp, Homo sapiens
tggtcacaggactctgcctcctc

SEQ ID NO: 350077 - DNA, 13 bp, Homo sapiens
tggtcagctccct

SEQ ID NO: 350078 - DNA, 19 bp, Homo sapiens
tggtcattcctaatgcatt

SEQ ID NO: 350079 - DNA, 21 bp, Homo sapiens
tggtcatttggtggctctaac

SEQ ID NO: 350080 - DNA, 14 bp, Homo sapiens
tggtccaacagttt

SEQ ID NO: 350081 - DNA, 14 bp, Homo sapiens
tggtccacacacca

SEQ ID NO: 350082 - DNA, 15 bp, Homo sapiens
tggtccaggccaggc

SEQ ID NO: 350083 - DNA, 17 bp, Homo sapiens
tggtccatttcatgtga

SEQ ID NO: 350084 - DNA, 21 bp, Homo sapiens
tggtccatttcatgtgatcta

SEQ ID NO: 350085 - DNA, 17 bp, Homo sapiens
tggtcccataggagcag

SEQ ID NO: 350086 - DNA, 12 bp, Homo sapiens
tggtcccctgtg

SEQ ID NO: 350087 - DNA, 11 bp, Homo sapiens
tggtccctggt

SEQ ID NO: 350088 - DNA, 14 bp, Homo sapiens
tggtcctaagtccc

SEQ ID NO: 350089 - DNA, 23 bp, Homo sapiens
tggtcctcacaagcctcttctga

SEQ ID NO: 350090 - DNA, 21 bp, Homo sapiens
tggtcctgttaaccctccacc

SEQ ID NO: 350091 - DNA, 15 bp, Homo sapiens
tggtccttctgaccc

SEQ ID NO: 350092 - DNA, 19 bp, Homo sapiens
tggtctaattcaactctgt

SEQ ID NO: 350093 - DNA, 18 bp, Homo sapiens
tggtctcaaactcctgac

SEQ ID NO: 350094 - DNA, 16 bp, Homo sapiens
tggtctccatttttcc

SEQ ID NO: 350095 - DNA, 12 bp, Homo sapiens
tggtctcctctc

SEQ ID NO: 350096 - DNA, 16 bp, Homo sapiens
tggtctcctctcagct

SEQ ID NO: 350097 - DNA, 14 bp, Homo sapiens
tgtttaagatgggc

SEQ ID NO: 350098 - DNA, 20 bp, Homo sapiens
tgtttaatattgagaaagaa

SEQ ID NO: 350099 - DNA, 16 bp, Homo sapiens
tgtttacactctttgt

SEQ ID NO: 350100 - DNA, 19 bp, Homo sapiens
tgtttacactctttgtaag

SEQ ID NO: 350101 - DNA, 12 bp, Homo sapiens
tgtttacatatc

SEQ ID NO: 350102 - DNA, 15 bp, Homo sapiens
tgtttaccctccctg

SEQ ID NO: 350103 - DNA, 21 bp, Homo sapiens
tgtttacctcactggtgcatt

SEQ ID NO: 350104 - DNA, 22 bp, Homo sapiens
tgtttacctcactggtgcattt

SEQ ID NO: 350105 - DNA, 23 bp, Homo sapiens
tgtttacctcactggtgcattta

SEQ ID NO: 350106 - DNA, 13 bp, Homo sapiens
tgtttagcattaa

SEQ ID NO: 350107 - DNA, 14 bp, Homo sapiens
tgtttagcattaaa

SEQ ID NO: 350108 - DNA, 16 bp, Homo sapiens
tgtttagtagctgata

SEQ ID NO: 350109 - DNA, 22 bp, Homo sapiens
tgtttagtagctgataaagaaa

SEQ ID NO: 350110 - DNA, 14 bp, Homo sapiens
tgtttagttgcaga

SEQ ID NO: 350111 - DNA, 21 bp, Homo sapiens
tgtttatagcaaacttggaat

SEQ ID NO: 350112 - DNA, 21 bp, Homo sapiens
tgtttatgaagaaagatacta

SEQ ID NO: 350113 - DNA, 16 bp, Homo sapiens
tgtttatgagccagac

SEQ ID NO: 350114 - DNA, 21 bp, Homo sapiens
tgtttatgagccagacaaatg

SEQ ID NO: 350115 - DNA, 14 bp, Homo sapiens
tgtttattgtcaaa

SEQ ID NO: 350116 - DNA, 17 bp, Homo sapiens
tgtttatttctgtttct

SEQ ID NO: 350117 - DNA, 14 bp, Homo sapiens
tgtttatttttata

SEQ ID NO: 350118 - DNA, 18 bp, Homo sapiens
tgtttatttttcatattg

SEQ ID NO: 350119 - DNA, 15 bp, Homo sapiens
tgtttcaccagtttc

SEQ ID NO: 350120 - DNA, 16 bp, Homo sapiens
tgtttcagctgcagtt

SEQ ID NO: 350121 - DNA, 14 bp, Homo sapiens
tgtttcatgttttg

SEQ ID NO: 350122 - DNA, 19 bp, Homo sapiens
tgtttcatgttttgtgact

SEQ ID NO: 350123 - DNA, 22 bp, Homo sapiens
tgtttccagaaattcttcaatt

SEQ ID NO: 350124 - DNA, 14 bp, Homo sapiens
tgtttccagctgcc

SEQ ID NO: 350125 - DNA, 12 bp, Homo sapiens
tgtttccaggca

SEQ ID NO: 350126 - DNA, 19 bp, Homo sapiens
tgtttccaggcatgaccct

SEQ ID NO: 350127 - DNA, 20 bp, Homo sapiens
tgtttccaggtcagaaacca

SEQ ID NO: 350128 - DNA, 16 bp, Homo sapiens
tgtttccatcatttct

SEQ ID NO: 350129 - DNA, 15 bp, Homo sapiens
tgtttccctgctggc

SEQ ID NO: 350130 - DNA, 18 bp, Homo sapiens
tgtttccctgctggccaa

SEQ ID NO: 350131 - DNA, 22 bp, Homo sapiens
tgtttccctgctggccaaagtc

SEQ ID NO: 350132 - DNA, 14 bp, Homo sapiens
tgtttcctgtgccc

SEQ ID NO: 350133 - DNA, 16 bp, Homo sapiens
tgtttcggtgccctgt

SEQ ID NO: 350134 - DNA, 16 bp, Homo sapiens
tgtttctatactgttt

SEQ ID NO: 350135 - DNA, 15 bp, Homo sapiens
tgtttctcctctgaa

SEQ ID NO: 350136 - DNA, 18 bp, Homo sapiens
tgtttctgcagaggcagc

SEQ ID NO: 350137 - DNA, 16 bp, Homo sapiens
tgtttctgcagccctt

SEQ ID NO: 350138 - DNA, 19 bp, Homo sapiens
tgtttcttccaaagcacat

SEQ ID NO: 350139 - DNA, 15 bp, Homo sapiens
tgtttcttgggaaaa

SEQ ID NO: 350140 - DNA, 23 bp, Homo sapiens
tgtttcttgggaaaatatcactt

SEQ ID NO: 350141 - DNA, 13 bp, Homo sapiens
tgtttctttctga

SEQ ID NO: 350142 - DNA, 17 bp, Homo sapiens
tgtttctttctgaagtg

SEQ ID NO: 350143 - DNA, 17 bp, Homo sapiens
tgtttctttctgtctct

SEQ ID NO: 350144 - DNA, 16 bp, Homo sapiens
tgtttgaaaatattat

SEQ ID NO: 350145 - DNA, 24 bp, Homo sapiens
tgtttgaaacactcgtgtgcatga

SEQ ID NO: 350146 - DNA, 13 bp, Homo sapiens
tgtttgaaatctt

SEQ ID NO: 350147 - DNA, 18 bp, Homo sapiens
tgtttgaacacttactgt

SEQ ID NO: 350148 - DNA, 22 bp, Homo sapiens
tgtttgaagaaccgcattttga

SEQ ID NO: 350149 - DNA, 14 bp, Homo sapiens
tgtttgaggttaaa

SEQ ID NO: 350150 - DNA, 14 bp, Homo sapiens
tgtttgagtttctg

SEQ ID NO: 350151 - DNA, 22 bp, Homo sapiens
tgtttgagtttctggctgaaaa

SEQ ID NO: 350152 - DNA, 18 bp, Homo sapiens
ttaaaatgattgtaaaat

SEQ ID NO: 350153 - DNA, 13 bp, Homo sapiens
ttaaaattagtga

SEQ ID NO: 350154 - DNA, 15 bp, Homo sapiens
ttaaaattagtgaga

SEQ ID NO: 350155 - DNA, 20 bp, Homo sapiens
ttaaaattcaagaaaataaa

SEQ ID NO: 350156 - DNA, 13 bp, Homo sapiens
ttaaacaaagtga

SEQ ID NO: 350157 - DNA, 16 bp, Homo sapiens
ttaaacacctgacaca

SEQ ID NO: 350158 - DNA, 17 bp, Homo sapiens
ttaaacacctgacacat

SEQ ID NO: 350159 - DNA, 15 bp, Homo sapiens
ttaaacactgtaatc

SEQ ID NO: 350160 - DNA, 16 bp, Homo sapiens
ttaaacactgtaatct

SEQ ID NO: 350161 - DNA, 17 bp, Homo sapiens
ttaaacactgtaatctt

SEQ ID NO: 350162 - DNA, 21 bp, Homo sapiens
ttaaacagggcatctccagga

SEQ ID NO: 350163 - DNA, 15 bp, Homo sapiens
ttaaacattgaagta

SEQ ID NO: 350164 - DNA, 17 bp, Homo sapiens
ttaaactctcctttgat

SEQ ID NO: 350165 - DNA, 18 bp, Homo sapiens
ttaaactgtatgtcttat

SEQ ID NO: 350166 - DNA, 16 bp, Homo sapiens
ttaaacttataaatca

SEQ ID NO: 350167 - DNA, 15 bp, Homo sapiens
ttaaacttcagcaac

SEQ ID NO: 350168 - DNA, 21 bp, Homo sapiens
ttaaactttgtcacttctgct

SEQ ID NO: 350169 - DNA, 20 bp, Homo sapiens
ttaaactttgtgcctttgac

SEQ ID NO: 350170 - DNA, 14 bp, Homo sapiens
ttaaagaaaaacca

SEQ ID NO: 350171 - DNA, 13 bp, Homo sapiens
ttaaagaaaatgt

SEQ ID NO: 350172 - DNA, 16 bp, Homo sapiens
ttaaagaaacagcttt

SEQ ID NO: 350173 - DNA, 21 bp, Homo sapiens
ttaaagaaacagctttcaagt

SEQ ID NO: 350174 - DNA, 11 bp, Homo sapiens
ttaaagaaagt

SEQ ID NO: 350175 - DNA, 21 bp, Homo sapiens
ttaaagaataaagtccaaagt

SEQ ID NO: 350176 - DNA, 11 bp, Homo sapiens
ttaaagactta

SEQ ID NO: 350177 - DNA, 22 bp, Homo sapiens
ttaaagacttgatgaataaaca

SEQ ID NO: 350178 - DNA, 23 bp, Homo sapiens
ttaaagacttgatgaataaacac

SEQ ID NO: 350179 - DNA, 13 bp, Homo sapiens
ttaaagagaggtt

SEQ ID NO: 350180 - DNA, 14 bp, Homo sapiens
ttaaagagaggtta

SEQ ID NO: 350181 - DNA, 19 bp, Homo sapiens
ttaaagaggcgtcttgtat

SEQ ID NO: 350182 - DNA, 22 bp, Homo sapiens
ttaaagaggcgtcttgtatttt

SEQ ID NO: 350183 - DNA, 15 bp, Homo sapiens
ttaaagcaataagtt

SEQ ID NO: 350184 - DNA, 21 bp, Homo sapiens
ttaaagcacatgccagggaaa

SEQ ID NO: 350185 - DNA, 21 bp, Homo sapiens
ttaaagcagagggactttgta

SEQ ID NO: 350186 - DNA, 15 bp, Homo sapiens
ttaaagctgcctgta

SEQ ID NO: 350187 - DNA, 18 bp, Homo sapiens
ttaaagctgcctgtagtt

SEQ ID NO: 350188 - DNA, 14 bp, Homo sapiens
ttaaagctgtttct

SEQ ID NO: 350189 - DNA, 12 bp, Homo sapiens
ttaaagcttggt

SEQ ID NO: 350190 - DNA, 15 bp, Homo sapiens
ttaaagcttttgatg

SEQ ID NO: 350191 - DNA, 15 bp, Homo sapiens
ttaaaggacaaacag

SEQ ID NO: 350192 - DNA, 21 bp, Homo sapiens
ttaaaggacaggaggaggaga

SEQ ID NO: 350193 - DNA, 15 bp, Homo sapiens
ttaaaggcagtccag

SEQ ID NO: 350194 - DNA, 18 bp, Homo sapiens
ttaaaggcagtccagagc

SEQ ID NO: 350195 - DNA, 17 bp, Homo sapiens
ttaaaggtcctgccctc

SEQ ID NO: 350196 - DNA, 15 bp, Homo sapiens
ttaaagtacctgtag

SEQ ID NO: 350197 - DNA, 16 bp, Homo sapiens
ttaaagtataaagtaa

SEQ ID NO: 350198 - DNA, 18 bp, Homo sapiens
ttaaagtttaaataccag

SEQ ID NO: 350199 - DNA, 12 bp, Homo sapiens
ttaaataaaact

SEQ ID NO: 350200 - DNA, 11 bp, Homo sapiens
ttaaataaaag

SEQ ID NO: 350201 - DNA, 20 bp, Homo sapiens
ttaaataaaagtgatcaata

SEQ ID NO: 350202 - DNA, 17 bp, Homo sapiens
ttaaataaagtatcatg

SEQ ID NO: 350203 - DNA, 19 bp, Homo sapiens
ttaaataaagtatcatgca

SEQ ID NO: 350204 - DNA, 18 bp, Homo sapiens
ttaaataattttacatgt

SEQ ID NO: 350205 - DNA, 18 bp, Homo sapiens
ttaaatacagacactaag

SEQ ID NO: 350206 - DNA, 19 bp, Homo sapiens
ttaaatacgcactacatgt

SEQ ID NO: 350207 - DNA, 13 bp, Homo sapiens
ttaaatatagaat

SEQ ID NO: 350208 - DNA, 16 bp, Homo sapiens
ttaaatatatgtatgt

SEQ ID NO: 350209 - DNA, 17 bp, Homo sapiens
ttaaatatatgtatgta

SEQ ID NO: 350210 - DNA, 19 bp, Homo sapiens
ttaaatatatgtatgtaaa

SEQ ID NO: 350211 - DNA, 13 bp, Homo sapiens
ttaaatatatttt

SEQ ID NO: 350212 - DNA, 22 bp, Homo sapiens
ttaaatatattttcaaagtaca

SEQ ID NO: 350213 - DNA, 23 bp, Homo sapiens
ttaaatatattttcaaagtacat

SEQ ID NO: 350214 - DNA, 14 bp, Homo sapiens
ttaaatatcattct

SEQ ID NO: 350215 - DNA, 18 bp, Homo sapiens
ttaaatatcattctttgt

SEQ ID NO: 350216 - DNA, 14 bp, Homo sapiens
ttaaatatttaatg

SEQ ID NO: 350217 - DNA, 15 bp, Homo sapiens
ttaaatatttaatga

SEQ ID NO: 350218 - DNA, 14 bp, Homo sapiens
ttaaatattttcca

SEQ ID NO: 350219 - DNA, 21 bp, Homo sapiens
ttaaatctgaaggttctggta

SEQ ID NO: 350220 - DNA, 16 bp, Homo sapiens
ttaaatctgtccctga

SEQ ID NO: 350221 - DNA, 14 bp, Homo sapiens
ttaaatctgtgatg

SEQ ID NO: 350222 - DNA, 13 bp, Homo sapiens
ttaaatgaaatac

SEQ ID NO: 350223 - DNA, 13 bp, Homo sapiens
ttaaatgattcca

SEQ ID NO: 350224 - DNA, 14 bp, Homo sapiens
ttaaatgattccaa

SEQ ID NO: 350225 - DNA, 15 bp, Homo sapiens
ttaaatgattccaaa

SEQ ID NO: 350226 - DNA, 16 bp, Homo sapiens
ttaaatgattccaaat

SEQ ID NO: 350227 - DNA, 17 bp, Homo sapiens
ttaaatgattccaaata

SEQ ID NO: 350228 - DNA, 12 bp, Homo sapiens
ttaaatgctttg

SEQ ID NO: 350229 - DNA, 13 bp, Homo sapiens
ttaaatggcatga

SEQ ID NO: 350230 - DNA, 22 bp, Homo sapiens
ttaaatggcatgacaaggtgtg

SEQ ID NO: 350231 - DNA, 16 bp, Homo sapiens
ttaaatgtaaataatc

SEQ ID NO: 350232 - DNA, 15 bp, Homo sapiens
ttaaattataaggac

SEQ ID NO: 350233 - DNA, 18 bp, Homo sapiens
ttaaattatactgtagct

SEQ ID NO: 350234 - DNA, 12 bp, Homo sapiens
ttaaattatatg

SEQ ID NO: 350235 - DNA, 13 bp, Homo sapiens
ttaaattatatga

SEQ ID NO: 350236 - DNA, 15 bp, Homo sapiens
ttaaattatatgata

SEQ ID NO: 350237 - DNA, 18 bp, Homo sapiens
ttaaattctctctaacat

SEQ ID NO: 350238 - DNA, 17 bp, Homo sapiens
ttaaattggcttgttta

SEQ ID NO: 350239 - DNA, 17 bp, Homo sapiens
ttaaattgttataactt

SEQ ID NO: 350240 - DNA, 16 bp, Homo sapiens
ttaaatttaatatact

SEQ ID NO: 350241 - DNA, 21 bp, Homo sapiens
ttaaatttaatatactgcata

SEQ ID NO: 350242 - DNA, 15 bp, Homo sapiens
ttaaatttctaccgc

SEQ ID NO: 350243 - DNA, 12 bp, Homo sapiens
ttaaattttcca

SEQ ID NO: 350244 - DNA, 14 bp, Homo sapiens
ttaaattttccatt

SEQ ID NO: 350245 - DNA, 15 bp, Homo sapiens
ttaacaaaagcaaga

SEQ ID NO: 350246 - DNA, 20 bp, Homo sapiens
ttaacaaacgcattaagagg

SEQ ID NO: 350247 - DNA, 20 bp, Homo sapiens
ttaacaaggaatgcctgtgc

SEQ ID NO: 350248 - DNA, 22 bp, Homo sapiens
ttaacaaggaatgcctgtgcca

SEQ ID NO: 350249 - DNA, 19 bp, Homo sapiens
ttaacagcgtgtcaacttt

SEQ ID NO: 350250 - DNA, 16 bp, Homo sapiens
ttaacaggtctttgaa

SEQ ID NO: 350251 - DNA, 20 bp, Homo sapiens
ttaacaggttttcttctaat

SEQ ID NO: 350252 - DNA, 22 bp, Homo sapiens
ttaacaggttttcttctaatca

SEQ ID NO: 350253 - DNA, 17 bp, Homo sapiens
ttaacagtaaaaatttc

SEQ ID NO: 350254 - DNA, 15 bp, Homo sapiens
ttaacagtcatttaa

SEQ ID NO: 350255 - DNA, 16 bp, Homo sapiens
ttaacagtcatttaaa

SEQ ID NO: 350256 - DNA, 16 bp, Homo sapiens
ttaacatatattgtta

SEQ ID NO: 350257 - DNA, 19 bp, Homo sapiens
ttaacatatattgttattt

SEQ ID NO: 350258 - DNA, 15 bp, Homo sapiens
ttaacatctgaagtg

SEQ ID NO: 350259 - DNA, 15 bp, Homo sapiens
ttaacattcatagag

SEQ ID NO: 350260 - DNA, 11 bp, Homo sapiens
ttaacattcct

SEQ ID NO: 350261 - DNA, 19 bp, Homo sapiens
ttaacattgaccaagaact

SEQ ID NO: 350262 - DNA, 19 bp, Homo sapiens
ttaacatttgatgtctaga

SEQ ID NO: 350263 - DNA, 20 bp, Homo sapiens
ttaaccaccgcatatgcatg

SEQ ID NO: 350264 - DNA, 22 bp, Homo sapiens
ttaaccaccgcatatgcatgcc

SEQ ID NO: 350265 - DNA, 13 bp, Homo sapiens
ttagaatggggct

SEQ ID NO: 350266 - DNA, 18 bp, Homo sapiens
ttagaatttgaaaggaaa

SEQ ID NO: 350267 - DNA, 20 bp, Homo sapiens
ttagacaaccatagaactgt

SEQ ID NO: 350268 - DNA, 23 bp, Homo sapiens
ttagacaatgtggaattacataa

SEQ ID NO: 350269 - DNA, 21 bp, Homo sapiens
ttagacttcgactcaggatcc

SEQ ID NO: 350270 - DNA, 20 bp, Homo sapiens
ttagagaaaataaatttaac

SEQ ID NO: 350271 - DNA, 23 bp, Homo sapiens
ttagagacagttgggtgagaaca

SEQ ID NO: 350272 - DNA, 15 bp, Homo sapiens
ttagagataagagtt

SEQ ID NO: 350273 - DNA, 16 bp, Homo sapiens
ttagagattaatttgt

SEQ ID NO: 350274 - DNA, 15 bp, Homo sapiens
ttagagattgcccca

SEQ ID NO: 350275 - DNA, 23 bp, Homo sapiens
ttagagggacagccaaaagtaag

SEQ ID NO: 350276 - DNA, 22 bp, Homo sapiens
ttagagtaaactattctataaa

SEQ ID NO: 350277 - DNA, 21 bp, Homo sapiens
ttagagtatgcaagaagaata

SEQ ID NO: 350278 - DNA, 22 bp, Homo sapiens
ttagagtatgcaagaagaatat

SEQ ID NO: 350279 - DNA, 22 bp, Homo sapiens
ttagagtgcccttaaaataatg

SEQ ID NO: 350280 - DNA, 18 bp, Homo sapiens
ttagatcaaggcaaaaat

SEQ ID NO: 350281 - DNA, 19 bp, Homo sapiens
ttagatcaaggcaaaaata

SEQ ID NO: 350282 - DNA, 17 bp, Homo sapiens
ttagatgtttaccttca

SEQ ID NO: 350283 - DNA, 17 bp, Homo sapiens
ttagattgggccatggc

SEQ ID NO: 350284 - DNA, 21 bp, Homo sapiens
ttagattttctgtaaatgaag

SEQ ID NO: 350285 - DNA, 12 bp, Homo sapiens
ttagcagctcag

SEQ ID NO: 350286 - DNA, 15 bp, Homo sapiens
ttagcagcttccaga

SEQ ID NO: 350287 - DNA, 16 bp, Homo sapiens
ttagcagttctgcaaa

SEQ ID NO: 350288 - DNA, 11 bp, Homo sapiens
ttagcatcccc

SEQ ID NO: 350289 - DNA, 18 bp, Homo sapiens
ttagcatggtgagctgag

SEQ ID NO: 350290 - DNA, 12 bp, Homo sapiens
ttagcattaaaa

SEQ ID NO: 350291 - DNA, 15 bp, Homo sapiens
ttagcattaaaaata

SEQ ID NO: 350292 - DNA, 15 bp, Homo sapiens
ttagccagtcattgt

SEQ ID NO: 350293 - DNA, 23 bp, Homo sapiens
ttagcccggccaaggacactgat

SEQ ID NO: 350294 - DNA, 14 bp, Homo sapiens
ttagcctggtgaca

SEQ ID NO: 350295 - DNA, 19 bp, Homo sapiens
ttagcctggtgacaggcag

SEQ ID NO: 350296 - DNA, 20 bp, Homo sapiens
ttagcctggtgacaggcaga

SEQ ID NO: 350297 - DNA, 21 bp, Homo sapiens
ttagccttgctgtagagactt

SEQ ID NO: 350298 - DNA, 23 bp, Homo sapiens
ttagcgttctggactctgcccca

SEQ ID NO: 350299 - DNA, 19 bp, Homo sapiens
ttagctacaatcctacctt

SEQ ID NO: 350300 - DNA, 23 bp, Homo sapiens
ttagctacaatcctaccttttga

SEQ ID NO: 350301 - DNA, 19 bp, Homo sapiens
ttagctagactaggagacc

SEQ ID NO: 350302 - DNA, 12 bp, Homo sapiens
ttagctcagccc

SEQ ID NO: 350303 - DNA, 16 bp, Homo sapiens
ttagctccctcccgca

SEQ ID NO: 350304 - DNA, 22 bp, Homo sapiens
ttagctgggaagaatgtattcg

SEQ ID NO: 350305 - DNA, 15 bp, Homo sapiens
ttagcttcctccaga

SEQ ID NO: 350306 - DNA, 18 bp, Homo sapiens
ttagcttcctccagagga

SEQ ID NO: 350307 - DNA, 15 bp, Homo sapiens
ttaggaaataaaacc

SEQ ID NO: 350308 - DNA, 19 bp, Homo sapiens
ttaggaaataaaacctttc

SEQ ID NO: 350309 - DNA, 21 bp, Homo sapiens
ttaggaaataaaacctttcaa

SEQ ID NO: 350310 - DNA, 21 bp, Homo sapiens
ttaggaacagagtatatatgt

SEQ ID NO: 350311 - DNA, 20 bp, Homo sapiens
ttaggaatatacatagtctt

SEQ ID NO: 350312 - DNA, 15 bp, Homo sapiens
ttaggaatgctcaat

SEQ ID NO: 350313 - DNA, 23 bp, Homo sapiens
ttaggagattttaggtgttgatt

SEQ ID NO: 350314 - DNA, 21 bp, Homo sapiens
ttaggatttaacagtcattta

SEQ ID NO: 350315 - DNA, 14 bp, Homo sapiens
ttaggccacgctcc

SEQ ID NO: 350316 - DNA, 22 bp, Homo sapiens
ttaggcccgccaaacttctgaa

SEQ ID NO: 350317 - DNA, 14 bp, Homo sapiens
ttaggcccgggccc

SEQ ID NO: 350318 - DNA, 12 bp, Homo sapiens
ttaggctgggcc

SEQ ID NO: 350319 - DNA, 14 bp, Homo sapiens
ttaggctgggccca

SEQ ID NO: 350320 - DNA, 20 bp, Homo sapiens
ttaggctgtcgtccccctcc

SEQ ID NO: 350321 - DNA, 21 bp, Homo sapiens
ttaggcttacaatgtgcactg

SEQ ID NO: 350322 - DNA, 16 bp, Homo sapiens
ttagggaaatccaact

SEQ ID NO: 350323 - DNA, 20 bp, Homo sapiens
ttagggcggggagaagagca

SEQ ID NO: 350324 - DNA, 16 bp, Homo sapiens
ttagggggtgggaggg

SEQ ID NO: 350325 - DNA, 11 bp, Homo sapiens
ttagggtacag

SEQ ID NO: 350326 - DNA, 15 bp, Homo sapiens
ttagggtttctgatt

SEQ ID NO: 350327 - DNA, 23 bp, Homo sapiens
ttaggtagatgagaaaacaggct

SEQ ID NO: 350328 - DNA, 22 bp, Homo sapiens
ttaggtcatccaacctctttcc

SEQ ID NO: 350329 - DNA, 19 bp, Homo sapiens
ttaggtcccagaatggaaa

SEQ ID NO: 350330 - DNA, 18 bp, Homo sapiens
ttagtacccacctgagct

SEQ ID NO: 350331 - DNA, 13 bp, Homo sapiens
ttagtagctgata

SEQ ID NO: 350332 - DNA, 15 bp, Homo sapiens
ttagtatctaacatg

SEQ ID NO: 350333 - DNA, 17 bp, Homo sapiens
ttagtcctccctgctca

SEQ ID NO: 350334 - DNA, 14 bp, Homo sapiens
ttagtgagatttgt

SEQ ID NO: 350335 - DNA, 17 bp, Homo sapiens
ttagtgagatttgtatt

SEQ ID NO: 350336 - DNA, 15 bp, Homo sapiens
ttagtgattgctttt

SEQ ID NO: 350337 - DNA, 16 bp, Homo sapiens
ttagtgattgtgtctg

SEQ ID NO: 350338 - DNA, 12 bp, Homo sapiens
ttagtgccaggc

SEQ ID NO: 350339 - DNA, 17 bp, Homo sapiens
ttagtgcggacaagttt

SEQ ID NO: 350340 - DNA, 16 bp, Homo sapiens
ttagtgggaagagctg

SEQ ID NO: 350341 - DNA, 17 bp, Homo sapiens
ttagtgggaagagctgg

SEQ ID NO: 350342 - DNA, 18 bp, Homo sapiens
ttagtggtatgtctcttt

SEQ ID NO: 350343 - DNA, 14 bp, Homo sapiens
ttagtgtctgtcca

SEQ ID NO: 350344 - DNA, 12 bp, Homo sapiens
ttagtgtgattg

SEQ ID NO: 350345 - DNA, 18 bp, Homo sapiens
ttagtgtggttttctgtt

SEQ ID NO: 350346 - DNA, 22 bp, Homo sapiens
ttagtgtttagcattaaaaata

SEQ ID NO: 350347 - DNA, 13 bp, Homo sapiens
ttagttaaaatct

SEQ ID NO: 350348 - DNA, 23 bp, Homo sapiens
ttagttaaaatctattttgtctg

SEQ ID NO: 350349 - DNA, 18 bp, Homo sapiens
ttagttatagtttcagat

SEQ ID NO: 350350 - DNA, 22 bp, Homo sapiens
ttagttatagtttcagatatat

SEQ ID NO: 350351 - DNA, 19 bp, Homo sapiens
ttagttccctgtctcttga

SEQ ID NO: 350352 - DNA, 21 bp, Homo sapiens
ttagtttttaaaaaggccttt

SEQ ID NO: 350353 - DNA, 15 bp, Homo sapiens
ttagtttttcacttt

SEQ ID NO: 350354 - DNA, 15 bp, Homo sapiens
ttataaaaatatcaa

SEQ ID NO: 350355 - DNA, 12 bp, Homo sapiens
ttataaaatctg

SEQ ID NO: 350356 - DNA, 15 bp, Homo sapiens
ttataaaatctgtat

SEQ ID NO: 350357 - DNA, 21 bp, Homo sapiens
ttataaaatctttccatctca

SEQ ID NO: 350358 - DNA, 16 bp, Homo sapiens
ttataaaattaagcaa

SEQ ID NO: 350359 - DNA, 15 bp, Homo sapiens
ttataaacacattga

SEQ ID NO: 350360 - DNA, 17 bp, Homo sapiens
ttataaactagatctcc

SEQ ID NO: 350361 - DNA, 15 bp, Homo sapiens
ttataaatatattta

SEQ ID NO: 350362 - DNA, 17 bp, Homo sapiens
ttataaatcatattgat

SEQ ID NO: 350363 - DNA, 19 bp, Homo sapiens
ttataaatcatattgatga

SEQ ID NO: 350364 - DNA, 17 bp, Homo sapiens
ttataaatccaaagtaa

SEQ ID NO: 350365 - DNA, 20 bp, Homo sapiens
ttataaatgagcaaatggaa

SEQ ID NO: 350366 - DNA, 18 bp, Homo sapiens
ttataaattaaatatatg

SEQ ID NO: 350367 - DNA, 18 bp, Homo sapiens
ttataactcatcataaaa

SEQ ID NO: 350368 - DNA, 22 bp, Homo sapiens
ttataactcatcataaaataaa

SEQ ID NO: 350369 - DNA, 19 bp, Homo sapiens
ttataactctgcactactc

SEQ ID NO: 350370 - DNA, 22 bp, Homo sapiens
ttataagaaaacatgtaaaggg

SEQ ID NO: 350371 - DNA, 15 bp, Homo sapiens
ttataagcaacatga

SEQ ID NO: 350372 - DNA, 12 bp, Homo sapiens
ttataagcattg

SEQ ID NO: 350373 - DNA, 13 bp, Homo sapiens
ttataagcattga

SEQ ID NO: 350374 - DNA, 17 bp, Homo sapiens
ttataaggactgcatgg

SEQ ID NO: 350375 - DNA, 22 bp, Homo sapiens
ttataaggactgcatggtaatt

SEQ ID NO: 350376 - DNA, 17 bp, Homo sapiens
ttataaggctgactctt

SEQ ID NO: 350377 - DNA, 15 bp, Homo sapiens
ttataataatgttaa

SEQ ID NO: 350378 - DNA, 15 bp, Homo sapiens
ttataatgaatgaaa

SEQ ID NO: 350379 - DNA, 15 bp, Homo sapiens
ttatacagacctaat

SEQ ID NO: 350380 - DNA, 21 bp, Homo sapiens
ttatacagacctaatatcatt

SEQ ID NO: 350381 - DNA, 16 bp, Homo sapiens
ttatacagttttaaag

SEQ ID NO: 350382 - DNA, 18 bp, Homo sapiens
ttatacagttttaaagaa

SEQ ID NO: 350383 - DNA, 16 bp, Homo sapiens
ttatacatctgtattt

SEQ ID NO: 350384 - DNA, 14 bp, Homo sapiens
ttatactgcacttt

SEQ ID NO: 350385 - DNA, 16 bp, Homo sapiens
ttatagaagtttagat

SEQ ID NO: 350386 - DNA, 15 bp, Homo sapiens
ttatagaatatttat

SEQ ID NO: 350387 - DNA, 17 bp, Homo sapiens
ttatagctattactgtc

SEQ ID NO: 350388 - DNA, 22 bp, Homo sapiens
ttataggtaatcaatgaatatt

SEQ ID NO: 350389 - DNA, 14 bp, Homo sapiens
ttatagtttataca

SEQ ID NO: 350390 - DNA, 16 bp, Homo sapiens
ttatagtttgtacatg

SEQ ID NO: 350391 - DNA, 23 bp, Homo sapiens
ttatataaatgtaaaaataataa

SEQ ID NO: 350392 - DNA, 23 bp, Homo sapiens
ttatatacagtacacagatacct

SEQ ID NO: 350393 - DNA, 18 bp, Homo sapiens
ttatatagcttgaaacat

SEQ ID NO: 350394 - DNA, 18 bp, Homo sapiens
ttatataggttgtgcaaa

SEQ ID NO: 350395 - DNA, 21 bp, Homo sapiens
ttatatataaaataaatatac

SEQ ID NO: 350396 - DNA, 13 bp, Homo sapiens
ttatatataaata

SEQ ID NO: 350397 - DNA, 14 bp, Homo sapiens
ttatatataaatat

SEQ ID NO: 350398 - DNA, 16 bp, Homo sapiens
ttatttctccatcccc

SEQ ID NO: 350399 - DNA, 12 bp, Homo sapiens
ttatttcttcaa

SEQ ID NO: 350400 - DNA, 12 bp, Homo sapiens
ttatttgagttt

SEQ ID NO: 350401 - DNA, 14 bp, Homo sapiens
ttatttgagtttga

SEQ ID NO: 350402 - DNA, 13 bp, Homo sapiens
ttatttgtgtaat

SEQ ID NO: 350403 - DNA, 21 bp, Homo sapiens
ttatttgtgtaatagaaaact

SEQ ID NO: 350404 - DNA, 17 bp, Homo sapiens
ttattttaaacaaaata

SEQ ID NO: 350405 - DNA, 12 bp, Homo sapiens
ttattttaaatc

SEQ ID NO: 350406 - DNA, 22 bp, Homo sapiens
ttattttaaattataaggactg

SEQ ID NO: 350407 - DNA, 23 bp, Homo sapiens
ttattttaaattataaggactgc

SEQ ID NO: 350408 - DNA, 15 bp, Homo sapiens
ttattttaatattta

SEQ ID NO: 350409 - DNA, 17 bp, Homo sapiens
ttattttaattcagttg

SEQ ID NO: 350410 - DNA, 20 bp, Homo sapiens
ttattttagcagttctgcaa

SEQ ID NO: 350411 - DNA, 14 bp, Homo sapiens
ttattttctgaatt

SEQ ID NO: 350412 - DNA, 19 bp, Homo sapiens
ttatttttatatagcttga

SEQ ID NO: 350413 - DNA, 20 bp, Homo sapiens
ttatttttatatcagcctga

SEQ ID NO: 350414 - DNA, 14 bp, Homo sapiens
ttatttttcatatt

SEQ ID NO: 350415 - DNA, 16 bp, Homo sapiens
ttatttttcatattgt

SEQ ID NO: 350416 - DNA, 22 bp, Homo sapiens
ttatttttctaaggttctcata

SEQ ID NO: 350417 - DNA, 14 bp, Homo sapiens
ttatttttggactt

SEQ ID NO: 350418 - DNA, 17 bp, Homo sapiens
ttatttttgtactgtgc

SEQ ID NO: 350419 - DNA, 21 bp, Homo sapiens
ttatttttgtactgtgctgat

SEQ ID NO: 350420 - DNA, 17 bp, Homo sapiens
ttatttttgtgtttcta

SEQ ID NO: 350421 - DNA, 14 bp, Homo sapiens
ttattttttaatta

SEQ ID NO: 350422 - DNA, 16 bp, Homo sapiens
ttattttttaattatt

SEQ ID NO: 350423 - DNA, 18 bp, Homo sapiens
ttattttttacattatta

SEQ ID NO: 350424 - DNA, 14 bp, Homo sapiens
ttatttttttctac

SEQ ID NO: 350425 - DNA, 17 bp, Homo sapiens
ttatttttttgatggct

SEQ ID NO: 350426 - DNA, 14 bp, Homo sapiens
ttcaaaaaaacact

SEQ ID NO: 350427 - DNA, 15 bp, Homo sapiens
ttcaaaaaaatccta

SEQ ID NO: 350428 - DNA, 22 bp, Homo sapiens
ttcaaaagcacaaaccctgggg

SEQ ID NO: 350429 - DNA, 23 bp, Homo sapiens
ttcaaaaggtgattaaatattta

SEQ ID NO: 350430 - DNA, 11 bp, Homo sapiens
ttcaaaagtgg

SEQ ID NO: 350431 - DNA, 21 bp, Homo sapiens
ttcaaaataaacaataaatgg

SEQ ID NO: 350432 - DNA, 16 bp, Homo sapiens
ttcaaaatacttcttt

SEQ ID NO: 350433 - DNA, 22 bp, Homo sapiens
ttcaaaatagttctatttctat

SEQ ID NO: 350434 - DNA, 19 bp, Homo sapiens
ttcaaaatcagtgatggga

SEQ ID NO: 350435 - DNA, 19 bp, Homo sapiens
ttcaaaatcttcactgaat

SEQ ID NO: 350436 - DNA, 14 bp, Homo sapiens
ttcaaaatgtctgt

SEQ ID NO: 350437 - DNA, 17 bp, Homo sapiens
ttcaaaattaaatctgt

SEQ ID NO: 350438 - DNA, 21 bp, Homo sapiens
ttcaaacagcatcaaaataca

SEQ ID NO: 350439 - DNA, 16 bp, Homo sapiens
ttcaaaccaggatttt

SEQ ID NO: 350440 - DNA, 13 bp, Homo sapiens
ttcaaactttcac

SEQ ID NO: 350441 - DNA, 17 bp, Homo sapiens
ttcaaactttcactttg

SEQ ID NO: 350442 - DNA, 13 bp, Homo sapiens
ttcaaagaatcac

SEQ ID NO: 350443 - DNA, 12 bp, Homo sapiens
ttcaaagctgag

SEQ ID NO: 350444 - DNA, 12 bp, Homo sapiens
ttcaaatgcatg

SEQ ID NO: 350445 - DNA, 16 bp, Homo sapiens
ttcaaatgcatgatat

SEQ ID NO: 350446 - DNA, 23 bp, Homo sapiens
ttcaaatgcatgatattgtatgt

SEQ ID NO: 350447 - DNA, 18 bp, Homo sapiens
ttcaaattcctgcaaaat

SEQ ID NO: 350448 - DNA, 11 bp, Homo sapiens
ttcaacaaatg

SEQ ID NO: 350449 - DNA, 14 bp, Homo sapiens
ttcaacatcaatgt

SEQ ID NO: 350450 - DNA, 16 bp, Homo sapiens
ttcaacatcaatgttc

SEQ ID NO: 350451 - DNA, 19 bp, Homo sapiens
ttcaaccactgtaaaatga

SEQ ID NO: 350452 - DNA, 20 bp, Homo sapiens
ttcaaccattccccatggga

SEQ ID NO: 350453 - DNA, 17 bp, Homo sapiens
ttcaaccctgccctgca

SEQ ID NO: 350454 - DNA, 13 bp, Homo sapiens
ttcaacgcagccc

SEQ ID NO: 350455 - DNA, 19 bp, Homo sapiens
ttcaacgcagccctgcttt

SEQ ID NO: 350456 - DNA, 23 bp, Homo sapiens
ttcaactaatacatggtttaaag

SEQ ID NO: 350457 - DNA, 17 bp, Homo sapiens
ttcaacttaaatcactg

SEQ ID NO: 350458 - DNA, 15 bp, Homo sapiens
ttcaagaacttctcg

SEQ ID NO: 350459 - DNA, 13 bp, Homo sapiens
ttcaagactgaaa

SEQ ID NO: 350460 - DNA, 21 bp, Homo sapiens
ttcaagactgaaatggcttct

SEQ ID NO: 350461 - DNA, 14 bp, Homo sapiens
ttcaagcaaatatt

SEQ ID NO: 350462 - DNA, 18 bp, Homo sapiens
ttcaagcttttcctttct

SEQ ID NO: 350463 - DNA, 21 bp, Homo sapiens
ttcaaggaagtgataacactg

SEQ ID NO: 350464 - DNA, 11 bp, Homo sapiens
ttcaaggccaa

SEQ ID NO: 350465 - DNA, 19 bp, Homo sapiens
ttcaaggtaatttcttgtg

SEQ ID NO: 350466 - DNA, 20 bp, Homo sapiens
ttcaaggtggccaaattatt

SEQ ID NO: 350467 - DNA, 21 bp, Homo sapiens
ttcaagtattaggggtaatat

SEQ ID NO: 350468 - DNA, 16 bp, Homo sapiens
ttcaagtcacctcctt

SEQ ID NO: 350469 - DNA, 21 bp, Homo sapiens
ttcaagtctgtgcctggagct

SEQ ID NO: 350470 - DNA, 21 bp, Homo sapiens
ttcaagtgcctttctgcagtt

SEQ ID NO: 350471 - DNA, 14 bp, Homo sapiens
ttcaagttattgta

SEQ ID NO: 350472 - DNA, 20 bp, Homo sapiens
ttcaagttattgtacagctg

SEQ ID NO: 350473 - DNA, 17 bp, Homo sapiens
ttcaataaaatgcactg

SEQ ID NO: 350474 - DNA, 11 bp, Homo sapiens
ttcaatattta

SEQ ID NO: 350475 - DNA, 16 bp, Homo sapiens
ttcaatccacagtatt

SEQ ID NO: 350476 - DNA, 20 bp, Homo sapiens
ttcaatctcccgctgctgct

SEQ ID NO: 350477 - DNA, 15 bp, Homo sapiens
ttcaatctctggaaa

SEQ ID NO: 350478 - DNA, 18 bp, Homo sapiens
ttcaatctctgttctgct

SEQ ID NO: 350479 - DNA, 16 bp, Homo sapiens
ttcaatgctacaaaat

SEQ ID NO: 350480 - DNA, 19 bp, Homo sapiens
ttcaatggcaccttcattc

SEQ ID NO: 350481 - DNA, 21 bp, Homo sapiens
ttcaatgggagtgaacatttc

SEQ ID NO: 350482 - DNA, 18 bp, Homo sapiens
ttcaattggacaattatt

SEQ ID NO: 350483 - DNA, 19 bp, Homo sapiens
ttcaatttgttcagtcttt

SEQ ID NO: 350484 - DNA, 16 bp, Homo sapiens
ttcacacacagcctgg

SEQ ID NO: 350485 - DNA, 13 bp, Homo sapiens
ttcacacagacaa

SEQ ID NO: 350486 - DNA, 17 bp, Homo sapiens
ttcacacctcacgctct

SEQ ID NO: 350487 - DNA, 16 bp, Homo sapiens
ttcacactgtgcgttt

SEQ ID NO: 350488 - DNA, 22 bp, Homo sapiens
ttcacagcacgggcacagctgc

SEQ ID NO: 350489 - DNA, 23 bp, Homo sapiens
ttcacagctctgtgttgccatgt

SEQ ID NO: 350490 - DNA, 16 bp, Homo sapiens
ttcacaggcagtgcat

SEQ ID NO: 350491 - DNA, 17 bp, Homo sapiens
ttcacaggcagtgcatg

SEQ ID NO: 350492 - DNA, 17 bp, Homo sapiens
ttcacatatttgtagct

SEQ ID NO: 350493 - DNA, 13 bp, Homo sapiens
ttcacatctccca

SEQ ID NO: 350494 - DNA, 15 bp, Homo sapiens
ttcacatctcccatg

SEQ ID NO: 350495 - DNA, 19 bp, Homo sapiens
ttcaccaacaacagtcagc

SEQ ID NO: 350496 - DNA, 20 bp, Homo sapiens
ttcaccaagcttagaagcca

SEQ ID NO: 350497 - DNA, 13 bp, Homo sapiens
ttcaccaccccct

SEQ ID NO: 350498 - DNA, 18 bp, Homo sapiens
ttcaccaccccctgtccc

SEQ ID NO: 350499 - DNA, 22 bp, Homo sapiens
ttcaccaccccctgtcccattc

SEQ ID NO: 350500 - DNA, 12 bp, Homo sapiens
ttcaccaccctg

SEQ ID NO: 350501 - DNA, 12 bp, Homo sapiens
ttcaccagagca

SEQ ID NO: 350502 - DNA, 13 bp, Homo sapiens
ttcaccagtctgt

SEQ ID NO: 350503 - DNA, 20 bp, Homo sapiens
ttcaccagtctgtctactgt

SEQ ID NO: 350504 - DNA, 22 bp, Homo sapiens
ttcaccagtctgtctactgtgg

SEQ ID NO: 350505 - DNA, 12 bp, Homo sapiens
ttcaccatgtaa

SEQ ID NO: 350506 - DNA, 18 bp, Homo sapiens
ttcacccagctaatctgt

SEQ ID NO: 350507 - DNA, 14 bp, Homo sapiens
ttcacccccaactt

SEQ ID NO: 350508 - DNA, 20 bp, Homo sapiens
ttcaccccggcaggccctgc

SEQ ID NO: 350509 - DNA, 17 bp, Homo sapiens
ttcacccctgcacttca

SEQ ID NO: 350510 - DNA, 10 bp, Homo sapiens
ttcacctccg

SEQ ID NO: 350511 - DNA, 18 bp, Homo sapiens
ttcacctctatccaaaga

SEQ ID NO: 350512 - DNA, 18 bp, Homo sapiens
ttcacgccattctcctgc

SEQ ID NO: 350513 - DNA, 17 bp, Homo sapiens
ttcacggactctttgct

SEQ ID NO: 350514 - DNA, 20 bp, Homo sapiens
ttcacgtaagatacaagttt

SEQ ID NO: 350515 - DNA, 23 bp, Homo sapiens
ttcactacccatcggtgtccatt

SEQ ID NO: 350516 - DNA, 18 bp, Homo sapiens
ttcactataaatggtgtt

SEQ ID NO: 350517 - DNA, 18 bp, Homo sapiens
ttcactcagaattattca

SEQ ID NO: 350518 - DNA, 21 bp, Homo sapiens
ttcactgaagtgaatacatgg

SEQ ID NO: 350519 - DNA, 13 bp, Homo sapiens
ttcactgaatatc

SEQ ID NO: 350520 - DNA, 15 bp, Homo sapiens
ttcactgattggaag

SEQ ID NO: 350521 - DNA, 23 bp, Homo sapiens
ttccagaaagcaggagcagctgt

SEQ ID NO: 350522 - DNA, 14 bp, Homo sapiens
ttccagaaattctt

SEQ ID NO: 350523 - DNA, 15 bp, Homo sapiens
ttccagaacagccct

SEQ ID NO: 350524 - DNA, 22 bp, Homo sapiens
ttccagaacagccctcggcctc

SEQ ID NO: 350525 - DNA, 18 bp, Homo sapiens
ttccagaagatgccctcc

SEQ ID NO: 350526 - DNA, 15 bp, Homo sapiens
ttccagaattgagag

SEQ ID NO: 350527 - DNA, 17 bp, Homo sapiens
ttccagacagagtggat

SEQ ID NO: 350528 - DNA, 17 bp, Homo sapiens
ttccagagagtggctcc

SEQ ID NO: 350529 - DNA, 18 bp, Homo sapiens
ttccagagtccggaggca

SEQ ID NO: 350530 - DNA, 24 bp, Homo sapiens
ttccagcaaaatatatgtttggct

SEQ ID NO: 350531 - DNA, 22 bp, Homo sapiens
ttccagcaattctcctgcctca

SEQ ID NO: 350532 - DNA, 16 bp, Homo sapiens
ttccagcagtgaaact

SEQ ID NO: 350533 - DNA, 22 bp, Homo sapiens
ttccagcgggccctctgccgac

SEQ ID NO: 350534 - DNA, 19 bp, Homo sapiens
ttccagctaagcctgatga

SEQ ID NO: 350535 - DNA, 19 bp, Homo sapiens
ttccagctctaataaaaca

SEQ ID NO: 350536 - DNA, 21 bp, Homo sapiens
ttccagctctgcccccgcggg

SEQ ID NO: 350537 - DNA, 12 bp, Homo sapiens
ttccagcttccc

SEQ ID NO: 350538 - DNA, 16 bp, Homo sapiens
ttccaggaagcacagg

SEQ ID NO: 350539 - DNA, 17 bp, Homo sapiens
ttccaggaagcacaggc

SEQ ID NO: 350540 - DNA, 13 bp, Homo sapiens
ttccaggacccct

SEQ ID NO: 350541 - DNA, 18 bp, Homo sapiens
ttccaggcatgaccctgg

SEQ ID NO: 350542 - DNA, 21 bp, Homo sapiens
ttccaggcatgaccctggagc

SEQ ID NO: 350543 - DNA, 13 bp, Homo sapiens
ttccaggcccctg

SEQ ID NO: 350544 - DNA, 17 bp, Homo sapiens
ttccaggcccctgagga

SEQ ID NO: 350545 - DNA, 19 bp, Homo sapiens
ttccaggcttccctgactt

SEQ ID NO: 350546 - DNA, 19 bp, Homo sapiens
ttccagtacctttgtcaca

SEQ ID NO: 350547 - DNA, 14 bp, Homo sapiens
ttccagtattgaaa

SEQ ID NO: 350548 - DNA, 18 bp, Homo sapiens
ttccagtattgaaaactt

SEQ ID NO: 350549 - DNA, 22 bp, Homo sapiens
ttccagtctccaccaggaacct

SEQ ID NO: 350550 - DNA, 17 bp, Homo sapiens
ttccagtggcctggctc

SEQ ID NO: 350551 - DNA, 22 bp, Homo sapiens
ttccagtggcctggctccgctg

SEQ ID NO: 350552 - DNA, 21 bp, Homo sapiens
ttccagttgcgtgtctgtttc

SEQ ID NO: 350553 - DNA, 23 bp, Homo sapiens
ttccagttggactgtggcctcag

SEQ ID NO: 350554 - DNA, 24 bp, Homo sapiens
ttccagttggactgtggcctcagg

SEQ ID NO: 350555 - DNA, 12 bp, Homo sapiens
ttccagtttttt

SEQ ID NO: 350556 - DNA, 18 bp, Homo sapiens
ttccagttttttgccact

SEQ ID NO: 350557 - DNA, 21 bp, Homo sapiens
ttccagttttttgccactgca

SEQ ID NO: 350558 - DNA, 23 bp, Homo sapiens
ttccagttttttgccactgcaaa

SEQ ID NO: 350559 - DNA, 17 bp, Homo sapiens
ttccataaggaatgtag

SEQ ID NO: 350560 - DNA, 19 bp, Homo sapiens
ttccataaggaatgtagct

SEQ ID NO: 350561 - DNA, 12 bp, Homo sapiens
ttccataattat

SEQ ID NO: 350562 - DNA, 18 bp, Homo sapiens
ttccataggacatactgc

SEQ ID NO: 350563 - DNA, 22 bp, Homo sapiens
ttccataggacatactgcatgt

SEQ ID NO: 350564 - DNA, 16 bp, Homo sapiens
ttccatcacagccagc

SEQ ID NO: 350565 - DNA, 17 bp, Homo sapiens
ttccatcacagccagcc

SEQ ID NO: 350566 - DNA, 15 bp, Homo sapiens
ttccatcagcagtga

SEQ ID NO: 350567 - DNA, 19 bp, Homo sapiens
ttccatcaggttccatccc

SEQ ID NO: 350568 - DNA, 15 bp, Homo sapiens
ttccatcatttctgt

SEQ ID NO: 350569 - DNA, 12 bp, Homo sapiens
ttccatccctaa

SEQ ID NO: 350570 - DNA, 20 bp, Homo sapiens
ttccatccctaagaattccc

SEQ ID NO: 350571 - DNA, 22 bp, Homo sapiens
ttccatccctaagaattcccag

SEQ ID NO: 350572 - DNA, 17 bp, Homo sapiens
ttccatccttgactgaa

SEQ ID NO: 350573 - DNA, 13 bp, Homo sapiens
ttccatgaaaacg

SEQ ID NO: 350574 - DNA, 15 bp, Homo sapiens
ttccatgaaaacgtt

SEQ ID NO: 350575 - DNA, 14 bp, Homo sapiens
ttccatgcagttat

SEQ ID NO: 350576 - DNA, 18 bp, Homo sapiens
ttccatggcttcctgaga

SEQ ID NO: 350577 - DNA, 16 bp, Homo sapiens
ttccatgtcgcctctg

SEQ ID NO: 350578 - DNA, 17 bp, Homo sapiens
ttccatgtcgcctctgc

SEQ ID NO: 350579 - DNA, 16 bp, Homo sapiens
ttccatgtgcccagtt

SEQ ID NO: 350580 - DNA, 15 bp, Homo sapiens
ttccattatgattct

SEQ ID NO: 350581 - DNA, 16 bp, Homo sapiens
ttccattatgattctt

SEQ ID NO: 350582 - DNA, 19 bp, Homo sapiens
ttccattcttttaaatggg

SEQ ID NO: 350583 - DNA, 17 bp, Homo sapiens
ttccattgctcccagtg

SEQ ID NO: 350584 - DNA, 12 bp, Homo sapiens
ttccatttctga

SEQ ID NO: 350585 - DNA, 14 bp, Homo sapiens
ttccatttctgatg

SEQ ID NO: 350586 - DNA, 19 bp, Homo sapiens
ttccatttttactaaagca

SEQ ID NO: 350587 - DNA, 23 bp, Homo sapiens
ttcccaaagcagtgcatgctgtc

SEQ ID NO: 350588 - DNA, 14 bp, Homo sapiens
ttcccaacagcctt

SEQ ID NO: 350589 - DNA, 15 bp, Homo sapiens
ttcccaactcactgt

SEQ ID NO: 350590 - DNA, 17 bp, Homo sapiens
ttcccaactttggaaaa

SEQ ID NO: 350591 - DNA, 14 bp, Homo sapiens
ttcccaataaaagt

SEQ ID NO: 350592 - DNA, 15 bp, Homo sapiens
ttcccaataaaagtg

SEQ ID NO: 350593 - DNA, 14 bp, Homo sapiens
ttcccaccagctcc

SEQ ID NO: 350594 - DNA, 12 bp, Homo sapiens
ttcccaccccta

SEQ ID NO: 350595 - DNA, 19 bp, Homo sapiens
ttcccactaagctttctcc

SEQ ID NO: 350596 - DNA, 14 bp, Homo sapiens
ttcccactgcactt

SEQ ID NO: 350597 - DNA, 14 bp, Homo sapiens
ttcccactgtcctt

SEQ ID NO: 350598 - DNA, 16 bp, Homo sapiens
ttcccagcacaggcag

SEQ ID NO: 350599 - DNA, 17 bp, Homo sapiens
ttcccagcacaggcagg

SEQ ID NO: 350600 - DNA, 16 bp, Homo sapiens
ttcccagccctttcca

SEQ ID NO: 350601 - DNA, 15 bp, Homo sapiens
ttcccaggcagggag

SEQ ID NO: 350602 - DNA, 13 bp, Homo sapiens
ttcccaggccagc

SEQ ID NO: 350603 - DNA, 15 bp, Homo sapiens
ttcccaggccagcga

SEQ ID NO: 350604 - DNA, 23 bp, Homo sapiens
ttcccagtgacacttcagagagc

SEQ ID NO: 350605 - DNA, 15 bp, Homo sapiens
ttcccataattttct

SEQ ID NO: 350606 - DNA, 14 bp, Homo sapiens
ttcccatcaccaga

SEQ ID NO: 350607 - DNA, 18 bp, Homo sapiens
ttcccatcaccccttccc

SEQ ID NO: 350608 - DNA, 13 bp, Homo sapiens
ttcccatccctga

SEQ ID NO: 350609 - DNA, 22 bp, Homo sapiens
ttcccatccctgaaacattgca

SEQ ID NO: 350610 - DNA, 15 bp, Homo sapiens
ttcccatgactgcac

SEQ ID NO: 350611 - DNA, 19 bp, Homo sapiens
ttcccatggtagactgtga

SEQ ID NO: 350612 - DNA, 14 bp, Homo sapiens
ttcccattcttgca

SEQ ID NO: 350613 - DNA, 18 bp, Homo sapiens
ttcccattgaaaatgtaa

SEQ ID NO: 350614 - DNA, 18 bp, Homo sapiens
ttcccatttctctacact

SEQ ID NO: 350615 - DNA, 14 bp, Homo sapiens
ttcccatttgtaat

SEQ ID NO: 350616 - DNA, 18 bp, Homo sapiens
ttcccatttgtaatgtat

SEQ ID NO: 350617 - DNA, 21 bp, Homo sapiens
ttccccaccagtgaatgaaag

SEQ ID NO: 350618 - DNA, 14 bp, Homo sapiens
ttccccactgcctg

SEQ ID NO: 350619 - DNA, 21 bp, Homo sapiens
ttccccagaccgatccttccc

SEQ ID NO: 350620 - DNA, 20 bp, Homo sapiens
ttccccagaggctcccaatc

SEQ ID NO: 350621 - DNA, 24 bp, Homo sapiens
ttccccagaggctcccaatcagct

SEQ ID NO: 350622 - DNA, 19 bp, Homo sapiens
ttccccagggttctgtatt

SEQ ID NO: 350623 - DNA, 16 bp, Homo sapiens
ttccccatactctgtc

SEQ ID NO: 350624 - DNA, 12 bp, Homo sapiens
ttccccatcccg

SEQ ID NO: 350625 - DNA, 17 bp, Homo sapiens
ttcccccaacctcagac

SEQ ID NO: 350626 - DNA, 12 bp, Homo sapiens
ttcccccagccc

SEQ ID NO: 350627 - DNA, 14 bp, Homo sapiens
ttcccccagcccaa

SEQ ID NO: 350628 - DNA, 14 bp, Homo sapiens
ttcccccagccctg

SEQ ID NO: 350629 - DNA, 19 bp, Homo sapiens
ttcccccaggcgcctgcgc

SEQ ID NO: 350630 - DNA, 18 bp, Homo sapiens
ttccccccactctcccca

SEQ ID NO: 350631 - DNA, 19 bp, Homo sapiens
ttccccccactctccccac

SEQ ID NO: 350632 - DNA, 11 bp, Homo sapiens
ttcccccttcc

SEQ ID NO: 350633 - DNA, 12 bp, Homo sapiens
ttcccccttccc

SEQ ID NO: 350634 - DNA, 16 bp, Homo sapiens
ttcccccttcccctgc

SEQ ID NO: 350635 - DNA, 17 bp, Homo sapiens
ttcccccttcccctgcg

SEQ ID NO: 350636 - DNA, 20 bp, Homo sapiens
ttccccggagctgggaaggt

SEQ ID NO: 350637 - DNA, 18 bp, Homo sapiens
ttcccctatcctgttctt

SEQ ID NO: 350638 - DNA, 19 bp, Homo sapiens
ttcccctcactggatgaaa

SEQ ID NO: 350639 - DNA, 12 bp, Homo sapiens
ttcccctcattg

SEQ ID NO: 350640 - DNA, 15 bp, Homo sapiens
ttcccctcccacctc

SEQ ID NO: 350641 - DNA, 13 bp, Homo sapiens
ttcccctccctgg

SEQ ID NO: 350642 - DNA, 16 bp, Homo sapiens
ttcccctccctggctc

SEQ ID NO: 350643 - DNA, 20 bp, Homo sapiens
ttcccctgcgccctccctcc

SEQ ID NO: 350644 - DNA, 21 bp, Homo sapiens
ttcccctgcgccctccctccc

SEQ ID NO: 350645 - DNA, 17 bp, Homo sapiens
ttcccctgttcactcta

SEQ ID NO: 350646 - DNA, 22 bp, Homo sapiens
ttcccgagcaaagtctaaagtt

SEQ ID NO: 350647 - DNA, 13 bp, Homo sapiens
ttcccgcagcacc

SEQ ID NO: 350648 - DNA, 19 bp, Homo sapiens
ttcccgcagcaccagcctg

SEQ ID NO: 350649 - DNA, 17 bp, Homo sapiens
ttcccgcctcagcctct

SEQ ID NO: 350650 - DNA, 18 bp, Homo sapiens
ttcccggagcacagccct

SEQ ID NO: 350651 - DNA, 17 bp, Homo sapiens
ttcccgggcccttcagt

SEQ ID NO: 350652 - DNA, 19 bp, Homo sapiens
ttccctaaaatacatttaa

SEQ ID NO: 350653 - DNA, 15 bp, Homo sapiens
ttccctacccacagg

SEQ ID NO: 350654 - DNA, 17 bp, Homo sapiens
ttccctacccacagggc

SEQ ID NO: 350655 - DNA, 13 bp, Homo sapiens
ttccctacctcag

SEQ ID NO: 350656 - DNA, 18 bp, Homo sapiens
ttccctactaacatccca

SEQ ID NO: 350657 - DNA, 17 bp, Homo sapiens
ttccctacttcctgtga

SEQ ID NO: 350658 - DNA, 23 bp, Homo sapiens
ttccctagaaagccatattccag

SEQ ID NO: 350659 - DNA, 15 bp, Homo sapiens
ttccctagactctgt

SEQ ID NO: 350660 - DNA, 16 bp, Homo sapiens
ttccctagactctgta

SEQ ID NO: 350661 - DNA, 18 bp, Homo sapiens
ttccctagggctgggtgt

SEQ ID NO: 350662 - DNA, 14 bp, Homo sapiens
ttccctagttcttt

SEQ ID NO: 350663 - DNA, 13 bp, Homo sapiens
ttccctatctttt

SEQ ID NO: 350664 - DNA, 18 bp, Homo sapiens
ttccctcactcttcctca

SEQ ID NO: 350665 - DNA, 11 bp, Homo sapiens
ttccctcaggc

SEQ ID NO: 350666 - DNA, 23 bp, Homo sapiens
ttccctccgggcaggggagccag

SEQ ID NO: 350667 - DNA, 13 bp, Homo sapiens
ttccctcctgaca

SEQ ID NO: 350668 - DNA, 13 bp, Homo sapiens
ttccctctgcctg

SEQ ID NO: 350669 - DNA, 14 bp, Homo sapiens
ttccctctgcctgt

SEQ ID NO: 350670 - DNA, 18 bp, Homo sapiens
ttccctctgcctgtccct

SEQ ID NO: 350671 - DNA, 17 bp, Homo sapiens
ttccctgacttgcttta

SEQ ID NO: 350672 - DNA, 16 bp, Homo sapiens
ttccctgcaccctgga

SEQ ID NO: 350673 - DNA, 23 bp, Homo sapiens
ttccctgcatcccttggcccctc

SEQ ID NO: 350674 - DNA, 22 bp, Homo sapiens
ttccctgcctaggagctgggga

SEQ ID NO: 350675 - DNA, 18 bp, Homo sapiens
ttccctgctggccaaagt

SEQ ID NO: 350676 - DNA, 21 bp, Homo sapiens
ttccctgctggccaaagtcag

SEQ ID NO: 350677 - DNA, 22 bp, Homo sapiens
ttccctgctgtcgtcttagcaa

SEQ ID NO: 350678 - DNA, 19 bp, Homo sapiens
ttccctggaccagatgctg

SEQ ID NO: 350679 - DNA, 20 bp, Homo sapiens
ttccctggagaccccagagt

SEQ ID NO: 350680 - DNA, 11 bp, Homo sapiens
ttccctggctc

SEQ ID NO: 350681 - DNA, 14 bp, Homo sapiens
ttccctggctcagg

SEQ ID NO: 350682 - DNA, 15 bp, Homo sapiens
ttccctggctcaggg

SEQ ID NO: 350683 - DNA, 14 bp, Homo sapiens
ttccctgggaaggc

SEQ ID NO: 350684 - DNA, 16 bp, Homo sapiens
ttccctgtcagaggct

SEQ ID NO: 350685 - DNA, 16 bp, Homo sapiens
ttccctgtgtggacca

SEQ ID NO: 350686 - DNA, 12 bp, Homo sapiens
ttccctgttctt

SEQ ID NO: 350687 - DNA, 14 bp, Homo sapiens
ttctattgtttctt

SEQ ID NO: 350688 - DNA, 19 bp, Homo sapiens
ttctcaaagatctgaatta

SEQ ID NO: 350689 - DNA, 12 bp, Homo sapiens
ttctcaaagcag

SEQ ID NO: 350690 - DNA, 23 bp, Homo sapiens
ttctcaaagtttttacagtgtat

SEQ ID NO: 350691 - DNA, 16 bp, Homo sapiens
ttctcaaatgctactc

SEQ ID NO: 350692 - DNA, 18 bp, Homo sapiens
ttctcaagcactgacact

SEQ ID NO: 350693 - DNA, 22 bp, Homo sapiens
ttctcaagcgctatccacagaa

SEQ ID NO: 350694 - DNA, 11 bp, Homo sapiens
ttctcaagtgc

SEQ ID NO: 350695 - DNA, 12 bp, Homo sapiens
ttctcacagcac

SEQ ID NO: 350696 - DNA, 21 bp, Homo sapiens
ttctcacagcacatgctggcc

SEQ ID NO: 350697 - DNA, 16 bp, Homo sapiens
ttctcactatgtttct

SEQ ID NO: 350698 - DNA, 18 bp, Homo sapiens
ttctcactcctacctggt

SEQ ID NO: 350699 - DNA, 18 bp, Homo sapiens
ttctcactgttccctctg

SEQ ID NO: 350700 - DNA, 15 bp, Homo sapiens
ttctcagactggtct

SEQ ID NO: 350701 - DNA, 16 bp, Homo sapiens
ttctcagagcatgtgt

SEQ ID NO: 350702 - DNA, 20 bp, Homo sapiens
ttctcagagctccacagaag

SEQ ID NO: 350703 - DNA, 21 bp, Homo sapiens
ttctcagagctccacagaaga

SEQ ID NO: 350704 - DNA, 13 bp, Homo sapiens
ttctcagatattt

SEQ ID NO: 350705 - DNA, 19 bp, Homo sapiens
ttctcagcaagtgtacagt

SEQ ID NO: 350706 - DNA, 16 bp, Homo sapiens
ttctcagctccactct

SEQ ID NO: 350707 - DNA, 17 bp, Homo sapiens
ttctcagggggtcagca

SEQ ID NO: 350708 - DNA, 16 bp, Homo sapiens
ttctcaggtgttgcca

SEQ ID NO: 350709 - DNA, 13 bp, Homo sapiens
ttctcatagcatt

SEQ ID NO: 350710 - DNA, 17 bp, Homo sapiens
ttctcatagcattaact

SEQ ID NO: 350711 - DNA, 17 bp, Homo sapiens
ttctcatagccccggtg

SEQ ID NO: 350712 - DNA, 17 bp, Homo sapiens
ttctcatgcactgcaaa

SEQ ID NO: 350713 - DNA, 14 bp, Homo sapiens
ttctcatggatttg

SEQ ID NO: 350714 - DNA, 16 bp, Homo sapiens
ttctcatgtgctttgt

SEQ ID NO: 350715 - DNA, 22 bp, Homo sapiens
ttctcatgtgctttgtagctta

SEQ ID NO: 350716 - DNA, 14 bp, Homo sapiens
ttctccaaatgaga

SEQ ID NO: 350717 - DNA, 18 bp, Homo sapiens
ttctccagaatgtaagaa

SEQ ID NO: 350718 - DNA, 16 bp, Homo sapiens
ttctcccctccaagtg

SEQ ID NO: 350719 - DNA, 16 bp, Homo sapiens
ttctcccctccagacc

SEQ ID NO: 350720 - DNA, 15 bp, Homo sapiens
ttctcccctgcactg

SEQ ID NO: 350721 - DNA, 15 bp, Homo sapiens
ttctccctccatggc

SEQ ID NO: 350722 - DNA, 23 bp, Homo sapiens
ttctccctggttttaccccagct

SEQ ID NO: 350723 - DNA, 17 bp, Homo sapiens
ttctccggggtctgtgc

SEQ ID NO: 350724 - DNA, 20 bp, Homo sapiens
ttctccggggtctgtgctgt

SEQ ID NO: 350725 - DNA, 13 bp, Homo sapiens
ttctcctccaaat

SEQ ID NO: 350726 - DNA, 17 bp, Homo sapiens
ttctcctccaaatgctg

SEQ ID NO: 350727 - DNA, 11 bp, Homo sapiens
ttctcctcccc

SEQ ID NO: 350728 - DNA, 17 bp, Homo sapiens
ttctcctctttctcagt

SEQ ID NO: 350729 - DNA, 17 bp, Homo sapiens
ttctcctgcctcagcct

SEQ ID NO: 350730 - DNA, 12 bp, Homo sapiens
ttctcctgtgcc

SEQ ID NO: 350731 - DNA, 12 bp, Homo sapiens
ttctcctgtgct

SEQ ID NO: 350732 - DNA, 20 bp, Homo sapiens
ttctccttagtcttctcata

SEQ ID NO: 350733 - DNA, 17 bp, Homo sapiens
ttctccttctccttccc

SEQ ID NO: 350734 - DNA, 17 bp, Homo sapiens
ttctcctttcacaacct

SEQ ID NO: 350735 - DNA, 22 bp, Homo sapiens
ttctcctttcacaaccttctgt

SEQ ID NO: 350736 - DNA, 19 bp, Homo sapiens
ttctcgtagatgctgccta

SEQ ID NO: 350737 - DNA, 18 bp, Homo sapiens
ttctcgtcttcctctctc

SEQ ID NO: 350738 - DNA, 22 bp, Homo sapiens
ttctcgtcttcctctctctcac

SEQ ID NO: 350739 - DNA, 13 bp, Homo sapiens
ttctcgtgaccca

SEQ ID NO: 350740 - DNA, 23 bp, Homo sapiens
ttctctaaatgaggggcctcagg

SEQ ID NO: 350741 - DNA, 18 bp, Homo sapiens
ttctctactcatgccaga

SEQ ID NO: 350742 - DNA, 20 bp, Homo sapiens
ttctctcaatttgggtccca

SEQ ID NO: 350743 - DNA, 20 bp, Homo sapiens
ttctctcagccttacatttg

SEQ ID NO: 350744 - DNA, 17 bp, Homo sapiens
ttctctccacttctggt

SEQ ID NO: 350745 - DNA, 18 bp, Homo sapiens
ttctctccccttgcactg

SEQ ID NO: 350746 - DNA, 21 bp, Homo sapiens
ttctctcccttcctctctcct

SEQ ID NO: 350747 - DNA, 20 bp, Homo sapiens
ttctctcctgattatttatc

SEQ ID NO: 350748 - DNA, 15 bp, Homo sapiens
ttctctcctgtgagc

SEQ ID NO: 350749 - DNA, 16 bp, Homo sapiens
ttctctctaaaaataa

SEQ ID NO: 350750 - DNA, 23 bp, Homo sapiens
ttctctctaaaaataaaatgatg

SEQ ID NO: 350751 - DNA, 20 bp, Homo sapiens
ttctctctatggtaaagata

SEQ ID NO: 350752 - DNA, 21 bp, Homo sapiens
ttctctctctctcaaaattat

SEQ ID NO: 350753 - DNA, 14 bp, Homo sapiens
ttctctctgtgtgg

SEQ ID NO: 350754 - DNA, 19 bp, Homo sapiens
ttctctcttcaatctctgg

SEQ ID NO: 350755 - DNA, 13 bp, Homo sapiens
ttctctcttctct

SEQ ID NO: 350756 - DNA, 12 bp, Homo sapiens
ttctctcttggt

SEQ ID NO: 350757 - DNA, 13 bp, Homo sapiens
ttctctgccagtg

SEQ ID NO: 350758 - DNA, 16 bp, Homo sapiens
ttctctgcgagcaaca

SEQ ID NO: 350759 - DNA, 14 bp, Homo sapiens
ttctctgctccacc

SEQ ID NO: 350760 - DNA, 12 bp, Homo sapiens
ttctctgcttca

SEQ ID NO: 350761 - DNA, 21 bp, Homo sapiens
ttctctgggtaggtgttgaaa

SEQ ID NO: 350762 - DNA, 17 bp, Homo sapiens
ttctctgtagggaactc

SEQ ID NO: 350763 - DNA, 12 bp, Homo sapiens
ttctctgtccag

SEQ ID NO: 350764 - DNA, 16 bp, Homo sapiens
ttctctgtccagggct

SEQ ID NO: 350765 - DNA, 15 bp, Homo sapiens
ttctctgtgctctga

SEQ ID NO: 350766 - DNA, 18 bp, Homo sapiens
ttctctgtgtttgttcct

SEQ ID NO: 350767 - DNA, 18 bp, Homo sapiens
ttctcttacgctctctgt

SEQ ID NO: 350768 - DNA, 18 bp, Homo sapiens
ttctcttctacttcttgt

SEQ ID NO: 350769 - DNA, 17 bp, Homo sapiens
ttctcttctatcctgca

SEQ ID NO: 350770 - DNA, 15 bp, Homo sapiens
ttctcttctgtccat

SEQ ID NO: 350771 - DNA, 18 bp, Homo sapiens
ttctcttgagtcacactg

SEQ ID NO: 350772 - DNA, 14 bp, Homo sapiens
ttctctttctctcc

SEQ ID NO: 350773 - DNA, 14 bp, Homo sapiens
ttctgaaaactgtt

SEQ ID NO: 350774 - DNA, 15 bp, Homo sapiens
ttctgaaaactgttt

SEQ ID NO: 350775 - DNA, 17 bp, Homo sapiens
ttctgaaaactgtttat

SEQ ID NO: 350776 - DNA, 22 bp, Homo sapiens
ttctgaactccatacagcctct

SEQ ID NO: 350777 - DNA, 16 bp, Homo sapiens
ttctgaataacttgaa

SEQ ID NO: 350778 - DNA, 17 bp, Homo sapiens
ttctgaattcataaaaa

SEQ ID NO: 350779 - DNA, 22 bp, Homo sapiens
ttctgacaaaaagtttccatat

SEQ ID NO: 350780 - DNA, 13 bp, Homo sapiens
ttctgacacttgt

SEQ ID NO: 350781 - DNA, 16 bp, Homo sapiens
ttctgacacttgtggt

SEQ ID NO: 350782 - DNA, 15 bp, Homo sapiens
ttctgacattaacag

SEQ ID NO: 350783 - DNA, 14 bp, Homo sapiens
ttctgaccccactt

SEQ ID NO: 350784 - DNA, 14 bp, Homo sapiens
ttctgacctcagca

SEQ ID NO: 350785 - DNA, 15 bp, Homo sapiens
ttctgacctcagcat

SEQ ID NO: 350786 - DNA, 13 bp, Homo sapiens
ttctgacggccct

SEQ ID NO: 350787 - DNA, 22 bp, Homo sapiens
ttctgagcacgggcaaagaaaa

SEQ ID NO: 350788 - DNA, 21 bp, Homo sapiens
ttctgagcccccacctgcctg

SEQ ID NO: 350789 - DNA, 20 bp, Homo sapiens
ttctgataagactggaaaat

SEQ ID NO: 350790 - DNA, 21 bp, Homo sapiens
ttctgatgtctctaaagcact

SEQ ID NO: 350791 - DNA, 15 bp, Homo sapiens
ttctgcaaatagaaa

SEQ ID NO: 350792 - DNA, 20 bp, Homo sapiens
ttctgcaactagccaaggct

SEQ ID NO: 350793 - DNA, 17 bp, Homo sapiens
ttctgcaactcatgaac

SEQ ID NO: 350794 - DNA, 13 bp, Homo sapiens
ttctgcagaggca

SEQ ID NO: 350795 - DNA, 15 bp, Homo sapiens
ttctgcagaggcagc

SEQ ID NO: 350796 - DNA, 20 bp, Homo sapiens
ttctgcagcatgacctgtga

SEQ ID NO: 350797 - DNA, 21 bp, Homo sapiens
ttctgcagcatgacctgtgac

SEQ ID NO: 350798 - DNA, 20 bp, Homo sapiens
ttctgcagcccttgggcagt

SEQ ID NO: 350799 - DNA, 16 bp, Homo sapiens
ttctgcagctgtttta

SEQ ID NO: 350800 - DNA, 18 bp, Homo sapiens
ttctgcatgcttagagca

SEQ ID NO: 350801 - DNA, 14 bp, Homo sapiens
ttctgccacttgca

SEQ ID NO: 350802 - DNA, 18 bp, Homo sapiens
ttctgccacttgcactgt

SEQ ID NO: 350803 - DNA, 17 bp, Homo sapiens
ttctgccaggtttgtta

SEQ ID NO: 350804 - DNA, 20 bp, Homo sapiens
ttctgcccccgttccagctg

SEQ ID NO: 350805 - DNA, 15 bp, Homo sapiens
ttctgccctgcccac

SEQ ID NO: 350806 - DNA, 14 bp, Homo sapiens
ttctgcctgcctgg

SEQ ID NO: 350807 - DNA, 17 bp, Homo sapiens
ttctgctcacattccct

SEQ ID NO: 350808 - DNA, 13 bp, Homo sapiens
ttctgctccaccc

SEQ ID NO: 350809 - DNA, 16 bp, Homo sapiens
ttctgctccacccttg

SEQ ID NO: 350810 - DNA, 17 bp, Homo sapiens
ttctgctccacccttgg

SEQ ID NO: 350811 - DNA, 15 bp, Homo sapiens
ttctgctgcccccag

SEQ ID NO: 350812 - DNA, 21 bp, Homo sapiens
ttctgctggataaaatgaggt

SEQ ID NO: 350813 - DNA, 16 bp, Homo sapiens
ttctgcttcaataaat

SEQ ID NO: 350814 - DNA, 19 bp, Homo sapiens
ttctgcttcaataaatctt

SEQ ID NO: 350815 - DNA, 13 bp, Homo sapiens
ttctgctttctat

SEQ ID NO: 350816 - DNA, 22 bp, Homo sapiens
ttctggaatgtaatcaatgttt

SEQ ID NO: 350817 - DNA, 15 bp, Homo sapiens
ttctggactctgccc

SEQ ID NO: 350818 - DNA, 17 bp, Homo sapiens
ttctggactctgcccca

SEQ ID NO: 350819 - DNA, 20 bp, Homo sapiens
ttctggcctgccttcgttaa

SEQ ID NO: 350820 - DNA, 13 bp, Homo sapiens
ttctggctcctgt

SEQ ID NO: 350821 - DNA, 14 bp, Homo sapiens
ttctggctgaaaat

SEQ ID NO: 350822 - DNA, 16 bp, Homo sapiens
ttctggctttgttctt

SEQ ID NO: 350823 - DNA, 13 bp, Homo sapiens
ttctgggaaaggt

SEQ ID NO: 350824 - DNA, 18 bp, Homo sapiens
ttctgggaaaggtgctca

SEQ ID NO: 350825 - DNA, 19 bp, Homo sapiens
ttctgggaaaggtgctcaa

SEQ ID NO: 350826 - DNA, 13 bp, Homo sapiens
ttctgggaagaaa

SEQ ID NO: 350827 - DNA, 19 bp, Homo sapiens
ttctgggaagcttgagcct

SEQ ID NO: 350828 - DNA, 14 bp, Homo sapiens
ttctgggacttgaa

SEQ ID NO: 350829 - DNA, 11 bp, Homo sapiens
ttctgggcaga

SEQ ID NO: 350830 - DNA, 16 bp, Homo sapiens
ttctgggcagagcctg

SEQ ID NO: 350831 - DNA, 19 bp, Homo sapiens
ttctgggcagctaaaagca

SEQ ID NO: 350832 - DNA, 23 bp, Homo sapiens
ttctgggcctgatggagaggaga

SEQ ID NO: 350833 - DNA, 23 bp, Homo sapiens
ttctgggggatttcaagggactg

SEQ ID NO: 350834 - DNA, 16 bp, Homo sapiens
ttctggggtggggctt

SEQ ID NO: 350835 - DNA, 18 bp, Homo sapiens
ttctggtaacctgtggtg

SEQ ID NO: 350836 - DNA, 18 bp, Homo sapiens
ttctggtactctcctaga

SEQ ID NO: 350837 - DNA, 20 bp, Homo sapiens
ttctggtaggaatagcatgt

SEQ ID NO: 350838 - DNA, 15 bp, Homo sapiens
ttctggtaggttctg

SEQ ID NO: 350839 - DNA, 18 bp, Homo sapiens
ttctggtcccctgtggtg

SEQ ID NO: 350840 - DNA, 21 bp, Homo sapiens
ttctggtggccccagctgtga

SEQ ID NO: 350841 - DNA, 16 bp, Homo sapiens
ttctggtgttacacat

SEQ ID NO: 350842 - DNA, 18 bp, Homo sapiens
ttctggtgttacacatac

SEQ ID NO: 350843 - DNA, 15 bp, Homo sapiens
ttctggttagctcag

SEQ ID NO: 350844 - DNA, 21 bp, Homo sapiens
ttctgtaaacctaatgtctgt

SEQ ID NO: 350845 - DNA, 23 bp, Homo sapiens
ttctgtaaactcaaaacttaaca

SEQ ID NO: 350846 - DNA, 16 bp, Homo sapiens
ttctgtagctattctt

SEQ ID NO: 350847 - DNA, 14 bp, Homo sapiens
ttctgtaggagaga

SEQ ID NO: 350848 - DNA, 16 bp, Homo sapiens
ttctgtaggttctgtg

SEQ ID NO: 350849 - DNA, 14 bp, Homo sapiens
ttctgtcaatgaaa

SEQ ID NO: 350850 - DNA, 17 bp, Homo sapiens
ttctgtccatcagtgca

SEQ ID NO: 350851 - DNA, 13 bp, Homo sapiens
ttctgtccccagc

SEQ ID NO: 350852 - DNA, 22 bp, Homo sapiens
ttctgtccttttggcactgaga

SEQ ID NO: 350853 - DNA, 13 bp, Homo sapiens
ttctgtctctctc

SEQ ID NO: 350854 - DNA, 17 bp, Homo sapiens
ttctgtctctctctctt

SEQ ID NO: 350855 - DNA, 16 bp, Homo sapiens
ttctgtgaagcccttt

SEQ ID NO: 350856 - DNA, 19 bp, Homo sapiens
ttctgtgagacccccacac

SEQ ID NO: 350857 - DNA, 15 bp, Homo sapiens
ttctgtgcactgtag

SEQ ID NO: 350858 - DNA, 11 bp, Homo sapiens
ttctgtgcctc

SEQ ID NO: 350859 - DNA, 16 bp, Homo sapiens
ttctgtgcctcccccc

SEQ ID NO: 350860 - DNA, 17 bp, Homo sapiens
ttctgtggaaaacaatt

SEQ ID NO: 350861 - DNA, 19 bp, Homo sapiens
ttctgtggagagtgagaat

SEQ ID NO: 350862 - DNA, 19 bp, Homo sapiens
ttctgtgggcttggccttg

SEQ ID NO: 350863 - DNA, 18 bp, Homo sapiens
ttctgtggttttcccctc

SEQ ID NO: 350864 - DNA, 22 bp, Homo sapiens
ttctgtggttttcccctccctg

SEQ ID NO: 350865 - DNA, 23 bp, Homo sapiens
ttctgtggttttcccctccctgg

SEQ ID NO: 350866 - DNA, 16 bp, Homo sapiens
ttctgtgtctgctgta

SEQ ID NO: 350867 - DNA, 19 bp, Homo sapiens
ttctgttaatagtcccggc

SEQ ID NO: 350868 - DNA, 13 bp, Homo sapiens
ttctgttctgata

SEQ ID NO: 350869 - DNA, 19 bp, Homo sapiens
ttctgttgtgtttgtcaaa

SEQ ID NO: 350870 - DNA, 13 bp, Homo sapiens
ttctgttgtttct

SEQ ID NO: 350871 - DNA, 21 bp, Homo sapiens
ttctgtttctaatttgctgct

SEQ ID NO: 350872 - DNA, 12 bp, Homo sapiens
ttctgtttctca

SEQ ID NO: 350873 - DNA, 17 bp, Homo sapiens
ttctgtttcttcttgtg

SEQ ID NO: 350874 - DNA, 15 bp, Homo sapiens
ttctgtttctttttc

SEQ ID NO: 350875 - DNA, 11 bp, Homo sapiens
ttctgtttgaa

SEQ ID NO: 350876 - DNA, 12 bp, Homo sapiens
ttctgttttgtt

SEQ ID NO: 350877 - DNA, 13 bp, Homo sapiens
ttctgtttttctc

SEQ ID NO: 350878 - DNA, 18 bp, Homo sapiens
ttctgtttttctcaaata

SEQ ID NO: 350879 - DNA, 19 bp, Homo sapiens
ttctgtttttctcaaataa

SEQ ID NO: 350880 - DNA, 22 bp, Homo sapiens
ttctgttttttttttttgtatt

SEQ ID NO: 350881 - DNA, 23 bp, Homo sapiens
ttctgttttttttttttgtattt

SEQ ID NO: 350882 - DNA, 16 bp, Homo sapiens
ttcttaaaggcctgga

SEQ ID NO: 350883 - DNA, 19 bp, Homo sapiens
ttcttaaaggcctggaacc

SEQ ID NO: 350884 - DNA, 13 bp, Homo sapiens
ttcttaaatggaa

SEQ ID NO: 350885 - DNA, 20 bp, Homo sapiens
ttcttaaatggaattatttt

SEQ ID NO: 350886 - DNA, 13 bp, Homo sapiens
ttcttaacaaccg

SEQ ID NO: 350887 - DNA, 15 bp, Homo sapiens
ttcttaagcactttg

SEQ ID NO: 350888 - DNA, 19 bp, Homo sapiens
ttcttaagcactttgaaaa

SEQ ID NO: 350889 - DNA, 23 bp, Homo sapiens
ttcttaagcactttgaaaatatt

SEQ ID NO: 350890 - DNA, 20 bp, Homo sapiens
ttcttaatatcactttggtc

SEQ ID NO: 350891 - DNA, 15 bp, Homo sapiens
ttcttacctcatttg

SEQ ID NO: 350892 - DNA, 18 bp, Homo sapiens
ttcttactaaacattttg

SEQ ID NO: 350893 - DNA, 13 bp, Homo sapiens
ttcttactgcttg

SEQ ID NO: 350894 - DNA, 22 bp, Homo sapiens
ttcttagagcagattctagcac

SEQ ID NO: 350895 - DNA, 13 bp, Homo sapiens
ttcttagttctca

SEQ ID NO: 350896 - DNA, 21 bp, Homo sapiens
ttcttagtttcagaagtactg

SEQ ID NO: 350897 - DNA, 17 bp, Homo sapiens
ttcttattactattatt

SEQ ID NO: 350898 - DNA, 22 bp, Homo sapiens
ttcttatttcccctttccaatt

SEQ ID NO: 350899 - DNA, 14 bp, Homo sapiens
ttcttatttgaaag

SEQ ID NO: 350900 - DNA, 22 bp, Homo sapiens
ttcttatttttcctaacaaaag

SEQ ID NO: 350901 - DNA, 21 bp, Homo sapiens
ttcttcaacatcaatgttcat

SEQ ID NO: 350902 - DNA, 22 bp, Homo sapiens
ttcttcaacatcaatgttcatt

SEQ ID NO: 350903 - DNA, 15 bp, Homo sapiens
ttcttcaatttgaaa

SEQ ID NO: 350904 - DNA, 15 bp, Homo sapiens
ttcttcatgcaatga

SEQ ID NO: 350905 - DNA, 18 bp, Homo sapiens
ttcttccacgtaattcaa

SEQ ID NO: 350906 - DNA, 16 bp, Homo sapiens
ttcttccatcagctct

SEQ ID NO: 350907 - DNA, 15 bp, Homo sapiens
ttcttcccatttgta

SEQ ID NO: 350908 - DNA, 18 bp, Homo sapiens
ttcttcctcaagtcttga

SEQ ID NO: 350909 - DNA, 20 bp, Homo sapiens
ttcttcctctcggctggaag

SEQ ID NO: 350910 - DNA, 11 bp, Homo sapiens
ttcttcctctg

SEQ ID NO: 350911 - DNA, 12 bp, Homo sapiens
ttcttcctctgc

SEQ ID NO: 350912 - DNA, 18 bp, Homo sapiens
ttcttcctcttacctgta

SEQ ID NO: 350913 - DNA, 20 bp, Homo sapiens
ttcttcgctgctctagctgg

SEQ ID NO: 350914 - DNA, 16 bp, Homo sapiens
ttcttcggaggtggca

SEQ ID NO: 350915 - DNA, 15 bp, Homo sapiens
ttcttcgggaagaga

SEQ ID NO: 350916 - DNA, 17 bp, Homo sapiens
ttcttcgggaagagagg

SEQ ID NO: 350917 - DNA, 17 bp, Homo sapiens
ttcttcgtccttttggt

SEQ ID NO: 350918 - DNA, 21 bp, Homo sapiens
ttcttctacaaccagagcccc

SEQ ID NO: 350919 - DNA, 19 bp, Homo sapiens
ttcttctgcgtttgtccct

SEQ ID NO: 350920 - DNA, 13 bp, Homo sapiens
ttcttcttccctc

SEQ ID NO: 350921 - DNA, 21 bp, Homo sapiens
ttcttctttttgcttcaaaaa

SEQ ID NO: 350922 - DNA, 14 bp, Homo sapiens
ttcttgaaagctgt

SEQ ID NO: 350923 - DNA, 15 bp, Homo sapiens
ttcttgatgtaaaat

SEQ ID NO: 350924 - DNA, 15 bp, Homo sapiens
ttcttgccacacagt

SEQ ID NO: 350925 - DNA, 14 bp, Homo sapiens
ttcttgctggttgt

SEQ ID NO: 350926 - DNA, 23 bp, Homo sapiens
ttcttgctggttgtcatttttgc

SEQ ID NO: 350927 - DNA, 17 bp, Homo sapiens
ttcttgcttgtaaaaat

SEQ ID NO: 350928 - DNA, 12 bp, Homo sapiens
ttcttgctttca

SEQ ID NO: 350929 - DNA, 15 bp, Homo sapiens
ttcttggacccctga

SEQ ID NO: 350930 - DNA, 17 bp, Homo sapiens
ttcttggcgttcctgcc

SEQ ID NO: 350931 - DNA, 15 bp, Homo sapiens
ttcttggcttctggg

SEQ ID NO: 350932 - DNA, 14 bp, Homo sapiens
ttcttgggctaggt

SEQ ID NO: 350933 - DNA, 23 bp, Homo sapiens
ttcttggggtactcttgatgtga

SEQ ID NO: 350934 - DNA, 22 bp, Homo sapiens
ttcttggtatttggatatctgt

SEQ ID NO: 350935 - DNA, 17 bp, Homo sapiens
ttcttggtcaagttttt

SEQ ID NO: 350936 - DNA, 14 bp, Homo sapiens
ttcttgtaaaactg

SEQ ID NO: 350937 - DNA, 16 bp, Homo sapiens
ttcttgtaaaactgtg

SEQ ID NO: 350938 - DNA, 13 bp, Homo sapiens
ttcttgtagtagt

SEQ ID NO: 350939 - DNA, 13 bp, Homo sapiens
ttcttgtgaaatg

SEQ ID NO: 350940 - DNA, 14 bp, Homo sapiens
ttcttgtgtgttta

SEQ ID NO: 350941 - DNA, 23 bp, Homo sapiens
ttcttgttagtactatatctgtt

SEQ ID NO: 350942 - DNA, 21 bp, Homo sapiens
ttcttgttcatgttttgctaa

SEQ ID NO: 350943 - DNA, 14 bp, Homo sapiens
ttcttgttctgttt

SEQ ID NO: 350944 - DNA, 14 bp, Homo sapiens
ttcttgtttaccaa

SEQ ID NO: 350945 - DNA, 22 bp, Homo sapiens
ttcttgtttaccaaagaagagt

SEQ ID NO: 350946 - DNA, 16 bp, Homo sapiens
ttctttaaactactga

SEQ ID NO: 350947 - DNA, 19 bp, Homo sapiens
ttctttaacatacatctaa

SEQ ID NO: 350948 - DNA, 14 bp, Homo sapiens
ttctttaaccagtc

SEQ ID NO: 350949 - DNA, 14 bp, Homo sapiens
ttctttaatcaaaa

SEQ ID NO: 350950 - DNA, 17 bp, Homo sapiens
ttctttaatcaaaagtc

SEQ ID NO: 350951 - DNA, 13 bp, Homo sapiens
ttctttaattgtt

SEQ ID NO: 350952 - DNA, 18 bp, Homo sapiens
ttctttacaaaatgaatg

SEQ ID NO: 350953 - DNA, 20 bp, Homo sapiens
ttctttacaaaatgaatgca

SEQ ID NO: 350954 - DNA, 15 bp, Homo sapiens
ttctttacaaactga

SEQ ID NO: 350955 - DNA, 14 bp, Homo sapiens
ttctttacctgaga

SEQ ID NO: 350956 - DNA, 16 bp, Homo sapiens
ttctttactaaagata

SEQ ID NO: 350957 - DNA, 14 bp, Homo sapiens
ttctttaggagatt

SEQ ID NO: 350958 - DNA, 13 bp, Homo sapiens
ttctttattcaca

SEQ ID NO: 350959 - DNA, 12 bp, Homo sapiens
ttctttcaagat

SEQ ID NO: 350960 - DNA, 18 bp, Homo sapiens
ttctttcaagatcttcaa

SEQ ID NO: 350961 - DNA, 10 bp, Homo sapiens
ttctttcccc

SEQ ID NO: 350962 - DNA, 16 bp, Homo sapiens
ttctttccccagaggc

SEQ ID NO: 350963 - DNA, 24 bp, Homo sapiens
ttctttccccagaggctcccaatc

SEQ ID NO: 350964 - DNA, 13 bp, Homo sapiens
ttctttctcccta

SEQ ID NO: 350965 - DNA, 15 bp, Homo sapiens
ttctttcttcctctg

SEQ ID NO: 350966 - DNA, 13 bp, Homo sapiens
ttctttcttggtg

SEQ ID NO: 350967 - DNA, 15 bp, Homo sapiens
ttctttctttcctta

SEQ ID NO: 350968 - DNA, 13 bp, Homo sapiens
ttctttcttttta

SEQ ID NO: 350969 - DNA, 11 bp, Homo sapiens
ttctttgaatg

SEQ ID NO: 350970 - DNA, 13 bp, Homo sapiens
ttctttgataaga

SEQ ID NO: 350971 - DNA, 22 bp, Homo sapiens
ttctttgcaacaataataaatg

SEQ ID NO: 350972 - DNA, 13 bp, Homo sapiens
ttctttgctgccc

SEQ ID NO: 350973 - DNA, 16 bp, Homo sapiens
ttctttgctgtgccaa

SEQ ID NO: 350974 - DNA, 21 bp, Homo sapiens
ttctttgtatcttaaatctgt

SEQ ID NO: 350975 - DNA, 13 bp, Homo sapiens
ttctttgttcctg

SEQ ID NO: 350976 - DNA, 18 bp, Homo sapiens
ttctttgtttttagagac

SEQ ID NO: 350977 - DNA, 15 bp, Homo sapiens
ttcttttaaatgggt

SEQ ID NO: 350978 - DNA, 17 bp, Homo sapiens
ttcttttactatctttt

SEQ ID NO: 350979 - DNA, 17 bp, Homo sapiens
ttcttttatatataaaa

SEQ ID NO: 350980 - DNA, 15 bp, Homo sapiens
ttcttttatatctgt

SEQ ID NO: 350981 - DNA, 22 bp, Homo sapiens
ttcttttcagcttgtttctata

SEQ ID NO: 350982 - DNA, 16 bp, Homo sapiens
ttcttttgaaatgcca

SEQ ID NO: 350983 - DNA, 15 bp, Homo sapiens
ttcttttgaactgtt

SEQ ID NO: 350984 - DNA, 23 bp, Homo sapiens
ttcttttgaactgttagatgctg

SEQ ID NO: 350985 - DNA, 19 bp, Homo sapiens
ttcttttgaccccttcctg

SEQ ID NO: 350986 - DNA, 11 bp, Homo sapiens
ttcttttgata

SEQ ID NO: 350987 - DNA, 15 bp, Homo sapiens
ttcttttgattttgt

SEQ ID NO: 350988 - DNA, 14 bp, Homo sapiens
ttcttttgccatga

SEQ ID NO: 350989 - DNA, 20 bp, Homo sapiens
ttctttttaaagcttttgat

SEQ ID NO: 350990 - DNA, 16 bp, Homo sapiens
ttctttttcttaccct

SEQ ID NO: 350991 - DNA, 14 bp, Homo sapiens
ttctttttttgtga

SEQ ID NO: 350992 - DNA, 18 bp, Homo sapiens
ttcttttttttcattata

SEQ ID NO: 350993 - DNA, 17 bp, Homo sapiens
ttcttttttttcttggt

SEQ ID NO: 350994 - DNA, 14 bp, Homo sapiens
ttgaaaaaaattgg

SEQ ID NO: 350995 - DNA, 16 bp, Homo sapiens
ttgaaaaaagaagttt

SEQ ID NO: 350996 - DNA, 14 bp, Homo sapiens
ttgaaaaaagagaa

SEQ ID NO: 350997 - DNA, 11 bp, Homo sapiens
ttgaaaacacc

SEQ ID NO: 350998 - DNA, 18 bp, Homo sapiens
ttgaaaacaccaagagta

SEQ ID NO: 350999 - DNA, 13 bp, Homo sapiens
ttgaaaacactta

SEQ ID NO: 351000 - DNA, 24 bp, Homo sapiens
ttgaaaaccaacaccatcacagct

SEQ ID NO: 351001 - DNA, 14 bp, Homo sapiens
ttgaaaagaagaaa

SEQ ID NO: 351002 - DNA, 14 bp, Homo sapiens
ttgaaaagattcca

SEQ ID NO: 351003 - DNA, 14 bp, Homo sapiens
ttgaaaatattatc

SEQ ID NO: 351004 - DNA, 23 bp, Homo sapiens
ttgaaaatattatctttgtaatt

SEQ ID NO: 351005 - DNA, 17 bp, Homo sapiens
ttgaaaatatttctatg

SEQ ID NO: 351006 - DNA, 14 bp, Homo sapiens
ttgaaaatgaaatg

SEQ ID NO: 351007 - DNA, 11 bp, Homo sapiens
ttgaaaatgag

SEQ ID NO: 351008 - DNA, 20 bp, Homo sapiens
ttgaaaatgtaagtaaatgt

SEQ ID NO: 351009 - DNA, 19 bp, Homo sapiens
ttgaaaattattttaaaca

SEQ ID NO: 351010 - DNA, 19 bp, Homo sapiens
ttgaaagaagtcaaatgaa

SEQ ID NO: 351011 - DNA, 17 bp, Homo sapiens
ttgaaagagaaccagtt

SEQ ID NO: 351012 - DNA, 19 bp, Homo sapiens
ttgaaagagttaagaatgt

SEQ ID NO: 351013 - DNA, 16 bp, Homo sapiens
ttgaaaggaaaaacag

SEQ ID NO: 351014 - DNA, 23 bp, Homo sapiens
ttgaaagtggggtgttgaagacc

SEQ ID NO: 351015 - DNA, 14 bp, Homo sapiens
ttgaaatcaaatgt

SEQ ID NO: 351016 - DNA, 18 bp, Homo sapiens
ttgaaattatgtatgttt

SEQ ID NO: 351017 - DNA, 14 bp, Homo sapiens
ttgaacacaggcaa

SEQ ID NO: 351018 - DNA, 15 bp, Homo sapiens
ttgaacattcattca

SEQ ID NO: 351019 - DNA, 23 bp, Homo sapiens
ttgaactctgttcccccaccctc

SEQ ID NO: 351020 - DNA, 18 bp, Homo sapiens
ttgaactgttagatgctg

SEQ ID NO: 351021 - DNA, 22 bp, Homo sapiens
ttgaagaaggaggaattttaga

SEQ ID NO: 351022 - DNA, 18 bp, Homo sapiens
ttgaagaagggaaattca

SEQ ID NO: 351023 - DNA, 18 bp, Homo sapiens
ttgaagaatattgttaaa

SEQ ID NO: 351024 - DNA, 18 bp, Homo sapiens
ttgaagagcctgacaagt

SEQ ID NO: 351025 - DNA, 19 bp, Homo sapiens
ttgaagatacacaagaggg

SEQ ID NO: 351026 - DNA, 20 bp, Homo sapiens
ttgaagatcgttagtatcta

SEQ ID NO: 351027 - DNA, 15 bp, Homo sapiens
ttgaagatgtagctt

SEQ ID NO: 351028 - DNA, 16 bp, Homo sapiens
ttgaagatgtccccca

SEQ ID NO: 351029 - DNA, 18 bp, Homo sapiens
ttgaaggaaccaagtgca

SEQ ID NO: 351030 - DNA, 12 bp, Homo sapiens
ttgaagtaatga

SEQ ID NO: 351031 - DNA, 18 bp, Homo sapiens
ttgaagtatctgtacctg

SEQ ID NO: 351032 - DNA, 16 bp, Homo sapiens
ttgaagttctggcaag

SEQ ID NO: 351033 - DNA, 18 bp, Homo sapiens
ttgaataaaaaacatttg

SEQ ID NO: 351034 - DNA, 19 bp, Homo sapiens
ttgaataaaaaacatttgt

SEQ ID NO: 351035 - DNA, 22 bp, Homo sapiens
ttgaataaaaaacatttgtaca

SEQ ID NO: 351036 - DNA, 22 bp, Homo sapiens
ttgaataccattaaaactgctt

SEQ ID NO: 351037 - DNA, 14 bp, Homo sapiens
ttgaatatatttta

SEQ ID NO: 351038 - DNA, 24 bp, Homo sapiens
ttgaatctgattggacattttctt

SEQ ID NO: 351039 - DNA, 18 bp, Homo sapiens
ttgaatgacaacagaagc

SEQ ID NO: 351040 - DNA, 17 bp, Homo sapiens
ttgaatgctttttgaat

SEQ ID NO: 351041 - DNA, 20 bp, Homo sapiens
ttgaatgctttttgaatgtt

SEQ ID NO: 351042 - DNA, 23 bp, Homo sapiens
ttgaatgctttttgaatgttatt

SEQ ID NO: 351043 - DNA, 15 bp, Homo sapiens
ttgaatggtgcagaa

SEQ ID NO: 351044 - DNA, 16 bp, Homo sapiens
ttgaatggtgttgtat

SEQ ID NO: 351045 - DNA, 18 bp, Homo sapiens
ttgaatgtaagaacatga

SEQ ID NO: 351046 - DNA, 19 bp, Homo sapiens
ttgaatgtccccattctat

SEQ ID NO: 351047 - DNA, 21 bp, Homo sapiens
ttgaatgtccccattctataa

SEQ ID NO: 351048 - DNA, 16 bp, Homo sapiens
ttgaatgtgatcatct

SEQ ID NO: 351049 - DNA, 18 bp, Homo sapiens
ttgaatgtgatcatcttt

SEQ ID NO: 351050 - DNA, 23 bp, Homo sapiens
ttgaatgtgatcatctttgctga

SEQ ID NO: 351051 - DNA, 17 bp, Homo sapiens
ttgaatgttaagcagat

SEQ ID NO: 351052 - DNA, 14 bp, Homo sapiens
ttgaatttaaataa

SEQ ID NO: 351053 - DNA, 16 bp, Homo sapiens
ttgacaaaatttgttg

SEQ ID NO: 351054 - DNA, 16 bp, Homo sapiens
ttgacaacattttatt

SEQ ID NO: 351055 - DNA, 12 bp, Homo sapiens
ttgacaccaggg

SEQ ID NO: 351056 - DNA, 17 bp, Homo sapiens
ttgacatccaaatctag

SEQ ID NO: 351057 - DNA, 18 bp, Homo sapiens
ttgacattcttcactgtc

SEQ ID NO: 351058 - DNA, 22 bp, Homo sapiens
ttgacattgtatgtatctattt

SEQ ID NO: 351059 - DNA, 13 bp, Homo sapiens
ttgacatttaata

SEQ ID NO: 351060 - DNA, 14 bp, Homo sapiens
ttgaccaaactgtg

SEQ ID NO: 351061 - DNA, 19 bp, Homo sapiens
ttgaccaaactgtgggtat

SEQ ID NO: 351062 - DNA, 14 bp, Homo sapiens
ttgaccaagaactg

SEQ ID NO: 351063 - DNA, 17 bp, Homo sapiens
ttgaccaagaactgcat

SEQ ID NO: 351064 - DNA, 18 bp, Homo sapiens
ttgaccaagaactgcatg

SEQ ID NO: 351065 - DNA, 15 bp, Homo sapiens
ttgaccatgtgatta

SEQ ID NO: 351066 - DNA, 22 bp, Homo sapiens
ttgaccgtttttatattacttt

SEQ ID NO: 351067 - DNA, 20 bp, Homo sapiens
ttgacctcaatggaggtttg

SEQ ID NO: 351068 - DNA, 16 bp, Homo sapiens
ttgacctgaactctgc

SEQ ID NO: 351069 - DNA, 15 bp, Homo sapiens
ttgacggatgattgg

SEQ ID NO: 351070 - DNA, 15 bp, Homo sapiens
ttgactatttataca

SEQ ID NO: 351071 - DNA, 14 bp, Homo sapiens
ttgactctaaatgc

SEQ ID NO: 351072 - DNA, 21 bp, Homo sapiens
ttgactcttttgccattaaac

SEQ ID NO: 351073 - DNA, 21 bp, Homo sapiens
ttgactgaagcgaacatcttc

SEQ ID NO: 351074 - DNA, 21 bp, Homo sapiens
ttgactgatgctgagattctt

SEQ ID NO: 351075 - DNA, 15 bp, Homo sapiens
ttgacttattttctc

SEQ ID NO: 351076 - DNA, 18 bp, Homo sapiens
ttgacttcagctgcctga

SEQ ID NO: 351077 - DNA, 19 bp, Homo sapiens
ttgacttctatcctgttaa

SEQ ID NO: 351078 - DNA, 20 bp, Homo sapiens
ttgacttctatcctgttaac

SEQ ID NO: 351079 - DNA, 17 bp, Homo sapiens
ttgactttatctcctgc

SEQ ID NO: 351080 - DNA, 14 bp, Homo sapiens
ttgagacaagccct

SEQ ID NO: 351081 - DNA, 13 bp, Homo sapiens
ttgagacactgtc

SEQ ID NO: 351082 - DNA, 16 bp, Homo sapiens
ttgagacactgtcaag

SEQ ID NO: 351083 - DNA, 23 bp, Homo sapiens
ttgagacactgtcaagattaagt

SEQ ID NO: 351084 - DNA, 22 bp, Homo sapiens
ttgagacagagtctcgctctgt

SEQ ID NO: 351085 - DNA, 16 bp, Homo sapiens
ttgagacttcaagctt

SEQ ID NO: 351086 - DNA, 17 bp, Homo sapiens
ttgagagcgctggcctc

SEQ ID NO: 351087 - DNA, 22 bp, Homo sapiens
ttgagatctgctgacagatgtt

SEQ ID NO: 351088 - DNA, 17 bp, Homo sapiens
ttgagatgtatgaaggc

SEQ ID NO: 351089 - DNA, 15 bp, Homo sapiens
ttgagcaaggcaaga

SEQ ID NO: 351090 - DNA, 22 bp, Homo sapiens
ttgagcagtaaatgtatattga

SEQ ID NO: 351091 - DNA, 19 bp, Homo sapiens
ttgagcagtggctggtcca

SEQ ID NO: 351092 - DNA, 16 bp, Homo sapiens
ttgagcatttttaagg

SEQ ID NO: 351093 - DNA, 13 bp, Homo sapiens
ttgagccaggcct

SEQ ID NO: 351094 - DNA, 17 bp, Homo sapiens
ttgagccaggcctgggt

SEQ ID NO: 351095 - DNA, 19 bp, Homo sapiens
ttgagcccacaaagcctta

SEQ ID NO: 351096 - DNA, 22 bp, Homo sapiens
ttgagccctcctggaatggagc

SEQ ID NO: 351097 - DNA, 13 bp, Homo sapiens
ttgagcctccccc

SEQ ID NO: 351098 - DNA, 15 bp, Homo sapiens
ttgagcgtgattctg

SEQ ID NO: 351099 - DNA, 18 bp, Homo sapiens
ttgagctcccctggagcc

SEQ ID NO: 351100 - DNA, 16 bp, Homo sapiens
ttgagctcttcattta

SEQ ID NO: 351101 - DNA, 18 bp, Homo sapiens
ttgagctgttttccctga

SEQ ID NO: 351102 - DNA, 18 bp, Homo sapiens
ttgaggatgcactggcct

SEQ ID NO: 351103 - DNA, 14 bp, Homo sapiens
ttgaggccaggagt

SEQ ID NO: 351104 - DNA, 18 bp, Homo sapiens
ttgagggaaaacataata

SEQ ID NO: 351105 - DNA, 22 bp, Homo sapiens
ttgagggacaaatttaaaacaa

SEQ ID NO: 351106 - DNA, 19 bp, Homo sapiens
ttgaggggcaactccagaa

SEQ ID NO: 351107 - DNA, 22 bp, Homo sapiens
ttgaggggctggccttcctgcc

SEQ ID NO: 351108 - DNA, 20 bp, Homo sapiens
ttgaggggcttccctctgct

SEQ ID NO: 351109 - DNA, 18 bp, Homo sapiens
ttgagggtaataaactta

SEQ ID NO: 351110 - DNA, 21 bp, Homo sapiens
ttgaggtagaggggaaggaaa

SEQ ID NO: 351111 - DNA, 22 bp, Homo sapiens
ttgaggtcaagtaagaagacat

SEQ ID NO: 351112 - DNA, 23 bp, Homo sapiens
ttgaggtcttttgacatgtggaa

SEQ ID NO: 351113 - DNA, 21 bp, Homo sapiens
ttgaggtggtctgaatgttct

SEQ ID NO: 351114 - DNA, 18 bp, Homo sapiens
ttgagtacagtgaggagg

SEQ ID NO: 351115 - DNA, 19 bp, Homo sapiens
ttgagtacagtgaggaggg

SEQ ID NO: 351116 - DNA, 17 bp, Homo sapiens
ttgagtcaaaagcctgg

SEQ ID NO: 351117 - DNA, 13 bp, Homo sapiens
ttgagtcatttta

SEQ ID NO: 351118 - DNA, 21 bp, Homo sapiens
ttgagtcttcacatttagaat

SEQ ID NO: 351119 - DNA, 23 bp, Homo sapiens
ttgagtgagccgggaccgtgcca

SEQ ID NO: 351120 - DNA, 12 bp, Homo sapiens
ttgagtgattat

SEQ ID NO: 351121 - DNA, 15 bp, Homo sapiens
ttgagtgggccccct

SEQ ID NO: 351122 - DNA, 16 bp, Homo sapiens
ttgagtgggccccctc

SEQ ID NO: 351123 - DNA, 18 bp, Homo sapiens
ttgagtttataattcagg

SEQ ID NO: 351124 - DNA, 15 bp, Homo sapiens
ttgagtttgctgtat

SEQ ID NO: 351125 - DNA, 20 bp, Homo sapiens
ttgagttttatttattttat

SEQ ID NO: 351126 - DNA, 19 bp, Homo sapiens
ttgataaaatgttcctttt

SEQ ID NO: 351127 - DNA, 12 bp, Homo sapiens
ttgataaagtaa

SEQ ID NO: 351128 - DNA, 11 bp, Homo sapiens
ttgataataaa

SEQ ID NO: 351129 - DNA, 12 bp, Homo sapiens
ttgatacattta

SEQ ID NO: 351130 - DNA, 13 bp, Homo sapiens
ttgatacatttat

SEQ ID NO: 351131 - DNA, 18 bp, Homo sapiens
ttgatacttgttccagat

SEQ ID NO: 351132 - DNA, 22 bp, Homo sapiens
ttgatatattctttccatgcag

SEQ ID NO: 351133 - DNA, 19 bp, Homo sapiens
ttgatatgattgtaacata

SEQ ID NO: 351134 - DNA, 17 bp, Homo sapiens
ttgatcaaattcatttt

SEQ ID NO: 351135 - DNA, 17 bp, Homo sapiens
ttgatcagatcttacaa

SEQ ID NO: 351136 - DNA, 13 bp, Homo sapiens
ttgatcatgcagg

SEQ ID NO: 351137 - DNA, 19 bp, Homo sapiens
ttgatcattttccccccac

SEQ ID NO: 351138 - DNA, 22 bp, Homo sapiens
ttgatcattttccccccactct

SEQ ID NO: 351139 - DNA, 14 bp, Homo sapiens
ttgatctaaggcat

SEQ ID NO: 351140 - DNA, 24 bp, Homo sapiens
ttgatctcctggtagcatgacctt

SEQ ID NO: 351141 - DNA, 20 bp, Homo sapiens
ttgatctggtgcgtgtggcc

SEQ ID NO: 351142 - DNA, 17 bp, Homo sapiens
ttgatgaataaacactt

SEQ ID NO: 351143 - DNA, 14 bp, Homo sapiens
ttgatgctgagtca

SEQ ID NO: 351144 - DNA, 19 bp, Homo sapiens
ttgatgctgtttctacatt

SEQ ID NO: 351145 - DNA, 11 bp, Homo sapiens
ttgatggctaa

SEQ ID NO: 351146 - DNA, 18 bp, Homo sapiens
ttgatgggagaaatgagg

SEQ ID NO: 351147 - DNA, 18 bp, Homo sapiens
ttgatgggccttcagatt

SEQ ID NO: 351148 - DNA, 16 bp, Homo sapiens
ttgatgtaaaatcttg

SEQ ID NO: 351149 - DNA, 18 bp, Homo sapiens
ttgatgtaaaatcttgtc

SEQ ID NO: 351150 - DNA, 19 bp, Homo sapiens
ttgatgtacagtctgtcat

SEQ ID NO: 351151 - DNA, 20 bp, Homo sapiens
ttgatgtatatgtttatata

SEQ ID NO: 351152 - DNA, 16 bp, Homo sapiens
ttgatgtcagccttgc

SEQ ID NO: 351153 - DNA, 17 bp, Homo sapiens
ttgatgtcagccttgca

SEQ ID NO: 351154 - DNA, 21 bp, Homo sapiens
ttgatgtcgatgctcactgct

SEQ ID NO: 351155 - DNA, 18 bp, Homo sapiens
ttgatgtctagataacat

SEQ ID NO: 351156 - DNA, 22 bp, Homo sapiens
ttgatgtctagataacattcat

SEQ ID NO: 351157 - DNA, 16 bp, Homo sapiens
ttgatgtgaaattaaa

SEQ ID NO: 351158 - DNA, 17 bp, Homo sapiens
ttgatgtgaagataatt

SEQ ID NO: 351159 - DNA, 22 bp, Homo sapiens
ttgatgtgaagataatttgcat

SEQ ID NO: 351160 - DNA, 23 bp, Homo sapiens
ttgatgtgaagataatttgcata

SEQ ID NO: 351161 - DNA, 15 bp, Homo sapiens
ttgatgtgtatgtgt

SEQ ID NO: 351162 - DNA, 13 bp, Homo sapiens
ttgattaaaagca

SEQ ID NO: 351163 - DNA, 19 bp, Homo sapiens
ttgattaaactgtatgtct

SEQ ID NO: 351164 - DNA, 15 bp, Homo sapiens
ttgattaagatttta

SEQ ID NO: 351165 - DNA, 16 bp, Homo sapiens
ttgattaagattttac

SEQ ID NO: 351166 - DNA, 20 bp, Homo sapiens
ttgattaagattttacaaaa

SEQ ID NO: 351167 - DNA, 16 bp, Homo sapiens
ttgattaagtatatct

SEQ ID NO: 351168 - DNA, 16 bp, Homo sapiens
ttgattaatgtttctt

SEQ ID NO: 351169 - DNA, 16 bp, Homo sapiens
ttgattacataatgtt

SEQ ID NO: 351170 - DNA, 17 bp, Homo sapiens
ttgattatgtacctttt

SEQ ID NO: 351171 - DNA, 17 bp, Homo sapiens
ttgattcataatgactt

SEQ ID NO: 351172 - DNA, 23 bp, Homo sapiens
ttgattccacttgtgtggaggga

SEQ ID NO: 351173 - DNA, 20 bp, Homo sapiens
ttgatttaactgacttaaca

SEQ ID NO: 351174 - DNA, 12 bp, Homo sapiens
ttgatttatgca

SEQ ID NO: 351175 - DNA, 19 bp, Homo sapiens
ttgatttatgcatggaaac

SEQ ID NO: 351176 - DNA, 13 bp, Homo sapiens
ttgatttgcatgg

SEQ ID NO: 351177 - DNA, 14 bp, Homo sapiens
ttgattttctgttg

SEQ ID NO: 351178 - DNA, 16 bp, Homo sapiens
ttgattttctgttgta

SEQ ID NO: 351179 - DNA, 14 bp, Homo sapiens
ttgattttctttct

SEQ ID NO: 351180 - DNA, 23 bp, Homo sapiens
ttgcaaaatttccagtacctttg

SEQ ID NO: 351181 - DNA, 17 bp, Homo sapiens
ttgcaaagaaaattctc

SEQ ID NO: 351182 - DNA, 16 bp, Homo sapiens
ttgcaaataagactct

SEQ ID NO: 351183 - DNA, 18 bp, Homo sapiens
ttgcaaattattctagtc

SEQ ID NO: 351184 - DNA, 18 bp, Homo sapiens
ttgcaacaataataaatg

SEQ ID NO: 351185 - DNA, 12 bp, Homo sapiens
ttgcaaccactg

SEQ ID NO: 351186 - DNA, 23 bp, Homo sapiens
ttgcaatgcttttatatggccca

SEQ ID NO: 351187 - DNA, 22 bp, Homo sapiens
ttgcaatgtcacaacctctctg

SEQ ID NO: 351188 - DNA, 16 bp, Homo sapiens
ttgcacaaaaagcaca

SEQ ID NO: 351189 - DNA, 18 bp, Homo sapiens
ttgcacacactcagtgca

SEQ ID NO: 351190 - DNA, 14 bp, Homo sapiens
ttgcacaggccact

SEQ ID NO: 351191 - DNA, 21 bp, Homo sapiens
ttgcacaggccacttgctcag

SEQ ID NO: 351192 - DNA, 22 bp, Homo sapiens
ttgcacaggccacttgctcaga

SEQ ID NO: 351193 - DNA, 18 bp, Homo sapiens
ttgcacagtccctcctgt

SEQ ID NO: 351194 - DNA, 23 bp, Homo sapiens
ttgcaccattctttcttggtgca

SEQ ID NO: 351195 - DNA, 18 bp, Homo sapiens
ttgcaccgtggtcagagg

SEQ ID NO: 351196 - DNA, 20 bp, Homo sapiens
ttgcacgcccatgtgtgagt

SEQ ID NO: 351197 - DNA, 20 bp, Homo sapiens
ttgcactaaaagtgatgtga

SEQ ID NO: 351198 - DNA, 19 bp, Homo sapiens
ttgcactaaagtatgtaaa

SEQ ID NO: 351199 - DNA, 21 bp, Homo sapiens
ttgcactggtcatcagtattg

SEQ ID NO: 351200 - DNA, 22 bp, Homo sapiens
ttgcagaaacattttgtggtca

SEQ ID NO: 351201 - DNA, 17 bp, Homo sapiens
ttgcagaacatgagtgc

SEQ ID NO: 351202 - DNA, 23 bp, Homo sapiens
ttgcagcagtgagtctcttcaga

SEQ ID NO: 351203 - DNA, 14 bp, Homo sapiens
ttgcagcagttgct

SEQ ID NO: 351204 - DNA, 14 bp, Homo sapiens
ttgcagcctagtag

SEQ ID NO: 351205 - DNA, 12 bp, Homo sapiens
ttgcagcttcct

SEQ ID NO: 351206 - DNA, 17 bp, Homo sapiens
ttgcagcttccttccaa

SEQ ID NO: 351207 - DNA, 20 bp, Homo sapiens
ttgcaggaagagatgctcta

SEQ ID NO: 351208 - DNA, 13 bp, Homo sapiens
ttgcaggctctgg

SEQ ID NO: 351209 - DNA, 18 bp, Homo sapiens
ttgcaggctctgggctca

SEQ ID NO: 351210 - DNA, 20 bp, Homo sapiens
ttgcaggctctgggctcagg

SEQ ID NO: 351211 - DNA, 19 bp, Homo sapiens
ttgcagttggactctcagg

SEQ ID NO: 351212 - DNA, 19 bp, Homo sapiens
ttgcataaacaatccaaat

SEQ ID NO: 351213 - DNA, 15 bp, Homo sapiens
ttgcataataagcta

SEQ ID NO: 351214 - DNA, 22 bp, Homo sapiens
ttgcatcgctgtccaagtgttt

SEQ ID NO: 351215 - DNA, 19 bp, Homo sapiens
ttgcatctacctgctcctt

SEQ ID NO: 351216 - DNA, 13 bp, Homo sapiens
ttgcatctgggcc

SEQ ID NO: 351217 - DNA, 12 bp, Homo sapiens
ttgcattagaaa

SEQ ID NO: 351218 - DNA, 13 bp, Homo sapiens
ttgcattcaaaat

SEQ ID NO: 351219 - DNA, 17 bp, Homo sapiens
ttgcatttattgcagtt

SEQ ID NO: 351220 - DNA, 20 bp, Homo sapiens
ttgcatttattgcagtttat

SEQ ID NO: 351221 - DNA, 14 bp, Homo sapiens
ttgcatttctttat

SEQ ID NO: 351222 - DNA, 15 bp, Homo sapiens
ttgcatttggtcaag

SEQ ID NO: 351223 - DNA, 14 bp, Homo sapiens
ttgcatttttgtat

SEQ ID NO: 351224 - DNA, 18 bp, Homo sapiens
ttgcattttttaaaacaa

SEQ ID NO: 351225 - DNA, 13 bp, Homo sapiens
ttgccaaagctgg

SEQ ID NO: 351226 - DNA, 17 bp, Homo sapiens
ttgccaaatatgtcctg

SEQ ID NO: 351227 - DNA, 16 bp, Homo sapiens
ttgccaactaagccct

SEQ ID NO: 351228 - DNA, 14 bp, Homo sapiens
ttgccaagaaatcg

SEQ ID NO: 351229 - DNA, 22 bp, Homo sapiens
ttgccaccaccagatgagaagt

SEQ ID NO: 351230 - DNA, 23 bp, Homo sapiens
ttgccaccaccagatgagaagtt

SEQ ID NO: 351231 - DNA, 17 bp, Homo sapiens
ttgccacctctggccaa

SEQ ID NO: 351232 - DNA, 21 bp, Homo sapiens
ttgccactgcaaacaataaac

SEQ ID NO: 351233 - DNA, 15 bp, Homo sapiens
ttgccagagccttaa

SEQ ID NO: 351234 - DNA, 17 bp, Homo sapiens
ttgccagcacaggggcc

SEQ ID NO: 351235 - DNA, 14 bp, Homo sapiens
ttgccagctcagca

SEQ ID NO: 351236 - DNA, 19 bp, Homo sapiens
ttgccagtatataagctgt

SEQ ID NO: 351237 - DNA, 20 bp, Homo sapiens
ttgccagtatataagctgtt

SEQ ID NO: 351238 - DNA, 17 bp, Homo sapiens
ttgccatagccccatat

SEQ ID NO: 351239 - DNA, 23 bp, Homo sapiens
ttgccatgacaacttctaattgc

SEQ ID NO: 351240 - DNA, 18 bp, Homo sapiens
ttgccatgggcctgctgc

SEQ ID NO: 351241 - DNA, 19 bp, Homo sapiens
ttgcccaacctcagcaacc

SEQ ID NO: 351242 - DNA, 18 bp, Homo sapiens
ttgcccaggctggtctca

SEQ ID NO: 351243 - DNA, 15 bp, Homo sapiens
ttgcccatccatctg

SEQ ID NO: 351244 - DNA, 14 bp, Homo sapiens
ttgcccatgggata

SEQ ID NO: 351245 - DNA, 11 bp, Homo sapiens
ttgccccaaga

SEQ ID NO: 351246 - DNA, 12 bp, Homo sapiens
ttgccccaagat

SEQ ID NO: 351247 - DNA, 13 bp, Homo sapiens
ttgccccagagcc

SEQ ID NO: 351248 - DNA, 18 bp, Homo sapiens
ttgccccagagccccact

SEQ ID NO: 351249 - DNA, 14 bp, Homo sapiens
ttgccccagtcctg

SEQ ID NO: 351250 - DNA, 20 bp, Homo sapiens
ttgccccatgataaaataag

SEQ ID NO: 351251 - DNA, 12 bp, Homo sapiens
ttgccccccacc

SEQ ID NO: 351252 - DNA, 13 bp, Homo sapiens
ttgccccccaccc

SEQ ID NO: 351253 - DNA, 14 bp, Homo sapiens
ttgcccgctcccac

SEQ ID NO: 351254 - DNA, 12 bp, Homo sapiens
ttgccctgccag

SEQ ID NO: 351255 - DNA, 18 bp, Homo sapiens
ttgccctttctgtaccat

SEQ ID NO: 351256 - DNA, 14 bp, Homo sapiens
ttgccgctgggaga

SEQ ID NO: 351257 - DNA, 15 bp, Homo sapiens
ttgccgctgggagag

SEQ ID NO: 351258 - DNA, 21 bp, Homo sapiens
ttgccgttgccaagaactgaa

SEQ ID NO: 351259 - DNA, 12 bp, Homo sapiens
ttgcctcctccc

SEQ ID NO: 351260 - DNA, 19 bp, Homo sapiens
ttgcctccttatttatcaa

SEQ ID NO: 351261 - DNA, 12 bp, Homo sapiens
ttgcctctactt

SEQ ID NO: 351262 - DNA, 11 bp, Homo sapiens
ttgcctggctg

SEQ ID NO: 351263 - DNA, 15 bp, Homo sapiens
ttgcctggctgtgga

SEQ ID NO: 351264 - DNA, 19 bp, Homo sapiens
ttgcctggctgtggaggcc

SEQ ID NO: 351265 - DNA, 21 bp, Homo sapiens
ttgcctggctgtggaggcctg

SEQ ID NO: 351266 - DNA, 15 bp, Homo sapiens
ttgccttaattctta

SEQ ID NO: 351267 - DNA, 14 bp, Homo sapiens
ttgccttaggaagt

SEQ ID NO: 351268 - DNA, 11 bp, Homo sapiens
ttgccttcagc

SEQ ID NO: 351269 - DNA, 13 bp, Homo sapiens
ttgccttcccctt

SEQ ID NO: 351270 - DNA, 17 bp, Homo sapiens
ttgccttgatgttgtgt

SEQ ID NO: 351271 - DNA, 15 bp, Homo sapiens
ttgccttgcatttgt

SEQ ID NO: 351272 - DNA, 17 bp, Homo sapiens
ttgcctttgtagttaat

SEQ ID NO: 351273 - DNA, 20 bp, Homo sapiens
ttgcgacggagagaaaaaag

SEQ ID NO: 351274 - DNA, 14 bp, Homo sapiens
ttgcgtcctgcaga

SEQ ID NO: 351275 - DNA, 19 bp, Homo sapiens
ttgcgtggtccttaggctt

SEQ ID NO: 351276 - DNA, 18 bp, Homo sapiens
ttgcgtgtctgtttcctt

SEQ ID NO: 351277 - DNA, 19 bp, Homo sapiens
ttgcgttagaatgaggagg

SEQ ID NO: 351278 - DNA, 21 bp, Homo sapiens
ttgctaaaaatagtggccaga

SEQ ID NO: 351279 - DNA, 23 bp, Homo sapiens
ttgctaactttgcccttcactgt

SEQ ID NO: 351280 - DNA, 18 bp, Homo sapiens
ttgctaagggaaataaca

SEQ ID NO: 351281 - DNA, 18 bp, Homo sapiens
ttgctaatcgggttgtca

SEQ ID NO: 351282 - DNA, 22 bp, Homo sapiens
ttgctaatgaattttaaaagca

SEQ ID NO: 351283 - DNA, 17 bp, Homo sapiens
ttgctaattttctcaaa

SEQ ID NO: 351284 - DNA, 19 bp, Homo sapiens
ttgctacctgtgagcatcc

SEQ ID NO: 351285 - DNA, 16 bp, Homo sapiens
ttgctagctatgtgac

SEQ ID NO: 351286 - DNA, 13 bp, Homo sapiens
ttgctaggtataa

SEQ ID NO: 351287 - DNA, 18 bp, Homo sapiens
ttgctagtgatacactgt

SEQ ID NO: 351288 - DNA, 16 bp, Homo sapiens
ttgctatataaataaa

SEQ ID NO: 351289 - DNA, 19 bp, Homo sapiens
ttgctatcatatattataa

SEQ ID NO: 351290 - DNA, 15 bp, Homo sapiens
ttgctatccgacatg

SEQ ID NO: 351291 - DNA, 20 bp, Homo sapiens
ttgctcagacgagacaccct

SEQ ID NO: 351292 - DNA, 13 bp, Homo sapiens
ttgctcagagaaa

SEQ ID NO: 351293 - DNA, 12 bp, Homo sapiens
ttgctcagagct

SEQ ID NO: 351294 - DNA, 14 bp, Homo sapiens
ttgctcagagctag

SEQ ID NO: 351295 - DNA, 14 bp, Homo sapiens
ttgctcagtgcctc

SEQ ID NO: 351296 - DNA, 18 bp, Homo sapiens
ttgctcagtgcctcctgg

SEQ ID NO: 351297 - DNA, 12 bp, Homo sapiens
ttgctccacccc

SEQ ID NO: 351298 - DNA, 20 bp, Homo sapiens
ttgctccaccccactcacag

SEQ ID NO: 351299 - DNA, 11 bp, Homo sapiens
ttgctccaggg

SEQ ID NO: 351300 - DNA, 17 bp, Homo sapiens
ttgctcccaacccattc

SEQ ID NO: 351301 - DNA, 21 bp, Homo sapiens
ttgctctcccctgccctgctg

SEQ ID NO: 351302 - DNA, 14 bp, Homo sapiens
ttgctctgggtgga

SEQ ID NO: 351303 - DNA, 22 bp, Homo sapiens
ttgctcttgcagagaagccttg

SEQ ID NO: 351304 - DNA, 13 bp, Homo sapiens
ttgctcttggaaa

SEQ ID NO: 351305 - DNA, 12 bp, Homo sapiens
ttgctgaaacac

SEQ ID NO: 351306 - DNA, 18 bp, Homo sapiens
ttgctgaatgtcattatt

SEQ ID NO: 351307 - DNA, 19 bp, Homo sapiens
ttgctgaattcctttacaa

SEQ ID NO: 351308 - DNA, 15 bp, Homo sapiens
ttgctgatggcttga

SEQ ID NO: 351309 - DNA, 21 bp, Homo sapiens
ttgctgccaagtcctgccttt

SEQ ID NO: 351310 - DNA, 23 bp, Homo sapiens
ttgctgctaccgccctgggctgg

SEQ ID NO: 351311 - DNA, 22 bp, Homo sapiens
ttgctgctataattctatactg

SEQ ID NO: 351312 - DNA, 17 bp, Homo sapiens
ttgctgctgataatgta

SEQ ID NO: 351313 - DNA, 14 bp, Homo sapiens
ttgctgctgtggaa

SEQ ID NO: 351314 - DNA, 23 bp, Homo sapiens
ttgctggaaaatctgtaaaaaag

SEQ ID NO: 351315 - DNA, 19 bp, Homo sapiens
ttgctggaatctactagaa

SEQ ID NO: 351316 - DNA, 19 bp, Homo sapiens
ttgctggagtcctgttctc

SEQ ID NO: 351317 - DNA, 20 bp, Homo sapiens
ttgctggagtcctgttctca

SEQ ID NO: 351318 - DNA, 21 bp, Homo sapiens
ttgctggagtcctgttctcag

SEQ ID NO: 351319 - DNA, 22 bp, Homo sapiens
ttgctggagtcctgttctcaga

SEQ ID NO: 351320 - DNA, 19 bp, Homo sapiens
ttgctggagtgctggctcc

SEQ ID NO: 351321 - DNA, 20 bp, Homo sapiens
ttgctggagtgctggctcca

SEQ ID NO: 351322 - DNA, 15 bp, Homo sapiens
ttgctggcatttgct

SEQ ID NO: 351323 - DNA, 21 bp, Homo sapiens
ttgctggggctcacggggcct

SEQ ID NO: 351324 - DNA, 14 bp, Homo sapiens
ttgctgggtccagg

SEQ ID NO: 351325 - DNA, 20 bp, Homo sapiens
ttgctggtgtctgagcttca

SEQ ID NO: 351326 - DNA, 15 bp, Homo sapiens
ttgctgtaaataaaa

SEQ ID NO: 351327 - DNA, 23 bp, Homo sapiens
ttgctgtaaataaaaatagctat

SEQ ID NO: 351328 - DNA, 23 bp, Homo sapiens
ttgctgtaagcacctgggctgag

SEQ ID NO: 351329 - DNA, 15 bp, Homo sapiens
ttgctgtagagactt

SEQ ID NO: 351330 - DNA, 17 bp, Homo sapiens
ttgctgtatacaaacag

SEQ ID NO: 351331 - DNA, 17 bp, Homo sapiens
ttgctgtcatgtgaatc

SEQ ID NO: 351332 - DNA, 18 bp, Homo sapiens
ttgctgtcccttttcctt

SEQ ID NO: 351333 - DNA, 19 bp, Homo sapiens
ttgctgtctggctttcccg

SEQ ID NO: 351334 - DNA, 12 bp, Homo sapiens
ttgctgtgaaat

SEQ ID NO: 351335 - DNA, 15 bp, Homo sapiens
ttgctgtgaggctgt

SEQ ID NO: 351336 - DNA, 12 bp, Homo sapiens
ttgctgtgccaa

SEQ ID NO: 351337 - DNA, 17 bp, Homo sapiens
ttgctgtggtctctttg

SEQ ID NO: 351338 - DNA, 19 bp, Homo sapiens
ttgctgttgtgcagtgtgc

SEQ ID NO: 351339 - DNA, 18 bp, Homo sapiens
ttgctgtttagcttcctc

SEQ ID NO: 351340 - DNA, 20 bp, Homo sapiens
ttgctgtttagcttcctcca

SEQ ID NO: 351341 - DNA, 17 bp, Homo sapiens
ttgcttaatctagagct

SEQ ID NO: 351342 - DNA, 18 bp, Homo sapiens
ttgcttaatctagagcta

SEQ ID NO: 351343 - DNA, 18 bp, Homo sapiens
ttgcttacatttttacaa

SEQ ID NO: 351344 - DNA, 22 bp, Homo sapiens
ttgcttagatgagggtgactgt

SEQ ID NO: 351345 - DNA, 22 bp, Homo sapiens
ttgcttagtcacttatttcata

SEQ ID NO: 351346 - DNA, 15 bp, Homo sapiens
ttgcttattgttcca

SEQ ID NO: 351347 - DNA, 16 bp, Homo sapiens
ttgcttattgttccaa

SEQ ID NO: 351348 - DNA, 23 bp, Homo sapiens
ttgcttattgttccaagacattg

SEQ ID NO: 351349 - DNA, 22 bp, Homo sapiens
ttgcttccaagcccttccctct

SEQ ID NO: 351350 - DNA, 16 bp, Homo sapiens
ttgcttccccttttgc

SEQ ID NO: 351351 - DNA, 15 bp, Homo sapiens
ttgcttctgggaagg

SEQ ID NO: 351352 - DNA, 14 bp, Homo sapiens
ttgcttctgtagta

SEQ ID NO: 351353 - DNA, 23 bp, Homo sapiens
ttgcttcttcaatggcaccttca

SEQ ID NO: 351354 - DNA, 14 bp, Homo sapiens
ttgcttgaaagaaa

SEQ ID NO: 351355 - DNA, 15 bp, Homo sapiens
ttgcttgccgagcct

SEQ ID NO: 351356 - DNA, 22 bp, Homo sapiens
ttgcttgccgagcctaatgaaa

SEQ ID NO: 351357 - DNA, 22 bp, Homo sapiens
ttgcttgcgtgctgggacagct

SEQ ID NO: 351358 - DNA, 14 bp, Homo sapiens
ttgcttgggccact

SEQ ID NO: 351359 - DNA, 19 bp, Homo sapiens
ttggcctagtcagatggat

SEQ ID NO: 351360 - DNA, 19 bp, Homo sapiens
ttggcctcaagcaaggaag

SEQ ID NO: 351361 - DNA, 17 bp, Homo sapiens
ttggcctcccctgctga

SEQ ID NO: 351362 - DNA, 19 bp, Homo sapiens
ttggcctccggcctcccct

SEQ ID NO: 351363 - DNA, 11 bp, Homo sapiens
ttggcctgcct

SEQ ID NO: 351364 - DNA, 17 bp, Homo sapiens
ttggcctgtcagagctt

SEQ ID NO: 351365 - DNA, 16 bp, Homo sapiens
ttggcctgtctcatcc

SEQ ID NO: 351366 - DNA, 23 bp, Homo sapiens
ttggcctgtctcatccccagggg

SEQ ID NO: 351367 - DNA, 16 bp, Homo sapiens
ttggcgctattacaaa

SEQ ID NO: 351368 - DNA, 18 bp, Homo sapiens
ttggcgctattacaaata

SEQ ID NO: 351369 - DNA, 14 bp, Homo sapiens
ttggcgtggagcag

SEQ ID NO: 351370 - DNA, 14 bp, Homo sapiens
ttggcgttcctgcc

SEQ ID NO: 351371 - DNA, 16 bp, Homo sapiens
ttggctcctttcccac

SEQ ID NO: 351372 - DNA, 18 bp, Homo sapiens
ttggctcctttcccacag

SEQ ID NO: 351373 - DNA, 15 bp, Homo sapiens
ttggctcgggacttc

SEQ ID NO: 351374 - DNA, 21 bp, Homo sapiens
ttggctcgggacttcaaaatc

SEQ ID NO: 351375 - DNA, 16 bp, Homo sapiens
ttggctcttaaggctt

SEQ ID NO: 351376 - DNA, 23 bp, Homo sapiens
ttggctggatgaaattttctaga

SEQ ID NO: 351377 - DNA, 11 bp, Homo sapiens
ttggctgggta

SEQ ID NO: 351378 - DNA, 15 bp, Homo sapiens
ttggcttataaacac

SEQ ID NO: 351379 - DNA, 17 bp, Homo sapiens
ttggcttataaacacat

SEQ ID NO: 351380 - DNA, 20 bp, Homo sapiens
ttggcttataaacacattga

SEQ ID NO: 351381 - DNA, 14 bp, Homo sapiens
ttggcttgcacttt

SEQ ID NO: 351382 - DNA, 17 bp, Homo sapiens
ttggctttaaacaccct

SEQ ID NO: 351383 - DNA, 21 bp, Homo sapiens
ttggctttcatgaggaggcag

SEQ ID NO: 351384 - DNA, 23 bp, Homo sapiens
ttggctttttaaattttccatta

SEQ ID NO: 351385 - DNA, 14 bp, Homo sapiens
ttgggaaaaactgg

SEQ ID NO: 351386 - DNA, 20 bp, Homo sapiens
ttgggaaaatatcactttgt

SEQ ID NO: 351387 - DNA, 15 bp, Homo sapiens
ttgggaaatacaaga

SEQ ID NO: 351388 - DNA, 15 bp, Homo sapiens
ttgggaaattcttgc

SEQ ID NO: 351389 - DNA, 16 bp, Homo sapiens
ttgggacagccagagc

SEQ ID NO: 351390 - DNA, 16 bp, Homo sapiens
ttgggaccgccagatg

SEQ ID NO: 351391 - DNA, 13 bp, Homo sapiens
ttgggactgtctt

SEQ ID NO: 351392 - DNA, 21 bp, Homo sapiens
ttgggagcaaaataaggaaga

SEQ ID NO: 351393 - DNA, 19 bp, Homo sapiens
ttgggagcctgaggcagga

SEQ ID NO: 351394 - DNA, 14 bp, Homo sapiens
ttgggagctctgct

SEQ ID NO: 351395 - DNA, 15 bp, Homo sapiens
ttgggaggccaaggc

SEQ ID NO: 351396 - DNA, 16 bp, Homo sapiens
ttgggaggccaaggca

SEQ ID NO: 351397 - DNA, 23 bp, Homo sapiens
ttgggagtacatatggtagacaa

SEQ ID NO: 351398 - DNA, 16 bp, Homo sapiens
ttgggattgggggctg

SEQ ID NO: 351399 - DNA, 17 bp, Homo sapiens
ttgggcagtggagaggg

SEQ ID NO: 351400 - DNA, 16 bp, Homo sapiens
ttgggcatccacccag

SEQ ID NO: 351401 - DNA, 22 bp, Homo sapiens
ttgggcctccttcccatgcctg

SEQ ID NO: 351402 - DNA, 17 bp, Homo sapiens
ttgggctactggcagct

SEQ ID NO: 351403 - DNA, 20 bp, Homo sapiens
ttgggctactggcagctcct

SEQ ID NO: 351404 - DNA, 24 bp, Homo sapiens
ttgggctactggcagctcctctcc

SEQ ID NO: 351405 - DNA, 20 bp, Homo sapiens
ttgggctcctggctgccagg

SEQ ID NO: 351406 - DNA, 19 bp, Homo sapiens
ttgggctttgcaggctctg

SEQ ID NO: 351407 - DNA, 14 bp, Homo sapiens
ttggggcctggctt

SEQ ID NO: 351408 - DNA, 16 bp, Homo sapiens
ttggggcctggcttgc

SEQ ID NO: 351409 - DNA, 19 bp, Homo sapiens
ttgggggattcaaatgcat

SEQ ID NO: 351410 - DNA, 16 bp, Homo sapiens
ttgggggctggtgcca

SEQ ID NO: 351411 - DNA, 16 bp, Homo sapiens
ttgggggctgtgggga

SEQ ID NO: 351412 - DNA, 19 bp, Homo sapiens
ttggggtactcttgatgtg

SEQ ID NO: 351413 - DNA, 23 bp, Homo sapiens
ttggggtactcttgatgtgaaga

SEQ ID NO: 351414 - DNA, 15 bp, Homo sapiens
ttggggtagagagga

SEQ ID NO: 351415 - DNA, 21 bp, Homo sapiens
ttgggtatcctgcccagtgtt

SEQ ID NO: 351416 - DNA, 17 bp, Homo sapiens
ttgggtctgaaaggaaa

SEQ ID NO: 351417 - DNA, 22 bp, Homo sapiens
ttgtctggctgtggcccctcct

SEQ ID NO: 351418 - DNA, 21 bp, Homo sapiens
ttgtctgtgtatttctatttt

SEQ ID NO: 351419 - DNA, 13 bp, Homo sapiens
ttgtcttatatat

SEQ ID NO: 351420 - DNA, 15 bp, Homo sapiens
ttgtcttatatatat

SEQ ID NO: 351421 - DNA, 13 bp, Homo sapiens
ttgtcttgtggag

SEQ ID NO: 351422 - DNA, 14 bp, Homo sapiens
ttgtctttaaagtt

SEQ ID NO: 351423 - DNA, 19 bp, Homo sapiens
ttgtctttagtgccggctg

SEQ ID NO: 351424 - DNA, 13 bp, Homo sapiens
ttgtctttcagga

SEQ ID NO: 351425 - DNA, 15 bp, Homo sapiens
ttgtctttctttgct

SEQ ID NO: 351426 - DNA, 14 bp, Homo sapiens
ttgtctttgaacgt

SEQ ID NO: 351427 - DNA, 15 bp, Homo sapiens
ttgtcttttcccctc

SEQ ID NO: 351428 - DNA, 20 bp, Homo sapiens
ttgtgaaaggaaagaggctc

SEQ ID NO: 351429 - DNA, 15 bp, Homo sapiens
ttgtgaaatgtctgt

SEQ ID NO: 351430 - DNA, 11 bp, Homo sapiens
ttgtgaaattt

SEQ ID NO: 351431 - DNA, 19 bp, Homo sapiens
ttgtgaaccaactgcctta

SEQ ID NO: 351432 - DNA, 17 bp, Homo sapiens
ttgtgaagatgtttgca

SEQ ID NO: 351433 - DNA, 19 bp, Homo sapiens
ttgtgaagtgattgacatt

SEQ ID NO: 351434 - DNA, 18 bp, Homo sapiens
ttgtgaattgataataaa

SEQ ID NO: 351435 - DNA, 15 bp, Homo sapiens
ttgtgacattcactc

SEQ ID NO: 351436 - DNA, 17 bp, Homo sapiens
ttgtgacccaattaagt

SEQ ID NO: 351437 - DNA, 23 bp, Homo sapiens
ttgtgactagtgctgaagcttat

SEQ ID NO: 351438 - DNA, 14 bp, Homo sapiens
ttgtgactgaaggg

SEQ ID NO: 351439 - DNA, 12 bp, Homo sapiens
ttgtgactggca

SEQ ID NO: 351440 - DNA, 11 bp, Homo sapiens
ttgtgagagcg

SEQ ID NO: 351441 - DNA, 15 bp, Homo sapiens
ttgtgagagcgaggc

SEQ ID NO: 351442 - DNA, 18 bp, Homo sapiens
ttgtgagccttgctgcca

SEQ ID NO: 351443 - DNA, 20 bp, Homo sapiens
ttgtgagccttgctgccaag

SEQ ID NO: 351444 - DNA, 21 bp, Homo sapiens
ttgtgagccttgctgccaagt

SEQ ID NO: 351445 - DNA, 20 bp, Homo sapiens
ttgtgaggcccatggttgag

SEQ ID NO: 351446 - DNA, 22 bp, Homo sapiens
ttgtgaggtgaatgtcttcctt

SEQ ID NO: 351447 - DNA, 15 bp, Homo sapiens
ttgtgagtatgtgtg

SEQ ID NO: 351448 - DNA, 20 bp, Homo sapiens
ttgtgatagctaacatttta

SEQ ID NO: 351449 - DNA, 21 bp, Homo sapiens
ttgtgatattgaccatgtgat

SEQ ID NO: 351450 - DNA, 22 bp, Homo sapiens
ttgtgccaatatgtattgtaaa

SEQ ID NO: 351451 - DNA, 17 bp, Homo sapiens
ttgtgccctgcctccac

SEQ ID NO: 351452 - DNA, 11 bp, Homo sapiens
ttgtgcctccc

SEQ ID NO: 351453 - DNA, 17 bp, Homo sapiens
ttgtgcctcccttccca

SEQ ID NO: 351454 - DNA, 21 bp, Homo sapiens
ttgtgcggtgtgtctccagct

SEQ ID NO: 351455 - DNA, 15 bp, Homo sapiens
ttgtgctcagcatga

SEQ ID NO: 351456 - DNA, 11 bp, Homo sapiens
ttgtgctgagt

SEQ ID NO: 351457 - DNA, 14 bp, Homo sapiens
ttgtgctgatgaga

SEQ ID NO: 351458 - DNA, 22 bp, Homo sapiens
ttgtgctttataccccatttga

SEQ ID NO: 351459 - DNA, 21 bp, Homo sapiens
ttgtggaaaatgaaaattagg

SEQ ID NO: 351460 - DNA, 15 bp, Homo sapiens
ttgtggaacaaaagt

SEQ ID NO: 351461 - DNA, 21 bp, Homo sapiens
ttgtggactttatttaatttc

SEQ ID NO: 351462 - DNA, 15 bp, Homo sapiens
ttgtggagaggagag

SEQ ID NO: 351463 - DNA, 23 bp, Homo sapiens
ttgtttttgaatttaaataaagt

SEQ ID NO: 351464 - DNA, 16 bp, Homo sapiens
ttgttttttaaagtct

SEQ ID NO: 351465 - DNA, 21 bp, Homo sapiens
ttgttttttaaagtcttgctg

SEQ ID NO: 351466 - DNA, 22 bp, Homo sapiens
ttgtttttttcctttttcctcc

SEQ ID NO: 351467 - DNA, 18 bp, Homo sapiens
ttgttttttttttccact

SEQ ID NO: 351468 - DNA, 19 bp, Homo sapiens
ttgttttttttttccactt

SEQ ID NO: 351469 - DNA, 20 bp, Homo sapiens
tttaaaaaaaaacattcaaa

SEQ ID NO: 351470 - DNA, 21 bp, Homo sapiens
tttaaaaaaataacatctctt

SEQ ID NO: 351471 - DNA, 23 bp, Homo sapiens
tttaaaaaaataacatctgaaaa

SEQ ID NO: 351472 - DNA, 14 bp, Homo sapiens
tttaaaaaaataat

SEQ ID NO: 351473 - DNA, 22 bp, Homo sapiens
tttaaaaaaataatataaatga

SEQ ID NO: 351474 - DNA, 23 bp, Homo sapiens
tttaaaaaaataatataaatgaa

SEQ ID NO: 351475 - DNA, 22 bp, Homo sapiens
tttaaaaaaatacagtattctg

SEQ ID NO: 351476 - DNA, 23 bp, Homo sapiens
tttaaaaaacaaaaaccagcagg

SEQ ID NO: 351477 - DNA, 17 bp, Homo sapiens
tttaaaaaggcctttgg

SEQ ID NO: 351478 - DNA, 15 bp, Homo sapiens
tttaaaaagtcttca

SEQ ID NO: 351479 - DNA, 17 bp, Homo sapiens
tttaaaaagttgcacat

SEQ ID NO: 351480 - DNA, 12 bp, Homo sapiens
tttaaaaatgat

SEQ ID NO: 351481 - DNA, 11 bp, Homo sapiens
tttaaaacaaa

SEQ ID NO: 351482 - DNA, 13 bp, Homo sapiens
tttaaaacaatga

SEQ ID NO: 351483 - DNA, 23 bp, Homo sapiens
tttaaaaccactatgcaaagaac

SEQ ID NO: 351484 - DNA, 12 bp, Homo sapiens
tttaaaagacac

SEQ ID NO: 351485 - DNA, 19 bp, Homo sapiens
tttaaaagccctttccaaa

SEQ ID NO: 351486 - DNA, 20 bp, Homo sapiens
tttaaaaggtattttgaata

SEQ ID NO: 351487 - DNA, 21 bp, Homo sapiens
tttaaaaggtattttgaatac

SEQ ID NO: 351488 - DNA, 17 bp, Homo sapiens
tttaaaagtttcaatgt

SEQ ID NO: 351489 - DNA, 20 bp, Homo sapiens
tttaaaagtttcaatgtgat

SEQ ID NO: 351490 - DNA, 18 bp, Homo sapiens
tttaaaagtttgtccttt

SEQ ID NO: 351491 - DNA, 12 bp, Homo sapiens
tttaaaatataa

SEQ ID NO: 351492 - DNA, 12 bp, Homo sapiens
tttaaaatgatt

SEQ ID NO: 351493 - DNA, 20 bp, Homo sapiens
tttaaaatgtaaactcttca

SEQ ID NO: 351494 - DNA, 14 bp, Homo sapiens
tttaaaattattaa

SEQ ID NO: 351495 - DNA, 21 bp, Homo sapiens
tttaaaattattaaaaattat

SEQ ID NO: 351496 - DNA, 19 bp, Homo sapiens
tttaaaatttaagtatctt

SEQ ID NO: 351497 - DNA, 14 bp, Homo sapiens
tttaaaccactaat

SEQ ID NO: 351498 - DNA, 19 bp, Homo sapiens
tttaaactaaccttttatc

SEQ ID NO: 351499 - DNA, 14 bp, Homo sapiens
tttaaacttataaa

SEQ ID NO: 351500 - DNA, 23 bp, Homo sapiens
tttcaatccacagtattgttctt

SEQ ID NO: 351501 - DNA, 13 bp, Homo sapiens
tttcaatcccaat

SEQ ID NO: 351502 - DNA, 21 bp, Homo sapiens
tttcaatgattgtttaattgt

SEQ ID NO: 351503 - DNA, 23 bp, Homo sapiens
tttcaatggttgggacaatggca

SEQ ID NO: 351504 - DNA, 18 bp, Homo sapiens
tttcaattgcagatgcca

SEQ ID NO: 351505 - DNA, 18 bp, Homo sapiens
tttcaatttactttttaa

SEQ ID NO: 351506 - DNA, 22 bp, Homo sapiens
tttcacaaccttctgtggctca

SEQ ID NO: 351507 - DNA, 18 bp, Homo sapiens
tttcaccatctttctaat

SEQ ID NO: 351508 - DNA, 22 bp, Homo sapiens
tttcacctgtttttaagctgtt

SEQ ID NO: 351509 - DNA, 16 bp, Homo sapiens
tttcactagagacaaa

SEQ ID NO: 351510 - DNA, 22 bp, Homo sapiens
tttcactgataccacgaggaaa

SEQ ID NO: 351511 - DNA, 10 bp, Homo sapiens
tttcactgct

SEQ ID NO: 351512 - DNA, 20 bp, Homo sapiens
tttcactgctggctgcctta

SEQ ID NO: 351513 - DNA, 24 bp, Homo sapiens
tttcactgctggctgccttagaac

SEQ ID NO: 351514 - DNA, 17 bp, Homo sapiens
tttcactggagttacat

SEQ ID NO: 351515 - DNA, 18 bp, Homo sapiens
tttcactggagttacatt

SEQ ID NO: 351516 - DNA, 12 bp, Homo sapiens
tttcactgggga

SEQ ID NO: 351517 - DNA, 13 bp, Homo sapiens
tttcacttgtctt

SEQ ID NO: 351518 - DNA, 22 bp, Homo sapiens
tttcagaaaatattatgtgttt

SEQ ID NO: 351519 - DNA, 20 bp, Homo sapiens
tttcagaaagggcagcccct

SEQ ID NO: 351520 - DNA, 20 bp, Homo sapiens
tttcagaacctcttccccag

SEQ ID NO: 351521 - DNA, 14 bp, Homo sapiens
tttcagaagtactg

SEQ ID NO: 351522 - DNA, 18 bp, Homo sapiens
tttcagaagtactggcat

SEQ ID NO: 351523 - DNA, 12 bp, Homo sapiens
tttcagagattt

SEQ ID NO: 351524 - DNA, 15 bp, Homo sapiens
tttcagatgctttag

SEQ ID NO: 351525 - DNA, 12 bp, Homo sapiens
tttcagatgtct

SEQ ID NO: 351526 - DNA, 19 bp, Homo sapiens
tttcagatgtcttctgcct

SEQ ID NO: 351527 - DNA, 20 bp, Homo sapiens
tttcagatgtcttctgcctg

SEQ ID NO: 351528 - DNA, 19 bp, Homo sapiens
tttcagcatcaaacatgaa

SEQ ID NO: 351529 - DNA, 15 bp, Homo sapiens
tttcagccaagaatt

SEQ ID NO: 351530 - DNA, 17 bp, Homo sapiens
tttcagccaagaattct

SEQ ID NO: 351531 - DNA, 19 bp, Homo sapiens
tttcagccaatttgtctcc

SEQ ID NO: 351532 - DNA, 23 bp, Homo sapiens
tttcagccaatttgtctcctact

SEQ ID NO: 351533 - DNA, 21 bp, Homo sapiens
tttcagcctgcttcttcccca

SEQ ID NO: 351534 - DNA, 19 bp, Homo sapiens
tttcagctagttaataatt

SEQ ID NO: 351535 - DNA, 14 bp, Homo sapiens
tttcagctgtgaac

SEQ ID NO: 351536 - DNA, 13 bp, Homo sapiens
tttcagcttaaaa

SEQ ID NO: 351537 - DNA, 17 bp, Homo sapiens
tttcagcttgtttctat

SEQ ID NO: 351538 - DNA, 19 bp, Homo sapiens
tttcagcttgtttctatac

SEQ ID NO: 351539 - DNA, 22 bp, Homo sapiens
tttcagcttgtttctatactgt

SEQ ID NO: 351540 - DNA, 22 bp, Homo sapiens
tttcaggaagttgctgagaaat

SEQ ID NO: 351541 - DNA, 22 bp, Homo sapiens
tttcaggcaaggcagctcccag

SEQ ID NO: 351542 - DNA, 17 bp, Homo sapiens
tttcaggttaaattaaa

SEQ ID NO: 351543 - DNA, 11 bp, Homo sapiens
tttcagtaata

SEQ ID NO: 351544 - DNA, 18 bp, Homo sapiens
tttcagtatactgtgtgg

SEQ ID NO: 351545 - DNA, 17 bp, Homo sapiens
tttcagtatcatctcca

SEQ ID NO: 351546 - DNA, 20 bp, Homo sapiens
tttcagtattaaactctcct

SEQ ID NO: 351547 - DNA, 17 bp, Homo sapiens
tttcagttaagttgctg

SEQ ID NO: 351548 - DNA, 11 bp, Homo sapiens
tttcataaatt

SEQ ID NO: 351549 - DNA, 18 bp, Homo sapiens
tttcataaggcctgccct

SEQ ID NO: 351550 - DNA, 22 bp, Homo sapiens
tttcataaggcctgccctccca

SEQ ID NO: 351551 - DNA, 20 bp, Homo sapiens
tttcatagataccattttga

SEQ ID NO: 351552 - DNA, 21 bp, Homo sapiens
tttcatagtgcctttttcctt

SEQ ID NO: 351553 - DNA, 22 bp, Homo sapiens
tttcatagtgcctttttcctta

SEQ ID NO: 351554 - DNA, 17 bp, Homo sapiens
tttcatagttctgttaa

SEQ ID NO: 351555 - DNA, 14 bp, Homo sapiens
tttcatattgtgcc

SEQ ID NO: 351556 - DNA, 15 bp, Homo sapiens
tttcatattgtgcca

SEQ ID NO: 351557 - DNA, 14 bp, Homo sapiens
tttcatcaatttaa

SEQ ID NO: 351558 - DNA, 14 bp, Homo sapiens
tttcatcctggcct

SEQ ID NO: 351559 - DNA, 15 bp, Homo sapiens
tttcatcctggcctc

SEQ ID NO: 351560 - DNA, 12 bp, Homo sapiens
tttcatcctgtg

SEQ ID NO: 351561 - DNA, 16 bp, Homo sapiens
tttcatcctgtgtccc

SEQ ID NO: 351562 - DNA, 18 bp, Homo sapiens
tttcatcctgtgtcccct

SEQ ID NO: 351563 - DNA, 17 bp, Homo sapiens
tttcatccttttttctc

SEQ ID NO: 351564 - DNA, 20 bp, Homo sapiens
tttcatccttttttctcttc

SEQ ID NO: 351565 - DNA, 14 bp, Homo sapiens
tttcatgattagac

SEQ ID NO: 351566 - DNA, 16 bp, Homo sapiens
tttcatgattagacaa

SEQ ID NO: 351567 - DNA, 21 bp, Homo sapiens
tttcatgattagcaagttaca

SEQ ID NO: 351568 - DNA, 12 bp, Homo sapiens
tttcatggaagt

SEQ ID NO: 351569 - DNA, 14 bp, Homo sapiens
tttcatgtaaataa

SEQ ID NO: 351570 - DNA, 21 bp, Homo sapiens
tttcatgtagaactcagcagt

SEQ ID NO: 351571 - DNA, 12 bp, Homo sapiens
tttcatgtgatc

SEQ ID NO: 351572 - DNA, 20 bp, Homo sapiens
tttcatgtgatctattactc

SEQ ID NO: 351573 - DNA, 23 bp, Homo sapiens
tttcattaaaatagattatccca

SEQ ID NO: 351574 - DNA, 14 bp, Homo sapiens
tttcattgaatact

SEQ ID NO: 351575 - DNA, 16 bp, Homo sapiens
tttcattgagggaaaa

SEQ ID NO: 351576 - DNA, 15 bp, Homo sapiens
tttcattgccttcct

SEQ ID NO: 351577 - DNA, 23 bp, Homo sapiens
tttcattgctgtgtcacactctg

SEQ ID NO: 351578 - DNA, 16 bp, Homo sapiens
tttcattgtatgatgt

SEQ ID NO: 351579 - DNA, 18 bp, Homo sapiens
tttcattgtatgatgtgt

SEQ ID NO: 351580 - DNA, 23 bp, Homo sapiens
tttcattgtatgatgtgttgtga

SEQ ID NO: 351581 - DNA, 13 bp, Homo sapiens
tttcattgtctct

SEQ ID NO: 351582 - DNA, 14 bp, Homo sapiens
tttcatttaggtga

SEQ ID NO: 351583 - DNA, 18 bp, Homo sapiens
tttccaaaggttgtacat

SEQ ID NO: 351584 - DNA, 21 bp, Homo sapiens
tttccaaattgatgggtgggc

SEQ ID NO: 351585 - DNA, 22 bp, Homo sapiens
tttccaagcctgggccactggc

SEQ ID NO: 351586 - DNA, 13 bp, Homo sapiens
tttccaaggtgca

SEQ ID NO: 351587 - DNA, 20 bp, Homo sapiens
tttccaagtttattgccctc

SEQ ID NO: 351588 - DNA, 18 bp, Homo sapiens
tttccacatccccaccct

SEQ ID NO: 351589 - DNA, 15 bp, Homo sapiens
tttccacatgctctg

SEQ ID NO: 351590 - DNA, 17 bp, Homo sapiens
tttccacatttgtcaca

SEQ ID NO: 351591 - DNA, 15 bp, Homo sapiens
tttccaccccctccc

SEQ ID NO: 351592 - DNA, 16 bp, Homo sapiens
tttccaccctgtctag

SEQ ID NO: 351593 - DNA, 16 bp, Homo sapiens
tttccacggaaacaga

SEQ ID NO: 351594 - DNA, 20 bp, Homo sapiens
tttccacggaaacagaactc

SEQ ID NO: 351595 - DNA, 16 bp, Homo sapiens
tttccactcccactgc

SEQ ID NO: 351596 - DNA, 12 bp, Homo sapiens
tttccactttgt

SEQ ID NO: 351597 - DNA, 12 bp, Homo sapiens
tttccagaattg

SEQ ID NO: 351598 - DNA, 17 bp, Homo sapiens
tttccagcaaaatatat

SEQ ID NO: 351599 - DNA, 20 bp, Homo sapiens
tttccagctaagcctgatga

SEQ ID NO: 351600 - DNA, 12 bp, Homo sapiens
tttccagctgcc

SEQ ID NO: 351601 - DNA, 21 bp, Homo sapiens
tttccagctgccaagtgctct

SEQ ID NO: 351602 - DNA, 19 bp, Homo sapiens
tttccaggcccctgaggac

SEQ ID NO: 351603 - DNA, 23 bp, Homo sapiens
tttccagtattgaaaacttcaaa

SEQ ID NO: 351604 - DNA, 12 bp, Homo sapiens
tttccagtgcaa

SEQ ID NO: 351605 - DNA, 18 bp, Homo sapiens
tttccatatggattttct

SEQ ID NO: 351606 - DNA, 12 bp, Homo sapiens
tttccatatgtt

SEQ ID NO: 351607 - DNA, 14 bp, Homo sapiens
tttccatctaaaat

SEQ ID NO: 351608 - DNA, 15 bp, Homo sapiens
tttccatgtggcctt

SEQ ID NO: 351609 - DNA, 18 bp, Homo sapiens
tttccatttctgatgtct

SEQ ID NO: 351610 - DNA, 13 bp, Homo sapiens
tttccctgagagc

SEQ ID NO: 351611 - DNA, 14 bp, Homo sapiens
tttccctgcatccc

SEQ ID NO: 351612 - DNA, 14 bp, Homo sapiens
tttccctggctcag

SEQ ID NO: 351613 - DNA, 14 bp, Homo sapiens
tttcccttccagtt

SEQ ID NO: 351614 - DNA, 16 bp, Homo sapiens
tttcccttcccttcca

SEQ ID NO: 351615 - DNA, 17 bp, Homo sapiens
tttcccttgcttcccct

SEQ ID NO: 351616 - DNA, 21 bp, Homo sapiens
tttccgtgagctcaaactggc

SEQ ID NO: 351617 - DNA, 23 bp, Homo sapiens
tttcctaacaaaagatgaaagca

SEQ ID NO: 351618 - DNA, 22 bp, Homo sapiens
tttcctaatcagaaatttttat

SEQ ID NO: 351619 - DNA, 20 bp, Homo sapiens
tttcctaattaaaataagaa

SEQ ID NO: 351620 - DNA, 20 bp, Homo sapiens
tttcctagtatacccactgc

SEQ ID NO: 351621 - DNA, 17 bp, Homo sapiens
tttcctatctgtatgtc

SEQ ID NO: 351622 - DNA, 19 bp, Homo sapiens
tttcctcattcctgaaaga

SEQ ID NO: 351623 - DNA, 16 bp, Homo sapiens
tttcctccccagcagg

SEQ ID NO: 351624 - DNA, 13 bp, Homo sapiens
tttcctcccttct

SEQ ID NO: 351625 - DNA, 15 bp, Homo sapiens
tttcctcccttgggt

SEQ ID NO: 351626 - DNA, 14 bp, Homo sapiens
tttcctccttccat

SEQ ID NO: 351627 - DNA, 15 bp, Homo sapiens
tttcctcctttatca

SEQ ID NO: 351628 - DNA, 15 bp, Homo sapiens
tttcctctctatctt

SEQ ID NO: 351629 - DNA, 12 bp, Homo sapiens
tttcctctctct

SEQ ID NO: 351630 - DNA, 14 bp, Homo sapiens
tttcctctctctct

SEQ ID NO: 351631 - DNA, 23 bp, Homo sapiens
tttcctctctctctctctctctg

SEQ ID NO: 351632 - DNA, 16 bp, Homo sapiens
tttcctctgagctgtt

SEQ ID NO: 351633 - DNA, 20 bp, Homo sapiens
tttcctctgagctgttatct

SEQ ID NO: 351634 - DNA, 18 bp, Homo sapiens
tttcctcttccttctcta

SEQ ID NO: 351635 - DNA, 22 bp, Homo sapiens
tttcctgccataaaagctatga

SEQ ID NO: 351636 - DNA, 21 bp, Homo sapiens
tttcctggataaaaaagaaaa

SEQ ID NO: 351637 - DNA, 17 bp, Homo sapiens
tttcctgggccttctca

SEQ ID NO: 351638 - DNA, 18 bp, Homo sapiens
tttcctgggccttctcag

SEQ ID NO: 351639 - DNA, 15 bp, Homo sapiens
tttcctgtcaatata

SEQ ID NO: 351640 - DNA, 22 bp, Homo sapiens
tttcctgtgcccatcatctctg

SEQ ID NO: 351641 - DNA, 19 bp, Homo sapiens
tttccttagacccgccagg

SEQ ID NO: 351642 - DNA, 13 bp, Homo sapiens
tttccttcagagt

SEQ ID NO: 351643 - DNA, 15 bp, Homo sapiens
tttccttcctgccct

SEQ ID NO: 351644 - DNA, 16 bp, Homo sapiens
tttccttcctgccctg

SEQ ID NO: 351645 - DNA, 16 bp, Homo sapiens
tttccttctaacatgt

SEQ ID NO: 351646 - DNA, 20 bp, Homo sapiens
tttccttctcgtcttcctct

SEQ ID NO: 351647 - DNA, 19 bp, Homo sapiens
tttcctttatatttagtga

SEQ ID NO: 351648 - DNA, 21 bp, Homo sapiens
tttccttttctattccttctg

SEQ ID NO: 351649 - DNA, 13 bp, Homo sapiens
tttcgttaacatt

SEQ ID NO: 351650 - DNA, 15 bp, Homo sapiens
tttctaaaaagtcaa

SEQ ID NO: 351651 - DNA, 15 bp, Homo sapiens
tttctaaaacaagtt

SEQ ID NO: 351652 - DNA, 12 bp, Homo sapiens
tttctaaaacat

SEQ ID NO: 351653 - DNA, 18 bp, Homo sapiens
tttctaaaacattaattg

SEQ ID NO: 351654 - DNA, 13 bp, Homo sapiens
tttctaaaactat

SEQ ID NO: 351655 - DNA, 12 bp, Homo sapiens
tttctaaactgt

SEQ ID NO: 351656 - DNA, 13 bp, Homo sapiens
tttctaaagtgtt

SEQ ID NO: 351657 - DNA, 17 bp, Homo sapiens
tttctaaagtgttggtc

SEQ ID NO: 351658 - DNA, 17 bp, Homo sapiens
tttctaaatttgataat

SEQ ID NO: 351659 - DNA, 21 bp, Homo sapiens
tttctaaggatagcctttgta

SEQ ID NO: 351660 - DNA, 15 bp, Homo sapiens
tttctaatgtgtgaa

SEQ ID NO: 351661 - DNA, 16 bp, Homo sapiens
tttctaatttgaatga

SEQ ID NO: 351662 - DNA, 16 bp, Homo sapiens
tttctaatttgctgct

SEQ ID NO: 351663 - DNA, 14 bp, Homo sapiens
tttctacaactgat

SEQ ID NO: 351664 - DNA, 12 bp, Homo sapiens
tttctacagaga

SEQ ID NO: 351665 - DNA, 16 bp, Homo sapiens
tttctaccttgaggtc

SEQ ID NO: 351666 - DNA, 15 bp, Homo sapiens
tttctactcattttt

SEQ ID NO: 351667 - DNA, 23 bp, Homo sapiens
tttctactcgagttacagacaaa

SEQ ID NO: 351668 - DNA, 15 bp, Homo sapiens
tttctactgaagttg

SEQ ID NO: 351669 - DNA, 16 bp, Homo sapiens
tttctacttttaaaga

SEQ ID NO: 351670 - DNA, 16 bp, Homo sapiens
tttctagacttgtgct

SEQ ID NO: 351671 - DNA, 16 bp, Homo sapiens
tttctagactttctgt

SEQ ID NO: 351672 - DNA, 22 bp, Homo sapiens
tttctagctataacaactctat

SEQ ID NO: 351673 - DNA, 19 bp, Homo sapiens
tttctagctgttgagctgt

SEQ ID NO: 351674 - DNA, 17 bp, Homo sapiens
tttctatactgtttgta

SEQ ID NO: 351675 - DNA, 15 bp, Homo sapiens
tttctatataaaatg

SEQ ID NO: 351676 - DNA, 15 bp, Homo sapiens
tttctatatttgtaa

SEQ ID NO: 351677 - DNA, 17 bp, Homo sapiens
tttctatatttgtaact

SEQ ID NO: 351678 - DNA, 17 bp, Homo sapiens
tttctatctgcaaatag

SEQ ID NO: 351679 - DNA, 18 bp, Homo sapiens
tttctatggattcacttc

SEQ ID NO: 351680 - DNA, 18 bp, Homo sapiens
tttctatgtaaattattg

SEQ ID NO: 351681 - DNA, 19 bp, Homo sapiens
tttctatgtagaactgttc

SEQ ID NO: 351682 - DNA, 19 bp, Homo sapiens
tttctattccttctggcct

SEQ ID NO: 351683 - DNA, 13 bp, Homo sapiens
tttctcaaaagca

SEQ ID NO: 351684 - DNA, 16 bp, Homo sapiens
tttctcaaaagcattt

SEQ ID NO: 351685 - DNA, 19 bp, Homo sapiens
tttctcaaaagcatttatc

SEQ ID NO: 351686 - DNA, 20 bp, Homo sapiens
tttctcaaagtttttacagt

SEQ ID NO: 351687 - DNA, 23 bp, Homo sapiens
tttctcaaataaagttcaaagca

SEQ ID NO: 351688 - DNA, 19 bp, Homo sapiens
tttctcagactggtctcga

SEQ ID NO: 351689 - DNA, 19 bp, Homo sapiens
tttctcatgtgctttgtag

SEQ ID NO: 351690 - DNA, 22 bp, Homo sapiens
tttctcattgatcacagatgtg

SEQ ID NO: 351691 - DNA, 11 bp, Homo sapiens
tttctccaggc

SEQ ID NO: 351692 - DNA, 18 bp, Homo sapiens
tttctccggggtctgtgc

SEQ ID NO: 351693 - DNA, 16 bp, Homo sapiens
tttctccgtatttatt

SEQ ID NO: 351694 - DNA, 15 bp, Homo sapiens
tttctctacactaag

SEQ ID NO: 351695 - DNA, 22 bp, Homo sapiens
tttctctcaaatgatacagtca

SEQ ID NO: 351696 - DNA, 13 bp, Homo sapiens
tttctctctgtgt

SEQ ID NO: 351697 - DNA, 23 bp, Homo sapiens
tttctctctgtgtggcaaacatt

SEQ ID NO: 351698 - DNA, 13 bp, Homo sapiens
tttctcttgggct

SEQ ID NO: 351699 - DNA, 12 bp, Homo sapiens
tttctctttctc

SEQ ID NO: 351700 - DNA, 14 bp, Homo sapiens
tttctctttctcct

SEQ ID NO: 351701 - DNA, 21 bp, Homo sapiens
tttctctttgggtttcttgtt

SEQ ID NO: 351702 - DNA, 23 bp, Homo sapiens
tttctctttgtggggcttggcgt

SEQ ID NO: 351703 - DNA, 14 bp, Homo sapiens
tttctgaaataaca

SEQ ID NO: 351704 - DNA, 19 bp, Homo sapiens
tttctgacccactgatctc

SEQ ID NO: 351705 - DNA, 22 bp, Homo sapiens
tttctgactgcaacttctgtcc

SEQ ID NO: 351706 - DNA, 19 bp, Homo sapiens
tttctgagcttttcatgga

SEQ ID NO: 351707 - DNA, 19 bp, Homo sapiens
tttctgcagccactattgt

SEQ ID NO: 351708 - DNA, 21 bp, Homo sapiens
tttctgcagccactattgtta

SEQ ID NO: 351709 - DNA, 19 bp, Homo sapiens
tttctgcccaactttcatt

SEQ ID NO: 351710 - DNA, 23 bp, Homo sapiens
tttctggactgaagcctgcagga

SEQ ID NO: 351711 - DNA, 13 bp, Homo sapiens
tttctggctcctg

SEQ ID NO: 351712 - DNA, 14 bp, Homo sapiens
tttctggctcctgt

SEQ ID NO: 351713 - DNA, 16 bp, Homo sapiens
tttctggctcctgtgt

SEQ ID NO: 351714 - DNA, 16 bp, Homo sapiens
tttctgggataagtaa

SEQ ID NO: 351715 - DNA, 17 bp, Homo sapiens
tttctggtaggttctgt

SEQ ID NO: 351716 - DNA, 15 bp, Homo sapiens
tttctgtaaatgaag

SEQ ID NO: 351717 - DNA, 12 bp, Homo sapiens
tttctgtagaat

SEQ ID NO: 351718 - DNA, 14 bp, Homo sapiens
tttctgtagaatgc

SEQ ID NO: 351719 - DNA, 22 bp, Homo sapiens
tttctgtagaatgctgtagaat

SEQ ID NO: 351720 - DNA, 15 bp, Homo sapiens
tttctgtccagaaaa

SEQ ID NO: 351721 - DNA, 22 bp, Homo sapiens
tttctgtcctcaggtgaataac

SEQ ID NO: 351722 - DNA, 14 bp, Homo sapiens
tttctgtctctctc

SEQ ID NO: 351723 - DNA, 17 bp, Homo sapiens
tttctgtggaaaacaat

SEQ ID NO: 351724 - DNA, 23 bp, Homo sapiens
tttctgtggttgcagcctgacca

SEQ ID NO: 351725 - DNA, 14 bp, Homo sapiens
tttctgttcatctt

SEQ ID NO: 351726 - DNA, 11 bp, Homo sapiens
tttctgttctg

SEQ ID NO: 351727 - DNA, 23 bp, Homo sapiens
cctgctctttctacatgactggg

SEQ ID NO: 351728 - DNA, 18 bp, Homo sapiens
cctgctgagagcccccac

SEQ ID NO: 351729 - DNA, 20 bp, Homo sapiens
cctgctgagagcccccacct

SEQ ID NO: 351730 - DNA, 17 bp, Homo sapiens
cctgctgccccagctga

SEQ ID NO: 351731 - DNA, 16 bp, Homo sapiens
cctgctgccgccactg

SEQ ID NO: 351732 - DNA, 23 bp, Homo sapiens
cctgctgccgcctcccagcctgg

SEQ ID NO: 351733 - DNA, 13 bp, Homo sapiens
cctgctgcctgcc

SEQ ID NO: 351734 - DNA, 22 bp, Homo sapiens
cctgctgcgtcagaccagtact

SEQ ID NO: 351735 - DNA, 16 bp, Homo sapiens
cctgctgctcctcggc

SEQ ID NO: 351736 - DNA, 19 bp, Homo sapiens
cctgctgctcctcggccag

SEQ ID NO: 351737 - DNA, 20 bp, Homo sapiens
cctgctgctgtaactgctga

SEQ ID NO: 351738 - DNA, 16 bp, Homo sapiens
cctgctgcttcctaac

SEQ ID NO: 351739 - DNA, 21 bp, Homo sapiens
cctgctgcttcctaacttatt

SEQ ID NO: 351740 - DNA, 12 bp, Homo sapiens
cctgctggcccc

SEQ ID NO: 351741 - DNA, 14 bp, Homo sapiens
cctgctggcccctc

SEQ ID NO: 351742 - DNA, 15 bp, Homo sapiens
cctgctggcccctca

SEQ ID NO: 351743 - DNA, 16 bp, Homo sapiens
cctgctggctgaggct

SEQ ID NO: 351744 - DNA, 17 bp, Homo sapiens
cctgctggctgaggctt

SEQ ID NO: 351745 - DNA, 19 bp, Homo sapiens
cctgctggctgaggcttgg

SEQ ID NO: 351746 - DNA, 21 bp, Homo sapiens
cctgctgggaaccccgcagcc

SEQ ID NO: 351747 - DNA, 23 bp, Homo sapiens
cctgctgggaaccccgcagcccg

SEQ ID NO: 351748 - DNA, 15 bp, Homo sapiens
cctgctgggtaaact

SEQ ID NO: 351749 - DNA, 17 bp, Homo sapiens
cctgctggttcactcta

SEQ ID NO: 351750 - DNA, 16 bp, Homo sapiens
cctgctgtgggtcagt

SEQ ID NO: 351751 - DNA, 23 bp, Homo sapiens
cctgcttaatgtcagtctacagg

SEQ ID NO: 351752 - DNA, 21 bp, Homo sapiens
cctgcttagaacccttctgct

SEQ ID NO: 351753 - DNA, 14 bp, Homo sapiens
cctgcttcacaccc

SEQ ID NO: 351754 - DNA, 22 bp, Homo sapiens
cctgcttcacacccctcagcgc

SEQ ID NO: 351755 - DNA, 17 bp, Homo sapiens
cctgcttcatatctctc

SEQ ID NO: 351756 - DNA, 17 bp, Homo sapiens
cctgcttcccaaactcc

SEQ ID NO: 351757 - DNA, 14 bp, Homo sapiens
cctgcttcccacct

SEQ ID NO: 351758 - DNA, 13 bp, Homo sapiens
cctgcttcccggg

SEQ ID NO: 351759 - DNA, 17 bp, Homo sapiens
cctgcttctcttttcct

SEQ ID NO: 351760 - DNA, 13 bp, Homo sapiens
cctgcttctgctg

SEQ ID NO: 351761 - DNA, 17 bp, Homo sapiens
cctgcttctgctgccct

SEQ ID NO: 351762 - DNA, 20 bp, Homo sapiens
cctgcttcttccccagggtt

SEQ ID NO: 351763 - DNA, 21 bp, Homo sapiens
cctgcttcttccccagggttc

SEQ ID NO: 351764 - DNA, 21 bp, Homo sapiens
cctgcttgcccgctcccacag

SEQ ID NO: 351765 - DNA, 18 bp, Homo sapiens
cctgctttgggctgccct

SEQ ID NO: 351766 - DNA, 19 bp, Homo sapiens
cctgctttgggctgccctg

SEQ ID NO: 351767 - DNA, 20 bp, Homo sapiens
cctgctttgggctgccctgg

SEQ ID NO: 351768 - DNA, 22 bp, Homo sapiens
cctgctttgggctgccctggtg

SEQ ID NO: 351769 - DNA, 14 bp, Homo sapiens
cctgcttttccagg

SEQ ID NO: 351770 - DNA, 23 bp, Homo sapiens
cctgcttttccaggatcctgcag

SEQ ID NO: 351771 - DNA, 13 bp, Homo sapiens
cctggaaccaatc

SEQ ID NO: 351772 - DNA, 16 bp, Homo sapiens
cctggaaccagcaagt

SEQ ID NO: 351773 - DNA, 24 bp, Homo sapiens
cctggaaccagcaagtcccagaca

SEQ ID NO: 351774 - DNA, 16 bp, Homo sapiens
cctggaaccagggagg

SEQ ID NO: 351775 - DNA, 21 bp, Homo sapiens
cctggaaccagggaggagagg

SEQ ID NO: 351776 - DNA, 23 bp, Homo sapiens
cctggaagagctgggtaccaggc

SEQ ID NO: 351777 - DNA, 16 bp, Homo sapiens
cctggaatgaagcatg

SEQ ID NO: 351778 - DNA, 18 bp, Homo sapiens
cctggaatgaagcatgta

SEQ ID NO: 351779 - DNA, 12 bp, Homo sapiens
cctggaattcac

SEQ ID NO: 351780 - DNA, 16 bp, Homo sapiens
cctggaattcagcacc

SEQ ID NO: 351781 - DNA, 17 bp, Homo sapiens
cctggaattcagcaccc

SEQ ID NO: 351782 - DNA, 16 bp, Homo sapiens
cctggacatattccca

SEQ ID NO: 351783 - DNA, 18 bp, Homo sapiens
cctggaccaccagcccca

SEQ ID NO: 351784 - DNA, 23 bp, Homo sapiens
cctggaccaccagccccagcaag

SEQ ID NO: 351785 - DNA, 16 bp, Homo sapiens
cctggaccagatgctg

SEQ ID NO: 351786 - DNA, 20 bp, Homo sapiens
cctgaaagcctgtctctttc

SEQ ID NO: 351787 - DNA, 18 bp, Homo sapiens
cctgaaatagtggttctt

SEQ ID NO: 351788 - DNA, 17 bp, Homo sapiens
cctgaaatgtttccagg

SEQ ID NO: 351789 - DNA, 15 bp, Homo sapiens
cctgaacaagaaaga

SEQ ID NO: 351790 - DNA, 17 bp, Homo sapiens
cctgaaccccatgggct

SEQ ID NO: 351791 - DNA, 18 bp, Homo sapiens
cctgaaccccatgggctt

SEQ ID NO: 351792 - DNA, 19 bp, Homo sapiens
cctgaaccccatgggcttg

SEQ ID NO: 351793 - DNA, 23 bp, Homo sapiens
cctgaaccccatgggcttggact

SEQ ID NO: 351794 - DNA, 14 bp, Homo sapiens
cctgaactctgcaa

SEQ ID NO: 351795 - DNA, 16 bp, Homo sapiens
cctgaactctgcaact

SEQ ID NO: 351796 - DNA, 19 bp, Homo sapiens
cctgaagagcgctcctctg

SEQ ID NO: 351797 - DNA, 21 bp, Homo sapiens
cctgaagcctctgccctgcct

SEQ ID NO: 351798 - DNA, 10 bp, Homo sapiens
cctgaataac

SEQ ID NO: 351799 - DNA, 18 bp, Homo sapiens
cctgaattctatttgctg

SEQ ID NO: 351800 - DNA, 23 bp, Homo sapiens
cctgaattgtttgatattgtcac

SEQ ID NO: 351801 - DNA, 17 bp, Homo sapiens
cctgacactgagcccca

SEQ ID NO: 351802 - DNA, 18 bp, Homo sapiens
cctgacactgagccccac

SEQ ID NO: 351803 - DNA, 21 bp, Homo sapiens
cctgacactgagccccacctc

SEQ ID NO: 351804 - DNA, 23 bp, Homo sapiens
cctgacagcgacagaaaacctca

SEQ ID NO: 351805 - DNA, 18 bp, Homo sapiens
cctgaccatcccatgagc

SEQ ID NO: 351806 - DNA, 14 bp, Homo sapiens
cctgaccccttgct

SEQ ID NO: 351807 - DNA, 19 bp, Homo sapiens
cctgaccccttgctccctt

SEQ ID NO: 351808 - DNA, 21 bp, Homo sapiens
cctgaccccttgctcccttca

SEQ ID NO: 351809 - DNA, 23 bp, Homo sapiens
cctgacccggcccctaccagcca

SEQ ID NO: 351810 - DNA, 12 bp, Homo sapiens
cctgacccgtct

SEQ ID NO: 351811 - DNA, 21 bp, Homo sapiens
cctgacctctgaagagctgag

SEQ ID NO: 351812 - DNA, 14 bp, Homo sapiens
cctgacctgtccag

SEQ ID NO: 351813 - DNA, 18 bp, Homo sapiens
cctgaccttagcgttctg

SEQ ID NO: 351814 - DNA, 19 bp, Homo sapiens
cctgacggcgcccccagtg

SEQ ID NO: 351815 - DNA, 12 bp, Homo sapiens
cctgactgggaa

SEQ ID NO: 351816 - DNA, 22 bp, Homo sapiens
cctgacttagcccgtcaccctt

SEQ ID NO: 351817 - DNA, 15 bp, Homo sapiens
cctgacttcccagct

SEQ ID NO: 351818 - DNA, 18 bp, Homo sapiens
cctgacttttacagcttt

SEQ ID NO: 351819 - DNA, 23 bp, Homo sapiens
cctgagaaacgtccatctctctc

SEQ ID NO: 351820 - DNA, 20 bp, Homo sapiens
cctgagaaagcccacctggg

SEQ ID NO: 351821 - DNA, 22 bp, Homo sapiens
cctgagaaagcccacctgggct

SEQ ID NO: 351822 - DNA, 13 bp, Homo sapiens
cctgagaatttaa

SEQ ID NO: 351823 - DNA, 23 bp, Homo sapiens
cctgagaatttaatttttaaaag

SEQ ID NO: 351824 - DNA, 15 bp, Homo sapiens
cctgagactccagaa

SEQ ID NO: 351825 - DNA, 23 bp, Homo sapiens
cctgagactgtcggagaggctgt

SEQ ID NO: 351826 - DNA, 20 bp, Homo sapiens
cctgagatgtaggctccacc

SEQ ID NO: 351827 - DNA, 15 bp, Homo sapiens
cctgagattctggga

SEQ ID NO: 351828 - DNA, 20 bp, Homo sapiens
cctgagattctgggaaaggt

SEQ ID NO: 351829 - DNA, 21 bp, Homo sapiens
cctgagattctgggaaaggtg

SEQ ID NO: 351830 - DNA, 20 bp, Homo sapiens
cctgagcagtctacttctgt

SEQ ID NO: 351831 - DNA, 16 bp, Homo sapiens
cctgagccacagtggg

SEQ ID NO: 351832 - DNA, 16 bp, Homo sapiens
cctgagccccctgcac

SEQ ID NO: 351833 - DNA, 23 bp, Homo sapiens
cctgagccccctgcacccacccc

SEQ ID NO: 351834 - DNA, 18 bp, Homo sapiens
cctgagcctgccccagct

SEQ ID NO: 351835 - DNA, 20 bp, Homo sapiens
cttacattagcagtttgctt

SEQ ID NO: 351836 - DNA, 14 bp, Homo sapiens
cttacatttttaca

SEQ ID NO: 351837 - DNA, 15 bp, Homo sapiens
cttaccaaaggatag

SEQ ID NO: 351838 - DNA, 17 bp, Homo sapiens
cttaccaactttctgta

SEQ ID NO: 351839 - DNA, 13 bp, Homo sapiens
cttaccagatgct

SEQ ID NO: 351840 - DNA, 16 bp, Homo sapiens
cttaccgtagcctccg

SEQ ID NO: 351841 - DNA, 19 bp, Homo sapiens
cttacctaaacagatataa

SEQ ID NO: 351842 - DNA, 19 bp, Homo sapiens
cttacctaagtgacatttg

SEQ ID NO: 351843 - DNA, 21 bp, Homo sapiens
cttacctaagtgacatttgta

SEQ ID NO: 351844 - DNA, 15 bp, Homo sapiens
cttacctgtacactg

SEQ ID NO: 351845 - DNA, 19 bp, Homo sapiens
cttacggtcatgatgtctg

SEQ ID NO: 351846 - DNA, 17 bp, Homo sapiens
cttactaatgtgcccca

SEQ ID NO: 351847 - DNA, 18 bp, Homo sapiens
cttactacatgtgggagc

SEQ ID NO: 351848 - DNA, 14 bp, Homo sapiens
cttactactttaaa

SEQ ID NO: 351849 - DNA, 18 bp, Homo sapiens
cttactactttaaatcct

SEQ ID NO: 351850 - DNA, 15 bp, Homo sapiens
cttactctgagccca

SEQ ID NO: 351851 - DNA, 22 bp, Homo sapiens
cttactctgagcccaggccgtt

SEQ ID NO: 351852 - DNA, 15 bp, Homo sapiens
cttactttgtgcaaa

SEQ ID NO: 351853 - DNA, 19 bp, Homo sapiens
cttactttgtgcaaaagca

SEQ ID NO: 351854 - DNA, 20 bp, Homo sapiens
cttagaaatcattgtagaaa

SEQ ID NO: 351855 - DNA, 23 bp, Homo sapiens
cttagaaatcattgtagaaacac

SEQ ID NO: 351856 - DNA, 17 bp, Homo sapiens
cttagaaattgcatttc

SEQ ID NO: 351857 - DNA, 19 bp, Homo sapiens
cttagaacagatggctgtg

SEQ ID NO: 351858 - DNA, 16 bp, Homo sapiens
cttagaagccaccatg

SEQ ID NO: 351859 - DNA, 11 bp, Homo sapiens
cttagaataaa

SEQ ID NO: 351860 - DNA, 16 bp, Homo sapiens
cttagaataaaattgt

SEQ ID NO: 351861 - DNA, 17 bp, Homo sapiens
cttagaataaaattgta

SEQ ID NO: 351862 - DNA, 19 bp, Homo sapiens
cttagaattagtggcactt

SEQ ID NO: 351863 - DNA, 20 bp, Homo sapiens
cttagactccttctccccaa

SEQ ID NO: 351864 - DNA, 20 bp, Homo sapiens
cttagacttcgactcaggat

SEQ ID NO: 351865 - DNA, 11 bp, Homo sapiens
cttagagagag

SEQ ID NO: 351866 - DNA, 19 bp, Homo sapiens
cttagagatgctactgtca

SEQ ID NO: 351867 - DNA, 21 bp, Homo sapiens
cttagaggtaggtgtattccc

SEQ ID NO: 351868 - DNA, 18 bp, Homo sapiens
cttagatctgagccctcc

SEQ ID NO: 351869 - DNA, 19 bp, Homo sapiens
cttagatgagggtgactgt

SEQ ID NO: 351870 - DNA, 13 bp, Homo sapiens
cttagattttctg

SEQ ID NO: 351871 - DNA, 13 bp, Homo sapiens
cttagcagctcag

SEQ ID NO: 351872 - DNA, 14 bp, Homo sapiens
cttagcagctcagg

SEQ ID NO: 351873 - DNA, 19 bp, Homo sapiens
cttagcagctcaggcgcag

SEQ ID NO: 351874 - DNA, 20 bp, Homo sapiens
cttagcagctcaggcgcagc

SEQ ID NO: 351875 - DNA, 15 bp, Homo sapiens
cttagcagcttccag

SEQ ID NO: 351876 - DNA, 23 bp, Homo sapiens
cttagcccgtcacccttatttat

SEQ ID NO: 351877 - DNA, 11 bp, Homo sapiens
cttagcctccc

SEQ ID NO: 351878 - DNA, 15 bp, Homo sapiens
cttagcctccctgaa

SEQ ID NO: 351879 - DNA, 16 bp, Homo sapiens
cttagcctctcccacc

SEQ ID NO: 351880 - DNA, 15 bp, Homo sapiens
cttagccttgctgta

SEQ ID NO: 351881 - DNA, 19 bp, Homo sapiens
cttagccttgctgtagaga

SEQ ID NO: 351882 - DNA, 23 bp, Homo sapiens
cttagccttgctgtagagacttc

SEQ ID NO: 351883 - DNA, 11 bp, Homo sapiens
cttagccttgt

SEQ ID NO: 351884 - DNA, 19 bp, Homo sapiens
cttagccttgtgccctgcc

SEQ ID NO: 351885 - DNA, 16 bp, Homo sapiens
cttagcgttctggact

SEQ ID NO: 351886 - DNA, 17 bp, Homo sapiens
cttagcgttctggactc

SEQ ID NO: 351887 - DNA, 18 bp, Homo sapiens
cttagcgttctggactct

SEQ ID NO: 351888 - DNA, 22 bp, Homo sapiens
cttagcgttctggactctgccc

SEQ ID NO: 351889 - DNA, 23 bp, Homo sapiens
cttcatttcctctgagctgttat

SEQ ID NO: 351890 - DNA, 14 bp, Homo sapiens
cttcatttggagat

SEQ ID NO: 351891 - DNA, 11 bp, Homo sapiens
cttcatttgtg

SEQ ID NO: 351892 - DNA, 19 bp, Homo sapiens
cttcattttggcaagaaga

SEQ ID NO: 351893 - DNA, 16 bp, Homo sapiens
cttcatttttcctaac

SEQ ID NO: 351894 - DNA, 16 bp, Homo sapiens
cttccaaaaattatta

SEQ ID NO: 351895 - DNA, 17 bp, Homo sapiens
cttccaaaattcttatt

SEQ ID NO: 351896 - DNA, 14 bp, Homo sapiens
cttccaaagagtca

SEQ ID NO: 351897 - DNA, 21 bp, Homo sapiens
cttccaaagagtcatcatggg

SEQ ID NO: 351898 - DNA, 14 bp, Homo sapiens
cttccaactgctgc

SEQ ID NO: 351899 - DNA, 16 bp, Homo sapiens
cttccaagacctgact

SEQ ID NO: 351900 - DNA, 17 bp, Homo sapiens
cttccaagacctgactc

SEQ ID NO: 351901 - DNA, 17 bp, Homo sapiens
cttccaaggagaccaag

SEQ ID NO: 351902 - DNA, 18 bp, Homo sapiens
cttccaaggagaccaagt

SEQ ID NO: 351903 - DNA, 13 bp, Homo sapiens
cttccacagcagc

SEQ ID NO: 351904 - DNA, 18 bp, Homo sapiens
cttccacctcacaactcc

SEQ ID NO: 351905 - DNA, 14 bp, Homo sapiens
cttccacctccctc

SEQ ID NO: 351906 - DNA, 17 bp, Homo sapiens
cttccacctcctagagg

SEQ ID NO: 351907 - DNA, 22 bp, Homo sapiens
cttccacctcctagaggtgggc

SEQ ID NO: 351908 - DNA, 11 bp, Homo sapiens
cttccacctgt

SEQ ID NO: 351909 - DNA, 17 bp, Homo sapiens
cttccacgctgtctcca

SEQ ID NO: 351910 - DNA, 20 bp, Homo sapiens
cttccacgctgtctccagac

SEQ ID NO: 351911 - DNA, 23 bp, Homo sapiens
cttccacgtaattcaatttctca

SEQ ID NO: 351912 - DNA, 14 bp, Homo sapiens
cttccactgcctct

SEQ ID NO: 351913 - DNA, 17 bp, Homo sapiens
cttccactgcctctgcc

SEQ ID NO: 351914 - DNA, 13 bp, Homo sapiens
cgtcctgaggaat

SEQ ID NO: 351915 - DNA, 15 bp, Homo sapiens
cgtcctgcagaggac

SEQ ID NO: 351916 - DNA, 21 bp, Homo sapiens
cgtcctgcagaggaccacagt

SEQ ID NO: 351917 - DNA, 11 bp, Homo sapiens
cgtcctgcagt

SEQ ID NO: 351918 - DNA, 14 bp, Homo sapiens
cgtcctgccacctg

SEQ ID NO: 351919 - DNA, 16 bp, Homo sapiens
cgtcctgccacctggg

SEQ ID NO: 351920 - DNA, 11 bp, Homo sapiens
cgtcctggaat

SEQ ID NO: 351921 - DNA, 13 bp, Homo sapiens
cgtcctggaatga

SEQ ID NO: 351922 - DNA, 22 bp, Homo sapiens
cgtcctggggtggttggaggcc

SEQ ID NO: 351923 - DNA, 12 bp, Homo sapiens
cgtcctgtccca

SEQ ID NO: 351924 - DNA, 13 bp, Homo sapiens
cgtcctgtcccag

SEQ ID NO: 351925 - DNA, 22 bp, Homo sapiens
cgtcggactgcccccagaaagc

SEQ ID NO: 351926 - DNA, 19 bp, Homo sapiens
cgtcgggggctgaggggca

SEQ ID NO: 351927 - DNA, 20 bp, Homo sapiens
cgtctacccagactcagaga

SEQ ID NO: 351928 - DNA, 12 bp, Homo sapiens
cgtctcctccct

SEQ ID NO: 351929 - DNA, 16 bp, Homo sapiens
cgtctcctctccagcc

SEQ ID NO: 351930 - DNA, 21 bp, Homo sapiens
cgtctcctgccgggcaggtcc

SEQ ID NO: 351931 - DNA, 16 bp, Homo sapiens
cgtctgaccctctcca

SEQ ID NO: 351932 - DNA, 22 bp, Homo sapiens
cgtctgagcggccgcctgtcct

SEQ ID NO: 351933 - DNA, 15 bp, Homo sapiens
cgtctgccaggccca

SEQ ID NO: 351934 - DNA, 18 bp, Homo sapiens
cgtctgccccaccctcaa

SEQ ID NO: 351935 - DNA, 12 bp, Homo sapiens
cgtctgcccctt

SEQ ID NO: 351936 - DNA, 17 bp, Homo sapiens
cgtctggcgagccctta

SEQ ID NO: 351937 - DNA, 18 bp, Homo sapiens
cgtctggcgagcccttag

SEQ ID NO: 351938 - DNA, 11 bp, Homo sapiens
cgtctgtccca

SEQ ID NO: 351939 - DNA, 18 bp, Homo sapiens
cgtctgtcttcacagctc

SEQ ID NO: 351940 - DNA, 23 bp, Homo sapiens
cgtctgtgattgccatttcttcc

SEQ ID NO: 351941 - DNA, 19 bp, Homo sapiens
cgtcttcaagaacttctcg

SEQ ID NO: 351942 - DNA, 16 bp, Homo sapiens
cgtcttcaatctctgt

SEQ ID NO: 351943 - DNA, 17 bp, Homo sapiens
cgtcttcaatctctgtt

SEQ ID NO: 351944 - DNA, 13 bp, Homo sapiens
cgtcttccctgct

SEQ ID NO: 351945 - DNA, 16 bp, Homo sapiens
cgtcttccctgcttca

SEQ ID NO: 351946 - DNA, 17 bp, Homo sapiens
cgtcttcctctctctca

SEQ ID NO: 351947 - DNA, 22 bp, Homo sapiens
cgtgaaacacaccaggctgtgg

SEQ ID NO: 351948 - DNA, 13 bp, Homo sapiens
cgtgaaaccctgt

SEQ ID NO: 351949 - DNA, 19 bp, Homo sapiens
cgtgaaagaattatttttg

SEQ ID NO: 351950 - DNA, 22 bp, Homo sapiens
cgtgaactcaccgctcaccctc

SEQ ID NO: 351951 - DNA, 20 bp, Homo sapiens
cgtgaagcagtgcctcgagg

SEQ ID NO: 351952 - DNA, 21 bp, Homo sapiens
cgtgaagcagtgcctcgaggc

SEQ ID NO: 351953 - DNA, 16 bp, Homo sapiens
cgtgaatgtgtatatg

SEQ ID NO: 351954 - DNA, 22 bp, Homo sapiens
cttcctggattttctttctatg

SEQ ID NO: 351955 - DNA, 12 bp, Homo sapiens
cttcctggcctc

SEQ ID NO: 351956 - DNA, 14 bp, Homo sapiens
cttcctggcctcac

SEQ ID NO: 351957 - DNA, 17 bp, Homo sapiens
cttcctgggcagcccag

SEQ ID NO: 351958 - DNA, 18 bp, Homo sapiens
cttcctgggcagcccaga

SEQ ID NO: 351959 - DNA, 21 bp, Homo sapiens
cttcctggggccccgctggga

SEQ ID NO: 351960 - DNA, 20 bp, Homo sapiens
cttcctgtagtgcccctccc

SEQ ID NO: 351961 - DNA, 16 bp, Homo sapiens
cttcctgtccagagag

SEQ ID NO: 351962 - DNA, 14 bp, Homo sapiens
cttcctgtccgccc

SEQ ID NO: 351963 - DNA, 14 bp, Homo sapiens
cttcctgtcctgct

SEQ ID NO: 351964 - DNA, 16 bp, Homo sapiens
cttcctgtcctgctca

SEQ ID NO: 351965 - DNA, 17 bp, Homo sapiens
cttcctgtcctgctcac

SEQ ID NO: 351966 - DNA, 13 bp, Homo sapiens
cttcctgtgactt

SEQ ID NO: 351967 - DNA, 16 bp, Homo sapiens
cttcctgtgacttcag

SEQ ID NO: 351968 - DNA, 17 bp, Homo sapiens
cttcctgttctgtgtct

SEQ ID NO: 351969 - DNA, 16 bp, Homo sapiens
cttcctgtttctaagt

SEQ ID NO: 351970 - DNA, 15 bp, Homo sapiens
cttccttcacctctg

SEQ ID NO: 351971 - DNA, 15 bp, Homo sapiens
cttccttctctactc

SEQ ID NO: 351972 - DNA, 14 bp, Homo sapiens
cttcctttgtctta

SEQ ID NO: 351973 - DNA, 22 bp, Homo sapiens
cttcctttgtttttttttcctg

SEQ ID NO: 351974 - DNA, 19 bp, Homo sapiens
cttccttttgtatcctcca

SEQ ID NO: 351975 - DNA, 13 bp, Homo sapiens
cttcgaaaacaga

SEQ ID NO: 351976 - DNA, 18 bp, Homo sapiens
cttcgagggttccaggct

SEQ ID NO: 351977 - DNA, 17 bp, Homo sapiens
cttcgcaaactgatgga

SEQ ID NO: 351978 - DNA, 24 bp, Homo sapiens
cttcgcgctggaatccagaaggaa

SEQ ID NO: 351979 - DNA, 16 bp, Homo sapiens
cttctttaccttcatt

SEQ ID NO: 351980 - DNA, 15 bp, Homo sapiens
cttctttctcctgtg

SEQ ID NO: 351981 - DNA, 22 bp, Homo sapiens
cttctttgaatttcctatctgt

SEQ ID NO: 351982 - DNA, 18 bp, Homo sapiens
cttctttgcttctttttc

SEQ ID NO: 351983 - DNA, 13 bp, Homo sapiens
cttctttttctta

SEQ ID NO: 351984 - DNA, 23 bp, Homo sapiens
cttcttttttgtctcaagattat

SEQ ID NO: 351985 - DNA, 16 bp, Homo sapiens
cttgaaacagcctggg

SEQ ID NO: 351986 - DNA, 16 bp, Homo sapiens
cttgaaacttcagccc

SEQ ID NO: 351987 - DNA, 21 bp, Homo sapiens
cttgaaagaagaaaaggttct

SEQ ID NO: 351988 - DNA, 16 bp, Homo sapiens
cttgaaagttttccag

SEQ ID NO: 351989 - DNA, 20 bp, Homo sapiens
cttgaacaatcaaggcaact

SEQ ID NO: 351990 - DNA, 20 bp, Homo sapiens
cttgaacctcattaaatggt

SEQ ID NO: 351991 - DNA, 16 bp, Homo sapiens
cttgaacctgggaagt

SEQ ID NO: 351992 - DNA, 13 bp, Homo sapiens
cttgaactcctga

SEQ ID NO: 351993 - DNA, 21 bp, Homo sapiens
cttgaactcctgacctcaggt

SEQ ID NO: 351994 - DNA, 22 bp, Homo sapiens
cttgaactgttctggcctcaga

SEQ ID NO: 351995 - DNA, 23 bp, Homo sapiens
cttgaactgttctggcctcagac

SEQ ID NO: 351996 - DNA, 12 bp, Homo sapiens
cttgaagaatat

SEQ ID NO: 351997 - DNA, 18 bp, Homo sapiens
cttgaagaatttgttctt

SEQ ID NO: 351998 - DNA, 20 bp, Homo sapiens
cttgaagatcgttagtatct

SEQ ID NO: 351999 - DNA, 13 bp, Homo sapiens
cttgaagggccca

SEQ ID NO: 352000 - DNA, 15 bp, Homo sapiens
cttgaagggcccagg

SEQ ID NO: 352001 - DNA, 17 bp, Homo sapiens
cttgaagtaggaagtag

SEQ ID NO: 352002 - DNA, 18 bp, Homo sapiens
cttgaatatggaacatat

SEQ ID NO: 352003 - DNA, 19 bp, Homo sapiens
cttgaatattatacttctt

SEQ ID NO: 352004 - DNA, 20 bp, Homo sapiens
cttgaatgatgccatgagga

SEQ ID NO: 352005 - DNA, 14 bp, Homo sapiens
cttgaatgtacaaa

SEQ ID NO: 352006 - DNA, 18 bp, Homo sapiens
cttgaattgtaaggaatg

SEQ ID NO: 352007 - DNA, 19 bp, Homo sapiens
cttgaattgtaaggaatga

SEQ ID NO: 352008 - DNA, 13 bp, Homo sapiens
cttgaatttcaaa

SEQ ID NO: 352009 - DNA, 21 bp, Homo sapiens
cttgaatttctagacagtatt

SEQ ID NO: 352010 - DNA, 13 bp, Homo sapiens
cttgaatttctgc

SEQ ID NO: 352011 - DNA, 12 bp, Homo sapiens
cttgacattcct

SEQ ID NO: 352012 - DNA, 13 bp, Homo sapiens
cttgacattcctt

SEQ ID NO: 352013 - DNA, 14 bp, Homo sapiens
cttgaccccacacg

SEQ ID NO: 352014 - DNA, 17 bp, Homo sapiens
cttgaccgtactctcac

SEQ ID NO: 352015 - DNA, 23 bp, Homo sapiens
cttgaccgtactctcacatgtgg

SEQ ID NO: 352016 - DNA, 21 bp, Homo sapiens
cttgaccgtttttatattact

SEQ ID NO: 352017 - DNA, 22 bp, Homo sapiens
cttgaccgtttttatattactt

SEQ ID NO: 352018 - DNA, 15 bp, Homo sapiens
cttgacctgaactct

SEQ ID NO: 352019 - DNA, 19 bp, Homo sapiens
cttgacctgaactctgcaa

SEQ ID NO: 352020 - DNA, 12 bp, Homo sapiens
cttgaccttcct

SEQ ID NO: 352021 - DNA, 21 bp, Homo sapiens
cttgaccttcctctggggctc

SEQ ID NO: 352022 - DNA, 14 bp, Homo sapiens
cttgacctttccag

SEQ ID NO: 352023 - DNA, 17 bp, Homo sapiens
cttgacgtgtgtggtcc

SEQ ID NO: 352024 - DNA, 18 bp, Homo sapiens
cttgactctaaatgcagt

SEQ ID NO: 352025 - DNA, 17 bp, Homo sapiens
cttgacttctgcccaaa

SEQ ID NO: 352026 - DNA, 21 bp, Homo sapiens
cttgagaccaagccggtgccc

SEQ ID NO: 352027 - DNA, 22 bp, Homo sapiens
cttgagaccaagccggtgccca

SEQ ID NO: 352028 - DNA, 21 bp, Homo sapiens
cttgagacccccaagcttcca

SEQ ID NO: 352029 - DNA, 18 bp, Homo sapiens
cttgagaccctcttctct

SEQ ID NO: 352030 - DNA, 21 bp, Homo sapiens
cttgagaccctcttctctggg

SEQ ID NO: 352031 - DNA, 19 bp, Homo sapiens
cttgagacctggaaccaga

SEQ ID NO: 352032 - DNA, 22 bp, Homo sapiens
cttgagagaaaaagtgcccctt

SEQ ID NO: 352033 - DNA, 14 bp, Homo sapiens
cttgagagcgctgg

SEQ ID NO: 352034 - DNA, 21 bp, Homo sapiens
cttgagatgtatgaaggcttt

SEQ ID NO: 352035 - DNA, 14 bp, Homo sapiens
cttgagatgtatta

SEQ ID NO: 352036 - DNA, 15 bp, Homo sapiens
cttgagatgtcttct

SEQ ID NO: 352037 - DNA, 18 bp, Homo sapiens
cttgagcaaggcaagaag

SEQ ID NO: 352038 - DNA, 10 bp, Homo sapiens
cttgagccca

SEQ ID NO: 352039 - DNA, 15 bp, Homo sapiens
cttgagcccactcct

SEQ ID NO: 352040 - DNA, 16 bp, Homo sapiens
cttgagcccaggaagt

SEQ ID NO: 352041 - DNA, 20 bp, Homo sapiens
cttgagcccaggagtttgag

SEQ ID NO: 352042 - DNA, 12 bp, Homo sapiens
cttgagcctccc

SEQ ID NO: 352043 - DNA, 13 bp, Homo sapiens
cttgagcctcccc

SEQ ID NO: 352044 - DNA, 19 bp, Homo sapiens
cttgagcctcccccaaagc

SEQ ID NO: 352045 - DNA, 22 bp, Homo sapiens
cttgagctcccctggagccagc

SEQ ID NO: 352046 - DNA, 23 bp, Homo sapiens
cttgagctcttcatttattttga

SEQ ID NO: 352047 - DNA, 20 bp, Homo sapiens
cttgagctgcctgctctgca

SEQ ID NO: 352048 - DNA, 22 bp, Homo sapiens
cttgagctgcctgctctgcagc

SEQ ID NO: 352049 - DNA, 12 bp, Homo sapiens
cttgaggacaca

SEQ ID NO: 352050 - DNA, 16 bp, Homo sapiens
cttgaggacacatgtc

SEQ ID NO: 352051 - DNA, 17 bp, Homo sapiens
cttgaggattttgagta

SEQ ID NO: 352052 - DNA, 20 bp, Homo sapiens
cttgagggtcattttccttt

SEQ ID NO: 352053 - DNA, 23 bp, Homo sapiens
cttgaggtcttttgacatgtgga

SEQ ID NO: 352054 - DNA, 15 bp, Homo sapiens
cttgagtaatttaaa

SEQ ID NO: 352055 - DNA, 17 bp, Homo sapiens
cttgagtaatttaaatg

SEQ ID NO: 352056 - DNA, 20 bp, Homo sapiens
cttgagtgggccccctctct

SEQ ID NO: 352057 - DNA, 22 bp, Homo sapiens
cttgagtgtgcaagcaaagaac

SEQ ID NO: 352058 - DNA, 14 bp, Homo sapiens
cttgagtttcattt

SEQ ID NO: 352059 - DNA, 16 bp, Homo sapiens
cttgagttttatttat

SEQ ID NO: 352060 - DNA, 21 bp, Homo sapiens
cttgataatgttgtggtttgt

SEQ ID NO: 352061 - DNA, 22 bp, Homo sapiens
cttgatagcaagcgttattttg

SEQ ID NO: 352062 - DNA, 17 bp, Homo sapiens
cttgatatcctctttga

SEQ ID NO: 352063 - DNA, 14 bp, Homo sapiens
cttgatatttcctt

SEQ ID NO: 352064 - DNA, 16 bp, Homo sapiens
cttgatctcctgacct

SEQ ID NO: 352065 - DNA, 16 bp, Homo sapiens
cttgatggtttatgtt

SEQ ID NO: 352066 - DNA, 15 bp, Homo sapiens
cttgatgtgaagata

SEQ ID NO: 352067 - DNA, 22 bp, Homo sapiens
cttgatgtgaagataatttgca

SEQ ID NO: 352068 - DNA, 20 bp, Homo sapiens
cttgattatgccttttaaaa

SEQ ID NO: 352069 - DNA, 14 bp, Homo sapiens
cttgattgattttt

SEQ ID NO: 352070 - DNA, 21 bp, Homo sapiens
cttgatttatcacacaaagca

SEQ ID NO: 352071 - DNA, 12 bp, Homo sapiens
cttgatttgcat

SEQ ID NO: 352072 - DNA, 13 bp, Homo sapiens
cttgatttgcatg

SEQ ID NO: 352073 - DNA, 17 bp, Homo sapiens
cttgatttgcatggatt

SEQ ID NO: 352074 - DNA, 14 bp, Homo sapiens
cttgattttcaagc

SEQ ID NO: 352075 - DNA, 17 bp, Homo sapiens
cttgcaaagcctttaaa

SEQ ID NO: 352076 - DNA, 19 bp, Homo sapiens
cttgcaaagcctttaaatt

SEQ ID NO: 352077 - DNA, 12 bp, Homo sapiens
cttgcacaggcc

SEQ ID NO: 352078 - DNA, 15 bp, Homo sapiens
cttgcacaggccact

SEQ ID NO: 352079 - DNA, 21 bp, Homo sapiens
cttgcactaaagtatgtaaag

SEQ ID NO: 352080 - DNA, 14 bp, Homo sapiens
cttgcactattcca

SEQ ID NO: 352081 - DNA, 17 bp, Homo sapiens
cttgcactattggactt

SEQ ID NO: 352082 - DNA, 14 bp, Homo sapiens
cttgcactgtatcc

SEQ ID NO: 352083 - DNA, 22 bp, Homo sapiens
cttgcagtatgatggcaggaga

SEQ ID NO: 352084 - DNA, 20 bp, Homo sapiens
cttgcataataagctaaaga

SEQ ID NO: 352085 - DNA, 17 bp, Homo sapiens
cttgcatctacctgctc

SEQ ID NO: 352086 - DNA, 13 bp, Homo sapiens
cttgcattagaaa

SEQ ID NO: 352087 - DNA, 17 bp, Homo sapiens
cttgcatttctttattt

SEQ ID NO: 352088 - DNA, 18 bp, Homo sapiens
cttgccaagctttcttct

SEQ ID NO: 352089 - DNA, 13 bp, Homo sapiens
cttgccaaggccg

SEQ ID NO: 352090 - DNA, 22 bp, Homo sapiens
cttgccaatgaggtctgaaatg

SEQ ID NO: 352091 - DNA, 15 bp, Homo sapiens
cttttctgtttgcta

SEQ ID NO: 352092 - DNA, 13 bp, Homo sapiens
cttttcttggaca

SEQ ID NO: 352093 - DNA, 20 bp, Homo sapiens
cttttcttggacacttaatt

SEQ ID NO: 352094 - DNA, 21 bp, Homo sapiens
cttttgaaagtttgttctgca

SEQ ID NO: 352095 - DNA, 19 bp, Homo sapiens
cttttgaaatttaaaaatc

SEQ ID NO: 352096 - DNA, 19 bp, Homo sapiens
cttttgaactcacgagcct

SEQ ID NO: 352097 - DNA, 20 bp, Homo sapiens
cttttgaactcacgagcctt

SEQ ID NO: 352098 - DNA, 15 bp, Homo sapiens
cttttgaagaacaaa

SEQ ID NO: 352099 - DNA, 19 bp, Homo sapiens
cttttgaataatgtagtgc

SEQ ID NO: 352100 - DNA, 22 bp, Homo sapiens
cttttgaatcaatctggcttct

SEQ ID NO: 352101 - DNA, 22 bp, Homo sapiens
cttttgaccccttcctgtctgg

SEQ ID NO: 352102 - DNA, 18 bp, Homo sapiens
cttttgagaacttttggt

SEQ ID NO: 352103 - DNA, 15 bp, Homo sapiens
cttttgagcagtaaa

SEQ ID NO: 352104 - DNA, 21 bp, Homo sapiens
cttttgagtgccttacacaat

SEQ ID NO: 352105 - DNA, 17 bp, Homo sapiens
cttttgataaaatgttc

SEQ ID NO: 352106 - DNA, 11 bp, Homo sapiens
cttttgataca

SEQ ID NO: 352107 - DNA, 16 bp, Homo sapiens
cttttgatagatccac

SEQ ID NO: 352108 - DNA, 13 bp, Homo sapiens
cttttgatattaa

SEQ ID NO: 352109 - DNA, 16 bp, Homo sapiens
cttttgatattaaatt

SEQ ID NO: 352110 - DNA, 17 bp, Homo sapiens
cttttgatggctatgtt

SEQ ID NO: 352111 - DNA, 20 bp, Homo sapiens
cttttgatggctatgttttg

SEQ ID NO: 352112 - DNA, 15 bp, Homo sapiens
cttttgatgtggtgt

SEQ ID NO: 352113 - DNA, 17 bp, Homo sapiens
cttttgcacatatattt

SEQ ID NO: 352114 - DNA, 12 bp, Homo sapiens
cttttgcagctt

SEQ ID NO: 352115 - DNA, 18 bp, Homo sapiens
cttttgcagcttccttcc

SEQ ID NO: 352116 - DNA, 23 bp, Homo sapiens
cttttgcccacacttgggagcaa

SEQ ID NO: 352117 - DNA, 16 bp, Homo sapiens
cttttgccccagaaag

SEQ ID NO: 352118 - DNA, 22 bp, Homo sapiens
cttttgcccgttgaggtagagg

SEQ ID NO: 352119 - DNA, 23 bp, Homo sapiens
cttttgctgtttggatgtttcca

SEQ ID NO: 352120 - DNA, 19 bp, Homo sapiens
cttttggagcaaagtggtt

SEQ ID NO: 352121 - DNA, 13 bp, Homo sapiens
cttttggcccccg

SEQ ID NO: 352122 - DNA, 20 bp, Homo sapiens
cttttggcccccgagctggg

SEQ ID NO: 352123 - DNA, 16 bp, Homo sapiens
cttttggcctttgtaa

SEQ ID NO: 352124 - DNA, 19 bp, Homo sapiens
cttttgggtttctgccctg

SEQ ID NO: 352125 - DNA, 20 bp, Homo sapiens
cttttgggtttctgccctgc

SEQ ID NO: 352126 - DNA, 14 bp, Homo sapiens
cttttggtctccct

SEQ ID NO: 352127 - DNA, 21 bp, Homo sapiens
cttttgtaaagttaattcatt

SEQ ID NO: 352128 - DNA, 13 bp, Homo sapiens
cttttgtaaatat

SEQ ID NO: 352129 - DNA, 17 bp, Homo sapiens
cttttgtaaatattctt

SEQ ID NO: 352130 - DNA, 18 bp, Homo sapiens
cttttgtaaatattcttg

SEQ ID NO: 352131 - DNA, 14 bp, Homo sapiens
gaaacaatttctgt

SEQ ID NO: 352132 - DNA, 9 bp, Homo sapiens
gaaacacaa

SEQ ID NO: 352133 - DNA, 22 bp, Homo sapiens
gaaacacaagagacttaaagga

SEQ ID NO: 352134 - DNA, 16 bp, Homo sapiens
gaaacacaccaggctg

SEQ ID NO: 352135 - DNA, 18 bp, Homo sapiens
gaaacaccacttaatctt

SEQ ID NO: 352136 - DNA, 24 bp, Homo sapiens
gaaacactcgtgtgcatgagaatg

SEQ ID NO: 352137 - DNA, 13 bp, Homo sapiens
gaaacactcttat

SEQ ID NO: 352138 - DNA, 17 bp, Homo sapiens
gaaacagaactcgatgc

SEQ ID NO: 352139 - DNA, 18 bp, Homo sapiens
gaaacagccatgtccaag

SEQ ID NO: 352140 - DNA, 19 bp, Homo sapiens
gaaacagccatgtccaagt

SEQ ID NO: 352141 - DNA, 22 bp, Homo sapiens
gaaacagcttgatgctgtttct

SEQ ID NO: 352142 - DNA, 20 bp, Homo sapiens
gaaacagctttcaagtgcct

SEQ ID NO: 352143 - DNA, 15 bp, Homo sapiens
gaaacatttgacaca

SEQ ID NO: 352144 - DNA, 17 bp, Homo sapiens
gaaaccacacttcttga

SEQ ID NO: 352145 - DNA, 15 bp, Homo sapiens
gaaaccaccctgagg

SEQ ID NO: 352146 - DNA, 22 bp, Homo sapiens
gaaaccagcttttactgttttt

SEQ ID NO: 352147 - DNA, 18 bp, Homo sapiens
gaaaccatgactgtgacc

SEQ ID NO: 352148 - DNA, 17 bp, Homo sapiens
gaaaccattgttcagaa

SEQ ID NO: 352149 - DNA, 16 bp, Homo sapiens
gaaacccccaggagga

SEQ ID NO: 352150 - DNA, 14 bp, Homo sapiens
gaaaccgtccctga

SEQ ID NO: 352151 - DNA, 12 bp, Homo sapiens
gaaacctgccct

SEQ ID NO: 352152 - DNA, 14 bp, Homo sapiens
gaaacctgccctgc

SEQ ID NO: 352153 - DNA, 18 bp, Homo sapiens
gaaacctgccctgcctga

SEQ ID NO: 352154 - DNA, 17 bp, Homo sapiens
gaaacctgttatgccaa

SEQ ID NO: 352155 - DNA, 17 bp, Homo sapiens
gaaaccttattgtacct

SEQ ID NO: 352156 - DNA, 19 bp, Homo sapiens
gaaaccttattgtacctct

SEQ ID NO: 352157 - DNA, 18 bp, Homo sapiens
gaaaccttgtttgtttta

SEQ ID NO: 352158 - DNA, 18 bp, Homo sapiens
gaaacctttatccctgct

SEQ ID NO: 352159 - DNA, 19 bp, Homo sapiens
gaaacgtacttaactgtgt

SEQ ID NO: 352160 - DNA, 21 bp, Homo sapiens
gaaacgtccatctctctccct

SEQ ID NO: 352161 - DNA, 15 bp, Homo sapiens
gaaactatgcaccta

SEQ ID NO: 352162 - DNA, 21 bp, Homo sapiens
gaaactatgcacctataaata

SEQ ID NO: 352163 - DNA, 21 bp, Homo sapiens
gaaactcacccccaaggggca

SEQ ID NO: 352164 - DNA, 19 bp, Homo sapiens
gaaactcacctgctggccc

SEQ ID NO: 352165 - DNA, 22 bp, Homo sapiens
gaaactcctgattttgtagtta

SEQ ID NO: 352166 - DNA, 18 bp, Homo sapiens
gaaactgaaaactgtaaa

SEQ ID NO: 352167 - DNA, 15 bp, Homo sapiens
gaaactgaaagtgtt

SEQ ID NO: 352168 - DNA, 15 bp, Homo sapiens
gaaactgaggcccag

SEQ ID NO: 352169 - DNA, 22 bp, Homo sapiens
gaaactgaggcccagagagctg

SEQ ID NO: 352170 - DNA, 23 bp, Homo sapiens
gaaactgaggcccagagagctga

SEQ ID NO: 352171 - DNA, 16 bp, Homo sapiens
gaaactgagtcctgtt

SEQ ID NO: 352172 - DNA, 17 bp, Homo sapiens
gaaactgagtctgtgga

SEQ ID NO: 352173 - DNA, 18 bp, Homo sapiens
gaaactgagtctgtggac

SEQ ID NO: 352174 - DNA, 17 bp, Homo sapiens
gaaactgctaattacac

SEQ ID NO: 352175 - DNA, 22 bp, Homo sapiens
gaaacttcaagcaccagggaag

SEQ ID NO: 352176 - DNA, 21 bp, Homo sapiens
gaaacttttcttaaaaagtta

SEQ ID NO: 352177 - DNA, 24 bp, Homo sapiens
gaaagaaaaataccatgtctctaa

SEQ ID NO: 352178 - DNA, 13 bp, Homo sapiens
gaaagaaaagaat

SEQ ID NO: 352179 - DNA, 12 bp, Homo sapiens
gaaagaaaagac

SEQ ID NO: 352180 - DNA, 22 bp, Homo sapiens
gaaagaaaaggaatgcaagaga

SEQ ID NO: 352181 - DNA, 23 bp, Homo sapiens
gaaagaaaaggaatgcaagagaa

SEQ ID NO: 352182 - DNA, 13 bp, Homo sapiens
gaaagaaaatgaa

SEQ ID NO: 352183 - DNA, 20 bp, Homo sapiens
gaaagaaacgtacttaactg

SEQ ID NO: 352184 - DNA, 18 bp, Homo sapiens
gaaagaagcactctgctg

SEQ ID NO: 352185 - DNA, 18 bp, Homo sapiens
gaaagaatgagaaagaaa

SEQ ID NO: 352186 - DNA, 17 bp, Homo sapiens
gaaagacaggaagacca

SEQ ID NO: 352187 - DNA, 19 bp, Homo sapiens
gaaagacaggaagaccaag

SEQ ID NO: 352188 - DNA, 19 bp, Homo sapiens
gaaagacatttcaaatctg

SEQ ID NO: 352189 - DNA, 21 bp, Homo sapiens
gaaagacctacattccctctc

SEQ ID NO: 352190 - DNA, 17 bp, Homo sapiens
gaaagaggagaaggaga

SEQ ID NO: 352191 - DNA, 21 bp, Homo sapiens
gaaagaggctgaggcctggac

SEQ ID NO: 352192 - DNA, 18 bp, Homo sapiens
gaaagagttaagaatgtc

SEQ ID NO: 352193 - DNA, 17 bp, Homo sapiens
gaaagagttgagcacag

SEQ ID NO: 352194 - DNA, 23 bp, Homo sapiens
gaaagatactaatagagtactta

SEQ ID NO: 352195 - DNA, 11 bp, Homo sapiens
gaaagatatct

SEQ ID NO: 352196 - DNA, 15 bp, Homo sapiens
gaaagatatctatga

SEQ ID NO: 352197 - DNA, 15 bp, Homo sapiens
gaaagcaaaaaataa

SEQ ID NO: 352198 - DNA, 20 bp, Homo sapiens
gaaagcaaaaaataaaataa

SEQ ID NO: 352199 - DNA, 19 bp, Homo sapiens
gaaagcacaaacttctgta

SEQ ID NO: 352200 - DNA, 22 bp, Homo sapiens
gaaagcaccgcagcatgtgggg

SEQ ID NO: 352201 - DNA, 14 bp, Homo sapiens
gaaagcagaggctg

SEQ ID NO: 352202 - DNA, 12 bp, Homo sapiens
gaaagcagcagc

SEQ ID NO: 352203 - DNA, 17 bp, Homo sapiens
gaaagcaggagcagctg

SEQ ID NO: 352204 - DNA, 19 bp, Homo sapiens
gaaagcatgtctctgcttc

SEQ ID NO: 352205 - DNA, 20 bp, Homo sapiens
gaaagcatgtctctgcttcc

SEQ ID NO: 352206 - DNA, 13 bp, Homo sapiens
gaaagccacctct

SEQ ID NO: 352207 - DNA, 16 bp, Homo sapiens
gaaagccagtgactcc

SEQ ID NO: 352208 - DNA, 19 bp, Homo sapiens
gaaagccattgaccaccca

SEQ ID NO: 352209 - DNA, 13 bp, Homo sapiens
gaaagcccacctg

SEQ ID NO: 352210 - DNA, 14 bp, Homo sapiens
gaaagcccacctgg

SEQ ID NO: 352211 - DNA, 15 bp, Homo sapiens
gaaagcctcctgccc

SEQ ID NO: 352212 - DNA, 16 bp, Homo sapiens
gaaagcctcctgcccc

SEQ ID NO: 352213 - DNA, 14 bp, Homo sapiens
gaaagcctctggaa

SEQ ID NO: 352214 - DNA, 15 bp, Homo sapiens
gaaagcctctggaaa

SEQ ID NO: 352215 - DNA, 20 bp, Homo sapiens
gaaagcctgtctctttccac

SEQ ID NO: 352216 - DNA, 18 bp, Homo sapiens
gaaagcctgttcccctca

SEQ ID NO: 352217 - DNA, 18 bp, Homo sapiens
gaaagcgggcagccccgt

SEQ ID NO: 352218 - DNA, 16 bp, Homo sapiens
gaaagctatatatgaa

SEQ ID NO: 352219 - DNA, 22 bp, Homo sapiens
gaaagctgatgatgtctcttgt

SEQ ID NO: 352220 - DNA, 22 bp, Homo sapiens
gaaagctgattactgtcaataa

SEQ ID NO: 352221 - DNA, 20 bp, Homo sapiens
gaaagctgcttctgggggat

SEQ ID NO: 352222 - DNA, 21 bp, Homo sapiens
gaaagctggtaaactatttgt

SEQ ID NO: 352223 - DNA, 23 bp, Homo sapiens
gaaaggaaaaacagaacatttct

SEQ ID NO: 352224 - DNA, 21 bp, Homo sapiens
gaaaggaagatgtaagaagct

SEQ ID NO: 352225 - DNA, 11 bp, Homo sapiens
gaaaggagact

SEQ ID NO: 352226 - DNA, 17 bp, Homo sapiens
gaaaggatggcagcctc

SEQ ID NO: 352227 - DNA, 14 bp, Homo sapiens
gaaaggattaagat

SEQ ID NO: 352228 - DNA, 17 bp, Homo sapiens
cttgggcccagtagccc

SEQ ID NO: 352229 - DNA, 23 bp, Homo sapiens
cttgggccccagaccccagggca

SEQ ID NO: 352230 - DNA, 15 bp, Homo sapiens
cttgggcggctgaga

SEQ ID NO: 352231 - DNA, 13 bp, Homo sapiens
cttgggctactgg

SEQ ID NO: 352232 - DNA, 21 bp, Homo sapiens
cttgggctactggcagctcct

SEQ ID NO: 352233 - DNA, 17 bp, Homo sapiens
cctgtggtttgttatca

SEQ ID NO: 352234 - DNA, 21 bp, Homo sapiens
cctgtgtataaaaaagaaaac

SEQ ID NO: 352235 - DNA, 16 bp, Homo sapiens
cctgtgtcatctgtca

SEQ ID NO: 352236 - DNA, 17 bp, Homo sapiens
cctgtgtcatctgtcag

SEQ ID NO: 352237 - DNA, 23 bp, Homo sapiens
cctgtgtccacatctaacaaagt

SEQ ID NO: 352238 - DNA, 16 bp, Homo sapiens
cctgtgtccagcagct

SEQ ID NO: 352239 - DNA, 13 bp, Homo sapiens
cctgtgtcccctg

SEQ ID NO: 352240 - DNA, 20 bp, Homo sapiens
cctgtgtcccctgacctgtc

SEQ ID NO: 352241 - DNA, 23 bp, Homo sapiens
cctgtgtcccctgacctgtccag

SEQ ID NO: 352242 - DNA, 15 bp, Homo sapiens
cctgtgtcggggggc

SEQ ID NO: 352243 - DNA, 14 bp, Homo sapiens
cctgtgtggagagg

SEQ ID NO: 352244 - DNA, 15 bp, Homo sapiens
cctgtgtggagaggg

SEQ ID NO: 352245 - DNA, 16 bp, Homo sapiens
cctgtgtggagaggga

SEQ ID NO: 352246 - DNA, 22 bp, Homo sapiens
cctgtgtggagagggaatgtga

SEQ ID NO: 352247 - DNA, 15 bp, Homo sapiens
cctgtgtgggagggc

SEQ ID NO: 352248 - DNA, 18 bp, Homo sapiens
cctgtgtgtaagctgact

SEQ ID NO: 352249 - DNA, 20 bp, Homo sapiens
cctgtgtgtcgttcccttgt

SEQ ID NO: 352250 - DNA, 14 bp, Homo sapiens
cctgtgtgttcttt

SEQ ID NO: 352251 - DNA, 16 bp, Homo sapiens
cctgtgttgtctctag

SEQ ID NO: 352252 - DNA, 22 bp, Homo sapiens
cctgtgttgtctctagagcagg

SEQ ID NO: 352253 - DNA, 18 bp, Homo sapiens
cctgttaagtctgagaag

SEQ ID NO: 352254 - DNA, 23 bp, Homo sapiens
cctgttacctaattagagcagat

SEQ ID NO: 352255 - DNA, 17 bp, Homo sapiens
cctgttacttaaatagc

SEQ ID NO: 352256 - DNA, 14 bp, Homo sapiens
cctgttacttacct

SEQ ID NO: 352257 - DNA, 20 bp, Homo sapiens
cctgttaggggaaaatagta

SEQ ID NO: 352258 - DNA, 15 bp, Homo sapiens
cctgttcaaaatgtt

SEQ ID NO: 352259 - DNA, 16 bp, Homo sapiens
cctgttcaaaatgtta

SEQ ID NO: 352260 - DNA, 22 bp, Homo sapiens
cctgttcaaaatgttaataaag

SEQ ID NO: 352261 - DNA, 16 bp, Homo sapiens
cctgttcattgtaagc

SEQ ID NO: 352262 - DNA, 18 bp, Homo sapiens
cctgttcccatgagatga

SEQ ID NO: 352263 - DNA, 18 bp, Homo sapiens
cctgttctcagagctcca

SEQ ID NO: 352264 - DNA, 23 bp, Homo sapiens
cctgttctcagagctccacagaa

SEQ ID NO: 352265 - DNA, 16 bp, Homo sapiens
cctgttctgtaggaga

SEQ ID NO: 352266 - DNA, 22 bp, Homo sapiens
cctgttgccctttctgtaccat

SEQ ID NO: 352267 - DNA, 18 bp, Homo sapiens
cctgttggctgctgccac

SEQ ID NO: 352268 - DNA, 18 bp, Homo sapiens
cctgtttacggtacttgg

SEQ ID NO: 352269 - DNA, 13 bp, Homo sapiens
cctgtttgcaggc

SEQ ID NO: 352270 - DNA, 19 bp, Homo sapiens
cctgttttctgtttcttct

SEQ ID NO: 352271 - DNA, 17 bp, Homo sapiens
cctgtttttaagctgtt

SEQ ID NO: 352272 - DNA, 18 bp, Homo sapiens
cctgtttttaagctgttt

SEQ ID NO: 352273 - DNA, 23 bp, Homo sapiens
ccttaaaactaggcatttgtaaa

SEQ ID NO: 352274 - DNA, 23 bp, Homo sapiens
ccttaaaactttaatcccacttg

SEQ ID NO: 352275 - DNA, 17 bp, Homo sapiens
ccttaaaataatgattt

SEQ ID NO: 352276 - DNA, 17 bp, Homo sapiens
ccttaaaattagcatct

SEQ ID NO: 352277 - DNA, 16 bp, Homo sapiens
ccttaactgtgctcag

SEQ ID NO: 352278 - DNA, 14 bp, Homo sapiens
ccttaagaaagcta

SEQ ID NO: 352279 - DNA, 16 bp, Homo sapiens
ccttaagaaagctata

SEQ ID NO: 352280 - DNA, 20 bp, Homo sapiens
ccttaaggacaaaaatgaac

SEQ ID NO: 352281 - DNA, 18 bp, Homo sapiens
ccttaataaacgtccaca

SEQ ID NO: 352282 - DNA, 15 bp, Homo sapiens
ccttaatggatgctc

SEQ ID NO: 352283 - DNA, 20 bp, Homo sapiens
ccttacacaatggttttctt

SEQ ID NO: 352284 - DNA, 17 bp, Homo sapiens
ccttaccaactttctgt

SEQ ID NO: 352285 - DNA, 15 bp, Homo sapiens
ccttaccccttagcc

SEQ ID NO: 352286 - DNA, 16 bp, Homo sapiens
ccttaccccttagcct

SEQ ID NO: 352287 - DNA, 16 bp, Homo sapiens
ccttaccctactggct

SEQ ID NO: 352288 - DNA, 14 bp, Homo sapiens
ccttacctcttccg

SEQ ID NO: 352289 - DNA, 21 bp, Homo sapiens
ccttagaaatcattgtagaaa

SEQ ID NO: 352290 - DNA, 14 bp, Homo sapiens
ccttagaacctttc

SEQ ID NO: 352291 - DNA, 18 bp, Homo sapiens
ccttagacccgccaggtc

SEQ ID NO: 352292 - DNA, 19 bp, Homo sapiens
ccttagacccgccaggtca

SEQ ID NO: 352293 - DNA, 20 bp, Homo sapiens
ccttagagattgccccagag

SEQ ID NO: 352294 - DNA, 17 bp, Homo sapiens
ccttagcaacagccgag

SEQ ID NO: 352295 - DNA, 13 bp, Homo sapiens
ccttagcagctca

SEQ ID NO: 352296 - DNA, 15 bp, Homo sapiens
ccttagcagctcagg

SEQ ID NO: 352297 - DNA, 23 bp, Homo sapiens
ccttagcagctcaggcgcagccc

SEQ ID NO: 352298 - DNA, 18 bp, Homo sapiens
ccttagccagttgtatat

SEQ ID NO: 352299 - DNA, 15 bp, Homo sapiens
ccttagccctgtctg

SEQ ID NO: 352300 - DNA, 14 bp, Homo sapiens
ccttagcctccctg

SEQ ID NO: 352301 - DNA, 13 bp, Homo sapiens
ccttagcctctcc

SEQ ID NO: 352302 - DNA, 15 bp, Homo sapiens
ccttagcctctccca

SEQ ID NO: 352303 - DNA, 16 bp, Homo sapiens
ccttagcctctcccac

SEQ ID NO: 352304 - DNA, 15 bp, Homo sapiens
ccttagccttgctgt

SEQ ID NO: 352305 - DNA, 17 bp, Homo sapiens
ccttagccttgctgtag

SEQ ID NO: 352306 - DNA, 21 bp, Homo sapiens
ccttagcgttctggactctgc

SEQ ID NO: 352307 - DNA, 20 bp, Homo sapiens
ccttaggaagtgacttgaat

SEQ ID NO: 352308 - DNA, 19 bp, Homo sapiens
ccttaggcttaagagagag

SEQ ID NO: 352309 - DNA, 13 bp, Homo sapiens
ccttagtcttctc

SEQ ID NO: 352310 - DNA, 13 bp, Homo sapiens
ccttatcaagtgt

SEQ ID NO: 352311 - DNA, 15 bp, Homo sapiens
ccttatcaagtgtct

SEQ ID NO: 352312 - DNA, 20 bp, Homo sapiens
ccttatctgtgcgtgaaaca

SEQ ID NO: 352313 - DNA, 18 bp, Homo sapiens
ccttatttttatttattt

SEQ ID NO: 352314 - DNA, 23 bp, Homo sapiens
cctttatttattaaacttcagca

SEQ ID NO: 352315 - DNA, 15 bp, Homo sapiens
cctttcacaaccttc

SEQ ID NO: 352316 - DNA, 17 bp, Homo sapiens
cctttcagatgtcttct

SEQ ID NO: 352317 - DNA, 19 bp, Homo sapiens
cctttcagatgtcttctgc

SEQ ID NO: 352318 - DNA, 20 bp, Homo sapiens
cctttcagatgtcttctgcc

SEQ ID NO: 352319 - DNA, 19 bp, Homo sapiens
cctttcatcctcagcaagt

SEQ ID NO: 352320 - DNA, 13 bp, Homo sapiens
cctttccagccta

SEQ ID NO: 352321 - DNA, 11 bp, Homo sapiens
cctttccataa

SEQ ID NO: 352322 - DNA, 14 bp, Homo sapiens
cctttcccacagtc

SEQ ID NO: 352323 - DNA, 22 bp, Homo sapiens
cctttcccacccactagccctc

SEQ ID NO: 352324 - DNA, 21 bp, Homo sapiens
cctttcccattggtctgcatg

SEQ ID NO: 352325 - DNA, 21 bp, Homo sapiens
cctttccccactcagctgtgg

SEQ ID NO: 352326 - DNA, 13 bp, Homo sapiens
cctttccctgcat

SEQ ID NO: 352327 - DNA, 18 bp, Homo sapiens
cctttcctcctttatcac

SEQ ID NO: 352328 - DNA, 17 bp, Homo sapiens
cctttcctgtgccaacc

SEQ ID NO: 352329 - DNA, 16 bp, Homo sapiens
cctttccttgccttct

SEQ ID NO: 352330 - DNA, 16 bp, Homo sapiens
cctttctagcaattgc

SEQ ID NO: 352331 - DNA, 13 bp, Homo sapiens
cctttctccagcc

SEQ ID NO: 352332 - DNA, 16 bp, Homo sapiens
cctttctccagccagc

SEQ ID NO: 352333 - DNA, 18 bp, Homo sapiens
cctttctccagccagcaa

SEQ ID NO: 352334 - DNA, 11 bp, Homo sapiens
cctttctctga

SEQ ID NO: 352335 - DNA, 18 bp, Homo sapiens
cctttctgcccacttccc

SEQ ID NO: 352336 - DNA, 13 bp, Homo sapiens
cctttctgggagg

SEQ ID NO: 352337 - DNA, 11 bp, Homo sapiens
cctttctgtat

SEQ ID NO: 352338 - DNA, 22 bp, Homo sapiens
cctttctgtatcaagcccctgt

SEQ ID NO: 352339 - DNA, 11 bp, Homo sapiens
cctttctgtgt

SEQ ID NO: 352340 - DNA, 20 bp, Homo sapiens
cctttcttccatcagctctc

SEQ ID NO: 352341 - DNA, 21 bp, Homo sapiens
cctttcttcttgtgtctcctt

SEQ ID NO: 352342 - DNA, 23 bp, Homo sapiens
cctttcttgacaaaacctaactt

SEQ ID NO: 352343 - DNA, 22 bp, Homo sapiens
cctttcttgcactattccacag

SEQ ID NO: 352344 - DNA, 15 bp, Homo sapiens
cctttcttggccagt

SEQ ID NO: 352345 - DNA, 21 bp, Homo sapiens
cctttcttttgaatcaatctg

SEQ ID NO: 352346 - DNA, 17 bp, Homo sapiens
cctttctttttcttctt

SEQ ID NO: 352347 - DNA, 20 bp, Homo sapiens
cctttcttttttttcttggt

SEQ ID NO: 352348 - DNA, 21 bp, Homo sapiens
cctttgaccctattcatgtct

SEQ ID NO: 352349 - DNA, 14 bp, Homo sapiens
cctttgacttcagc

SEQ ID NO: 352350 - DNA, 15 bp, Homo sapiens
cctttgacttcagct

SEQ ID NO: 352351 - DNA, 15 bp, Homo sapiens
cctttgagaaagaaa

SEQ ID NO: 352352 - DNA, 16 bp, Homo sapiens
cctttgagaaagaaat

SEQ ID NO: 352353 - DNA, 17 bp, Homo sapiens
cctttgagaaagaaata

SEQ ID NO: 352354 - DNA, 19 bp, Homo sapiens
cctttgaggcaaaggccag

SEQ ID NO: 352355 - DNA, 22 bp, Homo sapiens
cctttgaggtctaaacaaataa

SEQ ID NO: 352356 - DNA, 16 bp, Homo sapiens
cctttgagtgtgggac

SEQ ID NO: 352357 - DNA, 22 bp, Homo sapiens
cctttgagtttcctcaggctgc

SEQ ID NO: 352358 - DNA, 21 bp, Homo sapiens
cctttgattgagttcatcatg

SEQ ID NO: 352359 - DNA, 13 bp, Homo sapiens
cctttgcactgag

SEQ ID NO: 352360 - DNA, 18 bp, Homo sapiens
cctttgcactgagggcca

SEQ ID NO: 352361 - DNA, 15 bp, Homo sapiens
cctttgcaggcccag

SEQ ID NO: 352362 - DNA, 19 bp, Homo sapiens
cctttgctccaccccactc

SEQ ID NO: 352363 - DNA, 13 bp, Homo sapiens
cctttgctcttat

SEQ ID NO: 352364 - DNA, 17 bp, Homo sapiens
cctttgctgtgaggctg

SEQ ID NO: 352365 - DNA, 22 bp, Homo sapiens
cctttgctgtgaggctgtcctg

SEQ ID NO: 352366 - DNA, 23 bp, Homo sapiens
cctttgctgtttagcttcctcca

SEQ ID NO: 352367 - DNA, 13 bp, Homo sapiens
cctttggaaagcc

SEQ ID NO: 352368 - DNA, 12 bp, Homo sapiens
cctttggaggga

SEQ ID NO: 352369 - DNA, 18 bp, Homo sapiens
cctttggggggggcccgc

SEQ ID NO: 352370 - DNA, 17 bp, Homo sapiens
cctttgtaagacacaca

SEQ ID NO: 352371 - DNA, 19 bp, Homo sapiens
cctttgtaagacacacagc

SEQ ID NO: 352372 - DNA, 20 bp, Homo sapiens
cctttgtaagacacacagcc

SEQ ID NO: 352373 - DNA, 22 bp, Homo sapiens
cctttgtaagacacacagcctt

SEQ ID NO: 352374 - DNA, 12 bp, Homo sapiens
cctttgtaagtt

SEQ ID NO: 352375 - DNA, 23 bp, Homo sapiens
cctttgtaggggttttttggttc

SEQ ID NO: 352376 - DNA, 18 bp, Homo sapiens
cctttgtcaacttcagtt

SEQ ID NO: 352377 - DNA, 18 bp, Homo sapiens
cctttgtggactttattt

SEQ ID NO: 352378 - DNA, 15 bp, Homo sapiens
cctttgtttcggtgc

SEQ ID NO: 352379 - DNA, 23 bp, Homo sapiens
cctttgttttgatgtttgtggcc

SEQ ID NO: 352380 - DNA, 16 bp, Homo sapiens
ccttttatagctatta

SEQ ID NO: 352381 - DNA, 13 bp, Homo sapiens
cttgccacacagt

SEQ ID NO: 352382 - DNA, 20 bp, Homo sapiens
cttgccaccccccgccggca

SEQ ID NO: 352383 - DNA, 14 bp, Homo sapiens
cttgccactgcctc

SEQ ID NO: 352384 - DNA, 17 bp, Homo sapiens
cttgcccaactcccagc

SEQ ID NO: 352385 - DNA, 19 bp, Homo sapiens
cttgcccaactcccagcca

SEQ ID NO: 352386 - DNA, 20 bp, Homo sapiens
cttgcccaactcccagccac

SEQ ID NO: 352387 - DNA, 21 bp, Homo sapiens
cttgcccaactcccagccacc

SEQ ID NO: 352388 - DNA, 22 bp, Homo sapiens
cttgccccagatgcctcctctg

SEQ ID NO: 352389 - DNA, 16 bp, Homo sapiens
cttgcccccatccctc

SEQ ID NO: 352390 - DNA, 13 bp, Homo sapiens
cttgccccccacc

SEQ ID NO: 352391 - DNA, 16 bp, Homo sapiens
cttgcccgccagccag

SEQ ID NO: 352392 - DNA, 20 bp, Homo sapiens
cttgcccgccagccagtggc

SEQ ID NO: 352393 - DNA, 12 bp, Homo sapiens
gacccaggccct

SEQ ID NO: 352394 - DNA, 12 bp, Homo sapiens
gacccagtgaga

SEQ ID NO: 352395 - DNA, 22 bp, Homo sapiens
gacccagtgagattacagagga

SEQ ID NO: 352396 - DNA, 20 bp, Homo sapiens
gaccccacacgccggggctg

SEQ ID NO: 352397 - DNA, 22 bp, Homo sapiens
gaccccagagggaccagctggg

SEQ ID NO: 352398 - DNA, 14 bp, Homo sapiens
gaccccaggaagtg

SEQ ID NO: 352399 - DNA, 13 bp, Homo sapiens
gaccccagggcag

SEQ ID NO: 352400 - DNA, 23 bp, Homo sapiens
gaccccatctctgctgcttctgg

SEQ ID NO: 352401 - DNA, 19 bp, Homo sapiens
gaccccatctgctgagctc

SEQ ID NO: 352402 - DNA, 12 bp, Homo sapiens
gacccccaacca

SEQ ID NO: 352403 - DNA, 12 bp, Homo sapiens
gacccccacccc

SEQ ID NO: 352404 - DNA, 13 bp, Homo sapiens
gacccccacccct

SEQ ID NO: 352405 - DNA, 15 bp, Homo sapiens
gacccccaccccttc

SEQ ID NO: 352406 - DNA, 18 bp, Homo sapiens
gacccccaccccttcccc

SEQ ID NO: 352407 - DNA, 20 bp, Homo sapiens
gacccccagcaaccctccta

SEQ ID NO: 352408 - DNA, 16 bp, Homo sapiens
gacccccatctctgca

SEQ ID NO: 352409 - DNA, 14 bp, Homo sapiens
gaccccctcccctg

SEQ ID NO: 352410 - DNA, 21 bp, Homo sapiens
gaccccgacgccacagcccag

SEQ ID NO: 352411 - DNA, 13 bp, Homo sapiens
gaccccgcccctg

SEQ ID NO: 352412 - DNA, 17 bp, Homo sapiens
gaccccgcccctgggga

SEQ ID NO: 352413 - DNA, 15 bp, Homo sapiens
gacccctaccctttc

SEQ ID NO: 352414 - DNA, 19 bp, Homo sapiens
gacccctcccctaatgcct

SEQ ID NO: 352415 - DNA, 13 bp, Homo sapiens
gacccctctggcc

SEQ ID NO: 352416 - DNA, 16 bp, Homo sapiens
gacccctctggccagg

SEQ ID NO: 352417 - DNA, 13 bp, Homo sapiens
gacccctgcctgg

SEQ ID NO: 352418 - DNA, 23 bp, Homo sapiens
gacccctgctcccagcctgctga

SEQ ID NO: 352419 - DNA, 14 bp, Homo sapiens
gacccctgctcctg

SEQ ID NO: 352420 - DNA, 22 bp, Homo sapiens
gacccctggaccaccagcccca

SEQ ID NO: 352421 - DNA, 12 bp, Homo sapiens
gacccctggctg

SEQ ID NO: 352422 - DNA, 13 bp, Homo sapiens
gacccctggcttt

SEQ ID NO: 352423 - DNA, 17 bp, Homo sapiens
gaccccttcctgtctgg

SEQ ID NO: 352424 - DNA, 15 bp, Homo sapiens
gaccccttgctccct

SEQ ID NO: 352425 - DNA, 23 bp, Homo sapiens
gacccggagctaacactggcccc

SEQ ID NO: 352426 - DNA, 11 bp, Homo sapiens
gacccggaggc

SEQ ID NO: 352427 - DNA, 18 bp, Homo sapiens
gacccggaggggcctggc

SEQ ID NO: 352428 - DNA, 20 bp, Homo sapiens
gacccggaggggcctggcag

SEQ ID NO: 352429 - DNA, 19 bp, Homo sapiens
gacccggcccccgccctct

SEQ ID NO: 352430 - DNA, 21 bp, Homo sapiens
gacccggcccccgccctctgc

SEQ ID NO: 352431 - DNA, 18 bp, Homo sapiens
gacccggcccctaccagc

SEQ ID NO: 352432 - DNA, 10 bp, Homo sapiens
gaccctcact

SEQ ID NO: 352433 - DNA, 15 bp, Homo sapiens
gaccctcggggcagg

SEQ ID NO: 352434 - DNA, 19 bp, Homo sapiens
gaccctcggggcaggaagt

SEQ ID NO: 352435 - DNA, 17 bp, Homo sapiens
gaccctcgtttgatagt

SEQ ID NO: 352436 - DNA, 14 bp, Homo sapiens
gaccctctcacttt

SEQ ID NO: 352437 - DNA, 17 bp, Homo sapiens
gaccctctccaccccat

SEQ ID NO: 352438 - DNA, 20 bp, Homo sapiens
gaccctcttctctgggccca

SEQ ID NO: 352439 - DNA, 11 bp, Homo sapiens
gaccctgagac

SEQ ID NO: 352440 - DNA, 16 bp, Homo sapiens
gaccctgagactccag

SEQ ID NO: 352441 - DNA, 17 bp, Homo sapiens
gaccctgagactccaga

SEQ ID NO: 352442 - DNA, 22 bp, Homo sapiens
gaccctgccaactttccagact

SEQ ID NO: 352443 - DNA, 20 bp, Homo sapiens
gaccctggaattcagcaccc

SEQ ID NO: 352444 - DNA, 14 bp, Homo sapiens
gaccctggagcccg

SEQ ID NO: 352445 - DNA, 18 bp, Homo sapiens
gaccctgggagagtgagg

SEQ ID NO: 352446 - DNA, 17 bp, Homo sapiens
gacccttcagggccaga

SEQ ID NO: 352447 - DNA, 22 bp, Homo sapiens
gacccttctactttttccttcc

SEQ ID NO: 352448 - DNA, 15 bp, Homo sapiens
gacccttgaagatgt

SEQ ID NO: 352449 - DNA, 18 bp, Homo sapiens
gaccgagtgtggagctgc

SEQ ID NO: 352450 - DNA, 14 bp, Homo sapiens
gaccgcccagctct

SEQ ID NO: 352451 - DNA, 15 bp, Homo sapiens
gaccgcccagctctc

SEQ ID NO: 352452 - DNA, 16 bp, Homo sapiens
gaccgcccagctctcc

SEQ ID NO: 352453 - DNA, 15 bp, Homo sapiens
gaccgcctgcttcac

SEQ ID NO: 352454 - DNA, 21 bp, Homo sapiens
gaccgcctgcttcacacccct

SEQ ID NO: 352455 - DNA, 14 bp, Homo sapiens
gaccgcttcacccc

SEQ ID NO: 352456 - DNA, 16 bp, Homo sapiens
gaccgcttcacccctg

SEQ ID NO: 352457 - DNA, 17 bp, Homo sapiens
gaccgcttcacccctgc

SEQ ID NO: 352458 - DNA, 18 bp, Homo sapiens
gaccgcttcacccctgca

SEQ ID NO: 352459 - DNA, 14 bp, Homo sapiens
gaccggaagctcct

SEQ ID NO: 352460 - DNA, 16 bp, Homo sapiens
gaccggaagctcctgg

SEQ ID NO: 352461 - DNA, 23 bp, Homo sapiens
gaccgggagcctgcgtggcctgg

SEQ ID NO: 352462 - DNA, 17 bp, Homo sapiens
gaccgggtgggcctggc

SEQ ID NO: 352463 - DNA, 21 bp, Homo sapiens
gaccgggtgggcctggcctga

SEQ ID NO: 352464 - DNA, 23 bp, Homo sapiens
gaccgtgatttggaagagaggca

SEQ ID NO: 352465 - DNA, 19 bp, Homo sapiens
gaccgttttcatcctggcc

SEQ ID NO: 352466 - DNA, 18 bp, Homo sapiens
gaccgtttttatattact

SEQ ID NO: 352467 - DNA, 23 bp, Homo sapiens
gacctaatatcattttattcaca

SEQ ID NO: 352468 - DNA, 14 bp, Homo sapiens
gacctaatgctcct

SEQ ID NO: 352469 - DNA, 15 bp, Homo sapiens
gacctaatgctcctt

SEQ ID NO: 352470 - DNA, 16 bp, Homo sapiens
gacctacattccctct

SEQ ID NO: 352471 - DNA, 13 bp, Homo sapiens
gacctactctcat

SEQ ID NO: 352472 - DNA, 13 bp, Homo sapiens
gacctatgtttgc

SEQ ID NO: 352473 - DNA, 13 bp, Homo sapiens
gacctcaacctgt

SEQ ID NO: 352474 - DNA, 17 bp, Homo sapiens
gacctcagagtccaggc

SEQ ID NO: 352475 - DNA, 19 bp, Homo sapiens
gacctcagagtccaggccc

SEQ ID NO: 352476 - DNA, 13 bp, Homo sapiens
gacctcagatgtg

SEQ ID NO: 352477 - DNA, 21 bp, Homo sapiens
gacctcagctgcacattcctg

SEQ ID NO: 352478 - DNA, 20 bp, Homo sapiens
gacctcagttttatcatttt

SEQ ID NO: 352479 - DNA, 21 bp, Homo sapiens
gacctcagttttatcattttc

SEQ ID NO: 352480 - DNA, 19 bp, Homo sapiens
gacctcatcaggatgaacc

SEQ ID NO: 352481 - DNA, 23 bp, Homo sapiens
gacctcatcaggatgaacccagg

SEQ ID NO: 352482 - DNA, 16 bp, Homo sapiens
gacctcatctccaaga

SEQ ID NO: 352483 - DNA, 19 bp, Homo sapiens
gacctcatgatccacccac

SEQ ID NO: 352484 - DNA, 17 bp, Homo sapiens
gacctccacctgggaga

SEQ ID NO: 352485 - DNA, 18 bp, Homo sapiens
gacctccacctgggagat

SEQ ID NO: 352486 - DNA, 20 bp, Homo sapiens
gacctccacctgggagatgc

SEQ ID NO: 352487 - DNA, 14 bp, Homo sapiens
gacctccagctgtt

SEQ ID NO: 352488 - DNA, 15 bp, Homo sapiens
gacctcccctcttcc

SEQ ID NO: 352489 - DNA, 17 bp, Homo sapiens
gacctcctaacaagtag

SEQ ID NO: 352490 - DNA, 20 bp, Homo sapiens
gacctccttagccctgtctg

SEQ ID NO: 352491 - DNA, 13 bp, Homo sapiens
gacctctgaagag

SEQ ID NO: 352492 - DNA, 13 bp, Homo sapiens
gacctctgatccc

SEQ ID NO: 352493 - DNA, 13 bp, Homo sapiens
gacctctgggctt

SEQ ID NO: 352494 - DNA, 16 bp, Homo sapiens
gacctctgttgtcctc

SEQ ID NO: 352495 - DNA, 14 bp, Homo sapiens
gacctgaactctgc

SEQ ID NO: 352496 - DNA, 22 bp, Homo sapiens
gacctgagctccccaccacccc

SEQ ID NO: 352497 - DNA, 16 bp, Homo sapiens
gacctgaggcagatga

SEQ ID NO: 352498 - DNA, 17 bp, Homo sapiens
gacctgagtcggcccca

SEQ ID NO: 352499 - DNA, 21 bp, Homo sapiens
gacctgagtcggccccacatg

SEQ ID NO: 352500 - DNA, 13 bp, Homo sapiens
gacctgcctcctg

SEQ ID NO: 352501 - DNA, 14 bp, Homo sapiens
gacctgcctcctgc

SEQ ID NO: 352502 - DNA, 19 bp, Homo sapiens
gacctgcctcctgcctgcc

SEQ ID NO: 352503 - DNA, 19 bp, Homo sapiens
gacctgctccgccaggaaa

SEQ ID NO: 352504 - DNA, 22 bp, Homo sapiens
gacctgctgctccatggatgca

SEQ ID NO: 352505 - DNA, 17 bp, Homo sapiens
gacctggaagagctggg

SEQ ID NO: 352506 - DNA, 23 bp, Homo sapiens
gacctggacgtcttcaagaactt

SEQ ID NO: 352507 - DNA, 14 bp, Homo sapiens
gacctggagacagg

SEQ ID NO: 352508 - DNA, 17 bp, Homo sapiens
gacctgggccctggttc

SEQ ID NO: 352509 - DNA, 17 bp, Homo sapiens
gacctgtaacttttgta

SEQ ID NO: 352510 - DNA, 13 bp, Homo sapiens
gacctgtgctagt

SEQ ID NO: 352511 - DNA, 22 bp, Homo sapiens
gacctgtggggatttctcccag

SEQ ID NO: 352512 - DNA, 23 bp, Homo sapiens
gacctgtggggatttctcccagc

SEQ ID NO: 352513 - DNA, 18 bp, Homo sapiens
gacctgtgttcttgctga

SEQ ID NO: 352514 - DNA, 15 bp, Homo sapiens
gacctgttctgacct

SEQ ID NO: 352515 - DNA, 23 bp, Homo sapiens
gaccttagaaatcattgtagaaa

SEQ ID NO: 352516 - DNA, 15 bp, Homo sapiens
gaccttagcgttctg

SEQ ID NO: 352517 - DNA, 20 bp, Homo sapiens
gaccttagcgttctggactc

SEQ ID NO: 352518 - DNA, 21 bp, Homo sapiens
gaccttatctgtgcgtgaaac

SEQ ID NO: 352519 - DNA, 14 bp, Homo sapiens
gaccttccacaaag

SEQ ID NO: 352520 - DNA, 18 bp, Homo sapiens
gaccttctccaaatgaga

SEQ ID NO: 352521 - DNA, 22 bp, Homo sapiens
ctttgctgtgaggctgtcctgt

SEQ ID NO: 352522 - DNA, 15 bp, Homo sapiens
ctttgctgttgacgt

SEQ ID NO: 352523 - DNA, 20 bp, Homo sapiens
ctttgcttatgaatatttat

SEQ ID NO: 352524 - DNA, 19 bp, Homo sapiens
ctttgcttccttgctttta

SEQ ID NO: 352525 - DNA, 20 bp, Homo sapiens
ctttggaacaacagctatct

SEQ ID NO: 352526 - DNA, 17 bp, Homo sapiens
ctttggaagtttgtgtt

SEQ ID NO: 352527 - DNA, 14 bp, Homo sapiens
ctttggaatttgaa

SEQ ID NO: 352528 - DNA, 18 bp, Homo sapiens
ctttggaatttgaagaat

SEQ ID NO: 352529 - DNA, 17 bp, Homo sapiens
ctttggacacacacagc

SEQ ID NO: 352530 - DNA, 18 bp, Homo sapiens
ctttggacacacacagct

SEQ ID NO: 352531 - DNA, 19 bp, Homo sapiens
ctttggacacacacagctt

SEQ ID NO: 352532 - DNA, 19 bp, Homo sapiens
ctttggacgcacacagctt

SEQ ID NO: 352533 - DNA, 23 bp, Homo sapiens
ctttggagcttttttctttaaga

SEQ ID NO: 352534 - DNA, 13 bp, Homo sapiens
ctttggcttcaaa

SEQ ID NO: 352535 - DNA, 22 bp, Homo sapiens
ctttgggaaacgggttgtgttt

SEQ ID NO: 352536 - DNA, 18 bp, Homo sapiens
ctttgggaacactggcct

SEQ ID NO: 352537 - DNA, 19 bp, Homo sapiens
ctttgggaacactggcctg

SEQ ID NO: 352538 - DNA, 15 bp, Homo sapiens
ctttgggaggccaag

SEQ ID NO: 352539 - DNA, 17 bp, Homo sapiens
ctttgggaggccaaggc

SEQ ID NO: 352540 - DNA, 23 bp, Homo sapiens
ctttgggaggccaaggcaggtag

SEQ ID NO: 352541 - DNA, 14 bp, Homo sapiens
ctttgggaggctga

SEQ ID NO: 352542 - DNA, 16 bp, Homo sapiens
ctttgggatcagcctc

SEQ ID NO: 352543 - DNA, 17 bp, Homo sapiens
ctttgggcctggctccc

SEQ ID NO: 352544 - DNA, 20 bp, Homo sapiens
ctttgggctgccctggtgct

SEQ ID NO: 352545 - DNA, 17 bp, Homo sapiens
ctttgggctttgcaggc

SEQ ID NO: 352546 - DNA, 21 bp, Homo sapiens
ctttgggctttgcaggctctg

SEQ ID NO: 352547 - DNA, 23 bp, Homo sapiens
ctttgggctttgcaggctctggg

SEQ ID NO: 352548 - DNA, 21 bp, Homo sapiens
ctttggggacagttggcagag

SEQ ID NO: 352549 - DNA, 16 bp, Homo sapiens
ctttgggggattcaaa

SEQ ID NO: 352550 - DNA, 23 bp, Homo sapiens
ctttggtctccatttttcccagg

SEQ ID NO: 352551 - DNA, 16 bp, Homo sapiens
ctttggtctcttgctt

SEQ ID NO: 352552 - DNA, 17 bp, Homo sapiens
ctttggttcctcatggc

SEQ ID NO: 352553 - DNA, 14 bp, Homo sapiens
ctttggttggaact

SEQ ID NO: 352554 - DNA, 14 bp, Homo sapiens
ctttgtaaggactt

SEQ ID NO: 352555 - DNA, 21 bp, Homo sapiens
ctttgtaaggacttgtgcctc

SEQ ID NO: 352556 - DNA, 16 bp, Homo sapiens
ctttgtaatgcttgta

SEQ ID NO: 352557 - DNA, 17 bp, Homo sapiens
ctttgtagcttaaaaaa

SEQ ID NO: 352558 - DNA, 21 bp, Homo sapiens
ctttgtagcttaaaaaaagga

SEQ ID NO: 352559 - DNA, 14 bp, Homo sapiens
ctttgtattctctg

SEQ ID NO: 352560 - DNA, 18 bp, Homo sapiens
ctttgtattctctgtcca

SEQ ID NO: 352561 - DNA, 15 bp, Homo sapiens
ctttgtcaatgctct

SEQ ID NO: 352562 - DNA, 17 bp, Homo sapiens
ctttgtcccctcacctc

SEQ ID NO: 352563 - DNA, 22 bp, Homo sapiens
ctttgtgagtattctatgtaaa

SEQ ID NO: 352564 - DNA, 13 bp, Homo sapiens
ctttgtgcaatat

SEQ ID NO: 352565 - DNA, 14 bp, Homo sapiens
ctttgtgcctttga

SEQ ID NO: 352566 - DNA, 12 bp, Homo sapiens
ctttgtggactt

SEQ ID NO: 352567 - DNA, 16 bp, Homo sapiens
ctttgtggactttatt

SEQ ID NO: 352568 - DNA, 17 bp, Homo sapiens
ctttgtggatgtcttcc

SEQ ID NO: 352569 - DNA, 13 bp, Homo sapiens
ctttgtggcagtg

SEQ ID NO: 352570 - DNA, 12 bp, Homo sapiens
ctttgtggggct

SEQ ID NO: 352571 - DNA, 12 bp, Homo sapiens
gactctttgctg

SEQ ID NO: 352572 - DNA, 12 bp, Homo sapiens
gactgaaagcag

SEQ ID NO: 352573 - DNA, 17 bp, Homo sapiens
gactgaaagcagcagct

SEQ ID NO: 352574 - DNA, 23 bp, Homo sapiens
gactgaaattaaacgagcgaaga

SEQ ID NO: 352575 - DNA, 16 bp, Homo sapiens
gactgaagcgaacatc

SEQ ID NO: 352576 - DNA, 16 bp, Homo sapiens
gactgaccctgatcag

SEQ ID NO: 352577 - DNA, 22 bp, Homo sapiens
gactgacggctgtgtatttctg

SEQ ID NO: 352578 - DNA, 15 bp, Homo sapiens
gactgagcagactgg

SEQ ID NO: 352579 - DNA, 14 bp, Homo sapiens
gactgagccagtcc

SEQ ID NO: 352580 - DNA, 21 bp, Homo sapiens
gactgatcctgaacaagaaag

SEQ ID NO: 352581 - DNA, 13 bp, Homo sapiens
gactgcagaggag

SEQ ID NO: 352582 - DNA, 14 bp, Homo sapiens
gactgcagaggagc

SEQ ID NO: 352583 - DNA, 23 bp, Homo sapiens
gactgcagaggagccacctgggc

SEQ ID NO: 352584 - DNA, 14 bp, Homo sapiens
gactgcatgcaagc

SEQ ID NO: 352585 - DNA, 14 bp, Homo sapiens
gactgccaagcagc

SEQ ID NO: 352586 - DNA, 12 bp, Homo sapiens
gactgcccaccc

SEQ ID NO: 352587 - DNA, 15 bp, Homo sapiens
gactgcccaccctgg

SEQ ID NO: 352588 - DNA, 17 bp, Homo sapiens
gactgcccaccctgggc

SEQ ID NO: 352589 - DNA, 15 bp, Homo sapiens
gactgccccgtgcag

SEQ ID NO: 352590 - DNA, 20 bp, Homo sapiens
gactgccccgtgcagactgg

SEQ ID NO: 352591 - DNA, 23 bp, Homo sapiens
gactgccccgtgcagactggagg

SEQ ID NO: 352592 - DNA, 16 bp, Homo sapiens
gactgccgaccgaggc

SEQ ID NO: 352593 - DNA, 11 bp, Homo sapiens
gactgcctccc

SEQ ID NO: 352594 - DNA, 12 bp, Homo sapiens
gactgcctctgc

SEQ ID NO: 352595 - DNA, 21 bp, Homo sapiens
gactgcctctgccacactctg

SEQ ID NO: 352596 - DNA, 13 bp, Homo sapiens
gactgctgctccc

SEQ ID NO: 352597 - DNA, 17 bp, Homo sapiens
gactgctgctccccacc

SEQ ID NO: 352598 - DNA, 23 bp, Homo sapiens
gactgcttcacggactctttgct

SEQ ID NO: 352599 - DNA, 23 bp, Homo sapiens
gactggagacaatgcagatgcca

SEQ ID NO: 352600 - DNA, 16 bp, Homo sapiens
gactggaggtgggcat

SEQ ID NO: 352601 - DNA, 22 bp, Homo sapiens
gactggagtcagatgagcaagg

SEQ ID NO: 352602 - DNA, 21 bp, Homo sapiens
gactggagtgaggcttccagg

SEQ ID NO: 352603 - DNA, 14 bp, Homo sapiens
gactggcagccagg

SEQ ID NO: 352604 - DNA, 17 bp, Homo sapiens
gactggcagccagggag

SEQ ID NO: 352605 - DNA, 17 bp, Homo sapiens
gactggccagaggcagc

SEQ ID NO: 352606 - DNA, 16 bp, Homo sapiens
gactggccatgcaagt

SEQ ID NO: 352607 - DNA, 13 bp, Homo sapiens
gactggcccaccc

SEQ ID NO: 352608 - DNA, 15 bp, Homo sapiens
gactggcccacccct

SEQ ID NO: 352609 - DNA, 16 bp, Homo sapiens
gactggcccacccctc

SEQ ID NO: 352610 - DNA, 19 bp, Homo sapiens
gactggcccacccctcttc

SEQ ID NO: 352611 - DNA, 14 bp, Homo sapiens
gactggcccttgcc

SEQ ID NO: 352612 - DNA, 19 bp, Homo sapiens
gactggctgcacagcccaa

SEQ ID NO: 352613 - DNA, 19 bp, Homo sapiens
gactggctgtctgcctgta

SEQ ID NO: 352614 - DNA, 14 bp, Homo sapiens
gactggctgtgaga

SEQ ID NO: 352615 - DNA, 23 bp, Homo sapiens
gactggctgtgagacgaggcagg

SEQ ID NO: 352616 - DNA, 14 bp, Homo sapiens
gactggctttcctc

SEQ ID NO: 352617 - DNA, 23 bp, Homo sapiens
gactgggaagataggctctgcac

SEQ ID NO: 352618 - DNA, 22 bp, Homo sapiens
gactgggagccacttctcccca

SEQ ID NO: 352619 - DNA, 19 bp, Homo sapiens
gactgggagtcagagccct

SEQ ID NO: 352620 - DNA, 18 bp, Homo sapiens
gactgggggcctctgcct

SEQ ID NO: 352621 - DNA, 14 bp, Homo sapiens
gactgggggtgcca

SEQ ID NO: 352622 - DNA, 22 bp, Homo sapiens
gactgggggtgccaaccacctc

SEQ ID NO: 352623 - DNA, 10 bp, Homo sapiens
gactggtcca

SEQ ID NO: 352624 - DNA, 13 bp, Homo sapiens
gactggtccaggc

SEQ ID NO: 352625 - DNA, 15 bp, Homo sapiens
gactggtcctgtgtg

SEQ ID NO: 352626 - DNA, 13 bp, Homo sapiens
gactgtaagatgt

SEQ ID NO: 352627 - DNA, 15 bp, Homo sapiens
gactgtaagatgttg

SEQ ID NO: 352628 - DNA, 17 bp, Homo sapiens
gactgtaagatgttgtt

SEQ ID NO: 352629 - DNA, 22 bp, Homo sapiens
gactgtacctgtaggaaacaga

SEQ ID NO: 352630 - DNA, 18 bp, Homo sapiens
gactgtactcctcccagg

SEQ ID NO: 352631 - DNA, 11 bp, Homo sapiens
gactgtactgg

SEQ ID NO: 352632 - DNA, 16 bp, Homo sapiens
gactgtactggccagt

SEQ ID NO: 352633 - DNA, 20 bp, Homo sapiens
gactgtataggtagatccag

SEQ ID NO: 352634 - DNA, 19 bp, Homo sapiens
gactgtattttcaggaagg

SEQ ID NO: 352635 - DNA, 13 bp, Homo sapiens
gactgtcagctga

SEQ ID NO: 352636 - DNA, 23 bp, Homo sapiens
gactgtcggagaggctgtctggg

SEQ ID NO: 352637 - DNA, 16 bp, Homo sapiens
gactgtcgttctccac

SEQ ID NO: 352638 - DNA, 22 bp, Homo sapiens
gactgtctcaagagggcactgg

SEQ ID NO: 352639 - DNA, 17 bp, Homo sapiens
gactgtcttcaaccctg

SEQ ID NO: 352640 - DNA, 22 bp, Homo sapiens
gactgtcttcaaccctgccctg

SEQ ID NO: 352641 - DNA, 23 bp, Homo sapiens
gactgtgatttatttggagtgga

SEQ ID NO: 352642 - DNA, 16 bp, Homo sapiens
gactgtggcctcagga

SEQ ID NO: 352643 - DNA, 22 bp, Homo sapiens
gactgtgtgttgccacaggaca

SEQ ID NO: 352644 - DNA, 22 bp, Homo sapiens
gactgttccctccaaggtcctc

SEQ ID NO: 352645 - DNA, 13 bp, Homo sapiens
gactgtttggctt

SEQ ID NO: 352646 - DNA, 21 bp, Homo sapiens
gactgttttttcctgagcttg

SEQ ID NO: 352647 - DNA, 19 bp, Homo sapiens
gacttaacggctccaggat

SEQ ID NO: 352648 - DNA, 20 bp, Homo sapiens
gacttaactgcatttttaga

SEQ ID NO: 352649 - DNA, 16 bp, Homo sapiens
gacttaagacaaatgg

SEQ ID NO: 352650 - DNA, 19 bp, Homo sapiens
gacttaagacaaatgggac

SEQ ID NO: 352651 - DNA, 16 bp, Homo sapiens
gacttaatctttgctg

SEQ ID NO: 352652 - DNA, 16 bp, Homo sapiens
gacttagcccgtcacc

SEQ ID NO: 352653 - DNA, 21 bp, Homo sapiens
gacttatatatttgaaagaag

SEQ ID NO: 352654 - DNA, 19 bp, Homo sapiens
gacttcaaaaggtgattaa

SEQ ID NO: 352655 - DNA, 21 bp, Homo sapiens
gacttcaaaaggtgattaaat

SEQ ID NO: 352656 - DNA, 15 bp, Homo sapiens
gacttcaagatgcct

SEQ ID NO: 352657 - DNA, 17 bp, Homo sapiens
gacttcaagatgcctct

SEQ ID NO: 352658 - DNA, 22 bp, Homo sapiens
gacttcagactctctcctctct

SEQ ID NO: 352659 - DNA, 23 bp, Homo sapiens
gacttcagactctctcctctctc

SEQ ID NO: 352660 - DNA, 14 bp, Homo sapiens
gacttcagctctgt

SEQ ID NO: 352661 - DNA, 14 bp, Homo sapiens
gacttcagggcagg

SEQ ID NO: 352662 - DNA, 18 bp, Homo sapiens
gacttcagggcagggctc

SEQ ID NO: 352663 - DNA, 17 bp, Homo sapiens
gacttcccaacagcctt

SEQ ID NO: 352664 - DNA, 21 bp, Homo sapiens
gacttcccagctggcagcgcc

SEQ ID NO: 352665 - DNA, 11 bp, Homo sapiens
gacttccccat

SEQ ID NO: 352666 - DNA, 12 bp, Homo sapiens
gacttcctctgg

SEQ ID NO: 352667 - DNA, 13 bp, Homo sapiens
gacttcctggggc

SEQ ID NO: 352668 - DNA, 18 bp, Homo sapiens
gacttccttgctctccct

SEQ ID NO: 352669 - DNA, 18 bp, Homo sapiens
gacttcgactgtgacctg

SEQ ID NO: 352670 - DNA, 20 bp, Homo sapiens
gacttcgctattcccaggca

SEQ ID NO: 352671 - DNA, 16 bp, Homo sapiens
gacttctaggaggatg

SEQ ID NO: 352672 - DNA, 23 bp, Homo sapiens
gacttctaggaggatgctgtgcc

SEQ ID NO: 352673 - DNA, 16 bp, Homo sapiens
gacttctatcctgtta

SEQ ID NO: 352674 - DNA, 15 bp, Homo sapiens
gacttctgcccaaat

SEQ ID NO: 352675 - DNA, 16 bp, Homo sapiens
gacttgaaagcatcca

SEQ ID NO: 352676 - DNA, 15 bp, Homo sapiens
gacttgaaagttttc

SEQ ID NO: 352677 - DNA, 18 bp, Homo sapiens
gacttgaatgtacaaaga

SEQ ID NO: 352678 - DNA, 11 bp, Homo sapiens
gacttgcttta

SEQ ID NO: 352679 - DNA, 21 bp, Homo sapiens
gacttggagagaatcatgctg

SEQ ID NO: 352680 - DNA, 17 bp, Homo sapiens
gacttggcaacagaagc

SEQ ID NO: 352681 - DNA, 22 bp, Homo sapiens
gacttggccgcttccctaccca

SEQ ID NO: 352682 - DNA, 23 bp, Homo sapiens
gacttggccgcttccctacccac

SEQ ID NO: 352683 - DNA, 22 bp, Homo sapiens
gacttgggagagggagcaagcc

SEQ ID NO: 352684 - DNA, 19 bp, Homo sapiens
gacttgggggcagagcagc

SEQ ID NO: 352685 - DNA, 23 bp, Homo sapiens
gacttggtgtcctttccctccac

SEQ ID NO: 352686 - DNA, 19 bp, Homo sapiens
gacttgtaggaatctgcct

SEQ ID NO: 352687 - DNA, 17 bp, Homo sapiens
gacttgtatgctgccca

SEQ ID NO: 352688 - DNA, 16 bp, Homo sapiens
gacttgtgcctcttgg

SEQ ID NO: 352689 - DNA, 13 bp, Homo sapiens
gacttgtgtccca

SEQ ID NO: 352690 - DNA, 12 bp, Homo sapiens
gacttgtttcct

SEQ ID NO: 352691 - DNA, 17 bp, Homo sapiens
gactttaattcttctct

SEQ ID NO: 352692 - DNA, 13 bp, Homo sapiens
gactttagaaata

SEQ ID NO: 352693 - DNA, 18 bp, Homo sapiens
gactttagaaataaatgt

SEQ ID NO: 352694 - DNA, 16 bp, Homo sapiens
gactttagggatctgg

SEQ ID NO: 352695 - DNA, 16 bp, Homo sapiens
gactttatctcctgct

SEQ ID NO: 352696 - DNA, 18 bp, Homo sapiens
gactttatctcctgctct

SEQ ID NO: 352697 - DNA, 16 bp, Homo sapiens
gactttatttaatttc

SEQ ID NO: 352698 - DNA, 19 bp, Homo sapiens
gactttatttaatttcata

SEQ ID NO: 352699 - DNA, 19 bp, Homo sapiens
gactttattttctggtaga

SEQ ID NO: 352700 - DNA, 19 bp, Homo sapiens
gactttccaccccctccct

SEQ ID NO: 352701 - DNA, 14 bp, Homo sapiens
gaggcgtgcccccc

SEQ ID NO: 352702 - DNA, 21 bp, Homo sapiens
gaggcgtgcccccctcctcca

SEQ ID NO: 352703 - DNA, 20 bp, Homo sapiens
gaggcgtgggatccagagag

SEQ ID NO: 352704 - DNA, 22 bp, Homo sapiens
gaggcgtgggatccagagagaa

SEQ ID NO: 352705 - DNA, 20 bp, Homo sapiens
gaggcgttagtgggcaggtg

SEQ ID NO: 352706 - DNA, 21 bp, Homo sapiens
gaggcgttagtgggcaggtgg

SEQ ID NO: 352707 - DNA, 16 bp, Homo sapiens
gaggctatagctggga

SEQ ID NO: 352708 - DNA, 21 bp, Homo sapiens
gaggctattcctaggcctcag

SEQ ID NO: 352709 - DNA, 20 bp, Homo sapiens
gaggctcccagacccagggc

SEQ ID NO: 352710 - DNA, 22 bp, Homo sapiens
gaggctcccagacccagggcag

SEQ ID NO: 352711 - DNA, 23 bp, Homo sapiens
gaggctcccagacccagggcagt

SEQ ID NO: 352712 - DNA, 14 bp, Homo sapiens
gaggctcctggagc

SEQ ID NO: 352713 - DNA, 15 bp, Homo sapiens
gaggctcctggagcc

SEQ ID NO: 352714 - DNA, 18 bp, Homo sapiens
gaggctcctggagccagc

SEQ ID NO: 352715 - DNA, 22 bp, Homo sapiens
gaggctcctggagccagccacc

SEQ ID NO: 352716 - DNA, 17 bp, Homo sapiens
gaggctcgtgcatgtaa

SEQ ID NO: 352717 - DNA, 12 bp, Homo sapiens
gaggctctgaag

SEQ ID NO: 352718 - DNA, 14 bp, Homo sapiens
gaggctgagactgc

SEQ ID NO: 352719 - DNA, 16 bp, Homo sapiens
gaggctgaggcaagag

SEQ ID NO: 352720 - DNA, 16 bp, Homo sapiens
gaggctgcctctgggt

SEQ ID NO: 352721 - DNA, 23 bp, Homo sapiens
gaggctgggccaagccagggatg

SEQ ID NO: 352722 - DNA, 15 bp, Homo sapiens
gaggctgtctggggc

SEQ ID NO: 352723 - DNA, 19 bp, Homo sapiens
gaggcttccaggctcttcc

SEQ ID NO: 352724 - DNA, 17 bp, Homo sapiens
gaggcttgggcccagta

SEQ ID NO: 352725 - DNA, 19 bp, Homo sapiens
gaggcttgggcccagtagc

SEQ ID NO: 352726 - DNA, 18 bp, Homo sapiens
gaggcttgtcagagctgg

SEQ ID NO: 352727 - DNA, 21 bp, Homo sapiens
gaggcttgtcagagctgggag

SEQ ID NO: 352728 - DNA, 18 bp, Homo sapiens
gaggcttttcccaccagc

SEQ ID NO: 352729 - DNA, 13 bp, Homo sapiens
gagggaaacaaaa

SEQ ID NO: 352730 - DNA, 19 bp, Homo sapiens
gagggaaactcagatgtcc

SEQ ID NO: 352731 - DNA, 16 bp, Homo sapiens
gagggaaatacaagga

SEQ ID NO: 352732 - DNA, 15 bp, Homo sapiens
gagggaagcccaccc

SEQ ID NO: 352733 - DNA, 17 bp, Homo sapiens
gagggaagcccacccgc

SEQ ID NO: 352734 - DNA, 15 bp, Homo sapiens
gagggacaagggatt

SEQ ID NO: 352735 - DNA, 17 bp, Homo sapiens
gagggacatgctcacct

SEQ ID NO: 352736 - DNA, 17 bp, Homo sapiens
gagggaccagctggggg

SEQ ID NO: 352737 - DNA, 19 bp, Homo sapiens
gagggaccaggtgtctaga

SEQ ID NO: 352738 - DNA, 20 bp, Homo sapiens
gagggaccttggagagctca

SEQ ID NO: 352739 - DNA, 22 bp, Homo sapiens
gagggacgcggctcccggggca

SEQ ID NO: 352740 - DNA, 15 bp, Homo sapiens
gagggactgcctctg

SEQ ID NO: 352741 - DNA, 18 bp, Homo sapiens
gagggagaaggagaggct

SEQ ID NO: 352742 - DNA, 13 bp, Homo sapiens
gagggagccttgt

SEQ ID NO: 352743 - DNA, 13 bp, Homo sapiens
gagggaggaatcg

SEQ ID NO: 352744 - DNA, 19 bp, Homo sapiens
gaggtgtttaaagagaggt

SEQ ID NO: 352745 - DNA, 19 bp, Homo sapiens
gaggttataggtcactcct

SEQ ID NO: 352746 - DNA, 15 bp, Homo sapiens
gaggttatctgcctg

SEQ ID NO: 352747 - DNA, 19 bp, Homo sapiens
gaggttctcagagccaagt

SEQ ID NO: 352748 - DNA, 19 bp, Homo sapiens
gaggttgaggatgcactgg

SEQ ID NO: 352749 - DNA, 12 bp, Homo sapiens
gaggttgaggct

SEQ ID NO: 352750 - DNA, 15 bp, Homo sapiens
gaggtttcacctccg

SEQ ID NO: 352751 - DNA, 15 bp, Homo sapiens
gaggtttgtttgtgt

SEQ ID NO: 352752 - DNA, 15 bp, Homo sapiens
gagtaaaaattcata

SEQ ID NO: 352753 - DNA, 14 bp, Homo sapiens
gagtaaagataaaa

SEQ ID NO: 352754 - DNA, 17 bp, Homo sapiens
gagtaaagataaaagga

SEQ ID NO: 352755 - DNA, 16 bp, Homo sapiens
gagtaaataaactctt

SEQ ID NO: 352756 - DNA, 17 bp, Homo sapiens
gagtaaatattgtcaca

SEQ ID NO: 352757 - DNA, 21 bp, Homo sapiens
gagtaactattattataggta

SEQ ID NO: 352758 - DNA, 12 bp, Homo sapiens
gagtaagagctg

SEQ ID NO: 352759 - DNA, 15 bp, Homo sapiens
gagtaatgtttaaga

SEQ ID NO: 352760 - DNA, 13 bp, Homo sapiens
gagtaatttaaat

SEQ ID NO: 352761 - DNA, 15 bp, Homo sapiens
gagtacaaagacagg

SEQ ID NO: 352762 - DNA, 16 bp, Homo sapiens
gagtacccccctgaga

SEQ ID NO: 352763 - DNA, 16 bp, Homo sapiens
gagtacctgctgcccc

SEQ ID NO: 352764 - DNA, 14 bp, Homo sapiens
gagtagaaattgtt

SEQ ID NO: 352765 - DNA, 17 bp, Homo sapiens
gagtagacccctggctg

SEQ ID NO: 352766 - DNA, 18 bp, Homo sapiens
gagtagatggtgaaattt

SEQ ID NO: 352767 - DNA, 17 bp, Homo sapiens
gagtagcacccccagcc

SEQ ID NO: 352768 - DNA, 18 bp, Homo sapiens
gagtagcatggactctgg

SEQ ID NO: 352769 - DNA, 15 bp, Homo sapiens
gagtagcccaggtca

SEQ ID NO: 352770 - DNA, 15 bp, Homo sapiens
gagtaggctgtattt

SEQ ID NO: 352771 - DNA, 19 bp, Homo sapiens
gagtaggctgtattttctt

SEQ ID NO: 352772 - DNA, 22 bp, Homo sapiens
gagtagggtagaaggaaagcat

SEQ ID NO: 352773 - DNA, 22 bp, Homo sapiens
gagtagggttgccagtcctgca

SEQ ID NO: 352774 - DNA, 12 bp, Homo sapiens
gagtatatatgt

SEQ ID NO: 352775 - DNA, 17 bp, Homo sapiens
gagtatatatgtacagt

SEQ ID NO: 352776 - DNA, 19 bp, Homo sapiens
gagtatatatgtacagtta

SEQ ID NO: 352777 - DNA, 12 bp, Homo sapiens
gagtatatgcac

SEQ ID NO: 352778 - DNA, 14 bp, Homo sapiens
gagtatatgcactt

SEQ ID NO: 352779 - DNA, 16 bp, Homo sapiens
gagtatctgggaactg

SEQ ID NO: 352780 - DNA, 19 bp, Homo sapiens
gagtatctgtaacccttga

SEQ ID NO: 352781 - DNA, 10 bp, Homo sapiens
gagtatgtgt

SEQ ID NO: 352782 - DNA, 22 bp, Homo sapiens
gagtatgttaagctctttatga

SEQ ID NO: 352783 - DNA, 17 bp, Homo sapiens
gagtattaagaatgcag

SEQ ID NO: 352784 - DNA, 16 bp, Homo sapiens
gagtcaaaagcctggg

SEQ ID NO: 352785 - DNA, 19 bp, Homo sapiens
gagtcaagtgtgcctgcta

SEQ ID NO: 352786 - DNA, 13 bp, Homo sapiens
gagtcacctcctc

SEQ ID NO: 352787 - DNA, 15 bp, Homo sapiens
gagtcacctcctcca

SEQ ID NO: 352788 - DNA, 14 bp, Homo sapiens
gagtcacctgcaag

SEQ ID NO: 352789 - DNA, 15 bp, Homo sapiens
gagtcacctgcaagc

SEQ ID NO: 352790 - DNA, 21 bp, Homo sapiens
gagtcacctgcaagccccagg

SEQ ID NO: 352791 - DNA, 23 bp, Homo sapiens
gagtcaccttcattttggcaaga

SEQ ID NO: 352792 - DNA, 21 bp, Homo sapiens
gagtcaccttccaggacccct

SEQ ID NO: 352793 - DNA, 13 bp, Homo sapiens
gagtcagagccct

SEQ ID NO: 352794 - DNA, 14 bp, Homo sapiens
gagtcagagccctg

SEQ ID NO: 352795 - DNA, 15 bp, Homo sapiens
gagtcagagccctgg

SEQ ID NO: 352796 - DNA, 22 bp, Homo sapiens
gagtcagagccctggctgggtt

SEQ ID NO: 352797 - DNA, 11 bp, Homo sapiens
gagtcagatga

SEQ ID NO: 352798 - DNA, 21 bp, Homo sapiens
gagtcagatgagcaaggacat

SEQ ID NO: 352799 - DNA, 15 bp, Homo sapiens
gagtcagccattcct

SEQ ID NO: 352800 - DNA, 16 bp, Homo sapiens
gagtcagggagccctg

SEQ ID NO: 352801 - DNA, 17 bp, Homo sapiens
gagtcagggagccctgg

SEQ ID NO: 352802 - DNA, 15 bp, Homo sapiens
gagtcagggcccaga

SEQ ID NO: 352803 - DNA, 18 bp, Homo sapiens
gagtcaggtttggggttc

SEQ ID NO: 352804 - DNA, 20 bp, Homo sapiens
gagtcagtttttttaaaaag

SEQ ID NO: 352805 - DNA, 17 bp, Homo sapiens
gagtcatcaaaaagagt

SEQ ID NO: 352806 - DNA, 13 bp, Homo sapiens
gagtcatctccat

SEQ ID NO: 352807 - DNA, 14 bp, Homo sapiens
gagtccaaaatcat

SEQ ID NO: 352808 - DNA, 22 bp, Homo sapiens
gagtccaacgtggggcagcaca

SEQ ID NO: 352809 - DNA, 18 bp, Homo sapiens
gagtccactttcctctct

SEQ ID NO: 352810 - DNA, 14 bp, Homo sapiens
gagtccagctcccc

SEQ ID NO: 352811 - DNA, 17 bp, Homo sapiens
gagtccattgcaaaagg

SEQ ID NO: 352812 - DNA, 18 bp, Homo sapiens
gagtcccagagcaggagg

SEQ ID NO: 352813 - DNA, 19 bp, Homo sapiens
gagtcccagagcaggaggc

SEQ ID NO: 352814 - DNA, 23 bp, Homo sapiens
gagtcccagagcaggaggcccct

SEQ ID NO: 352815 - DNA, 16 bp, Homo sapiens
gagtcccagtgggagg

SEQ ID NO: 352816 - DNA, 14 bp, Homo sapiens
gagtcccttccagg

SEQ ID NO: 352817 - DNA, 16 bp, Homo sapiens
gagtcctcactcccag

SEQ ID NO: 352818 - DNA, 14 bp, Homo sapiens
gagtcctgaggcag

SEQ ID NO: 352819 - DNA, 15 bp, Homo sapiens
gagtcctgaggcaga

SEQ ID NO: 352820 - DNA, 13 bp, Homo sapiens
gagtcctgttctc

SEQ ID NO: 352821 - DNA, 16 bp, Homo sapiens
gagtcctgttctcaga

SEQ ID NO: 352822 - DNA, 19 bp, Homo sapiens
gagtcctgttctcagagct

SEQ ID NO: 352823 - DNA, 14 bp, Homo sapiens
gagtcctttctttt

SEQ ID NO: 352824 - DNA, 16 bp, Homo sapiens
gagtcctttcttttga

SEQ ID NO: 352825 - DNA, 19 bp, Homo sapiens
gagtcggatctagccatgg

SEQ ID NO: 352826 - DNA, 19 bp, Homo sapiens
gagtcggctgggcagggcc

SEQ ID NO: 352827 - DNA, 23 bp, Homo sapiens
gagtcgtcatcacttttcagtga

SEQ ID NO: 352828 - DNA, 16 bp, Homo sapiens
gagtctctgaacatcc

SEQ ID NO: 352829 - DNA, 20 bp, Homo sapiens
gagtctctgccacccactca

SEQ ID NO: 352830 - DNA, 12 bp, Homo sapiens
gagtctcttctc

SEQ ID NO: 352831 - DNA, 14 bp, Homo sapiens
gagtctcttctcca

SEQ ID NO: 352832 - DNA, 15 bp, Homo sapiens
gagtctgaaggagag

SEQ ID NO: 352833 - DNA, 19 bp, Homo sapiens
gagtctgaaggagaggagt

SEQ ID NO: 352834 - DNA, 15 bp, Homo sapiens
gagtctgacaggaag

SEQ ID NO: 352835 - DNA, 20 bp, Homo sapiens
gagtctgacaggaagactgg

SEQ ID NO: 352836 - DNA, 16 bp, Homo sapiens
gagtctgattgcagga

SEQ ID NO: 352837 - DNA, 13 bp, Homo sapiens
gagtctgcttgtc

SEQ ID NO: 352838 - DNA, 21 bp, Homo sapiens
gagtctggagaccaggactct

SEQ ID NO: 352839 - DNA, 14 bp, Homo sapiens
gagtctggcctgcc

SEQ ID NO: 352840 - DNA, 15 bp, Homo sapiens
gagtctggcctgcca

SEQ ID NO: 352841 - DNA, 16 bp, Homo sapiens
gagtctgggcctctga

SEQ ID NO: 352842 - DNA, 17 bp, Homo sapiens
gagtctgtcctttccca

SEQ ID NO: 352843 - DNA, 21 bp, Homo sapiens
gagtctgtgaataaagccaca

SEQ ID NO: 352844 - DNA, 11 bp, Homo sapiens
gagtctgtgga

SEQ ID NO: 352845 - DNA, 12 bp, Homo sapiens
gagtctgtggac

SEQ ID NO: 352846 - DNA, 19 bp, Homo sapiens
gagtctgtgtgtagccagg

SEQ ID NO: 352847 - DNA, 14 bp, Homo sapiens
gagtcttcacattt

SEQ ID NO: 352848 - DNA, 15 bp, Homo sapiens
gagtcttcacattta

SEQ ID NO: 352849 - DNA, 23 bp, Homo sapiens
gagtctttgtaagtaaactgccc

SEQ ID NO: 352850 - DNA, 20 bp, Homo sapiens
gagtctttgtaatgcttgta

SEQ ID NO: 352851 - DNA, 14 bp, Homo sapiens
gagtgaaagggcta

SEQ ID NO: 352852 - DNA, 22 bp, Homo sapiens
gagtgacatcggttcaggagga

SEQ ID NO: 352853 - DNA, 20 bp, Homo sapiens
gagtgacatgcggctgccca

SEQ ID NO: 352854 - DNA, 14 bp, Homo sapiens
gagtgactagacgt

SEQ ID NO: 352855 - DNA, 13 bp, Homo sapiens
gagtgagagagag

SEQ ID NO: 352856 - DNA, 17 bp, Homo sapiens
gagtgagcttggtgcgg

SEQ ID NO: 352857 - DNA, 15 bp, Homo sapiens
gagtgaggcttccag

SEQ ID NO: 352858 - DNA, 19 bp, Homo sapiens
gagtgaggcttccaggctc

SEQ ID NO: 352859 - DNA, 16 bp, Homo sapiens
gagtgaggtcatcccg

SEQ ID NO: 352860 - DNA, 20 bp, Homo sapiens
gagtgaggtcatcccggggc

SEQ ID NO: 352861 - DNA, 22 bp, Homo sapiens
gagtgatatggcttgtagggtg

SEQ ID NO: 352862 - DNA, 20 bp, Homo sapiens
gagtgcagaacacctggccg

SEQ ID NO: 352863 - DNA, 19 bp, Homo sapiens
gagtgcagaggctgagcag

SEQ ID NO: 352864 - DNA, 20 bp, Homo sapiens
gagtgcagaggctgagcagg

SEQ ID NO: 352865 - DNA, 20 bp, Homo sapiens
gagtgcatggccacagccac

SEQ ID NO: 352866 - DNA, 13 bp, Homo sapiens
gagtgccccagaa

SEQ ID NO: 352867 - DNA, 13 bp, Homo sapiens
gagtgcccctgca

SEQ ID NO: 352868 - DNA, 15 bp, Homo sapiens
gagtgcccctgcagg

SEQ ID NO: 352869 - DNA, 18 bp, Homo sapiens
gagtgccttacacaatgg

SEQ ID NO: 352870 - DNA, 14 bp, Homo sapiens
gagtgcgctagagc

SEQ ID NO: 352871 - DNA, 18 bp, Homo sapiens
gagtgctgcttgtgcctc

SEQ ID NO: 352872 - DNA, 22 bp, Homo sapiens
gagtgctgcttgtgcctccctt

SEQ ID NO: 352873 - DNA, 12 bp, Homo sapiens
gatctccaaagc

SEQ ID NO: 352874 - DNA, 13 bp, Homo sapiens
gatctccaaagct

SEQ ID NO: 352875 - DNA, 14 bp, Homo sapiens
gatctccaggccca

SEQ ID NO: 352876 - DNA, 14 bp, Homo sapiens
gatctcctggtagc

SEQ ID NO: 352877 - DNA, 13 bp, Homo sapiens
gatctcctgtaat

SEQ ID NO: 352878 - DNA, 20 bp, Homo sapiens
gatctcctgtaattttgtag

SEQ ID NO: 352879 - DNA, 21 bp, Homo sapiens
gatctctactaccacaaggaa

SEQ ID NO: 352880 - DNA, 12 bp, Homo sapiens
gatctctcagga

SEQ ID NO: 352881 - DNA, 14 bp, Homo sapiens
gatctctcaggagc

SEQ ID NO: 352882 - DNA, 19 bp, Homo sapiens
gatctctcaggagcacagg

SEQ ID NO: 352883 - DNA, 15 bp, Homo sapiens
gatctcttaggaagc

SEQ ID NO: 352884 - DNA, 21 bp, Homo sapiens
gatctgacatgattccttcct

SEQ ID NO: 352885 - DNA, 22 bp, Homo sapiens
gatctgacatgattccttcctg

SEQ ID NO: 352886 - DNA, 15 bp, Homo sapiens
gatctgatggtgagc

SEQ ID NO: 352887 - DNA, 13 bp, Homo sapiens
gatctgcctgggc

SEQ ID NO: 352888 - DNA, 18 bp, Homo sapiens
gatctgcctgggcctgtg

SEQ ID NO: 352889 - DNA, 20 bp, Homo sapiens
gatctgcctgggcctgtgca

SEQ ID NO: 352890 - DNA, 21 bp, Homo sapiens
gatctgctgacagatgttcca

SEQ ID NO: 352891 - DNA, 13 bp, Homo sapiens
gatctggagtctg

SEQ ID NO: 352892 - DNA, 14 bp, Homo sapiens
gatctggagtctga

SEQ ID NO: 352893 - DNA, 19 bp, Homo sapiens
gatctggagtctgaaggag

SEQ ID NO: 352894 - DNA, 13 bp, Homo sapiens
gatctggggaagg

SEQ ID NO: 352895 - DNA, 18 bp, Homo sapiens
gatctggggctctgggat

SEQ ID NO: 352896 - DNA, 17 bp, Homo sapiens
gatctggtgcgtgtggc

SEQ ID NO: 352897 - DNA, 22 bp, Homo sapiens
gatctggtgcgtgtggccctgt

SEQ ID NO: 352898 - DNA, 13 bp, Homo sapiens
gatctgtgcccca

SEQ ID NO: 352899 - DNA, 14 bp, Homo sapiens
gatcttcaatggct

SEQ ID NO: 352900 - DNA, 23 bp, Homo sapiens
gatcttcaggatgcacggtttct

SEQ ID NO: 352901 - DNA, 18 bp, Homo sapiens
gatcttccttccgctctg

SEQ ID NO: 352902 - DNA, 14 bp, Homo sapiens
gatcttctgaaatg

SEQ ID NO: 352903 - DNA, 21 bp, Homo sapiens
gatcttggagacaattacaag

SEQ ID NO: 352904 - DNA, 19 bp, Homo sapiens
gatctttacataattcaga

SEQ ID NO: 352905 - DNA, 13 bp, Homo sapiens
gatctttgcttcc

SEQ ID NO: 352906 - DNA, 20 bp, Homo sapiens
gatgaaaaaaagggaaaaca

SEQ ID NO: 352907 - DNA, 12 bp, Homo sapiens
gatgaaaataaa

SEQ ID NO: 352908 - DNA, 16 bp, Homo sapiens
gatgaaagttccccca

SEQ ID NO: 352909 - DNA, 20 bp, Homo sapiens
gatgaaatttatttccatct

SEQ ID NO: 352910 - DNA, 20 bp, Homo sapiens
gatgaactttttaacaaatg

SEQ ID NO: 352911 - DNA, 19 bp, Homo sapiens
gatgaagaacacagcatgt

SEQ ID NO: 352912 - DNA, 14 bp, Homo sapiens
gatgaatgcagtat

SEQ ID NO: 352913 - DNA, 16 bp, Homo sapiens
gatgaatgcagtataa

SEQ ID NO: 352914 - DNA, 13 bp, Homo sapiens
gatgaatgtatgt

SEQ ID NO: 352915 - DNA, 16 bp, Homo sapiens
gatgacaaagaaaatg

SEQ ID NO: 352916 - DNA, 20 bp, Homo sapiens
gatgacaaagaaaatgagaa

SEQ ID NO: 352917 - DNA, 18 bp, Homo sapiens
gatgacacataaatctgt

SEQ ID NO: 352918 - DNA, 19 bp, Homo sapiens
gatgacaggcgcctgccat

SEQ ID NO: 352919 - DNA, 20 bp, Homo sapiens
gatgacaggcgcctgccatc

SEQ ID NO: 352920 - DNA, 15 bp, Homo sapiens
gatgacagggagctg

SEQ ID NO: 352921 - DNA, 17 bp, Homo sapiens
gatgacccctcccctaa

SEQ ID NO: 352922 - DNA, 18 bp, Homo sapiens
gatgacccggggcagctg

SEQ ID NO: 352923 - DNA, 18 bp, Homo sapiens
gatgaccttgaatgatgc

SEQ ID NO: 352924 - DNA, 20 bp, Homo sapiens
gatgaccttgaatgatgcca

SEQ ID NO: 352925 - DNA, 13 bp, Homo sapiens
gatgagaaaacag

SEQ ID NO: 352926 - DNA, 18 bp, Homo sapiens
gatgagaattcagctgcc

SEQ ID NO: 352927 - DNA, 23 bp, Homo sapiens
gatgagacagggttttttcattt

SEQ ID NO: 352928 - DNA, 17 bp, Homo sapiens
gatgagatttgccagca

SEQ ID NO: 352929 - DNA, 14 bp, Homo sapiens
gatgagcaaggaca

SEQ ID NO: 352930 - DNA, 15 bp, Homo sapiens
gatgagcaaggacat

SEQ ID NO: 352931 - DNA, 18 bp, Homo sapiens
gatgagcaaggacattgc

SEQ ID NO: 352932 - DNA, 19 bp, Homo sapiens
gatgagcaaggacattgcc

SEQ ID NO: 352933 - DNA, 20 bp, Homo sapiens
gatgagcactcctgattttt

SEQ ID NO: 352934 - DNA, 20 bp, Homo sapiens
gatgagccccacgtggagct

SEQ ID NO: 352935 - DNA, 15 bp, Homo sapiens
gatgagctgaaaagt

SEQ ID NO: 352936 - DNA, 15 bp, Homo sapiens
gatgagctttctttt

SEQ ID NO: 352937 - DNA, 19 bp, Homo sapiens
gatgaggccgctagaggcc

SEQ ID NO: 352938 - DNA, 14 bp, Homo sapiens
gatgaggggaggaa

SEQ ID NO: 352939 - DNA, 14 bp, Homo sapiens
gatgagggtgactg

SEQ ID NO: 352940 - DNA, 14 bp, Homo sapiens
gatgaggtgctggg

SEQ ID NO: 352941 - DNA, 17 bp, Homo sapiens
gatgaggtgctgggagg

SEQ ID NO: 352942 - DNA, 13 bp, Homo sapiens
gatgagtcctgtt

SEQ ID NO: 352943 - DNA, 12 bp, Homo sapiens
gatgatagactt

SEQ ID NO: 352944 - DNA, 22 bp, Homo sapiens
gatgatctcttaggaagccttt

SEQ ID NO: 352945 - DNA, 12 bp, Homo sapiens
gatgatgctgtg

SEQ ID NO: 352946 - DNA, 16 bp, Homo sapiens
gatgatgtctcttgta

SEQ ID NO: 352947 - DNA, 19 bp, Homo sapiens
gatgattaaacacctgaca

SEQ ID NO: 352948 - DNA, 22 bp, Homo sapiens
gatgattcaatcattttgggaa

SEQ ID NO: 352949 - DNA, 13 bp, Homo sapiens
gatgattgtacag

SEQ ID NO: 352950 - DNA, 19 bp, Homo sapiens
gatgatttctagcaggcag

SEQ ID NO: 352951 - DNA, 20 bp, Homo sapiens
gatgatttctagcaggcagg

SEQ ID NO: 352952 - DNA, 19 bp, Homo sapiens
gatgatttttaagtacaaa

SEQ ID NO: 352953 - DNA, 17 bp, Homo sapiens
gatgcaagatatttata

SEQ ID NO: 352954 - DNA, 21 bp, Homo sapiens
gatgcaccaagtacagccttc

SEQ ID NO: 352955 - DNA, 14 bp, Homo sapiens
gatgcactggcctg

SEQ ID NO: 352956 - DNA, 19 bp, Homo sapiens
gatgcacttattttttaat

SEQ ID NO: 352957 - DNA, 20 bp, Homo sapiens
gatgccaaggaggtcccagg

SEQ ID NO: 352958 - DNA, 17 bp, Homo sapiens
gatgccacacagagtgg

SEQ ID NO: 352959 - DNA, 20 bp, Homo sapiens
gatgccatctgtgtcctggt

SEQ ID NO: 352960 - DNA, 13 bp, Homo sapiens
gatgccatggcct

SEQ ID NO: 352961 - DNA, 23 bp, Homo sapiens
gatgccccctaatccccttctcc

SEQ ID NO: 352962 - DNA, 13 bp, Homo sapiens
gatgccccttccc

SEQ ID NO: 352963 - DNA, 23 bp, Homo sapiens
gatgcccgcccggggagtttccg

SEQ ID NO: 352964 - DNA, 21 bp, Homo sapiens
gatgccctttggaaagccatt

SEQ ID NO: 352965 - DNA, 15 bp, Homo sapiens
gatgcctcccggctt

SEQ ID NO: 352966 - DNA, 19 bp, Homo sapiens
gatgcctcccggctttgca

SEQ ID NO: 352967 - DNA, 22 bp, Homo sapiens
gatgcctccctgaccctgcaga

SEQ ID NO: 352968 - DNA, 15 bp, Homo sapiens
gatgcctcctctgtc

SEQ ID NO: 352969 - DNA, 14 bp, Homo sapiens
gatgcctgacacag

SEQ ID NO: 352970 - DNA, 23 bp, Homo sapiens
gatgcctttgctgtttagcttcc

SEQ ID NO: 352971 - DNA, 23 bp, Homo sapiens
gatgcgggcattttgaatgtgat

SEQ ID NO: 352972 - DNA, 15 bp, Homo sapiens
gatgctaataaactg

SEQ ID NO: 352973 - DNA, 15 bp, Homo sapiens
gatgctactaagaaa

SEQ ID NO: 352974 - DNA, 14 bp, Homo sapiens
gatgctcaggcttg

SEQ ID NO: 352975 - DNA, 12 bp, Homo sapiens
gatgctccagcc

SEQ ID NO: 352976 - DNA, 13 bp, Homo sapiens
gatgctccagcca

SEQ ID NO: 352977 - DNA, 13 bp, Homo sapiens
gatgctccctccc

SEQ ID NO: 352978 - DNA, 13 bp, Homo sapiens
gatgctgaaataa

SEQ ID NO: 352979 - DNA, 23 bp, Homo sapiens
gatgctgaaataaactagggttt

SEQ ID NO: 352980 - DNA, 14 bp, Homo sapiens
gatgctggagaggt

SEQ ID NO: 352981 - DNA, 13 bp, Homo sapiens
gatgctggcccca

SEQ ID NO: 352982 - DNA, 22 bp, Homo sapiens
gatgctgtgacaataagtttga

SEQ ID NO: 352983 - DNA, 19 bp, Homo sapiens
gatgcttcatgtgaacgtg

SEQ ID NO: 352984 - DNA, 11 bp, Homo sapiens
gatgcttctgc

SEQ ID NO: 352985 - DNA, 18 bp, Homo sapiens
gatgcttgtaacaagaaa

SEQ ID NO: 352986 - DNA, 21 bp, Homo sapiens
gatgcttgtaacaagaaaaca

SEQ ID NO: 352987 - DNA, 20 bp, Homo sapiens
gatggaacccttttggcccc

SEQ ID NO: 352988 - DNA, 22 bp, Homo sapiens
gatggaacccttttggcccccg

SEQ ID NO: 352989 - DNA, 17 bp, Homo sapiens
gatggaaggagagaggt

SEQ ID NO: 352990 - DNA, 22 bp, Homo sapiens
gatggacagttcacaccctgca

SEQ ID NO: 352991 - DNA, 15 bp, Homo sapiens
gatggacccctccct

SEQ ID NO: 352992 - DNA, 18 bp, Homo sapiens
gatggaccgggtgggcct

SEQ ID NO: 352993 - DNA, 19 bp, Homo sapiens
gatggaccgggtgggcctg

SEQ ID NO: 352994 - DNA, 11 bp, Homo sapiens
gatggagaagg

SEQ ID NO: 352995 - DNA, 15 bp, Homo sapiens
gatggagaaggaaaa

SEQ ID NO: 352996 - DNA, 19 bp, Homo sapiens
gatggagaatgccagccca

SEQ ID NO: 352997 - DNA, 22 bp, Homo sapiens
gatggagactccatgagaagcc

SEQ ID NO: 352998 - DNA, 23 bp, Homo sapiens
gatggagacttcaggttgttctg

SEQ ID NO: 352999 - DNA, 14 bp, Homo sapiens
gatggagaggagaa

SEQ ID NO: 353000 - DNA, 12 bp, Homo sapiens
gatggagcccat

SEQ ID NO: 353001 - DNA, 14 bp, Homo sapiens
gatggagcccccag

SEQ ID NO: 353002 - DNA, 16 bp, Homo sapiens
gatggaggtatttgaa

SEQ ID NO: 353003 - DNA, 16 bp, Homo sapiens
gatggagtgttttagt

SEQ ID NO: 353004 - DNA, 22 bp, Homo sapiens
gatggatctgctccatgcagat

SEQ ID NO: 353005 - DNA, 16 bp, Homo sapiens
gatggatgtagataca

SEQ ID NO: 353006 - DNA, 17 bp, Homo sapiens
gatggatgtagatacag

SEQ ID NO: 353007 - DNA, 16 bp, Homo sapiens
gatggattctcagata

SEQ ID NO: 353008 - DNA, 13 bp, Homo sapiens
gatttatgcattt

SEQ ID NO: 353009 - DNA, 17 bp, Homo sapiens
gatttatgttgtataga

SEQ ID NO: 353010 - DNA, 20 bp, Homo sapiens
gatttatttggagtggaggc

SEQ ID NO: 353011 - DNA, 23 bp, Homo sapiens
gatttcaaggtccgagctctgtc

SEQ ID NO: 353012 - DNA, 14 bp, Homo sapiens
gatttcaatgattg

SEQ ID NO: 353013 - DNA, 20 bp, Homo sapiens
gatttcaatgattgtttaat

SEQ ID NO: 353014 - DNA, 18 bp, Homo sapiens
gatttcagcacatgcact

SEQ ID NO: 353015 - DNA, 20 bp, Homo sapiens
gatttcagcacatgcactac

SEQ ID NO: 353016 - DNA, 18 bp, Homo sapiens
gatttccaagaatcggca

SEQ ID NO: 353017 - DNA, 22 bp, Homo sapiens
gatttccagtctccaccaggaa

SEQ ID NO: 353018 - DNA, 15 bp, Homo sapiens
gatttccatttgcaa

SEQ ID NO: 353019 - DNA, 15 bp, Homo sapiens
gatttccctaaaaat

SEQ ID NO: 353020 - DNA, 20 bp, Homo sapiens
gatttcccttttttcttccc

SEQ ID NO: 353021 - DNA, 12 bp, Homo sapiens
gatttcctaagc

SEQ ID NO: 353022 - DNA, 16 bp, Homo sapiens
gatttctaatcaaaag

SEQ ID NO: 353023 - DNA, 12 bp, Homo sapiens
gatttctacaac

SEQ ID NO: 353024 - DNA, 17 bp, Homo sapiens
gatttctagaaaagctt

SEQ ID NO: 353025 - DNA, 19 bp, Homo sapiens
gatttctagaaaagcttcc

SEQ ID NO: 353026 - DNA, 21 bp, Homo sapiens
gatttctagaaaagcttccta

SEQ ID NO: 353027 - DNA, 17 bp, Homo sapiens
gatttctagcaggcagg

SEQ ID NO: 353028 - DNA, 23 bp, Homo sapiens
gatttctcattgatcacagatgt

SEQ ID NO: 353029 - DNA, 19 bp, Homo sapiens
gatttcttcgctgctctag

SEQ ID NO: 353030 - DNA, 15 bp, Homo sapiens
gatttgaaacttggt

SEQ ID NO: 353031 - DNA, 19 bp, Homo sapiens
gatttgagtttcctttaaa

SEQ ID NO: 353032 - DNA, 15 bp, Homo sapiens
gatttgcatggattt

SEQ ID NO: 353033 - DNA, 18 bp, Homo sapiens
gatttgcatggattttgg

SEQ ID NO: 353034 - DNA, 20 bp, Homo sapiens
gatttgccagcacaggggcc

SEQ ID NO: 353035 - DNA, 14 bp, Homo sapiens
gatttggttgttta

SEQ ID NO: 353036 - DNA, 21 bp, Homo sapiens
gatttgtagtttgtcccattt

SEQ ID NO: 353037 - DNA, 16 bp, Homo sapiens
gatttgtatttatatt

SEQ ID NO: 353038 - DNA, 21 bp, Homo sapiens
gattttaaaatgacttttatt

SEQ ID NO: 353039 - DNA, 21 bp, Homo sapiens
gattttaaatgcaaattaaag

SEQ ID NO: 353040 - DNA, 20 bp, Homo sapiens
gattttaacaaaagcaagac

SEQ ID NO: 353041 - DNA, 13 bp, Homo sapiens
gattttaattttg

SEQ ID NO: 353042 - DNA, 15 bp, Homo sapiens
gattttaattttgaa

SEQ ID NO: 353043 - DNA, 15 bp, Homo sapiens
gattttattttcaag

SEQ ID NO: 353044 - DNA, 22 bp, Homo sapiens
gattttattttcaagcaaatat

SEQ ID NO: 353045 - DNA, 17 bp, Homo sapiens
gattttctattgttact

SEQ ID NO: 353046 - DNA, 16 bp, Homo sapiens
gattttctttctatgt

SEQ ID NO: 353047 - DNA, 16 bp, Homo sapiens
gattttgcttttccct

SEQ ID NO: 353048 - DNA, 18 bp, Homo sapiens
gattttggataaatcatt

SEQ ID NO: 353049 - DNA, 17 bp, Homo sapiens
gattttggctcactgca

SEQ ID NO: 353050 - DNA, 21 bp, Homo sapiens
gattttggtattacactgtat

SEQ ID NO: 353051 - DNA, 16 bp, Homo sapiens
gattttgtattgccat

SEQ ID NO: 353052 - DNA, 20 bp, Homo sapiens
gattttgtgttttttcgttc

SEQ ID NO: 353053 - DNA, 14 bp, Homo sapiens
gatttttgttaagc

SEQ ID NO: 353054 - DNA, 18 bp, Homo sapiens
gcaaaaaataaaataagt

SEQ ID NO: 353055 - DNA, 17 bp, Homo sapiens
gcaaaacatgctacctg

SEQ ID NO: 353056 - DNA, 20 bp, Homo sapiens
gcaaaacctgcagttcctga

SEQ ID NO: 353057 - DNA, 13 bp, Homo sapiens
gcaaaaggcagct

SEQ ID NO: 353058 - DNA, 14 bp, Homo sapiens
gcaaaaggcagctc

SEQ ID NO: 353059 - DNA, 23 bp, Homo sapiens
gcaaaaggcagctcacccctggg

SEQ ID NO: 353060 - DNA, 21 bp, Homo sapiens
gcaaaatatatgtttggctga

SEQ ID NO: 353061 - DNA, 18 bp, Homo sapiens
gcaaaatatgccccttct

SEQ ID NO: 353062 - DNA, 18 bp, Homo sapiens
gcaaaattatagaagttt

SEQ ID NO: 353063 - DNA, 21 bp, Homo sapiens
gcaaacaatcccaatctttct

SEQ ID NO: 353064 - DNA, 19 bp, Homo sapiens
gcaaacagccctaaataaa

SEQ ID NO: 353065 - DNA, 21 bp, Homo sapiens
gcaaacatcaaataaatttct

SEQ ID NO: 353066 - DNA, 23 bp, Homo sapiens
gcaaacatcaaataaatttctgg

SEQ ID NO: 353067 - DNA, 21 bp, Homo sapiens
gcaaacatggggttggctggg

SEQ ID NO: 353068 - DNA, 14 bp, Homo sapiens
gcaaaccaggagca

SEQ ID NO: 353069 - DNA, 14 bp, Homo sapiens
gcaaacctgcccca

SEQ ID NO: 353070 - DNA, 17 bp, Homo sapiens
gcaaacctgccccatcc

SEQ ID NO: 353071 - DNA, 18 bp, Homo sapiens
gcaaacctgccccatccc

SEQ ID NO: 353072 - DNA, 18 bp, Homo sapiens
gcaaactgaagcccacag

SEQ ID NO: 353073 - DNA, 23 bp, Homo sapiens
gcaaacttggaatttgtaacctc

SEQ ID NO: 353074 - DNA, 15 bp, Homo sapiens
gcaaagaaaattctc

SEQ ID NO: 353075 - DNA, 15 bp, Homo sapiens
gcaaagaactgcccc

SEQ ID NO: 353076 - DNA, 14 bp, Homo sapiens
gcaaagaatcaaca

SEQ ID NO: 353077 - DNA, 18 bp, Homo sapiens
gcaaagaggtgctgcttt

SEQ ID NO: 353078 - DNA, 19 bp, Homo sapiens
gcaaagccacaaggctggc

SEQ ID NO: 353079 - DNA, 21 bp, Homo sapiens
gcaaagccacaaggctggcca

SEQ ID NO: 353080 - DNA, 16 bp, Homo sapiens
gcaaagcctttaaatt

SEQ ID NO: 353081 - DNA, 12 bp, Homo sapiens
gcaaaggagaca

SEQ ID NO: 353082 - DNA, 15 bp, Homo sapiens
gcaaaggagggcctc

SEQ ID NO: 353083 - DNA, 17 bp, Homo sapiens
gcaaaggagggcctcag

SEQ ID NO: 353084 - DNA, 20 bp, Homo sapiens
gcaaaggagggcctcagaga

SEQ ID NO: 353085 - DNA, 21 bp, Homo sapiens
gcaaaggagggcctcagagac

SEQ ID NO: 353086 - DNA, 17 bp, Homo sapiens
gcaaagtaccaactgag

SEQ ID NO: 353087 - DNA, 20 bp, Homo sapiens
gcaaagtaccaactgagcca

SEQ ID NO: 353088 - DNA, 20 bp, Homo sapiens
gcaaagtgaagacactggct

SEQ ID NO: 353089 - DNA, 23 bp, Homo sapiens
gcaaagtgctgtacccttccacc

SEQ ID NO: 353090 - DNA, 14 bp, Homo sapiens
gcaaagttttcaga

SEQ ID NO: 353091 - DNA, 22 bp, Homo sapiens
gcaaagttttccatttttgtca

SEQ ID NO: 353092 - DNA, 17 bp, Homo sapiens
gcaaatagaaaacagga

SEQ ID NO: 353093 - DNA, 15 bp, Homo sapiens
gcaaatatgtttgca

SEQ ID NO: 353094 - DNA, 19 bp, Homo sapiens
gcaaatatttatgacctca

SEQ ID NO: 353095 - DNA, 13 bp, Homo sapiens
gcaaatcagaaac

SEQ ID NO: 353096 - DNA, 15 bp, Homo sapiens
gcaaatcagacacaa

SEQ ID NO: 353097 - DNA, 23 bp, Homo sapiens
gcaaatcagacacaattagagaa

SEQ ID NO: 353098 - DNA, 18 bp, Homo sapiens
gcaaatccataccccctg

SEQ ID NO: 353099 - DNA, 21 bp, Homo sapiens
gcaaatccataccccctgccc

SEQ ID NO: 353100 - DNA, 18 bp, Homo sapiens
gcaaatctcctttgtcca

SEQ ID NO: 353101 - DNA, 19 bp, Homo sapiens
gcaatgacaggtaaattaa

SEQ ID NO: 353102 - DNA, 21 bp, Homo sapiens
gcaatgcctagacttcccaac

SEQ ID NO: 353103 - DNA, 11 bp, Homo sapiens
gcaatgggact

SEQ ID NO: 353104 - DNA, 14 bp, Homo sapiens
gcaatgggactgga

SEQ ID NO: 353105 - DNA, 15 bp, Homo sapiens
gcaatgggactggag

SEQ ID NO: 353106 - DNA, 20 bp, Homo sapiens
gcaatgttccgttcatctga

SEQ ID NO: 353107 - DNA, 17 bp, Homo sapiens
gcaattatttaaagaaa

SEQ ID NO: 353108 - DNA, 18 bp, Homo sapiens
gcaattatttaaagaaag

SEQ ID NO: 353109 - DNA, 16 bp, Homo sapiens
gcaattgcacaaatac

SEQ ID NO: 353110 - DNA, 21 bp, Homo sapiens
gcaatttgttattcttttatt

SEQ ID NO: 353111 - DNA, 13 bp, Homo sapiens
gcacaaaccctgg

SEQ ID NO: 353112 - DNA, 22 bp, Homo sapiens
gcacaaagataacgcaggagag

SEQ ID NO: 353113 - DNA, 14 bp, Homo sapiens
gcacaactctccaa

SEQ ID NO: 353114 - DNA, 14 bp, Homo sapiens
gcacaagcattcct

SEQ ID NO: 353115 - DNA, 13 bp, Homo sapiens
gcacaagccaggg

SEQ ID NO: 353116 - DNA, 17 bp, Homo sapiens
gcacaagccagggtgtg

SEQ ID NO: 353117 - DNA, 14 bp, Homo sapiens
gcacaagcgtgttt

SEQ ID NO: 353118 - DNA, 18 bp, Homo sapiens
gcacaagctcagaataga

SEQ ID NO: 353119 - DNA, 15 bp, Homo sapiens
gcacaaggagtgccc

SEQ ID NO: 353120 - DNA, 17 bp, Homo sapiens
gcacaatctcacacagc

SEQ ID NO: 353121 - DNA, 18 bp, Homo sapiens
gcacaatctcacacagct

SEQ ID NO: 353122 - DNA, 14 bp, Homo sapiens
gcacaattctgtcc

SEQ ID NO: 353123 - DNA, 15 bp, Homo sapiens
gcacaattctgtccc

SEQ ID NO: 353124 - DNA, 18 bp, Homo sapiens
gcacaattctgtccctgt

SEQ ID NO: 353125 - DNA, 17 bp, Homo sapiens
gcaccggcgctgcaggt

SEQ ID NO: 353126 - DNA, 21 bp, Homo sapiens
gcaccgtggtcagagggactg

SEQ ID NO: 353127 - DNA, 17 bp, Homo sapiens
gcaccgtggtgtgaggc

SEQ ID NO: 353128 - DNA, 19 bp, Homo sapiens
gcacctaaaccaccagtgc

SEQ ID NO: 353129 - DNA, 16 bp, Homo sapiens
gcacctaaagcagcca

SEQ ID NO: 353130 - DNA, 17 bp, Homo sapiens
gcacctaaagcagccag

SEQ ID NO: 353131 - DNA, 21 bp, Homo sapiens
gcacctactatgtgctgggtg

SEQ ID NO: 353132 - DNA, 22 bp, Homo sapiens
gcacctactatgtgctgggtgc

SEQ ID NO: 353133 - DNA, 13 bp, Homo sapiens
gcacctataaata

SEQ ID NO: 353134 - DNA, 21 bp, Homo sapiens
gcacctcagaaagtcaccagg

SEQ ID NO: 353135 - DNA, 19 bp, Homo sapiens
gcacctcatggactccagg

SEQ ID NO: 353136 - DNA, 14 bp, Homo sapiens
gcacctccagctgt

SEQ ID NO: 353137 - DNA, 23 bp, Homo sapiens
gcacctcccagtttgctgggttt

SEQ ID NO: 353138 - DNA, 22 bp, Homo sapiens
gcacctcctaccctcccaccag

SEQ ID NO: 353139 - DNA, 19 bp, Homo sapiens
gcacctcctctctgctggg

SEQ ID NO: 353140 - DNA, 20 bp, Homo sapiens
gcacctcctgagaaggcgag

SEQ ID NO: 353141 - DNA, 19 bp, Homo sapiens
gcacctgaggcccagcaga

SEQ ID NO: 353142 - DNA, 14 bp, Homo sapiens
gcagagaaggcctc

SEQ ID NO: 353143 - DNA, 12 bp, Homo sapiens
gcagagacaata

SEQ ID NO: 353144 - DNA, 19 bp, Homo sapiens
gcagagacaataaaacatt

SEQ ID NO: 353145 - DNA, 21 bp, Homo sapiens
gcagagacaataaaacattcc

SEQ ID NO: 353146 - DNA, 15 bp, Homo sapiens
gcagagacggcagcc

SEQ ID NO: 353147 - DNA, 16 bp, Homo sapiens
gcagagacggcagccc

SEQ ID NO: 353148 - DNA, 18 bp, Homo sapiens
gcagagacggcagcccca

SEQ ID NO: 353149 - DNA, 22 bp, Homo sapiens
gcagagacggcagccccatcct

SEQ ID NO: 353150 - DNA, 19 bp, Homo sapiens
gcagagcagcacaaagaaa

SEQ ID NO: 353151 - DNA, 14 bp, Homo sapiens
gcagagccatgggc

SEQ ID NO: 353152 - DNA, 22 bp, Homo sapiens
gcagagccatgggcctgggcct

SEQ ID NO: 353153 - DNA, 14 bp, Homo sapiens
gcagagccccggag

SEQ ID NO: 353154 - DNA, 20 bp, Homo sapiens
gcagagccccggagcaccac

SEQ ID NO: 353155 - DNA, 17 bp, Homo sapiens
gcagagccgttcctggg

SEQ ID NO: 353156 - DNA, 13 bp, Homo sapiens
gcagagctcagag

SEQ ID NO: 353157 - DNA, 18 bp, Homo sapiens
gcagagctcagaggagtc

SEQ ID NO: 353158 - DNA, 19 bp, Homo sapiens
gcagagctcagcacagcct

SEQ ID NO: 353159 - DNA, 16 bp, Homo sapiens
gcagaggaccacagtg

SEQ ID NO: 353160 - DNA, 17 bp, Homo sapiens
gcagaggagccacctgg

SEQ ID NO: 353161 - DNA, 15 bp, Homo sapiens
gcagaggcagcagga

SEQ ID NO: 353162 - DNA, 13 bp, Homo sapiens
gcagaggggcagc

SEQ ID NO: 353163 - DNA, 17 bp, Homo sapiens
gcagaggggcagccgct

SEQ ID NO: 353164 - DNA, 18 bp, Homo sapiens
gcagaggggcagccgcta

SEQ ID NO: 353165 - DNA, 22 bp, Homo sapiens
gcagaggggcagccgctaggag

SEQ ID NO: 353166 - DNA, 18 bp, Homo sapiens
gcagagggtcactttaca

SEQ ID NO: 353167 - DNA, 18 bp, Homo sapiens
gcagaggtcccctgaggt

SEQ ID NO: 353168 - DNA, 14 bp, Homo sapiens
gcagagtgccccac

SEQ ID NO: 353169 - DNA, 16 bp, Homo sapiens
gcagataatcagcctc

SEQ ID NO: 353170 - DNA, 17 bp, Homo sapiens
gcagataatcagcctct

SEQ ID NO: 353171 - DNA, 18 bp, Homo sapiens
gcagataatcagcctctt

SEQ ID NO: 353172 - DNA, 19 bp, Homo sapiens
gcagataatcagcctctta

SEQ ID NO: 353173 - DNA, 18 bp, Homo sapiens
gcagatctagccaggcct

SEQ ID NO: 353174 - DNA, 16 bp, Homo sapiens
gcagatgacccctccc

SEQ ID NO: 353175 - DNA, 16 bp, Homo sapiens
gcagatgataaaagga

SEQ ID NO: 353176 - DNA, 17 bp, Homo sapiens
gcagatgataaaaggaa

SEQ ID NO: 353177 - DNA, 21 bp, Homo sapiens
gcagatgataaaaggaatctg

SEQ ID NO: 353178 - DNA, 13 bp, Homo sapiens
gcagatgccagag

SEQ ID NO: 353179 - DNA, 12 bp, Homo sapiens
gcagatgggctg

SEQ ID NO: 353180 - DNA, 16 bp, Homo sapiens
gcagattcctgggcct

SEQ ID NO: 353181 - DNA, 22 bp, Homo sapiens
gcagattcctgggcctgtcccc

SEQ ID NO: 353182 - DNA, 17 bp, Homo sapiens
gcagattgaaaaggaca

SEQ ID NO: 353183 - DNA, 15 bp, Homo sapiens
gcagatttctcacct

SEQ ID NO: 353184 - DNA, 16 bp, Homo sapiens
gcagattttacaaaag

SEQ ID NO: 353185 - DNA, 20 bp, Homo sapiens
gcagattttacaaaagatgt

SEQ ID NO: 353186 - DNA, 13 bp, Homo sapiens
gcagcaaaggaag

SEQ ID NO: 353187 - DNA, 19 bp, Homo sapiens
gcagcaacacaatgttatt

SEQ ID NO: 353188 - DNA, 19 bp, Homo sapiens
gcagcaacaggaccaggag

SEQ ID NO: 353189 - DNA, 17 bp, Homo sapiens
gcagcacaattctgtcc

SEQ ID NO: 353190 - DNA, 13 bp, Homo sapiens
gcagcaccagcct

SEQ ID NO: 353191 - DNA, 18 bp, Homo sapiens
gcagcaccagcctgagcc

SEQ ID NO: 353192 - DNA, 19 bp, Homo sapiens
gcagcaccagcctgagcca

SEQ ID NO: 353193 - DNA, 14 bp, Homo sapiens
gcagcacctggagc

SEQ ID NO: 353194 - DNA, 18 bp, Homo sapiens
gcagcacctggagcccac

SEQ ID NO: 353195 - DNA, 19 bp, Homo sapiens
gcagcacgtcgccatccgt

SEQ ID NO: 353196 - DNA, 19 bp, Homo sapiens
gcagcagcccagcttcctg

SEQ ID NO: 353197 - DNA, 22 bp, Homo sapiens
gcagcagctgggacccctccca

SEQ ID NO: 353198 - DNA, 12 bp, Homo sapiens
gcagcagcttgc

SEQ ID NO: 353199 - DNA, 13 bp, Homo sapiens
gcagcagcttgct

SEQ ID NO: 353200 - DNA, 20 bp, Homo sapiens
gcagcaggcctgttgctttt

SEQ ID NO: 353201 - DNA, 17 bp, Homo sapiens
gcagcagtaccatccca

SEQ ID NO: 353202 - DNA, 22 bp, Homo sapiens
gcagcatctactactctgtctt

SEQ ID NO: 353203 - DNA, 17 bp, Homo sapiens
gcagcatgacctgtgac

SEQ ID NO: 353204 - DNA, 10 bp, Homo sapiens
gcagcatgtg

SEQ ID NO: 353205 - DNA, 17 bp, Homo sapiens
gcagccagccagtcttg

SEQ ID NO: 353206 - DNA, 23 bp, Homo sapiens
gcagccagccgtgagtgcagacc

SEQ ID NO: 353207 - DNA, 12 bp, Homo sapiens
gcagccaggaca

SEQ ID NO: 353208 - DNA, 19 bp, Homo sapiens
gcagccaggacaccgggca

SEQ ID NO: 353209 - DNA, 12 bp, Homo sapiens
gcagccaggctg

SEQ ID NO: 353210 - DNA, 17 bp, Homo sapiens
gcagccagggagcccgg

SEQ ID NO: 353211 - DNA, 13 bp, Homo sapiens
gcagccatgcctc

SEQ ID NO: 353212 - DNA, 14 bp, Homo sapiens
gcagccatgcctca

SEQ ID NO: 353213 - DNA, 17 bp, Homo sapiens
gcagccatgcctcatgc

SEQ ID NO: 353214 - DNA, 15 bp, Homo sapiens
gcagcccacagagga

SEQ ID NO: 353215 - DNA, 20 bp, Homo sapiens
gcagcccacagaggacagtg

SEQ ID NO: 353216 - DNA, 23 bp, Homo sapiens
gcagcccagaacgggcctccccg

SEQ ID NO: 353217 - DNA, 13 bp, Homo sapiens
gcagcccagagag

SEQ ID NO: 353218 - DNA, 20 bp, Homo sapiens
gcagcccatgcccacctgcc

SEQ ID NO: 353219 - DNA, 19 bp, Homo sapiens
gcagccccacttcaccccc

SEQ ID NO: 353220 - DNA, 22 bp, Homo sapiens
gcagccccacttcacccccaac

SEQ ID NO: 353221 - DNA, 23 bp, Homo sapiens
gcagccccacttcacccccaact

SEQ ID NO: 353222 - DNA, 13 bp, Homo sapiens
gcagccccaggac

SEQ ID NO: 353223 - DNA, 15 bp, Homo sapiens
gcagccccaggacca

SEQ ID NO: 353224 - DNA, 18 bp, Homo sapiens
gcagccccatccttcccg

SEQ ID NO: 353225 - DNA, 22 bp, Homo sapiens
gcagccccccagtgtccccagg

SEQ ID NO: 353226 - DNA, 12 bp, Homo sapiens
gcagccccctcc

SEQ ID NO: 353227 - DNA, 13 bp, Homo sapiens
gcagccccctcca

SEQ ID NO: 353228 - DNA, 14 bp, Homo sapiens
gcagccccctccac

SEQ ID NO: 353229 - DNA, 11 bp, Homo sapiens
gcagcccctgc

SEQ ID NO: 353230 - DNA, 23 bp, Homo sapiens
gcagcccgcctgccgtgcatggc

SEQ ID NO: 353231 - DNA, 23 bp, Homo sapiens
gcagcccgggagatccgccctgg

SEQ ID NO: 353232 - DNA, 21 bp, Homo sapiens
gcagcccgtgaagcagtgcct

SEQ ID NO: 353233 - DNA, 20 bp, Homo sapiens
gcagccctagtgggagccca

SEQ ID NO: 353234 - DNA, 21 bp, Homo sapiens
gcagccctagtgggagcccag

SEQ ID NO: 353235 - DNA, 18 bp, Homo sapiens
gcagccgccttccttgac

SEQ ID NO: 353236 - DNA, 20 bp, Homo sapiens
gcagccgccttccttgacct

SEQ ID NO: 353237 - DNA, 15 bp, Homo sapiens
gcagccgcgctctgc

SEQ ID NO: 353238 - DNA, 20 bp, Homo sapiens
gcagccgcgctctgcccctc

SEQ ID NO: 353239 - DNA, 18 bp, Homo sapiens
gcagccggcacagggtct

SEQ ID NO: 353240 - DNA, 19 bp, Homo sapiens
gcagccggcacagggtctg

SEQ ID NO: 353241 - DNA, 15 bp, Homo sapiens
gcagcctccaagaaa

SEQ ID NO: 353242 - DNA, 12 bp, Homo sapiens
gcagcctccact

SEQ ID NO: 353243 - DNA, 17 bp, Homo sapiens
gcagcctccactgtgtc

SEQ ID NO: 353244 - DNA, 18 bp, Homo sapiens
gcagcctccagagccagc

SEQ ID NO: 353245 - DNA, 12 bp, Homo sapiens
gcagcctccagt

SEQ ID NO: 353246 - DNA, 22 bp, Homo sapiens
gcagcctccagttgtagcaggt

SEQ ID NO: 353247 - DNA, 17 bp, Homo sapiens
gcagcctccctgtcact

SEQ ID NO: 353248 - DNA, 14 bp, Homo sapiens
gcagcctcctcctg

SEQ ID NO: 353249 - DNA, 19 bp, Homo sapiens
gcagcctcgaactcctggg

SEQ ID NO: 353250 - DNA, 22 bp, Homo sapiens
gcagcctctgaagttggacagc

SEQ ID NO: 353251 - DNA, 18 bp, Homo sapiens
gcagcctctgccaggcct

SEQ ID NO: 353252 - DNA, 20 bp, Homo sapiens
gcagcctgagctccaccctc

SEQ ID NO: 353253 - DNA, 12 bp, Homo sapiens
gcagcctgatgg

SEQ ID NO: 353254 - DNA, 14 bp, Homo sapiens
gcagcctgatggcc

SEQ ID NO: 353255 - DNA, 18 bp, Homo sapiens
gcagcctgatggccaagg

SEQ ID NO: 353256 - DNA, 20 bp, Homo sapiens
gcagcctggctcccaggaca

SEQ ID NO: 353257 - DNA, 22 bp, Homo sapiens
gcagcctggttccctctttcct

SEQ ID NO: 353258 - DNA, 19 bp, Homo sapiens
gcagcctgtgagggagtgc

SEQ ID NO: 353259 - DNA, 13 bp, Homo sapiens
gcagcctgtggga

SEQ ID NO: 353260 - DNA, 19 bp, Homo sapiens
gcagccttcccctccctgt

SEQ ID NO: 353261 - DNA, 15 bp, Homo sapiens
gccagcccagctcca

SEQ ID NO: 353262 - DNA, 23 bp, Homo sapiens
gccagcccagctccactcagggc

SEQ ID NO: 353263 - DNA, 14 bp, Homo sapiens
gccagccccaccca

SEQ ID NO: 353264 - DNA, 17 bp, Homo sapiens
gccagccccacccagga

SEQ ID NO: 353265 - DNA, 12 bp, Homo sapiens
gccagcccctcc

SEQ ID NO: 353266 - DNA, 17 bp, Homo sapiens
gccagcccctcccacca

SEQ ID NO: 353267 - DNA, 21 bp, Homo sapiens
gccagcccctcggctctgccg

SEQ ID NO: 353268 - DNA, 14 bp, Homo sapiens
gccagccctaggct

SEQ ID NO: 353269 - DNA, 18 bp, Homo sapiens
gccagccctaggctaccc

SEQ ID NO: 353270 - DNA, 22 bp, Homo sapiens
gccagccctccctggctgtgag

SEQ ID NO: 353271 - DNA, 24 bp, Homo sapiens
gccagccctccctggctgtgagca

SEQ ID NO: 353272 - DNA, 14 bp, Homo sapiens
gccagccctggttc

SEQ ID NO: 353273 - DNA, 17 bp, Homo sapiens
gccagcccttcccaggc

SEQ ID NO: 353274 - DNA, 14 bp, Homo sapiens
gccagcctcagtgc

SEQ ID NO: 353275 - DNA, 16 bp, Homo sapiens
gccagcctcagtgcca

SEQ ID NO: 353276 - DNA, 15 bp, Homo sapiens
gccagcctgggactc

SEQ ID NO: 353277 - DNA, 21 bp, Homo sapiens
gccagcctgggactcccagtg

SEQ ID NO: 353278 - DNA, 20 bp, Homo sapiens
gccagcctggggcctggcag

SEQ ID NO: 353279 - DNA, 16 bp, Homo sapiens
gccagccttcctctgc

SEQ ID NO: 353280 - DNA, 17 bp, Homo sapiens
gccagccttcctctgca

SEQ ID NO: 353281 - DNA, 19 bp, Homo sapiens
gccagccttcctctgcagc

SEQ ID NO: 353282 - DNA, 16 bp, Homo sapiens
gccagccttggaggat

SEQ ID NO: 353283 - DNA, 17 bp, Homo sapiens
gccagcgaggcgaggct

SEQ ID NO: 353284 - DNA, 21 bp, Homo sapiens
gccagcgaggcgaggctgcct

SEQ ID NO: 353285 - DNA, 20 bp, Homo sapiens
gccagctcagcagttcactt

SEQ ID NO: 353286 - DNA, 17 bp, Homo sapiens
gccagctctgggggctc

SEQ ID NO: 353287 - DNA, 14 bp, Homo sapiens
gccagctgcagctg

SEQ ID NO: 353288 - DNA, 12 bp, Homo sapiens
gccagctgcccc

SEQ ID NO: 353289 - DNA, 12 bp, Homo sapiens
gccagctgcctt

SEQ ID NO: 353290 - DNA, 16 bp, Homo sapiens
gccagctgtactgagt

SEQ ID NO: 353291 - DNA, 21 bp, Homo sapiens
gccagcttggtggttatgtcc

SEQ ID NO: 353292 - DNA, 17 bp, Homo sapiens
gccagcttttcctccct

SEQ ID NO: 353293 - DNA, 23 bp, Homo sapiens
gccaggaagaatggtgtgtttcc

SEQ ID NO: 353294 - DNA, 16 bp, Homo sapiens
gccaggaatgtttcag

SEQ ID NO: 353295 - DNA, 23 bp, Homo sapiens
gccaggaatgtttcagctgcagt

SEQ ID NO: 353296 - DNA, 17 bp, Homo sapiens
gccaggaccgccaaaga

SEQ ID NO: 353297 - DNA, 14 bp, Homo sapiens
gccaggactctctt

SEQ ID NO: 353298 - DNA, 11 bp, Homo sapiens
gccaggagacc

SEQ ID NO: 353299 - DNA, 16 bp, Homo sapiens
gccaggagcaatggga

SEQ ID NO: 353300 - DNA, 19 bp, Homo sapiens
gccaggagcaatgggactg

SEQ ID NO: 353301 - DNA, 20 bp, Homo sapiens
gccaggagcaatgggactgg

SEQ ID NO: 353302 - DNA, 21 bp, Homo sapiens
gccaggagcaatgggactgga

SEQ ID NO: 353303 - DNA, 15 bp, Homo sapiens
gccaggagcagcctc

SEQ ID NO: 353304 - DNA, 19 bp, Homo sapiens
gccaggagcagcctccaag

SEQ ID NO: 353305 - DNA, 21 bp, Homo sapiens
gccaggagcctcctgaccctg

SEQ ID NO: 353306 - DNA, 22 bp, Homo sapiens
gccaggagctcttcaggcctcc

SEQ ID NO: 353307 - DNA, 16 bp, Homo sapiens
gccaggaggctggcag

SEQ ID NO: 353308 - DNA, 14 bp, Homo sapiens
gccaggagtctgtg

SEQ ID NO: 353309 - DNA, 19 bp, Homo sapiens
gccaggagtctgtgctctt

SEQ ID NO: 353310 - DNA, 14 bp, Homo sapiens
gccaggcacctggc

SEQ ID NO: 353311 - DNA, 16 bp, Homo sapiens
gccaggcacctggcct

SEQ ID NO: 353312 - DNA, 22 bp, Homo sapiens
gccaggcacctggcctgctggg

SEQ ID NO: 353313 - DNA, 14 bp, Homo sapiens
gccaggcagatctg

SEQ ID NO: 353314 - DNA, 15 bp, Homo sapiens
gccaggcagatctgt

SEQ ID NO: 353315 - DNA, 21 bp, Homo sapiens
gccaggcagggagtgtctgca

SEQ ID NO: 353316 - DNA, 19 bp, Homo sapiens
gccaggcatggcccagcct

SEQ ID NO: 353317 - DNA, 23 bp, Homo sapiens
gccaggcatggcccagcctggag

SEQ ID NO: 353318 - DNA, 17 bp, Homo sapiens
gccaggccatggccaag

SEQ ID NO: 353319 - DNA, 18 bp, Homo sapiens
gccaggcccatctcaggt

SEQ ID NO: 353320 - DNA, 20 bp, Homo sapiens
gccaggccctcctgctggct

SEQ ID NO: 353321 - DNA, 21 bp, Homo sapiens
gccaggccctcctgctggctg

SEQ ID NO: 353322 - DNA, 16 bp, Homo sapiens
gccaggcctgtatgag

SEQ ID NO: 353323 - DNA, 20 bp, Homo sapiens
gccaggcgttggtgccactt

SEQ ID NO: 353324 - DNA, 17 bp, Homo sapiens
gccaggctcaggccatg

SEQ ID NO: 353325 - DNA, 18 bp, Homo sapiens
gccaggctcaggccatgg

SEQ ID NO: 353326 - DNA, 13 bp, Homo sapiens
gccaggctctccc

SEQ ID NO: 353327 - DNA, 14 bp, Homo sapiens
gccaggctgcggtg

SEQ ID NO: 353328 - DNA, 22 bp, Homo sapiens
gccaggctgcggtgggcagcca

SEQ ID NO: 353329 - DNA, 21 bp, Homo sapiens
gccaggctgtaagcattctga

SEQ ID NO: 353330 - DNA, 18 bp, Homo sapiens
gccaggctgtcagcgcct

SEQ ID NO: 353331 - DNA, 15 bp, Homo sapiens
gccagggatggggcc

SEQ ID NO: 353332 - DNA, 22 bp, Homo sapiens
gccagggcccctcaccctgcct

SEQ ID NO: 353333 - DNA, 13 bp, Homo sapiens
gccagggctctgg

SEQ ID NO: 353334 - DNA, 14 bp, Homo sapiens
gccagggctgtcct

SEQ ID NO: 353335 - DNA, 15 bp, Homo sapiens
gccagggctgtcctt

SEQ ID NO: 353336 - DNA, 16 bp, Homo sapiens
gccagggctgtcctta

SEQ ID NO: 353337 - DNA, 21 bp, Homo sapiens
gccagggtagagcaaaggaga

SEQ ID NO: 353338 - DNA, 14 bp, Homo sapiens
gccagggttccaga

SEQ ID NO: 353339 - DNA, 17 bp, Homo sapiens
gccagggttccagacag

SEQ ID NO: 353340 - DNA, 22 bp, Homo sapiens
gccagggttccagacagggtgg

SEQ ID NO: 353341 - DNA, 23 bp, Homo sapiens
gccagggttccagacagggtggg

SEQ ID NO: 353342 - DNA, 13 bp, Homo sapiens
gccaggtgtcctg

SEQ ID NO: 353343 - DNA, 16 bp, Homo sapiens
gccaggttgcagctgc

SEQ ID NO: 353344 - DNA, 20 bp, Homo sapiens
gccagtaaggcagctctgtc

SEQ ID NO: 353345 - DNA, 23 bp, Homo sapiens
gccagtacagagaaattctgtgg

SEQ ID NO: 353346 - DNA, 17 bp, Homo sapiens
gccagtagagagtgccc

SEQ ID NO: 353347 - DNA, 19 bp, Homo sapiens
gccagtagagagtgccctt

SEQ ID NO: 353348 - DNA, 14 bp, Homo sapiens
gccagtagctgcca

SEQ ID NO: 353349 - DNA, 21 bp, Homo sapiens
gccagtagctgccaaaaagaa

SEQ ID NO: 353350 - DNA, 19 bp, Homo sapiens
gccagtcctgcctggccag

SEQ ID NO: 353351 - DNA, 20 bp, Homo sapiens
gccagtcctgcctggccagg

SEQ ID NO: 353352 - DNA, 14 bp, Homo sapiens
gccagtctgggctg

SEQ ID NO: 353353 - DNA, 17 bp, Homo sapiens
gccagtcttgcctaggc

SEQ ID NO: 353354 - DNA, 19 bp, Homo sapiens
gccagtcttgcctaggcca

SEQ ID NO: 353355 - DNA, 17 bp, Homo sapiens
gccagtgactccaggag

SEQ ID NO: 353356 - DNA, 15 bp, Homo sapiens
gccagtgactttttc

SEQ ID NO: 353357 - DNA, 18 bp, Homo sapiens
gccagtgactttttctga

SEQ ID NO: 353358 - DNA, 22 bp, Homo sapiens
gccagtggacagagggagaagg

SEQ ID NO: 353359 - DNA, 13 bp, Homo sapiens
gccagtggctggg

SEQ ID NO: 353360 - DNA, 22 bp, Homo sapiens
gccagtggggtcccccctgagt

SEQ ID NO: 353361 - DNA, 15 bp, Homo sapiens
gccatatcaccagtc

SEQ ID NO: 353362 - DNA, 12 bp, Homo sapiens
gccatcacgctt

SEQ ID NO: 353363 - DNA, 18 bp, Homo sapiens
gccatcacttctccccgc

SEQ ID NO: 353364 - DNA, 19 bp, Homo sapiens
gccatccggcccccagagc

SEQ ID NO: 353365 - DNA, 17 bp, Homo sapiens
gccatcgggtgccaaat

SEQ ID NO: 353366 - DNA, 13 bp, Homo sapiens
gccatctgtaaat

SEQ ID NO: 353367 - DNA, 17 bp, Homo sapiens
gccatctgtaaatatcc

SEQ ID NO: 353368 - DNA, 22 bp, Homo sapiens
gccatctgtaaatatcccagag

SEQ ID NO: 353369 - DNA, 12 bp, Homo sapiens
gccatctgtggg

SEQ ID NO: 353370 - DNA, 13 bp, Homo sapiens
gccatctgtgggc

SEQ ID NO: 353371 - DNA, 23 bp, Homo sapiens
gccatgacaacttctaattgcca

SEQ ID NO: 353372 - DNA, 16 bp, Homo sapiens
gccatgaggcctcagt

SEQ ID NO: 353373 - DNA, 22 bp, Homo sapiens
gccatgatggaaatatttattt

SEQ ID NO: 353374 - DNA, 22 bp, Homo sapiens
gccatgatgtggagtggggcag

SEQ ID NO: 353375 - DNA, 15 bp, Homo sapiens
gccatgattttggcc

SEQ ID NO: 353376 - DNA, 17 bp, Homo sapiens
gccatgattttggccac

SEQ ID NO: 353377 - DNA, 18 bp, Homo sapiens
gccatgattttggccact

SEQ ID NO: 353378 - DNA, 22 bp, Homo sapiens
gccatgattttggccactttgc

SEQ ID NO: 353379 - DNA, 22 bp, Homo sapiens
gccatgcaactccatgcctatt

SEQ ID NO: 353380 - DNA, 17 bp, Homo sapiens
gccatgccactgccagg

SEQ ID NO: 353381 - DNA, 21 bp, Homo sapiens
gccatgccactgccaggcacc

SEQ ID NO: 353382 - DNA, 13 bp, Homo sapiens
gccatgcctcatg

SEQ ID NO: 353383 - DNA, 16 bp, Homo sapiens
gccatgcctcatgcca

SEQ ID NO: 353384 - DNA, 11 bp, Homo sapiens
gccatgctctt

SEQ ID NO: 353385 - DNA, 18 bp, Homo sapiens
gccatggactctacactg

SEQ ID NO: 353386 - DNA, 23 bp, Homo sapiens
gccatggccaaggggccagctgc

SEQ ID NO: 353387 - DNA, 13 bp, Homo sapiens
gccatggctcagg

SEQ ID NO: 353388 - DNA, 14 bp, Homo sapiens
gccatggctcaggc

SEQ ID NO: 353389 - DNA, 21 bp, Homo sapiens
gccatggctcaggcaagcccc

SEQ ID NO: 353390 - DNA, 21 bp, Homo sapiens
gccatggctttcatcctgtgt

SEQ ID NO: 353391 - DNA, 18 bp, Homo sapiens
gccatgggcctgggcctg

SEQ ID NO: 353392 - DNA, 20 bp, Homo sapiens
gccatgggggcccctcggca

SEQ ID NO: 353393 - DNA, 17 bp, Homo sapiens
gccattcatctgggctg

SEQ ID NO: 353394 - DNA, 19 bp, Homo sapiens
gccattcatctgggctggc

SEQ ID NO: 353395 - DNA, 21 bp, Homo sapiens
gccattcatctgggctggcag

SEQ ID NO: 353396 - DNA, 15 bp, Homo sapiens
gccattcccttggaa

SEQ ID NO: 353397 - DNA, 19 bp, Homo sapiens
gccattctcctgcctcagc

SEQ ID NO: 353398 - DNA, 23 bp, Homo sapiens
gccattctcctgcctcagccttc

SEQ ID NO: 353399 - DNA, 14 bp, Homo sapiens
gccattgaccaccc

SEQ ID NO: 353400 - DNA, 17 bp, Homo sapiens
gccattgccaccaggag

SEQ ID NO: 353401 - DNA, 19 bp, Homo sapiens
gccattgtactccagcctg

SEQ ID NO: 353402 - DNA, 15 bp, Homo sapiens
gccattgtctttcct

SEQ ID NO: 353403 - DNA, 16 bp, Homo sapiens
gccattgtctttcctc

SEQ ID NO: 353404 - DNA, 17 bp, Homo sapiens
gccattgtctttcctcc

SEQ ID NO: 353405 - DNA, 14 bp, Homo sapiens
gccatttcttccca

SEQ ID NO: 353406 - DNA, 14 bp, Homo sapiens
gccatttgccccaa

SEQ ID NO: 353407 - DNA, 18 bp, Homo sapiens
gccatttgtcttttgtaa

SEQ ID NO: 353408 - DNA, 21 bp, Homo sapiens
gccatttgtcttttgtaaagt

SEQ ID NO: 353409 - DNA, 14 bp, Homo sapiens
gccattttgtaact

SEQ ID NO: 353410 - DNA, 23 bp, Homo sapiens
gccattttgtaactgcctaccag

SEQ ID NO: 353411 - DNA, 21 bp, Homo sapiens
gcccaaagagaaatcacaggg

SEQ ID NO: 353412 - DNA, 17 bp, Homo sapiens
gcccaaagctggagcca

SEQ ID NO: 353413 - DNA, 23 bp, Homo sapiens
gcccaaaggaagtagcaggccca

SEQ ID NO: 353414 - DNA, 14 bp, Homo sapiens
gcccaaagtgggga

SEQ ID NO: 353415 - DNA, 17 bp, Homo sapiens
gcccaaattatcaagct

SEQ ID NO: 353416 - DNA, 19 bp, Homo sapiens
gcccaaattatcaagctaa

SEQ ID NO: 353417 - DNA, 21 bp, Homo sapiens
gcccaaccaatgcacacagta

SEQ ID NO: 353418 - DNA, 13 bp, Homo sapiens
gcccaaccaggag

SEQ ID NO: 353419 - DNA, 14 bp, Homo sapiens
gcccaacctcagca

SEQ ID NO: 353420 - DNA, 20 bp, Homo sapiens
gcccaactcccagccaccac

SEQ ID NO: 353421 - DNA, 20 bp, Homo sapiens
gcccaagacagatgccccag

SEQ ID NO: 353422 - DNA, 13 bp, Homo sapiens
gcccaagagcaga

SEQ ID NO: 353423 - DNA, 19 bp, Homo sapiens
gcccaagagcagagtctgg

SEQ ID NO: 353424 - DNA, 20 bp, Homo sapiens
gcccaagagcagagtctggg

SEQ ID NO: 353425 - DNA, 18 bp, Homo sapiens
gcccaagcatgccccacc

SEQ ID NO: 353426 - DNA, 20 bp, Homo sapiens
gcccaagcatgccccaccca

SEQ ID NO: 353427 - DNA, 22 bp, Homo sapiens
gcccaagcttaatagccctccc

SEQ ID NO: 353428 - DNA, 23 bp, Homo sapiens
gcccaagcttaatagccctcccc

SEQ ID NO: 353429 - DNA, 21 bp, Homo sapiens
gcccaaggcagtgttcctcac

SEQ ID NO: 353430 - DNA, 18 bp, Homo sapiens
gcccaagggcctcccacc

SEQ ID NO: 353431 - DNA, 20 bp, Homo sapiens
gcccaagggcctcccaccag

SEQ ID NO: 353432 - DNA, 11 bp, Homo sapiens
gcccaataaag

SEQ ID NO: 353433 - DNA, 23 bp, Homo sapiens
gcccaataaaggtcccttagccc

SEQ ID NO: 353434 - DNA, 18 bp, Homo sapiens
gcccaatattataatttt

SEQ ID NO: 353435 - DNA, 21 bp, Homo sapiens
gcccaatgctttgggaggcca

SEQ ID NO: 353436 - DNA, 21 bp, Homo sapiens
gcccacacccgacaccagccc

SEQ ID NO: 353437 - DNA, 13 bp, Homo sapiens
gcccacagaggac

SEQ ID NO: 353438 - DNA, 15 bp, Homo sapiens
gcccacagaggacag

SEQ ID NO: 353439 - DNA, 22 bp, Homo sapiens
gcccacagcccgcatgcagcag

SEQ ID NO: 353440 - DNA, 20 bp, Homo sapiens
gcccacagccgccggaagtg

SEQ ID NO: 353441 - DNA, 17 bp, Homo sapiens
gcccacaggaggcaagc

SEQ ID NO: 353442 - DNA, 22 bp, Homo sapiens
gcccacaggtgtccccagccca

SEQ ID NO: 353443 - DNA, 16 bp, Homo sapiens
gcccacagtgctcagt

SEQ ID NO: 353444 - DNA, 18 bp, Homo sapiens
gcccacagtgctcagttg

SEQ ID NO: 353445 - DNA, 23 bp, Homo sapiens
gcccacagtgctcagttgtactt

SEQ ID NO: 353446 - DNA, 14 bp, Homo sapiens
gcccacatcccagg

SEQ ID NO: 353447 - DNA, 15 bp, Homo sapiens
gcccacatcccaggc

SEQ ID NO: 353448 - DNA, 19 bp, Homo sapiens
gcccacattagggggtttg

SEQ ID NO: 353449 - DNA, 17 bp, Homo sapiens
gcccacattgcccacac

SEQ ID NO: 353450 - DNA, 23 bp, Homo sapiens
gcccaccaccaagccctgcaaat

SEQ ID NO: 353451 - DNA, 13 bp, Homo sapiens
gcccacccacacc

SEQ ID NO: 353452 - DNA, 17 bp, Homo sapiens
gcccacccacaccccgt

SEQ ID NO: 353453 - DNA, 14 bp, Homo sapiens
gcccacccagggcc

SEQ ID NO: 353454 - DNA, 16 bp, Homo sapiens
gcccacccagggcccg

SEQ ID NO: 353455 - DNA, 19 bp, Homo sapiens
gcccaccccgctgcctggc

SEQ ID NO: 353456 - DNA, 15 bp, Homo sapiens
gcccacccctgctgc

SEQ ID NO: 353457 - DNA, 17 bp, Homo sapiens
gcccacccctgctgccg

SEQ ID NO: 353458 - DNA, 21 bp, Homo sapiens
gcccacccctgctgccgccac

SEQ ID NO: 353459 - DNA, 12 bp, Homo sapiens
gcccacccgccc

SEQ ID NO: 353460 - DNA, 14 bp, Homo sapiens
gcccacccgcccca

SEQ ID NO: 353461 - DNA, 15 bp, Homo sapiens
gcccacccgccccag

SEQ ID NO: 353462 - DNA, 16 bp, Homo sapiens
gcccacccgccccaga

SEQ ID NO: 353463 - DNA, 19 bp, Homo sapiens
gcccacccgccccagagac

SEQ ID NO: 353464 - DNA, 23 bp, Homo sapiens
gcccacccgtgttctcctccaaa

SEQ ID NO: 353465 - DNA, 13 bp, Homo sapiens
gcccaccctgggc

SEQ ID NO: 353466 - DNA, 14 bp, Homo sapiens
gcccaccctgggcc

SEQ ID NO: 353467 - DNA, 18 bp, Homo sapiens
gcccaccctgggcctccc

SEQ ID NO: 353468 - DNA, 22 bp, Homo sapiens
gcccacctaccttcaaagctga

SEQ ID NO: 353469 - DNA, 13 bp, Homo sapiens
gcccacctcctcc

SEQ ID NO: 353470 - DNA, 15 bp, Homo sapiens
gcccacctcctccag

SEQ ID NO: 353471 - DNA, 17 bp, Homo sapiens
gcccacctcctccagcg

SEQ ID NO: 353472 - DNA, 17 bp, Homo sapiens
gcccacctgaaagcctg

SEQ ID NO: 353473 - DNA, 18 bp, Homo sapiens
gcccacctgaaagcctgt

SEQ ID NO: 353474 - DNA, 19 bp, Homo sapiens
gcccacctgaaagcctgtc

SEQ ID NO: 353475 - DNA, 21 bp, Homo sapiens
gcccacctgaaagcctgtctc

SEQ ID NO: 353476 - DNA, 13 bp, Homo sapiens
gcccacctgccca

SEQ ID NO: 353477 - DNA, 20 bp, Homo sapiens
gcccacctgcccatcacagg

SEQ ID NO: 353478 - DNA, 14 bp, Homo sapiens
gcccacgcagagcc

SEQ ID NO: 353479 - DNA, 16 bp, Homo sapiens
gcccacgcagagcccc

SEQ ID NO: 353480 - DNA, 17 bp, Homo sapiens
gcccacgcagagccccg

SEQ ID NO: 353481 - DNA, 15 bp, Homo sapiens
gcccacgctcctgcc

SEQ ID NO: 353482 - DNA, 14 bp, Homo sapiens
gcccacggccaccc

SEQ ID NO: 353483 - DNA, 15 bp, Homo sapiens
gcccacggccaccca

SEQ ID NO: 353484 - DNA, 16 bp, Homo sapiens
gcccacggccacccac

SEQ ID NO: 353485 - DNA, 21 bp, Homo sapiens
gcccacggccacccacccttc

SEQ ID NO: 353486 - DNA, 19 bp, Homo sapiens
gcccacggctaagaggctg

SEQ ID NO: 353487 - DNA, 21 bp, Homo sapiens
gcccacggctaagaggctgct

SEQ ID NO: 353488 - DNA, 21 bp, Homo sapiens
gcccactaggatcccactggc

SEQ ID NO: 353489 - DNA, 19 bp, Homo sapiens
gcccactggccagctctgg

SEQ ID NO: 353490 - DNA, 19 bp, Homo sapiens
gcccactgtcctgggcgcc

SEQ ID NO: 353491 - DNA, 15 bp, Homo sapiens
gcctctgagccagga

SEQ ID NO: 353492 - DNA, 12 bp, Homo sapiens
gcctctgccagg

SEQ ID NO: 353493 - DNA, 15 bp, Homo sapiens
gcctctgccccgtct

SEQ ID NO: 353494 - DNA, 13 bp, Homo sapiens
gcctctgcccgca

SEQ ID NO: 353495 - DNA, 16 bp, Homo sapiens
gcctctgcccgcagag

SEQ ID NO: 353496 - DNA, 22 bp, Homo sapiens
gcctctgcccgcagagcccacg

SEQ ID NO: 353497 - DNA, 12 bp, Homo sapiens
gcctctgccctg

SEQ ID NO: 353498 - DNA, 13 bp, Homo sapiens
gcctctgccctgc

SEQ ID NO: 353499 - DNA, 16 bp, Homo sapiens
gcctctgccctgcctc

SEQ ID NO: 353500 - DNA, 17 bp, Homo sapiens
gcctctgccctgcctcc

SEQ ID NO: 353501 - DNA, 11 bp, Homo sapiens
gcctctgcctc

SEQ ID NO: 353502 - DNA, 16 bp, Homo sapiens
gcctctgcctccagga

SEQ ID NO: 353503 - DNA, 12 bp, Homo sapiens
gcctctgcctgt

SEQ ID NO: 353504 - DNA, 13 bp, Homo sapiens
gcctctgcctgtc

SEQ ID NO: 353505 - DNA, 15 bp, Homo sapiens
gcctctgccttagag

SEQ ID NO: 353506 - DNA, 20 bp, Homo sapiens
gcctctggaggcctctgggc

SEQ ID NO: 353507 - DNA, 17 bp, Homo sapiens
gcctctggccagacggc

SEQ ID NO: 353508 - DNA, 18 bp, Homo sapiens
gcctctggctagaggcca

SEQ ID NO: 353509 - DNA, 23 bp, Homo sapiens
gcctctggctagaggccagcccc

SEQ ID NO: 353510 - DNA, 13 bp, Homo sapiens
gcctctgggcctc

SEQ ID NO: 353511 - DNA, 19 bp, Homo sapiens
gcctctgggtgagtggctg

SEQ ID NO: 353512 - DNA, 11 bp, Homo sapiens
gcctctggtgt

SEQ ID NO: 353513 - DNA, 19 bp, Homo sapiens
gcctctggttccactcagc

SEQ ID NO: 353514 - DNA, 23 bp, Homo sapiens
gcctctggtttggggcgaggcag

SEQ ID NO: 353515 - DNA, 22 bp, Homo sapiens
gcctcttaaagctgcctgtagt

SEQ ID NO: 353516 - DNA, 15 bp, Homo sapiens
gcctcttacttgcca

SEQ ID NO: 353517 - DNA, 13 bp, Homo sapiens
gcctcttccaccc

SEQ ID NO: 353518 - DNA, 22 bp, Homo sapiens
gcctcttcctccctcattccac

SEQ ID NO: 353519 - DNA, 18 bp, Homo sapiens
gcctcttgagcagtggct

SEQ ID NO: 353520 - DNA, 20 bp, Homo sapiens
gcctcttgtgctcacgctcc

SEQ ID NO: 353521 - DNA, 18 bp, Homo sapiens
gcctgaaatgtttccagg

SEQ ID NO: 353522 - DNA, 19 bp, Homo sapiens
gcctgaaatgtttccaggc

SEQ ID NO: 353523 - DNA, 21 bp, Homo sapiens
gcctgacaaccactggtctgt

SEQ ID NO: 353524 - DNA, 21 bp, Homo sapiens
gcctgacacaggggacactga

SEQ ID NO: 353525 - DNA, 16 bp, Homo sapiens
gcctgacactgagccc

SEQ ID NO: 353526 - DNA, 16 bp, Homo sapiens
gcctgaccaaaagtga

SEQ ID NO: 353527 - DNA, 23 bp, Homo sapiens
gcctgacccggcccctaccagcc

SEQ ID NO: 353528 - DNA, 15 bp, Homo sapiens
gcctgacctggcaca

SEQ ID NO: 353529 - DNA, 14 bp, Homo sapiens
gcctgacttttaca

SEQ ID NO: 353530 - DNA, 13 bp, Homo sapiens
gcctgagagcaga

SEQ ID NO: 353531 - DNA, 21 bp, Homo sapiens
gcctgagagtatttaggcaga

SEQ ID NO: 353532 - DNA, 14 bp, Homo sapiens
gcctgagccacagt

SEQ ID NO: 353533 - DNA, 14 bp, Homo sapiens
gcctgagcccagga

SEQ ID NO: 353534 - DNA, 18 bp, Homo sapiens
gcctgagctccaccctcc

SEQ ID NO: 353535 - DNA, 21 bp, Homo sapiens
gcctgagctccaccctcccct

SEQ ID NO: 353536 - DNA, 22 bp, Homo sapiens
gcctgagctccaccctcccctc

SEQ ID NO: 353537 - DNA, 19 bp, Homo sapiens
gcctgagctggggccacaa

SEQ ID NO: 353538 - DNA, 14 bp, Homo sapiens
gcctgaggatgagc

SEQ ID NO: 353539 - DNA, 21 bp, Homo sapiens
gcctgaggatgagctggaagg

SEQ ID NO: 353540 - DNA, 13 bp, Homo sapiens
gcctgaggcagga

SEQ ID NO: 353541 - DNA, 14 bp, Homo sapiens
gcctgagggaagcc

SEQ ID NO: 353542 - DNA, 16 bp, Homo sapiens
gcctgagggaagccca

SEQ ID NO: 353543 - DNA, 18 bp, Homo sapiens
gcctgagggaagcccacc

SEQ ID NO: 353544 - DNA, 19 bp, Homo sapiens
gcctgagggaagcccaccc

SEQ ID NO: 353545 - DNA, 21 bp, Homo sapiens
gcctgagggaagcccacccgc

SEQ ID NO: 353546 - DNA, 22 bp, Homo sapiens
gcctgagggaagcccacccgcc

SEQ ID NO: 353547 - DNA, 17 bp, Homo sapiens
gcctgagggcccctctg

SEQ ID NO: 353548 - DNA, 22 bp, Homo sapiens
gcctgagggcccctctgcccag

SEQ ID NO: 353549 - DNA, 12 bp, Homo sapiens
gcctgagggtgg

SEQ ID NO: 353550 - DNA, 14 bp, Homo sapiens
gcctgagggtggag

SEQ ID NO: 353551 - DNA, 13 bp, Homo sapiens
gcctgaggtctgt

SEQ ID NO: 353552 - DNA, 22 bp, Homo sapiens
gcctgagtcagggcccagaggc

SEQ ID NO: 353553 - DNA, 20 bp, Homo sapiens
gcctgagtggtgaggggcca

SEQ ID NO: 353554 - DNA, 14 bp, Homo sapiens
gcctgatgctccct

SEQ ID NO: 353555 - DNA, 19 bp, Homo sapiens
gcctgatgctccctcccct

SEQ ID NO: 353556 - DNA, 15 bp, Homo sapiens
gcctgatgctgcccc

SEQ ID NO: 353557 - DNA, 15 bp, Homo sapiens
gcctgatggagagga

SEQ ID NO: 353558 - DNA, 17 bp, Homo sapiens
gcctgatggagaggaga

SEQ ID NO: 353559 - DNA, 13 bp, Homo sapiens
gcctgatggccaa

SEQ ID NO: 353560 - DNA, 15 bp, Homo sapiens
gcctgatggccaagg

SEQ ID NO: 353561 - DNA, 16 bp, Homo sapiens
gcctgatggccaaggg

SEQ ID NO: 353562 - DNA, 23 bp, Homo sapiens
gcctgattggggcctcacccaga

SEQ ID NO: 353563 - DNA, 15 bp, Homo sapiens
gcctgcaatttcata

SEQ ID NO: 353564 - DNA, 10 bp, Homo sapiens
gcctgcacac

SEQ ID NO: 353565 - DNA, 16 bp, Homo sapiens
gcctgcacacacctgc

SEQ ID NO: 353566 - DNA, 20 bp, Homo sapiens
gcctgcacacacctgcctgc

SEQ ID NO: 353567 - DNA, 13 bp, Homo sapiens
gcctgcaccagga

SEQ ID NO: 353568 - DNA, 14 bp, Homo sapiens
gcctgcaccaggag

SEQ ID NO: 353569 - DNA, 13 bp, Homo sapiens
gcctgcacctgcg

SEQ ID NO: 353570 - DNA, 14 bp, Homo sapiens
gcctgcagcccaga

SEQ ID NO: 353571 - DNA, 16 bp, Homo sapiens
gcctgcagcccagaac

SEQ ID NO: 353572 - DNA, 13 bp, Homo sapiens
gcctgcaggcccc

SEQ ID NO: 353573 - DNA, 14 bp, Homo sapiens
gcctgcaggcccca

SEQ ID NO: 353574 - DNA, 17 bp, Homo sapiens
gcctgcaggccccagcc

SEQ ID NO: 353575 - DNA, 19 bp, Homo sapiens
gcctgcaggccccagccaa

SEQ ID NO: 353576 - DNA, 20 bp, Homo sapiens
gcctgcagggtggtgctggg

SEQ ID NO: 353577 - DNA, 22 bp, Homo sapiens
gcctgcagggtggtgctgggac

SEQ ID NO: 353578 - DNA, 20 bp, Homo sapiens
gcctgcatcatgacaaagtt

SEQ ID NO: 353579 - DNA, 22 bp, Homo sapiens
gcctgcatcattctttctgcta

SEQ ID NO: 353580 - DNA, 21 bp, Homo sapiens
gcctgccaatgccacagccaa

SEQ ID NO: 353581 - DNA, 14 bp, Homo sapiens
gcctgccactctct

SEQ ID NO: 353582 - DNA, 18 bp, Homo sapiens
gcctgcccaatgctttgg

SEQ ID NO: 353583 - DNA, 14 bp, Homo sapiens
gcctgccccacacg

SEQ ID NO: 353584 - DNA, 14 bp, Homo sapiens
gcctgccccagctg

SEQ ID NO: 353585 - DNA, 16 bp, Homo sapiens
gcctgccccagctggg

SEQ ID NO: 353586 - DNA, 19 bp, Homo sapiens
gcctgccccagctgggctg

SEQ ID NO: 353587 - DNA, 16 bp, Homo sapiens
gcctgcccccctcatc

SEQ ID NO: 353588 - DNA, 21 bp, Homo sapiens
gcctgccccccttcccacccc

SEQ ID NO: 353589 - DNA, 13 bp, Homo sapiens
gcctgcccgcccg

SEQ ID NO: 353590 - DNA, 15 bp, Homo sapiens
gcctgcccgcccgcc

SEQ ID NO: 353591 - DNA, 16 bp, Homo sapiens
gcctgcccgcccgccg

SEQ ID NO: 353592 - DNA, 17 bp, Homo sapiens
gcctgcccggccggaga

SEQ ID NO: 353593 - DNA, 13 bp, Homo sapiens
gcctgccctccca

SEQ ID NO: 353594 - DNA, 20 bp, Homo sapiens
gcctgccgccgtctctgtcc

SEQ ID NO: 353595 - DNA, 21 bp, Homo sapiens
gcctgccgccgtctctgtccc

SEQ ID NO: 353596 - DNA, 12 bp, Homo sapiens
gcctgccgtgca

SEQ ID NO: 353597 - DNA, 22 bp, Homo sapiens
gcctgcctagcactcacatgct

SEQ ID NO: 353598 - DNA, 18 bp, Homo sapiens
gcctgcctcccaaggtcc

SEQ ID NO: 353599 - DNA, 14 bp, Homo sapiens
gcctgcctccggcc

SEQ ID NO: 353600 - DNA, 18 bp, Homo sapiens
gcctgcctccggccctgc

SEQ ID NO: 353601 - DNA, 16 bp, Homo sapiens
gcctgcctgtctgtct

SEQ ID NO: 353602 - DNA, 22 bp, Homo sapiens
gcctgcctgtctgtctctccat

SEQ ID NO: 353603 - DNA, 17 bp, Homo sapiens
gcctgcggcctgctgga

SEQ ID NO: 353604 - DNA, 12 bp, Homo sapiens
gcctgcggctgc

SEQ ID NO: 353605 - DNA, 13 bp, Homo sapiens
gcctgcggctgct

SEQ ID NO: 353606 - DNA, 16 bp, Homo sapiens
gcctgcggctgctggc

SEQ ID NO: 353607 - DNA, 23 bp, Homo sapiens
gcctgcggctgctggcacagact

SEQ ID NO: 353608 - DNA, 20 bp, Homo sapiens
gcctgcgtcatggctcaagg

SEQ ID NO: 353609 - DNA, 19 bp, Homo sapiens
gcctgctaaggctcctcct

SEQ ID NO: 353610 - DNA, 16 bp, Homo sapiens
gcctgctagagcaacc

SEQ ID NO: 353611 - DNA, 17 bp, Homo sapiens
gcctgctagagcaaccc

SEQ ID NO: 353612 - DNA, 17 bp, Homo sapiens
gcctgctatccagccgc

SEQ ID NO: 353613 - DNA, 20 bp, Homo sapiens
gcctgctcccagcagcccta

SEQ ID NO: 353614 - DNA, 20 bp, Homo sapiens
gcctgctccttggcaccccc

SEQ ID NO: 353615 - DNA, 21 bp, Homo sapiens
gcctgctccttggcaccccca

SEQ ID NO: 353616 - DNA, 18 bp, Homo sapiens
gcctgctctccttgccct

SEQ ID NO: 353617 - DNA, 13 bp, Homo sapiens
gcctgctctgcag

SEQ ID NO: 353618 - DNA, 21 bp, Homo sapiens
gcctgctgggaaccccgcagc

SEQ ID NO: 353619 - DNA, 21 bp, Homo sapiens
gcctgcttcacacccctcagc

SEQ ID NO: 353620 - DNA, 12 bp, Homo sapiens
gcctggaaccag

SEQ ID NO: 353621 - DNA, 17 bp, Homo sapiens
gcctggaaccagggagg

SEQ ID NO: 353622 - DNA, 21 bp, Homo sapiens
gcctggaaccagggaggagag

SEQ ID NO: 353623 - DNA, 14 bp, Homo sapiens
gcctggacctgcct

SEQ ID NO: 353624 - DNA, 17 bp, Homo sapiens
gcctggacctgcctcct

SEQ ID NO: 353625 - DNA, 23 bp, Homo sapiens
gcctggacctgcctcctgcctgc

SEQ ID NO: 353626 - DNA, 17 bp, Homo sapiens
gcctggactttcctgca

SEQ ID NO: 353627 - DNA, 14 bp, Homo sapiens
gcctggagccgtgg

SEQ ID NO: 353628 - DNA, 12 bp, Homo sapiens
gcctggagctcc

SEQ ID NO: 353629 - DNA, 20 bp, Homo sapiens
gcctggagctcctgggaagg

SEQ ID NO: 353630 - DNA, 12 bp, Homo sapiens
gcctggcaccca

SEQ ID NO: 353631 - DNA, 22 bp, Homo sapiens
gcctggcagaactgagctcctc

SEQ ID NO: 353632 - DNA, 19 bp, Homo sapiens
gcctggcagggaggtcagg

SEQ ID NO: 353633 - DNA, 23 bp, Homo sapiens
gcctggcagggaggtcaggccct

SEQ ID NO: 353634 - DNA, 13 bp, Homo sapiens
gcctggcaggtgg

SEQ ID NO: 353635 - DNA, 17 bp, Homo sapiens
gcctggcaggtggaact

SEQ ID NO: 353636 - DNA, 16 bp, Homo sapiens
gcctggccacctctct

SEQ ID NO: 353637 - DNA, 17 bp, Homo sapiens
gcctggccacctctctc

SEQ ID NO: 353638 - DNA, 21 bp, Homo sapiens
gcctggccacgcagccaggac

SEQ ID NO: 353639 - DNA, 23 bp, Homo sapiens
gcctggccacgcagccaggacac

SEQ ID NO: 353640 - DNA, 19 bp, Homo sapiens
gcctggccaggagctcttc

SEQ ID NO: 353641 - DNA, 14 bp, Homo sapiens
gcctggccaggcag

SEQ ID NO: 353642 - DNA, 18 bp, Homo sapiens
gcctggcccacgccctcc

SEQ ID NO: 353643 - DNA, 15 bp, Homo sapiens
gcctggcccccagct

SEQ ID NO: 353644 - DNA, 18 bp, Homo sapiens
gcctggcccccctccagg

SEQ ID NO: 353645 - DNA, 11 bp, Homo sapiens
gcctggcctat

SEQ ID NO: 353646 - DNA, 16 bp, Homo sapiens
gcctggcctatttaag

SEQ ID NO: 353647 - DNA, 13 bp, Homo sapiens
gcctggcctcccc

SEQ ID NO: 353648 - DNA, 12 bp, Homo sapiens
gcctggcctgag

SEQ ID NO: 353649 - DNA, 22 bp, Homo sapiens
gcctggcctgagctggggccac

SEQ ID NO: 353650 - DNA, 15 bp, Homo sapiens
gcctggcctggccct

SEQ ID NO: 353651 - DNA, 17 bp, Homo sapiens
gcctggcctggccctgc

SEQ ID NO: 353652 - DNA, 15 bp, Homo sapiens
gcctggcctggtcca

SEQ ID NO: 353653 - DNA, 13 bp, Homo sapiens
gcctggcgggcag

SEQ ID NO: 353654 - DNA, 19 bp, Homo sapiens
gcctggcgggcagcccctg

SEQ ID NO: 353655 - DNA, 12 bp, Homo sapiens
gcccagagctgg

SEQ ID NO: 353656 - DNA, 15 bp, Homo sapiens
gcccagagctgggtg

SEQ ID NO: 353657 - DNA, 19 bp, Homo sapiens
gcccagagctgggtgagtg

SEQ ID NO: 353658 - DNA, 19 bp, Homo sapiens
gcccagaggcacagccggg

SEQ ID NO: 353659 - DNA, 13 bp, Homo sapiens
gcccagaggctga

SEQ ID NO: 353660 - DNA, 20 bp, Homo sapiens
gcccagaggggcggggccag

SEQ ID NO: 353661 - DNA, 21 bp, Homo sapiens
gcccagaggggcggggccagg

SEQ ID NO: 353662 - DNA, 15 bp, Homo sapiens
gcccagagtagccca

SEQ ID NO: 353663 - DNA, 15 bp, Homo sapiens
gcccagatcccagaa

SEQ ID NO: 353664 - DNA, 20 bp, Homo sapiens
gcccagatcgttctgccact

SEQ ID NO: 353665 - DNA, 15 bp, Homo sapiens
gcccagcagagccgt

SEQ ID NO: 353666 - DNA, 13 bp, Homo sapiens
gcccagcagcttg

SEQ ID NO: 353667 - DNA, 14 bp, Homo sapiens
gcccagcagcttgg

SEQ ID NO: 353668 - DNA, 18 bp, Homo sapiens
gcccagcagcttggctga

SEQ ID NO: 353669 - DNA, 23 bp, Homo sapiens
gcccagcatatgtgccataaaca

SEQ ID NO: 353670 - DNA, 17 bp, Homo sapiens
gcccagccaaaccctgt

SEQ ID NO: 353671 - DNA, 13 bp, Homo sapiens
gcccagcccagct

SEQ ID NO: 353672 - DNA, 16 bp, Homo sapiens
gcccagccctcccagc

SEQ ID NO: 353673 - DNA, 15 bp, Homo sapiens
gcccagccggggtgg

SEQ ID NO: 353674 - DNA, 11 bp, Homo sapiens
gcccagcctct

SEQ ID NO: 353675 - DNA, 13 bp, Homo sapiens
gcccagcctctcc

SEQ ID NO: 353676 - DNA, 11 bp, Homo sapiens
gcccagcctgg

SEQ ID NO: 353677 - DNA, 15 bp, Homo sapiens
gcccagcctggagcc

SEQ ID NO: 353678 - DNA, 14 bp, Homo sapiens
gcccagcctggccc

SEQ ID NO: 353679 - DNA, 15 bp, Homo sapiens
gcccagcctggcccc

SEQ ID NO: 353680 - DNA, 16 bp, Homo sapiens
gcccagcctggcccca

SEQ ID NO: 353681 - DNA, 21 bp, Homo sapiens
gcccagcctggccccaaatgt

SEQ ID NO: 353682 - DNA, 15 bp, Homo sapiens
gcccagcctgtcctg

SEQ ID NO: 353683 - DNA, 18 bp, Homo sapiens
gcccagcctgtcctggta

SEQ ID NO: 353684 - DNA, 17 bp, Homo sapiens
gcccagcggcccctccc

SEQ ID NO: 353685 - DNA, 20 bp, Homo sapiens
gcccagcggcccctcccaca

SEQ ID NO: 353686 - DNA, 15 bp, Homo sapiens
gcccagctacattcc

SEQ ID NO: 353687 - DNA, 18 bp, Homo sapiens
gcccagctacattcctca

SEQ ID NO: 353688 - DNA, 21 bp, Homo sapiens
gcccagctacattcctcagct

SEQ ID NO: 353689 - DNA, 17 bp, Homo sapiens
gcccagctccactcagg

SEQ ID NO: 353690 - DNA, 22 bp, Homo sapiens
gcccagctccactcagggctgg

SEQ ID NO: 353691 - DNA, 23 bp, Homo sapiens
gcccagctccactcagggctggc

SEQ ID NO: 353692 - DNA, 11 bp, Homo sapiens
gcccagctccc

SEQ ID NO: 353693 - DNA, 11 bp, Homo sapiens
gcccagctctc

SEQ ID NO: 353694 - DNA, 17 bp, Homo sapiens
gcccagctctgaccctg

SEQ ID NO: 353695 - DNA, 19 bp, Homo sapiens
gcccagctgctctgcccag

SEQ ID NO: 353696 - DNA, 21 bp, Homo sapiens
gcccagctgctctgcccagag

SEQ ID NO: 353697 - DNA, 23 bp, Homo sapiens
gcccagctgctctgcccagagct

SEQ ID NO: 353698 - DNA, 13 bp, Homo sapiens
gcccagctgggct

SEQ ID NO: 353699 - DNA, 18 bp, Homo sapiens
gcccagctgggctctgcc

SEQ ID NO: 353700 - DNA, 19 bp, Homo sapiens
gcccagctgtagccatggc

SEQ ID NO: 353701 - DNA, 22 bp, Homo sapiens
gcccagctgtagccatggctca

SEQ ID NO: 353702 - DNA, 14 bp, Homo sapiens
gcccagcttgggcc

SEQ ID NO: 353703 - DNA, 17 bp, Homo sapiens
gcccagcttgggcccag

SEQ ID NO: 353704 - DNA, 20 bp, Homo sapiens
gcccagcttgggcccagctg

SEQ ID NO: 353705 - DNA, 23 bp, Homo sapiens
gcccagcttgggcccagctgggc

SEQ ID NO: 353706 - DNA, 19 bp, Homo sapiens
gcccaggaaaaacctgtgg

SEQ ID NO: 353707 - DNA, 20 bp, Homo sapiens
gcccaggagagcccccacca

SEQ ID NO: 353708 - DNA, 20 bp, Homo sapiens
gcccaggagctgagtcacct

SEQ ID NO: 353709 - DNA, 22 bp, Homo sapiens
gcccaggagctgagtcacctcc

SEQ ID NO: 353710 - DNA, 12 bp, Homo sapiens
gcccaggcagca

SEQ ID NO: 353711 - DNA, 13 bp, Homo sapiens
gcccaggcagcac

SEQ ID NO: 353712 - DNA, 18 bp, Homo sapiens
gcccaggcagcacctgga

SEQ ID NO: 353713 - DNA, 21 bp, Homo sapiens
gcccaggccggggtggagcat

SEQ ID NO: 353714 - DNA, 22 bp, Homo sapiens
gcccaggccggggtggagcatg

SEQ ID NO: 353715 - DNA, 23 bp, Homo sapiens
gcccaggccggggtggagcatgg

SEQ ID NO: 353716 - DNA, 16 bp, Homo sapiens
gcccaggcctggagcg

SEQ ID NO: 353717 - DNA, 21 bp, Homo sapiens
gcccaggctcccctgcccgcc

SEQ ID NO: 353718 - DNA, 15 bp, Homo sapiens
gcccaggctctgctg

SEQ ID NO: 353719 - DNA, 18 bp, Homo sapiens
gcccagggagaggccatg

SEQ ID NO: 353720 - DNA, 12 bp, Homo sapiens
gcccaggggctg

SEQ ID NO: 353721 - DNA, 21 bp, Homo sapiens
gcccaggggctttggtggccc

SEQ ID NO: 353722 - DNA, 15 bp, Homo sapiens
gcccagggtgcagtg

SEQ ID NO: 353723 - DNA, 20 bp, Homo sapiens
gcccagggtgcagtgtgagt

SEQ ID NO: 353724 - DNA, 21 bp, Homo sapiens
gcccagggttcccccagccct

SEQ ID NO: 353725 - DNA, 22 bp, Homo sapiens
gcccagggttcccccagccctg

SEQ ID NO: 353726 - DNA, 15 bp, Homo sapiens
gcccaggtaccaccc

SEQ ID NO: 353727 - DNA, 16 bp, Homo sapiens
gcccaggtaccaccct

SEQ ID NO: 353728 - DNA, 17 bp, Homo sapiens
gcccaggtaccaccctt

SEQ ID NO: 353729 - DNA, 17 bp, Homo sapiens
gcccagtagccattttg

SEQ ID NO: 353730 - DNA, 21 bp, Homo sapiens
gcccagtagccattttgtaac

SEQ ID NO: 353731 - DNA, 23 bp, Homo sapiens
gcccagtagccattttgtaactg

SEQ ID NO: 353732 - DNA, 16 bp, Homo sapiens
gcccagtagccccaat

SEQ ID NO: 353733 - DNA, 15 bp, Homo sapiens
gcccagtccactggg

SEQ ID NO: 353734 - DNA, 14 bp, Homo sapiens
gcccagtccctgga

SEQ ID NO: 353735 - DNA, 16 bp, Homo sapiens
gcccagtccctggagc

SEQ ID NO: 353736 - DNA, 19 bp, Homo sapiens
gcccagtccctggagctgt

SEQ ID NO: 353737 - DNA, 24 bp, Homo sapiens
gcccagtccctggagctgtccttc

SEQ ID NO: 353738 - DNA, 23 bp, Homo sapiens
gcccagtgatggcattactctgc

SEQ ID NO: 353739 - DNA, 18 bp, Homo sapiens
gcccagtgttgtttgtaa

SEQ ID NO: 353740 - DNA, 21 bp, Homo sapiens
gcccagttagcccggccaagg

SEQ ID NO: 353741 - DNA, 23 bp, Homo sapiens
gcccagttagcccggccaaggac

SEQ ID NO: 353742 - DNA, 20 bp, Homo sapiens
gcccataatagttagccctc

SEQ ID NO: 353743 - DNA, 21 bp, Homo sapiens
gcccataatagttagccctca

SEQ ID NO: 353744 - DNA, 23 bp, Homo sapiens
gcccataatagttagccctcagt

SEQ ID NO: 353745 - DNA, 15 bp, Homo sapiens
gcccatattttactt

SEQ ID NO: 353746 - DNA, 20 bp, Homo sapiens
gcccatattttacttggaaa

SEQ ID NO: 353747 - DNA, 22 bp, Homo sapiens
gcccatattttacttggaaata

SEQ ID NO: 353748 - DNA, 21 bp, Homo sapiens
gcccatcacagggttgggccc

SEQ ID NO: 353749 - DNA, 19 bp, Homo sapiens
gcccatcactcggctgtgg

SEQ ID NO: 353750 - DNA, 13 bp, Homo sapiens
gcccatcatctct

SEQ ID NO: 353751 - DNA, 16 bp, Homo sapiens
gcccatcatctctgcc

SEQ ID NO: 353752 - DNA, 18 bp, Homo sapiens
gcccatcctgtctgttca

SEQ ID NO: 353753 - DNA, 15 bp, Homo sapiens
gcccatctcagcctc

SEQ ID NO: 353754 - DNA, 16 bp, Homo sapiens
gcccatctcagcctcc

SEQ ID NO: 353755 - DNA, 21 bp, Homo sapiens
gcccatctcagcctcctgagc

SEQ ID NO: 353756 - DNA, 19 bp, Homo sapiens
gcccatctcaggtgccact

SEQ ID NO: 353757 - DNA, 23 bp, Homo sapiens
gcccatctcaggtgccactccct

SEQ ID NO: 353758 - DNA, 23 bp, Homo sapiens
gcccgacttgctgttttgttctg

SEQ ID NO: 353759 - DNA, 13 bp, Homo sapiens
gcccgagagctct

SEQ ID NO: 353760 - DNA, 17 bp, Homo sapiens
gcccgagagctcttagt

SEQ ID NO: 353761 - DNA, 22 bp, Homo sapiens
gcccgagctggtgcattacaga

SEQ ID NO: 353762 - DNA, 17 bp, Homo sapiens
gcccgatattctccctg

SEQ ID NO: 353763 - DNA, 24 bp, Homo sapiens
gcccgcacaccctcactctgccag

SEQ ID NO: 353764 - DNA, 16 bp, Homo sapiens
gcccgcacccccaccc

SEQ ID NO: 353765 - DNA, 17 bp, Homo sapiens
gcccgcatgcagcagct

SEQ ID NO: 353766 - DNA, 15 bp, Homo sapiens
gcccgccagccagtg

SEQ ID NO: 353767 - DNA, 19 bp, Homo sapiens
gcccgcccaccccgctgcc

SEQ ID NO: 353768 - DNA, 22 bp, Homo sapiens
gcccgcccaccccgctgcctgg

SEQ ID NO: 353769 - DNA, 14 bp, Homo sapiens
gcccgcccacctgg

SEQ ID NO: 353770 - DNA, 15 bp, Homo sapiens
gcccgcccactgtcc

SEQ ID NO: 353771 - DNA, 19 bp, Homo sapiens
gcccgcccactgtcctggg

SEQ ID NO: 353772 - DNA, 16 bp, Homo sapiens
gcccgcccccgccctc

SEQ ID NO: 353773 - DNA, 21 bp, Homo sapiens
gcccgcccccgccctcgctcc

SEQ ID NO: 353774 - DNA, 19 bp, Homo sapiens
gcccgccctcctctgcccc

SEQ ID NO: 353775 - DNA, 17 bp, Homo sapiens
gcccgccggttggccgg

SEQ ID NO: 353776 - DNA, 23 bp, Homo sapiens
gcccgccggttggccggctggcc

SEQ ID NO: 353777 - DNA, 12 bp, Homo sapiens
gcccgcctgccg

SEQ ID NO: 353778 - DNA, 13 bp, Homo sapiens
gcccgcctggcag

SEQ ID NO: 353779 - DNA, 14 bp, Homo sapiens
gcccgcctggcaga

SEQ ID NO: 353780 - DNA, 15 bp, Homo sapiens
gcccgctcaacctct

SEQ ID NO: 353781 - DNA, 13 bp, Homo sapiens
gcccgctcccaca

SEQ ID NO: 353782 - DNA, 14 bp, Homo sapiens
gcccgctgcaatgc

SEQ ID NO: 353783 - DNA, 13 bp, Homo sapiens
gcccgctgggctg

SEQ ID NO: 353784 - DNA, 15 bp, Homo sapiens
gcccgctgggctgag

SEQ ID NO: 353785 - DNA, 18 bp, Homo sapiens
gcccgctgggctgagccc

SEQ ID NO: 353786 - DNA, 15 bp, Homo sapiens
gcccggatgcccacc

SEQ ID NO: 353787 - DNA, 16 bp, Homo sapiens
gcccggatgcccaccc

SEQ ID NO: 353788 - DNA, 18 bp, Homo sapiens
gcccggcagtgcaccccc

SEQ ID NO: 353789 - DNA, 13 bp, Homo sapiens
gcccggcccacgc

SEQ ID NO: 353790 - DNA, 21 bp, Homo sapiens
gcccggcccacgcagagcccc

SEQ ID NO: 353791 - DNA, 22 bp, Homo sapiens
gcccggcccacgcagagccccg

SEQ ID NO: 353792 - DNA, 14 bp, Homo sapiens
gcccggcccagcct

SEQ ID NO: 353793 - DNA, 21 bp, Homo sapiens
gcccggccgccccgccccaga

SEQ ID NO: 353794 - DNA, 13 bp, Homo sapiens
gcccgggcccaga

SEQ ID NO: 353795 - DNA, 18 bp, Homo sapiens
gcccggtggtttgccatg

SEQ ID NO: 353796 - DNA, 19 bp, Homo sapiens
gcccggtggtttgccatgt

SEQ ID NO: 353797 - DNA, 13 bp, Homo sapiens
gcccgtgaagcag

SEQ ID NO: 353798 - DNA, 18 bp, Homo sapiens
gcccgtgcagtacaggca

SEQ ID NO: 353799 - DNA, 24 bp, Homo sapiens
gcccgtgcgcagccgcgctctgcc

SEQ ID NO: 353800 - DNA, 18 bp, Homo sapiens
gcccgtgtggccccttca

SEQ ID NO: 353801 - DNA, 17 bp, Homo sapiens
gcccgttgaggatgagg

SEQ ID NO: 353802 - DNA, 18 bp, Homo sapiens
gcccgttgccgggcctgg

SEQ ID NO: 353803 - DNA, 20 bp, Homo sapiens
gcccgttgccgggcctggac

SEQ ID NO: 353804 - DNA, 16 bp, Homo sapiens
gccctacagaggtctc

SEQ ID NO: 353805 - DNA, 13 bp, Homo sapiens
gccctttccttgc

SEQ ID NO: 353806 - DNA, 15 bp, Homo sapiens
gccctttgcctgtag

SEQ ID NO: 353807 - DNA, 13 bp, Homo sapiens
gccctttggagaa

SEQ ID NO: 353808 - DNA, 15 bp, Homo sapiens
gcccttttaaatggc

SEQ ID NO: 353809 - DNA, 21 bp, Homo sapiens
gcccttttcctgggccttctc

SEQ ID NO: 353810 - DNA, 22 bp, Homo sapiens
gcccttttcctgggccttctca

SEQ ID NO: 353811 - DNA, 15 bp, Homo sapiens
gcccttttctggctc

SEQ ID NO: 353812 - DNA, 19 bp, Homo sapiens
gccgaagaagggtccttcc

SEQ ID NO: 353813 - DNA, 20 bp, Homo sapiens
gccgaatcccctccctgtca

SEQ ID NO: 353814 - DNA, 14 bp, Homo sapiens
gccgaatgtgcagg

SEQ ID NO: 353815 - DNA, 22 bp, Homo sapiens
gccgaccgaggctggagctggc

SEQ ID NO: 353816 - DNA, 16 bp, Homo sapiens
gccgaccgcctgcttc

SEQ ID NO: 353817 - DNA, 18 bp, Homo sapiens
gccgaccgcctgcttcac

SEQ ID NO: 353818 - DNA, 14 bp, Homo sapiens
gccgagaccgcaga

SEQ ID NO: 353819 - DNA, 18 bp, Homo sapiens
gccgagatcggggtggca

SEQ ID NO: 353820 - DNA, 16 bp, Homo sapiens
gccgagccgggcctgg

SEQ ID NO: 353821 - DNA, 17 bp, Homo sapiens
gccgagccgggcctggg

SEQ ID NO: 353822 - DNA, 20 bp, Homo sapiens
gccgagccgggcctggggct

SEQ ID NO: 353823 - DNA, 21 bp, Homo sapiens
gccgagctcgtgtatcctggg

SEQ ID NO: 353824 - DNA, 12 bp, Homo sapiens
gccgaggcaggg

SEQ ID NO: 353825 - DNA, 18 bp, Homo sapiens
gccgaggcaggggctggg

SEQ ID NO: 353826 - DNA, 18 bp, Homo sapiens
gccgagggtcctggctcc

SEQ ID NO: 353827 - DNA, 20 bp, Homo sapiens
gccgagtccaggagccccag

SEQ ID NO: 353828 - DNA, 21 bp, Homo sapiens
gccgagtggatagatgccctg

SEQ ID NO: 353829 - DNA, 14 bp, Homo sapiens
gccgatgagctggt

SEQ ID NO: 353830 - DNA, 16 bp, Homo sapiens
gccgatggggcccaca

SEQ ID NO: 353831 - DNA, 21 bp, Homo sapiens
gccgcaaatccataccccctg

SEQ ID NO: 353832 - DNA, 15 bp, Homo sapiens
gccgcatggcccctc

SEQ ID NO: 353833 - DNA, 14 bp, Homo sapiens
gccgccactaggtg

SEQ ID NO: 353834 - DNA, 17 bp, Homo sapiens
gccgccactaggtgtcc

SEQ ID NO: 353835 - DNA, 22 bp, Homo sapiens
gccgccactaggtgtccccaac

SEQ ID NO: 353836 - DNA, 20 bp, Homo sapiens
gccgccaggaccgccaaaga

SEQ ID NO: 353837 - DNA, 16 bp, Homo sapiens
gccgccatcagcccaa

SEQ ID NO: 353838 - DNA, 17 bp, Homo sapiens
gccgccattgccaccag

SEQ ID NO: 353839 - DNA, 13 bp, Homo sapiens
gccgcccacctgc

SEQ ID NO: 353840 - DNA, 16 bp, Homo sapiens
gccgcccacctgcatc

SEQ ID NO: 353841 - DNA, 20 bp, Homo sapiens
gccgcccacctgcatcagcc

SEQ ID NO: 353842 - DNA, 20 bp, Homo sapiens
gccgcccagacaccacagac

SEQ ID NO: 353843 - DNA, 12 bp, Homo sapiens
gccgccccagcc

SEQ ID NO: 353844 - DNA, 19 bp, Homo sapiens
gccgccccagcctctgagc

SEQ ID NO: 353845 - DNA, 21 bp, Homo sapiens
gccgccccgccccagagctcc

SEQ ID NO: 353846 - DNA, 21 bp, Homo sapiens
gccgccccgtgtccccccagg

SEQ ID NO: 353847 - DNA, 15 bp, Homo sapiens
gccgcccgggcccag

SEQ ID NO: 353848 - DNA, 13 bp, Homo sapiens
gccctaccagcgc

SEQ ID NO: 353849 - DNA, 21 bp, Homo sapiens
gccctagaccctcccccacca

SEQ ID NO: 353850 - DNA, 18 bp, Homo sapiens
gccctaggattcctcccc

SEQ ID NO: 353851 - DNA, 21 bp, Homo sapiens
gccctataacccctgcctgga

SEQ ID NO: 353852 - DNA, 23 bp, Homo sapiens
gccctcaagacccttttgggttt

SEQ ID NO: 353853 - DNA, 14 bp, Homo sapiens
gccctcactccact

SEQ ID NO: 353854 - DNA, 16 bp, Homo sapiens
gccctcactccactcc

SEQ ID NO: 353855 - DNA, 17 bp, Homo sapiens
gccctcactccactccc

SEQ ID NO: 353856 - DNA, 17 bp, Homo sapiens
gccctcagaggaaaggc

SEQ ID NO: 353857 - DNA, 15 bp, Homo sapiens
gccctccactgccct

SEQ ID NO: 353858 - DNA, 16 bp, Homo sapiens
gccctccactgccctc

SEQ ID NO: 353859 - DNA, 16 bp, Homo sapiens
gccctccatcccgaca

SEQ ID NO: 353860 - DNA, 13 bp, Homo sapiens
gccctcccagctg

SEQ ID NO: 353861 - DNA, 14 bp, Homo sapiens
gccctcccagctgg

SEQ ID NO: 353862 - DNA, 14 bp, Homo sapiens
gccctcccccacgg

SEQ ID NO: 353863 - DNA, 14 bp, Homo sapiens
gccctccccctcaa

SEQ ID NO: 353864 - DNA, 16 bp, Homo sapiens
gccctccccctcaacc

SEQ ID NO: 353865 - DNA, 11 bp, Homo sapiens
gccctccctcc

SEQ ID NO: 353866 - DNA, 12 bp, Homo sapiens
gccctccctccc

SEQ ID NO: 353867 - DNA, 16 bp, Homo sapiens
gccctccctccctcca

SEQ ID NO: 353868 - DNA, 14 bp, Homo sapiens
gccctccctctccc

SEQ ID NO: 353869 - DNA, 21 bp, Homo sapiens
gccctccctctcccaggcccg

SEQ ID NO: 353870 - DNA, 15 bp, Homo sapiens
gccctccctgcccct

SEQ ID NO: 353871 - DNA, 17 bp, Homo sapiens
gccctcctctgccccct

SEQ ID NO: 353872 - DNA, 16 bp, Homo sapiens
gccctcctgctggctg

SEQ ID NO: 353873 - DNA, 21 bp, Homo sapiens
gccctccttcttgccctgagc

SEQ ID NO: 353874 - DNA, 13 bp, Homo sapiens
gccctccttgcca

SEQ ID NO: 353875 - DNA, 15 bp, Homo sapiens
gccctccttgccacc

SEQ ID NO: 353876 - DNA, 16 bp, Homo sapiens
gccctcgaaccaaggc

SEQ ID NO: 353877 - DNA, 19 bp, Homo sapiens
gccctcgaaccaaggcagc

SEQ ID NO: 353878 - DNA, 20 bp, Homo sapiens
gccctcgaaccaaggcagcc

SEQ ID NO: 353879 - DNA, 22 bp, Homo sapiens
gccctcgaaccaaggcagcctc

SEQ ID NO: 353880 - DNA, 23 bp, Homo sapiens
gccctcgaaccaaggcagcctcc

SEQ ID NO: 353881 - DNA, 13 bp, Homo sapiens
gccctcggcctcc

SEQ ID NO: 353882 - DNA, 23 bp, Homo sapiens
gccctcgtggtggaaacttttct

SEQ ID NO: 353883 - DNA, 12 bp, Homo sapiens
gccctctccaca

SEQ ID NO: 353884 - DNA, 19 bp, Homo sapiens
gccctctcccatgcacaca

SEQ ID NO: 353885 - DNA, 20 bp, Homo sapiens
gccctctgcccccagctgct

SEQ ID NO: 353886 - DNA, 24 bp, Homo sapiens
gccctctgccgaccgcctgcttca

SEQ ID NO: 353887 - DNA, 15 bp, Homo sapiens
gccctctgtagctcc

SEQ ID NO: 353888 - DNA, 14 bp, Homo sapiens
gccctctgtgccta

SEQ ID NO: 353889 - DNA, 15 bp, Homo sapiens
gccctcttcaggggt

SEQ ID NO: 353890 - DNA, 15 bp, Homo sapiens
gccctctttctctct

SEQ ID NO: 353891 - DNA, 19 bp, Homo sapiens
gccctgaacctttgtccac

SEQ ID NO: 353892 - DNA, 21 bp, Homo sapiens
gccctgagctttccggggagg

SEQ ID NO: 353893 - DNA, 16 bp, Homo sapiens
gccctgaggaaggagg

SEQ ID NO: 353894 - DNA, 21 bp, Homo sapiens
gccctgaggtgaaagggagct

SEQ ID NO: 353895 - DNA, 22 bp, Homo sapiens
gccctgaggtgaaagggagcta

SEQ ID NO: 353896 - DNA, 22 bp, Homo sapiens
gccctgcaccttgggcacggga

SEQ ID NO: 353897 - DNA, 14 bp, Homo sapiens
gccctgcaggaggc

SEQ ID NO: 353898 - DNA, 20 bp, Homo sapiens
gccctgcaggaggcctggga

SEQ ID NO: 353899 - DNA, 21 bp, Homo sapiens
gccctgcaggaggcctgggag

SEQ ID NO: 353900 - DNA, 19 bp, Homo sapiens
gccctgccaagcctggagc

SEQ ID NO: 353901 - DNA, 20 bp, Homo sapiens
gctccttcatgcttttctca

SEQ ID NO: 353902 - DNA, 19 bp, Homo sapiens
gctccttggcacccccatg

SEQ ID NO: 353903 - DNA, 20 bp, Homo sapiens
gctccttggcacccccatgc

SEQ ID NO: 353904 - DNA, 14 bp, Homo sapiens
gctccttgttccta

SEQ ID NO: 353905 - DNA, 14 bp, Homo sapiens
gctcctttcccaca

SEQ ID NO: 353906 - DNA, 17 bp, Homo sapiens
gctcctttcccacagtc

SEQ ID NO: 353907 - DNA, 20 bp, Homo sapiens
gctcctttctccagccagca

SEQ ID NO: 353908 - DNA, 14 bp, Homo sapiens
gctccttttctgtg

SEQ ID NO: 353909 - DNA, 21 bp, Homo sapiens
gctccttttctgtgaagccct

SEQ ID NO: 353910 - DNA, 24 bp, Homo sapiens
gctccttttctgtgaagccctttg

SEQ ID NO: 353911 - DNA, 14 bp, Homo sapiens
gctccttttgtccc

SEQ ID NO: 353912 - DNA, 21 bp, Homo sapiens
gctccttttgtccccagggcc

SEQ ID NO: 353913 - DNA, 23 bp, Homo sapiens
gctccttttgtccccagggcccc

SEQ ID NO: 353914 - DNA, 15 bp, Homo sapiens
gctcgagtgcccctg

SEQ ID NO: 353915 - DNA, 19 bp, Homo sapiens
gctcgagtgcccctgcagg

SEQ ID NO: 353916 - DNA, 15 bp, Homo sapiens
gctcgatgcctttgc

SEQ ID NO: 353917 - DNA, 23 bp, Homo sapiens
gctcgccaaccgcatctgctcat

SEQ ID NO: 353918 - DNA, 14 bp, Homo sapiens
gctcggacacagtt

SEQ ID NO: 353919 - DNA, 13 bp, Homo sapiens
gctcgggaaggcc

SEQ ID NO: 353920 - DNA, 16 bp, Homo sapiens
gctcgggaaggcctga

SEQ ID NO: 353921 - DNA, 14 bp, Homo sapiens
gctcgggactgtct

SEQ ID NO: 353922 - DNA, 13 bp, Homo sapiens
gctcgtgcatgta

SEQ ID NO: 353923 - DNA, 14 bp, Homo sapiens
gctcgtgggctctg

SEQ ID NO: 353924 - DNA, 23 bp, Homo sapiens
gctcgtttttcagcacccccacc

SEQ ID NO: 353925 - DNA, 19 bp, Homo sapiens
gctctaacattactgcctt

SEQ ID NO: 353926 - DNA, 15 bp, Homo sapiens
gctctacacaacatg

SEQ ID NO: 353927 - DNA, 19 bp, Homo sapiens
gctctacccatgagcctgc

SEQ ID NO: 353928 - DNA, 20 bp, Homo sapiens
gctctacccatgagcctgcc

SEQ ID NO: 353929 - DNA, 16 bp, Homo sapiens
gctctagacaaccctg

SEQ ID NO: 353930 - DNA, 18 bp, Homo sapiens
gctctagacaaccctgca

SEQ ID NO: 353931 - DNA, 16 bp, Homo sapiens
gctctagccaggagtc

SEQ ID NO: 353932 - DNA, 18 bp, Homo sapiens
gctctagccaggagtctg

SEQ ID NO: 353933 - DNA, 20 bp, Homo sapiens
gctctagccaggagtctgtg

SEQ ID NO: 353934 - DNA, 24 bp, Homo sapiens
gctctagccaggagtctgtgctct

SEQ ID NO: 353935 - DNA, 16 bp, Homo sapiens
gctctagctggcagga

SEQ ID NO: 353936 - DNA, 19 bp, Homo sapiens
gctctagggttgctggagc

SEQ ID NO: 353937 - DNA, 14 bp, Homo sapiens
gctctaggtggggc

SEQ ID NO: 353938 - DNA, 16 bp, Homo sapiens
gctctaggtttcttga

SEQ ID NO: 353939 - DNA, 14 bp, Homo sapiens
gctctatctctcaa

SEQ ID NO: 353940 - DNA, 12 bp, Homo sapiens
gctctatctgca

SEQ ID NO: 353941 - DNA, 23 bp, Homo sapiens
gctctatttcggaaatacactac

SEQ ID NO: 353942 - DNA, 13 bp, Homo sapiens
gctctccaccttg

SEQ ID NO: 353943 - DNA, 19 bp, Homo sapiens
gctctccagtcaggaggca

SEQ ID NO: 353944 - DNA, 20 bp, Homo sapiens
gctctccagtcaggaggcat

SEQ ID NO: 353945 - DNA, 17 bp, Homo sapiens
gctctccatcataggct

SEQ ID NO: 353946 - DNA, 21 bp, Homo sapiens
gctctcccacatcccactgga

SEQ ID NO: 353947 - DNA, 19 bp, Homo sapiens
gctctcccctgccctgctg

SEQ ID NO: 353948 - DNA, 15 bp, Homo sapiens
gctctccctctctgc

SEQ ID NO: 353949 - DNA, 19 bp, Homo sapiens
gctctccctctctgcacct

SEQ ID NO: 353950 - DNA, 23 bp, Homo sapiens
gctctccctcttctcaagtgcct

SEQ ID NO: 353951 - DNA, 15 bp, Homo sapiens
gctctcctcttgcca

SEQ ID NO: 353952 - DNA, 16 bp, Homo sapiens
gctctcctgggccagg

SEQ ID NO: 353953 - DNA, 14 bp, Homo sapiens
gctctccttcactc

SEQ ID NO: 353954 - DNA, 18 bp, Homo sapiens
gctctccttgccctgggc

SEQ ID NO: 353955 - DNA, 14 bp, Homo sapiens
gctctcgtccctct

SEQ ID NO: 353956 - DNA, 15 bp, Homo sapiens
gctctctcagaccct

SEQ ID NO: 353957 - DNA, 22 bp, Homo sapiens
gctctctcagacccttgaagat

SEQ ID NO: 353958 - DNA, 11 bp, Homo sapiens
gctctctgctg

SEQ ID NO: 353959 - DNA, 13 bp, Homo sapiens
gctctctgctgta

SEQ ID NO: 353960 - DNA, 18 bp, Homo sapiens
gctctctggccttttcct

SEQ ID NO: 353961 - DNA, 19 bp, Homo sapiens
gctctctggccttttccta

SEQ ID NO: 353962 - DNA, 17 bp, Homo sapiens
gctctgaaagctgcttc

SEQ ID NO: 353963 - DNA, 15 bp, Homo sapiens
gctctgaatctctca

SEQ ID NO: 353964 - DNA, 17 bp, Homo sapiens
gctctgaatctctcaaa

SEQ ID NO: 353965 - DNA, 21 bp, Homo sapiens
gctctgaatctctcaaaatgt

SEQ ID NO: 353966 - DNA, 19 bp, Homo sapiens
gctctgacccaagtggggc

SEQ ID NO: 353967 - DNA, 18 bp, Homo sapiens
gctctgacctgcccccgc

SEQ ID NO: 353968 - DNA, 14 bp, Homo sapiens
gctctgcacagatg

SEQ ID NO: 353969 - DNA, 21 bp, Homo sapiens
gctctgcagcccacagaggac

SEQ ID NO: 353970 - DNA, 23 bp, Homo sapiens
gctctgcagcccacagaggacag

SEQ ID NO: 353971 - DNA, 14 bp, Homo sapiens
gctctgcatacaca

SEQ ID NO: 353972 - DNA, 22 bp, Homo sapiens
gctctgccaccctacctgttca

SEQ ID NO: 353973 - DNA, 23 bp, Homo sapiens
gctctgccaccctacctgttcag

SEQ ID NO: 353974 - DNA, 14 bp, Homo sapiens
gctctgccatcagc

SEQ ID NO: 353975 - DNA, 20 bp, Homo sapiens
gctctgccatcagcccctgc

SEQ ID NO: 353976 - DNA, 12 bp, Homo sapiens
gctctgcccaga

SEQ ID NO: 353977 - DNA, 13 bp, Homo sapiens
gctctgcccagag

SEQ ID NO: 353978 - DNA, 14 bp, Homo sapiens
gctctgccccaagc

SEQ ID NO: 353979 - DNA, 11 bp, Homo sapiens
gctctgcccct

SEQ ID NO: 353980 - DNA, 16 bp, Homo sapiens
gctctggaagcctgct

SEQ ID NO: 353981 - DNA, 21 bp, Homo sapiens
gctctggaagcctgctgattt

SEQ ID NO: 353982 - DNA, 23 bp, Homo sapiens
gctctggagccacctgtcccacc

SEQ ID NO: 353983 - DNA, 15 bp, Homo sapiens
gctctggatcctgca

SEQ ID NO: 353984 - DNA, 22 bp, Homo sapiens
gctctggcaggtggccagggct

SEQ ID NO: 353985 - DNA, 13 bp, Homo sapiens
gctctggccacaa

SEQ ID NO: 353986 - DNA, 12 bp, Homo sapiens
gctctggccacc

SEQ ID NO: 353987 - DNA, 14 bp, Homo sapiens
gctctggccaccct

SEQ ID NO: 353988 - DNA, 17 bp, Homo sapiens
gctctggccaccctggc

SEQ ID NO: 353989 - DNA, 18 bp, Homo sapiens
gctctggccaccctggcc

SEQ ID NO: 353990 - DNA, 21 bp, Homo sapiens
gctctggccaccctggcccgc

SEQ ID NO: 353991 - DNA, 17 bp, Homo sapiens
gctctggcggcttcctg

SEQ ID NO: 353992 - DNA, 23 bp, Homo sapiens
gctctggcggcttcctgtccact

SEQ ID NO: 353993 - DNA, 15 bp, Homo sapiens
gctctggctcacaga

SEQ ID NO: 353994 - DNA, 18 bp, Homo sapiens
gctctggctcacagactg

SEQ ID NO: 353995 - DNA, 22 bp, Homo sapiens
gctctggctcacagactggaga

SEQ ID NO: 353996 - DNA, 23 bp, Homo sapiens
gctctggctcagggcccacctcc

SEQ ID NO: 353997 - DNA, 11 bp, Homo sapiens
gctctggctcc

SEQ ID NO: 353998 - DNA, 15 bp, Homo sapiens
gctctggctccctgg

SEQ ID NO: 353999 - DNA, 20 bp, Homo sapiens
gctctgggctcagggctgga

SEQ ID NO: 354000 - DNA, 21 bp, Homo sapiens
gctctgggctcagggctggag

SEQ ID NO: 354001 - DNA, 17 bp, Homo sapiens
gctctggggatttctgg

SEQ ID NO: 354002 - DNA, 19 bp, Homo sapiens
gctctggggatttctggga

SEQ ID NO: 354003 - DNA, 18 bp, Homo sapiens
gctctggtgggaaaatgt

SEQ ID NO: 354004 - DNA, 14 bp, Homo sapiens
gctctgtattctgc

SEQ ID NO: 354005 - DNA, 15 bp, Homo sapiens
gctctgtgccagaaa

SEQ ID NO: 354006 - DNA, 16 bp, Homo sapiens
gctctgtgcctgggat

SEQ ID NO: 354007 - DNA, 11 bp, Homo sapiens
gctctgtggcc

SEQ ID NO: 354008 - DNA, 22 bp, Homo sapiens
gctctgtggcctgtgtccagca

SEQ ID NO: 354009 - DNA, 17 bp, Homo sapiens
gctctgtgttgccatgt

SEQ ID NO: 354010 - DNA, 17 bp, Homo sapiens
gctctgttacccaggct

SEQ ID NO: 354011 - DNA, 12 bp, Homo sapiens
gctcttaatgtt

SEQ ID NO: 354012 - DNA, 22 bp, Homo sapiens
gctcttagattgggccatggct

SEQ ID NO: 354013 - DNA, 16 bp, Homo sapiens
gctcttagcagcttcc

SEQ ID NO: 354014 - DNA, 17 bp, Homo sapiens
gctcttagcagcttcca

SEQ ID NO: 354015 - DNA, 18 bp, Homo sapiens
gctcttagcagcttccag

SEQ ID NO: 354016 - DNA, 16 bp, Homo sapiens
gctcttagtcctccct

SEQ ID NO: 354017 - DNA, 16 bp, Homo sapiens
gctcttagtttttaaa

SEQ ID NO: 354018 - DNA, 16 bp, Homo sapiens
gctcttcaagctgtcc

SEQ ID NO: 354019 - DNA, 23 bp, Homo sapiens
gctcttcaagctgtcccctctgt

SEQ ID NO: 354020 - DNA, 14 bp, Homo sapiens
gctcttcaccagga

SEQ ID NO: 354021 - DNA, 12 bp, Homo sapiens
gctcttcaggcc

SEQ ID NO: 354022 - DNA, 21 bp, Homo sapiens
gctcttcccccatgtgcctgt

SEQ ID NO: 354023 - DNA, 22 bp, Homo sapiens
gctcttcccccatgtgcctgtc

SEQ ID NO: 354024 - DNA, 22 bp, Homo sapiens
ggcccagcctgtcctggtacag

SEQ ID NO: 354025 - DNA, 16 bp, Homo sapiens
ggcccagcggcccctc

SEQ ID NO: 354026 - DNA, 17 bp, Homo sapiens
ggcccagcggcccctcc

SEQ ID NO: 354027 - DNA, 23 bp, Homo sapiens
ggcccagcggcccctcccacaca

SEQ ID NO: 354028 - DNA, 11 bp, Homo sapiens
ggcccagctga

SEQ ID NO: 354029 - DNA, 12 bp, Homo sapiens
ggcccagctggg

SEQ ID NO: 354030 - DNA, 17 bp, Homo sapiens
ggcccagctgggctctg

SEQ ID NO: 354031 - DNA, 21 bp, Homo sapiens
ggcccagctgggctctgccac

SEQ ID NO: 354032 - DNA, 14 bp, Homo sapiens
ggcccagctgtagc

SEQ ID NO: 354033 - DNA, 15 bp, Homo sapiens
ggcccagctgtagcc

SEQ ID NO: 354034 - DNA, 16 bp, Homo sapiens
ggcccagctgtagcca

SEQ ID NO: 354035 - DNA, 21 bp, Homo sapiens
ggcccagctgtagccatggct

SEQ ID NO: 354036 - DNA, 20 bp, Homo sapiens
ggcccaggaaaaacctgtgg

SEQ ID NO: 354037 - DNA, 17 bp, Homo sapiens
ggcccaggagagccccc

SEQ ID NO: 354038 - DNA, 16 bp, Homo sapiens
ggcccaggcctggagc

SEQ ID NO: 354039 - DNA, 19 bp, Homo sapiens
ggcccaggcctggagcgtt

SEQ ID NO: 354040 - DNA, 16 bp, Homo sapiens
ggcccaggctcccctg

SEQ ID NO: 354041 - DNA, 13 bp, Homo sapiens
ggcccagtagccc

SEQ ID NO: 354042 - DNA, 14 bp, Homo sapiens
ggcccatctcagcc

SEQ ID NO: 354043 - DNA, 22 bp, Homo sapiens
ggcccatgccctccgtcctggc

SEQ ID NO: 354044 - DNA, 14 bp, Homo sapiens
ggcccatggcccca

SEQ ID NO: 354045 - DNA, 18 bp, Homo sapiens
ggcccatggccccagctg

SEQ ID NO: 354046 - DNA, 13 bp, Homo sapiens
ggcccatggtgga

SEQ ID NO: 354047 - DNA, 16 bp, Homo sapiens
ggccccaaaaccacag

SEQ ID NO: 354048 - DNA, 11 bp, Homo sapiens
ggccccaaagc

SEQ ID NO: 354049 - DNA, 16 bp, Homo sapiens
ggccccaaagcccagc

SEQ ID NO: 354050 - DNA, 18 bp, Homo sapiens
ggccccaaagcccagccc

SEQ ID NO: 354051 - DNA, 21 bp, Homo sapiens
ggccccaaagcccagcccggc

SEQ ID NO: 354052 - DNA, 18 bp, Homo sapiens
ggccccacccaccctctg

SEQ ID NO: 354053 - DNA, 16 bp, Homo sapiens
ggccccagaccccagg

SEQ ID NO: 354054 - DNA, 18 bp, Homo sapiens
ggccccagaccccagggc

SEQ ID NO: 354055 - DNA, 12 bp, Homo sapiens
ggccccagagac

SEQ ID NO: 354056 - DNA, 13 bp, Homo sapiens
ggccccagagact

SEQ ID NO: 354057 - DNA, 15 bp, Homo sapiens
ggccccagatctgcc

SEQ ID NO: 354058 - DNA, 18 bp, Homo sapiens
ggccccagatctgcctgg

SEQ ID NO: 354059 - DNA, 21 bp, Homo sapiens
ggccccagatctgcctgggcc

SEQ ID NO: 354060 - DNA, 12 bp, Homo sapiens
ggccccagccaa

SEQ ID NO: 354061 - DNA, 22 bp, Homo sapiens
ggccccagccaagtgccttccg

SEQ ID NO: 354062 - DNA, 17 bp, Homo sapiens
ggccccagcctccaggc

SEQ ID NO: 354063 - DNA, 14 bp, Homo sapiens
ggccccagctggct

SEQ ID NO: 354064 - DNA, 16 bp, Homo sapiens
ggccccagctggctgg

SEQ ID NO: 354065 - DNA, 19 bp, Homo sapiens
ggccccagctggctgggtc

SEQ ID NO: 354066 - DNA, 22 bp, Homo sapiens
ggccccagctgtgactgagggc

SEQ ID NO: 354067 - DNA, 22 bp, Homo sapiens
ggccccaggcggaggggcttgg

SEQ ID NO: 354068 - DNA, 17 bp, Homo sapiens
ggccccaggctcccctg

SEQ ID NO: 354069 - DNA, 18 bp, Homo sapiens
ggccccaggctcccctgg

SEQ ID NO: 354070 - DNA, 13 bp, Homo sapiens
ggccccagggaac

SEQ ID NO: 354071 - DNA, 15 bp, Homo sapiens
ggctgcctctgggag

SEQ ID NO: 354072 - DNA, 15 bp, Homo sapiens
ggctgcctctgggtg

SEQ ID NO: 354073 - DNA, 22 bp, Homo sapiens
ggctgcctctgggtgagtggct

SEQ ID NO: 354074 - DNA, 13 bp, Homo sapiens
ggctgcctgccgc

SEQ ID NO: 354075 - DNA, 18 bp, Homo sapiens
ggctgcctggagaaagga

SEQ ID NO: 354076 - DNA, 14 bp, Homo sapiens
ggctgcgcctgccc

SEQ ID NO: 354077 - DNA, 15 bp, Homo sapiens
ggctgcgcctgcccg

SEQ ID NO: 354078 - DNA, 17 bp, Homo sapiens
ggctgctacccagaacc

SEQ ID NO: 354079 - DNA, 20 bp, Homo sapiens
ggctgctctgtcttggtcct

SEQ ID NO: 354080 - DNA, 11 bp, Homo sapiens
ggctgctgcca

SEQ ID NO: 354081 - DNA, 14 bp, Homo sapiens
ggctgctggaggaa

SEQ ID NO: 354082 - DNA, 18 bp, Homo sapiens
ggcttccaggctcttcct

SEQ ID NO: 354083 - DNA, 18 bp, Homo sapiens
ggcttcccaaaccaagtg

SEQ ID NO: 354084 - DNA, 12 bp, Homo sapiens
ggcttcccagga

SEQ ID NO: 354085 - DNA, 15 bp, Homo sapiens
ggcttcccaggaccc

SEQ ID NO: 354086 - DNA, 14 bp, Homo sapiens
ggcttcccgctcag

SEQ ID NO: 354087 - DNA, 17 bp, Homo sapiens
ggcttcccgctcagccc

SEQ ID NO: 354088 - DNA, 21 bp, Homo sapiens
ggcttcccgctcagccctccc

SEQ ID NO: 354089 - DNA, 14 bp, Homo sapiens
ggcttccctctgct

SEQ ID NO: 354090 - DNA, 15 bp, Homo sapiens
ggcttccctctgctc

SEQ ID NO: 354091 - DNA, 20 bp, Homo sapiens
ggcttccctgacttgcttta

SEQ ID NO: 354092 - DNA, 23 bp, Homo sapiens
ggcttcctccgtccacccaggct

SEQ ID NO: 354093 - DNA, 15 bp, Homo sapiens
ggcttctcctgaccc

SEQ ID NO: 354094 - DNA, 15 bp, Homo sapiens
ggcttgactcaggat

SEQ ID NO: 354095 - DNA, 13 bp, Homo sapiens
ggcttgctccagg

SEQ ID NO: 354096 - DNA, 16 bp, Homo sapiens
ggcttgctccagggtc

SEQ ID NO: 354097 - DNA, 18 bp, Homo sapiens
ggcttgcttgccgagcct

SEQ ID NO: 354098 - DNA, 16 bp, Homo sapiens
ggcttggaagggcgct

SEQ ID NO: 354099 - DNA, 13 bp, Homo sapiens
ggcttggagcaga

SEQ ID NO: 354100 - DNA, 23 bp, Homo sapiens
ggcttggagcagagacggcagcc

SEQ ID NO: 354101 - DNA, 22 bp, Homo sapiens
ggcttggccacaacctgaaaga

SEQ ID NO: 354102 - DNA, 16 bp, Homo sapiens
ggcttgggcccagtag

SEQ ID NO: 354103 - DNA, 23 bp, Homo sapiens
ggcttgggcttccatttgtgtgt

SEQ ID NO: 354104 - DNA, 18 bp, Homo sapiens
ggcttggggtagagagga

SEQ ID NO: 354105 - DNA, 19 bp, Homo sapiens
ggcttggggtagagaggac

SEQ ID NO: 354106 - DNA, 20 bp, Homo sapiens
ggcttggggtagagaggaca

SEQ ID NO: 354107 - DNA, 14 bp, Homo sapiens
ggctttaacaaaac

SEQ ID NO: 354108 - DNA, 16 bp, Homo sapiens
ggctttcatcctgtgt

SEQ ID NO: 354109 - DNA, 22 bp, Homo sapiens
ggctttctccggggtctgtgct

SEQ ID NO: 354110 - DNA, 24 bp, Homo sapiens
ggctttctccggggtctgtgctgt

SEQ ID NO: 354111 - DNA, 14 bp, Homo sapiens
ggctttgcagggag

SEQ ID NO: 354112 - DNA, 19 bp, Homo sapiens
ggctttgcccaacctcagc

SEQ ID NO: 354113 - DNA, 15 bp, Homo sapiens
ggctttggtggcccc

SEQ ID NO: 354114 - DNA, 18 bp, Homo sapiens
ggcttttaaaagcattga

SEQ ID NO: 354115 - DNA, 13 bp, Homo sapiens
ggcttttaagaaa

SEQ ID NO: 354116 - DNA, 13 bp, Homo sapiens
ggcttttcactgc

SEQ ID NO: 354117 - DNA, 14 bp, Homo sapiens
ggcttttcactgct

SEQ ID NO: 354118 - DNA, 15 bp, Homo sapiens
ggcttttcactgctg

SEQ ID NO: 354119 - DNA, 17 bp, Homo sapiens
ggcttttcactgctggc

SEQ ID NO: 354120 - DNA, 17 bp, Homo sapiens
ggcttttcccaccagct

SEQ ID NO: 354121 - DNA, 16 bp, Homo sapiens
ggcttttctctttcct

SEQ ID NO: 354122 - DNA, 17 bp, Homo sapiens
ggcttttctctttcctc

SEQ ID NO: 354123 - DNA, 16 bp, Homo sapiens
gggaaaaaaaaaaaag

SEQ ID NO: 354124 - DNA, 13 bp, Homo sapiens
gggaaaaaaaggt

SEQ ID NO: 354125 - DNA, 23 bp, Homo sapiens
gggaaacagagtccaatttaagg

SEQ ID NO: 354126 - DNA, 21 bp, Homo sapiens
gggaaactcagatgtccaaac

SEQ ID NO: 354127 - DNA, 19 bp, Homo sapiens
gggaaagccagtgactcca

SEQ ID NO: 354128 - DNA, 22 bp, Homo sapiens
gggaaagccagtgactccagga

SEQ ID NO: 354129 - DNA, 19 bp, Homo sapiens
gggaaaggatggagtgttt

SEQ ID NO: 354130 - DNA, 17 bp, Homo sapiens
gggatactgaaaaatac

SEQ ID NO: 354131 - DNA, 23 bp, Homo sapiens
gggatacttagtggtatgtctct

SEQ ID NO: 354132 - DNA, 23 bp, Homo sapiens
gggatcagcctccgccattccaa

SEQ ID NO: 354133 - DNA, 18 bp, Homo sapiens
gggatcctggagcccctg

SEQ ID NO: 354134 - DNA, 20 bp, Homo sapiens
gggatgagcctctccttgcc

SEQ ID NO: 354135 - DNA, 20 bp, Homo sapiens
gggatggagaatgccagccc

SEQ ID NO: 354136 - DNA, 13 bp, Homo sapiens
gggatgggcacag

SEQ ID NO: 354137 - DNA, 17 bp, Homo sapiens
gggatgtttgtgctgca

SEQ ID NO: 354138 - DNA, 20 bp, Homo sapiens
gggattacaggcgtgagcca

SEQ ID NO: 354139 - DNA, 17 bp, Homo sapiens
gggattatgggtcacag

SEQ ID NO: 354140 - DNA, 18 bp, Homo sapiens
gggattatgggtcacagg

SEQ ID NO: 354141 - DNA, 15 bp, Homo sapiens
gggattcaaatgcat

SEQ ID NO: 354142 - DNA, 18 bp, Homo sapiens
gggattcatggctttgta

SEQ ID NO: 354143 - DNA, 18 bp, Homo sapiens
gggatttcaagggactgg

SEQ ID NO: 354144 - DNA, 19 bp, Homo sapiens
gggcaagagctcaggagaa

SEQ ID NO: 354145 - DNA, 23 bp, Homo sapiens
gggcaagagctcaggagaaggcc

SEQ ID NO: 354146 - DNA, 17 bp, Homo sapiens
gggcaagggccgtgccc

SEQ ID NO: 354147 - DNA, 20 bp, Homo sapiens
gggcaaggtgggggagcctg

SEQ ID NO: 354148 - DNA, 23 bp, Homo sapiens
gggcaaggtgggggagcctggag

SEQ ID NO: 354149 - DNA, 22 bp, Homo sapiens
gggcaagtcccttgacctttcc

SEQ ID NO: 354150 - DNA, 14 bp, Homo sapiens
gggcacaccactgc

SEQ ID NO: 354151 - DNA, 21 bp, Homo sapiens
gggcacaccactgccctgcct

SEQ ID NO: 354152 - DNA, 19 bp, Homo sapiens
gggcacaggctgccccacc

SEQ ID NO: 354153 - DNA, 15 bp, Homo sapiens
gggccccggggctgg

SEQ ID NO: 354154 - DNA, 17 bp, Homo sapiens
gggccccggggctggca

SEQ ID NO: 354155 - DNA, 19 bp, Homo sapiens
gggcccctccctctgcccc

SEQ ID NO: 354156 - DNA, 18 bp, Homo sapiens
gggcccctcctctgtgct

SEQ ID NO: 354157 - DNA, 23 bp, Homo sapiens
gggcccctcggcattcacacaca

SEQ ID NO: 354158 - DNA, 12 bp, Homo sapiens
gggcccctctgc

SEQ ID NO: 354159 - DNA, 23 bp, Homo sapiens
gggcccgcctggcagaactgagc

SEQ ID NO: 354160 - DNA, 20 bp, Homo sapiens
gggcccgctcaacctctcag

SEQ ID NO: 354161 - DNA, 22 bp, Homo sapiens
gggccctaggcatactctccag

SEQ ID NO: 354162 - DNA, 23 bp, Homo sapiens
gggccctaggcatactctccagg

SEQ ID NO: 354163 - DNA, 12 bp, Homo sapiens
gggccctcctga

SEQ ID NO: 354164 - DNA, 17 bp, Homo sapiens
gggccctctctctgggc

SEQ ID NO: 354165 - DNA, 21 bp, Homo sapiens
gggccctctctctgggcccag

SEQ ID NO: 354166 - DNA, 13 bp, Homo sapiens
gggccctctgagc

SEQ ID NO: 354167 - DNA, 12 bp, Homo sapiens
gggccctctgcc

SEQ ID NO: 354168 - DNA, 12 bp, Homo sapiens
gggccctctgta

SEQ ID NO: 354169 - DNA, 15 bp, Homo sapiens
gggccctctgtagct

SEQ ID NO: 354170 - DNA, 14 bp, Homo sapiens
gggccctctgtcca

SEQ ID NO: 354171 - DNA, 22 bp, Homo sapiens
gggccctgcaggaggcctggga

SEQ ID NO: 354172 - DNA, 10 bp, Homo sapiens
gggccctgct

SEQ ID NO: 354173 - DNA, 11 bp, Homo sapiens
gggccctgctc

SEQ ID NO: 354174 - DNA, 19 bp, Homo sapiens
gggccctgctcaggcctca

SEQ ID NO: 354175 - DNA, 22 bp, Homo sapiens
gggccctggttcccccaggacc

SEQ ID NO: 354176 - DNA, 17 bp, Homo sapiens
gggcccttggggcctgg

SEQ ID NO: 354177 - DNA, 19 bp, Homo sapiens
gggcccttggggcctggct

SEQ ID NO: 354178 - DNA, 16 bp, Homo sapiens
gggccgagtccaggag

SEQ ID NO: 354179 - DNA, 23 bp, Homo sapiens
gggccgcagggcgctccggcaga

SEQ ID NO: 354180 - DNA, 14 bp, Homo sapiens
gggccgcctcctcc

SEQ ID NO: 354181 - DNA, 18 bp, Homo sapiens
gggccgcctcctccagac

SEQ ID NO: 354182 - DNA, 18 bp, Homo sapiens
gggccggccccaggctcc

SEQ ID NO: 354183 - DNA, 23 bp, Homo sapiens
gggcctagtggcttcagcccctg

SEQ ID NO: 354184 - DNA, 13 bp, Homo sapiens
gggcctcacccag

SEQ ID NO: 354185 - DNA, 14 bp, Homo sapiens
gggcctcacccaga

SEQ ID NO: 354186 - DNA, 16 bp, Homo sapiens
gggcctcacccagaag

SEQ ID NO: 354187 - DNA, 21 bp, Homo sapiens
gggcctcacctttcccacagt

SEQ ID NO: 354188 - DNA, 23 bp, Homo sapiens
gggcctcacctttcccacagtct

SEQ ID NO: 354189 - DNA, 13 bp, Homo sapiens
gggcctcagagac

SEQ ID NO: 354190 - DNA, 16 bp, Homo sapiens
gggcctcccactcctg

SEQ ID NO: 354191 - DNA, 13 bp, Homo sapiens
gggcctcccgtcc

SEQ ID NO: 354192 - DNA, 18 bp, Homo sapiens
gggcctccttgtccaggt

SEQ ID NO: 354193 - DNA, 16 bp, Homo sapiens
gggcctcgggacctca

SEQ ID NO: 354194 - DNA, 14 bp, Homo sapiens
gggcctctgaaatt

SEQ ID NO: 354195 - DNA, 21 bp, Homo sapiens
gggcctctgaaatttcccaca

SEQ ID NO: 354196 - DNA, 14 bp, Homo sapiens
gggcctctgcctcc

SEQ ID NO: 354197 - DNA, 18 bp, Homo sapiens
gggcctctgcctccagga

SEQ ID NO: 354198 - DNA, 16 bp, Homo sapiens
gggcctgatggagagg

SEQ ID NO: 354199 - DNA, 15 bp, Homo sapiens
gggcctgcaggcccc

SEQ ID NO: 354200 - DNA, 18 bp, Homo sapiens
gggcctgcaggccccagc

SEQ ID NO: 354201 - DNA, 17 bp, Homo sapiens
gggcctgctgcgtcaga

SEQ ID NO: 354202 - DNA, 16 bp, Homo sapiens
gggcctggacctgcct

SEQ ID NO: 354203 - DNA, 11 bp, Homo sapiens
gggcctggcct

SEQ ID NO: 354204 - DNA, 18 bp, Homo sapiens
gggcctggcctatttaag

SEQ ID NO: 354205 - DNA, 14 bp, Homo sapiens
gggcctggcctgag

SEQ ID NO: 354206 - DNA, 18 bp, Homo sapiens
gggcctggcctgagctgg

SEQ ID NO: 354207 - DNA, 22 bp, Homo sapiens
gggcctggcctgagctggggcc

SEQ ID NO: 354208 - DNA, 16 bp, Homo sapiens
gggcctggcttgctcc

SEQ ID NO: 354209 - DNA, 20 bp, Homo sapiens
gggcctggcttgctccaggg

SEQ ID NO: 354210 - DNA, 22 bp, Homo sapiens
gggcctggcttgctccagggtc

SEQ ID NO: 354211 - DNA, 13 bp, Homo sapiens
gggcctgggcctc

SEQ ID NO: 354212 - DNA, 13 bp, Homo sapiens
gggcctggtcacc

SEQ ID NO: 354213 - DNA, 14 bp, Homo sapiens
gggcctgtgcagca

SEQ ID NO: 354214 - DNA, 20 bp, Homo sapiens
gggcctgtgcagcagcccag

SEQ ID NO: 354215 - DNA, 12 bp, Homo sapiens
gggcctgttgcc

SEQ ID NO: 354216 - DNA, 14 bp, Homo sapiens
gggcctgttgccct

SEQ ID NO: 354217 - DNA, 18 bp, Homo sapiens
gggccttggcccaggggt

SEQ ID NO: 354218 - DNA, 19 bp, Homo sapiens
gggcctttaaagacttaag

SEQ ID NO: 354219 - DNA, 16 bp, Homo sapiens
gggcctttcctgtgcc

SEQ ID NO: 354220 - DNA, 23 bp, Homo sapiens
gggcgcccattcgtctgtcccag

SEQ ID NO: 354221 - DNA, 14 bp, Homo sapiens
gggcgccctggaag

SEQ ID NO: 354222 - DNA, 15 bp, Homo sapiens
gggcgccctggaagc

SEQ ID NO: 354223 - DNA, 21 bp, Homo sapiens
gggcgctcaggacccaggccc

SEQ ID NO: 354224 - DNA, 17 bp, Homo sapiens
gggcgctccggcagagg

SEQ ID NO: 354225 - DNA, 15 bp, Homo sapiens
gggcgctgagggcag

SEQ ID NO: 354226 - DNA, 16 bp, Homo sapiens
gggcgctgagggcagg

SEQ ID NO: 354227 - DNA, 14 bp, Homo sapiens
gggcggcagagagg

SEQ ID NO: 354228 - DNA, 15 bp, Homo sapiens
gggcggcaggaggga

SEQ ID NO: 354229 - DNA, 13 bp, Homo sapiens
gggcggccaggca

SEQ ID NO: 354230 - DNA, 13 bp, Homo sapiens
gggcgggaggcca

SEQ ID NO: 354231 - DNA, 16 bp, Homo sapiens
gggcgtgacttcagac

SEQ ID NO: 354232 - DNA, 20 bp, Homo sapiens
gggctaacatttaggagaag

SEQ ID NO: 354233 - DNA, 14 bp, Homo sapiens
gggctaaccagttc

SEQ ID NO: 354234 - DNA, 19 bp, Homo sapiens
gggctaactggccccaggc

SEQ ID NO: 354235 - DNA, 20 bp, Homo sapiens
gggctaactggccccaggcg

SEQ ID NO: 354236 - DNA, 13 bp, Homo sapiens
gggctaaggcccc

SEQ ID NO: 354237 - DNA, 20 bp, Homo sapiens
gggctaattctgggaaggga

SEQ ID NO: 354238 - DNA, 13 bp, Homo sapiens
gggctactggcag

SEQ ID NO: 354239 - DNA, 21 bp, Homo sapiens
gggctagtaataaaatattta

SEQ ID NO: 354240 - DNA, 15 bp, Homo sapiens
gggctatggcaaggg

SEQ ID NO: 354241 - DNA, 16 bp, Homo sapiens
gggctatggcaagggg

SEQ ID NO: 354242 - DNA, 18 bp, Homo sapiens
gggctatttctctcccca

SEQ ID NO: 354243 - DNA, 12 bp, Homo sapiens
gggctatttgtg

SEQ ID NO: 354244 - DNA, 20 bp, Homo sapiens
gggctcacggggcctccaac

SEQ ID NO: 354245 - DNA, 22 bp, Homo sapiens
gggctcagctctggctcacaga

SEQ ID NO: 354246 - DNA, 19 bp, Homo sapiens
gggctccacgggggcctag

SEQ ID NO: 354247 - DNA, 13 bp, Homo sapiens
gggctccagcatc

SEQ ID NO: 354248 - DNA, 16 bp, Homo sapiens
gggctccagcatccag

SEQ ID NO: 354249 - DNA, 21 bp, Homo sapiens
gggctccagcatccagcctgt

SEQ ID NO: 354250 - DNA, 13 bp, Homo sapiens
gggctcccttcat

SEQ ID NO: 354251 - DNA, 14 bp, Homo sapiens
gggctcctggctgc

SEQ ID NO: 354252 - DNA, 22 bp, Homo sapiens
gggctcctttctccagccagca

SEQ ID NO: 354253 - DNA, 20 bp, Homo sapiens
gggctcgagtgcccctgcag

SEQ ID NO: 354254 - DNA, 21 bp, Homo sapiens
gggctctccaaaggggctgct

SEQ ID NO: 354255 - DNA, 22 bp, Homo sapiens
gggctctccaaaggggctgctg

SEQ ID NO: 354256 - DNA, 12 bp, Homo sapiens
gggctctgaccc

SEQ ID NO: 354257 - DNA, 15 bp, Homo sapiens
gggctctgcttcctc

SEQ ID NO: 354258 - DNA, 17 bp, Homo sapiens
gggctctggccaccctg

SEQ ID NO: 354259 - DNA, 19 bp, Homo sapiens
gggctctggccaccctggc

SEQ ID NO: 354260 - DNA, 17 bp, Homo sapiens
gggctgagaggatgaac

SEQ ID NO: 354261 - DNA, 15 bp, Homo sapiens
gggctgagagggctg

SEQ ID NO: 354262 - DNA, 16 bp, Homo sapiens
gggctgagagggctgt

SEQ ID NO: 354263 - DNA, 20 bp, Homo sapiens
gggctgagagggctgtggct

SEQ ID NO: 354264 - DNA, 15 bp, Homo sapiens
gggctgagcccctcc

SEQ ID NO: 354265 - DNA, 20 bp, Homo sapiens
gggctgagcccctcctctcc

SEQ ID NO: 354266 - DNA, 22 bp, Homo sapiens
gggctgagcctgaggccttcca

SEQ ID NO: 354267 - DNA, 14 bp, Homo sapiens
gggctgaggaggca

SEQ ID NO: 354268 - DNA, 11 bp, Homo sapiens
gggctgagggg

SEQ ID NO: 354269 - DNA, 12 bp, Homo sapiens
gggctgcaggct

SEQ ID NO: 354270 - DNA, 17 bp, Homo sapiens
gggctgcatcctcagcc

SEQ ID NO: 354271 - DNA, 18 bp, Homo sapiens
gggctgcatgcgggcttc

SEQ ID NO: 354272 - DNA, 18 bp, Homo sapiens
gggctgccatgtgaagag

SEQ ID NO: 354273 - DNA, 14 bp, Homo sapiens
gggggcacagccag

SEQ ID NO: 354274 - DNA, 21 bp, Homo sapiens
gggggcagggcccatctgccg

SEQ ID NO: 354275 - DNA, 18 bp, Homo sapiens
gggggcatgggggaggct

SEQ ID NO: 354276 - DNA, 17 bp, Homo sapiens
gggggccaaggtcctgc

SEQ ID NO: 354277 - DNA, 21 bp, Homo sapiens
gggggcctgagttgaggggct

SEQ ID NO: 354278 - DNA, 19 bp, Homo sapiens
gggggcctttaaagactta

SEQ ID NO: 354279 - DNA, 22 bp, Homo sapiens
gggggcgctcaggacccaggcc

SEQ ID NO: 354280 - DNA, 17 bp, Homo sapiens
gggggctaactggcccc

SEQ ID NO: 354281 - DNA, 19 bp, Homo sapiens
gggggctaactggccccag

SEQ ID NO: 354282 - DNA, 12 bp, Homo sapiens
gggggctccaga

SEQ ID NO: 354283 - DNA, 12 bp, Homo sapiens
gggggctctcca

SEQ ID NO: 354284 - DNA, 16 bp, Homo sapiens
gggggctgcttctcca

SEQ ID NO: 354285 - DNA, 14 bp, Homo sapiens
gggggctggtgcca

SEQ ID NO: 354286 - DNA, 13 bp, Homo sapiens
ggggggagctctg

SEQ ID NO: 354287 - DNA, 18 bp, Homo sapiens
gggggtctatacattcct

SEQ ID NO: 354288 - DNA, 23 bp, Homo sapiens
gggggtctgctctgtgcctggga

SEQ ID NO: 354289 - DNA, 21 bp, Homo sapiens
gggggtgccaaccacctctgg

SEQ ID NO: 354290 - DNA, 23 bp, Homo sapiens
gggggtgcctggtgcgctgtgct

SEQ ID NO: 354291 - DNA, 23 bp, Homo sapiens
gggggtggagagaccagcctttc

SEQ ID NO: 354292 - DNA, 22 bp, Homo sapiens
gggggtgtcacagaggcagtgg

SEQ ID NO: 354293 - DNA, 19 bp, Homo sapiens
gggggttgcagtggagagg

SEQ ID NO: 354294 - DNA, 20 bp, Homo sapiens
ggggtaaatatatgttttga

SEQ ID NO: 354295 - DNA, 15 bp, Homo sapiens
ggggtagagaggaca

SEQ ID NO: 354296 - DNA, 22 bp, Homo sapiens
ggggtcaccttgagaggcatga

SEQ ID NO: 354297 - DNA, 19 bp, Homo sapiens
ggggtccccactccctgtc

SEQ ID NO: 354298 - DNA, 13 bp, Homo sapiens
ggggtcggaagcc

SEQ ID NO: 354299 - DNA, 14 bp, Homo sapiens
ggggtctatacatt

SEQ ID NO: 354300 - DNA, 13 bp, Homo sapiens
ggggtctgcctcc

SEQ ID NO: 354301 - DNA, 23 bp, Homo sapiens
ggggtctgctctgtgcctgggat

SEQ ID NO: 354302 - DNA, 18 bp, Homo sapiens
ggggtgacgcctgccctc

SEQ ID NO: 354303 - DNA, 23 bp, Homo sapiens
ggggtgcctggtgcgctgtgctc

SEQ ID NO: 354304 - DNA, 13 bp, Homo sapiens
ggggtgctgcctt

SEQ ID NO: 354305 - DNA, 19 bp, Homo sapiens
ggggtgctgccttgtagat

SEQ ID NO: 354306 - DNA, 17 bp, Homo sapiens
ggggtgggaggctccca

SEQ ID NO: 354307 - DNA, 15 bp, Homo sapiens
ggggtgggcctctgg

SEQ ID NO: 354308 - DNA, 19 bp, Homo sapiens
ggggtgtcacagaggcagt

SEQ ID NO: 354309 - DNA, 22 bp, Homo sapiens
ggggttgggattgggggctggt

SEQ ID NO: 354310 - DNA, 14 bp, Homo sapiens
gggtaaaaagagaa

SEQ ID NO: 354311 - DNA, 21 bp, Homo sapiens
gggtaaaaagagaaggcaagc

SEQ ID NO: 354312 - DNA, 19 bp, Homo sapiens
gggtaaatatatgttttga

SEQ ID NO: 354313 - DNA, 23 bp, Homo sapiens
gggtaaatatatgttttgagaaa

SEQ ID NO: 354314 - DNA, 13 bp, Homo sapiens
gggtaacactgat

SEQ ID NO: 354315 - DNA, 14 bp, Homo sapiens
gggtacccaggctg

SEQ ID NO: 354316 - DNA, 15 bp, Homo sapiens
gggtacccaggctgg

SEQ ID NO: 354317 - DNA, 15 bp, Homo sapiens
gggtagagaggacag

SEQ ID NO: 354318 - DNA, 14 bp, Homo sapiens
gggtagagctgatc

SEQ ID NO: 354319 - DNA, 14 bp, Homo sapiens
gggtagggggcctg

SEQ ID NO: 354320 - DNA, 20 bp, Homo sapiens
gggtatccaagttggactgg

SEQ ID NO: 354321 - DNA, 21 bp, Homo sapiens
gggtatccaagttggactggg

SEQ ID NO: 354322 - DNA, 21 bp, Homo sapiens
gggtatcccacctccagccca

SEQ ID NO: 354323 - DNA, 20 bp, Homo sapiens
gggtatgaagtgtggggcgg

SEQ ID NO: 354324 - DNA, 12 bp, Homo sapiens
gggtcacaggaa

SEQ ID NO: 354325 - DNA, 13 bp, Homo sapiens
gggtcaccttgag

SEQ ID NO: 354326 - DNA, 15 bp, Homo sapiens
gggtcagctctggcc

SEQ ID NO: 354327 - DNA, 21 bp, Homo sapiens
gggtcaggaacagtggctggg

SEQ ID NO: 354328 - DNA, 21 bp, Homo sapiens
gggtcaggccacggcagccta

SEQ ID NO: 354329 - DNA, 15 bp, Homo sapiens
gggtcatcccagcac

SEQ ID NO: 354330 - DNA, 21 bp, Homo sapiens
gggtcatcccagcacctgcca

SEQ ID NO: 354331 - DNA, 22 bp, Homo sapiens
gggtcatcccagcacctgccag

SEQ ID NO: 354332 - DNA, 16 bp, Homo sapiens
gggtccaggaaggcag

SEQ ID NO: 354333 - DNA, 20 bp, Homo sapiens
gggtcctgcaatctccaggg

SEQ ID NO: 354334 - DNA, 13 bp, Homo sapiens
gggtcctgtgcct

SEQ ID NO: 354335 - DNA, 19 bp, Homo sapiens
gggtcggaagcctgtcctc

SEQ ID NO: 354336 - DNA, 16 bp, Homo sapiens
gggtcgggggaggagc

SEQ ID NO: 354337 - DNA, 19 bp, Homo sapiens
gggtcgggggaggagcacc

SEQ ID NO: 354338 - DNA, 16 bp, Homo sapiens
gggtctatacattcct

SEQ ID NO: 354339 - DNA, 18 bp, Homo sapiens
gggtctccctgagcctgc

SEQ ID NO: 354340 - DNA, 16 bp, Homo sapiens
gggtctgctctgtgcc

SEQ ID NO: 354341 - DNA, 20 bp, Homo sapiens
gggtctgctctgtgcctggg

SEQ ID NO: 354342 - DNA, 19 bp, Homo sapiens
gggtctgctctttctctgc

SEQ ID NO: 354343 - DNA, 20 bp, Homo sapiens
gggtctgtgctgtgcctgct

SEQ ID NO: 354344 - DNA, 21 bp, Homo sapiens
gggtgacagagcaagaccctg

SEQ ID NO: 354345 - DNA, 21 bp, Homo sapiens
gctcttctcctttcacaacct

SEQ ID NO: 354346 - DNA, 13 bp, Homo sapiens
gctcttctgggca

SEQ ID NO: 354347 - DNA, 17 bp, Homo sapiens
gctcttctgggcagagc

SEQ ID NO: 354348 - DNA, 23 bp, Homo sapiens
gctcttgcatcctcctcccaact

SEQ ID NO: 354349 - DNA, 17 bp, Homo sapiens
gctcttggcaggagtgg

SEQ ID NO: 354350 - DNA, 13 bp, Homo sapiens
gctcttggcattt

SEQ ID NO: 354351 - DNA, 17 bp, Homo sapiens
gctcttggtccctggtc

SEQ ID NO: 354352 - DNA, 20 bp, Homo sapiens
gctcttggtccctggtccct

SEQ ID NO: 354353 - DNA, 22 bp, Homo sapiens
gctcttgtggtacacacagatt

SEQ ID NO: 354354 - DNA, 14 bp, Homo sapiens
gctctttcagagag

SEQ ID NO: 354355 - DNA, 15 bp, Homo sapiens
gctctttcagagagg

SEQ ID NO: 354356 - DNA, 16 bp, Homo sapiens
gctctttccttgctca

SEQ ID NO: 354357 - DNA, 18 bp, Homo sapiens
gctctttccttgctcaac

SEQ ID NO: 354358 - DNA, 19 bp, Homo sapiens
gctctttctacatgactgg

SEQ ID NO: 354359 - DNA, 23 bp, Homo sapiens
gctctttctacatgactgggcct

SEQ ID NO: 354360 - DNA, 14 bp, Homo sapiens
gctctttgtggcag

SEQ ID NO: 354361 - DNA, 24 bp, Homo sapiens
gctcttttggtggggagcacttgc

SEQ ID NO: 354362 - DNA, 23 bp, Homo sapiens
gctgaaaaccatctggcctggcc

SEQ ID NO: 354363 - DNA, 14 bp, Homo sapiens
gctgaaaagtgctt

SEQ ID NO: 354364 - DNA, 15 bp, Homo sapiens
gctgaaaatcactat

SEQ ID NO: 354365 - DNA, 13 bp, Homo sapiens
gctgaaataaact

SEQ ID NO: 354366 - DNA, 20 bp, Homo sapiens
gctgaaattatgtcaaatgg

SEQ ID NO: 354367 - DNA, 18 bp, Homo sapiens
gctgaagtctctttttct

SEQ ID NO: 354368 - DNA, 21 bp, Homo sapiens
gctgaattcctttacaactaa

SEQ ID NO: 354369 - DNA, 14 bp, Homo sapiens
gctgaattgaacat

SEQ ID NO: 354370 - DNA, 19 bp, Homo sapiens
gctgacacataatttgaat

SEQ ID NO: 354371 - DNA, 14 bp, Homo sapiens
gctgacacctacca

SEQ ID NO: 354372 - DNA, 18 bp, Homo sapiens
gctgacacctaccatgct

SEQ ID NO: 354373 - DNA, 20 bp, Homo sapiens
gctgacacctaccatgctgc

SEQ ID NO: 354374 - DNA, 19 bp, Homo sapiens
gctgacacctcccttcgtg

SEQ ID NO: 354375 - DNA, 14 bp, Homo sapiens
gctgaccccaggaa

SEQ ID NO: 354376 - DNA, 22 bp, Homo sapiens
gctgaccccaggaagtgggaga

SEQ ID NO: 354377 - DNA, 18 bp, Homo sapiens
gctgacctctgttgtcct

SEQ ID NO: 354378 - DNA, 18 bp, Homo sapiens
gctgacgaggctgggcca

SEQ ID NO: 354379 - DNA, 21 bp, Homo sapiens
gctgacgccaataataaaaaa

SEQ ID NO: 354380 - DNA, 15 bp, Homo sapiens
gctgactagaagggc

SEQ ID NO: 354381 - DNA, 14 bp, Homo sapiens
gctgactcagtcca

SEQ ID NO: 354382 - DNA, 23 bp, Homo sapiens
gctgactcttactaaccaccatt

SEQ ID NO: 354383 - DNA, 20 bp, Homo sapiens
gctgactggccccagggact

SEQ ID NO: 354384 - DNA, 15 bp, Homo sapiens
gctgactggggctgg

SEQ ID NO: 354385 - DNA, 17 bp, Homo sapiens
gctgactggggctgggg

SEQ ID NO: 354386 - DNA, 18 bp, Homo sapiens
gctgactgggggcctctg

SEQ ID NO: 354387 - DNA, 21 bp, Homo sapiens
gctgactgggggcctctgcct

SEQ ID NO: 354388 - DNA, 22 bp, Homo sapiens
gctgactgggggcctctgcctc

SEQ ID NO: 354389 - DNA, 18 bp, Homo sapiens
gctgactgtactcctccc

SEQ ID NO: 354390 - DNA, 15 bp, Homo sapiens
gctgagagccccagc

SEQ ID NO: 354391 - DNA, 17 bp, Homo sapiens
gctgagagccccagctg

SEQ ID NO: 354392 - DNA, 18 bp, Homo sapiens
gctgagagggctgtggct

SEQ ID NO: 354393 - DNA, 16 bp, Homo sapiens
gctgagatgcaccaag

SEQ ID NO: 354394 - DNA, 22 bp, Homo sapiens
gctgagatgcaccaagtacagc

SEQ ID NO: 354395 - DNA, 19 bp, Homo sapiens
gctgagatgtttagtagct

SEQ ID NO: 354396 - DNA, 17 bp, Homo sapiens
gctgagccccctctcct

SEQ ID NO: 354397 - DNA, 17 bp, Homo sapiens
gctgagcccctacccca

SEQ ID NO: 354398 - DNA, 14 bp, Homo sapiens
gctgagcccctcct

SEQ ID NO: 354399 - DNA, 15 bp, Homo sapiens
gctgagcccctcctc

SEQ ID NO: 354400 - DNA, 19 bp, Homo sapiens
gctgagcccctcctctcct

SEQ ID NO: 354401 - DNA, 19 bp, Homo sapiens
gctgagcctactgtctcct

SEQ ID NO: 354402 - DNA, 22 bp, Homo sapiens
gctgagcttagccttgtgccct

SEQ ID NO: 354403 - DNA, 14 bp, Homo sapiens
gctgagcttgagct

SEQ ID NO: 354404 - DNA, 18 bp, Homo sapiens
gctgagcttgagctcccc

SEQ ID NO: 354405 - DNA, 21 bp, Homo sapiens
gctgaggactccctccatgtg

SEQ ID NO: 354406 - DNA, 18 bp, Homo sapiens
gctgaggccattccctgt

SEQ ID NO: 354407 - DNA, 13 bp, Homo sapiens
gctgaggcctgga

SEQ ID NO: 354408 - DNA, 14 bp, Homo sapiens
gctgaggcctggac

SEQ ID NO: 354409 - DNA, 14 bp, Homo sapiens
gctgaggcttgggc

SEQ ID NO: 354410 - DNA, 20 bp, Homo sapiens
gctgagggaccttggagagc

SEQ ID NO: 354411 - DNA, 21 bp, Homo sapiens
gctgagtatgttaagctcttt

SEQ ID NO: 354412 - DNA, 15 bp, Homo sapiens
gctgagtcacctcct

SEQ ID NO: 354413 - DNA, 21 bp, Homo sapiens
gctgagtcggctgggcagggc

SEQ ID NO: 354414 - DNA, 22 bp, Homo sapiens
gctgagtcggctgggcagggcc

SEQ ID NO: 354415 - DNA, 17 bp, Homo sapiens
gctgagtctggctaggg

SEQ ID NO: 354416 - DNA, 18 bp, Homo sapiens
gctgagtggaatgcaggg

SEQ ID NO: 354417 - DNA, 16 bp, Homo sapiens
gctgagtggtccacat

SEQ ID NO: 354418 - DNA, 22 bp, Homo sapiens
gctgagttacttgtctgaggcc

SEQ ID NO: 354419 - DNA, 19 bp, Homo sapiens
gctgatagcatatattcat

SEQ ID NO: 354420 - DNA, 16 bp, Homo sapiens
gctgatcgtgctaaat

SEQ ID NO: 354421 - DNA, 17 bp, Homo sapiens
gctgatgaaactcctga

SEQ ID NO: 354422 - DNA, 16 bp, Homo sapiens
gctgatgtaggagctg

SEQ ID NO: 354423 - DNA, 17 bp, Homo sapiens
gctgatgtaggagctgg

SEQ ID NO: 354424 - DNA, 19 bp, Homo sapiens
gctgatgtccctagaaaac

SEQ ID NO: 354425 - DNA, 23 bp, Homo sapiens
gctgatgttttgtattttgtgtt

SEQ ID NO: 354426 - DNA, 17 bp, Homo sapiens
gctgatttccaggcccc

SEQ ID NO: 354427 - DNA, 21 bp, Homo sapiens
gctgatttccaggcccctgag

SEQ ID NO: 354428 - DNA, 22 bp, Homo sapiens
gctgatttccaggcccctgagg

SEQ ID NO: 354429 - DNA, 23 bp, Homo sapiens
gctgatttccaggcccctgagga

SEQ ID NO: 354430 - DNA, 20 bp, Homo sapiens
gctgattttaacaataacta

SEQ ID NO: 354431 - DNA, 21 bp, Homo sapiens
gctgcaaacattgtacatcca

SEQ ID NO: 354432 - DNA, 12 bp, Homo sapiens
gctgcacagccc

SEQ ID NO: 354433 - DNA, 20 bp, Homo sapiens
gctgcacattcctggccccg

SEQ ID NO: 354434 - DNA, 15 bp, Homo sapiens
gctgcaccagagtga

SEQ ID NO: 354435 - DNA, 22 bp, Homo sapiens
gctgcaccagagtgaaagggct

SEQ ID NO: 354436 - DNA, 14 bp, Homo sapiens
gctgcaccagcagg

SEQ ID NO: 354437 - DNA, 20 bp, Homo sapiens
gctgcacctcctaccctccc

SEQ ID NO: 354438 - DNA, 14 bp, Homo sapiens
gctgcactgcagtg

SEQ ID NO: 354439 - DNA, 19 bp, Homo sapiens
gctgcagacaaaaagaaca

SEQ ID NO: 354440 - DNA, 16 bp, Homo sapiens
gctgcagcaggcagag

SEQ ID NO: 354441 - DNA, 22 bp, Homo sapiens
gctgcagcaggcagaggagagt

SEQ ID NO: 354442 - DNA, 20 bp, Homo sapiens
gctgcagcgcctcctggaca

SEQ ID NO: 354443 - DNA, 15 bp, Homo sapiens
gctgcagctgggctg

SEQ ID NO: 354444 - DNA, 13 bp, Homo sapiens
gctgcagcttggg

SEQ ID NO: 354445 - DNA, 17 bp, Homo sapiens
gctgcaggatccttgcc

SEQ ID NO: 354446 - DNA, 21 bp, Homo sapiens
gctgcaggtacttcctcctga

SEQ ID NO: 354447 - DNA, 21 bp, Homo sapiens
gctgcatccgtgagcagtgtg

SEQ ID NO: 354448 - DNA, 18 bp, Homo sapiens
gctgcatcctcagcccca

SEQ ID NO: 354449 - DNA, 23 bp, Homo sapiens
gctgcatcctcagccccagggcc

SEQ ID NO: 354450 - DNA, 16 bp, Homo sapiens
gctgcatggacgcctg

SEQ ID NO: 354451 - DNA, 22 bp, Homo sapiens
gctgcatggggtggggtagggc

SEQ ID NO: 354452 - DNA, 15 bp, Homo sapiens
gctgccaaattttgg

SEQ ID NO: 354453 - DNA, 18 bp, Homo sapiens
gctgccaaggccagagtg

SEQ ID NO: 354454 - DNA, 22 bp, Homo sapiens
gctgccaaggccagagtggcct

SEQ ID NO: 354455 - DNA, 23 bp, Homo sapiens
gctgccaaggccagagtggcctg

SEQ ID NO: 354456 - DNA, 18 bp, Homo sapiens
gctgccacacttcaggct

SEQ ID NO: 354457 - DNA, 22 bp, Homo sapiens
gctgccacacttcaggctcttc

SEQ ID NO: 354458 - DNA, 16 bp, Homo sapiens
gctgccaccacgtctg

SEQ ID NO: 354459 - DNA, 10 bp, Homo sapiens
gctgccaggc

SEQ ID NO: 354460 - DNA, 17 bp, Homo sapiens
gctgccataattctaag

SEQ ID NO: 354461 - DNA, 18 bp, Homo sapiens
gctgccatttttgcaaac

SEQ ID NO: 354462 - DNA, 17 bp, Homo sapiens
gctgcccacacacccca

SEQ ID NO: 354463 - DNA, 19 bp, Homo sapiens
gctgcccacaccaccgccc

SEQ ID NO: 354464 - DNA, 14 bp, Homo sapiens
gctgcccacggcca

SEQ ID NO: 354465 - DNA, 18 bp, Homo sapiens
gctgcccacggccaccca

SEQ ID NO: 354466 - DNA, 19 bp, Homo sapiens
gctgcccacggccacccac

SEQ ID NO: 354467 - DNA, 19 bp, Homo sapiens
gctgcccagccctcccagc

SEQ ID NO: 354468 - DNA, 12 bp, Homo sapiens
gctgcccaggct

SEQ ID NO: 354469 - DNA, 16 bp, Homo sapiens
gctgcccaggctctgc

SEQ ID NO: 354470 - DNA, 14 bp, Homo sapiens
gctgccccaacctg

SEQ ID NO: 354471 - DNA, 21 bp, Homo sapiens
gctgcccccgctcatgggccc

SEQ ID NO: 354472 - DNA, 15 bp, Homo sapiens
ggcattgggctgaca

SEQ ID NO: 354473 - DNA, 20 bp, Homo sapiens
ggcattggttccctttgctc

SEQ ID NO: 354474 - DNA, 21 bp, Homo sapiens
ggcattttcctcgcctaggcc

SEQ ID NO: 354475 - DNA, 20 bp, Homo sapiens
ggccaaagtcagtaggagag

SEQ ID NO: 354476 - DNA, 21 bp, Homo sapiens
ggccaaattatttgtgtaata

SEQ ID NO: 354477 - DNA, 15 bp, Homo sapiens
ggccaacaccaggga

SEQ ID NO: 354478 - DNA, 19 bp, Homo sapiens
ggccaacgtggacctgcct

SEQ ID NO: 354479 - DNA, 23 bp, Homo sapiens
ggccaagacttggcaacagaagc

SEQ ID NO: 354480 - DNA, 12 bp, Homo sapiens
ggccaagcctgc

SEQ ID NO: 354481 - DNA, 17 bp, Homo sapiens
ggccaaggactgccgac

SEQ ID NO: 354482 - DNA, 20 bp, Homo sapiens
ggccaagtgcaggctggcac

SEQ ID NO: 354483 - DNA, 20 bp, Homo sapiens
ggccacaatcctccccacca

SEQ ID NO: 354484 - DNA, 13 bp, Homo sapiens
ggccacacccagg

SEQ ID NO: 354485 - DNA, 17 bp, Homo sapiens
ggccacacgctgcccag

SEQ ID NO: 354486 - DNA, 19 bp, Homo sapiens
ggccacacgctgcccaggc

SEQ ID NO: 354487 - DNA, 20 bp, Homo sapiens
ggccacacgctgcccaggct

SEQ ID NO: 354488 - DNA, 16 bp, Homo sapiens
ggccacagcaggactg

SEQ ID NO: 354489 - DNA, 16 bp, Homo sapiens
ggccacagccacctcc

SEQ ID NO: 354490 - DNA, 17 bp, Homo sapiens
ggccacagctgctggag

SEQ ID NO: 354491 - DNA, 12 bp, Homo sapiens
ggccaccagctc

SEQ ID NO: 354492 - DNA, 12 bp, Homo sapiens
ggccacccacca

SEQ ID NO: 354493 - DNA, 16 bp, Homo sapiens
ggccacccaccagggc

SEQ ID NO: 354494 - DNA, 23 bp, Homo sapiens
ggccacccactgtggggcaagcc

SEQ ID NO: 354495 - DNA, 20 bp, Homo sapiens
ggccaccccaaaccccagcc

SEQ ID NO: 354496 - DNA, 23 bp, Homo sapiens
ggccacccgttctgctggcctgg

SEQ ID NO: 354497 - DNA, 15 bp, Homo sapiens
ggccaccctccttcc

SEQ ID NO: 354498 - DNA, 16 bp, Homo sapiens
ggccaccctccttccc

SEQ ID NO: 354499 - DNA, 14 bp, Homo sapiens
ggccaccctggccc

SEQ ID NO: 354500 - DNA, 15 bp, Homo sapiens
ggccaccctggcccg

SEQ ID NO: 354501 - DNA, 20 bp, Homo sapiens
ggccacccttcacgctggct

SEQ ID NO: 354502 - DNA, 10 bp, Homo sapiens
ggccacctgc

SEQ ID NO: 354503 - DNA, 11 bp, Homo sapiens
ggccacctgca

SEQ ID NO: 354504 - DNA, 14 bp, Homo sapiens
ggccacctgcaggt

SEQ ID NO: 354505 - DNA, 22 bp, Homo sapiens
ggccacctgcccccttctccca

SEQ ID NO: 354506 - DNA, 23 bp, Homo sapiens
ggccacctgcccccttctcccac

SEQ ID NO: 354507 - DNA, 13 bp, Homo sapiens
ggccacgcagcca

SEQ ID NO: 354508 - DNA, 15 bp, Homo sapiens
ggccacgccccagcc

SEQ ID NO: 354509 - DNA, 17 bp, Homo sapiens
ggccacgccccagcccg

SEQ ID NO: 354510 - DNA, 14 bp, Homo sapiens
ggccacgctccctc

SEQ ID NO: 354511 - DNA, 23 bp, Homo sapiens
ggccacgggggaggccgaggcag

SEQ ID NO: 354512 - DNA, 21 bp, Homo sapiens
ggccacgtatagtcctagctg

SEQ ID NO: 354513 - DNA, 13 bp, Homo sapiens
ggccactccctgc

SEQ ID NO: 354514 - DNA, 14 bp, Homo sapiens
ggccactccctgcc

SEQ ID NO: 354515 - DNA, 11 bp, Homo sapiens
ggccactctgc

SEQ ID NO: 354516 - DNA, 13 bp, Homo sapiens
ggccactgacctc

SEQ ID NO: 354517 - DNA, 21 bp, Homo sapiens
ggccactgcagtcacccctgt

SEQ ID NO: 354518 - DNA, 22 bp, Homo sapiens
ggccactgccctctccacaccc

SEQ ID NO: 354519 - DNA, 22 bp, Homo sapiens
ggccactggcatctctggagtg

SEQ ID NO: 354520 - DNA, 13 bp, Homo sapiens
ggccactgtggcc

SEQ ID NO: 354521 - DNA, 20 bp, Homo sapiens
ggccactgtggccagagctg

SEQ ID NO: 354522 - DNA, 20 bp, Homo sapiens
ggccagaaggagggcagagc

SEQ ID NO: 354523 - DNA, 21 bp, Homo sapiens
ggccagaaggagggcagagcc

SEQ ID NO: 354524 - DNA, 24 bp, Homo sapiens
ggccagaaggagggcagagccatg

SEQ ID NO: 354525 - DNA, 18 bp, Homo sapiens
ggggctattccctggaga

SEQ ID NO: 354526 - DNA, 21 bp, Homo sapiens
ggggctcctttctccagccag

SEQ ID NO: 354527 - DNA, 22 bp, Homo sapiens
ggggctcctttctccagccagc

SEQ ID NO: 354528 - DNA, 22 bp, Homo sapiens
ggggctcgagtgcccctgcagg

SEQ ID NO: 354529 - DNA, 18 bp, Homo sapiens
ggggctcgtggccttccc

SEQ ID NO: 354530 - DNA, 12 bp, Homo sapiens
ggggctctggga

SEQ ID NO: 354531 - DNA, 12 bp, Homo sapiens
ggggctgagcct

SEQ ID NO: 354532 - DNA, 21 bp, Homo sapiens
ggggctgcatcctcagcccca

SEQ ID NO: 354533 - DNA, 15 bp, Homo sapiens
ggggctgctggggca

SEQ ID NO: 354534 - DNA, 21 bp, Homo sapiens
ggggctgcttctccacctccc

SEQ ID NO: 354535 - DNA, 17 bp, Homo sapiens
ggggctggcactgactg

SEQ ID NO: 354536 - DNA, 11 bp, Homo sapiens
ggggctggccc

SEQ ID NO: 354537 - DNA, 14 bp, Homo sapiens
ggggctggccctgc

SEQ ID NO: 354538 - DNA, 16 bp, Homo sapiens
ggggctggccctgccc

SEQ ID NO: 354539 - DNA, 19 bp, Homo sapiens
ggggctggccctgccctcc

SEQ ID NO: 354540 - DNA, 19 bp, Homo sapiens
ggggctggccttcctgccc

SEQ ID NO: 354541 - DNA, 13 bp, Homo sapiens
ggggctgggcaga

SEQ ID NO: 354542 - DNA, 22 bp, Homo sapiens
ggggctgtggccgtctcctccc

SEQ ID NO: 354543 - DNA, 21 bp, Homo sapiens
ggggcttcaccagtctgtcta

SEQ ID NO: 354544 - DNA, 17 bp, Homo sapiens
ggggcttggaagggcgc

SEQ ID NO: 354545 - DNA, 16 bp, Homo sapiens
ggggcttggagcagag

SEQ ID NO: 354546 - DNA, 15 bp, Homo sapiens
ggggctttggaagct

SEQ ID NO: 354547 - DNA, 19 bp, Homo sapiens
gggggaaaaaaaaaaaaga

SEQ ID NO: 354548 - DNA, 17 bp, Homo sapiens
gggggaaggccttgctg

SEQ ID NO: 354549 - DNA, 17 bp, Homo sapiens
gggggattcaaatgcat

SEQ ID NO: 354550 - DNA, 21 bp, Homo sapiens
gggggcaagagctcaggagaa

SEQ ID NO: 354551 - DNA, 13 bp, Homo sapiens
gtaaggaatgatt

SEQ ID NO: 354552 - DNA, 14 bp, Homo sapiens
gtaaggaggagaaa

SEQ ID NO: 354553 - DNA, 15 bp, Homo sapiens
gtaaggaggagaaaa

SEQ ID NO: 354554 - DNA, 16 bp, Homo sapiens
gtaaggaggagaaaat

SEQ ID NO: 354555 - DNA, 13 bp, Homo sapiens
gtaaggtgcagtt

SEQ ID NO: 354556 - DNA, 17 bp, Homo sapiens
gtaagtaaatgtctgtg

SEQ ID NO: 354557 - DNA, 13 bp, Homo sapiens
gtaagtaattatc

SEQ ID NO: 354558 - DNA, 22 bp, Homo sapiens
gtaagtggggttgcaaccactg

SEQ ID NO: 354559 - DNA, 20 bp, Homo sapiens
gtaagtgtgagtaagagctg

SEQ ID NO: 354560 - DNA, 21 bp, Homo sapiens
gtaagtgtgagtaagagctgg

SEQ ID NO: 354561 - DNA, 14 bp, Homo sapiens
gtaagttactgggc

SEQ ID NO: 354562 - DNA, 22 bp, Homo sapiens
gtaagttctgaaaactgtttat

SEQ ID NO: 354563 - DNA, 19 bp, Homo sapiens
gtaagtttatgtctaaaga

SEQ ID NO: 354564 - DNA, 16 bp, Homo sapiens
gtaataaactgtgttt

SEQ ID NO: 354565 - DNA, 22 bp, Homo sapiens
gtaataactgtgaagtttacat

SEQ ID NO: 354566 - DNA, 13 bp, Homo sapiens
gtaataggaagaa

SEQ ID NO: 354567 - DNA, 19 bp, Homo sapiens
gtaataggaagaacagtac

SEQ ID NO: 354568 - DNA, 15 bp, Homo sapiens
gtacccacctgagct

SEQ ID NO: 354569 - DNA, 17 bp, Homo sapiens
gtacccacctgagcttt

SEQ ID NO: 354570 - DNA, 11 bp, Homo sapiens
gtacccagcca

SEQ ID NO: 354571 - DNA, 12 bp, Homo sapiens
gtacccagccac

SEQ ID NO: 354572 - DNA, 14 bp, Homo sapiens
gtacccccctgaga

SEQ ID NO: 354573 - DNA, 14 bp, Homo sapiens
gtacctataaagta

SEQ ID NO: 354574 - DNA, 20 bp, Homo sapiens
gtacctataaagtaaagcta

SEQ ID NO: 354575 - DNA, 21 bp, Homo sapiens
gtacctataaagtaaagctaa

SEQ ID NO: 354576 - DNA, 15 bp, Homo sapiens
gtacctctctctgct

SEQ ID NO: 354577 - DNA, 15 bp, Homo sapiens
gtacctgatgtacct

SEQ ID NO: 354578 - DNA, 15 bp, Homo sapiens
gtacctgtaggaaac

SEQ ID NO: 354579 - DNA, 21 bp, Homo sapiens
gtacctgtagtgagaaactga

SEQ ID NO: 354580 - DNA, 12 bp, Homo sapiens
gtacctgtgcct

SEQ ID NO: 354581 - DNA, 13 bp, Homo sapiens
gtacgtgggagag

SEQ ID NO: 354582 - DNA, 19 bp, Homo sapiens
gtacgtgggagaggcagaa

SEQ ID NO: 354583 - DNA, 18 bp, Homo sapiens
gtactaaaactagataac

SEQ ID NO: 354584 - DNA, 15 bp, Homo sapiens
gtactacatttgcat

SEQ ID NO: 354585 - DNA, 21 bp, Homo sapiens
gtactacatttgcatgccttt

SEQ ID NO: 354586 - DNA, 17 bp, Homo sapiens
gtactactctccagctt

SEQ ID NO: 354587 - DNA, 13 bp, Homo sapiens
gtactactgtaga

SEQ ID NO: 354588 - DNA, 15 bp, Homo sapiens
gtactagaagctgat

SEQ ID NO: 354589 - DNA, 22 bp, Homo sapiens
gtactagggggaagtgacaagg

SEQ ID NO: 354590 - DNA, 13 bp, Homo sapiens
gtactatatctgt

SEQ ID NO: 354591 - DNA, 15 bp, Homo sapiens
gtactatttaactga

SEQ ID NO: 354592 - DNA, 18 bp, Homo sapiens
gtactatttaactgacta

SEQ ID NO: 354593 - DNA, 17 bp, Homo sapiens
gtactcacttttcactt

SEQ ID NO: 354594 - DNA, 15 bp, Homo sapiens
gtactccagcctggg

SEQ ID NO: 354595 - DNA, 15 bp, Homo sapiens
gtactcccccagccc

SEQ ID NO: 354596 - DNA, 21 bp, Homo sapiens
gtactcctgcaaaattttata

SEQ ID NO: 354597 - DNA, 11 bp, Homo sapiens
gtactctccta

SEQ ID NO: 354598 - DNA, 18 bp, Homo sapiens
gtactctttggctttgtt

SEQ ID NO: 354599 - DNA, 16 bp, Homo sapiens
gtactgagccttgtaa

SEQ ID NO: 354600 - DNA, 17 bp, Homo sapiens
gtactgagttctcatcc

SEQ ID NO: 354601 - DNA, 23 bp, Homo sapiens
gtactgggaatggaaggctttgc

SEQ ID NO: 354602 - DNA, 14 bp, Homo sapiens
gtactgtagttttt

SEQ ID NO: 354603 - DNA, 22 bp, Homo sapiens
gtactgtgctgattcaataaaa

SEQ ID NO: 354604 - DNA, 14 bp, Homo sapiens
gtacttcagtcttg

SEQ ID NO: 354605 - DNA, 21 bp, Homo sapiens
gtacttcataagatattcttt

SEQ ID NO: 354606 - DNA, 21 bp, Homo sapiens
gtacttcttcatccatagaca

SEQ ID NO: 354607 - DNA, 22 bp, Homo sapiens
gtacttgaaatctaggattatt

SEQ ID NO: 354608 - DNA, 21 bp, Homo sapiens
gtacttgaccgtttttatatt

SEQ ID NO: 354609 - DNA, 16 bp, Homo sapiens
gtacttgctcaataaa

SEQ ID NO: 354610 - DNA, 17 bp, Homo sapiens
gtacttgtgtttgctta

SEQ ID NO: 354611 - DNA, 19 bp, Homo sapiens
gtactttatattttctata

SEQ ID NO: 354612 - DNA, 22 bp, Homo sapiens
gtactttatgaaaaaaatatat

SEQ ID NO: 354613 - DNA, 20 bp, Homo sapiens
gtactttccttattggcaac

SEQ ID NO: 354614 - DNA, 23 bp, Homo sapiens
gtactttgatttacagtgcctgt

SEQ ID NO: 354615 - DNA, 23 bp, Homo sapiens
gtactttgtttttccatgtgttt

SEQ ID NO: 354616 - DNA, 16 bp, Homo sapiens
gtagaaataatatgca

SEQ ID NO: 354617 - DNA, 18 bp, Homo sapiens
gtagaaattgttcctgat

SEQ ID NO: 354618 - DNA, 22 bp, Homo sapiens
gtagaaattttatctcttcttc

SEQ ID NO: 354619 - DNA, 11 bp, Homo sapiens
gtcatctgtca

SEQ ID NO: 354620 - DNA, 13 bp, Homo sapiens
gtcatcttgagct

SEQ ID NO: 354621 - DNA, 13 bp, Homo sapiens
gtcatcttttaga

SEQ ID NO: 354622 - DNA, 16 bp, Homo sapiens
gtcatctttttcccct

SEQ ID NO: 354623 - DNA, 22 bp, Homo sapiens
gtcatgaattcatactctgttg

SEQ ID NO: 354624 - DNA, 18 bp, Homo sapiens
gtcatgacatttctcaaa

SEQ ID NO: 354625 - DNA, 20 bp, Homo sapiens
gtcatgcgtccactttccct

SEQ ID NO: 354626 - DNA, 17 bp, Homo sapiens
gtcatgcttcagttgta

SEQ ID NO: 354627 - DNA, 21 bp, Homo sapiens
gtcatggagaatctgctgcat

SEQ ID NO: 354628 - DNA, 20 bp, Homo sapiens
gtcatggcttaatgtttatt

SEQ ID NO: 354629 - DNA, 21 bp, Homo sapiens
gtcatgggaacgcagcctcca

SEQ ID NO: 354630 - DNA, 18 bp, Homo sapiens
gtcatggtgatgcaagtc

SEQ ID NO: 354631 - DNA, 12 bp, Homo sapiens
gtcatgtgtata

SEQ ID NO: 354632 - DNA, 14 bp, Homo sapiens
gtcattatgtagaa

SEQ ID NO: 354633 - DNA, 14 bp, Homo sapiens
gtcattatttaaag

SEQ ID NO: 354634 - DNA, 22 bp, Homo sapiens
gtcattatttgataacattttg

SEQ ID NO: 354635 - DNA, 14 bp, Homo sapiens
gtcatttataaaac

SEQ ID NO: 354636 - DNA, 16 bp, Homo sapiens
gtcatttctactttga

SEQ ID NO: 354637 - DNA, 15 bp, Homo sapiens
gtcatttctcttttt

SEQ ID NO: 354638 - DNA, 21 bp, Homo sapiens
gtcatttgcgcacaacttaaa

SEQ ID NO: 354639 - DNA, 13 bp, Homo sapiens
gtcatttgctaat

SEQ ID NO: 354640 - DNA, 15 bp, Homo sapiens
gtcatttgctaatga

SEQ ID NO: 354641 - DNA, 17 bp, Homo sapiens
gtcatttggtggctcta

SEQ ID NO: 354642 - DNA, 19 bp, Homo sapiens
gtcatttggtggctctaac

SEQ ID NO: 354643 - DNA, 20 bp, Homo sapiens
gtccaaaggagtgcatggcc

SEQ ID NO: 354644 - DNA, 21 bp, Homo sapiens
gtccaaaggagtgcatggcca

SEQ ID NO: 354645 - DNA, 19 bp, Homo sapiens
gtccaaatgtgatcaactg

SEQ ID NO: 354646 - DNA, 13 bp, Homo sapiens
gtccaaattcttt

SEQ ID NO: 354647 - DNA, 20 bp, Homo sapiens
gtccaacaactccaggaaaa

SEQ ID NO: 354648 - DNA, 15 bp, Homo sapiens
gtccaacagagtgga

SEQ ID NO: 354649 - DNA, 22 bp, Homo sapiens
gtccaaccccggggcatggaca

SEQ ID NO: 354650 - DNA, 20 bp, Homo sapiens
gtccaacgtggggcagcaca

SEQ ID NO: 354651 - DNA, 13 bp, Homo sapiens
gtccaagggccat

SEQ ID NO: 354652 - DNA, 16 bp, Homo sapiens
gtccaagtgtgtgtgc

SEQ ID NO: 354653 - DNA, 22 bp, Homo sapiens
gtccaagttcttcacctctatc

SEQ ID NO: 354654 - DNA, 18 bp, Homo sapiens
gtccaattccagagctgt

SEQ ID NO: 354655 - DNA, 13 bp, Homo sapiens
gtccacaaatgtc

SEQ ID NO: 354656 - DNA, 14 bp, Homo sapiens
gtccacaaatgtcc

SEQ ID NO: 354657 - DNA, 15 bp, Homo sapiens
gtccacaaatgtcct

SEQ ID NO: 354658 - DNA, 20 bp, Homo sapiens
gtccacaaatgtcctcagag

SEQ ID NO: 354659 - DNA, 21 bp, Homo sapiens
gtccacaaatgtcctcagagg

SEQ ID NO: 354660 - DNA, 15 bp, Homo sapiens
gtccacacaccacag

SEQ ID NO: 354661 - DNA, 19 bp, Homo sapiens
gtccacaggggcaggcctg

SEQ ID NO: 354662 - DNA, 21 bp, Homo sapiens
gtccacaggggcaggcctggg

SEQ ID NO: 354663 - DNA, 12 bp, Homo sapiens
gtccacattcta

SEQ ID NO: 354664 - DNA, 20 bp, Homo sapiens
gtccacattctacttcagct

SEQ ID NO: 354665 - DNA, 22 bp, Homo sapiens
gtccacattctgctgcccccag

SEQ ID NO: 354666 - DNA, 15 bp, Homo sapiens
gtccacccaggctgc

SEQ ID NO: 354667 - DNA, 16 bp, Homo sapiens
gtccacccaggctgca

SEQ ID NO: 354668 - DNA, 18 bp, Homo sapiens
gtccacccccattgtgaa

SEQ ID NO: 354669 - DNA, 18 bp, Homo sapiens
gtccaccccgtcccggcc

SEQ ID NO: 354670 - DNA, 19 bp, Homo sapiens
gtccaccccgtcccggccc

SEQ ID NO: 354671 - DNA, 17 bp, Homo sapiens
gtccaccctgcagccag

SEQ ID NO: 354672 - DNA, 15 bp, Homo sapiens
gtccacggctctagg

SEQ ID NO: 354673 - DNA, 22 bp, Homo sapiens
gtccactacgctcctgtctcca

SEQ ID NO: 354674 - DNA, 18 bp, Homo sapiens
gtccactctcggggccct

SEQ ID NO: 354675 - DNA, 21 bp, Homo sapiens
gtccactctcggggcccttgg

SEQ ID NO: 354676 - DNA, 15 bp, Homo sapiens
gtccactttcccttc

SEQ ID NO: 354677 - DNA, 22 bp, Homo sapiens
gtccagaagaaattatttaata

SEQ ID NO: 354678 - DNA, 15 bp, Homo sapiens
gtccagaagaatatt

SEQ ID NO: 354679 - DNA, 22 bp, Homo sapiens
gtccagaagaatattcaggact

SEQ ID NO: 354680 - DNA, 12 bp, Homo sapiens
gtccagacctgg

SEQ ID NO: 354681 - DNA, 14 bp, Homo sapiens
gtccagacctgggc

SEQ ID NO: 354682 - DNA, 17 bp, Homo sapiens
gtccagacctgggccct

SEQ ID NO: 354683 - DNA, 19 bp, Homo sapiens
gtccagacctgggccctgg

SEQ ID NO: 354684 - DNA, 21 bp, Homo sapiens
gtccagagacatgggcctccc

SEQ ID NO: 354685 - DNA, 23 bp, Homo sapiens
gtccagatgtgcaggctcctcct

SEQ ID NO: 354686 - DNA, 16 bp, Homo sapiens
gtccagctctcccctg

SEQ ID NO: 354687 - DNA, 17 bp, Homo sapiens
gtccagctctcccctgc

SEQ ID NO: 354688 - DNA, 20 bp, Homo sapiens
gtccagctctcccctgcgca

SEQ ID NO: 354689 - DNA, 18 bp, Homo sapiens
gtccaggaaggcagctgc

SEQ ID NO: 354690 - DNA, 19 bp, Homo sapiens
gtccaggaaggcagctgct

SEQ ID NO: 354691 - DNA, 17 bp, Homo sapiens
gtccaggagaccttcca

SEQ ID NO: 354692 - DNA, 18 bp, Homo sapiens
gtccaggagccccagcca

SEQ ID NO: 354693 - DNA, 19 bp, Homo sapiens
gtccaggagccccagccag

SEQ ID NO: 354694 - DNA, 11 bp, Homo sapiens
gtccaggccac

SEQ ID NO: 354695 - DNA, 13 bp, Homo sapiens
gtccaggccactg

SEQ ID NO: 354696 - DNA, 14 bp, Homo sapiens
gtccagggcttcag

SEQ ID NO: 354697 - DNA, 17 bp, Homo sapiens
gtccaggtcgggctcag

SEQ ID NO: 354698 - DNA, 23 bp, Homo sapiens
gtccaggtcgggctcagctctgg

SEQ ID NO: 354699 - DNA, 15 bp, Homo sapiens
gtccagtcctcacat

SEQ ID NO: 354700 - DNA, 17 bp, Homo sapiens
gtccagtgacctgctgg

SEQ ID NO: 354701 - DNA, 24 bp, Homo sapiens
gtccagtgggaggtgagaccacct

SEQ ID NO: 354702 - DNA, 15 bp, Homo sapiens
gtccataagagaaat

SEQ ID NO: 354703 - DNA, 20 bp, Homo sapiens
gtccatatcagacctctgat

SEQ ID NO: 354704 - DNA, 16 bp, Homo sapiens
gtccatcagtgcatga

SEQ ID NO: 354705 - DNA, 13 bp, Homo sapiens
gtccatctctctc

SEQ ID NO: 354706 - DNA, 14 bp, Homo sapiens
gtccatctctctcc

SEQ ID NO: 354707 - DNA, 16 bp, Homo sapiens
gtccatctctctccct

SEQ ID NO: 354708 - DNA, 14 bp, Homo sapiens
gtccatctgtctgt

SEQ ID NO: 354709 - DNA, 18 bp, Homo sapiens
gtccatggcaccagcccc

SEQ ID NO: 354710 - DNA, 20 bp, Homo sapiens
gtccatggcaccagccccct

SEQ ID NO: 354711 - DNA, 14 bp, Homo sapiens
gtccattatctgct

SEQ ID NO: 354712 - DNA, 17 bp, Homo sapiens
gtccattatttgagttt

SEQ ID NO: 354713 - DNA, 18 bp, Homo sapiens
gtccattgcaaaaggtta

SEQ ID NO: 354714 - DNA, 18 bp, Homo sapiens
gtccatttacctggaaac

SEQ ID NO: 354715 - DNA, 18 bp, Homo sapiens
gtccatttcatgtgatct

SEQ ID NO: 354716 - DNA, 19 bp, Homo sapiens
gtcccaaacagctgcctct

SEQ ID NO: 354717 - DNA, 16 bp, Homo sapiens
gtcccaaggagctgat

SEQ ID NO: 354718 - DNA, 12 bp, Homo sapiens
gtcccacagctt

SEQ ID NO: 354719 - DNA, 17 bp, Homo sapiens
gtcccaccaactctgca

SEQ ID NO: 354720 - DNA, 21 bp, Homo sapiens
gtcccaccaactctgcactcc

SEQ ID NO: 354721 - DNA, 22 bp, Homo sapiens
gtcccaccaactctgcactcca

SEQ ID NO: 354722 - DNA, 23 bp, Homo sapiens
gtcccaccaactctgcactccat

SEQ ID NO: 354723 - DNA, 14 bp, Homo sapiens
gtcccactgagtct

SEQ ID NO: 354724 - DNA, 19 bp, Homo sapiens
gtcccagaaccacactgtt

SEQ ID NO: 354725 - DNA, 13 bp, Homo sapiens
gtcccagagcccg

SEQ ID NO: 354726 - DNA, 21 bp, Homo sapiens
gtcccagagcttattggccac

SEQ ID NO: 354727 - DNA, 19 bp, Homo sapiens
gtcccagaggttatctgcc

SEQ ID NO: 354728 - DNA, 21 bp, Homo sapiens
gtcccagaggttatctgcctg

SEQ ID NO: 354729 - DNA, 22 bp, Homo sapiens
gtcccagaggttatctgcctgg

SEQ ID NO: 354730 - DNA, 16 bp, Homo sapiens
gtcccagcacctggca

SEQ ID NO: 354731 - DNA, 14 bp, Homo sapiens
gtcccagccacccc

SEQ ID NO: 354732 - DNA, 19 bp, Homo sapiens
gtcccagctaaagaggtgg

SEQ ID NO: 354733 - DNA, 23 bp, Homo sapiens
gtcccagctacttgggagcctga

SEQ ID NO: 354734 - DNA, 16 bp, Homo sapiens
gtcccaggaagcaggg

SEQ ID NO: 354735 - DNA, 16 bp, Homo sapiens
gtcccaggatcccctg

SEQ ID NO: 354736 - DNA, 22 bp, Homo sapiens
gtcccaggatcccctgctactc

SEQ ID NO: 354737 - DNA, 18 bp, Homo sapiens
gtcccaggggtctccctg

SEQ ID NO: 354738 - DNA, 20 bp, Homo sapiens
gtcccaggggtctccctgag

SEQ ID NO: 354739 - DNA, 23 bp, Homo sapiens
gtcccaggggtctccctgagcct

SEQ ID NO: 354740 - DNA, 18 bp, Homo sapiens
gtcccagtattctcagag

SEQ ID NO: 354741 - DNA, 12 bp, Homo sapiens
gtcccagtgaac

SEQ ID NO: 354742 - DNA, 16 bp, Homo sapiens
gtcccagtgccattgg

SEQ ID NO: 354743 - DNA, 17 bp, Homo sapiens
gtcccagtgggaggcgc

SEQ ID NO: 354744 - DNA, 23 bp, Homo sapiens
gtcccatgaccttgacgtgtgtg

SEQ ID NO: 354745 - DNA, 17 bp, Homo sapiens
gtcccatgatccctgtg

SEQ ID NO: 354746 - DNA, 16 bp, Homo sapiens
gtcccattctagatcc

SEQ ID NO: 354747 - DNA, 21 bp, Homo sapiens
gtcccattctagatcctgcac

SEQ ID NO: 354748 - DNA, 16 bp, Homo sapiens
gtcccatttctcactg

SEQ ID NO: 354749 - DNA, 16 bp, Homo sapiens
gtccccaacgtcccct

SEQ ID NO: 354750 - DNA, 12 bp, Homo sapiens
gtccccagccct

SEQ ID NO: 354751 - DNA, 15 bp, Homo sapiens
gtccccagccctgtc

SEQ ID NO: 354752 - DNA, 13 bp, Homo sapiens
gtccccagccctt

SEQ ID NO: 354753 - DNA, 13 bp, Homo sapiens
gtccccagggccc

SEQ ID NO: 354754 - DNA, 19 bp, Homo sapiens
gtccccagggtgcaggcgc

SEQ ID NO: 354755 - DNA, 15 bp, Homo sapiens
gtccccatccccacc

SEQ ID NO: 354756 - DNA, 17 bp, Homo sapiens
gtccccattctataaat

SEQ ID NO: 354757 - DNA, 16 bp, Homo sapiens
gtcccccatgccacca

SEQ ID NO: 354758 - DNA, 17 bp, Homo sapiens
gtcccccatgccaccac

SEQ ID NO: 354759 - DNA, 16 bp, Homo sapiens
gtccccccaggtgctg

SEQ ID NO: 354760 - DNA, 19 bp, Homo sapiens
gtccccccctaactttctt

SEQ ID NO: 354761 - DNA, 20 bp, Homo sapiens
gtcccccctgagtgggctgg

SEQ ID NO: 354762 - DNA, 22 bp, Homo sapiens
gtccccctacccaccgatggag

SEQ ID NO: 354763 - DNA, 18 bp, Homo sapiens
gtccccgggaaaggccgg

SEQ ID NO: 354764 - DNA, 18 bp, Homo sapiens
gtccccgtgtgccccaag

SEQ ID NO: 354765 - DNA, 19 bp, Homo sapiens
gtcccctccacatcccagc

SEQ ID NO: 354766 - DNA, 16 bp, Homo sapiens
gtcccctccatctggg

SEQ ID NO: 354767 - DNA, 18 bp, Homo sapiens
gtcccctccatctgggga

SEQ ID NO: 354768 - DNA, 19 bp, Homo sapiens
gtcccctccatctggggat

SEQ ID NO: 354769 - DNA, 22 bp, Homo sapiens
gtcccctccccggccctaccag

SEQ ID NO: 354770 - DNA, 12 bp, Homo sapiens
gtcccctccgcc

SEQ ID NO: 354771 - DNA, 19 bp, Homo sapiens
gtcccctccgccgtgccgg

SEQ ID NO: 354772 - DNA, 14 bp, Homo sapiens
gtcccctgacctgt

SEQ ID NO: 354773 - DNA, 18 bp, Homo sapiens
gtcccctgacctgtccag

SEQ ID NO: 354774 - DNA, 12 bp, Homo sapiens
gtcccctgaggt

SEQ ID NO: 354775 - DNA, 12 bp, Homo sapiens
gtcccctgcctc

SEQ ID NO: 354776 - DNA, 15 bp, Homo sapiens
gtcccctgggccacc

SEQ ID NO: 354777 - DNA, 17 bp, Homo sapiens
gtcccctgggccaccct

SEQ ID NO: 354778 - DNA, 19 bp, Homo sapiens
gtcccctgtggtgatgtgc

SEQ ID NO: 354779 - DNA, 21 bp, Homo sapiens
gtcccctgtggtgatgtgcct

SEQ ID NO: 354780 - DNA, 12 bp, Homo sapiens
gtccccttcccc

SEQ ID NO: 354781 - DNA, 13 bp, Homo sapiens
gtccccttcccct

SEQ ID NO: 354782 - DNA, 16 bp, Homo sapiens
gtccccttcccctgct

SEQ ID NO: 354783 - DNA, 17 bp, Homo sapiens
gtccccttcccctgctg

SEQ ID NO: 354784 - DNA, 24 bp, Homo sapiens
gtcccgaggaagggccagagcctg

SEQ ID NO: 354785 - DNA, 14 bp, Homo sapiens
gtcccgaggcagca

SEQ ID NO: 354786 - DNA, 16 bp, Homo sapiens
gtcccgattgtaactc

SEQ ID NO: 354787 - DNA, 19 bp, Homo sapiens
gtcccggctgacacctccc

SEQ ID NO: 354788 - DNA, 23 bp, Homo sapiens
gtcccgggaggaacgtggttcag

SEQ ID NO: 354789 - DNA, 16 bp, Homo sapiens
gtcccgggttagcctg

SEQ ID NO: 354790 - DNA, 21 bp, Homo sapiens
gtcccggttcagacccctgcc

SEQ ID NO: 354791 - DNA, 17 bp, Homo sapiens
gtccctaaagaaaaaaa

SEQ ID NO: 354792 - DNA, 23 bp, Homo sapiens
gtccctaagcatgtgtcccagga

SEQ ID NO: 354793 - DNA, 15 bp, Homo sapiens
gtccctaattctctt

SEQ ID NO: 354794 - DNA, 19 bp, Homo sapiens
gtccctaattctcttcgct

SEQ ID NO: 354795 - DNA, 18 bp, Homo sapiens
gtccctaccactgagccc

SEQ ID NO: 354796 - DNA, 19 bp, Homo sapiens
gtccctaccactgagccct

SEQ ID NO: 354797 - DNA, 23 bp, Homo sapiens
gtccctaccactgagcccttgca

SEQ ID NO: 354798 - DNA, 21 bp, Homo sapiens
gtccctaccgagtctcttctc

SEQ ID NO: 354799 - DNA, 23 bp, Homo sapiens
gtccctaccgagtctcttctcca

SEQ ID NO: 354800 - DNA, 20 bp, Homo sapiens
gtccctccacgttcacccct

SEQ ID NO: 354801 - DNA, 21 bp, Homo sapiens
gtccctccacgttcacccctc

SEQ ID NO: 354802 - DNA, 16 bp, Homo sapiens
gtccctccactaggag

SEQ ID NO: 354803 - DNA, 18 bp, Homo sapiens
gtccctccctcctggctc

SEQ ID NO: 354804 - DNA, 22 bp, Homo sapiens
gtccctccctcctggctcacag

SEQ ID NO: 354805 - DNA, 15 bp, Homo sapiens
gtccctcgtccacag

SEQ ID NO: 354806 - DNA, 12 bp, Homo sapiens
gtccctctcact

SEQ ID NO: 354807 - DNA, 16 bp, Homo sapiens
gtccctctcactcccc

SEQ ID NO: 354808 - DNA, 12 bp, Homo sapiens
gtccctctgcct

SEQ ID NO: 354809 - DNA, 13 bp, Homo sapiens
gtccctctgcctt

SEQ ID NO: 354810 - DNA, 18 bp, Homo sapiens
gtccctgaagtcttgcat

SEQ ID NO: 354811 - DNA, 23 bp, Homo sapiens
gtccctgaagtcttgcattgaat

SEQ ID NO: 354812 - DNA, 14 bp, Homo sapiens
gtccctgacttccc

SEQ ID NO: 354813 - DNA, 16 bp, Homo sapiens
gtccctgacttcccag

SEQ ID NO: 354814 - DNA, 23 bp, Homo sapiens
gtccctgagaagcctcatgggag

SEQ ID NO: 354815 - DNA, 17 bp, Homo sapiens
gtccctgccccctcccc

SEQ ID NO: 354816 - DNA, 14 bp, Homo sapiens
gtccctgccccgcc

SEQ ID NO: 354817 - DNA, 15 bp, Homo sapiens
gtccctgccccgccc

SEQ ID NO: 354818 - DNA, 18 bp, Homo sapiens
gtccctgccccgcccccc

SEQ ID NO: 354819 - DNA, 22 bp, Homo sapiens
gtccctgccccgccccccagag

SEQ ID NO: 354820 - DNA, 12 bp, Homo sapiens
gtccctggacca

SEQ ID NO: 354821 - DNA, 17 bp, Homo sapiens
gtccctggagctgtcct

SEQ ID NO: 354822 - DNA, 19 bp, Homo sapiens
gtccctggtccctcgtcca

SEQ ID NO: 354823 - DNA, 22 bp, Homo sapiens
gtccctggtccctcgtccacag

SEQ ID NO: 354824 - DNA, 16 bp, Homo sapiens
gtccctgtccctgccc

SEQ ID NO: 354825 - DNA, 15 bp, Homo sapiens
gtccctgtgcctaac

SEQ ID NO: 354826 - DNA, 12 bp, Homo sapiens
gtccctgtggta

SEQ ID NO: 354827 - DNA, 17 bp, Homo sapiens
gtcccttacctggctta

SEQ ID NO: 354828 - DNA, 15 bp, Homo sapiens
gtcccttagccccga

SEQ ID NO: 354829 - DNA, 15 bp, Homo sapiens
gtcccttccccctgc

SEQ ID NO: 354830 - DNA, 19 bp, Homo sapiens
gtcccttcccctccctggc

SEQ ID NO: 354831 - DNA, 13 bp, Homo sapiens
gtcccttcctgtc

SEQ ID NO: 354832 - DNA, 16 bp, Homo sapiens
gtcccttcctgtcctg

SEQ ID NO: 354833 - DNA, 17 bp, Homo sapiens
gtcccttgacctttcca

SEQ ID NO: 354834 - DNA, 13 bp, Homo sapiens
gtcccttgcctca

SEQ ID NO: 354835 - DNA, 15 bp, Homo sapiens
gtccctttccctgca

SEQ ID NO: 354836 - DNA, 16 bp, Homo sapiens
gtccctttccctgcat

SEQ ID NO: 354837 - DNA, 14 bp, Homo sapiens
gtccgcaccagctg

SEQ ID NO: 354838 - DNA, 15 bp, Homo sapiens
gtccgcccgcccacc

SEQ ID NO: 354839 - DNA, 19 bp, Homo sapiens
gtccgccctcttcccctct

SEQ ID NO: 354840 - DNA, 21 bp, Homo sapiens
gtccgcctctgcccgcagagc

SEQ ID NO: 354841 - DNA, 15 bp, Homo sapiens
gtccggaggcagcag

SEQ ID NO: 354842 - DNA, 13 bp, Homo sapiens
gtccggcctgcag

SEQ ID NO: 354843 - DNA, 15 bp, Homo sapiens
gtccggcctgcagcc

SEQ ID NO: 354844 - DNA, 17 bp, Homo sapiens
gtccggcctgcagccca

SEQ ID NO: 354845 - DNA, 18 bp, Homo sapiens
gtccggcctgcagcccag

SEQ ID NO: 354846 - DNA, 15 bp, Homo sapiens
gtccggcttggctag

SEQ ID NO: 354847 - DNA, 21 bp, Homo sapiens
gtccggtggaaggccttcttt

SEQ ID NO: 354848 - DNA, 23 bp, Homo sapiens
gtccgtccgcccgcccaccccgc

SEQ ID NO: 354849 - DNA, 16 bp, Homo sapiens
gtccgttgacgtgacc

SEQ ID NO: 354850 - DNA, 19 bp, Homo sapiens
gtcctaaggacacactaat

SEQ ID NO: 354851 - DNA, 21 bp, Homo sapiens
gtcctactttacatatgcttt

SEQ ID NO: 354852 - DNA, 22 bp, Homo sapiens
gtcctaggtgaccccatctctg

SEQ ID NO: 354853 - DNA, 15 bp, Homo sapiens
gtcctcacagcctct

SEQ ID NO: 354854 - DNA, 17 bp, Homo sapiens
gtcctcacagcctctcc

SEQ ID NO: 354855 - DNA, 17 bp, Homo sapiens
gtcctcaccttctgttt

SEQ ID NO: 354856 - DNA, 16 bp, Homo sapiens
gtcctcactcccagtc

SEQ ID NO: 354857 - DNA, 17 bp, Homo sapiens
gtcctcactcccagtcc

SEQ ID NO: 354858 - DNA, 16 bp, Homo sapiens
gtcctcacttggggga

SEQ ID NO: 354859 - DNA, 13 bp, Homo sapiens
gtcctccaaaaca

SEQ ID NO: 354860 - DNA, 15 bp, Homo sapiens
gtcctccaaaacaca

SEQ ID NO: 354861 - DNA, 16 bp, Homo sapiens
gtcctccaccggtgcc

SEQ ID NO: 354862 - DNA, 21 bp, Homo sapiens
gtcctccaccggtgcctcctc

SEQ ID NO: 354863 - DNA, 18 bp, Homo sapiens
gtcctccagaagcctctg

SEQ ID NO: 354864 - DNA, 20 bp, Homo sapiens
gtcctccagaagcctctggc

SEQ ID NO: 354865 - DNA, 13 bp, Homo sapiens
gtcctccccttgg

SEQ ID NO: 354866 - DNA, 18 bp, Homo sapiens
gtcctccccttgggcggc

SEQ ID NO: 354867 - DNA, 19 bp, Homo sapiens
gtcctccccttgggcggct

SEQ ID NO: 354868 - DNA, 17 bp, Homo sapiens
gtcctccctcctgcagg

SEQ ID NO: 354869 - DNA, 16 bp, Homo sapiens
gtcctcgtggcggggc

SEQ ID NO: 354870 - DNA, 19 bp, Homo sapiens
gtcctcgtggcggggcagc

SEQ ID NO: 354871 - DNA, 19 bp, Homo sapiens
gtcctctcagttctctccc

SEQ ID NO: 354872 - DNA, 20 bp, Homo sapiens
gtcctctcagttctctccct

SEQ ID NO: 354873 - DNA, 23 bp, Homo sapiens
gtcctctcagttctctcccttcc

SEQ ID NO: 354874 - DNA, 15 bp, Homo sapiens
gtcctgacgccctgc

SEQ ID NO: 354875 - DNA, 13 bp, Homo sapiens
gtcctgactcaac

SEQ ID NO: 354876 - DNA, 19 bp, Homo sapiens
gtcctgagccccctgcacc

SEQ ID NO: 354877 - DNA, 20 bp, Homo sapiens
gtcctgagccccctgcaccc

SEQ ID NO: 354878 - DNA, 23 bp, Homo sapiens
gtcctgagccccctgcacccacc

SEQ ID NO: 354879 - DNA, 16 bp, Homo sapiens
gtcctgaggcagaacc

SEQ ID NO: 354880 - DNA, 17 bp, Homo sapiens
gtcctgaggcagaacct

SEQ ID NO: 354881 - DNA, 23 bp, Homo sapiens
gtcctgaggcagaacctggtggc

SEQ ID NO: 354882 - DNA, 17 bp, Homo sapiens
gtcctgaggctggggct

SEQ ID NO: 354883 - DNA, 15 bp, Homo sapiens
gtcctgatggtcagc

SEQ ID NO: 354884 - DNA, 19 bp, Homo sapiens
gtcctgatggtcagctccc

SEQ ID NO: 354885 - DNA, 23 bp, Homo sapiens
gtcctgatggtcagctcccttct

SEQ ID NO: 354886 - DNA, 15 bp, Homo sapiens
gtcctgattctccct

SEQ ID NO: 354887 - DNA, 21 bp, Homo sapiens
gtcctgcaatctccagggctg

SEQ ID NO: 354888 - DNA, 18 bp, Homo sapiens
gtcctgcagagctggggg

SEQ ID NO: 354889 - DNA, 20 bp, Homo sapiens
gtcctgcagaggaccacagt

SEQ ID NO: 354890 - DNA, 18 bp, Homo sapiens
gtcctgcagtgtgagatt

SEQ ID NO: 354891 - DNA, 16 bp, Homo sapiens
gtcctgccacctgggg

SEQ ID NO: 354892 - DNA, 16 bp, Homo sapiens
gtcctgccagctgcct

SEQ ID NO: 354893 - DNA, 13 bp, Homo sapiens
gtcctgcctggcc

SEQ ID NO: 354894 - DNA, 15 bp, Homo sapiens
gtcctgcctggccag

SEQ ID NO: 354895 - DNA, 19 bp, Homo sapiens
gtcctgcctggccaggcag

SEQ ID NO: 354896 - DNA, 13 bp, Homo sapiens
gtcctgctgctcg

SEQ ID NO: 354897 - DNA, 14 bp, Homo sapiens
gtcctgctgctcgg

SEQ ID NO: 354898 - DNA, 14 bp, Homo sapiens
gtcctgctgtggaa

SEQ ID NO: 354899 - DNA, 17 bp, Homo sapiens
gtcctggctacatccca

SEQ ID NO: 354900 - DNA, 19 bp, Homo sapiens
gtcctggctacatcccagc

SEQ ID NO: 354901 - DNA, 14 bp, Homo sapiens
gtcctggctgtgca

SEQ ID NO: 354902 - DNA, 17 bp, Homo sapiens
gtcctgggagacccatg

SEQ ID NO: 354903 - DNA, 21 bp, Homo sapiens
gtcctggggaggctgagactg

SEQ ID NO: 354904 - DNA, 16 bp, Homo sapiens
gtcctggtggggctga

SEQ ID NO: 354905 - DNA, 21 bp, Homo sapiens
gtcctggtggggctgagcctg

SEQ ID NO: 354906 - DNA, 14 bp, Homo sapiens
gtcctgtaaacact

SEQ ID NO: 354907 - DNA, 16 bp, Homo sapiens
gtcctgtaaacactca

SEQ ID NO: 354908 - DNA, 19 bp, Homo sapiens
gtcctgtggtgacaggccc

SEQ ID NO: 354909 - DNA, 12 bp, Homo sapiens
gtcctgtgtcat

SEQ ID NO: 354910 - DNA, 16 bp, Homo sapiens
gtcctgttctcagagc

SEQ ID NO: 354911 - DNA, 17 bp, Homo sapiens
gtcctgttctcagagct

SEQ ID NO: 354912 - DNA, 16 bp, Homo sapiens
gtccttcccacggcca

SEQ ID NO: 354913 - DNA, 19 bp, Homo sapiens
gtccttcccacggccactg

SEQ ID NO: 354914 - DNA, 13 bp, Homo sapiens
gtccttcttcctc

SEQ ID NO: 354915 - DNA, 22 bp, Homo sapiens
gtccttggggaggggtcagctc

SEQ ID NO: 354916 - DNA, 19 bp, Homo sapiens
gtcctttaggcagcctgcc

SEQ ID NO: 354917 - DNA, 15 bp, Homo sapiens
gtcctttccagtggc

SEQ ID NO: 354918 - DNA, 23 bp, Homo sapiens
gtcctttccagtggcctggctcc

SEQ ID NO: 354919 - DNA, 13 bp, Homo sapiens
gtcctttccctcc

SEQ ID NO: 354920 - DNA, 15 bp, Homo sapiens
gtcctttccctccac

SEQ ID NO: 354921 - DNA, 11 bp, Homo sapiens
gtcctttctcc

SEQ ID NO: 354922 - DNA, 13 bp, Homo sapiens
gtcctttcttttg

SEQ ID NO: 354923 - DNA, 21 bp, Homo sapiens
gtcctttcttttgaaatgcca

SEQ ID NO: 354924 - DNA, 15 bp, Homo sapiens
gtcctttgagaaaga

SEQ ID NO: 354925 - DNA, 22 bp, Homo sapiens
gtcctttgagtgtcaggctctg

SEQ ID NO: 354926 - DNA, 12 bp, Homo sapiens
gtccttttggtt

SEQ ID NO: 354927 - DNA, 12 bp, Homo sapiens
gtcgagacactt

SEQ ID NO: 354928 - DNA, 17 bp, Homo sapiens
gtcgcagaccagagctg

SEQ ID NO: 354929 - DNA, 11 bp, Homo sapiens
gtcgcccctcc

SEQ ID NO: 354930 - DNA, 14 bp, Homo sapiens
gtcgcccctcctcg

SEQ ID NO: 354931 - DNA, 13 bp, Homo sapiens
gtcgccctctgtg

SEQ ID NO: 354932 - DNA, 14 bp, Homo sapiens
gtcgccctctgtgc

SEQ ID NO: 354933 - DNA, 23 bp, Homo sapiens
gtcgccctctgtgcctaataaag

SEQ ID NO: 354934 - DNA, 16 bp, Homo sapiens
gtcgccgtccctctgc

SEQ ID NO: 354935 - DNA, 17 bp, Homo sapiens
gtcgccgtccctctgcc

SEQ ID NO: 354936 - DNA, 18 bp, Homo sapiens
gtcgcctgcggactccat

SEQ ID NO: 354937 - DNA, 13 bp, Homo sapiens
gtcggaagcctgt

SEQ ID NO: 354938 - DNA, 12 bp, Homo sapiens
gtcggaatggta

SEQ ID NO: 354939 - DNA, 17 bp, Homo sapiens
gtcggactgcccccaga

SEQ ID NO: 354940 - DNA, 17 bp, Homo sapiens
gtcggaggcttgggacc

SEQ ID NO: 354941 - DNA, 18 bp, Homo sapiens
gtcggcgccttctacctg

SEQ ID NO: 354942 - DNA, 13 bp, Homo sapiens
gtcggctgggcag

SEQ ID NO: 354943 - DNA, 23 bp, Homo sapiens
gtcggctgggcagggccgcaggg

SEQ ID NO: 354944 - DNA, 18 bp, Homo sapiens
gtcgggaaattctgctgc

SEQ ID NO: 354945 - DNA, 12 bp, Homo sapiens
gtcgggctcagc

SEQ ID NO: 354946 - DNA, 12 bp, Homo sapiens
gtcgggggagga

SEQ ID NO: 354947 - DNA, 14 bp, Homo sapiens
gtcgggggaggagc

SEQ ID NO: 354948 - DNA, 17 bp, Homo sapiens
gtcgggggaggagcacc

SEQ ID NO: 354949 - DNA, 18 bp, Homo sapiens
gtcggggggcgagggagg

SEQ ID NO: 354950 - DNA, 20 bp, Homo sapiens
gtcggggggcgagggagggg

SEQ ID NO: 354951 - DNA, 18 bp, Homo sapiens
gtcgtccccctccagtgc

SEQ ID NO: 354952 - DNA, 21 bp, Homo sapiens
gtcgtgcctccttccacctcc

SEQ ID NO: 354953 - DNA, 12 bp, Homo sapiens
gtcgttcatttt

SEQ ID NO: 354954 - DNA, 16 bp, Homo sapiens
gtcgtttcattcattt

SEQ ID NO: 354955 - DNA, 14 bp, Homo sapiens
gtctaaagagcttt

SEQ ID NO: 354956 - DNA, 20 bp, Homo sapiens
gtctaaccccaggttttctg

SEQ ID NO: 354957 - DNA, 23 bp, Homo sapiens
gtctaactttagaagtgcatttc

SEQ ID NO: 354958 - DNA, 18 bp, Homo sapiens
gtctacctgaaaattcaa

SEQ ID NO: 354959 - DNA, 19 bp, Homo sapiens
gtctactgtggtgatctgt

SEQ ID NO: 354960 - DNA, 18 bp, Homo sapiens
gtctagaatcctgcttta

SEQ ID NO: 354961 - DNA, 21 bp, Homo sapiens
gtctagaggctattcctaggc

SEQ ID NO: 354962 - DNA, 23 bp, Homo sapiens
gtctagatggatgaattatgata

SEQ ID NO: 354963 - DNA, 15 bp, Homo sapiens
gtctaggtctcctca

SEQ ID NO: 354964 - DNA, 16 bp, Homo sapiens
gtctaggtctcctcag

SEQ ID NO: 354965 - DNA, 18 bp, Homo sapiens
gtctaggtctcctcaggg

SEQ ID NO: 354966 - DNA, 17 bp, Homo sapiens
gtctagtttcattatag

SEQ ID NO: 354967 - DNA, 15 bp, Homo sapiens
gtctatacattcctg

SEQ ID NO: 354968 - DNA, 16 bp, Homo sapiens
gtctattctgagcctt

SEQ ID NO: 354969 - DNA, 17 bp, Homo sapiens
gtctattctgagccttg

SEQ ID NO: 354970 - DNA, 18 bp, Homo sapiens
gtctattctgagccttga

SEQ ID NO: 354971 - DNA, 22 bp, Homo sapiens
gtctatttttttaactgaaaat

SEQ ID NO: 354972 - DNA, 20 bp, Homo sapiens
gtctcaaactcctgggctca

SEQ ID NO: 354973 - DNA, 15 bp, Homo sapiens
gtctcaagagggcac

SEQ ID NO: 354974 - DNA, 17 bp, Homo sapiens
gtctcaagagggcactg

SEQ ID NO: 354975 - DNA, 19 bp, Homo sapiens
gtctcaagcactaaaaagt

SEQ ID NO: 354976 - DNA, 15 bp, Homo sapiens
gtctcaatgttccat

SEQ ID NO: 354977 - DNA, 16 bp, Homo sapiens
gtctcaattttgtatt

SEQ ID NO: 354978 - DNA, 18 bp, Homo sapiens
gtctcaattttgtattta

SEQ ID NO: 354979 - DNA, 19 bp, Homo sapiens
gtctcaattttgtatttaa

SEQ ID NO: 354980 - DNA, 19 bp, Homo sapiens
gtctcacaatagcgtgagc

SEQ ID NO: 354981 - DNA, 19 bp, Homo sapiens
gtctcacagtgttgcccag

SEQ ID NO: 354982 - DNA, 19 bp, Homo sapiens
gtctcaccagctcagcccc

SEQ ID NO: 354983 - DNA, 13 bp, Homo sapiens
gtctcaggaggag

SEQ ID NO: 354984 - DNA, 15 bp, Homo sapiens
gtctcagtttcactt

SEQ ID NO: 354985 - DNA, 17 bp, Homo sapiens
gtctcattcctctgtcc

SEQ ID NO: 354986 - DNA, 13 bp, Homo sapiens
gtctcattgccag

SEQ ID NO: 354987 - DNA, 14 bp, Homo sapiens
gtctcattgccagt

SEQ ID NO: 354988 - DNA, 16 bp, Homo sapiens
gtctcattttgtatgt

SEQ ID NO: 354989 - DNA, 16 bp, Homo sapiens
gtctccaccaggaacc

SEQ ID NO: 354990 - DNA, 19 bp, Homo sapiens
gtctccaccaggaacctct

SEQ ID NO: 354991 - DNA, 17 bp, Homo sapiens
gtctccagacccccacc

SEQ ID NO: 354992 - DNA, 19 bp, Homo sapiens
gtctccagggcccccaccg

SEQ ID NO: 354993 - DNA, 20 bp, Homo sapiens
gtctccagggcccccaccga

SEQ ID NO: 354994 - DNA, 23 bp, Homo sapiens
gtctccataaaagtcctgtcacc

SEQ ID NO: 354995 - DNA, 18 bp, Homo sapiens
gtctccatatcagctctc

SEQ ID NO: 354996 - DNA, 19 bp, Homo sapiens
gtctccatatcagctctct

SEQ ID NO: 354997 - DNA, 20 bp, Homo sapiens
gtctccatatcagctctctg

SEQ ID NO: 354998 - DNA, 16 bp, Homo sapiens
gtctccatttttccca

SEQ ID NO: 354999 - DNA, 19 bp, Homo sapiens
gtctccatttttcccagga

SEQ ID NO: 355000 - DNA, 20 bp, Homo sapiens
gtctcccagttatgaatcag

SEQ ID NO: 355001 - DNA, 17 bp, Homo sapiens
gtctcccctctgctggc

SEQ ID NO: 355002 - DNA, 19 bp, Homo sapiens
gtctccctccgactccaga

SEQ ID NO: 355003 - DNA, 13 bp, Homo sapiens
gtctccctgggag

SEQ ID NO: 355004 - DNA, 19 bp, Homo sapiens
gtctcccttggccacggcc

SEQ ID NO: 355005 - DNA, 20 bp, Homo sapiens
gtctcccttggccacggcct

SEQ ID NO: 355006 - DNA, 17 bp, Homo sapiens
gtctcctactctgtgta

SEQ ID NO: 355007 - DNA, 20 bp, Homo sapiens
gtctcctccccgtagccact

SEQ ID NO: 355008 - DNA, 17 bp, Homo sapiens
gtctcctctcagcttct

SEQ ID NO: 355009 - DNA, 19 bp, Homo sapiens
gtctcctctgattatcagg

SEQ ID NO: 355010 - DNA, 21 bp, Homo sapiens
gtctcctctgtcagtttgtga

SEQ ID NO: 355011 - DNA, 23 bp, Homo sapiens
gtctcctctgtcagtttgtgaag

SEQ ID NO: 355012 - DNA, 11 bp, Homo sapiens
gtctcctgccg

SEQ ID NO: 355013 - DNA, 17 bp, Homo sapiens
gtctccttactctgagc

SEQ ID NO: 355014 - DNA, 18 bp, Homo sapiens
gtctccttactctgagcc

SEQ ID NO: 355015 - DNA, 23 bp, Homo sapiens
gtctccttactctgagcccaggc

SEQ ID NO: 355016 - DNA, 14 bp, Homo sapiens
gtctccttcccact

SEQ ID NO: 355017 - DNA, 23 bp, Homo sapiens
gtctccttcccactgtcctttct

SEQ ID NO: 355018 - DNA, 15 bp, Homo sapiens
gtctcctttgcactg

SEQ ID NO: 355019 - DNA, 16 bp, Homo sapiens
gtctcctttgcactga

SEQ ID NO: 355020 - DNA, 20 bp, Homo sapiens
gtctcctttgcactgagggc

SEQ ID NO: 355021 - DNA, 23 bp, Homo sapiens
gtctcctttgcactgagggccac

SEQ ID NO: 355022 - DNA, 19 bp, Homo sapiens
gtgcagcagcccagcttcc

SEQ ID NO: 355023 - DNA, 15 bp, Homo sapiens
gtgcagccccaggac

SEQ ID NO: 355024 - DNA, 19 bp, Homo sapiens
gtgcagcccgccatggccg

SEQ ID NO: 355025 - DNA, 13 bp, Homo sapiens
gtgcagcccttcc

SEQ ID NO: 355026 - DNA, 13 bp, Homo sapiens
gtgcagctgattt

SEQ ID NO: 355027 - DNA, 12 bp, Homo sapiens
gtgcagctggga

SEQ ID NO: 355028 - DNA, 16 bp, Homo sapiens
gtgcaggcagccttga

SEQ ID NO: 355029 - DNA, 15 bp, Homo sapiens
gtgcaggctcctcct

SEQ ID NO: 355030 - DNA, 22 bp, Homo sapiens
gtgcagtgtgagtgtgatgggc

SEQ ID NO: 355031 - DNA, 22 bp, Homo sapiens
gtgcagttcccccaacctcaga

SEQ ID NO: 355032 - DNA, 19 bp, Homo sapiens
gtgcataagttaacttcca

SEQ ID NO: 355033 - DNA, 13 bp, Homo sapiens
gtgcatctcagcc

SEQ ID NO: 355034 - DNA, 16 bp, Homo sapiens
gtgcatgagaatgtca

SEQ ID NO: 355035 - DNA, 17 bp, Homo sapiens
gtgcatgagaatgtcat

SEQ ID NO: 355036 - DNA, 19 bp, Homo sapiens
gtgcatgagaatgtcattt

SEQ ID NO: 355037 - DNA, 20 bp, Homo sapiens
gtgcatgccttcataaatta

SEQ ID NO: 355038 - DNA, 22 bp, Homo sapiens
gtgcatgctgtcccttacgtga

SEQ ID NO: 355039 - DNA, 18 bp, Homo sapiens
gtgcatgggtgaagggag

SEQ ID NO: 355040 - DNA, 14 bp, Homo sapiens
gtgcatgtgaagca

SEQ ID NO: 355041 - DNA, 14 bp, Homo sapiens
gtgcatgtgtgtgc

SEQ ID NO: 355042 - DNA, 15 bp, Homo sapiens
gtgcatgtgtgtgct

SEQ ID NO: 355043 - DNA, 14 bp, Homo sapiens
gtgcattacagaga

SEQ ID NO: 355044 - DNA, 21 bp, Homo sapiens
gtgcattggaagaccccaccc

SEQ ID NO: 355045 - DNA, 18 bp, Homo sapiens
gtgcattggataacacca

SEQ ID NO: 355046 - DNA, 17 bp, Homo sapiens
gtgcatttaaaatggac

SEQ ID NO: 355047 - DNA, 18 bp, Homo sapiens
gtgcatttaaaatggact

SEQ ID NO: 355048 - DNA, 20 bp, Homo sapiens
gtgcatttcacctgtgacaa

SEQ ID NO: 355049 - DNA, 19 bp, Homo sapiens
gtgcatttgtgtctgcctg

SEQ ID NO: 355050 - DNA, 23 bp, Homo sapiens
gtgccaaaaacaacaacaaaatg

SEQ ID NO: 355051 - DNA, 22 bp, Homo sapiens
gtgccaaacaaaaaggttctca

SEQ ID NO: 355052 - DNA, 17 bp, Homo sapiens
gtgccaaagcaggtcag

SEQ ID NO: 355053 - DNA, 15 bp, Homo sapiens
gtgccaaatcctggg

SEQ ID NO: 355054 - DNA, 24 bp, Homo sapiens
gtgccaaatcctgggcatccccag

SEQ ID NO: 355055 - DNA, 18 bp, Homo sapiens
gtgccaaccacctctggc

SEQ ID NO: 355056 - DNA, 22 bp, Homo sapiens
gtgccaaccacctctggccctg

SEQ ID NO: 355057 - DNA, 23 bp, Homo sapiens
gtgccaacctgatgccccttccc

SEQ ID NO: 355058 - DNA, 16 bp, Homo sapiens
gtgccaagattctact

SEQ ID NO: 355059 - DNA, 17 bp, Homo sapiens
gtgccaatatgtattgt

SEQ ID NO: 355060 - DNA, 21 bp, Homo sapiens
gtgccaccacccctccctctg

SEQ ID NO: 355061 - DNA, 21 bp, Homo sapiens
gtgccacccgtaggcagcctc

SEQ ID NO: 355062 - DNA, 17 bp, Homo sapiens
gtgccaccctctgcagg

SEQ ID NO: 355063 - DNA, 18 bp, Homo sapiens
gtgccaccctctgcaggg

SEQ ID NO: 355064 - DNA, 23 bp, Homo sapiens
gtgccaccctctgcagggcagcc

SEQ ID NO: 355065 - DNA, 17 bp, Homo sapiens
gtgccacctatgcctgt

SEQ ID NO: 355066 - DNA, 13 bp, Homo sapiens
gtgccactccctg

SEQ ID NO: 355067 - DNA, 15 bp, Homo sapiens
gtgccactccctgag

SEQ ID NO: 355068 - DNA, 16 bp, Homo sapiens
gtgccactccctgagc

SEQ ID NO: 355069 - DNA, 19 bp, Homo sapiens
gtgccactgcccgagctgg

SEQ ID NO: 355070 - DNA, 22 bp, Homo sapiens
gtgccactgcccgagctggtgc

SEQ ID NO: 355071 - DNA, 23 bp, Homo sapiens
gtgccacttcttaaaggcctgga

SEQ ID NO: 355072 - DNA, 19 bp, Homo sapiens
gtgccacttgacattcctt

SEQ ID NO: 355073 - DNA, 13 bp, Homo sapiens
gtgccagccttcc

SEQ ID NO: 355074 - DNA, 19 bp, Homo sapiens
gtgccaggactctctttct

SEQ ID NO: 355075 - DNA, 18 bp, Homo sapiens
gtgccaggagcaatggga

SEQ ID NO: 355076 - DNA, 21 bp, Homo sapiens
gtgccaggagcaatgggactg

SEQ ID NO: 355077 - DNA, 22 bp, Homo sapiens
gtgccaggagcaatgggactgg

SEQ ID NO: 355078 - DNA, 16 bp, Homo sapiens
gtgccaggtggctcag

SEQ ID NO: 355079 - DNA, 23 bp, Homo sapiens
gtgccatagagtttaacacaagt

SEQ ID NO: 355080 - DNA, 13 bp, Homo sapiens
gtgccattcccag

SEQ ID NO: 355081 - DNA, 16 bp, Homo sapiens
gtgccattcccagcgt

SEQ ID NO: 355082 - DNA, 19 bp, Homo sapiens
gtgccattgtactccagcc

SEQ ID NO: 355083 - DNA, 16 bp, Homo sapiens
gtgcccaaagtgggga

SEQ ID NO: 355084 - DNA, 19 bp, Homo sapiens
gtgcccaaagtggggaggg

SEQ ID NO: 355085 - DNA, 12 bp, Homo sapiens
gtgcccacagcc

SEQ ID NO: 355086 - DNA, 15 bp, Homo sapiens
gtgcccacatcccag

SEQ ID NO: 355087 - DNA, 19 bp, Homo sapiens
gtgcccacccgtgttctcc

SEQ ID NO: 355088 - DNA, 20 bp, Homo sapiens
gtgcccacccgtgttctcct

SEQ ID NO: 355089 - DNA, 11 bp, Homo sapiens
gtgcccagagt

SEQ ID NO: 355090 - DNA, 18 bp, Homo sapiens
gtgcccagcccggacctt

SEQ ID NO: 355091 - DNA, 13 bp, Homo sapiens
gtgcccagctcag

SEQ ID NO: 355092 - DNA, 13 bp, Homo sapiens
gtgcccagtgatg

SEQ ID NO: 355093 - DNA, 21 bp, Homo sapiens
gtgcccagtgatggcattact

SEQ ID NO: 355094 - DNA, 16 bp, Homo sapiens
gtgcccagttaatctt

SEQ ID NO: 355095 - DNA, 23 bp, Homo sapiens
gtgcccatcatctctgcctttga

SEQ ID NO: 355096 - DNA, 11 bp, Homo sapiens
gtgccccaaga

SEQ ID NO: 355097 - DNA, 17 bp, Homo sapiens
gtgccccacagctacct

SEQ ID NO: 355098 - DNA, 13 bp, Homo sapiens
gtgccccacctgc

SEQ ID NO: 355099 - DNA, 17 bp, Homo sapiens
gtgccccatcagcagct

SEQ ID NO: 355100 - DNA, 14 bp, Homo sapiens
gtgccccccagttc

SEQ ID NO: 355101 - DNA, 14 bp, Homo sapiens
gtgcccccctcctc

SEQ ID NO: 355102 - DNA, 19 bp, Homo sapiens
gtgcccccctcctccagta

SEQ ID NO: 355103 - DNA, 13 bp, Homo sapiens
ggtaactgccagc

SEQ ID NO: 355104 - DNA, 23 bp, Homo sapiens
ggtaagagggagccggtttggga

SEQ ID NO: 355105 - DNA, 22 bp, Homo sapiens
ggtaatcaatgaatattgaagt

SEQ ID NO: 355106 - DNA, 16 bp, Homo sapiens
ggtaatggaggccaag

SEQ ID NO: 355107 - DNA, 18 bp, Homo sapiens
ggtaatggaggccaagcc

SEQ ID NO: 355108 - DNA, 14 bp, Homo sapiens
ggtacacagtgaga

SEQ ID NO: 355109 - DNA, 17 bp, Homo sapiens
ggtacatggcccgcagt

SEQ ID NO: 355110 - DNA, 21 bp, Homo sapiens
ggtaccaagatcacaaatagt

SEQ ID NO: 355111 - DNA, 21 bp, Homo sapiens
ggtaccagtgttagtgggaag

SEQ ID NO: 355112 - DNA, 14 bp, Homo sapiens
ggtaccctggcaga

SEQ ID NO: 355113 - DNA, 19 bp, Homo sapiens
ggtactcccccagccctca

SEQ ID NO: 355114 - DNA, 14 bp, Homo sapiens
ggtactctcctaga

SEQ ID NO: 355115 - DNA, 16 bp, Homo sapiens
ggtactctcctagaga

SEQ ID NO: 355116 - DNA, 21 bp, Homo sapiens
ggtacttcctcctgatggcca

SEQ ID NO: 355117 - DNA, 21 bp, Homo sapiens
ggtacttctgtgttgtgattc

SEQ ID NO: 355118 - DNA, 11 bp, Homo sapiens
ggtagaaatgc

SEQ ID NO: 355119 - DNA, 12 bp, Homo sapiens
ggtagaagccag

SEQ ID NO: 355120 - DNA, 17 bp, Homo sapiens
ggtagacttggagctgt

SEQ ID NO: 355121 - DNA, 21 bp, Homo sapiens
ggtagagaggggactggggga

SEQ ID NO: 355122 - DNA, 16 bp, Homo sapiens
ggtagaggcatttgtc

SEQ ID NO: 355123 - DNA, 23 bp, Homo sapiens
ggtagatccagatccagactgta

SEQ ID NO: 355124 - DNA, 16 bp, Homo sapiens
ggtagatcgcttgagc

SEQ ID NO: 355125 - DNA, 18 bp, Homo sapiens
ggtagatgagaaaacagg

SEQ ID NO: 355126 - DNA, 16 bp, Homo sapiens
ggtagcatgacctttt

SEQ ID NO: 355127 - DNA, 18 bp, Homo sapiens
ggtagccctggccagagg

SEQ ID NO: 355128 - DNA, 20 bp, Homo sapiens
ggtagccctggccagaggct

SEQ ID NO: 355129 - DNA, 14 bp, Homo sapiens
ggtagcgagctgct

SEQ ID NO: 355130 - DNA, 15 bp, Homo sapiens
ggtagcgagctgctc

SEQ ID NO: 355131 - DNA, 12 bp, Homo sapiens
ggtagctctgag

SEQ ID NO: 355132 - DNA, 20 bp, Homo sapiens
ggtagcttctgacctcagca

SEQ ID NO: 355133 - DNA, 20 bp, Homo sapiens
ggtaggaaaccaccctgagg

SEQ ID NO: 355134 - DNA, 21 bp, Homo sapiens
ggtaggaatagcatgtcacta

SEQ ID NO: 355135 - DNA, 19 bp, Homo sapiens
ggtaggaggtttggatggg

SEQ ID NO: 355136 - DNA, 11 bp, Homo sapiens
ggtaggccctt

SEQ ID NO: 355137 - DNA, 22 bp, Homo sapiens
ggtaggcccttgtcctgccagc

SEQ ID NO: 355138 - DNA, 23 bp, Homo sapiens
ggtaggcccttgtcctgccagct

SEQ ID NO: 355139 - DNA, 13 bp, Homo sapiens
ggtaggggttggg

SEQ ID NO: 355140 - DNA, 23 bp, Homo sapiens
ggtagtactcctgcaaaatttta

SEQ ID NO: 355141 - DNA, 14 bp, Homo sapiens
ggtagtactgggaa

SEQ ID NO: 355142 - DNA, 18 bp, Homo sapiens
ggtagtagaatctcagca

SEQ ID NO: 355143 - DNA, 21 bp, Homo sapiens
ggtagttctgtgcctcccccc

SEQ ID NO: 355144 - DNA, 18 bp, Homo sapiens
ggtagttgcaattgaatt

SEQ ID NO: 355145 - DNA, 12 bp, Homo sapiens
ggtataaaaaat

SEQ ID NO: 355146 - DNA, 15 bp, Homo sapiens
ggtatatctgggctg

SEQ ID NO: 355147 - DNA, 23 bp, Homo sapiens
ggtatatctgggctggccagttg

SEQ ID NO: 355148 - DNA, 19 bp, Homo sapiens
ggtatcattcaactctcca

SEQ ID NO: 355149 - DNA, 14 bp, Homo sapiens
ggtatccagaggtg

SEQ ID NO: 355150 - DNA, 13 bp, Homo sapiens
ggtatcccacctc

SEQ ID NO: 355151 - DNA, 20 bp, Homo sapiens
ggtatcccacctccagccca

SEQ ID NO: 355152 - DNA, 18 bp, Homo sapiens
ggtatcctgcccagtgtt

SEQ ID NO: 355153 - DNA, 20 bp, Homo sapiens
ggtatgaacttgaggacaca

SEQ ID NO: 355154 - DNA, 13 bp, Homo sapiens
ggtatgggaagcc

SEQ ID NO: 355155 - DNA, 11 bp, Homo sapiens
ggtatgtacag

SEQ ID NO: 355156 - DNA, 11 bp, Homo sapiens
ggtattaaact

SEQ ID NO: 355157 - DNA, 20 bp, Homo sapiens
ggtattacactgtatttgta

SEQ ID NO: 355158 - DNA, 16 bp, Homo sapiens
ggtcaactccaaggca

SEQ ID NO: 355159 - DNA, 22 bp, Homo sapiens
ggtcaactccaaggcaaatgtc

SEQ ID NO: 355160 - DNA, 23 bp, Homo sapiens
ggtcaacttgagcatgttactga

SEQ ID NO: 355161 - DNA, 19 bp, Homo sapiens
ggtcaataattgtggagag

SEQ ID NO: 355162 - DNA, 17 bp, Homo sapiens
ggtcaatcctgtgggtg

SEQ ID NO: 355163 - DNA, 16 bp, Homo sapiens
ggtcacaggactctgc

SEQ ID NO: 355164 - DNA, 21 bp, Homo sapiens
ggtcaccacaattagagcttg

SEQ ID NO: 355165 - DNA, 14 bp, Homo sapiens
ggtcacccccaccc

SEQ ID NO: 355166 - DNA, 12 bp, Homo sapiens
ggtcacctgtgc

SEQ ID NO: 355167 - DNA, 14 bp, Homo sapiens
ggtcacctgtgcta

SEQ ID NO: 355168 - DNA, 15 bp, Homo sapiens
ggtcaccttcctggg

SEQ ID NO: 355169 - DNA, 22 bp, Homo sapiens
ggtcaccttcctgggcagccca

SEQ ID NO: 355170 - DNA, 24 bp, Homo sapiens
ggtcaccttcctgggcagcccaga

SEQ ID NO: 355171 - DNA, 13 bp, Homo sapiens
ggtcactcctggg

SEQ ID NO: 355172 - DNA, 15 bp, Homo sapiens
ggtcactgccatgga

SEQ ID NO: 355173 - DNA, 17 bp, Homo sapiens
ggtcacttaagggggga

SEQ ID NO: 355174 - DNA, 17 bp, Homo sapiens
ggtcagagggactgtca

SEQ ID NO: 355175 - DNA, 23 bp, Homo sapiens
ggtcagcaccgtggtgtgaggcc

SEQ ID NO: 355176 - DNA, 20 bp, Homo sapiens
ggtcagcagaaacccccagg

SEQ ID NO: 355177 - DNA, 13 bp, Homo sapiens
ggtcagcagagcc

SEQ ID NO: 355178 - DNA, 14 bp, Homo sapiens
ggtcagcagagccg

SEQ ID NO: 355179 - DNA, 18 bp, Homo sapiens
ggtcagctcccttctctg

SEQ ID NO: 355180 - DNA, 13 bp, Homo sapiens
ggtcaggctccat

SEQ ID NO: 355181 - DNA, 20 bp, Homo sapiens
ggtcaggttatactcctcct

SEQ ID NO: 355182 - DNA, 17 bp, Homo sapiens
ggtcagtacccacctga

SEQ ID NO: 355183 - DNA, 20 bp, Homo sapiens
ggtcagtgaagcccaggagg

SEQ ID NO: 355184 - DNA, 19 bp, Homo sapiens
ggtcagtgtggagaggggt

SEQ ID NO: 355185 - DNA, 19 bp, Homo sapiens
ggtcagtgttataaaatct

SEQ ID NO: 355186 - DNA, 21 bp, Homo sapiens
ggtcatactatctactctcct

SEQ ID NO: 355187 - DNA, 21 bp, Homo sapiens
ggtcataggctcactctttcc

SEQ ID NO: 355188 - DNA, 19 bp, Homo sapiens
ggtcatcccggggccatgg

SEQ ID NO: 355189 - DNA, 22 bp, Homo sapiens
ggtcatcccggggccatggaag

SEQ ID NO: 355190 - DNA, 19 bp, Homo sapiens
ggtcatttcagagccctcg

SEQ ID NO: 355191 - DNA, 17 bp, Homo sapiens
ggtcattttcctttctg

SEQ ID NO: 355192 - DNA, 10 bp, Homo sapiens
ggtccacatt

SEQ ID NO: 355193 - DNA, 15 bp, Homo sapiens
ggtccaccccgtccc

SEQ ID NO: 355194 - DNA, 18 bp, Homo sapiens
ggtccaccccgtcccggc

SEQ ID NO: 355195 - DNA, 20 bp, Homo sapiens
ggtccaccccgtcccggccc

SEQ ID NO: 355196 - DNA, 15 bp, Homo sapiens
ggtccactccctgct

SEQ ID NO: 355197 - DNA, 20 bp, Homo sapiens
ggtccagagaccacaccact

SEQ ID NO: 355198 - DNA, 14 bp, Homo sapiens
ggtccaggaaggca

SEQ ID NO: 355199 - DNA, 16 bp, Homo sapiens
ggtccaggaaggcagc

SEQ ID NO: 355200 - DNA, 17 bp, Homo sapiens
ggtccaggaaggcagct

SEQ ID NO: 355201 - DNA, 20 bp, Homo sapiens
ggtccaggaaggcagctgct

SEQ ID NO: 355202 - DNA, 21 bp, Homo sapiens
ggtccaggccaggcctcatcc

SEQ ID NO: 355203 - DNA, 19 bp, Homo sapiens
ggtccatttcatgtgatct

SEQ ID NO: 355204 - DNA, 17 bp, Homo sapiens
ggtcccaggaagcaggg

SEQ ID NO: 355205 - DNA, 17 bp, Homo sapiens
ggtcccccatgccacca

SEQ ID NO: 355206 - DNA, 16 bp, Homo sapiens
ggtcccccctgagtgg

SEQ ID NO: 355207 - DNA, 20 bp, Homo sapiens
ggtccccggacgctggctcg

SEQ ID NO: 355208 - DNA, 21 bp, Homo sapiens
ggtccccggacgctggctcgg

SEQ ID NO: 355209 - DNA, 20 bp, Homo sapiens
ggtccctaattctcttcgct

SEQ ID NO: 355210 - DNA, 17 bp, Homo sapiens
ggtccgagctctgtcct

SEQ ID NO: 355211 - DNA, 14 bp, Homo sapiens
ggtccgcaccagct

SEQ ID NO: 355212 - DNA, 15 bp, Homo sapiens
ggtccgcaccagctg

SEQ ID NO: 355213 - DNA, 18 bp, Homo sapiens
ggtccgcaccagctgctc

SEQ ID NO: 355214 - DNA, 23 bp, Homo sapiens
ggtccgcaccagctgctctgccc

SEQ ID NO: 355215 - DNA, 22 bp, Homo sapiens
ggtcctcacaagcctcttctga

SEQ ID NO: 355216 - DNA, 19 bp, Homo sapiens
ggtcctcttaggtcccggg

SEQ ID NO: 355217 - DNA, 11 bp, Homo sapiens
ggtcctgccct

SEQ ID NO: 355218 - DNA, 22 bp, Homo sapiens
ggtcctgctatttcccaagctg

SEQ ID NO: 355219 - DNA, 14 bp, Homo sapiens
ggtcctgctgctcg

SEQ ID NO: 355220 - DNA, 21 bp, Homo sapiens
ggtcctgctgctcgggaaggc

SEQ ID NO: 355221 - DNA, 15 bp, Homo sapiens
ggtcctggctcctga

SEQ ID NO: 355222 - DNA, 16 bp, Homo sapiens
ggtcctggggaggctg

SEQ ID NO: 355223 - DNA, 17 bp, Homo sapiens
ggtcctgtctcccctct

SEQ ID NO: 355224 - DNA, 15 bp, Homo sapiens
ggtcctgtgcctgga

SEQ ID NO: 355225 - DNA, 16 bp, Homo sapiens
ggtcctttaggcagcc

SEQ ID NO: 355226 - DNA, 19 bp, Homo sapiens
ggtcctttaggcagcctgc

SEQ ID NO: 355227 - DNA, 21 bp, Homo sapiens
ggtcctttaggcagcctgccg

SEQ ID NO: 355228 - DNA, 21 bp, Homo sapiens
ggtcctttccttctcgtcttc

SEQ ID NO: 355229 - DNA, 12 bp, Homo sapiens
ggtcgcccctcc

SEQ ID NO: 355230 - DNA, 15 bp, Homo sapiens
ggtcggaagcctgtc

SEQ ID NO: 355231 - DNA, 13 bp, Homo sapiens
ggtcggccctgcc

SEQ ID NO: 355232 - DNA, 17 bp, Homo sapiens
ggtcgtgctcatgtctg

SEQ ID NO: 355233 - DNA, 16 bp, Homo sapiens
ggtcgtggtggagaat

SEQ ID NO: 355234 - DNA, 20 bp, Homo sapiens
ggtctatttctcccttcaat

SEQ ID NO: 355235 - DNA, 15 bp, Homo sapiens
ggtctcagaggaggg

SEQ ID NO: 355236 - DNA, 20 bp, Homo sapiens
ggtctccatgaagaagctgg

SEQ ID NO: 355237 - DNA, 19 bp, Homo sapiens
gtctcgctttgttgcccag

SEQ ID NO: 355238 - DNA, 18 bp, Homo sapiens
gtctcgtcaggaggtgcc

SEQ ID NO: 355239 - DNA, 13 bp, Homo sapiens
gtctctaaagcac

SEQ ID NO: 355240 - DNA, 22 bp, Homo sapiens
gtctctaagccaactttaattg

SEQ ID NO: 355241 - DNA, 20 bp, Homo sapiens
gtctctacaaaaaaaatcaa

SEQ ID NO: 355242 - DNA, 12 bp, Homo sapiens
gtctctagagca

SEQ ID NO: 355243 - DNA, 17 bp, Homo sapiens
gtctctcacctagacct

SEQ ID NO: 355244 - DNA, 16 bp, Homo sapiens
gtctctcccaccccgg

SEQ ID NO: 355245 - DNA, 20 bp, Homo sapiens
gtctctccctaccctcttct

SEQ ID NO: 355246 - DNA, 23 bp, Homo sapiens
gtctctccctaccctcttctcag

SEQ ID NO: 355247 - DNA, 14 bp, Homo sapiens
gtctctctctcttt

SEQ ID NO: 355248 - DNA, 15 bp, Homo sapiens
gtctctctctctttt

SEQ ID NO: 355249 - DNA, 11 bp, Homo sapiens
gtctctctgtg

SEQ ID NO: 355250 - DNA, 13 bp, Homo sapiens
gtctctgagcagt

SEQ ID NO: 355251 - DNA, 14 bp, Homo sapiens
gtctctgagcagtg

SEQ ID NO: 355252 - DNA, 17 bp, Homo sapiens
gtctctgagccccctgt

SEQ ID NO: 355253 - DNA, 16 bp, Homo sapiens
gtctctgcagtgtcca

SEQ ID NO: 355254 - DNA, 17 bp, Homo sapiens
gtctctgcagtgtccat

SEQ ID NO: 355255 - DNA, 13 bp, Homo sapiens
gtctctgccaccc

SEQ ID NO: 355256 - DNA, 18 bp, Homo sapiens
gtctctgccatgtggcag

SEQ ID NO: 355257 - DNA, 19 bp, Homo sapiens
gtctctgccatgtggcaga

SEQ ID NO: 355258 - DNA, 12 bp, Homo sapiens
gtctctgctgaa

SEQ ID NO: 355259 - DNA, 15 bp, Homo sapiens
gtctctgcttccatg

SEQ ID NO: 355260 - DNA, 17 bp, Homo sapiens
gtctctgcttccatggc

SEQ ID NO: 355261 - DNA, 23 bp, Homo sapiens
gtctctgggtttacaacaaacac

SEQ ID NO: 355262 - DNA, 17 bp, Homo sapiens
gtctcttctccactgga

SEQ ID NO: 355263 - DNA, 14 bp, Homo sapiens
gtctcttgtagaag

SEQ ID NO: 355264 - DNA, 14 bp, Homo sapiens
gtctctttctttcc

SEQ ID NO: 355265 - DNA, 16 bp, Homo sapiens
gtctctttctttccaa

SEQ ID NO: 355266 - DNA, 22 bp, Homo sapiens
gtctcttttgttcctggctttg

SEQ ID NO: 355267 - DNA, 19 bp, Homo sapiens
gtctgaaatacctttgcct

SEQ ID NO: 355268 - DNA, 15 bp, Homo sapiens
gtctgaacagctgta

SEQ ID NO: 355269 - DNA, 20 bp, Homo sapiens
gtctgaaccaccctggaaat

SEQ ID NO: 355270 - DNA, 19 bp, Homo sapiens
gtctgaacccttgtgcttg

SEQ ID NO: 355271 - DNA, 20 bp, Homo sapiens
gtctgaaggaatagccagag

SEQ ID NO: 355272 - DNA, 22 bp, Homo sapiens
gtctgaaggaatagccagagag

SEQ ID NO: 355273 - DNA, 22 bp, Homo sapiens
gtctgaaggactggattggcca

SEQ ID NO: 355274 - DNA, 16 bp, Homo sapiens
gtctgaaggagaggag

SEQ ID NO: 355275 - DNA, 15 bp, Homo sapiens
gtctgaatgttctga

SEQ ID NO: 355276 - DNA, 18 bp, Homo sapiens
gtctgaatgttctgacat

SEQ ID NO: 355277 - DNA, 22 bp, Homo sapiens
gtctgacaggaagactggagac

SEQ ID NO: 355278 - DNA, 17 bp, Homo sapiens
gtctgacatcctgacct

SEQ ID NO: 355279 - DNA, 14 bp, Homo sapiens
gtctgaccctctcc

SEQ ID NO: 355280 - DNA, 16 bp, Homo sapiens
gtctgactccagagtc

SEQ ID NO: 355281 - DNA, 20 bp, Homo sapiens
gtctgactccagagtctgag

SEQ ID NO: 355282 - DNA, 23 bp, Homo sapiens
gtctgactccagagtctgagccc

SEQ ID NO: 355283 - DNA, 12 bp, Homo sapiens
gtctgactcctt

SEQ ID NO: 355284 - DNA, 14 bp, Homo sapiens
gtctgactgtgtgt

SEQ ID NO: 355285 - DNA, 21 bp, Homo sapiens
gtctgagaaggctaaagaaga

SEQ ID NO: 355286 - DNA, 19 bp, Homo sapiens
gtctgagagaccatctcct

SEQ ID NO: 355287 - DNA, 17 bp, Homo sapiens
gtctgagccaaagagaa

SEQ ID NO: 355288 - DNA, 18 bp, Homo sapiens
gtctgagccaaagagaat

SEQ ID NO: 355289 - DNA, 12 bp, Homo sapiens
gtctgagccccc

SEQ ID NO: 355290 - DNA, 24 bp, Homo sapiens
gtctgagccctgccctcactccac

SEQ ID NO: 355291 - DNA, 22 bp, Homo sapiens
gtctgagcggccgcctgtcctt

SEQ ID NO: 355292 - DNA, 12 bp, Homo sapiens
gtctgagtcatc

SEQ ID NO: 355293 - DNA, 15 bp, Homo sapiens
gtctgatattggtgt

SEQ ID NO: 355294 - DNA, 21 bp, Homo sapiens
gtctgcaaaggagggcctcag

SEQ ID NO: 355295 - DNA, 22 bp, Homo sapiens
gtctgcaaaggagggcctcaga

SEQ ID NO: 355296 - DNA, 21 bp, Homo sapiens
gtctgcacacataacacacat

SEQ ID NO: 355297 - DNA, 22 bp, Homo sapiens
gtctgcagctattcacacacac

SEQ ID NO: 355298 - DNA, 16 bp, Homo sapiens
gtctgcaggccaccag

SEQ ID NO: 355299 - DNA, 14 bp, Homo sapiens
gtctgcatggcaga

SEQ ID NO: 355300 - DNA, 23 bp, Homo sapiens
gtctgcatgtcttttatcattgc

SEQ ID NO: 355301 - DNA, 17 bp, Homo sapiens
gtctgcattttctcagg

SEQ ID NO: 355302 - DNA, 19 bp, Homo sapiens
gtctgcattttctcaggca

SEQ ID NO: 355303 - DNA, 11 bp, Homo sapiens
gtctgccaggc

SEQ ID NO: 355304 - DNA, 17 bp, Homo sapiens
gtctgccaggcccatct

SEQ ID NO: 355305 - DNA, 22 bp, Homo sapiens
gtctgccaggcccatctcaggt

SEQ ID NO: 355306 - DNA, 19 bp, Homo sapiens
gtctgccccttgaccccac

SEQ ID NO: 355307 - DNA, 16 bp, Homo sapiens
gtctgccgtgagagcc

SEQ ID NO: 355308 - DNA, 20 bp, Homo sapiens
gtctgcctcccacgctggga

SEQ ID NO: 355309 - DNA, 17 bp, Homo sapiens
gtctgcctgcctcatgc

SEQ ID NO: 355310 - DNA, 15 bp, Homo sapiens
gtctgcctgtatttt

SEQ ID NO: 355311 - DNA, 17 bp, Homo sapiens
gtctgcgccgctgtgct

SEQ ID NO: 355312 - DNA, 18 bp, Homo sapiens
gtctgctaggcgctgggg

SEQ ID NO: 355313 - DNA, 15 bp, Homo sapiens
gtctgctatattttc

SEQ ID NO: 355314 - DNA, 18 bp, Homo sapiens
gtctgctatattttcatg

SEQ ID NO: 355315 - DNA, 17 bp, Homo sapiens
gtctgctctttctctgc

SEQ ID NO: 355316 - DNA, 19 bp, Homo sapiens
gtctgctgccctccatccc

SEQ ID NO: 355317 - DNA, 14 bp, Homo sapiens
gtctgctgctccca

SEQ ID NO: 355318 - DNA, 19 bp, Homo sapiens
gtctgcttaccaaaacata

SEQ ID NO: 355319 - DNA, 19 bp, Homo sapiens
gtctggaatcccagctccg

SEQ ID NO: 355320 - DNA, 20 bp, Homo sapiens
gtctggaatcccagctccgc

SEQ ID NO: 355321 - DNA, 22 bp, Homo sapiens
gtctggagaccaggactctgcc

SEQ ID NO: 355322 - DNA, 22 bp, Homo sapiens
gtctggagcccctatcctgcac

SEQ ID NO: 355323 - DNA, 19 bp, Homo sapiens
gtctggcgagcccttagcc

SEQ ID NO: 355324 - DNA, 20 bp, Homo sapiens
gtctggctcggacccacccc

SEQ ID NO: 355325 - DNA, 16 bp, Homo sapiens
gtctggctgtggcccc

SEQ ID NO: 355326 - DNA, 19 bp, Homo sapiens
gtctggctgtggcccctcc

SEQ ID NO: 355327 - DNA, 20 bp, Homo sapiens
gtctgggacttccttgctct

SEQ ID NO: 355328 - DNA, 21 bp, Homo sapiens
gtctgggacttccttgctctc

SEQ ID NO: 355329 - DNA, 14 bp, Homo sapiens
gtctgggaggcagg

SEQ ID NO: 355330 - DNA, 15 bp, Homo sapiens
gtctgggaggcaggt

SEQ ID NO: 355331 - DNA, 21 bp, Homo sapiens
gtctgggagtgttctgtttcc

SEQ ID NO: 355332 - DNA, 19 bp, Homo sapiens
gtctgggatgtagaacttc

SEQ ID NO: 355333 - DNA, 12 bp, Homo sapiens
gtctgggcctct

SEQ ID NO: 355334 - DNA, 16 bp, Homo sapiens
gtctggttttaacaat

SEQ ID NO: 355335 - DNA, 23 bp, Homo sapiens
gtctgtactccttggatttgcat

SEQ ID NO: 355336 - DNA, 14 bp, Homo sapiens
gtctgtagtgtttt

SEQ ID NO: 355337 - DNA, 16 bp, Homo sapiens
gtctgtattcatacag

SEQ ID NO: 355338 - DNA, 19 bp, Homo sapiens
gtctgtatttatgtgtgag

SEQ ID NO: 355339 - DNA, 22 bp, Homo sapiens
gtctgtcatgaacatgttcctg

SEQ ID NO: 355340 - DNA, 23 bp, Homo sapiens
gtctgtcctatggagcctctgca

SEQ ID NO: 355341 - DNA, 15 bp, Homo sapiens
gtctgtctactgtgg

SEQ ID NO: 355342 - DNA, 16 bp, Homo sapiens
gtctgtctgtctgtcc

SEQ ID NO: 355343 - DNA, 21 bp, Homo sapiens
gtctgtgaaagtctcctgtat

SEQ ID NO: 355344 - DNA, 19 bp, Homo sapiens
gtctgtgaataaagccaca

SEQ ID NO: 355345 - DNA, 14 bp, Homo sapiens
gtctgtgattgcca

SEQ ID NO: 355346 - DNA, 17 bp, Homo sapiens
gtctgtgcctggagctc

SEQ ID NO: 355347 - DNA, 12 bp, Homo sapiens
gtctgtgctctt

SEQ ID NO: 355348 - DNA, 14 bp, Homo sapiens
gtctgtgctgtgcc

SEQ ID NO: 355349 - DNA, 16 bp, Homo sapiens
gtctgtgctgtgcctg

SEQ ID NO: 355350 - DNA, 18 bp, Homo sapiens
gtctgtgctgtgcctgct

SEQ ID NO: 355351 - DNA, 19 bp, Homo sapiens
gtctgtgctgtgcctgcta

SEQ ID NO: 355352 - DNA, 20 bp, Homo sapiens
gtctgtggtccagaagaaat

SEQ ID NO: 355353 - DNA, 17 bp, Homo sapiens
gtctgtgtgcaagtgtg

SEQ ID NO: 355354 - DNA, 16 bp, Homo sapiens
gtctgtgtgtagccag

SEQ ID NO: 355355 - DNA, 22 bp, Homo sapiens
gtctgtttccaggtcagaaacc

SEQ ID NO: 355356 - DNA, 21 bp, Homo sapiens
gtctgtttccttctctttctc

SEQ ID NO: 355357 - DNA, 14 bp, Homo sapiens
gtcttaaataaaac

SEQ ID NO: 355358 - DNA, 16 bp, Homo sapiens
gtcttaaataaaacta

SEQ ID NO: 355359 - DNA, 14 bp, Homo sapiens
gtcttacaggaagc

SEQ ID NO: 355360 - DNA, 16 bp, Homo sapiens
gtcttactactttaaa

SEQ ID NO: 355361 - DNA, 15 bp, Homo sapiens
gtcttagagagagag

SEQ ID NO: 355362 - DNA, 16 bp, Homo sapiens
gtcttagagagagaga

SEQ ID NO: 355363 - DNA, 22 bp, Homo sapiens
gtcttcaaccctgccctgcacc

SEQ ID NO: 355364 - DNA, 20 bp, Homo sapiens
gtcttcaatctctgttctgc

SEQ ID NO: 355365 - DNA, 18 bp, Homo sapiens
gtcttcacttgcactggg

SEQ ID NO: 355366 - DNA, 14 bp, Homo sapiens
gtcttcagatcctg

SEQ ID NO: 355367 - DNA, 17 bp, Homo sapiens
gtcttcagatcctgctg

SEQ ID NO: 355368 - DNA, 20 bp, Homo sapiens
gtcttcagatcctgctgccg

SEQ ID NO: 355369 - DNA, 18 bp, Homo sapiens
gtcttcagggggccaggt

SEQ ID NO: 355370 - DNA, 15 bp, Homo sapiens
gtgattgacaactga

SEQ ID NO: 355371 - DNA, 22 bp, Homo sapiens
gtgattgccatttcttcccaag

SEQ ID NO: 355372 - DNA, 17 bp, Homo sapiens
gtgatttatgcatttat

SEQ ID NO: 355373 - DNA, 21 bp, Homo sapiens
gtgatttatttggagtggagg

SEQ ID NO: 355374 - DNA, 19 bp, Homo sapiens
gtgcaaaacatgctacctg

SEQ ID NO: 355375 - DNA, 22 bp, Homo sapiens
gtgcaaagttccctacttcctg

SEQ ID NO: 355376 - DNA, 15 bp, Homo sapiens
gtgcaacagcactgg

SEQ ID NO: 355377 - DNA, 20 bp, Homo sapiens
gtgcaacagcactggctctc

SEQ ID NO: 355378 - DNA, 23 bp, Homo sapiens
gtgcaacagcactggctctctcc

SEQ ID NO: 355379 - DNA, 23 bp, Homo sapiens
gtgcaacccttaccccttagcct

SEQ ID NO: 355380 - DNA, 18 bp, Homo sapiens
gtgcaactcttgtattgc

SEQ ID NO: 355381 - DNA, 14 bp, Homo sapiens
gtgcaagtgtgtgc

SEQ ID NO: 355382 - DNA, 15 bp, Homo sapiens
gtgcaagtgtgtgca

SEQ ID NO: 355383 - DNA, 15 bp, Homo sapiens
gtgcaatatgagggg

SEQ ID NO: 355384 - DNA, 17 bp, Homo sapiens
gtgcaatgagccagatg

SEQ ID NO: 355385 - DNA, 16 bp, Homo sapiens
gtgcacattctccctt

SEQ ID NO: 355386 - DNA, 18 bp, Homo sapiens
gtgcacccactcaccagg

SEQ ID NO: 355387 - DNA, 20 bp, Homo sapiens
gtgcacccactcaccagggt

SEQ ID NO: 355388 - DNA, 16 bp, Homo sapiens
gtgcacgtggagagct

SEQ ID NO: 355389 - DNA, 13 bp, Homo sapiens
gtgcactccagct

SEQ ID NO: 355390 - DNA, 15 bp, Homo sapiens
gtgcactccagcttc

SEQ ID NO: 355391 - DNA, 23 bp, Homo sapiens
gtgcactgaatcgtttcatgtaa

SEQ ID NO: 355392 - DNA, 13 bp, Homo sapiens
gtgcactggcccc

SEQ ID NO: 355393 - DNA, 13 bp, Homo sapiens
gtgcactgtcact

SEQ ID NO: 355394 - DNA, 15 bp, Homo sapiens
gtgcacttttctgtg

SEQ ID NO: 355395 - DNA, 15 bp, Homo sapiens
gtgcagaacacctgg

SEQ ID NO: 355396 - DNA, 19 bp, Homo sapiens
gtgcagagaggttgtgaaa

SEQ ID NO: 355397 - DNA, 17 bp, Homo sapiens
gtgcagaggctgagcag

SEQ ID NO: 355398 - DNA, 16 bp, Homo sapiens
gtgcagcagcccagct

SEQ ID NO: 355399 - DNA, 20 bp, Homo sapiens
gtgggctggtgccccacagc

SEQ ID NO: 355400 - DNA, 21 bp, Homo sapiens
gtgggctttctccggggtctg

SEQ ID NO: 355401 - DNA, 17 bp, Homo sapiens
gtggggaagagagcctg

SEQ ID NO: 355402 - DNA, 19 bp, Homo sapiens
gtggggaagagagcctgcc

SEQ ID NO: 355403 - DNA, 21 bp, Homo sapiens
gtggggaagcaagacgtcctg

SEQ ID NO: 355404 - DNA, 22 bp, Homo sapiens
gtggggagacacctcagagccc

SEQ ID NO: 355405 - DNA, 15 bp, Homo sapiens
gtggggagggtgggc

SEQ ID NO: 355406 - DNA, 16 bp, Homo sapiens
gtggggatgtttgtgc

SEQ ID NO: 355407 - DNA, 15 bp, Homo sapiens
gtggggattgcccat

SEQ ID NO: 355408 - DNA, 16 bp, Homo sapiens
gtggggatttctccca

SEQ ID NO: 355409 - DNA, 13 bp, Homo sapiens
gtggggcaagcct

SEQ ID NO: 355410 - DNA, 22 bp, Homo sapiens
gtggggcaagcctgagtggtga

SEQ ID NO: 355411 - DNA, 14 bp, Homo sapiens
gtggggcactcctt

SEQ ID NO: 355412 - DNA, 12 bp, Homo sapiens
gtggggcagcac

SEQ ID NO: 355413 - DNA, 19 bp, Homo sapiens
gtggggcagcacagagagg

SEQ ID NO: 355414 - DNA, 21 bp, Homo sapiens
gtggggcccatggccccagct

SEQ ID NO: 355415 - DNA, 23 bp, Homo sapiens
gtggggcccatggccccagctgg

SEQ ID NO: 355416 - DNA, 23 bp, Homo sapiens
gtggggccccaaagcccagcccg

SEQ ID NO: 355417 - DNA, 16 bp, Homo sapiens
gtggggcctccttgtc

SEQ ID NO: 355418 - DNA, 14 bp, Homo sapiens
gtggggcctgatgg

SEQ ID NO: 355419 - DNA, 16 bp, Homo sapiens
gtggggctgagcctga

SEQ ID NO: 355420 - DNA, 18 bp, Homo sapiens
gtggggcttagaatgggg

SEQ ID NO: 355421 - DNA, 21 bp, Homo sapiens
gtgggggagaatggctctggc

SEQ ID NO: 355422 - DNA, 13 bp, Homo sapiens
gtgggggagcctg

SEQ ID NO: 355423 - DNA, 19 bp, Homo sapiens
gtgggggtctgggaggcag

SEQ ID NO: 355424 - DNA, 20 bp, Homo sapiens
gtgggggtctgggaggcagg

SEQ ID NO: 355425 - DNA, 16 bp, Homo sapiens
gtgggggttggctggg

SEQ ID NO: 355426 - DNA, 23 bp, Homo sapiens
gtggggtcccccctgagtgggct

SEQ ID NO: 355427 - DNA, 17 bp, Homo sapiens
gtggggtgaagctgggg

SEQ ID NO: 355428 - DNA, 22 bp, Homo sapiens
gtgggtaagactaaatctgtaa

SEQ ID NO: 355429 - DNA, 17 bp, Homo sapiens
gtgggtacccaggctgg

SEQ ID NO: 355430 - DNA, 14 bp, Homo sapiens
gtgggtacgggagg

SEQ ID NO: 355431 - DNA, 18 bp, Homo sapiens
gtgggtatcccacctcca

SEQ ID NO: 355432 - DNA, 20 bp, Homo sapiens
gtgggtatcccacctccagc

SEQ ID NO: 355433 - DNA, 21 bp, Homo sapiens
gtgggtatttcttatttgaaa

SEQ ID NO: 355434 - DNA, 23 bp, Homo sapiens
gtgggtatttcttatttgaaagt

SEQ ID NO: 355435 - DNA, 17 bp, Homo sapiens
gtgggtcaactccaagg

SEQ ID NO: 355436 - DNA, 19 bp, Homo sapiens
gtgggtcacctgacctctg

SEQ ID NO: 355437 - DNA, 22 bp, Homo sapiens
gtgggtcatcccagcacctgcc

SEQ ID NO: 355438 - DNA, 18 bp, Homo sapiens
gtgggtccaggaaggcag

SEQ ID NO: 355439 - DNA, 21 bp, Homo sapiens
gtgggtcttggattggtacca

SEQ ID NO: 355440 - DNA, 13 bp, Homo sapiens
gtgggtgaccagg

SEQ ID NO: 355441 - DNA, 19 bp, Homo sapiens
gtgggtggaaccaggaacc

SEQ ID NO: 355442 - DNA, 20 bp, Homo sapiens
gtgggtggcacctcctgaga

SEQ ID NO: 355443 - DNA, 15 bp, Homo sapiens
gtgggtggggaagga

SEQ ID NO: 355444 - DNA, 17 bp, Homo sapiens
gtgggtttagcaggctg

SEQ ID NO: 355445 - DNA, 22 bp, Homo sapiens
gtgggttttattgtccttcaga

SEQ ID NO: 355446 - DNA, 20 bp, Homo sapiens
gtggtacacacagattactg

SEQ ID NO: 355447 - DNA, 21 bp, Homo sapiens
gtggtaccctggcagagaaga

SEQ ID NO: 355448 - DNA, 20 bp, Homo sapiens
gtggtactttattcttgctg

SEQ ID NO: 355449 - DNA, 22 bp, Homo sapiens
gtggtattggccgatgagctgg

SEQ ID NO: 355450 - DNA, 23 bp, Homo sapiens
gtggtcagagggactgtcagctg

SEQ ID NO: 355451 - DNA, 16 bp, Homo sapiens
gtggtcagcagaaacc

SEQ ID NO: 355452 - DNA, 16 bp, Homo sapiens
gtggtcattaagcatt

SEQ ID NO: 355453 - DNA, 13 bp, Homo sapiens
gtggtctatttct

SEQ ID NO: 355454 - DNA, 16 bp, Homo sapiens
gtggtctcctctcagc

SEQ ID NO: 355455 - DNA, 18 bp, Homo sapiens
gtggtctcctctcagctt

SEQ ID NO: 355456 - DNA, 14 bp, Homo sapiens
gtggtctgaatgtt

SEQ ID NO: 355457 - DNA, 18 bp, Homo sapiens
gtggtctgaatgttctga

SEQ ID NO: 355458 - DNA, 24 bp, Homo sapiens
gtggtctgaatgttctgacattaa

SEQ ID NO: 355459 - DNA, 16 bp, Homo sapiens
gtggtctttctggaga

SEQ ID NO: 355460 - DNA, 21 bp, Homo sapiens
gtggtgagaggcatccagtat

SEQ ID NO: 355461 - DNA, 23 bp, Homo sapiens
gtggtgagcagaagtggagctgg

SEQ ID NO: 355462 - DNA, 19 bp, Homo sapiens
gtggtgatcaattaaatgt

SEQ ID NO: 355463 - DNA, 20 bp, Homo sapiens
gtggtgatcgcacaaggaca

SEQ ID NO: 355464 - DNA, 15 bp, Homo sapiens
gtggtgcagccccag

SEQ ID NO: 355465 - DNA, 16 bp, Homo sapiens
gtggtgcagccccagg

SEQ ID NO: 355466 - DNA, 19 bp, Homo sapiens
gtggtgcagccttcccctc

SEQ ID NO: 355467 - DNA, 18 bp, Homo sapiens
gtggtggcgggcgcctgt

SEQ ID NO: 355468 - DNA, 15 bp, Homo sapiens
gtggtggctctgaga

SEQ ID NO: 355469 - DNA, 19 bp, Homo sapiens
gtggtggcttcggcctgct

SEQ ID NO: 355470 - DNA, 13 bp, Homo sapiens
gtggtgtccttct

SEQ ID NO: 355471 - DNA, 20 bp, Homo sapiens
gtggttacagtgcagacagg

SEQ ID NO: 355472 - DNA, 21 bp, Homo sapiens
gtggttaccgagtatctgtaa

SEQ ID NO: 355473 - DNA, 22 bp, Homo sapiens
gtggttatttctcaacaaagca

SEQ ID NO: 355474 - DNA, 19 bp, Homo sapiens
gtggttctattttactttg

SEQ ID NO: 355475 - DNA, 23 bp, Homo sapiens
gtggttctattttactttgtact

SEQ ID NO: 355476 - DNA, 23 bp, Homo sapiens
taactagtgtttctgcagaggca

SEQ ID NO: 355477 - DNA, 23 bp, Homo sapiens
taactcagatcactactgcagtc

SEQ ID NO: 355478 - DNA, 22 bp, Homo sapiens
taactcatggcaggcatctgta

SEQ ID NO: 355479 - DNA, 18 bp, Homo sapiens
taactctcgggacctcgt

SEQ ID NO: 355480 - DNA, 13 bp, Homo sapiens
taactctgcatag

SEQ ID NO: 355481 - DNA, 13 bp, Homo sapiens
taactcttgctca

SEQ ID NO: 355482 - DNA, 15 bp, Homo sapiens
taactcttgctcact

SEQ ID NO: 355483 - DNA, 17 bp, Homo sapiens
taactgaaaatgtaaat

SEQ ID NO: 355484 - DNA, 14 bp, Homo sapiens
taactgactattct

SEQ ID NO: 355485 - DNA, 11 bp, Homo sapiens
taactgagctg

SEQ ID NO: 355486 - DNA, 20 bp, Homo sapiens
taactgagtagctctcctga

SEQ ID NO: 355487 - DNA, 23 bp, Homo sapiens
taactgagtagctctcctgactt

SEQ ID NO: 355488 - DNA, 14 bp, Homo sapiens
taactgcattctat

SEQ ID NO: 355489 - DNA, 16 bp, Homo sapiens
taactgcattctataa

SEQ ID NO: 355490 - DNA, 17 bp, Homo sapiens
taactgcattctataat

SEQ ID NO: 355491 - DNA, 17 bp, Homo sapiens
taactgcccaaagcagc

SEQ ID NO: 355492 - DNA, 18 bp, Homo sapiens
taactgccttaaaacttt

SEQ ID NO: 355493 - DNA, 11 bp, Homo sapiens
taactgctgca

SEQ ID NO: 355494 - DNA, 16 bp, Homo sapiens
taactggatattcttt

SEQ ID NO: 355495 - DNA, 15 bp, Homo sapiens
taactggccccaggc

SEQ ID NO: 355496 - DNA, 17 bp, Homo sapiens
taactgggttcaaaaag

SEQ ID NO: 355497 - DNA, 16 bp, Homo sapiens
taactgtatgtgtctt

SEQ ID NO: 355498 - DNA, 23 bp, Homo sapiens
taactgtcctttttcttccctta

SEQ ID NO: 355499 - DNA, 13 bp, Homo sapiens
taactgtgaagtt

SEQ ID NO: 355500 - DNA, 15 bp, Homo sapiens
taactgtgcactata

SEQ ID NO: 355501 - DNA, 16 bp, Homo sapiens
taactgtgcagagact

SEQ ID NO: 355502 - DNA, 15 bp, Homo sapiens
taactgtgtatgtac

SEQ ID NO: 355503 - DNA, 18 bp, Homo sapiens
taactgtgtatgtacata

SEQ ID NO: 355504 - DNA, 22 bp, Homo sapiens
taactgtgtatgtacatatata

SEQ ID NO: 355505 - DNA, 14 bp, Homo sapiens
taacttaaataatt

SEQ ID NO: 355506 - DNA, 16 bp, Homo sapiens
taacttaacattgcat

SEQ ID NO: 355507 - DNA, 20 bp, Homo sapiens
taacttagtgtttagcatta

SEQ ID NO: 355508 - DNA, 22 bp, Homo sapiens
taacttagtgtttagcattaaa

SEQ ID NO: 355509 - DNA, 19 bp, Homo sapiens
taacttccttcacatctcc

SEQ ID NO: 355510 - DNA, 15 bp, Homo sapiens
taacttgctgtgaaa

SEQ ID NO: 355511 - DNA, 18 bp, Homo sapiens
taacttgctgtgaaatga

SEQ ID NO: 355512 - DNA, 12 bp, Homo sapiens
taactttaagtt

SEQ ID NO: 355513 - DNA, 15 bp, Homo sapiens
taactttaagtttca

SEQ ID NO: 355514 - DNA, 16 bp, Homo sapiens
taactttaagtttcag

SEQ ID NO: 355515 - DNA, 17 bp, Homo sapiens
taactttatcacattat

SEQ ID NO: 355516 - DNA, 16 bp, Homo sapiens
taactttctgaaataa

SEQ ID NO: 355517 - DNA, 13 bp, Homo sapiens
taactttgcatgt

SEQ ID NO: 355518 - DNA, 16 bp, Homo sapiens
taacttttattatctt

SEQ ID NO: 355519 - DNA, 20 bp, Homo sapiens
taagaaaaaataacacacat

SEQ ID NO: 355520 - DNA, 17 bp, Homo sapiens
taagaaaaaggaaattg

SEQ ID NO: 355521 - DNA, 23 bp, Homo sapiens
taagaaaacaaaatctaaaacaa

SEQ ID NO: 355522 - DNA, 14 bp, Homo sapiens
taagaaaatacaat

SEQ ID NO: 355523 - DNA, 18 bp, Homo sapiens
taagaaaatacaataaac

SEQ ID NO: 355524 - DNA, 19 bp, Homo sapiens
taagaaaatacaataaact

SEQ ID NO: 355525 - DNA, 19 bp, Homo sapiens
taagaaaatagagatgagc

SEQ ID NO: 355526 - DNA, 21 bp, Homo sapiens
taagaaaatagagatgagctt

SEQ ID NO: 355527 - DNA, 22 bp, Homo sapiens
taagaaacacagggttttgtat

SEQ ID NO: 355528 - DNA, 23 bp, Homo sapiens
taagaaacacagggttttgtatt

SEQ ID NO: 355529 - DNA, 18 bp, Homo sapiens
taagaaagtgaagcaaat

SEQ ID NO: 355530 - DNA, 17 bp, Homo sapiens
taagaaatggctttcca

SEQ ID NO: 355531 - DNA, 19 bp, Homo sapiens
taagaaccttttgagtgcc

SEQ ID NO: 355532 - DNA, 16 bp, Homo sapiens
taagaagtacaataag

SEQ ID NO: 355533 - DNA, 18 bp, Homo sapiens
taagaagtggtgttccat

SEQ ID NO: 355534 - DNA, 19 bp, Homo sapiens
taagaatagttctaaaatt

SEQ ID NO: 355535 - DNA, 22 bp, Homo sapiens
taagaatgctggttttcctaaa

SEQ ID NO: 355536 - DNA, 17 bp, Homo sapiens
taagaatggttgcctta

SEQ ID NO: 355537 - DNA, 13 bp, Homo sapiens
taagaattgtttt

SEQ ID NO: 355538 - DNA, 20 bp, Homo sapiens
taagaattgtttttgaattt

SEQ ID NO: 355539 - DNA, 16 bp, Homo sapiens
taagaatttagggaga

SEQ ID NO: 355540 - DNA, 16 bp, Homo sapiens
taatatgatctgtgga

SEQ ID NO: 355541 - DNA, 16 bp, Homo sapiens
taatatgctgccaaat

SEQ ID NO: 355542 - DNA, 18 bp, Homo sapiens
taatatgctgccaaattt

SEQ ID NO: 355543 - DNA, 18 bp, Homo sapiens
taatatggcaaaaatggc

SEQ ID NO: 355544 - DNA, 14 bp, Homo sapiens
taatatgtttgagg

SEQ ID NO: 355545 - DNA, 12 bp, Homo sapiens
taatattaaatt

SEQ ID NO: 355546 - DNA, 15 bp, Homo sapiens
taatattaaattcct

SEQ ID NO: 355547 - DNA, 12 bp, Homo sapiens
taatatttcttc

SEQ ID NO: 355548 - DNA, 21 bp, Homo sapiens
taatcaaaagggaaaagaaga

SEQ ID NO: 355549 - DNA, 19 bp, Homo sapiens
taatcacttaacctgcttt

SEQ ID NO: 355550 - DNA, 13 bp, Homo sapiens
taatcagaaattt

SEQ ID NO: 355551 - DNA, 15 bp, Homo sapiens
taatcagaaattttt

SEQ ID NO: 355552 - DNA, 18 bp, Homo sapiens
taatcagcattattcttc

SEQ ID NO: 355553 - DNA, 12 bp, Homo sapiens
taatcagcctct

SEQ ID NO: 355554 - DNA, 15 bp, Homo sapiens
taatcagcctcttaa

SEQ ID NO: 355555 - DNA, 19 bp, Homo sapiens
taatcagggaggtcatttt

SEQ ID NO: 355556 - DNA, 22 bp, Homo sapiens
taatcagtgtagccccaagaag

SEQ ID NO: 355557 - DNA, 12 bp, Homo sapiens
taatcagtgtga

SEQ ID NO: 355558 - DNA, 13 bp, Homo sapiens
taatcataacata

SEQ ID NO: 355559 - DNA, 22 bp, Homo sapiens
taatcataacatagttgaaaaa

SEQ ID NO: 355560 - DNA, 16 bp, Homo sapiens
taatcatatcaactta

SEQ ID NO: 355561 - DNA, 15 bp, Homo sapiens
taatcatcttctctt

SEQ ID NO: 355562 - DNA, 23 bp, Homo sapiens
taatcatcttctctttttccaga

SEQ ID NO: 355563 - DNA, 14 bp, Homo sapiens
taatcatttatctt

SEQ ID NO: 355564 - DNA, 15 bp, Homo sapiens
taatcatttccagca

SEQ ID NO: 355565 - DNA, 19 bp, Homo sapiens
taatcccagcactttggga

SEQ ID NO: 355566 - DNA, 15 bp, Homo sapiens
taatccccttctccc

SEQ ID NO: 355567 - DNA, 18 bp, Homo sapiens
taatccccttctcccctg

SEQ ID NO: 355568 - DNA, 13 bp, Homo sapiens
taatcgaaagaaa

SEQ ID NO: 355569 - DNA, 15 bp, Homo sapiens
taatcggttgaccct

SEQ ID NO: 355570 - DNA, 23 bp, Homo sapiens
taatcggttgaccctactgtgga

SEQ ID NO: 355571 - DNA, 18 bp, Homo sapiens
taatctagtttacagaaa

SEQ ID NO: 355572 - DNA, 16 bp, Homo sapiens
taatctattgggttca

SEQ ID NO: 355573 - DNA, 15 bp, Homo sapiens
taatctctaaaattc

SEQ ID NO: 355574 - DNA, 19 bp, Homo sapiens
taatctctaaaattctagt

SEQ ID NO: 355575 - DNA, 20 bp, Homo sapiens
taatctctaaaattctagtc

SEQ ID NO: 355576 - DNA, 22 bp, Homo sapiens
taatctctgattaaatttaata

SEQ ID NO: 355577 - DNA, 12 bp, Homo sapiens
taatctgaaaca

SEQ ID NO: 355578 - DNA, 19 bp, Homo sapiens
taatctggaaggcccctcc

SEQ ID NO: 355579 - DNA, 18 bp, Homo sapiens
taatctggactcctctgt

SEQ ID NO: 355580 - DNA, 21 bp, Homo sapiens
taatctggactcctctgtcca

SEQ ID NO: 355581 - DNA, 22 bp, Homo sapiens
taatctggactcctctgtccag

SEQ ID NO: 355582 - DNA, 17 bp, Homo sapiens
taatctgtagggctgga

SEQ ID NO: 355583 - DNA, 12 bp, Homo sapiens
taatctgttgtt

SEQ ID NO: 355584 - DNA, 19 bp, Homo sapiens
taatcttaggggagagctt

SEQ ID NO: 355585 - DNA, 14 bp, Homo sapiens
taatctttatttta

SEQ ID NO: 355586 - DNA, 21 bp, Homo sapiens
taatctttattttattattca

SEQ ID NO: 355587 - DNA, 22 bp, Homo sapiens
taatctttattttattattcag

SEQ ID NO: 355588 - DNA, 23 bp, Homo sapiens
taatctttctttacctgagacca

SEQ ID NO: 355589 - DNA, 12 bp, Homo sapiens
taatctttgctg

SEQ ID NO: 355590 - DNA, 13 bp, Homo sapiens
taatctttttctc

SEQ ID NO: 355591 - DNA, 21 bp, Homo sapiens
taatgaaaaggaagttaatac

SEQ ID NO: 355592 - DNA, 18 bp, Homo sapiens
taatgaaaatagatgcaa

SEQ ID NO: 355593 - DNA, 19 bp, Homo sapiens
taatgaaatagttatttta

SEQ ID NO: 355594 - DNA, 14 bp, Homo sapiens
taatgaactgtgac

SEQ ID NO: 355595 - DNA, 17 bp, Homo sapiens
taatgaatgaaacattt

SEQ ID NO: 355596 - DNA, 19 bp, Homo sapiens
taatgaatgcaaaaagata

SEQ ID NO: 355597 - DNA, 18 bp, Homo sapiens
taatgaattttaaaagca

SEQ ID NO: 355598 - DNA, 22 bp, Homo sapiens
taatgaattttaaaagcatata

SEQ ID NO: 355599 - DNA, 15 bp, Homo sapiens
taatgaattttatgt

SEQ ID NO: 355600 - DNA, 13 bp, Homo sapiens
taatgacaacaaa

SEQ ID NO: 355601 - DNA, 16 bp, Homo sapiens
taatgacgtattgtga

SEQ ID NO: 355602 - DNA, 21 bp, Homo sapiens
taatgacttaagcacacttga

SEQ ID NO: 355603 - DNA, 22 bp, Homo sapiens
taatgagatatatctttatact

SEQ ID NO: 355604 - DNA, 23 bp, Homo sapiens
taatgagtaatgcagacatttac

SEQ ID NO: 355605 - DNA, 16 bp, Homo sapiens
taatgatactgtctaa

SEQ ID NO: 355606 - DNA, 15 bp, Homo sapiens
taattccctatcttt

SEQ ID NO: 355607 - DNA, 15 bp, Homo sapiens
taattcctcttttta

SEQ ID NO: 355608 - DNA, 21 bp, Homo sapiens
taattctaagttatttacttt

SEQ ID NO: 355609 - DNA, 13 bp, Homo sapiens
taattctatactg

SEQ ID NO: 355610 - DNA, 15 bp, Homo sapiens
taattctattgaaag

SEQ ID NO: 355611 - DNA, 17 bp, Homo sapiens
taattctgggaagggag

SEQ ID NO: 355612 - DNA, 12 bp, Homo sapiens
taattctgtaaa

SEQ ID NO: 355613 - DNA, 20 bp, Homo sapiens
taattctgttctgatattaa

SEQ ID NO: 355614 - DNA, 15 bp, Homo sapiens
taattctttgataag

SEQ ID NO: 355615 - DNA, 22 bp, Homo sapiens
taattgagccttttattaacat

SEQ ID NO: 355616 - DNA, 19 bp, Homo sapiens
taattgatcaaattcattt

SEQ ID NO: 355617 - DNA, 12 bp, Homo sapiens
taattgattaaa

SEQ ID NO: 355618 - DNA, 18 bp, Homo sapiens
taattgattaaactgtat

SEQ ID NO: 355619 - DNA, 23 bp, Homo sapiens
taattgcagataactttgacttt

SEQ ID NO: 355620 - DNA, 21 bp, Homo sapiens
taattgctggagactacaatt

SEQ ID NO: 355621 - DNA, 15 bp, Homo sapiens
taattgcttacattt

SEQ ID NO: 355622 - DNA, 16 bp, Homo sapiens
taattgcttacatttt

SEQ ID NO: 355623 - DNA, 14 bp, Homo sapiens
taattgtatctcct

SEQ ID NO: 355624 - DNA, 21 bp, Homo sapiens
taattgtatctccttcagaag

SEQ ID NO: 355625 - DNA, 21 bp, Homo sapiens
taattgtgaaaaagttaaaca

SEQ ID NO: 355626 - DNA, 16 bp, Homo sapiens
taattgttacaatttt

SEQ ID NO: 355627 - DNA, 22 bp, Homo sapiens
taattgttatacatttttaatt

SEQ ID NO: 355628 - DNA, 16 bp, Homo sapiens
taatttaagtttgtag

SEQ ID NO: 355629 - DNA, 18 bp, Homo sapiens
taatttacctgaagtctt

SEQ ID NO: 355630 - DNA, 17 bp, Homo sapiens
taatttatatttgtctc

SEQ ID NO: 355631 - DNA, 23 bp, Homo sapiens
taatttatcttgtctctgggctt

SEQ ID NO: 355632 - DNA, 12 bp, Homo sapiens
taatttatttat

SEQ ID NO: 355633 - DNA, 14 bp, Homo sapiens
taatttattttgta

SEQ ID NO: 355634 - DNA, 15 bp, Homo sapiens
taatttattttgtat

SEQ ID NO: 355635 - DNA, 22 bp, Homo sapiens
taatttcacagataatttactt

SEQ ID NO: 355636 - DNA, 13 bp, Homo sapiens
taatttcataaat

SEQ ID NO: 355637 - DNA, 16 bp, Homo sapiens
taatttcataaattgg

SEQ ID NO: 355638 - DNA, 17 bp, Homo sapiens
taatttcataaattggc

SEQ ID NO: 355639 - DNA, 15 bp, Homo sapiens
taatttctgtccaga

SEQ ID NO: 355640 - DNA, 16 bp, Homo sapiens
taatttgatgaaagct

SEQ ID NO: 355641 - DNA, 19 bp, Homo sapiens
taatttgatgaaagctgat

SEQ ID NO: 355642 - DNA, 15 bp, Homo sapiens
taatttgttatatca

SEQ ID NO: 355643 - DNA, 13 bp, Homo sapiens
taattttaagaaa

SEQ ID NO: 355644 - DNA, 20 bp, Homo sapiens
taattttatgaactgcatgt

SEQ ID NO: 355645 - DNA, 12 bp, Homo sapiens
taattttattat

SEQ ID NO: 355646 - DNA, 13 bp, Homo sapiens
taattttctcaaa

SEQ ID NO: 355647 - DNA, 19 bp, Homo sapiens
taattttctcaaaagcatt

SEQ ID NO: 355648 - DNA, 14 bp, Homo sapiens
taattttcttcatg

SEQ ID NO: 355649 - DNA, 21 bp, Homo sapiens
taattttgtgaatctattgtt

SEQ ID NO: 355650 - DNA, 19 bp, Homo sapiens
taattttgtgctctttcct

SEQ ID NO: 355651 - DNA, 17 bp, Homo sapiens
taatttttaaaagactt

SEQ ID NO: 355652 - DNA, 17 bp, Homo sapiens
taatttttaaaagagga

SEQ ID NO: 355653 - DNA, 18 bp, Homo sapiens
taattttttagttaaaat

SEQ ID NO: 355654 - DNA, 17 bp, Homo sapiens
taattttttattcaagt

SEQ ID NO: 355655 - DNA, 16 bp, Homo sapiens
taatttttttcaatat

SEQ ID NO: 355656 - DNA, 22 bp, Homo sapiens
taatttttttcaatatttatta

SEQ ID NO: 355657 - DNA, 16 bp, Homo sapiens
taattttttttaatgt

SEQ ID NO: 355658 - DNA, 22 bp, Homo sapiens
tacaaaaaaacctttattcttt

SEQ ID NO: 355659 - DNA, 20 bp, Homo sapiens
tacaaaaatatattaaaaat

SEQ ID NO: 355660 - DNA, 21 bp, Homo sapiens
tacaaaaatatattaaaaata

SEQ ID NO: 355661 - DNA, 23 bp, Homo sapiens
tacaaaagaggagcacttccaaa

SEQ ID NO: 355662 - DNA, 13 bp, Homo sapiens
tacaaaatgaatg

SEQ ID NO: 355663 - DNA, 13 bp, Homo sapiens
tacaaacaaagga

SEQ ID NO: 355664 - DNA, 21 bp, Homo sapiens
tacaaacaaaggatttgaaaa

SEQ ID NO: 355665 - DNA, 15 bp, Homo sapiens
tacaaacaggtgcta

SEQ ID NO: 355666 - DNA, 14 bp, Homo sapiens
tacaaactgcaata

SEQ ID NO: 355667 - DNA, 22 bp, Homo sapiens
tacaaactgcaatagagactgt

SEQ ID NO: 355668 - DNA, 12 bp, Homo sapiens
tacaaagacagg

SEQ ID NO: 355669 - DNA, 19 bp, Homo sapiens
tacaaagatacttgatgca

SEQ ID NO: 355670 - DNA, 22 bp, Homo sapiens
tacaaagatacttgatgcactt

SEQ ID NO: 355671 - DNA, 18 bp, Homo sapiens
tacaaagctgaagaaaat

SEQ ID NO: 355672 - DNA, 14 bp, Homo sapiens
tacaaagtagagaa

SEQ ID NO: 355673 - DNA, 16 bp, Homo sapiens
tacaaagtagagaagt

SEQ ID NO: 355674 - DNA, 14 bp, Homo sapiens
tacaaataaagatg

SEQ ID NO: 355675 - DNA, 17 bp, Homo sapiens
tacaaatactcttagga

SEQ ID NO: 355676 - DNA, 23 bp, Homo sapiens
tacaaatgggggcggctggaaag

SEQ ID NO: 355677 - DNA, 14 bp, Homo sapiens
tacaaattttcact

SEQ ID NO: 355678 - DNA, 24 bp, Homo sapiens
tacaaattttcactgctgctcctc

SEQ ID NO: 355679 - DNA, 12 bp, Homo sapiens
tacaacaaacac

SEQ ID NO: 355680 - DNA, 20 bp, Homo sapiens
tacaacaaacactgtgatgt

SEQ ID NO: 355681 - DNA, 19 bp, Homo sapiens
tacaacaagagtttatttc

SEQ ID NO: 355682 - DNA, 20 bp, Homo sapiens
tacaacagcacgtgcagcca

SEQ ID NO: 355683 - DNA, 14 bp, Homo sapiens
tacaaccagagccc

SEQ ID NO: 355684 - DNA, 15 bp, Homo sapiens
tacaaccaggtcttg

SEQ ID NO: 355685 - DNA, 15 bp, Homo sapiens
tacaactaaataaca

SEQ ID NO: 355686 - DNA, 14 bp, Homo sapiens
tacaacttcagcag

SEQ ID NO: 355687 - DNA, 19 bp, Homo sapiens
tacaagactaacctttgtt

SEQ ID NO: 355688 - DNA, 16 bp, Homo sapiens
tacaagagcagcctgt

SEQ ID NO: 355689 - DNA, 19 bp, Homo sapiens
tacaagagcagcctgtggc

SEQ ID NO: 355690 - DNA, 23 bp, Homo sapiens
tacaagagcagcctgtggcatct

SEQ ID NO: 355691 - DNA, 22 bp, Homo sapiens
tacaagagccatgtaccagtgt

SEQ ID NO: 355692 - DNA, 22 bp, Homo sapiens
tacaaggcaggcctttcctaca

SEQ ID NO: 355693 - DNA, 20 bp, Homo sapiens
tacaagtatacttatatttc

SEQ ID NO: 355694 - DNA, 15 bp, Homo sapiens
tacaagtgtatatca

SEQ ID NO: 355695 - DNA, 19 bp, Homo sapiens
tacaagttaaggtatctgg

SEQ ID NO: 355696 - DNA, 18 bp, Homo sapiens
tacaagttctatttaagt

SEQ ID NO: 355697 - DNA, 13 bp, Homo sapiens
tacaagttttgta

SEQ ID NO: 355698 - DNA, 14 bp, Homo sapiens
tacaagttttgtat

SEQ ID NO: 355699 - DNA, 12 bp, Homo sapiens
tacaataaacta

SEQ ID NO: 355700 - DNA, 19 bp, Homo sapiens
tacaataaaggatgtttat

SEQ ID NO: 355701 - DNA, 14 bp, Homo sapiens
tacaatcagctgct

SEQ ID NO: 355702 - DNA, 13 bp, Homo sapiens
tacaatctattta

SEQ ID NO: 355703 - DNA, 17 bp, Homo sapiens
tacaatctatttattgg

SEQ ID NO: 355704 - DNA, 16 bp, Homo sapiens
tacaatgtgcactgaa

SEQ ID NO: 355705 - DNA, 20 bp, Homo sapiens
tacaattcctggcaaacacc

SEQ ID NO: 355706 - DNA, 18 bp, Homo sapiens
tacaattctttgttgctt

SEQ ID NO: 355707 - DNA, 19 bp, Homo sapiens
tacaattctttgttgctta

SEQ ID NO: 355708 - DNA, 17 bp, Homo sapiens
tacaattgcactgctgt

SEQ ID NO: 355709 - DNA, 17 bp, Homo sapiens
tacaattgtaaaactga

SEQ ID NO: 355710 - DNA, 14 bp, Homo sapiens
tacacaaaaagaaa

SEQ ID NO: 355711 - DNA, 16 bp, Homo sapiens
tacacaacacctaaaa

SEQ ID NO: 355712 - DNA, 16 bp, Homo sapiens
tacacaacatgtatgt

SEQ ID NO: 355713 - DNA, 21 bp, Homo sapiens
tacacaacatgtatgtggata

SEQ ID NO: 355714 - DNA, 9 bp, Homo sapiens
tacacacac

SEQ ID NO: 355715 - DNA, 18 bp, Homo sapiens
tacacaccctccagcaca

SEQ ID NO: 355716 - DNA, 19 bp, Homo sapiens
tacacaccctccagcacag

SEQ ID NO: 355717 - DNA, 21 bp, Homo sapiens
tacacagttcacaaacagtaa

SEQ ID NO: 355718 - DNA, 19 bp, Homo sapiens
tacacagtttaaacacatc

SEQ ID NO: 355719 - DNA, 23 bp, Homo sapiens
tacacataagaccgtgtcccaag

SEQ ID NO: 355720 - DNA, 23 bp, Homo sapiens
tacacatagcatgtaatggtatc

SEQ ID NO: 355721 - DNA, 17 bp, Homo sapiens
tacacatctcagaccct

SEQ ID NO: 355722 - DNA, 19 bp, Homo sapiens
tacaccacctcactcctgt

SEQ ID NO: 355723 - DNA, 19 bp, Homo sapiens
tacacccagttctgaataa

SEQ ID NO: 355724 - DNA, 16 bp, Homo sapiens
tacacccatgcacaga

SEQ ID NO: 355725 - DNA, 19 bp, Homo sapiens
tacacccatgcacagaaca

SEQ ID NO: 355726 - DNA, 15 bp, Homo sapiens
taaattgctccttga

SEQ ID NO: 355727 - DNA, 18 bp, Homo sapiens
taaattggctcctttccc

SEQ ID NO: 355728 - DNA, 19 bp, Homo sapiens
taaattggctcctttccca

SEQ ID NO: 355729 - DNA, 20 bp, Homo sapiens
taaattggctcctttcccac

SEQ ID NO: 355730 - DNA, 23 bp, Homo sapiens
taaattggctcctttcccacagt

SEQ ID NO: 355731 - DNA, 17 bp, Homo sapiens
taaattggtgataagtg

SEQ ID NO: 355732 - DNA, 21 bp, Homo sapiens
taaattggtgataagtggaaa

SEQ ID NO: 355733 - DNA, 22 bp, Homo sapiens
taaattggtgataagtggaaaa

SEQ ID NO: 355734 - DNA, 18 bp, Homo sapiens
taaattgttataacttca

SEQ ID NO: 355735 - DNA, 18 bp, Homo sapiens
taaattgttcctctttgt

SEQ ID NO: 355736 - DNA, 19 bp, Homo sapiens
taaattgttcctctttgtt

SEQ ID NO: 355737 - DNA, 12 bp, Homo sapiens
taaattgtttga

SEQ ID NO: 355738 - DNA, 16 bp, Homo sapiens
taaatttaactgcata

SEQ ID NO: 355739 - DNA, 18 bp, Homo sapiens
taaatttaactgcatata

SEQ ID NO: 355740 - DNA, 13 bp, Homo sapiens
taaatttacgtat

SEQ ID NO: 355741 - DNA, 10 bp, Homo sapiens
taaatttagc

SEQ ID NO: 355742 - DNA, 16 bp, Homo sapiens
taaatttcacaatata

SEQ ID NO: 355743 - DNA, 12 bp, Homo sapiens
taaatttctcag

SEQ ID NO: 355744 - DNA, 11 bp, Homo sapiens
taaatttctgg

SEQ ID NO: 355745 - DNA, 14 bp, Homo sapiens
taaatttctgggat

SEQ ID NO: 355746 - DNA, 21 bp, Homo sapiens
taaatttctgggatatttaac

SEQ ID NO: 355747 - DNA, 22 bp, Homo sapiens
taaatttgtactatttaactga

SEQ ID NO: 355748 - DNA, 15 bp, Homo sapiens
taaatttgttgtcat

SEQ ID NO: 355749 - DNA, 23 bp, Homo sapiens
taaatttgttgtcatgtgtatga

SEQ ID NO: 355750 - DNA, 14 bp, Homo sapiens
taaattttaaaaag

SEQ ID NO: 355751 - DNA, 22 bp, Homo sapiens
taaattttaatgtaaaattcat

SEQ ID NO: 355752 - DNA, 12 bp, Homo sapiens
taaattttcacc

SEQ ID NO: 355753 - DNA, 15 bp, Homo sapiens
taaattttctgaaac

SEQ ID NO: 355754 - DNA, 16 bp, Homo sapiens
taaattttctttttct

SEQ ID NO: 355755 - DNA, 16 bp, Homo sapiens
taaattttgagttcta

SEQ ID NO: 355756 - DNA, 13 bp, Homo sapiens
taaattttgtgat

SEQ ID NO: 355757 - DNA, 14 bp, Homo sapiens
taacaaaacaagaa

SEQ ID NO: 355758 - DNA, 15 bp, Homo sapiens
taacaaaacaagaaa

SEQ ID NO: 355759 - DNA, 18 bp, Homo sapiens
taacaaaacaagaaagaa

SEQ ID NO: 355760 - DNA, 18 bp, Homo sapiens
taacaaaagatgaaagca

SEQ ID NO: 355761 - DNA, 22 bp, Homo sapiens
taacaaactgaaaaatctagac

SEQ ID NO: 355762 - DNA, 17 bp, Homo sapiens
taacaacaatttaggaa

SEQ ID NO: 355763 - DNA, 22 bp, Homo sapiens
taacaacaatttaggaatgctc

SEQ ID NO: 355764 - DNA, 20 bp, Homo sapiens
taacaaccctgttgagtatt

SEQ ID NO: 355765 - DNA, 22 bp, Homo sapiens
taacaacctttcccatttcgtg

SEQ ID NO: 355766 - DNA, 14 bp, Homo sapiens
taacaagaaactca

SEQ ID NO: 355767 - DNA, 21 bp, Homo sapiens
taacaagccaaacattcttat

SEQ ID NO: 355768 - DNA, 11 bp, Homo sapiens
taacaaggaat

SEQ ID NO: 355769 - DNA, 19 bp, Homo sapiens
taacaaggaatgcctgtgc

SEQ ID NO: 355770 - DNA, 17 bp, Homo sapiens
taacaataactactgtg

SEQ ID NO: 355771 - DNA, 18 bp, Homo sapiens
taacaataactactgtgt

SEQ ID NO: 355772 - DNA, 21 bp, Homo sapiens
taacaataactactgtgttcc

SEQ ID NO: 355773 - DNA, 17 bp, Homo sapiens
taacaatgaagataaaa

SEQ ID NO: 355774 - DNA, 17 bp, Homo sapiens
taacaatgcatgctttg

SEQ ID NO: 355775 - DNA, 17 bp, Homo sapiens
taacaatgccttgttgt

SEQ ID NO: 355776 - DNA, 19 bp, Homo sapiens
taacaatgccttgttgtat

SEQ ID NO: 355777 - DNA, 15 bp, Homo sapiens
taacaatttccttta

SEQ ID NO: 355778 - DNA, 18 bp, Homo sapiens
taacacaagtcctgtgaa

SEQ ID NO: 355779 - DNA, 22 bp, Homo sapiens
taacacaatatgagtaatgttt

SEQ ID NO: 355780 - DNA, 17 bp, Homo sapiens
taacacagcatgtgtat

SEQ ID NO: 355781 - DNA, 15 bp, Homo sapiens
taacacagtaaaata

SEQ ID NO: 355782 - DNA, 17 bp, Homo sapiens
taacacatttgattctg

SEQ ID NO: 355783 - DNA, 23 bp, Homo sapiens
taacactagtctgtgtgctgtgg

SEQ ID NO: 355784 - DNA, 21 bp, Homo sapiens
taacactcgactctgctgctc

SEQ ID NO: 355785 - DNA, 13 bp, Homo sapiens
taacactggcccc

SEQ ID NO: 355786 - DNA, 18 bp, Homo sapiens
taacagataagcaagaga

SEQ ID NO: 355787 - DNA, 16 bp, Homo sapiens
taacagatcctttcaa

SEQ ID NO: 355788 - DNA, 23 bp, Homo sapiens
taacagcgtgtcaactttcattt

SEQ ID NO: 355789 - DNA, 14 bp, Homo sapiens
taacagctcaggat

SEQ ID NO: 355790 - DNA, 22 bp, Homo sapiens
taacaggacttgaattcaaagc

SEQ ID NO: 355791 - DNA, 14 bp, Homo sapiens
taacaggatgaaag

SEQ ID NO: 355792 - DNA, 17 bp, Homo sapiens
taacaggcattgcacta

SEQ ID NO: 355793 - DNA, 15 bp, Homo sapiens
taacagggccttgct

SEQ ID NO: 355794 - DNA, 14 bp, Homo sapiens
taacaggggctggt

SEQ ID NO: 355795 - DNA, 18 bp, Homo sapiens
taacagggtaaattattc

SEQ ID NO: 355796 - DNA, 13 bp, Homo sapiens
taacagtcattta

SEQ ID NO: 355797 - DNA, 13 bp, Homo sapiens
taacagttttcca

SEQ ID NO: 355798 - DNA, 14 bp, Homo sapiens
taacagttttccat

SEQ ID NO: 355799 - DNA, 17 bp, Homo sapiens
taacagttttccatgaa

SEQ ID NO: 355800 - DNA, 19 bp, Homo sapiens
taacagttttccatgaaaa

SEQ ID NO: 355801 - DNA, 21 bp, Homo sapiens
taacagttttccatgaaaacg

SEQ ID NO: 355802 - DNA, 15 bp, Homo sapiens
taacataaaatctgt

SEQ ID NO: 355803 - DNA, 20 bp, Homo sapiens
taacatacatctaagtcagt

SEQ ID NO: 355804 - DNA, 14 bp, Homo sapiens
taacatataaatta

SEQ ID NO: 355805 - DNA, 16 bp, Homo sapiens
taacatataaattaat

SEQ ID NO: 355806 - DNA, 14 bp, Homo sapiens
taacatataatgtt

SEQ ID NO: 355807 - DNA, 20 bp, Homo sapiens
taacatcactatccatgcac

SEQ ID NO: 355808 - DNA, 18 bp, Homo sapiens
taacatctgaaaagaaat

SEQ ID NO: 355809 - DNA, 15 bp, Homo sapiens
taacatgctgtgtaa

SEQ ID NO: 355810 - DNA, 18 bp, Homo sapiens
taacatggaagggaagaa

SEQ ID NO: 355811 - DNA, 15 bp, Homo sapiens
taacatggaagtact

SEQ ID NO: 355812 - DNA, 18 bp, Homo sapiens
taacatggacatgatctt

SEQ ID NO: 355813 - DNA, 18 bp, Homo sapiens
taacattcagtactttat

SEQ ID NO: 355814 - DNA, 21 bp, Homo sapiens
taacattcagtactttatgaa

SEQ ID NO: 355815 - DNA, 11 bp, Homo sapiens
taacattcctc

SEQ ID NO: 355816 - DNA, 16 bp, Homo sapiens
taacattcgatctcat

SEQ ID NO: 355817 - DNA, 15 bp, Homo sapiens
taacattgaaagtga

SEQ ID NO: 355818 - DNA, 20 bp, Homo sapiens
taacattgaccaagaactgc

SEQ ID NO: 355819 - DNA, 23 bp, Homo sapiens
taacattgaccaagaactgcatg

SEQ ID NO: 355820 - DNA, 12 bp, Homo sapiens
taacattgtaaa

SEQ ID NO: 355821 - DNA, 23 bp, Homo sapiens
taacatttcattaaccaaagaaa

SEQ ID NO: 355822 - DNA, 13 bp, Homo sapiens
taaccacaaggtc

SEQ ID NO: 355823 - DNA, 22 bp, Homo sapiens
taaccacaaggtccactccctg

SEQ ID NO: 355824 - DNA, 24 bp, Homo sapiens
taaccaccgcatatgcatgccagg

SEQ ID NO: 355825 - DNA, 20 bp, Homo sapiens
taaccactaatgttagaatt

SEQ ID NO: 355826 - DNA, 20 bp, Homo sapiens
taaccacttaaaaaatgtcc

SEQ ID NO: 355827 - DNA, 15 bp, Homo sapiens
taaccagctgtaaca

SEQ ID NO: 355828 - DNA, 16 bp, Homo sapiens
taaccaggccccagcc

SEQ ID NO: 355829 - DNA, 19 bp, Homo sapiens
taaccaggccccagcctcc

SEQ ID NO: 355830 - DNA, 21 bp, Homo sapiens
taaccagggcaccaagcccac

SEQ ID NO: 355831 - DNA, 21 bp, Homo sapiens
taaccatatgattgaaaagaa

SEQ ID NO: 355832 - DNA, 13 bp, Homo sapiens
taaccatcagtta

SEQ ID NO: 355833 - DNA, 17 bp, Homo sapiens
taaccatcagttactgg

SEQ ID NO: 355834 - DNA, 16 bp, Homo sapiens
taaattatttctaaaa

SEQ ID NO: 355835 - DNA, 15 bp, Homo sapiens
taaattcaaacctaa

SEQ ID NO: 355836 - DNA, 21 bp, Homo sapiens
taaattcaacacttattttct

SEQ ID NO: 355837 - DNA, 22 bp, Homo sapiens
taaattcaacacttattttctg

SEQ ID NO: 355838 - DNA, 19 bp, Homo sapiens
taaattcgctgtgagtgag

SEQ ID NO: 355839 - DNA, 13 bp, Homo sapiens
taaattctccaac

SEQ ID NO: 355840 - DNA, 13 bp, Homo sapiens
taaattgaaattg

SEQ ID NO: 355841 - DNA, 17 bp, Homo sapiens
taaattgcataaagcat

SEQ ID NO: 355842 - DNA, 15 bp, Homo sapiens
tacctttgcgtggat

SEQ ID NO: 355843 - DNA, 21 bp, Homo sapiens
tacctttgcgtggatcaagct

SEQ ID NO: 355844 - DNA, 15 bp, Homo sapiens
tacgctcctgtctcc

SEQ ID NO: 355845 - DNA, 19 bp, Homo sapiens
tacggtcatgatgtctgca

SEQ ID NO: 355846 - DNA, 16 bp, Homo sapiens
tacgtagtgtagattt

SEQ ID NO: 355847 - DNA, 17 bp, Homo sapiens
tacgtataaatatgaaa

SEQ ID NO: 355848 - DNA, 22 bp, Homo sapiens
tacgtatgaatgatatctttga

SEQ ID NO: 355849 - DNA, 18 bp, Homo sapiens
tacgtcccgctgctgtgc

SEQ ID NO: 355850 - DNA, 17 bp, Homo sapiens
tacgtgagggggagctg

SEQ ID NO: 355851 - DNA, 22 bp, Homo sapiens
tacgtgtgtgtgtgtgtatgtg

SEQ ID NO: 355852 - DNA, 21 bp, Homo sapiens
tacgtgtttacttggtgagga

SEQ ID NO: 355853 - DNA, 15 bp, Homo sapiens
tacgttattgttgac

SEQ ID NO: 355854 - DNA, 16 bp, Homo sapiens
tacgttattgttgact

SEQ ID NO: 355855 - DNA, 14 bp, Homo sapiens
tactaaaaatgcaa

SEQ ID NO: 355856 - DNA, 18 bp, Homo sapiens
tactaaacattttgttat

SEQ ID NO: 355857 - DNA, 12 bp, Homo sapiens
tactaaagcagt

SEQ ID NO: 355858 - DNA, 19 bp, Homo sapiens
tactaaagcagtgttttca

SEQ ID NO: 355859 - DNA, 12 bp, Homo sapiens
tactaaatatga

SEQ ID NO: 355860 - DNA, 17 bp, Homo sapiens
tactaaatatgaaattt

SEQ ID NO: 355861 - DNA, 16 bp, Homo sapiens
tactaacatcccaata

SEQ ID NO: 355862 - DNA, 17 bp, Homo sapiens
tactaaccaccatttcc

SEQ ID NO: 355863 - DNA, 14 bp, Homo sapiens
tactaaccatttct

SEQ ID NO: 355864 - DNA, 13 bp, Homo sapiens
tactaagaataaa

SEQ ID NO: 355865 - DNA, 18 bp, Homo sapiens
tactaagacccacaaact

SEQ ID NO: 355866 - DNA, 16 bp, Homo sapiens
tactaagatgaaattg

SEQ ID NO: 355867 - DNA, 20 bp, Homo sapiens
tactaagatgaaattgccaa

SEQ ID NO: 355868 - DNA, 14 bp, Homo sapiens
tactaagccaggag

SEQ ID NO: 355869 - DNA, 16 bp, Homo sapiens
tactaagccaggaggc

SEQ ID NO: 355870 - DNA, 10 bp, Homo sapiens
tactaataaa

SEQ ID NO: 355871 - DNA, 12 bp, Homo sapiens
tactaataaaaa

SEQ ID NO: 355872 - DNA, 14 bp, Homo sapiens
tactaataaaaagg

SEQ ID NO: 355873 - DNA, 16 bp, Homo sapiens
tactaataaaaaggtt

SEQ ID NO: 355874 - DNA, 17 bp, Homo sapiens
tactaataaaaaggttt

SEQ ID NO: 355875 - DNA, 21 bp, Homo sapiens
tactaataaaaaggtttaatt

SEQ ID NO: 355876 - DNA, 20 bp, Homo sapiens
tactaatagagtacttaata

SEQ ID NO: 355877 - DNA, 14 bp, Homo sapiens
tactaatgatgttt

SEQ ID NO: 355878 - DNA, 15 bp, Homo sapiens
tactaattaacatat

SEQ ID NO: 355879 - DNA, 13 bp, Homo sapiens
tactaatttattg

SEQ ID NO: 355880 - DNA, 18 bp, Homo sapiens
tactacatgtgggagctt

SEQ ID NO: 355881 - DNA, 13 bp, Homo sapiens
tactacatttgca

SEQ ID NO: 355882 - DNA, 14 bp, Homo sapiens
tactaccacaagga

SEQ ID NO: 355883 - DNA, 16 bp, Homo sapiens
tactaccacaaggaaa

SEQ ID NO: 355884 - DNA, 22 bp, Homo sapiens
tactactttaaatcctaccaaa

SEQ ID NO: 355885 - DNA, 14 bp, Homo sapiens
tactagtactatta

SEQ ID NO: 355886 - DNA, 18 bp, Homo sapiens
tactatatgcataaacaa

SEQ ID NO: 355887 - DNA, 15 bp, Homo sapiens
tactatctactctcc

SEQ ID NO: 355888 - DNA, 23 bp, Homo sapiens
tactatggctgtatttttagaga

SEQ ID NO: 355889 - DNA, 21 bp, Homo sapiens
tactatgtattaccagccccc

SEQ ID NO: 355890 - DNA, 17 bp, Homo sapiens
tactattaagcagtaaa

SEQ ID NO: 355891 - DNA, 20 bp, Homo sapiens
tactattatggaattactct

SEQ ID NO: 355892 - DNA, 21 bp, Homo sapiens
tactattcccactttcattca

SEQ ID NO: 355893 - DNA, 22 bp, Homo sapiens
tactattccctttgacttcagc

SEQ ID NO: 355894 - DNA, 17 bp, Homo sapiens
tactattggacagacac

SEQ ID NO: 355895 - DNA, 19 bp, Homo sapiens
tactatttaactgactatt

SEQ ID NO: 355896 - DNA, 13 bp, Homo sapiens
tactatttagata

SEQ ID NO: 355897 - DNA, 14 bp, Homo sapiens
tactcaaacatgtt

SEQ ID NO: 355898 - DNA, 20 bp, Homo sapiens
tactcataaggcatatacaa

SEQ ID NO: 355899 - DNA, 14 bp, Homo sapiens
tactcatgccagat

SEQ ID NO: 355900 - DNA, 16 bp, Homo sapiens
tactccagcctgggtg

SEQ ID NO: 355901 - DNA, 16 bp, Homo sapiens
tactcccttcctggcc

SEQ ID NO: 355902 - DNA, 16 bp, Homo sapiens
tactcctacctggtca

SEQ ID NO: 355903 - DNA, 12 bp, Homo sapiens
tactcctgcaaa

SEQ ID NO: 355904 - DNA, 14 bp, Homo sapiens
tactccttaagaac

SEQ ID NO: 355905 - DNA, 15 bp, Homo sapiens
tactccttggatttg

SEQ ID NO: 355906 - DNA, 17 bp, Homo sapiens
tactctacgccaaagtg

SEQ ID NO: 355907 - DNA, 15 bp, Homo sapiens
tactctcacatgtgg

SEQ ID NO: 355908 - DNA, 19 bp, Homo sapiens
tactctccaggattgtcca

SEQ ID NO: 355909 - DNA, 14 bp, Homo sapiens
tactctcctagaga

SEQ ID NO: 355910 - DNA, 12 bp, Homo sapiens
tactctgagccc

SEQ ID NO: 355911 - DNA, 16 bp, Homo sapiens
tactctgagcccaggc

SEQ ID NO: 355912 - DNA, 15 bp, Homo sapiens
tactctggttctttg

SEQ ID NO: 355913 - DNA, 17 bp, Homo sapiens
tactctgtccaggccac

SEQ ID NO: 355914 - DNA, 15 bp, Homo sapiens
tactctgtgtaatct

SEQ ID NO: 355915 - DNA, 14 bp, Homo sapiens
tactctgttgcctc

SEQ ID NO: 355916 - DNA, 16 bp, Homo sapiens
tactctgttgcctcct

SEQ ID NO: 355917 - DNA, 18 bp, Homo sapiens
tactctgttgcctcctct

SEQ ID NO: 355918 - DNA, 23 bp, Homo sapiens
tactctgttgcctcctctctccc

SEQ ID NO: 355919 - DNA, 14 bp, Homo sapiens
tactcttgtcattt

SEQ ID NO: 355920 - DNA, 15 bp, Homo sapiens
tactcttgttgccca

SEQ ID NO: 355921 - DNA, 17 bp, Homo sapiens
tactcttgttgcccagg

SEQ ID NO: 355922 - DNA, 14 bp, Homo sapiens
tactgaaaatgcat

SEQ ID NO: 355923 - DNA, 22 bp, Homo sapiens
tactgaaatttgttatacttca

SEQ ID NO: 355924 - DNA, 23 bp, Homo sapiens
tactgaaatttgttatacttcaa

SEQ ID NO: 355925 - DNA, 16 bp, Homo sapiens
tactgaagttgggaaa

SEQ ID NO: 355926 - DNA, 14 bp, Homo sapiens
tactgaatttgcta

SEQ ID NO: 355927 - DNA, 15 bp, Homo sapiens
tactgaatttgctaa

SEQ ID NO: 355928 - DNA, 20 bp, Homo sapiens
tactgacatgtggggccagg

SEQ ID NO: 355929 - DNA, 22 bp, Homo sapiens
tactgacatgtggggccaggtc

SEQ ID NO: 355930 - DNA, 22 bp, Homo sapiens
tactgagaggaggggtaaatat

SEQ ID NO: 355931 - DNA, 23 bp, Homo sapiens
tactgagaggaggggtaaatata

SEQ ID NO: 355932 - DNA, 16 bp, Homo sapiens
tactgatcatgcattg

SEQ ID NO: 355933 - DNA, 20 bp, Homo sapiens
tactgatgagacaacacaca

SEQ ID NO: 355934 - DNA, 17 bp, Homo sapiens
tactgatttttgtgatt

SEQ ID NO: 355935 - DNA, 20 bp, Homo sapiens
tactgcaatatttggattgt

SEQ ID NO: 355936 - DNA, 22 bp, Homo sapiens
tactgcagaatacagtaagctg

SEQ ID NO: 355937 - DNA, 22 bp, Homo sapiens
tactgcagctttacatgcaatt

SEQ ID NO: 355938 - DNA, 21 bp, Homo sapiens
tactgccacggtcctttgagt

SEQ ID NO: 355939 - DNA, 22 bp, Homo sapiens
tactgccctccagctctttcct

SEQ ID NO: 355940 - DNA, 15 bp, Homo sapiens
tactgcttttaactt

SEQ ID NO: 355941 - DNA, 22 bp, Homo sapiens
tactggagccatgtctacaaaa

SEQ ID NO: 355942 - DNA, 12 bp, Homo sapiens
tactggcagctc

SEQ ID NO: 355943 - DNA, 15 bp, Homo sapiens
tactggccagtgtca

SEQ ID NO: 355944 - DNA, 16 bp, Homo sapiens
tactggccagtgtcat

SEQ ID NO: 355945 - DNA, 14 bp, Homo sapiens
tactgggaagcagt

SEQ ID NO: 355946 - DNA, 22 bp, Homo sapiens
tactgggaatggaaggctttgc

SEQ ID NO: 355947 - DNA, 14 bp, Homo sapiens
tactggttatagtt

SEQ ID NO: 355948 - DNA, 20 bp, Homo sapiens
tactgtacattttttttcaa

SEQ ID NO: 355949 - DNA, 15 bp, Homo sapiens
tactgtagtttttct

SEQ ID NO: 355950 - DNA, 11 bp, Homo sapiens
tactgtcaata

SEQ ID NO: 355951 - DNA, 14 bp, Homo sapiens
tactgtcaataaac

SEQ ID NO: 355952 - DNA, 12 bp, Homo sapiens
tactgtcagtgt

SEQ ID NO: 355953 - DNA, 19 bp, Homo sapiens
tactgtctggttttaacaa

SEQ ID NO: 355954 - DNA, 21 bp, Homo sapiens
tactgtctggttttaacaatt

SEQ ID NO: 355955 - DNA, 13 bp, Homo sapiens
tactgtctgtagt

SEQ ID NO: 355956 - DNA, 15 bp, Homo sapiens
tactgtctgtagtgt

SEQ ID NO: 355957 - DNA, 19 bp, Homo sapiens
tactgtgctgattcaataa

SEQ ID NO: 355958 - DNA, 19 bp, Homo sapiens
tactgtgttcctggcaata

SEQ ID NO: 355959 - DNA, 15 bp, Homo sapiens
tactgttaaaggaaa

SEQ ID NO: 355960 - DNA, 19 bp, Homo sapiens
tactgttaaccatttaagt

SEQ ID NO: 355961 - DNA, 12 bp, Homo sapiens
tactgtttgtaa

SEQ ID NO: 355962 - DNA, 20 bp, Homo sapiens
tactgtttgtaatatacagt

SEQ ID NO: 355963 - DNA, 22 bp, Homo sapiens
tactgtttgtaatatacagttt

SEQ ID NO: 355964 - DNA, 16 bp, Homo sapiens
tacttaaaaatatgtg

SEQ ID NO: 355965 - DNA, 17 bp, Homo sapiens
tacttaaaaatatgtga

SEQ ID NO: 355966 - DNA, 21 bp, Homo sapiens
tacttaaaaatatgtgagcat

SEQ ID NO: 355967 - DNA, 19 bp, Homo sapiens
tacttaaacaaaaactttc

SEQ ID NO: 355968 - DNA, 23 bp, Homo sapiens
tacttaaacaaaaactttccatg

SEQ ID NO: 355969 - DNA, 12 bp, Homo sapiens
tacttaaacagc

SEQ ID NO: 355970 - DNA, 16 bp, Homo sapiens
tacttaaacagctttt

SEQ ID NO: 355971 - DNA, 13 bp, Homo sapiens
tacttaaagcttg

SEQ ID NO: 355972 - DNA, 20 bp, Homo sapiens
tacttaaatagcatctgctc

SEQ ID NO: 355973 - DNA, 17 bp, Homo sapiens
tacttaactgtgtgaag

SEQ ID NO: 355974 - DNA, 21 bp, Homo sapiens
tacttatatttttaataaaag

SEQ ID NO: 355975 - DNA, 12 bp, Homo sapiens
tacttattcaaa

SEQ ID NO: 355976 - DNA, 18 bp, Homo sapiens
tacttcaagttaaagtga

SEQ ID NO: 355977 - DNA, 16 bp, Homo sapiens
tacttcagctttggat

SEQ ID NO: 355978 - DNA, 19 bp, Homo sapiens
tacttcctatcaagccagt

SEQ ID NO: 355979 - DNA, 16 bp, Homo sapiens
tacttcctcctgatgg

SEQ ID NO: 355980 - DNA, 17 bp, Homo sapiens
tacttcctcctgatggc

SEQ ID NO: 355981 - DNA, 17 bp, Homo sapiens
tacttcgtcttctaatt

SEQ ID NO: 355982 - DNA, 15 bp, Homo sapiens
tacttcttatacatt

SEQ ID NO: 355983 - DNA, 15 bp, Homo sapiens
tacttctttttcatt

SEQ ID NO: 355984 - DNA, 22 bp, Homo sapiens
tacttgaccgtttttatattac

SEQ ID NO: 355985 - DNA, 23 bp, Homo sapiens
tacttgaccgtttttatattact

SEQ ID NO: 355986 - DNA, 21 bp, Homo sapiens
tacttgagggaccaatattac

SEQ ID NO: 355987 - DNA, 13 bp, Homo sapiens
tacttgagtgtgc

SEQ ID NO: 355988 - DNA, 16 bp, Homo sapiens
tacttgatcattctca

SEQ ID NO: 355989 - DNA, 19 bp, Homo sapiens
tacttgctccttgaataag

SEQ ID NO: 355990 - DNA, 17 bp, Homo sapiens
tacttggaaatattaaa

SEQ ID NO: 355991 - DNA, 19 bp, Homo sapiens
tacttggtgaggaggaggc

SEQ ID NO: 355992 - DNA, 21 bp, Homo sapiens
tacttggtgaggaggaggcag

SEQ ID NO: 355993 - DNA, 18 bp, Homo sapiens
tacttgtctgaggcctca

SEQ ID NO: 355994 - DNA, 17 bp, Homo sapiens
tacttgtgactgaaggg

SEQ ID NO: 355995 - DNA, 17 bp, Homo sapiens
tacttgtggttttcaaa

SEQ ID NO: 355996 - DNA, 16 bp, Homo sapiens
tacttgtgtttgctta

SEQ ID NO: 355997 - DNA, 18 bp, Homo sapiens
tacttgtgtttgcttaaa

SEQ ID NO: 355998 - DNA, 21 bp, Homo sapiens
tacttgtgtttgcttaaacaa

SEQ ID NO: 355999 - DNA, 14 bp, Homo sapiens
tacttgttcatttc

SEQ ID NO: 356000 - DNA, 15 bp, Homo sapiens
tacttgttcatttct

SEQ ID NO: 356001 - DNA, 19 bp, Homo sapiens
tacttgttcatttctgtct

SEQ ID NO: 356002 - DNA, 14 bp, Homo sapiens
tacttgtttaacat

SEQ ID NO: 356003 - DNA, 19 bp, Homo sapiens
tactttaaatcctaccaaa

SEQ ID NO: 356004 - DNA, 12 bp, Homo sapiens
tactttaaatta

SEQ ID NO: 356005 - DNA, 16 bp, Homo sapiens
tactttaaattatatg

SEQ ID NO: 356006 - DNA, 21 bp, Homo sapiens
tactttaaattatatgatatg

SEQ ID NO: 356007 - DNA, 22 bp, Homo sapiens
tactttaaattatatgatatgc

SEQ ID NO: 356008 - DNA, 22 bp, Homo sapiens
tactttaagcactacataaact

SEQ ID NO: 356009 - DNA, 23 bp, Homo sapiens
tactttacatatgctttaagaat

SEQ ID NO: 356010 - DNA, 22 bp, Homo sapiens
tactttaggtagtagaatctca

SEQ ID NO: 356011 - DNA, 18 bp, Homo sapiens
tactttattaatatgagt

SEQ ID NO: 356012 - DNA, 15 bp, Homo sapiens
tactttattcttgct

SEQ ID NO: 356013 - DNA, 12 bp, Homo sapiens
tactttgcttct

SEQ ID NO: 356014 - DNA, 24 bp, Homo sapiens
tactttggaatgactataaacatt

SEQ ID NO: 356015 - DNA, 22 bp, Homo sapiens
tactttgtaagtgagagagaca

SEQ ID NO: 356016 - DNA, 16 bp, Homo sapiens
tactttgtacttgtgt

SEQ ID NO: 356017 - DNA, 21 bp, Homo sapiens
tactttgtacttgtgtttgct

SEQ ID NO: 356018 - DNA, 13 bp, Homo sapiens
tactttgtgcaaa

SEQ ID NO: 356019 - DNA, 17 bp, Homo sapiens
tactttgtgcaatatga

SEQ ID NO: 356020 - DNA, 11 bp, Homo sapiens
tactttgtgct

SEQ ID NO: 356021 - DNA, 14 bp, Homo sapiens
tactttgtgctgat

SEQ ID NO: 356022 - DNA, 13 bp, Homo sapiens
tactttgtgtctt

SEQ ID NO: 356023 - DNA, 19 bp, Homo sapiens
tactttgtttttccatgtg

SEQ ID NO: 356024 - DNA, 12 bp, Homo sapiens
tacttttaacgt

SEQ ID NO: 356025 - DNA, 17 bp, Homo sapiens
tacttttaccactattt

SEQ ID NO: 356026 - DNA, 16 bp, Homo sapiens
tacttttctgcaatgt

SEQ ID NO: 356027 - DNA, 20 bp, Homo sapiens
tacttttctgcaatgttatt

SEQ ID NO: 356028 - DNA, 18 bp, Homo sapiens
tacttttgataatagata

SEQ ID NO: 356029 - DNA, 21 bp, Homo sapiens
tacttttgataatagataact

SEQ ID NO: 356030 - DNA, 12 bp, Homo sapiens
tacttttgtaaa

SEQ ID NO: 356031 - DNA, 16 bp, Homo sapiens
tacttttgtgtattct

SEQ ID NO: 356032 - DNA, 18 bp, Homo sapiens
tacttttgtgtattctgt

SEQ ID NO: 356033 - DNA, 14 bp, Homo sapiens
tacttttgtttcag

SEQ ID NO: 356034 - DNA, 21 bp, Homo sapiens
tactttttaaacagtgtttat

SEQ ID NO: 356035 - DNA, 14 bp, Homo sapiens
tactttttccttcc

SEQ ID NO: 356036 - DNA, 15 bp, Homo sapiens
tactttttccttcct

SEQ ID NO: 356037 - DNA, 15 bp, Homo sapiens
tactttttgtaaaaa

SEQ ID NO: 356038 - DNA, 19 bp, Homo sapiens
tacttttttctagtttcag

SEQ ID NO: 356039 - DNA, 13 bp, Homo sapiens
tagaaaaaaacaa

SEQ ID NO: 356040 - DNA, 11 bp, Homo sapiens
tagaaaaagca

SEQ ID NO: 356041 - DNA, 23 bp, Homo sapiens
tagaaaaaggagcttacctccca

SEQ ID NO: 356042 - DNA, 15 bp, Homo sapiens
tagaaaacaatgcaa

SEQ ID NO: 356043 - DNA, 17 bp, Homo sapiens
tagaaaacaggaaaaaa

SEQ ID NO: 356044 - DNA, 13 bp, Homo sapiens
tagaaaactgaaa

SEQ ID NO: 356045 - DNA, 15 bp, Homo sapiens
tagaaaactgaaaat

SEQ ID NO: 356046 - DNA, 21 bp, Homo sapiens
tagaaaactgaaaatctaata

SEQ ID NO: 356047 - DNA, 22 bp, Homo sapiens
tagaaaactgaaaatctaatat

SEQ ID NO: 356048 - DNA, 21 bp, Homo sapiens
tagaaaatagagcttttaaaa

SEQ ID NO: 356049 - DNA, 21 bp, Homo sapiens
tagaaacacacttttgcacat

SEQ ID NO: 356050 - DNA, 14 bp, Homo sapiens
tagaaaccttaata

SEQ ID NO: 356051 - DNA, 18 bp, Homo sapiens
tagaaactgagtcctgtt

SEQ ID NO: 356052 - DNA, 23 bp, Homo sapiens
tagaaagaaaagaccctgagact

SEQ ID NO: 356053 - DNA, 14 bp, Homo sapiens
tagaaagaagccca

SEQ ID NO: 356054 - DNA, 21 bp, Homo sapiens
tagaaagctctgcatgtgtgt

SEQ ID NO: 356055 - DNA, 21 bp, Homo sapiens
tagaaagtgaataaaaattaa

SEQ ID NO: 356056 - DNA, 19 bp, Homo sapiens
tagaaataaatagctatat

SEQ ID NO: 356057 - DNA, 16 bp, Homo sapiens
tagaaataagtggtta

SEQ ID NO: 356058 - DNA, 16 bp, Homo sapiens
tagaaataatatgcat

SEQ ID NO: 356059 - DNA, 23 bp, Homo sapiens
tagaaatacccaacgcacaaatg

SEQ ID NO: 356060 - DNA, 15 bp, Homo sapiens
tagaaatataattga

SEQ ID NO: 356061 - DNA, 14 bp, Homo sapiens
tagaaatcattgta

SEQ ID NO: 356062 - DNA, 14 bp, Homo sapiens
tagaaatgtatcct

SEQ ID NO: 356063 - DNA, 18 bp, Homo sapiens
tagaaatgtatcctgata

SEQ ID NO: 356064 - DNA, 13 bp, Homo sapiens
tagaaatgtattt

SEQ ID NO: 356065 - DNA, 19 bp, Homo sapiens
tagaaatgtattttgaaaa

SEQ ID NO: 356066 - DNA, 14 bp, Homo sapiens
tagaaattacaagt

SEQ ID NO: 356067 - DNA, 16 bp, Homo sapiens
tagaaattacaagttt

SEQ ID NO: 356068 - DNA, 21 bp, Homo sapiens
tagaaatttattcttatctta

SEQ ID NO: 356069 - DNA, 14 bp, Homo sapiens
tagaaattttacaa

SEQ ID NO: 356070 - DNA, 23 bp, Homo sapiens
tagaacaatgtacaaggtatgta

SEQ ID NO: 356071 - DNA, 13 bp, Homo sapiens
tagaacagaaaac

SEQ ID NO: 356072 - DNA, 14 bp, Homo sapiens
tagaacagaaaaca

SEQ ID NO: 356073 - DNA, 21 bp, Homo sapiens
tagaacagaaaacaacaaaaa

SEQ ID NO: 356074 - DNA, 22 bp, Homo sapiens
tagaacagaaaacaacaaaaaa

SEQ ID NO: 356075 - DNA, 17 bp, Homo sapiens
tagaacagatggctgtg

SEQ ID NO: 356076 - DNA, 15 bp, Homo sapiens
tagaaccactatgaa

SEQ ID NO: 356077 - DNA, 16 bp, Homo sapiens
tagaacccttctgctt

SEQ ID NO: 356078 - DNA, 20 bp, Homo sapiens
tagaacccttctgctttcta

SEQ ID NO: 356079 - DNA, 14 bp, Homo sapiens
tagaactcagcagt

SEQ ID NO: 356080 - DNA, 19 bp, Homo sapiens
tagaactgtatgtcagaca

SEQ ID NO: 356081 - DNA, 22 bp, Homo sapiens
tagaactgtcccacaaaatatt

SEQ ID NO: 356082 - DNA, 12 bp, Homo sapiens
tagaactgttca

SEQ ID NO: 356083 - DNA, 16 bp, Homo sapiens
tagaacttagttttgt

SEQ ID NO: 356084 - DNA, 17 bp, Homo sapiens
tagaacttagttttgtt

SEQ ID NO: 356085 - DNA, 16 bp, Homo sapiens
tagaacttgaccccct

SEQ ID NO: 356086 - DNA, 18 bp, Homo sapiens
tagaagaaaacatatatt

SEQ ID NO: 356087 - DNA, 17 bp, Homo sapiens
tagaagaaaagcactgg

SEQ ID NO: 356088 - DNA, 19 bp, Homo sapiens
tagaagaaagcaaaaaata

SEQ ID NO: 356089 - DNA, 19 bp, Homo sapiens
tagaagaaagtaaaaagaa

SEQ ID NO: 356090 - DNA, 20 bp, Homo sapiens
tagaagatgaatcagtatga

SEQ ID NO: 356091 - DNA, 17 bp, Homo sapiens
tagaagccaagacagtg

SEQ ID NO: 356092 - DNA, 20 bp, Homo sapiens
tagaagcttcttgctcctgt

SEQ ID NO: 356093 - DNA, 21 bp, Homo sapiens
tagaaggaagcacctatgaaa

SEQ ID NO: 356094 - DNA, 17 bp, Homo sapiens
tagaagtgcatttctga

SEQ ID NO: 356095 - DNA, 23 bp, Homo sapiens
tagaagtgcatttctgaatagaa

SEQ ID NO: 356096 - DNA, 21 bp, Homo sapiens
tagattgatctaaggcatgct

SEQ ID NO: 356097 - DNA, 19 bp, Homo sapiens
tagatttaccctttataga

SEQ ID NO: 356098 - DNA, 20 bp, Homo sapiens
tagatttaccctttatagaa

SEQ ID NO: 356099 - DNA, 18 bp, Homo sapiens
tagattttaatcaaattt

SEQ ID NO: 356100 - DNA, 15 bp, Homo sapiens
tagattttctgtaaa

SEQ ID NO: 356101 - DNA, 23 bp, Homo sapiens
tagcaaaaggatgatttaacatt

SEQ ID NO: 356102 - DNA, 19 bp, Homo sapiens
tagcaacaacttactaaat

SEQ ID NO: 356103 - DNA, 18 bp, Homo sapiens
tagcaagaagattctaaa

SEQ ID NO: 356104 - DNA, 18 bp, Homo sapiens
tagcaagttacagtgatg

SEQ ID NO: 356105 - DNA, 21 bp, Homo sapiens
tagcaattgcttctctaaaac

SEQ ID NO: 356106 - DNA, 19 bp, Homo sapiens
tagcacaaggagtgcccgc

SEQ ID NO: 356107 - DNA, 19 bp, Homo sapiens
tagcaccaatacaaattga

SEQ ID NO: 356108 - DNA, 14 bp, Homo sapiens
tagcactcacatgc

SEQ ID NO: 356109 - DNA, 20 bp, Homo sapiens
tagcactggtttgtttctca

SEQ ID NO: 356110 - DNA, 19 bp, Homo sapiens
tagcagagtcattgttaca

SEQ ID NO: 356111 - DNA, 20 bp, Homo sapiens
tagcagattttaattttgaa

SEQ ID NO: 356112 - DNA, 22 bp, Homo sapiens
tagcagctcaggcgcagcccta

SEQ ID NO: 356113 - DNA, 20 bp, Homo sapiens
tagcttatctccctgcttca

SEQ ID NO: 356114 - DNA, 22 bp, Homo sapiens
tagcttatctccctgcttcata

SEQ ID NO: 356115 - DNA, 19 bp, Homo sapiens
tagcttcctccagaggagg

SEQ ID NO: 356116 - DNA, 14 bp, Homo sapiens
tagctttaccctca

SEQ ID NO: 356117 - DNA, 19 bp, Homo sapiens
tagctttattttttaagta

SEQ ID NO: 356118 - DNA, 22 bp, Homo sapiens
tagctttattttttaagtattt

SEQ ID NO: 356119 - DNA, 15 bp, Homo sapiens
tagctttttaaaaca

SEQ ID NO: 356120 - DNA, 22 bp, Homo sapiens
tagctttttaccgttcacttcc

SEQ ID NO: 356121 - DNA, 15 bp, Homo sapiens
tagctttttcctgga

SEQ ID NO: 356122 - DNA, 18 bp, Homo sapiens
taggaaaccaccctgagg

SEQ ID NO: 356123 - DNA, 19 bp, Homo sapiens
taggaaataaaacctttca

SEQ ID NO: 356124 - DNA, 23 bp, Homo sapiens
taggaaatcttgtccagagacaa

SEQ ID NO: 356125 - DNA, 19 bp, Homo sapiens
taggaacagagtatatatg

SEQ ID NO: 356126 - DNA, 14 bp, Homo sapiens
taggaagagaaacc

SEQ ID NO: 356127 - DNA, 18 bp, Homo sapiens
taggaagtgacttgaatg

SEQ ID NO: 356128 - DNA, 21 bp, Homo sapiens
taggaagtgacttgaatgtac

SEQ ID NO: 356129 - DNA, 17 bp, Homo sapiens
taggaagtgtaacagct

SEQ ID NO: 356130 - DNA, 19 bp, Homo sapiens
taggaagtgtaacagctga

SEQ ID NO: 356131 - DNA, 15 bp, Homo sapiens
taggaataacactgc

SEQ ID NO: 356132 - DNA, 16 bp, Homo sapiens
taggaataacactgca

SEQ ID NO: 356133 - DNA, 19 bp, Homo sapiens
taggaatctgccttccagc

SEQ ID NO: 356134 - DNA, 16 bp, Homo sapiens
taggaatgctcaatgt

SEQ ID NO: 356135 - DNA, 17 bp, Homo sapiens
taggaattcatcttttg

SEQ ID NO: 356136 - DNA, 18 bp, Homo sapiens
taggacatctctgtaaaa

SEQ ID NO: 356137 - DNA, 15 bp, Homo sapiens
tagtgcctcagcgct

SEQ ID NO: 356138 - DNA, 24 bp, Homo sapiens
tagtgcctgtgatcgtgtgttgcc

SEQ ID NO: 356139 - DNA, 16 bp, Homo sapiens
tagtgcctttttcctt

SEQ ID NO: 356140 - DNA, 21 bp, Homo sapiens
tagtgcgatgtttcaggaggc

SEQ ID NO: 356141 - DNA, 17 bp, Homo sapiens
tagtgcggacaagtttt

SEQ ID NO: 356142 - DNA, 19 bp, Homo sapiens
tagtgcggacaagttttaa

SEQ ID NO: 356143 - DNA, 21 bp, Homo sapiens
tagtgcttaaaaatcattgat

SEQ ID NO: 356144 - DNA, 22 bp, Homo sapiens
tagtgcttcttgtaatatttct

SEQ ID NO: 356145 - DNA, 23 bp, Homo sapiens
tagtgctttacctttattaatga

SEQ ID NO: 356146 - DNA, 20 bp, Homo sapiens
tagtggaaagattgtgtctg

SEQ ID NO: 356147 - DNA, 18 bp, Homo sapiens
tagtggaagagcagcctg

SEQ ID NO: 356148 - DNA, 23 bp, Homo sapiens
tagtggaagagcagcctgatggc

SEQ ID NO: 356149 - DNA, 14 bp, Homo sapiens
tagtggagagaact

SEQ ID NO: 356150 - DNA, 16 bp, Homo sapiens
tagtgggaagagctgg

SEQ ID NO: 356151 - DNA, 15 bp, Homo sapiens
tagtgggagcccagc

SEQ ID NO: 356152 - DNA, 13 bp, Homo sapiens
tagtgggcaggtg

SEQ ID NO: 356153 - DNA, 15 bp, Homo sapiens
tagtgggcaggtggc

SEQ ID NO: 356154 - DNA, 15 bp, Homo sapiens
tagtggtatgtctct

SEQ ID NO: 356155 - DNA, 13 bp, Homo sapiens
tagtggtggctct

SEQ ID NO: 356156 - DNA, 19 bp, Homo sapiens
tagtgtaaaataagaatga

SEQ ID NO: 356157 - DNA, 17 bp, Homo sapiens
tagtgtataccacctgt

SEQ ID NO: 356158 - DNA, 21 bp, Homo sapiens
tagtgtataccacctgtacat

SEQ ID NO: 356159 - DNA, 18 bp, Homo sapiens
tagtgtcacttttttcct

SEQ ID NO: 356160 - DNA, 22 bp, Homo sapiens
tagtgtcacttttttcctgtca

SEQ ID NO: 356161 - DNA, 19 bp, Homo sapiens
tagtgtgagtggcagccat

SEQ ID NO: 356162 - DNA, 17 bp, Homo sapiens
tagtgtgctcggacaca

SEQ ID NO: 356163 - DNA, 19 bp, Homo sapiens
tagtgtgctcggacacagt

SEQ ID NO: 356164 - DNA, 22 bp, Homo sapiens
tagtgtggttttctgtttctaa

SEQ ID NO: 356165 - DNA, 15 bp, Homo sapiens
tagtgtgttctgatt

SEQ ID NO: 356166 - DNA, 19 bp, Homo sapiens
tagtgtgttctgattagaa

SEQ ID NO: 356167 - DNA, 20 bp, Homo sapiens
tagtgtgttctgattagaaa

SEQ ID NO: 356168 - DNA, 14 bp, Homo sapiens
tagtgttaactgtt

SEQ ID NO: 356169 - DNA, 15 bp, Homo sapiens
tagtgtttctgcaga

SEQ ID NO: 356170 - DNA, 15 bp, Homo sapiens
tagtgttttgcaagg

SEQ ID NO: 356171 - DNA, 18 bp, Homo sapiens
tagtgttttgtacttgtt

SEQ ID NO: 356172 - DNA, 14 bp, Homo sapiens
tagttaaaagcctt

SEQ ID NO: 356173 - DNA, 11 bp, Homo sapiens
tagttaaaatc

SEQ ID NO: 356174 - DNA, 17 bp, Homo sapiens
tagttacctactgagta

SEQ ID NO: 356175 - DNA, 15 bp, Homo sapiens
tagttagcaggaaat

SEQ ID NO: 356176 - DNA, 15 bp, Homo sapiens
tagttagccctcagt

SEQ ID NO: 356177 - DNA, 18 bp, Homo sapiens
tagttaggaaataaaacc

SEQ ID NO: 356178 - DNA, 20 bp, Homo sapiens
tagttaggatagcatttttg

SEQ ID NO: 356179 - DNA, 15 bp, Homo sapiens
tagttagtagcatgt

SEQ ID NO: 356180 - DNA, 16 bp, Homo sapiens
tagttagtagcatgtt

SEQ ID NO: 356181 - DNA, 12 bp, Homo sapiens
tagttattttaa

SEQ ID NO: 356182 - DNA, 17 bp, Homo sapiens
tagttattttaatacct

SEQ ID NO: 356183 - DNA, 11 bp, Homo sapiens
tagttcaatgc

SEQ ID NO: 356184 - DNA, 19 bp, Homo sapiens
tagttcagacactttggaa

SEQ ID NO: 356185 - DNA, 17 bp, Homo sapiens
tagttccattcttggtc

SEQ ID NO: 356186 - DNA, 18 bp, Homo sapiens
tagttcctgtggccagga

SEQ ID NO: 356187 - DNA, 11 bp, Homo sapiens
tagttctagat

SEQ ID NO: 356188 - DNA, 12 bp, Homo sapiens
tagttctatttc

SEQ ID NO: 356189 - DNA, 16 bp, Homo sapiens
tagttctatttctatc

SEQ ID NO: 356190 - DNA, 18 bp, Homo sapiens
tagttctatttctatctg

SEQ ID NO: 356191 - DNA, 20 bp, Homo sapiens
tagttctcactgttccctct

SEQ ID NO: 356192 - DNA, 13 bp, Homo sapiens
tagttctgttaaa

SEQ ID NO: 356193 - DNA, 14 bp, Homo sapiens
tagttctttgttcc

SEQ ID NO: 356194 - DNA, 17 bp, Homo sapiens
tagttctttgttcctgc

SEQ ID NO: 356195 - DNA, 17 bp, Homo sapiens
tagttgaacaagatttc

SEQ ID NO: 356196 - DNA, 12 bp, Homo sapiens
tagttgaatttt

SEQ ID NO: 356197 - DNA, 19 bp, Homo sapiens
tagttgagtcttcacattt

SEQ ID NO: 356198 - DNA, 14 bp, Homo sapiens
tagttgatgaccaa

SEQ ID NO: 356199 - DNA, 21 bp, Homo sapiens
tagttgatgaccaatctctgt

SEQ ID NO: 356200 - DNA, 14 bp, Homo sapiens
tagttgcaattgaa

SEQ ID NO: 356201 - DNA, 16 bp, Homo sapiens
tagttgcaattgaatt

SEQ ID NO: 356202 - DNA, 11 bp, Homo sapiens
tagttggaatg

SEQ ID NO: 356203 - DNA, 14 bp, Homo sapiens
tagttgtctttctt

SEQ ID NO: 356204 - DNA, 13 bp, Homo sapiens
tagtttaggagaa

SEQ ID NO: 356205 - DNA, 14 bp, Homo sapiens
tagtttaggagaaa

SEQ ID NO: 356206 - DNA, 18 bp, Homo sapiens
tagtttaggagaaaccag

SEQ ID NO: 356207 - DNA, 18 bp, Homo sapiens
tagtttatacagttttaa

SEQ ID NO: 356208 - DNA, 16 bp, Homo sapiens
tagtttctagaggcct

SEQ ID NO: 356209 - DNA, 12 bp, Homo sapiens
tagtttcttgtg

SEQ ID NO: 356210 - DNA, 13 bp, Homo sapiens
tagtttgcagagg

SEQ ID NO: 356211 - DNA, 16 bp, Homo sapiens
tagtttgcatacttcc

SEQ ID NO: 356212 - DNA, 17 bp, Homo sapiens
tagtttgtataacttct

SEQ ID NO: 356213 - DNA, 18 bp, Homo sapiens
tagtttgtataacttctt

SEQ ID NO: 356214 - DNA, 14 bp, Homo sapiens
tagttttagttgca

SEQ ID NO: 356215 - DNA, 16 bp, Homo sapiens
tagttttagttgcaga

SEQ ID NO: 356216 - DNA, 16 bp, Homo sapiens
tagttttatgtttctt

SEQ ID NO: 356217 - DNA, 15 bp, Homo sapiens
tagttttggttttta

SEQ ID NO: 356218 - DNA, 22 bp, Homo sapiens
tagtttttaaaaaggcctttgg

SEQ ID NO: 356219 - DNA, 17 bp, Homo sapiens
tagtttttcttcaacat

SEQ ID NO: 356220 - DNA, 22 bp, Homo sapiens
tataaaaaaattgtaaatgttt

SEQ ID NO: 356221 - DNA, 16 bp, Homo sapiens
tataaaaaagaaaact

SEQ ID NO: 356222 - DNA, 19 bp, Homo sapiens
tataaaaagaaaagataaa

SEQ ID NO: 356223 - DNA, 12 bp, Homo sapiens
tataaaaagcca

SEQ ID NO: 356224 - DNA, 14 bp, Homo sapiens
tataaaaagccact

SEQ ID NO: 356225 - DNA, 21 bp, Homo sapiens
tataaaactcagttaaaatgt

SEQ ID NO: 356226 - DNA, 15 bp, Homo sapiens
tataaaactttcctc

SEQ ID NO: 356227 - DNA, 16 bp, Homo sapiens
tataaaataaatatac

SEQ ID NO: 356228 - DNA, 21 bp, Homo sapiens
tataaaataaatatactaata

SEQ ID NO: 356229 - DNA, 17 bp, Homo sapiens
tataaaatctagatcaa

SEQ ID NO: 356230 - DNA, 14 bp, Homo sapiens
tataaaatctgtat

SEQ ID NO: 356231 - DNA, 14 bp, Homo sapiens
tataaaatctttcc

SEQ ID NO: 356232 - DNA, 15 bp, Homo sapiens
tataagtcacaaaga

SEQ ID NO: 356233 - DNA, 13 bp, Homo sapiens
tataagttaaaga

SEQ ID NO: 356234 - DNA, 18 bp, Homo sapiens
tataagttaaagagacaa

SEQ ID NO: 356235 - DNA, 13 bp, Homo sapiens
tataataaagtat

SEQ ID NO: 356236 - DNA, 14 bp, Homo sapiens
tataataaatggga

SEQ ID NO: 356237 - DNA, 18 bp, Homo sapiens
tataataatgttctctgg

SEQ ID NO: 356238 - DNA, 17 bp, Homo sapiens
tataatacttaaaaata

SEQ ID NO: 356239 - DNA, 17 bp, Homo sapiens
tataatatatgttttaa

SEQ ID NO: 356240 - DNA, 18 bp, Homo sapiens
tataatcccagcactttg

SEQ ID NO: 356241 - DNA, 19 bp, Homo sapiens
tataatcccagcatgttga

SEQ ID NO: 356242 - DNA, 20 bp, Homo sapiens
tataatgaatgaaacatttt

SEQ ID NO: 356243 - DNA, 23 bp, Homo sapiens
tataatgacttatatgctgaatt

SEQ ID NO: 356244 - DNA, 17 bp, Homo sapiens
tataatgagtttcatta

SEQ ID NO: 356245 - DNA, 15 bp, Homo sapiens
tataatgctggagcg

SEQ ID NO: 356246 - DNA, 17 bp, Homo sapiens
tataatggcctcttaaa

SEQ ID NO: 356247 - DNA, 16 bp, Homo sapiens
tataatggtttactgc

SEQ ID NO: 356248 - DNA, 20 bp, Homo sapiens
tataatggtttactgctgtc

SEQ ID NO: 356249 - DNA, 17 bp, Homo sapiens
tataatgttgttattta

SEQ ID NO: 356250 - DNA, 15 bp, Homo sapiens
tataatgtttgctat

SEQ ID NO: 356251 - DNA, 13 bp, Homo sapiens
tataattccctat

SEQ ID NO: 356252 - DNA, 17 bp, Homo sapiens
tataattctactttgag

SEQ ID NO: 356253 - DNA, 14 bp, Homo sapiens
tataattctattga

SEQ ID NO: 356254 - DNA, 16 bp, Homo sapiens
tataattctgtaaatg

SEQ ID NO: 356255 - DNA, 12 bp, Homo sapiens
tataattgttat

SEQ ID NO: 356256 - DNA, 18 bp, Homo sapiens
tataattttaaaattgca

SEQ ID NO: 356257 - DNA, 19 bp, Homo sapiens
tataattttattgctggaa

SEQ ID NO: 356258 - DNA, 20 bp, Homo sapiens
tataatttttttattactga

SEQ ID NO: 356259 - DNA, 13 bp, Homo sapiens
tatacaaacaggt

SEQ ID NO: 356260 - DNA, 22 bp, Homo sapiens
tatacaaatgggggcggctgga

SEQ ID NO: 356261 - DNA, 22 bp, Homo sapiens
tatacaactttggaatttgaag

SEQ ID NO: 356262 - DNA, 21 bp, Homo sapiens
tatacacccagttctgaataa

SEQ ID NO: 356263 - DNA, 22 bp, Homo sapiens
tatacacttacactttatgcac

SEQ ID NO: 356264 - DNA, 22 bp, Homo sapiens
tatacagacctaatatcatttt

SEQ ID NO: 356265 - DNA, 16 bp, Homo sapiens
tatacagttcaataaa

SEQ ID NO: 356266 - DNA, 20 bp, Homo sapiens
tatacagttcaataaactta

SEQ ID NO: 356267 - DNA, 19 bp, Homo sapiens
tatacagttttaaagaatc

SEQ ID NO: 356268 - DNA, 22 bp, Homo sapiens
tatacataacagggtaaattat

SEQ ID NO: 356269 - DNA, 17 bp, Homo sapiens
tatacatacctctctct

SEQ ID NO: 356270 - DNA, 22 bp, Homo sapiens
tatacatcacctttttgacttt

SEQ ID NO: 356271 - DNA, 12 bp, Homo sapiens
tatacatctagc

SEQ ID NO: 356272 - DNA, 14 bp, Homo sapiens
tatacattcctgag

SEQ ID NO: 356273 - DNA, 20 bp, Homo sapiens
tatacattcctgagattctg

SEQ ID NO: 356274 - DNA, 23 bp, Homo sapiens
tatacatttcataaggcctgccc

SEQ ID NO: 356275 - DNA, 13 bp, Homo sapiens
tatacattttgtt

SEQ ID NO: 356276 - DNA, 19 bp, Homo sapiens
tataccagagacctgaggc

SEQ ID NO: 356277 - DNA, 16 bp, Homo sapiens
tataccagcaaaagtg

SEQ ID NO: 356278 - DNA, 19 bp, Homo sapiens
tataccccttacttagcat

SEQ ID NO: 356279 - DNA, 15 bp, Homo sapiens
tatactaagaaaaga

SEQ ID NO: 356280 - DNA, 13 bp, Homo sapiens
tatactaataaaa

SEQ ID NO: 356281 - DNA, 16 bp, Homo sapiens
tatactaataaaaagg

SEQ ID NO: 356282 - DNA, 19 bp, Homo sapiens
tatactaataaaaaggttt

SEQ ID NO: 356283 - DNA, 13 bp, Homo sapiens
tatactatgaaat

SEQ ID NO: 356284 - DNA, 21 bp, Homo sapiens
tatactctcaccatttggatc

SEQ ID NO: 356285 - DNA, 18 bp, Homo sapiens
tatactgcactttagtgt

SEQ ID NO: 356286 - DNA, 24 bp, Homo sapiens
tatactggttatagttgatatgta

SEQ ID NO: 356287 - DNA, 18 bp, Homo sapiens
tatactgtgtcatggtga

SEQ ID NO: 356288 - DNA, 20 bp, Homo sapiens
tatactgtttgtaatataca

SEQ ID NO: 356289 - DNA, 19 bp, Homo sapiens
tatacttaatactgaattt

SEQ ID NO: 356290 - DNA, 13 bp, Homo sapiens
tatacttgagtgt

SEQ ID NO: 356291 - DNA, 19 bp, Homo sapiens
tatacttgtggttttcaaa

SEQ ID NO: 356292 - DNA, 14 bp, Homo sapiens
tatagaaaaagcac

SEQ ID NO: 356293 - DNA, 14 bp, Homo sapiens
tatagaaatgtatt

SEQ ID NO: 356294 - DNA, 22 bp, Homo sapiens
tatagaataatgtgggaagaaa

SEQ ID NO: 356295 - DNA, 20 bp, Homo sapiens
tatagaatacttttttctag

SEQ ID NO: 356296 - DNA, 21 bp, Homo sapiens
tatagaatatttattacctct

SEQ ID NO: 356297 - DNA, 18 bp, Homo sapiens
tatagacctatgataaat

SEQ ID NO: 356298 - DNA, 18 bp, Homo sapiens
tatagccctttccccact

SEQ ID NO: 356299 - DNA, 19 bp, Homo sapiens
tatagccctttccccactc

SEQ ID NO: 356300 - DNA, 16 bp, Homo sapiens
tatagctacaggaagc

SEQ ID NO: 356301 - DNA, 13 bp, Homo sapiens
tatagctagctat

SEQ ID NO: 356302 - DNA, 19 bp, Homo sapiens
tatagctagctatttctat

SEQ ID NO: 356303 - DNA, 11 bp, Homo sapiens
tatagctatta

SEQ ID NO: 356304 - DNA, 19 bp, Homo sapiens
tatagctctacacaacatg

SEQ ID NO: 356305 - DNA, 17 bp, Homo sapiens
tatagcttccagattac

SEQ ID NO: 356306 - DNA, 19 bp, Homo sapiens
tatagcttccagattacaa

SEQ ID NO: 356307 - DNA, 16 bp, Homo sapiens
tataggagacttgtag

SEQ ID NO: 356308 - DNA, 12 bp, Homo sapiens
tataggagagga

SEQ ID NO: 356309 - DNA, 13 bp, Homo sapiens
tataggccatctg

SEQ ID NO: 356310 - DNA, 14 bp, Homo sapiens
tataggccatctgt

SEQ ID NO: 356311 - DNA, 15 bp, Homo sapiens
tataggccatctgta

SEQ ID NO: 356312 - DNA, 17 bp, Homo sapiens
tataggccatctgtaaa

SEQ ID NO: 356313 - DNA, 18 bp, Homo sapiens
tataggccatctgtaaat

SEQ ID NO: 356314 - DNA, 19 bp, Homo sapiens
tataggccatctgtaaata

SEQ ID NO: 356315 - DNA, 17 bp, Homo sapiens
tataggtagatccagat

SEQ ID NO: 356316 - DNA, 22 bp, Homo sapiens
tatcaaggctgcctggagaaag

SEQ ID NO: 356317 - DNA, 17 bp, Homo sapiens
tatcaagtggcatgtgc

SEQ ID NO: 356318 - DNA, 11 bp, Homo sapiens
tatcacacact

SEQ ID NO: 356319 - DNA, 14 bp, Homo sapiens
tatcaccagtctta

SEQ ID NO: 356320 - DNA, 15 bp, Homo sapiens
tatcacctgtcatca

SEQ ID NO: 356321 - DNA, 15 bp, Homo sapiens
tatcacgggcccgct

SEQ ID NO: 356322 - DNA, 20 bp, Homo sapiens
tatcactaataaagtctgtc

SEQ ID NO: 356323 - DNA, 14 bp, Homo sapiens
tatcagacctctga

SEQ ID NO: 356324 - DNA, 15 bp, Homo sapiens
tatcagagctcttaa

SEQ ID NO: 356325 - DNA, 22 bp, Homo sapiens
tatcagagctcttaatgttgct

SEQ ID NO: 356326 - DNA, 14 bp, Homo sapiens
tatcagattgcttt

SEQ ID NO: 356327 - DNA, 20 bp, Homo sapiens
tatcagtacaattctttgtt

SEQ ID NO: 356328 - DNA, 13 bp, Homo sapiens
tatcagtgaatat

SEQ ID NO: 356329 - DNA, 15 bp, Homo sapiens
tatcagtgacagagt

SEQ ID NO: 356330 - DNA, 16 bp, Homo sapiens
tatcagtgacagagtt

SEQ ID NO: 356331 - DNA, 19 bp, Homo sapiens
tatcagtgatggtctcaca

SEQ ID NO: 356332 - DNA, 16 bp, Homo sapiens
tatcagtgcttaatgt

SEQ ID NO: 356333 - DNA, 21 bp, Homo sapiens
tatcagttgagcttcatatac

SEQ ID NO: 356334 - DNA, 14 bp, Homo sapiens
tatcataatgtaat

SEQ ID NO: 356335 - DNA, 21 bp, Homo sapiens
tatcatatgtatctaaatgaa

SEQ ID NO: 356336 - DNA, 19 bp, Homo sapiens
tatcatcccaacagccaag

SEQ ID NO: 356337 - DNA, 14 bp, Homo sapiens
tatcatgacatgtt

SEQ ID NO: 356338 - DNA, 12 bp, Homo sapiens
tatcatggtctc

SEQ ID NO: 356339 - DNA, 15 bp, Homo sapiens
tatcattaaacatga

SEQ ID NO: 356340 - DNA, 16 bp, Homo sapiens
tatcattaaacatgaa

SEQ ID NO: 356341 - DNA, 17 bp, Homo sapiens
tatcattaaacatgaat

SEQ ID NO: 356342 - DNA, 18 bp, Homo sapiens
tatcattaaacatgaatt

SEQ ID NO: 356343 - DNA, 22 bp, Homo sapiens
tatcattaaacatgaatttaat

SEQ ID NO: 356344 - DNA, 16 bp, Homo sapiens
tatcattatagcatgt

SEQ ID NO: 356345 - DNA, 19 bp, Homo sapiens
tatcattctttgtatctta

SEQ ID NO: 356346 - DNA, 21 bp, Homo sapiens
tatcattctttgtatcttaaa

SEQ ID NO: 356347 - DNA, 15 bp, Homo sapiens
tatcatttcataaaa

SEQ ID NO: 356348 - DNA, 16 bp, Homo sapiens
tatcattttattcaca

SEQ ID NO: 356349 - DNA, 22 bp, Homo sapiens
tatccaaagaacttgatttgca

SEQ ID NO: 356350 - DNA, 15 bp, Homo sapiens
tatccaaagactgta

SEQ ID NO: 356351 - DNA, 19 bp, Homo sapiens
tatccaacatcaacatctt

SEQ ID NO: 356352 - DNA, 20 bp, Homo sapiens
tatccacagaacctttgtca

SEQ ID NO: 356353 - DNA, 23 bp, Homo sapiens
tatccaccaaaagggctccctga

SEQ ID NO: 356354 - DNA, 14 bp, Homo sapiens
tatccagtcaaaga

SEQ ID NO: 356355 - DNA, 23 bp, Homo sapiens
tatccataacctctatatcttta

SEQ ID NO: 356356 - DNA, 13 bp, Homo sapiens
tatccatgtactg

SEQ ID NO: 356357 - DNA, 15 bp, Homo sapiens
tatccatgtactgta

SEQ ID NO: 356358 - DNA, 16 bp, Homo sapiens
tatccatgtactgtag

SEQ ID NO: 356359 - DNA, 16 bp, Homo sapiens
tatccattctttctga

SEQ ID NO: 356360 - DNA, 13 bp, Homo sapiens
tatcccacctcca

SEQ ID NO: 356361 - DNA, 14 bp, Homo sapiens
tatcccacctccag

SEQ ID NO: 356362 - DNA, 16 bp, Homo sapiens
tatcccacctccagcc

SEQ ID NO: 356363 - DNA, 16 bp, Homo sapiens
tatcccacggaaaatg

SEQ ID NO: 356364 - DNA, 19 bp, Homo sapiens
tatcccacggaaaatgcca

SEQ ID NO: 356365 - DNA, 17 bp, Homo sapiens
tatccccaggccaggtc

SEQ ID NO: 356366 - DNA, 18 bp, Homo sapiens
tatccccaggccaggtcc

SEQ ID NO: 356367 - DNA, 19 bp, Homo sapiens
tatccgacatgtactgcta

SEQ ID NO: 356368 - DNA, 17 bp, Homo sapiens
tatcctagttccattct

SEQ ID NO: 356369 - DNA, 22 bp, Homo sapiens
tatcctccgccctttttgtcct

SEQ ID NO: 356370 - DNA, 15 bp, Homo sapiens
tatcctgcaccctct

SEQ ID NO: 356371 - DNA, 20 bp, Homo sapiens
tatcctgctagctgtagaaa

SEQ ID NO: 356372 - DNA, 21 bp, Homo sapiens
tatcctggctttgcccaacct

SEQ ID NO: 356373 - DNA, 13 bp, Homo sapiens
tatcctgttaaca

SEQ ID NO: 356374 - DNA, 23 bp, Homo sapiens
tatcctgttaggggaaaatagta

SEQ ID NO: 356375 - DNA, 14 bp, Homo sapiens
tatcctgttcttcc

SEQ ID NO: 356376 - DNA, 14 bp, Homo sapiens
tatccttttatctc

SEQ ID NO: 356377 - DNA, 21 bp, Homo sapiens
tatccttttttattgaataac

SEQ ID NO: 356378 - DNA, 14 bp, Homo sapiens
tatcgaaagtaaaa

SEQ ID NO: 356379 - DNA, 15 bp, Homo sapiens
tatcgatctggaaag

SEQ ID NO: 356380 - DNA, 20 bp, Homo sapiens
tatctaatccttaaaagcat

SEQ ID NO: 356381 - DNA, 19 bp, Homo sapiens
tatctatgactgtgtttaa

SEQ ID NO: 356382 - DNA, 15 bp, Homo sapiens
tatctatttatctgt

SEQ ID NO: 356383 - DNA, 19 bp, Homo sapiens
tatctatttatctgtctga

SEQ ID NO: 356384 - DNA, 14 bp, Homo sapiens
tatctcaagtatat

SEQ ID NO: 356385 - DNA, 15 bp, Homo sapiens
tatctcaagtatata

SEQ ID NO: 356386 - DNA, 13 bp, Homo sapiens
tatctccctgctt

SEQ ID NO: 356387 - DNA, 14 bp, Homo sapiens
tatctccctgcttc

SEQ ID NO: 356388 - DNA, 20 bp, Homo sapiens
tatctccctgcttcatatct

SEQ ID NO: 356389 - DNA, 14 bp, Homo sapiens
tatctcgaagtctt

SEQ ID NO: 356390 - DNA, 15 bp, Homo sapiens
tatctcgaagtcttc

SEQ ID NO: 356391 - DNA, 17 bp, Homo sapiens
tatctcgctagccatat

SEQ ID NO: 356392 - DNA, 14 bp, Homo sapiens
tatctctaatgaaa

SEQ ID NO: 356393 - DNA, 16 bp, Homo sapiens
tatctctcccttcttt

SEQ ID NO: 356394 - DNA, 16 bp, Homo sapiens
tatctctgaagcatgt

SEQ ID NO: 356395 - DNA, 17 bp, Homo sapiens
tatctctgaagcatgtt

SEQ ID NO: 356396 - DNA, 18 bp, Homo sapiens
tatctctgaagcatgttt

SEQ ID NO: 356397 - DNA, 13 bp, Homo sapiens
tatctctttctct

SEQ ID NO: 356398 - DNA, 22 bp, Homo sapiens
tatctgaacacatactagaaag

SEQ ID NO: 356399 - DNA, 13 bp, Homo sapiens
tatctgaggtcac

SEQ ID NO: 356400 - DNA, 19 bp, Homo sapiens
tatctgcaaatagtttcaa

SEQ ID NO: 356401 - DNA, 22 bp, Homo sapiens
tatctgcaaatagtttcaaatg

SEQ ID NO: 356402 - DNA, 21 bp, Homo sapiens
tatctgcaatgtttttgtgta

SEQ ID NO: 356403 - DNA, 23 bp, Homo sapiens
tatctgcatttataaatgtgtgg

SEQ ID NO: 356404 - DNA, 15 bp, Homo sapiens
tatctgcctggcctg

SEQ ID NO: 356405 - DNA, 18 bp, Homo sapiens
tatctgctgcctctgaaa

SEQ ID NO: 356406 - DNA, 20 bp, Homo sapiens
tatctgctgcctctgaaaat

SEQ ID NO: 356407 - DNA, 20 bp, Homo sapiens
tatctgctgttccttcgagg

SEQ ID NO: 356408 - DNA, 20 bp, Homo sapiens
tatctgcttcagtggagaat

SEQ ID NO: 356409 - DNA, 22 bp, Homo sapiens
tatctggaaaaaaaaaaatatg

SEQ ID NO: 356410 - DNA, 19 bp, Homo sapiens
tatctgggattctacttta

SEQ ID NO: 356411 - DNA, 21 bp, Homo sapiens
tatctgggggactagaacaca

SEQ ID NO: 356412 - DNA, 12 bp, Homo sapiens
tatctgtacctg

SEQ ID NO: 356413 - DNA, 16 bp, Homo sapiens
tatctgtatctctctc

SEQ ID NO: 356414 - DNA, 19 bp, Homo sapiens
tatctgtctgagccctgcc

SEQ ID NO: 356415 - DNA, 16 bp, Homo sapiens
tatctgtctttatgat

SEQ ID NO: 356416 - DNA, 19 bp, Homo sapiens
tatctgtgaaatgctggca

SEQ ID NO: 356417 - DNA, 15 bp, Homo sapiens
tatctgtgagttctg

SEQ ID NO: 356418 - DNA, 20 bp, Homo sapiens
tatctgtgatggatggacac

SEQ ID NO: 356419 - DNA, 15 bp, Homo sapiens
tatctgttttactgc

SEQ ID NO: 356420 - DNA, 18 bp, Homo sapiens
tatctgttttactgcttt

SEQ ID NO: 356421 - DNA, 19 bp, Homo sapiens
tatctgttttactgctttt

SEQ ID NO: 356422 - DNA, 15 bp, Homo sapiens
tatcttaaagaaaca

SEQ ID NO: 356423 - DNA, 18 bp, Homo sapiens
tatcttaaagaaacagct

SEQ ID NO: 356424 - DNA, 13 bp, Homo sapiens
tatcttcaaactt

SEQ ID NO: 356425 - DNA, 18 bp, Homo sapiens
tatcttcaaactttcact

SEQ ID NO: 356426 - DNA, 13 bp, Homo sapiens
tatcttgcatcta

SEQ ID NO: 356427 - DNA, 14 bp, Homo sapiens
tatcttgtgtatgg

SEQ ID NO: 356428 - DNA, 18 bp, Homo sapiens
tattaccatcttaatctt

SEQ ID NO: 356429 - DNA, 19 bp, Homo sapiens
tattaccatcttaatcttt

SEQ ID NO: 356430 - DNA, 20 bp, Homo sapiens
tattaccatcttaatcttta

SEQ ID NO: 356431 - DNA, 15 bp, Homo sapiens
tattaccatgagaag

SEQ ID NO: 356432 - DNA, 19 bp, Homo sapiens
tattacctctgatacctca

SEQ ID NO: 356433 - DNA, 16 bp, Homo sapiens
tattactgatgtgtgc

SEQ ID NO: 356434 - DNA, 18 bp, Homo sapiens
tattactgtctggtttta

SEQ ID NO: 356435 - DNA, 14 bp, Homo sapiens
tattactgtcttta

SEQ ID NO: 356436 - DNA, 22 bp, Homo sapiens
tattactgtctttattcttatt

SEQ ID NO: 356437 - DNA, 13 bp, Homo sapiens
tattactgttctt

SEQ ID NO: 356438 - DNA, 20 bp, Homo sapiens
tattactgttgcatttactt

SEQ ID NO: 356439 - DNA, 22 bp, Homo sapiens
tattagctgtaaatacatgtgt

SEQ ID NO: 356440 - DNA, 22 bp, Homo sapiens
tattaggctataagaagtagca

SEQ ID NO: 356441 - DNA, 16 bp, Homo sapiens
tattagtggaaagtga

SEQ ID NO: 356442 - DNA, 13 bp, Homo sapiens
tattagttaatat

SEQ ID NO: 356443 - DNA, 20 bp, Homo sapiens
tattataggtaatcaatgaa

SEQ ID NO: 356444 - DNA, 13 bp, Homo sapiens
tattatctttgta

SEQ ID NO: 356445 - DNA, 19 bp, Homo sapiens
tattatgatctctgctttg

SEQ ID NO: 356446 - DNA, 14 bp, Homo sapiens
tattatgcaaagta

SEQ ID NO: 356447 - DNA, 20 bp, Homo sapiens
tattatgtccattattcaag

SEQ ID NO: 356448 - DNA, 22 bp, Homo sapiens
tattatgtggcttttatttcag

SEQ ID NO: 356449 - DNA, 12 bp, Homo sapiens
tattatgtgttt

SEQ ID NO: 356450 - DNA, 13 bp, Homo sapiens
tattatgtttcct

SEQ ID NO: 356451 - DNA, 17 bp, Homo sapiens
tattattactgttctta

SEQ ID NO: 356452 - DNA, 15 bp, Homo sapiens
tattattattactgt

SEQ ID NO: 356453 - DNA, 19 bp, Homo sapiens
tattattcaccatgtaaaa

SEQ ID NO: 356454 - DNA, 14 bp, Homo sapiens
tattattgaagatt

SEQ ID NO: 356455 - DNA, 13 bp, Homo sapiens
tattatttatata

SEQ ID NO: 356456 - DNA, 23 bp, Homo sapiens
tattatttctccatcccctccct

SEQ ID NO: 356457 - DNA, 14 bp, Homo sapiens
tattatttggagtt

SEQ ID NO: 356458 - DNA, 15 bp, Homo sapiens
tattatttggagtta

SEQ ID NO: 356459 - DNA, 17 bp, Homo sapiens
tattatttggagttagg

SEQ ID NO: 356460 - DNA, 15 bp, Homo sapiens
tattcaaacacacag

SEQ ID NO: 356461 - DNA, 21 bp, Homo sapiens
tattcaagaaagatatctatg

SEQ ID NO: 356462 - DNA, 20 bp, Homo sapiens
tattcaagttattgtacagc

SEQ ID NO: 356463 - DNA, 11 bp, Homo sapiens
tattcaataaa

SEQ ID NO: 356464 - DNA, 12 bp, Homo sapiens
tattcaataaag

SEQ ID NO: 356465 - DNA, 13 bp, Homo sapiens
tattcaataaagc

SEQ ID NO: 356466 - DNA, 14 bp, Homo sapiens
tattcaataaagct

SEQ ID NO: 356467 - DNA, 12 bp, Homo sapiens
tattcacacaca

SEQ ID NO: 356468 - DNA, 14 bp, Homo sapiens
aaaaccattgcttc

SEQ ID NO: 356469 - DNA, 22 bp, Homo sapiens
aaaacccaccttgttggagcct

SEQ ID NO: 356470 - DNA, 12 bp, Homo sapiens
aaaacccatcgt

SEQ ID NO: 356471 - DNA, 21 bp, Homo sapiens
aaaacccatcgtggtatgtga

SEQ ID NO: 356472 - DNA, 23 bp, Homo sapiens
aaaaccttagctccctcccgcac

SEQ ID NO: 356473 - DNA, 17 bp, Homo sapiens
aaaacgatttaatttat

SEQ ID NO: 356474 - DNA, 16 bp, Homo sapiens
aaaacggccctcttga

SEQ ID NO: 356475 - DNA, 15 bp, Homo sapiens
aaaacgttttattgt

SEQ ID NO: 356476 - DNA, 16 bp, Homo sapiens
aaaacgttttattgtg

SEQ ID NO: 356477 - DNA, 15 bp, Homo sapiens
aaaactaaaattcaa

SEQ ID NO: 356478 - DNA, 19 bp, Homo sapiens
aaaactatcggttcaagtt

SEQ ID NO: 356479 - DNA, 12 bp, Homo sapiens
aaaactatggtt

SEQ ID NO: 356480 - DNA, 17 bp, Homo sapiens
aaaactatttaaaattg

SEQ ID NO: 356481 - DNA, 19 bp, Homo sapiens
aaaactatttaaaattggc

SEQ ID NO: 356482 - DNA, 18 bp, Homo sapiens
aaaactcagttaaaatgt

SEQ ID NO: 356483 - DNA, 18 bp, Homo sapiens
aaaactcatacaatgata

SEQ ID NO: 356484 - DNA, 22 bp, Homo sapiens
aaaactgaccatcagtatattt

SEQ ID NO: 356485 - DNA, 18 bp, Homo sapiens
aaaactgcacagtgctgt

SEQ ID NO: 356486 - DNA, 12 bp, Homo sapiens
aaaactgtgaca

SEQ ID NO: 356487 - DNA, 22 bp, Homo sapiens
aaaactgtgacattccacagag

SEQ ID NO: 356488 - DNA, 17 bp, Homo sapiens
aaaacttaacatattta

SEQ ID NO: 356489 - DNA, 19 bp, Homo sapiens
aaaacttaacatatttact

SEQ ID NO: 356490 - DNA, 17 bp, Homo sapiens
aaaacttagtttgtgaa

SEQ ID NO: 356491 - DNA, 11 bp, Homo sapiens
aaaacttattt

SEQ ID NO: 356492 - DNA, 11 bp, Homo sapiens
aaaacttcaaa

SEQ ID NO: 356493 - DNA, 22 bp, Homo sapiens
aaaacttcaaagctgaatattt

SEQ ID NO: 356494 - DNA, 21 bp, Homo sapiens
aaaacttcattctaaaccaaa

SEQ ID NO: 356495 - DNA, 17 bp, Homo sapiens
aaaacttctcttctgag

SEQ ID NO: 356496 - DNA, 22 bp, Homo sapiens
aaaacttgcacttgtttttctt

SEQ ID NO: 356497 - DNA, 15 bp, Homo sapiens
aaaactttattttat

SEQ ID NO: 356498 - DNA, 23 bp, Homo sapiens
aaaactttattttatataataaa

SEQ ID NO: 356499 - DNA, 21 bp, Homo sapiens
aaaactttccatgacagtagc

SEQ ID NO: 356500 - DNA, 20 bp, Homo sapiens
aaaactttcctcgcctgaca

SEQ ID NO: 356501 - DNA, 24 bp, Homo sapiens
aaaactttgacgagtcaccttcca

SEQ ID NO: 356502 - DNA, 18 bp, Homo sapiens
aaaacttttataaattaa

SEQ ID NO: 356503 - DNA, 18 bp, Homo sapiens
aaaagaaaccgtaatttt

SEQ ID NO: 356504 - DNA, 15 bp, Homo sapiens
aaaagaaatcaattt

SEQ ID NO: 356505 - DNA, 13 bp, Homo sapiens
aaaagaagactgg

SEQ ID NO: 356506 - DNA, 15 bp, Homo sapiens
aaaagaagagtttta

SEQ ID NO: 356507 - DNA, 19 bp, Homo sapiens
aaaagaatccctgttcatt

SEQ ID NO: 356508 - DNA, 21 bp, Homo sapiens
aaaagaatctgcatttagcac

SEQ ID NO: 356509 - DNA, 20 bp, Homo sapiens
aaaagagaattacttatatt

SEQ ID NO: 356510 - DNA, 14 bp, Homo sapiens
aaaagagaattaga

SEQ ID NO: 356511 - DNA, 18 bp, Homo sapiens
aaaagagaattagattat

SEQ ID NO: 356512 - DNA, 21 bp, Homo sapiens
aaaagagagaaaacttatttg

SEQ ID NO: 356513 - DNA, 19 bp, Homo sapiens
aaaagaggaaattaaataa

SEQ ID NO: 356514 - DNA, 16 bp, Homo sapiens
aaaagatacatttgta

SEQ ID NO: 356515 - DNA, 20 bp, Homo sapiens
aaaagatacgactttatttt

SEQ ID NO: 356516 - DNA, 18 bp, Homo sapiens
aaaagatggcctttgctt

SEQ ID NO: 356517 - DNA, 13 bp, Homo sapiens
aaaagatttaagc

SEQ ID NO: 356518 - DNA, 14 bp, Homo sapiens
aaaagcaagactgt

SEQ ID NO: 356519 - DNA, 13 bp, Homo sapiens
aaaagcacaaacc

SEQ ID NO: 356520 - DNA, 12 bp, Homo sapiens
aaaagcacagct

SEQ ID NO: 356521 - DNA, 11 bp, Homo sapiens
aaaagcacctc

SEQ ID NO: 356522 - DNA, 21 bp, Homo sapiens
aaaagcccacctgaaagcctg

SEQ ID NO: 356523 - DNA, 13 bp, Homo sapiens
aaaagctgtgtct

SEQ ID NO: 356524 - DNA, 16 bp, Homo sapiens
aaaagctttaaaaaat

SEQ ID NO: 356525 - DNA, 20 bp, Homo sapiens
aaaaggaaaactcaccattt

SEQ ID NO: 356526 - DNA, 16 bp, Homo sapiens
aaaaggagcgggcagg

SEQ ID NO: 356527 - DNA, 17 bp, Homo sapiens
aaaaggagcgggcaggg

SEQ ID NO: 356528 - DNA, 23 bp, Homo sapiens
aaaaggagctcttcttgtgaaat

SEQ ID NO: 356529 - DNA, 18 bp, Homo sapiens
aaaaggcctttgggattt

SEQ ID NO: 356530 - DNA, 19 bp, Homo sapiens
aaaaggcctttgggatttg

SEQ ID NO: 356531 - DNA, 13 bp, Homo sapiens
aaaagggacagca

SEQ ID NO: 356532 - DNA, 23 bp, Homo sapiens
aaaagggacagtattctcagtgc

SEQ ID NO: 356533 - DNA, 23 bp, Homo sapiens
aaaagggcagggcatctcctgtg

SEQ ID NO: 356534 - DNA, 13 bp, Homo sapiens
aaaaggtgaccct

SEQ ID NO: 356535 - DNA, 17 bp, Homo sapiens
aaaaggttaacagtaaa

SEQ ID NO: 356536 - DNA, 19 bp, Homo sapiens
aaaaggttcactaaagcag

SEQ ID NO: 356537 - DNA, 19 bp, Homo sapiens
aaaaggttcttactgcttg

SEQ ID NO: 356538 - DNA, 20 bp, Homo sapiens
aaaaggttgcctgaaaaatg

SEQ ID NO: 356539 - DNA, 23 bp, Homo sapiens
aaaagtaaaacagatttgttcat

SEQ ID NO: 356540 - DNA, 20 bp, Homo sapiens
aaaagtatacttttgtttca

SEQ ID NO: 356541 - DNA, 14 bp, Homo sapiens
aaaagtatatgtta

SEQ ID NO: 356542 - DNA, 17 bp, Homo sapiens
aaaagtccttagaatga

SEQ ID NO: 356543 - DNA, 17 bp, Homo sapiens
aaaagtctgcattacat

SEQ ID NO: 356544 - DNA, 18 bp, Homo sapiens
aaaagtctgcattacatt

SEQ ID NO: 356545 - DNA, 19 bp, Homo sapiens
aaaagtcttaacaacagct

SEQ ID NO: 356546 - DNA, 17 bp, Homo sapiens
aaaagtgacacagcagc

SEQ ID NO: 356547 - DNA, 21 bp, Homo sapiens
aaaagtgatcaataaaatgtg

SEQ ID NO: 356548 - DNA, 17 bp, Homo sapiens
aaaagtgatgtgattta

SEQ ID NO: 356549 - DNA, 22 bp, Homo sapiens
aaaagtgatgtgatttatgcat

SEQ ID NO: 356550 - DNA, 16 bp, Homo sapiens
aaaagttaaaaaaaat

SEQ ID NO: 356551 - DNA, 12 bp, Homo sapiens
aaaagttataac

SEQ ID NO: 356552 - DNA, 23 bp, Homo sapiens
aaaagtttacaacataatctagt

SEQ ID NO: 356553 - DNA, 13 bp, Homo sapiens
aaaagtttcaatg

SEQ ID NO: 356554 - DNA, 18 bp, Homo sapiens
aaaagtttcaatgtgatt

SEQ ID NO: 356555 - DNA, 12 bp, Homo sapiens
aaaagtttgtcc

SEQ ID NO: 356556 - DNA, 21 bp, Homo sapiens
aaaataaaaagtgacacagca

SEQ ID NO: 356557 - DNA, 12 bp, Homo sapiens
aaaataaaataa

SEQ ID NO: 356558 - DNA, 11 bp, Homo sapiens
aaaataaaatg

SEQ ID NO: 356559 - DNA, 16 bp, Homo sapiens
aaaataaaattatggt

SEQ ID NO: 356560 - DNA, 23 bp, Homo sapiens
aaaataaacgaaacatttagaca

SEQ ID NO: 356561 - DNA, 10 bp, Homo sapiens
aaaataaata

SEQ ID NO: 356562 - DNA, 11 bp, Homo sapiens
aaaataaatat

SEQ ID NO: 356563 - DNA, 20 bp, Homo sapiens
aaaataaatatactaataaa

SEQ ID NO: 356564 - DNA, 22 bp, Homo sapiens
aaaataaatatactaataaaaa

SEQ ID NO: 356565 - DNA, 12 bp, Homo sapiens
aaaataaattta

SEQ ID NO: 356566 - DNA, 13 bp, Homo sapiens
aaaataacatatt

SEQ ID NO: 356567 - DNA, 16 bp, Homo sapiens
aaaataacatctgaaa

SEQ ID NO: 356568 - DNA, 16 bp, Homo sapiens
aaaataactgtgcact

SEQ ID NO: 356569 - DNA, 15 bp, Homo sapiens
aaaataagtaacata

SEQ ID NO: 356570 - DNA, 16 bp, Homo sapiens
aaaataagtaacatat

SEQ ID NO: 356571 - DNA, 17 bp, Homo sapiens
aaaataagtaacatata

SEQ ID NO: 356572 - DNA, 16 bp, Homo sapiens
aaaataagttaaaggc

SEQ ID NO: 356573 - DNA, 12 bp, Homo sapiens
aaaataataatt

SEQ ID NO: 356574 - DNA, 16 bp, Homo sapiens
aaagcgggcagccccg

SEQ ID NO: 356575 - DNA, 16 bp, Homo sapiens
aaagctccatgtttag

SEQ ID NO: 356576 - DNA, 17 bp, Homo sapiens
aaagctcttctttttta

SEQ ID NO: 356577 - DNA, 14 bp, Homo sapiens
aaagctgaatattt

SEQ ID NO: 356578 - DNA, 17 bp, Homo sapiens
aaagctgacgaggctgg

SEQ ID NO: 356579 - DNA, 19 bp, Homo sapiens
aaagctgacgaggctgggc

SEQ ID NO: 356580 - DNA, 23 bp, Homo sapiens
aaagctgatgatgtctcttgtag

SEQ ID NO: 356581 - DNA, 15 bp, Homo sapiens
aaagctgcctgtagt

SEQ ID NO: 356582 - DNA, 15 bp, Homo sapiens
aaagctgtgtctctg

SEQ ID NO: 356583 - DNA, 21 bp, Homo sapiens
aaagctgtgtctctgtatata

SEQ ID NO: 356584 - DNA, 19 bp, Homo sapiens
aaagcttctatcccaggag

SEQ ID NO: 356585 - DNA, 19 bp, Homo sapiens
aaagcttgcaacaaaattc

SEQ ID NO: 356586 - DNA, 12 bp, Homo sapiens
aaagctttcctg

SEQ ID NO: 356587 - DNA, 14 bp, Homo sapiens
aaagctttcctgga

SEQ ID NO: 356588 - DNA, 13 bp, Homo sapiens
aaaggaaaaacag

SEQ ID NO: 356589 - DNA, 22 bp, Homo sapiens
aaaggaaattggacagttttga

SEQ ID NO: 356590 - DNA, 19 bp, Homo sapiens
aaaggaacacccggaaaga

SEQ ID NO: 356591 - DNA, 13 bp, Homo sapiens
aaaggaagactag

SEQ ID NO: 356592 - DNA, 13 bp, Homo sapiens
aaaggaagctttc

SEQ ID NO: 356593 - DNA, 22 bp, Homo sapiens
aaaggaagctttctctgcttca

SEQ ID NO: 356594 - DNA, 19 bp, Homo sapiens
aaaggaagtagcaggccca

SEQ ID NO: 356595 - DNA, 14 bp, Homo sapiens
aaaggaatgcaaga

SEQ ID NO: 356596 - DNA, 17 bp, Homo sapiens
aaaggaatgcaagagaa

SEQ ID NO: 356597 - DNA, 22 bp, Homo sapiens
aaaggacaccttttaactcacc

SEQ ID NO: 356598 - DNA, 15 bp, Homo sapiens
aaaggacaggaggag

SEQ ID NO: 356599 - DNA, 15 bp, Homo sapiens
aaaggacccacccat

SEQ ID NO: 356600 - DNA, 21 bp, Homo sapiens
aaaggagcttacctcccacct

SEQ ID NO: 356601 - DNA, 19 bp, Homo sapiens
aaaggagtgcatggccaca

SEQ ID NO: 356602 - DNA, 13 bp, Homo sapiens
aaaggatatttaa

SEQ ID NO: 356603 - DNA, 23 bp, Homo sapiens
aaaggatatttaagaaaatacaa

SEQ ID NO: 356604 - DNA, 15 bp, Homo sapiens
aaaggatgaagaaca

SEQ ID NO: 356605 - DNA, 17 bp, Homo sapiens
aaaggattttggaaaag

SEQ ID NO: 356606 - DNA, 17 bp, Homo sapiens
aaaggcaccatctaata

SEQ ID NO: 356607 - DNA, 15 bp, Homo sapiens
aaaggcagagattgg

SEQ ID NO: 356608 - DNA, 23 bp, Homo sapiens
aaaggcagctcacccctgggcag

SEQ ID NO: 356609 - DNA, 17 bp, Homo sapiens
aaaggcagtccagagct

SEQ ID NO: 356610 - DNA, 19 bp, Homo sapiens
aaaggcagtggggctgggg

SEQ ID NO: 356611 - DNA, 14 bp, Homo sapiens
aaaggcctcttcct

SEQ ID NO: 356612 - DNA, 12 bp, Homo sapiens
aaaggcctggaa

SEQ ID NO: 356613 - DNA, 17 bp, Homo sapiens
aaaggccttaacaaacg

SEQ ID NO: 356614 - DNA, 12 bp, Homo sapiens
aaaggcctttgg

SEQ ID NO: 356615 - DNA, 17 bp, Homo sapiens
aaaggctgaacataaat

SEQ ID NO: 356616 - DNA, 13 bp, Homo sapiens
aaaggctgtggta

SEQ ID NO: 356617 - DNA, 22 bp, Homo sapiens
aaaggctttggcaacagaaaac

SEQ ID NO: 356618 - DNA, 18 bp, Homo sapiens
aaagggaagttgtgcctt

SEQ ID NO: 356619 - DNA, 16 bp, Homo sapiens
aaagggacagcatgcc

SEQ ID NO: 356620 - DNA, 22 bp, Homo sapiens
aaagggagcagagaaggccagg

SEQ ID NO: 356621 - DNA, 13 bp, Homo sapiens
aaagggagcccct

SEQ ID NO: 356622 - DNA, 20 bp, Homo sapiens
aaagggcagggcatctcctg

SEQ ID NO: 356623 - DNA, 17 bp, Homo sapiens
aaagggctatggcaagg

SEQ ID NO: 356624 - DNA, 22 bp, Homo sapiens
aaaggggagaaactgaaagtgt

SEQ ID NO: 356625 - DNA, 19 bp, Homo sapiens
aaaggggcgagcacccacg

SEQ ID NO: 356626 - DNA, 14 bp, Homo sapiens
aaaggggctgctgg

SEQ ID NO: 356627 - DNA, 23 bp, Homo sapiens
aaagggtagcctggcttttctgg

SEQ ID NO: 356628 - DNA, 14 bp, Homo sapiens
aaaggtaaatacaa

SEQ ID NO: 356629 - DNA, 15 bp, Homo sapiens
aaaggtaatctgaaa

SEQ ID NO: 356630 - DNA, 16 bp, Homo sapiens
aaaggtgctcaaagat

SEQ ID NO: 356631 - DNA, 19 bp, Homo sapiens
aaaggtgctcaaagatgta

SEQ ID NO: 356632 - DNA, 23 bp, Homo sapiens
aaaggtgctcaaagatgtactga

SEQ ID NO: 356633 - DNA, 16 bp, Homo sapiens
aaaggttaacagtaaa

SEQ ID NO: 356634 - DNA, 17 bp, Homo sapiens
aaaggttcactaaagca

SEQ ID NO: 356635 - DNA, 13 bp, Homo sapiens
aaagtaaaaagaa

SEQ ID NO: 356636 - DNA, 15 bp, Homo sapiens
aaagtaaaaagaaca

SEQ ID NO: 356637 - DNA, 16 bp, Homo sapiens
aaagtaaaaagaacaa

SEQ ID NO: 356638 - DNA, 22 bp, Homo sapiens
aaagtaaaacagatttgttcat

SEQ ID NO: 356639 - DNA, 16 bp, Homo sapiens
aaagtaaatgctacct

SEQ ID NO: 356640 - DNA, 17 bp, Homo sapiens
aaagtacatagtgaatt

SEQ ID NO: 356641 - DNA, 20 bp, Homo sapiens
aaagtacatagtgaatttta

SEQ ID NO: 356642 - DNA, 13 bp, Homo sapiens
aaagtacatttaa

SEQ ID NO: 356643 - DNA, 14 bp, Homo sapiens
aaagtacatttaat

SEQ ID NO: 356644 - DNA, 17 bp, Homo sapiens
aaagtacgtgtttactt

SEQ ID NO: 356645 - DNA, 13 bp, Homo sapiens
aaagtagagaagt

SEQ ID NO: 356646 - DNA, 19 bp, Homo sapiens
aaagtagagaagtatccaa

SEQ ID NO: 356647 - DNA, 22 bp, Homo sapiens
aaagtagcagtcatcatctttt

SEQ ID NO: 356648 - DNA, 16 bp, Homo sapiens
aaagtaggtatacaaa

SEQ ID NO: 356649 - DNA, 16 bp, Homo sapiens
aaagtatacttttgtt

SEQ ID NO: 356650 - DNA, 18 bp, Homo sapiens
aaagtatatatagaatct

SEQ ID NO: 356651 - DNA, 14 bp, Homo sapiens
aaagtatcatgcat

SEQ ID NO: 356652 - DNA, 19 bp, Homo sapiens
aaagtatgtaaagtatgta

SEQ ID NO: 356653 - DNA, 20 bp, Homo sapiens
aaagtatgtaaagtatgtaa

SEQ ID NO: 356654 - DNA, 20 bp, Homo sapiens
aaagtatgtttttaaatttt

SEQ ID NO: 356655 - DNA, 18 bp, Homo sapiens
aaagtattccaccttaaa

SEQ ID NO: 356656 - DNA, 21 bp, Homo sapiens
aaagtattccaccttaaatta

SEQ ID NO: 356657 - DNA, 14 bp, Homo sapiens
aaagtcctgtcacc

SEQ ID NO: 356658 - DNA, 22 bp, Homo sapiens
aaagtctaaagtttacagtaaa

SEQ ID NO: 356659 - DNA, 14 bp, Homo sapiens
aaagtctatgctta

SEQ ID NO: 356660 - DNA, 19 bp, Homo sapiens
aaagtctatttttttaact

SEQ ID NO: 356661 - DNA, 17 bp, Homo sapiens
aaagtctgtctgcactg

SEQ ID NO: 356662 - DNA, 15 bp, Homo sapiens
aaagtcttgtgacta

SEQ ID NO: 356663 - DNA, 21 bp, Homo sapiens
aaagtcttgtgactagtgctg

SEQ ID NO: 356664 - DNA, 23 bp, Homo sapiens
aaagtgaagcaaatcagaaactt

SEQ ID NO: 356665 - DNA, 12 bp, Homo sapiens
aaagtgaatttg

SEQ ID NO: 356666 - DNA, 15 bp, Homo sapiens
aaagtgaatttgaat

SEQ ID NO: 356667 - DNA, 23 bp, Homo sapiens
aaagtgacatgaaaattacaaca

SEQ ID NO: 356668 - DNA, 23 bp, Homo sapiens
aaagtgaccaggctcacaactgt

SEQ ID NO: 356669 - DNA, 20 bp, Homo sapiens
aaagtgactgtttggcttat

SEQ ID NO: 356670 - DNA, 20 bp, Homo sapiens
aaagtgagatgggaagggct

SEQ ID NO: 356671 - DNA, 19 bp, Homo sapiens
aaagtgagcatgctttctg

SEQ ID NO: 356672 - DNA, 23 bp, Homo sapiens
aaagtgatcaataaaatgtgatt

SEQ ID NO: 356673 - DNA, 16 bp, Homo sapiens
aaagtgcaattgcaca

SEQ ID NO: 356674 - DNA, 20 bp, Homo sapiens
aaatgcatgatattgtatgt

SEQ ID NO: 356675 - DNA, 11 bp, Homo sapiens
aaatgcattca

SEQ ID NO: 356676 - DNA, 18 bp, Homo sapiens
aaatgcattcatgtttta

SEQ ID NO: 356677 - DNA, 14 bp, Homo sapiens
aaatgccaatctct

SEQ ID NO: 356678 - DNA, 22 bp, Homo sapiens
aaatgccacattttgctttata

SEQ ID NO: 356679 - DNA, 23 bp, Homo sapiens
aaatgccacgtgccattgtcttt

SEQ ID NO: 356680 - DNA, 18 bp, Homo sapiens
aaatgctacctctgatca

SEQ ID NO: 356681 - DNA, 15 bp, Homo sapiens
aaatgctactcagta

SEQ ID NO: 356682 - DNA, 20 bp, Homo sapiens
aaatgctaggttaattccaa

SEQ ID NO: 356683 - DNA, 17 bp, Homo sapiens
aaatggaagtggcaata

SEQ ID NO: 356684 - DNA, 16 bp, Homo sapiens
aaatggaattattttg

SEQ ID NO: 356685 - DNA, 16 bp, Homo sapiens
aaatggacactgtgcc

SEQ ID NO: 356686 - DNA, 15 bp, Homo sapiens
aaatggacgtgttat

SEQ ID NO: 356687 - DNA, 20 bp, Homo sapiens
aaatggagcttgtacatatt

SEQ ID NO: 356688 - DNA, 22 bp, Homo sapiens
aaatggaggtccttctgctgga

SEQ ID NO: 356689 - DNA, 13 bp, Homo sapiens
aaatggatgtaat

SEQ ID NO: 356690 - DNA, 18 bp, Homo sapiens
aaatggatgtaatatagg

SEQ ID NO: 356691 - DNA, 17 bp, Homo sapiens
aaatggctggtttttag

SEQ ID NO: 356692 - DNA, 14 bp, Homo sapiens
aaatggctttccac

SEQ ID NO: 356693 - DNA, 16 bp, Homo sapiens
aaatgggactgatgtc

SEQ ID NO: 356694 - DNA, 22 bp, Homo sapiens
aaatgggggcggctggaaagag

SEQ ID NO: 356695 - DNA, 22 bp, Homo sapiens
aaatggggtttgggcccctcag

SEQ ID NO: 356696 - DNA, 20 bp, Homo sapiens
aaatgggtgaaaaatggtaa

SEQ ID NO: 356697 - DNA, 14 bp, Homo sapiens
aaatggtaatataa

SEQ ID NO: 356698 - DNA, 19 bp, Homo sapiens
aaatgtaaaaataataatt

SEQ ID NO: 356699 - DNA, 15 bp, Homo sapiens
aaatgtaaaaatgaa

SEQ ID NO: 356700 - DNA, 16 bp, Homo sapiens
aaatgtaaaaatgaag

SEQ ID NO: 356701 - DNA, 21 bp, Homo sapiens
aaatgtaaaaatgaaggaatt

SEQ ID NO: 356702 - DNA, 18 bp, Homo sapiens
aaatgtaaactcttcacc

SEQ ID NO: 356703 - DNA, 15 bp, Homo sapiens
aaatgtaaatattct

SEQ ID NO: 356704 - DNA, 17 bp, Homo sapiens
aaatgtaaatattctat

SEQ ID NO: 356705 - DNA, 17 bp, Homo sapiens
aaatgtaaatttataaa

SEQ ID NO: 356706 - DNA, 22 bp, Homo sapiens
aaatgtaagatcgttctctgcc

SEQ ID NO: 356707 - DNA, 16 bp, Homo sapiens
aaatgtacctgatgta

SEQ ID NO: 356708 - DNA, 19 bp, Homo sapiens
aaatgtactacatttgcat

SEQ ID NO: 356709 - DNA, 20 bp, Homo sapiens
aaatgtactacatttgcatg

SEQ ID NO: 356710 - DNA, 16 bp, Homo sapiens
aaatgtaggtatgaat

SEQ ID NO: 356711 - DNA, 14 bp, Homo sapiens
aaatgtattcaaat

SEQ ID NO: 356712 - DNA, 15 bp, Homo sapiens
aacaggaggaactgg

SEQ ID NO: 356713 - DNA, 18 bp, Homo sapiens
aacaggaggaactggtcc

SEQ ID NO: 356714 - DNA, 20 bp, Homo sapiens
aacaggaggaactggtccag

SEQ ID NO: 356715 - DNA, 19 bp, Homo sapiens
aacaggattagacagtcaa

SEQ ID NO: 356716 - DNA, 20 bp, Homo sapiens
aacaggctcaatattcctga

SEQ ID NO: 356717 - DNA, 16 bp, Homo sapiens
aacagggcccaggcct

SEQ ID NO: 356718 - DNA, 18 bp, Homo sapiens
aacagggggaaaatgttt

SEQ ID NO: 356719 - DNA, 23 bp, Homo sapiens
aacaggttgaggctaaaacaaat

SEQ ID NO: 356720 - DNA, 14 bp, Homo sapiens
aacagtaaatgtgc

SEQ ID NO: 356721 - DNA, 14 bp, Homo sapiens
aacagtacattttt

SEQ ID NO: 356722 - DNA, 19 bp, Homo sapiens
aacagtcacccttctgggc

SEQ ID NO: 356723 - DNA, 15 bp, Homo sapiens
aacagtggaatataa

SEQ ID NO: 356724 - DNA, 17 bp, Homo sapiens
aacagtggctgggtggg

SEQ ID NO: 356725 - DNA, 19 bp, Homo sapiens
aacagtggctgggtgggcc

SEQ ID NO: 356726 - DNA, 20 bp, Homo sapiens
aacagtgggagccctgacct

SEQ ID NO: 356727 - DNA, 21 bp, Homo sapiens
aacagtgtggatgtaaatttt

SEQ ID NO: 356728 - DNA, 12 bp, Homo sapiens
aacagtgtggct

SEQ ID NO: 356729 - DNA, 21 bp, Homo sapiens
aacagtgtggcttaaacattt

SEQ ID NO: 356730 - DNA, 22 bp, Homo sapiens
aacagtgtggcttaaacatttt

SEQ ID NO: 356731 - DNA, 13 bp, Homo sapiens
aacagtgtttccc

SEQ ID NO: 356732 - DNA, 19 bp, Homo sapiens
aacagtgtttcccataatt

SEQ ID NO: 356733 - DNA, 21 bp, Homo sapiens
aacagtgtttcccataatttt

SEQ ID NO: 356734 - DNA, 18 bp, Homo sapiens
aacagttaactttcagaa

SEQ ID NO: 356735 - DNA, 17 bp, Homo sapiens
aacagttggtgatttta

SEQ ID NO: 356736 - DNA, 23 bp, Homo sapiens
aacagtttatgcagtgctgcttt

SEQ ID NO: 356737 - DNA, 19 bp, Homo sapiens
aacagttttccatgaaaac

SEQ ID NO: 356738 - DNA, 14 bp, Homo sapiens
aacataaaatctgt

SEQ ID NO: 356739 - DNA, 16 bp, Homo sapiens
aacataaaatctgtga

SEQ ID NO: 356740 - DNA, 16 bp, Homo sapiens
aacataaaatgaggca

SEQ ID NO: 356741 - DNA, 18 bp, Homo sapiens
aacataaaatgaggcagt

SEQ ID NO: 356742 - DNA, 12 bp, Homo sapiens
aacataactgta

SEQ ID NO: 356743 - DNA, 15 bp, Homo sapiens
aacataactgtaaca

SEQ ID NO: 356744 - DNA, 16 bp, Homo sapiens
aacataatatcttgaa

SEQ ID NO: 356745 - DNA, 12 bp, Homo sapiens
aacatacatcta

SEQ ID NO: 356746 - DNA, 23 bp, Homo sapiens
aacatacatctaagtcagtttca

SEQ ID NO: 356747 - DNA, 15 bp, Homo sapiens
aacatataaattaat

SEQ ID NO: 356748 - DNA, 21 bp, Homo sapiens
aacatatgtacataaattgca

SEQ ID NO: 356749 - DNA, 22 bp, Homo sapiens
aacatattcttgctttcacaaa

SEQ ID NO: 356750 - DNA, 12 bp, Homo sapiens
aacatcaaataa

SEQ ID NO: 356751 - DNA, 14 bp, Homo sapiens
aacatcaacatctt

SEQ ID NO: 356752 - DNA, 17 bp, Homo sapiens
aacatcagacctgtctt

SEQ ID NO: 356753 - DNA, 23 bp, Homo sapiens
aacatcatcaggcttggaatgaa

SEQ ID NO: 356754 - DNA, 19 bp, Homo sapiens
aacatcccaataaagtcct

SEQ ID NO: 356755 - DNA, 14 bp, Homo sapiens
aacatctcgagccc

SEQ ID NO: 356756 - DNA, 18 bp, Homo sapiens
aacatctctttcatctag

SEQ ID NO: 356757 - DNA, 16 bp, Homo sapiens
aacatctgaaaagaaa

SEQ ID NO: 356758 - DNA, 14 bp, Homo sapiens
aacatcttcatata

SEQ ID NO: 356759 - DNA, 21 bp, Homo sapiens
aacatctttttaacctgcaaa

SEQ ID NO: 356760 - DNA, 23 bp, Homo sapiens
aacatgaaaaacacggcagctgt

SEQ ID NO: 356761 - DNA, 20 bp, Homo sapiens
aacatgaatttaatgtctag

SEQ ID NO: 356762 - DNA, 13 bp, Homo sapiens
aacatgcagctct

SEQ ID NO: 356763 - DNA, 18 bp, Homo sapiens
aacatgcagctctgcagc

SEQ ID NO: 356764 - DNA, 16 bp, Homo sapiens
aacatgcagttcatta

SEQ ID NO: 356765 - DNA, 18 bp, Homo sapiens
aacatgcagttcattatt

SEQ ID NO: 356766 - DNA, 17 bp, Homo sapiens
aacatggattccaaagc

SEQ ID NO: 356767 - DNA, 20 bp, Homo sapiens
aacatggattccaaagcatt

SEQ ID NO: 356768 - DNA, 15 bp, Homo sapiens
aacatggcatgtgaa

SEQ ID NO: 356769 - DNA, 17 bp, Homo sapiens
aacatggcatgtgaaaa

SEQ ID NO: 356770 - DNA, 12 bp, Homo sapiens
aacatggccaca

SEQ ID NO: 356771 - DNA, 22 bp, Homo sapiens
aacatggcctttgcttgaaaga

SEQ ID NO: 356772 - DNA, 15 bp, Homo sapiens
aacatgggcattggg

SEQ ID NO: 356773 - DNA, 17 bp, Homo sapiens
aacatggtgtgtgtctc

SEQ ID NO: 356774 - DNA, 16 bp, Homo sapiens
aacatgttactgacca

SEQ ID NO: 356775 - DNA, 13 bp, Homo sapiens
aacatgttcctga

SEQ ID NO: 356776 - DNA, 21 bp, Homo sapiens
aacattaaaagaagactggaa

SEQ ID NO: 356777 - DNA, 16 bp, Homo sapiens
aacattaaacactgta

SEQ ID NO: 356778 - DNA, 18 bp, Homo sapiens
aacattagaagaaaacat

SEQ ID NO: 356779 - DNA, 19 bp, Homo sapiens
aacattagaagaaaacata

SEQ ID NO: 356780 - DNA, 23 bp, Homo sapiens
aacattattcctgcactcacagg

SEQ ID NO: 356781 - DNA, 21 bp, Homo sapiens
aacattcaaaaacatggccac

SEQ ID NO: 356782 - DNA, 17 bp, Homo sapiens
aacattcaaaagcacaa

SEQ ID NO: 356783 - DNA, 19 bp, Homo sapiens
aacattcagatttaccata

SEQ ID NO: 356784 - DNA, 18 bp, Homo sapiens
aacattcatcaagctgta

SEQ ID NO: 356785 - DNA, 19 bp, Homo sapiens
aacattccgtttacatttt

SEQ ID NO: 356786 - DNA, 22 bp, Homo sapiens
aacattccgtttacattttaga

SEQ ID NO: 356787 - DNA, 16 bp, Homo sapiens
aacattcctccagcct

SEQ ID NO: 356788 - DNA, 20 bp, Homo sapiens
aacattcctccagcctcccc

SEQ ID NO: 356789 - DNA, 22 bp, Homo sapiens
aacattcctccagcctcccctc

SEQ ID NO: 356790 - DNA, 15 bp, Homo sapiens
aacattctatttcaa

SEQ ID NO: 356791 - DNA, 18 bp, Homo sapiens
aacattctttaacataca

SEQ ID NO: 356792 - DNA, 18 bp, Homo sapiens
aacattgaccaagaactg

SEQ ID NO: 356793 - DNA, 18 bp, Homo sapiens
aacattgatgaatgagga

SEQ ID NO: 356794 - DNA, 16 bp, Homo sapiens
aacattgcatgtattt

SEQ ID NO: 356795 - DNA, 22 bp, Homo sapiens
aacattgcatgtatttaagaaa

SEQ ID NO: 356796 - DNA, 19 bp, Homo sapiens
aacattgccttgcatttgt

SEQ ID NO: 356797 - DNA, 15 bp, Homo sapiens
aacattgctgatttt

SEQ ID NO: 356798 - DNA, 14 bp, Homo sapiens
aacatttagacaat

SEQ ID NO: 356799 - DNA, 19 bp, Homo sapiens
aacatttaggagaagttgg

SEQ ID NO: 356800 - DNA, 20 bp, Homo sapiens
aacatttctaactaaggaca

SEQ ID NO: 356801 - DNA, 16 bp, Homo sapiens
aacatttctcatgtgc

SEQ ID NO: 356802 - DNA, 23 bp, Homo sapiens
aacatttctcatgtgctttgtag

SEQ ID NO: 356803 - DNA, 17 bp, Homo sapiens
aacatttgacacataaa

SEQ ID NO: 356804 - DNA, 16 bp, Homo sapiens
aacatttgatgtctag

SEQ ID NO: 356805 - DNA, 17 bp, Homo sapiens
aacctgacgtagctgca

SEQ ID NO: 356806 - DNA, 18 bp, Homo sapiens
aacctgatgccccttccc

SEQ ID NO: 356807 - DNA, 17 bp, Homo sapiens
aacctgatgttaaaatt

SEQ ID NO: 356808 - DNA, 18 bp, Homo sapiens
aacctgatgttaaaattc

SEQ ID NO: 356809 - DNA, 13 bp, Homo sapiens
aacctgcatgcag

SEQ ID NO: 356810 - DNA, 15 bp, Homo sapiens
aacctgcatttttaa

SEQ ID NO: 356811 - DNA, 19 bp, Homo sapiens
aacctgccacaatgtgata

SEQ ID NO: 356812 - DNA, 17 bp, Homo sapiens
aacctgccctgcctgag

SEQ ID NO: 356813 - DNA, 11 bp, Homo sapiens
aacctgctctc

SEQ ID NO: 356814 - DNA, 13 bp, Homo sapiens
aacctggtggctg

SEQ ID NO: 356815 - DNA, 15 bp, Homo sapiens
aacctgtaaattatt

SEQ ID NO: 356816 - DNA, 20 bp, Homo sapiens
aacctgtaaattattttaaa

SEQ ID NO: 356817 - DNA, 15 bp, Homo sapiens
aacctgtacttcaag

SEQ ID NO: 356818 - DNA, 16 bp, Homo sapiens
aacctgtggtgtattt

SEQ ID NO: 356819 - DNA, 15 bp, Homo sapiens
aaccttacttaaagc

SEQ ID NO: 356820 - DNA, 16 bp, Homo sapiens
aaccttagctccctcc

SEQ ID NO: 356821 - DNA, 15 bp, Homo sapiens
aaccttattgtacct

SEQ ID NO: 356822 - DNA, 19 bp, Homo sapiens
aaccttattgtacctctct

SEQ ID NO: 356823 - DNA, 20 bp, Homo sapiens
aaccttgacttctgcccaaa

SEQ ID NO: 356824 - DNA, 23 bp, Homo sapiens
aaccttgacttctgcccaaatcc

SEQ ID NO: 356825 - DNA, 13 bp, Homo sapiens
aaccttgtttgtt

SEQ ID NO: 356826 - DNA, 12 bp, Homo sapiens
aacctttgtcaa

SEQ ID NO: 356827 - DNA, 13 bp, Homo sapiens
aacctttgtgtaa

SEQ ID NO: 356828 - DNA, 16 bp, Homo sapiens
aacctttgtgtaataa

SEQ ID NO: 356829 - DNA, 22 bp, Homo sapiens
aaccttttatcaataaagcact

SEQ ID NO: 356830 - DNA, 16 bp, Homo sapiens
aacctttttgtaaata

SEQ ID NO: 356831 - DNA, 15 bp, Homo sapiens
aacctttttttttga

SEQ ID NO: 356832 - DNA, 17 bp, Homo sapiens
aacctttttttttgaaa

SEQ ID NO: 356833 - DNA, 14 bp, Homo sapiens
aacgaaacatttag

SEQ ID NO: 356834 - DNA, 14 bp, Homo sapiens
aacgaaacccactc

SEQ ID NO: 356835 - DNA, 12 bp, Homo sapiens
aacgaagaaaaa

SEQ ID NO: 356836 - DNA, 22 bp, Homo sapiens
aacgaatataagcttaaaataa

SEQ ID NO: 356837 - DNA, 14 bp, Homo sapiens
aacgacaatagctt

SEQ ID NO: 356838 - DNA, 16 bp, Homo sapiens
aacgcagccctgcttt

SEQ ID NO: 356839 - DNA, 13 bp, Homo sapiens
aacgcatggagtg

SEQ ID NO: 356840 - DNA, 18 bp, Homo sapiens
aacgcatggagtgtgtat

SEQ ID NO: 356841 - DNA, 22 bp, Homo sapiens
aacgcatggagtgtgtattgtt

SEQ ID NO: 356842 - DNA, 18 bp, Homo sapiens
aacgcattaagaggttta

SEQ ID NO: 356843 - DNA, 23 bp, Homo sapiens
aacgccagtctcccaggccccct

SEQ ID NO: 356844 - DNA, 15 bp, Homo sapiens
aacgcctgccttctg

SEQ ID NO: 356845 - DNA, 16 bp, Homo sapiens
aacgcgtgtgtgcctg

SEQ ID NO: 356846 - DNA, 12 bp, Homo sapiens
aaaatatttcta

SEQ ID NO: 356847 - DNA, 13 bp, Homo sapiens
aaaatatttctaa

SEQ ID NO: 356848 - DNA, 20 bp, Homo sapiens
aaaatatttctaagcttatt

SEQ ID NO: 356849 - DNA, 21 bp, Homo sapiens
aaaatatttctatgtaaatta

SEQ ID NO: 356850 - DNA, 20 bp, Homo sapiens
aaaatatttttttctagcta

SEQ ID NO: 356851 - DNA, 18 bp, Homo sapiens
aaaatcaaatttttctgg

SEQ ID NO: 356852 - DNA, 16 bp, Homo sapiens
aaaatcactcatataa

SEQ ID NO: 356853 - DNA, 11 bp, Homo sapiens
aaaatcaggat

SEQ ID NO: 356854 - DNA, 18 bp, Homo sapiens
aaaatcagtgatgggagt

SEQ ID NO: 356855 - DNA, 22 bp, Homo sapiens
aaaatcatgcttataagcaaca

SEQ ID NO: 356856 - DNA, 22 bp, Homo sapiens
aaaatcattgattgtcagctac

SEQ ID NO: 356857 - DNA, 23 bp, Homo sapiens
aaaatctgccctcagatgaaaat

SEQ ID NO: 356858 - DNA, 15 bp, Homo sapiens
aaaatctgctaggga

SEQ ID NO: 356859 - DNA, 18 bp, Homo sapiens
aaaatctgtagagcaggg

SEQ ID NO: 356860 - DNA, 18 bp, Homo sapiens
aaaatcttcactgaatat

SEQ ID NO: 356861 - DNA, 19 bp, Homo sapiens
aaaatcttcactgaatatc

SEQ ID NO: 356862 - DNA, 22 bp, Homo sapiens
aaaatcttgtgctagaatactt

SEQ ID NO: 356863 - DNA, 23 bp, Homo sapiens
aaaatctttcagaatacaattca

SEQ ID NO: 356864 - DNA, 13 bp, Homo sapiens
aaaatgagaattt

SEQ ID NO: 356865 - DNA, 23 bp, Homo sapiens
aaaatgagctcgcatttgtcaat

SEQ ID NO: 356866 - DNA, 15 bp, Homo sapiens
aaaatgcaaaataaa

SEQ ID NO: 356867 - DNA, 17 bp, Homo sapiens
aaaatgcccttaaatca

SEQ ID NO: 356868 - DNA, 21 bp, Homo sapiens
aaaatggatgacaaagaaaat

SEQ ID NO: 356869 - DNA, 12 bp, Homo sapiens
aaaatgtaaatt

SEQ ID NO: 356870 - DNA, 10 bp, Homo sapiens
aaaatgtact

SEQ ID NO: 356871 - DNA, 18 bp, Homo sapiens
aaaatgtactgagatttt

SEQ ID NO: 356872 - DNA, 21 bp, Homo sapiens
aaaatgtattcaagcaaacat

SEQ ID NO: 356873 - DNA, 17 bp, Homo sapiens
aaaatgtcctgcctttt

SEQ ID NO: 356874 - DNA, 21 bp, Homo sapiens
aaaatgtctgtagctcctcaa

SEQ ID NO: 356875 - DNA, 14 bp, Homo sapiens
aaaatgtgtgtttt

SEQ ID NO: 356876 - DNA, 13 bp, Homo sapiens
aaaatgttaataa

SEQ ID NO: 356877 - DNA, 23 bp, Homo sapiens
aaaatgttcattctatgacaata

SEQ ID NO: 356878 - DNA, 16 bp, Homo sapiens
aaaatgttggtgcaat

SEQ ID NO: 356879 - DNA, 18 bp, Homo sapiens
aaaatgttggtgcaatta

SEQ ID NO: 356880 - DNA, 23 bp, Homo sapiens
aaaatgtttgccctgttcaaagt

SEQ ID NO: 356881 - DNA, 17 bp, Homo sapiens
aaaattaaggcaactga

SEQ ID NO: 356882 - DNA, 21 bp, Homo sapiens
aaaattaaggcaactgaacaa

SEQ ID NO: 356883 - DNA, 23 bp, Homo sapiens
aaaattagtgagatttgtattta

SEQ ID NO: 356884 - DNA, 16 bp, Homo sapiens
aaaattataaactcta

SEQ ID NO: 356885 - DNA, 16 bp, Homo sapiens
aaaattatagaagttt

SEQ ID NO: 356886 - DNA, 13 bp, Homo sapiens
aaaattatcagtg

SEQ ID NO: 356887 - DNA, 14 bp, Homo sapiens
aaaattatctttaa

SEQ ID NO: 356888 - DNA, 16 bp, Homo sapiens
aaaattatctttaaaa

SEQ ID NO: 356889 - DNA, 14 bp, Homo sapiens
aaaattattaaaaa

SEQ ID NO: 356890 - DNA, 21 bp, Homo sapiens
aaaattattaaaaattataga

SEQ ID NO: 356891 - DNA, 23 bp, Homo sapiens
aaaattattccctgaattgtttg

SEQ ID NO: 356892 - DNA, 17 bp, Homo sapiens
aaaattatttgcctttt

SEQ ID NO: 356893 - DNA, 17 bp, Homo sapiens
aaaattattttaaacaa

SEQ ID NO: 356894 - DNA, 12 bp, Homo sapiens
aaaattctagtc

SEQ ID NO: 356895 - DNA, 12 bp, Homo sapiens
aaaattctcaag

SEQ ID NO: 356896 - DNA, 15 bp, Homo sapiens
aaaattctgaatgta

SEQ ID NO: 356897 - DNA, 18 bp, Homo sapiens
aaaattgcagcagttgct

SEQ ID NO: 356898 - DNA, 19 bp, Homo sapiens
aaaattggcattaaaactt

SEQ ID NO: 356899 - DNA, 13 bp, Homo sapiens
aaaattgtataga

SEQ ID NO: 356900 - DNA, 16 bp, Homo sapiens
aaaattgtatagagat

SEQ ID NO: 356901 - DNA, 16 bp, Homo sapiens
aaaatttaagcattgt

SEQ ID NO: 356902 - DNA, 19 bp, Homo sapiens
aaaatttaagtatcttttt

SEQ ID NO: 356903 - DNA, 23 bp, Homo sapiens
aaaatttccagtacctttgtcac

SEQ ID NO: 356904 - DNA, 19 bp, Homo sapiens
aaaatttgaaccaaaacat

SEQ ID NO: 356905 - DNA, 19 bp, Homo sapiens
aaaatttgtttgaaatctt

SEQ ID NO: 356906 - DNA, 19 bp, Homo sapiens
aaacaaaaccaagccttgg

SEQ ID NO: 356907 - DNA, 12 bp, Homo sapiens
aaacaaaataga

SEQ ID NO: 356908 - DNA, 14 bp, Homo sapiens
aaacaaaatctgaa

SEQ ID NO: 356909 - DNA, 17 bp, Homo sapiens
aaacaaaatctgaactc

SEQ ID NO: 356910 - DNA, 20 bp, Homo sapiens
aaacaaaatttgtttgaaat

SEQ ID NO: 356911 - DNA, 15 bp, Homo sapiens
aaacaaagctgattt

SEQ ID NO: 356912 - DNA, 21 bp, Homo sapiens
aaacaaaggatttgaaaacac

SEQ ID NO: 356913 - DNA, 17 bp, Homo sapiens
aaacaaatatgcaaaag

SEQ ID NO: 356914 - DNA, 17 bp, Homo sapiens
aaacaaatatttcactt

SEQ ID NO: 356915 - DNA, 22 bp, Homo sapiens
aaacaagagttttcttccttgt

SEQ ID NO: 356916 - DNA, 20 bp, Homo sapiens
aaacaagttggctagaagaa

SEQ ID NO: 356917 - DNA, 16 bp, Homo sapiens
aaacaatatttattgt

SEQ ID NO: 356918 - DNA, 22 bp, Homo sapiens
aaacaatatttattgtatttta

SEQ ID NO: 356919 - DNA, 22 bp, Homo sapiens
aaacaatccaaatgcattcatg

SEQ ID NO: 356920 - DNA, 13 bp, Homo sapiens
aaacaattcaaag

SEQ ID NO: 356921 - DNA, 17 bp, Homo sapiens
aaacaatttattttatt

SEQ ID NO: 356922 - DNA, 21 bp, Homo sapiens
aaacacacaaaagattatgta

SEQ ID NO: 356923 - DNA, 16 bp, Homo sapiens
aaacacacagtattcg

SEQ ID NO: 356924 - DNA, 17 bp, Homo sapiens
aaacacaccaggctgtg

SEQ ID NO: 356925 - DNA, 12 bp, Homo sapiens
aaacacactttt

SEQ ID NO: 356926 - DNA, 12 bp, Homo sapiens
aaacacagagag

SEQ ID NO: 356927 - DNA, 19 bp, Homo sapiens
aaacacatagattcacctg

SEQ ID NO: 356928 - DNA, 21 bp, Homo sapiens
aaacacattgaatgcgcttta

SEQ ID NO: 356929 - DNA, 14 bp, Homo sapiens
aaacaccacttaat

SEQ ID NO: 356930 - DNA, 17 bp, Homo sapiens
aaacaccacttaatctt

SEQ ID NO: 356931 - DNA, 20 bp, Homo sapiens
aaacaccacttaatcttctc

SEQ ID NO: 356932 - DNA, 16 bp, Homo sapiens
aaacacctaagtgact

SEQ ID NO: 356933 - DNA, 17 bp, Homo sapiens
aaacacctgacacatct

SEQ ID NO: 356934 - DNA, 23 bp, Homo sapiens
aaacactgtaatcttaaaagtgt

SEQ ID NO: 356935 - DNA, 17 bp, Homo sapiens
aaacagaaaaaaaacac

SEQ ID NO: 356936 - DNA, 15 bp, Homo sapiens
aaacagaaaagagaa

SEQ ID NO: 356937 - DNA, 21 bp, Homo sapiens
aaacagaactcgatgcactga

SEQ ID NO: 356938 - DNA, 17 bp, Homo sapiens
aaacagaatattctgta

SEQ ID NO: 356939 - DNA, 22 bp, Homo sapiens
aaacagagtccaatttaaggaa

SEQ ID NO: 356940 - DNA, 15 bp, Homo sapiens
aaacagatataaatg

SEQ ID NO: 356941 - DNA, 15 bp, Homo sapiens
aaacagccatgtcca

SEQ ID NO: 356942 - DNA, 23 bp, Homo sapiens
aaacagccgtcagccaaatgtaa

SEQ ID NO: 356943 - DNA, 14 bp, Homo sapiens
aaacagctgcctct

SEQ ID NO: 356944 - DNA, 12 bp, Homo sapiens
aaacagctttca

SEQ ID NO: 356945 - DNA, 14 bp, Homo sapiens
aaacagctttcaag

SEQ ID NO: 356946 - DNA, 18 bp, Homo sapiens
aaacagctttcaagtgcc

SEQ ID NO: 356947 - DNA, 19 bp, Homo sapiens
aaacagctttcaagtgcct

SEQ ID NO: 356948 - DNA, 15 bp, Homo sapiens
aaacaggaaaaaaac

SEQ ID NO: 356949 - DNA, 16 bp, Homo sapiens
aaacattttaaaatca

SEQ ID NO: 356950 - DNA, 21 bp, Homo sapiens
aaacattttgtggtcattaag

SEQ ID NO: 356951 - DNA, 17 bp, Homo sapiens
aaaccaacccatgtata

SEQ ID NO: 356952 - DNA, 12 bp, Homo sapiens
aaaccaatgatt

SEQ ID NO: 356953 - DNA, 15 bp, Homo sapiens
aaaccaatgattcat

SEQ ID NO: 356954 - DNA, 17 bp, Homo sapiens
aaaccaatgattcataa

SEQ ID NO: 356955 - DNA, 19 bp, Homo sapiens
aaaccaatggtgatcctct

SEQ ID NO: 356956 - DNA, 21 bp, Homo sapiens
aaaccaatggtgatcctctat

SEQ ID NO: 356957 - DNA, 15 bp, Homo sapiens
aaaccacagccctgt

SEQ ID NO: 356958 - DNA, 17 bp, Homo sapiens
aaaccacagccctgtca

SEQ ID NO: 356959 - DNA, 10 bp, Homo sapiens
aaaccacttt

SEQ ID NO: 356960 - DNA, 20 bp, Homo sapiens
aaaccactttttgcagcttt

SEQ ID NO: 356961 - DNA, 23 bp, Homo sapiens
aaaccaggagcattttgtgtctt

SEQ ID NO: 356962 - DNA, 19 bp, Homo sapiens
aaaccagggtttatctttt

SEQ ID NO: 356963 - DNA, 17 bp, Homo sapiens
aaaccagtcttctccct

SEQ ID NO: 356964 - DNA, 17 bp, Homo sapiens
aaaccataaaataaata

SEQ ID NO: 356965 - DNA, 19 bp, Homo sapiens
aaaccatccatctgtggaa

SEQ ID NO: 356966 - DNA, 13 bp, Homo sapiens
aaaccattgcttc

SEQ ID NO: 356967 - DNA, 14 bp, Homo sapiens
aaacccacaagctg

SEQ ID NO: 356968 - DNA, 15 bp, Homo sapiens
aaaccccagccccaa

SEQ ID NO: 356969 - DNA, 13 bp, Homo sapiens
aaacccctgggta

SEQ ID NO: 356970 - DNA, 13 bp, Homo sapiens
aaaccccttccca

SEQ ID NO: 356971 - DNA, 18 bp, Homo sapiens
aaaccctaaacctcttca

SEQ ID NO: 356972 - DNA, 14 bp, Homo sapiens
aaaccctgcttctg

SEQ ID NO: 356973 - DNA, 21 bp, Homo sapiens
aaaccctgtggggcctgatgg

SEQ ID NO: 356974 - DNA, 14 bp, Homo sapiens
aaacccttcagtgc

SEQ ID NO: 356975 - DNA, 20 bp, Homo sapiens
aaacctaaaattaagaagta

SEQ ID NO: 356976 - DNA, 17 bp, Homo sapiens
aaacctcaaaatgtcta

SEQ ID NO: 356977 - DNA, 19 bp, Homo sapiens
aaacctccatcctgccagg

SEQ ID NO: 356978 - DNA, 20 bp, Homo sapiens
aaacctccatcctgccagga

SEQ ID NO: 356979 - DNA, 22 bp, Homo sapiens
aaacctccatcctgccaggagc

SEQ ID NO: 356980 - DNA, 22 bp, Homo sapiens
aaacctgaaaaaaagtttacaa

SEQ ID NO: 356981 - DNA, 14 bp, Homo sapiens
aaacctgcattttt

SEQ ID NO: 356982 - DNA, 16 bp, Homo sapiens
aaacctgccctgcctg

SEQ ID NO: 356983 - DNA, 18 bp, Homo sapiens
aaacctgtcaatgataca

SEQ ID NO: 356984 - DNA, 16 bp, Homo sapiens
aaacctgttatgccaa

SEQ ID NO: 356985 - DNA, 19 bp, Homo sapiens
aaaccttaccttggaattg

SEQ ID NO: 356986 - DNA, 14 bp, Homo sapiens
aaaccttgtttctt

SEQ ID NO: 356987 - DNA, 15 bp, Homo sapiens
aaacctttattcttt

SEQ ID NO: 356988 - DNA, 19 bp, Homo sapiens
aaacctttcaaatttcaca

SEQ ID NO: 356989 - DNA, 14 bp, Homo sapiens
aaaccttttaaaaa

SEQ ID NO: 356990 - DNA, 14 bp, Homo sapiens
aaacgaatataagc

SEQ ID NO: 356991 - DNA, 23 bp, Homo sapiens
aaacgaatataagcttaaaataa

SEQ ID NO: 356992 - DNA, 13 bp, Homo sapiens
aaacggccctctt

SEQ ID NO: 356993 - DNA, 17 bp, Homo sapiens
aaacggttaaaactgtc

SEQ ID NO: 356994 - DNA, 19 bp, Homo sapiens
aaacgtacttaactgtgtg

SEQ ID NO: 356995 - DNA, 22 bp, Homo sapiens
aaacgtttcagtaataaaacat

SEQ ID NO: 356996 - DNA, 16 bp, Homo sapiens
aaacgttttattgtgt

SEQ ID NO: 356997 - DNA, 17 bp, Homo sapiens
aaacgttttgtttgaaa

SEQ ID NO: 356998 - DNA, 14 bp, Homo sapiens
aaactaaaatacaa

SEQ ID NO: 356999 - DNA, 22 bp, Homo sapiens
aaactaaaatagattaaaggaa

SEQ ID NO: 357000 - DNA, 15 bp, Homo sapiens
aaactaacagataag

SEQ ID NO: 357001 - DNA, 20 bp, Homo sapiens
aaactaacagataagcaaga

SEQ ID NO: 357002 - DNA, 12 bp, Homo sapiens
aaactaaccttt

SEQ ID NO: 357003 - DNA, 14 bp, Homo sapiens
aaactaagctcttt

SEQ ID NO: 357004 - DNA, 17 bp, Homo sapiens
aaactacagaataatgt

SEQ ID NO: 357005 - DNA, 21 bp, Homo sapiens
aaactactgattgaatgttaa

SEQ ID NO: 357006 - DNA, 19 bp, Homo sapiens
aaactactgtacatttttt

SEQ ID NO: 357007 - DNA, 20 bp, Homo sapiens
aaactagataacttaaataa

SEQ ID NO: 357008 - DNA, 19 bp, Homo sapiens
aaactaggcatttgtaaat

SEQ ID NO: 357009 - DNA, 13 bp, Homo sapiens
aaactagtactat

SEQ ID NO: 357010 - DNA, 16 bp, Homo sapiens
aaactatcagtttgtc

SEQ ID NO: 357011 - DNA, 19 bp, Homo sapiens
aaactatccaattaaaatt

SEQ ID NO: 357012 - DNA, 17 bp, Homo sapiens
aaactatggttcccaat

SEQ ID NO: 357013 - DNA, 18 bp, Homo sapiens
aaactatggttcccaata

SEQ ID NO: 357014 - DNA, 16 bp, Homo sapiens
aaactatttaaaattg

SEQ ID NO: 357015 - DNA, 13 bp, Homo sapiens
aaactcaccattt

SEQ ID NO: 357016 - DNA, 16 bp, Homo sapiens
aaactcaccatttcat

SEQ ID NO: 357017 - DNA, 17 bp, Homo sapiens
aaactcaccatttcatc

SEQ ID NO: 357018 - DNA, 18 bp, Homo sapiens
aaactcacctgctggccc

SEQ ID NO: 357019 - DNA, 19 bp, Homo sapiens
aaactcacctgctggcccc

SEQ ID NO: 357020 - DNA, 16 bp, Homo sapiens
aaactcactgctcaag

SEQ ID NO: 357021 - DNA, 20 bp, Homo sapiens
aaactcactgctcaagaaga

SEQ ID NO: 357022 - DNA, 14 bp, Homo sapiens
aaactcagttaaaa

SEQ ID NO: 357023 - DNA, 15 bp, Homo sapiens
aaactcagttaaaat

SEQ ID NO: 357024 - DNA, 12 bp, Homo sapiens
aaactccacagg

SEQ ID NO: 357025 - DNA, 16 bp, Homo sapiens
aaactcctactgcttc

SEQ ID NO: 357026 - DNA, 11 bp, Homo sapiens
aaactcctgac

SEQ ID NO: 357027 - DNA, 20 bp, Homo sapiens
aaactctaaacattaatcaa

SEQ ID NO: 357028 - DNA, 18 bp, Homo sapiens
aaactcttagagaataag

SEQ ID NO: 357029 - DNA, 14 bp, Homo sapiens
aaactcttcaaggc

SEQ ID NO: 357030 - DNA, 16 bp, Homo sapiens
aaactctttaacttct

SEQ ID NO: 357031 - DNA, 15 bp, Homo sapiens
aaactgaaaaatcta

SEQ ID NO: 357032 - DNA, 14 bp, Homo sapiens
aaactgaaaatcta

SEQ ID NO: 357033 - DNA, 17 bp, Homo sapiens
aaactgaaaatctaata

SEQ ID NO: 357034 - DNA, 21 bp, Homo sapiens
aaactgagactcagacaggaa

SEQ ID NO: 357035 - DNA, 21 bp, Homo sapiens
aaactgaggcccagagagctg

SEQ ID NO: 357036 - DNA, 13 bp, Homo sapiens
aaactgagtcctg

SEQ ID NO: 357037 - DNA, 18 bp, Homo sapiens
aaactgagtcctgttctt

SEQ ID NO: 357038 - DNA, 16 bp, Homo sapiens
aaactgagtctgtgga

SEQ ID NO: 357039 - DNA, 21 bp, Homo sapiens
aaactgatggaccgggtgggc

SEQ ID NO: 357040 - DNA, 17 bp, Homo sapiens
aaactgcaatagagact

SEQ ID NO: 357041 - DNA, 18 bp, Homo sapiens
aaactgcaatagagactg

SEQ ID NO: 357042 - DNA, 15 bp, Homo sapiens
aaactgcacagtgct

SEQ ID NO: 357043 - DNA, 16 bp, Homo sapiens
aaactgcacagtgctg

SEQ ID NO: 357044 - DNA, 17 bp, Homo sapiens
aaactgcacagtgctgt

SEQ ID NO: 357045 - DNA, 20 bp, Homo sapiens
aaactggagaggctaacctc

SEQ ID NO: 357046 - DNA, 20 bp, Homo sapiens
aaactggcatctgacacaaa

SEQ ID NO: 357047 - DNA, 16 bp, Homo sapiens
aaactggctttttccc

SEQ ID NO: 357048 - DNA, 15 bp, Homo sapiens
aaactgtagaaatga

SEQ ID NO: 357049 - DNA, 16 bp, Homo sapiens
aaactgtagaaatgat

SEQ ID NO: 357050 - DNA, 21 bp, Homo sapiens
aaactgtcctctttcagaaaa

SEQ ID NO: 357051 - DNA, 17 bp, Homo sapiens
aaactgtgtaactgccc

SEQ ID NO: 357052 - DNA, 14 bp, Homo sapiens
aaagaaattctgtt

SEQ ID NO: 357053 - DNA, 15 bp, Homo sapiens
aaagaaattctgtta

SEQ ID NO: 357054 - DNA, 14 bp, Homo sapiens
aaagaacaaacaaa

SEQ ID NO: 357055 - DNA, 18 bp, Homo sapiens
aaagaacaaacaaaactt

SEQ ID NO: 357056 - DNA, 18 bp, Homo sapiens
aaagaacccatttgccat

SEQ ID NO: 357057 - DNA, 18 bp, Homo sapiens
aaagaacccccctcccca

SEQ ID NO: 357058 - DNA, 20 bp, Homo sapiens
aaagaactccttattttgta

SEQ ID NO: 357059 - DNA, 19 bp, Homo sapiens
aaagaacttgatttgcatg

SEQ ID NO: 357060 - DNA, 16 bp, Homo sapiens
aaagaagaaagactct

SEQ ID NO: 357061 - DNA, 17 bp, Homo sapiens
aaagaagaaagtctatg

SEQ ID NO: 357062 - DNA, 19 bp, Homo sapiens
aaagaagaaagtctatgct

SEQ ID NO: 357063 - DNA, 13 bp, Homo sapiens
aaagaagaacagc

SEQ ID NO: 357064 - DNA, 20 bp, Homo sapiens
aaagaagagtaaaatggctg

SEQ ID NO: 357065 - DNA, 19 bp, Homo sapiens
aaagaagagttttagagaa

SEQ ID NO: 357066 - DNA, 15 bp, Homo sapiens
aaagaagatgttgaa

SEQ ID NO: 357067 - DNA, 23 bp, Homo sapiens
aaagaagtctcttaattctgatg

SEQ ID NO: 357068 - DNA, 21 bp, Homo sapiens
aaagaatagtgcctcagcgct

SEQ ID NO: 357069 - DNA, 22 bp, Homo sapiens
aaagaatcacctaattaatttc

SEQ ID NO: 357070 - DNA, 21 bp, Homo sapiens
aaagaatccctgttcattgta

SEQ ID NO: 357071 - DNA, 22 bp, Homo sapiens
aaagaatccctgttcattgtaa

SEQ ID NO: 357072 - DNA, 19 bp, Homo sapiens
aaagaattcttatacacat

SEQ ID NO: 357073 - DNA, 20 bp, Homo sapiens
aaagacaaatatttctttct

SEQ ID NO: 357074 - DNA, 13 bp, Homo sapiens
aaagacacctact

SEQ ID NO: 357075 - DNA, 19 bp, Homo sapiens
aaagacacctactgagtgg

SEQ ID NO: 357076 - DNA, 14 bp, Homo sapiens
aaagacaggaagac

SEQ ID NO: 357077 - DNA, 20 bp, Homo sapiens
aaagacagtggatcatgaaa

SEQ ID NO: 357078 - DNA, 16 bp, Homo sapiens
aaagaccaaattttga

SEQ ID NO: 357079 - DNA, 17 bp, Homo sapiens
aaagaccaatgtgaaga

SEQ ID NO: 357080 - DNA, 20 bp, Homo sapiens
aaagacctacattccctctc

SEQ ID NO: 357081 - DNA, 12 bp, Homo sapiens
aaagacctgcct

SEQ ID NO: 357082 - DNA, 23 bp, Homo sapiens
aaagactaatttaaaaaataact

SEQ ID NO: 357083 - DNA, 18 bp, Homo sapiens
aaagactcagccaagaca

SEQ ID NO: 357084 - DNA, 17 bp, Homo sapiens
aaagactcctttcctgc

SEQ ID NO: 357085 - DNA, 17 bp, Homo sapiens
aaagactctattctcaa

SEQ ID NO: 357086 - DNA, 15 bp, Homo sapiens
aaagacttaatcata

SEQ ID NO: 357087 - DNA, 18 bp, Homo sapiens
aaagacttaatcatatca

SEQ ID NO: 357088 - DNA, 18 bp, Homo sapiens
aaagacttagtatatttt

SEQ ID NO: 357089 - DNA, 18 bp, Homo sapiens
aaagacttcaaatgttat

SEQ ID NO: 357090 - DNA, 12 bp, Homo sapiens
aaagagaaaaac

SEQ ID NO: 357091 - DNA, 18 bp, Homo sapiens
aaagagagaaaacttatt

SEQ ID NO: 357092 - DNA, 18 bp, Homo sapiens
aaagagagaatgtagata

SEQ ID NO: 357093 - DNA, 13 bp, Homo sapiens
aaagagagagcag

SEQ ID NO: 357094 - DNA, 21 bp, Homo sapiens
aaagagataccaagatgccat

SEQ ID NO: 357095 - DNA, 12 bp, Homo sapiens
aaagagctgcct

SEQ ID NO: 357096 - DNA, 18 bp, Homo sapiens
aaagagctgttttggatg

SEQ ID NO: 357097 - DNA, 17 bp, Homo sapiens
aaagaggaaattaaata

SEQ ID NO: 357098 - DNA, 17 bp, Homo sapiens
aaagaggagaaggagag

SEQ ID NO: 357099 - DNA, 20 bp, Homo sapiens
aaagaggcgtcttgtatttt

SEQ ID NO: 357100 - DNA, 18 bp, Homo sapiens
aaagaggctatgtgagca

SEQ ID NO: 357101 - DNA, 20 bp, Homo sapiens
aaagaggctgaaagaggcca

SEQ ID NO: 357102 - DNA, 12 bp, Homo sapiens
aaagaggctgag

SEQ ID NO: 357103 - DNA, 20 bp, Homo sapiens
aaagaggctgaggcctggac

SEQ ID NO: 357104 - DNA, 21 bp, Homo sapiens
aaagaggctgaggcctggact

SEQ ID NO: 357105 - DNA, 20 bp, Homo sapiens
aaagagtatcaaaggcagaa

SEQ ID NO: 357106 - DNA, 14 bp, Homo sapiens
aaagagtcacacaa

SEQ ID NO: 357107 - DNA, 20 bp, Homo sapiens
aaagagtcttaattttctaa

SEQ ID NO: 357108 - DNA, 14 bp, Homo sapiens
aaagataacgcagg

SEQ ID NO: 357109 - DNA, 15 bp, Homo sapiens
aaagataacgcagga

SEQ ID NO: 357110 - DNA, 16 bp, Homo sapiens
aaagataacgcaggag

SEQ ID NO: 357111 - DNA, 20 bp, Homo sapiens
aaagataacgcaggagagag

SEQ ID NO: 357112 - DNA, 19 bp, Homo sapiens
aaagatacatttgtatgtt

SEQ ID NO: 357113 - DNA, 20 bp, Homo sapiens
aaagatacgactttattttc

SEQ ID NO: 357114 - DNA, 18 bp, Homo sapiens
aaagatacttgatgcact

SEQ ID NO: 357115 - DNA, 14 bp, Homo sapiens
aaagatatctatga

SEQ ID NO: 357116 - DNA, 22 bp, Homo sapiens
aaagatattattcaccatgtaa

SEQ ID NO: 357117 - DNA, 23 bp, Homo sapiens
aaagatgattttgcttttcccta

SEQ ID NO: 357118 - DNA, 18 bp, Homo sapiens
aaagatgctagaaaaatg

SEQ ID NO: 357119 - DNA, 13 bp, Homo sapiens
aaagatggaagtg

SEQ ID NO: 357120 - DNA, 20 bp, Homo sapiens
aaagatggcgcacccggcag

SEQ ID NO: 357121 - DNA, 23 bp, Homo sapiens
aaagatggctgtgcctctgcctg

SEQ ID NO: 357122 - DNA, 23 bp, Homo sapiens
aaagatgtaatgtagttctttgt

SEQ ID NO: 357123 - DNA, 13 bp, Homo sapiens
aaagatgtactga

SEQ ID NO: 357124 - DNA, 15 bp, Homo sapiens
aaagattatgtattg

SEQ ID NO: 357125 - DNA, 14 bp, Homo sapiens
aaagattcactaaa

SEQ ID NO: 357126 - DNA, 13 bp, Homo sapiens
aaagattctttaa

SEQ ID NO: 357127 - DNA, 17 bp, Homo sapiens
aaagatttaagcacaaa

SEQ ID NO: 357128 - DNA, 15 bp, Homo sapiens
aaagatttaatgtta

SEQ ID NO: 357129 - DNA, 19 bp, Homo sapiens
aaagatttttgttaagctc

SEQ ID NO: 357130 - DNA, 20 bp, Homo sapiens
aaagatttttgttaagctca

SEQ ID NO: 357131 - DNA, 13 bp, Homo sapiens
aaagcaaaaaata

SEQ ID NO: 357132 - DNA, 19 bp, Homo sapiens
aaagcaaaaaataaaataa

SEQ ID NO: 357133 - DNA, 13 bp, Homo sapiens
aaagcaacatcag

SEQ ID NO: 357134 - DNA, 13 bp, Homo sapiens
aaagcaactttcc

SEQ ID NO: 357135 - DNA, 17 bp, Homo sapiens
aaagcaagggctccagc

SEQ ID NO: 357136 - DNA, 22 bp, Homo sapiens
aaagcaagggctccagcatcca

SEQ ID NO: 357137 - DNA, 15 bp, Homo sapiens
aaagcaataaatgaa

SEQ ID NO: 357138 - DNA, 16 bp, Homo sapiens
aaagcacaaaccctgg

SEQ ID NO: 357139 - DNA, 21 bp, Homo sapiens
aaagcacagctctcactggcc

SEQ ID NO: 357140 - DNA, 21 bp, Homo sapiens
aaagcacagtgttaaatgaaa

SEQ ID NO: 357141 - DNA, 16 bp, Homo sapiens
aaagcacattgaaaga

SEQ ID NO: 357142 - DNA, 21 bp, Homo sapiens
aaagcaccatcatcatagagg

SEQ ID NO: 357143 - DNA, 18 bp, Homo sapiens
aaagcaccgcagcatgtg

SEQ ID NO: 357144 - DNA, 19 bp, Homo sapiens
aaagcacgaaatgttattt

SEQ ID NO: 357145 - DNA, 21 bp, Homo sapiens
aaagcactattgtttagatat

SEQ ID NO: 357146 - DNA, 16 bp, Homo sapiens
aaagcacttggactct

SEQ ID NO: 357147 - DNA, 23 bp, Homo sapiens
aaagcagaggctggcctcagact

SEQ ID NO: 357148 - DNA, 20 bp, Homo sapiens
aaagcagcagctaggactga

SEQ ID NO: 357149 - DNA, 21 bp, Homo sapiens
aaagcagcagctaggactgag

SEQ ID NO: 357150 - DNA, 23 bp, Homo sapiens
aaagcaggacatatgagaaaact

SEQ ID NO: 357151 - DNA, 13 bp, Homo sapiens
aaagcaggagtgg

SEQ ID NO: 357152 - DNA, 16 bp, Homo sapiens
aaagcagtgcatgctg

SEQ ID NO: 357153 - DNA, 20 bp, Homo sapiens
aacgctcttagctttctcag

SEQ ID NO: 357154 - DNA, 14 bp, Homo sapiens
aacggctccaggat

SEQ ID NO: 357155 - DNA, 14 bp, Homo sapiens
aacgggcctccccg

SEQ ID NO: 357156 - DNA, 21 bp, Homo sapiens
aacggggtggacgagggagtg

SEQ ID NO: 357157 - DNA, 13 bp, Homo sapiens
aacgggtctgtgg

SEQ ID NO: 357158 - DNA, 14 bp, Homo sapiens
aacggttaaaactg

SEQ ID NO: 357159 - DNA, 15 bp, Homo sapiens
aacgtacccaaggtc

SEQ ID NO: 357160 - DNA, 19 bp, Homo sapiens
aacgtacttaactgtgtga

SEQ ID NO: 357161 - DNA, 16 bp, Homo sapiens
aacgtatgtatttcat

SEQ ID NO: 357162 - DNA, 17 bp, Homo sapiens
aacgtccacagagtata

SEQ ID NO: 357163 - DNA, 17 bp, Homo sapiens
aacgtccttccacttca

SEQ ID NO: 357164 - DNA, 18 bp, Homo sapiens
aacgtgccccccagttcc

SEQ ID NO: 357165 - DNA, 19 bp, Homo sapiens
aacgtgcgtgtctctgcca

SEQ ID NO: 357166 - DNA, 17 bp, Homo sapiens
aacgttaaaagacagtg

SEQ ID NO: 357167 - DNA, 15 bp, Homo sapiens
aacgttttaataatt

SEQ ID NO: 357168 - DNA, 14 bp, Homo sapiens
aactaaaagacatt

SEQ ID NO: 357169 - DNA, 16 bp, Homo sapiens
aactaagctctttgag

SEQ ID NO: 357170 - DNA, 17 bp, Homo sapiens
aactaagctctttgaga

SEQ ID NO: 357171 - DNA, 21 bp, Homo sapiens
aactaaggaaccctggaaact

SEQ ID NO: 357172 - DNA, 23 bp, Homo sapiens
aactaagttttttacttccacag

SEQ ID NO: 357173 - DNA, 22 bp, Homo sapiens
aactaatatgggcattgtagtt

SEQ ID NO: 357174 - DNA, 14 bp, Homo sapiens
aactaatcaagagt

SEQ ID NO: 357175 - DNA, 22 bp, Homo sapiens
aactaatctattgggttcatta

SEQ ID NO: 357176 - DNA, 17 bp, Homo sapiens
aactaattataatgcaa

SEQ ID NO: 357177 - DNA, 16 bp, Homo sapiens
aactaattcaataaaa

SEQ ID NO: 357178 - DNA, 12 bp, Homo sapiens
aactaattttgt

SEQ ID NO: 357179 - DNA, 23 bp, Homo sapiens
aactacagagtctgacaggaaga

SEQ ID NO: 357180 - DNA, 14 bp, Homo sapiens
aactaccaggaata

SEQ ID NO: 357181 - DNA, 19 bp, Homo sapiens
aactaccaggaataatgat

SEQ ID NO: 357182 - DNA, 18 bp, Homo sapiens
aactaccagtgggcatgt

SEQ ID NO: 357183 - DNA, 19 bp, Homo sapiens
aactacgcttgctcatttt

SEQ ID NO: 357184 - DNA, 18 bp, Homo sapiens
aactactaaagtgcctac

SEQ ID NO: 357185 - DNA, 14 bp, Homo sapiens
aactactaagaata

SEQ ID NO: 357186 - DNA, 16 bp, Homo sapiens
aactactgcaaaaagt

SEQ ID NO: 357187 - DNA, 23 bp, Homo sapiens
aactactgcaaaaagtacatagt

SEQ ID NO: 357188 - DNA, 14 bp, Homo sapiens
aactactgtgttcc

SEQ ID NO: 357189 - DNA, 16 bp, Homo sapiens
aactactgtgttcctg

SEQ ID NO: 357190 - DNA, 17 bp, Homo sapiens
aactagaatttattcaa

SEQ ID NO: 357191 - DNA, 22 bp, Homo sapiens
aactagaatttattcaattcct

SEQ ID NO: 357192 - DNA, 16 bp, Homo sapiens
aactagataacttaaa

SEQ ID NO: 357193 - DNA, 18 bp, Homo sapiens
aactagataacttaaata

SEQ ID NO: 357194 - DNA, 15 bp, Homo sapiens
aactagatctcctgt

SEQ ID NO: 357195 - DNA, 16 bp, Homo sapiens
aactagatctcctgta

SEQ ID NO: 357196 - DNA, 21 bp, Homo sapiens
aactagatctcctgtaatttt

SEQ ID NO: 357197 - DNA, 22 bp, Homo sapiens
aactagatctcctgtaattttg

SEQ ID NO: 357198 - DNA, 22 bp, Homo sapiens
aactagcaaaaggatgatttaa

SEQ ID NO: 357199 - DNA, 14 bp, Homo sapiens
aactagccaaggct

SEQ ID NO: 357200 - DNA, 17 bp, Homo sapiens
aactaggcatttgtaaa

SEQ ID NO: 357201 - DNA, 23 bp, Homo sapiens
aactaggcatttgtaaatattaa

SEQ ID NO: 357202 - DNA, 18 bp, Homo sapiens
aactagggttttggcctg

SEQ ID NO: 357203 - DNA, 18 bp, Homo sapiens
aactagtgtttctgcaga

SEQ ID NO: 357204 - DNA, 22 bp, Homo sapiens
aactagtgtttctgcagaggca

SEQ ID NO: 357205 - DNA, 22 bp, Homo sapiens
aactatccaattaaaattaagg

SEQ ID NO: 357206 - DNA, 16 bp, Homo sapiens
aactatcggttcaagt

SEQ ID NO: 357207 - DNA, 13 bp, Homo sapiens
aactatgaaatcg

SEQ ID NO: 357208 - DNA, 15 bp, Homo sapiens
aactatgcacctata

SEQ ID NO: 357209 - DNA, 24 bp, Homo sapiens
aactatgcacctataaatactaaa

SEQ ID NO: 357210 - DNA, 21 bp, Homo sapiens
aactatgtaatgcttatgtgt

SEQ ID NO: 357211 - DNA, 12 bp, Homo sapiens
aactatttaaaa

SEQ ID NO: 357212 - DNA, 23 bp, Homo sapiens
aactcaaaaggagaactgtgctc

SEQ ID NO: 357213 - DNA, 17 bp, Homo sapiens
aactcacctaatgttta

SEQ ID NO: 357214 - DNA, 16 bp, Homo sapiens
aactcacctgctggcc

SEQ ID NO: 357215 - DNA, 17 bp, Homo sapiens
aactcactcttatgaaa

SEQ ID NO: 357216 - DNA, 15 bp, Homo sapiens
aactcagatcactac

SEQ ID NO: 357217 - DNA, 21 bp, Homo sapiens
aactcagccttaagaaagcta

SEQ ID NO: 357218 - DNA, 21 bp, Homo sapiens
aactcagctattaagaaaatc

SEQ ID NO: 357219 - DNA, 15 bp, Homo sapiens
aactcatcataaaat

SEQ ID NO: 357220 - DNA, 16 bp, Homo sapiens
aactcatgaacaaaat

SEQ ID NO: 357221 - DNA, 17 bp, Homo sapiens
aactcatttttgccata

SEQ ID NO: 357222 - DNA, 12 bp, Homo sapiens
aactccaaggca

SEQ ID NO: 357223 - DNA, 20 bp, Homo sapiens
aactccacagggactgttct

SEQ ID NO: 357224 - DNA, 14 bp, Homo sapiens
aactccatgaccag

SEQ ID NO: 357225 - DNA, 17 bp, Homo sapiens
aactccatgaccaggcc

SEQ ID NO: 357226 - DNA, 11 bp, Homo sapiens
aactccatgcc

SEQ ID NO: 357227 - DNA, 14 bp, Homo sapiens
aactccatgcctat

SEQ ID NO: 357228 - DNA, 13 bp, Homo sapiens
aactcccagccac

SEQ ID NO: 357229 - DNA, 23 bp, Homo sapiens
aactcccaggacctggagacagg

SEQ ID NO: 357230 - DNA, 19 bp, Homo sapiens
aactccgcccagcctctcc

SEQ ID NO: 357231 - DNA, 19 bp, Homo sapiens
aactcctgattttgtagtt

SEQ ID NO: 357232 - DNA, 16 bp, Homo sapiens
aactcctgcctgtgtt

SEQ ID NO: 357233 - DNA, 17 bp, Homo sapiens
aactccttattttgtat

SEQ ID NO: 357234 - DNA, 20 bp, Homo sapiens
aactccttccatccttgact

SEQ ID NO: 357235 - DNA, 12 bp, Homo sapiens
aactccttggcc

SEQ ID NO: 357236 - DNA, 15 bp, Homo sapiens
aactcgaacttgaag

SEQ ID NO: 357237 - DNA, 18 bp, Homo sapiens
aactcgcttctctgtgac

SEQ ID NO: 357238 - DNA, 15 bp, Homo sapiens
aactcgtctgatgtt

SEQ ID NO: 357239 - DNA, 21 bp, Homo sapiens
aactcgtctgatgttttgatg

SEQ ID NO: 357240 - DNA, 18 bp, Homo sapiens
aactctaagtgtaaaaaa

SEQ ID NO: 357241 - DNA, 15 bp, Homo sapiens
aactctaatagtgct

SEQ ID NO: 357242 - DNA, 14 bp, Homo sapiens
aactctacccctgc

SEQ ID NO: 357243 - DNA, 16 bp, Homo sapiens
aactctacccctgctc

SEQ ID NO: 357244 - DNA, 12 bp, Homo sapiens
aactctccactc

SEQ ID NO: 357245 - DNA, 11 bp, Homo sapiens
aactctcccca

SEQ ID NO: 357246 - DNA, 22 bp, Homo sapiens
aactctcgggacctcgtttggg

SEQ ID NO: 357247 - DNA, 16 bp, Homo sapiens
aactctctgtcttctc

SEQ ID NO: 357248 - DNA, 19 bp, Homo sapiens
aactctctgtcttctctcc

SEQ ID NO: 357249 - DNA, 15 bp, Homo sapiens
aactctgcactactc

SEQ ID NO: 357250 - DNA, 16 bp, Homo sapiens
aactctgcactccatg

SEQ ID NO: 357251 - DNA, 23 bp, Homo sapiens
aactctgcactccatggccaccc

SEQ ID NO: 357252 - DNA, 11 bp, Homo sapiens
aactctgcata

SEQ ID NO: 357253 - DNA, 19 bp, Homo sapiens
aagcctttcataccagtca

SEQ ID NO: 357254 - DNA, 14 bp, Homo sapiens
aagcctttccataa

SEQ ID NO: 357255 - DNA, 19 bp, Homo sapiens
aagcgaacatcttcatata

SEQ ID NO: 357256 - DNA, 15 bp, Homo sapiens
aagcgagcacagtat

SEQ ID NO: 357257 - DNA, 22 bp, Homo sapiens
aagcggccgatgggagtctccc

SEQ ID NO: 357258 - DNA, 14 bp, Homo sapiens
aagcggggggaggg

SEQ ID NO: 357259 - DNA, 19 bp, Homo sapiens
aagcgtggtcccgaggaag

SEQ ID NO: 357260 - DNA, 12 bp, Homo sapiens
aagcgtggtgga

SEQ ID NO: 357261 - DNA, 16 bp, Homo sapiens
aagcgttcctggcctt

SEQ ID NO: 357262 - DNA, 17 bp, Homo sapiens
aagctaaaatgaaaaat

SEQ ID NO: 357263 - DNA, 21 bp, Homo sapiens
aagctagacaaaggcccagaa

SEQ ID NO: 357264 - DNA, 19 bp, Homo sapiens
aagctaggaaaggcagaaa

SEQ ID NO: 357265 - DNA, 19 bp, Homo sapiens
aagctatgagaataacttc

SEQ ID NO: 357266 - DNA, 16 bp, Homo sapiens
aagctcagagcagcct

SEQ ID NO: 357267 - DNA, 13 bp, Homo sapiens
aagctcagcccac

SEQ ID NO: 357268 - DNA, 16 bp, Homo sapiens
aagctcagcccacccc

SEQ ID NO: 357269 - DNA, 21 bp, Homo sapiens
aagctcagcccacccccctca

SEQ ID NO: 357270 - DNA, 17 bp, Homo sapiens
aagctcagctactgatt

SEQ ID NO: 357271 - DNA, 21 bp, Homo sapiens
aagctcagtttggctgtaatt

SEQ ID NO: 357272 - DNA, 20 bp, Homo sapiens
aagctcatattttgtatata

SEQ ID NO: 357273 - DNA, 20 bp, Homo sapiens
aagctccaggtgccctgtgg

SEQ ID NO: 357274 - DNA, 21 bp, Homo sapiens
aagctccaggtgccctgtggg

SEQ ID NO: 357275 - DNA, 23 bp, Homo sapiens
aagctcctggtatgggtttctcc

SEQ ID NO: 357276 - DNA, 17 bp, Homo sapiens
aagctgaaccccctcca

SEQ ID NO: 357277 - DNA, 18 bp, Homo sapiens
aagctgaatattttttat

SEQ ID NO: 357278 - DNA, 17 bp, Homo sapiens
aagctgattactgtcaa

SEQ ID NO: 357279 - DNA, 19 bp, Homo sapiens
aagctgattactgtcaata

SEQ ID NO: 357280 - DNA, 20 bp, Homo sapiens
aagctgattcccagagcaga

SEQ ID NO: 357281 - DNA, 11 bp, Homo sapiens
aagctgatttc

SEQ ID NO: 357282 - DNA, 20 bp, Homo sapiens
aagctgatttcccttttttc

SEQ ID NO: 357283 - DNA, 21 bp, Homo sapiens
aagctgccatttcccttctgg

SEQ ID NO: 357284 - DNA, 18 bp, Homo sapiens
aagctgcctccctgtcca

SEQ ID NO: 357285 - DNA, 19 bp, Homo sapiens
aagctgcctctgacagcag

SEQ ID NO: 357286 - DNA, 21 bp, Homo sapiens
aagctgctttaaaaaaataca

SEQ ID NO: 357287 - DNA, 11 bp, Homo sapiens
aagctgctttt

SEQ ID NO: 357288 - DNA, 14 bp, Homo sapiens
aagctgcttttgac

SEQ ID NO: 357289 - DNA, 19 bp, Homo sapiens
aagctggacaagaagctgc

SEQ ID NO: 357290 - DNA, 20 bp, Homo sapiens
aagctggacaagaagctgct

SEQ ID NO: 357291 - DNA, 12 bp, Homo sapiens
aagctggcagga

SEQ ID NO: 357292 - DNA, 22 bp, Homo sapiens
aagctggccgagggtcctggct

SEQ ID NO: 357293 - DNA, 16 bp, Homo sapiens
aagctgggactcattc

SEQ ID NO: 357294 - DNA, 16 bp, Homo sapiens
aagctggggacagctt

SEQ ID NO: 357295 - DNA, 17 bp, Homo sapiens
aagctgtaaaaagagag

SEQ ID NO: 357296 - DNA, 18 bp, Homo sapiens
aagctgtaaaaagagaga

SEQ ID NO: 357297 - DNA, 16 bp, Homo sapiens
aagctgtacccttgag

SEQ ID NO: 357298 - DNA, 19 bp, Homo sapiens
aagctgtactcagagcaga

SEQ ID NO: 357299 - DNA, 22 bp, Homo sapiens
aagctgtagtagccctttctgt

SEQ ID NO: 357300 - DNA, 14 bp, Homo sapiens
aagctgtgtctctg

SEQ ID NO: 357301 - DNA, 20 bp, Homo sapiens
aagctgtgtctctgtatata

SEQ ID NO: 357302 - DNA, 23 bp, Homo sapiens
aagctgtttccatagggtgacac

SEQ ID NO: 357303 - DNA, 14 bp, Homo sapiens
aagcttaaaataag

SEQ ID NO: 357304 - DNA, 18 bp, Homo sapiens
aagcttaatagccctccc

SEQ ID NO: 357305 - DNA, 15 bp, Homo sapiens
aagcttagaagccac

SEQ ID NO: 357306 - DNA, 14 bp, Homo sapiens
aagcttagtataaa

SEQ ID NO: 357307 - DNA, 21 bp, Homo sapiens
aagcttcctagcttatctccc

SEQ ID NO: 357308 - DNA, 23 bp, Homo sapiens
aagcttcctttgtttttttttcc

SEQ ID NO: 357309 - DNA, 13 bp, Homo sapiens
aagcttctcagac

SEQ ID NO: 357310 - DNA, 19 bp, Homo sapiens
aagcttcttgctcctgttt

SEQ ID NO: 357311 - DNA, 18 bp, Homo sapiens
aagcttgagcctccccca

SEQ ID NO: 357312 - DNA, 17 bp, Homo sapiens
aagcttgtttccctgct

SEQ ID NO: 357313 - DNA, 20 bp, Homo sapiens
aagcttgtttccctgctggc

SEQ ID NO: 357314 - DNA, 13 bp, Homo sapiens
aagctttcctgga

SEQ ID NO: 357315 - DNA, 12 bp, Homo sapiens
aagctttctcct

SEQ ID NO: 357316 - DNA, 11 bp, Homo sapiens
aagctttctct

SEQ ID NO: 357317 - DNA, 17 bp, Homo sapiens
aagcttttcctttcttt

SEQ ID NO: 357318 - DNA, 22 bp, Homo sapiens
aaggaaaaacagaacatttctc

SEQ ID NO: 357319 - DNA, 21 bp, Homo sapiens
aaggaaaactcaccatttcat

SEQ ID NO: 357320 - DNA, 12 bp, Homo sapiens
aaggaaaagagt

SEQ ID NO: 357321 - DNA, 15 bp, Homo sapiens
aaggaaaaggctggc

SEQ ID NO: 357322 - DNA, 12 bp, Homo sapiens
aaggaaaatgat

SEQ ID NO: 357323 - DNA, 18 bp, Homo sapiens
aaggaaactgaggcccag

SEQ ID NO: 357324 - DNA, 20 bp, Homo sapiens
aaggaaagcaataaatgaat

SEQ ID NO: 357325 - DNA, 15 bp, Homo sapiens
aaggaaatccagccc

SEQ ID NO: 357326 - DNA, 22 bp, Homo sapiens
aaggaaatctcaccccatccca

SEQ ID NO: 357327 - DNA, 15 bp, Homo sapiens
aaggaacacccggaa

SEQ ID NO: 357328 - DNA, 22 bp, Homo sapiens
aaggaagaataaaaaagaagag

SEQ ID NO: 357329 - DNA, 13 bp, Homo sapiens
aaggaagactaga

SEQ ID NO: 357330 - DNA, 22 bp, Homo sapiens
aaggaagctttctctgcttcag

SEQ ID NO: 357331 - DNA, 13 bp, Homo sapiens
aaggaaggcgtgt

SEQ ID NO: 357332 - DNA, 22 bp, Homo sapiens
aaggaagggcatccttctgcct

SEQ ID NO: 357333 - DNA, 23 bp, Homo sapiens
aaggaatgattaattaaaacaca

SEQ ID NO: 357334 - DNA, 13 bp, Homo sapiens
aaggaatgcaaga

SEQ ID NO: 357335 - DNA, 20 bp, Homo sapiens
aatagtttctgattcactat

SEQ ID NO: 357336 - DNA, 11 bp, Homo sapiens
aatagttttac

SEQ ID NO: 357337 - DNA, 17 bp, Homo sapiens
aatataaactgtgagat

SEQ ID NO: 357338 - DNA, 15 bp, Homo sapiens
aatataaatgaatga

SEQ ID NO: 357339 - DNA, 15 bp, Homo sapiens
aatataacaatatat

SEQ ID NO: 357340 - DNA, 13 bp, Homo sapiens
aatataactgcct

SEQ ID NO: 357341 - DNA, 17 bp, Homo sapiens
aatataagcttaaaata

SEQ ID NO: 357342 - DNA, 18 bp, Homo sapiens
aatataaggaaagcaata

SEQ ID NO: 357343 - DNA, 23 bp, Homo sapiens
aatataaggaaagcaataaatga

SEQ ID NO: 357344 - DNA, 20 bp, Homo sapiens
aatataatggcctcttaaaa

SEQ ID NO: 357345 - DNA, 11 bp, Homo sapiens
aatataattat

SEQ ID NO: 357346 - DNA, 15 bp, Homo sapiens
aatataattctgtaa

SEQ ID NO: 357347 - DNA, 16 bp, Homo sapiens
aatataattctgtaaa

SEQ ID NO: 357348 - DNA, 18 bp, Homo sapiens
aatatacaatttcttgaa

SEQ ID NO: 357349 - DNA, 22 bp, Homo sapiens
aatatacagtttttgtaaccat

SEQ ID NO: 357350 - DNA, 18 bp, Homo sapiens
aatatacattcaaactta

SEQ ID NO: 357351 - DNA, 19 bp, Homo sapiens
aatatacattcaaacttaa

SEQ ID NO: 357352 - DNA, 19 bp, Homo sapiens
aatatactaaccatttctt

SEQ ID NO: 357353 - DNA, 12 bp, Homo sapiens
aatatactaata

SEQ ID NO: 357354 - DNA, 17 bp, Homo sapiens
aatatactaataaaaag

SEQ ID NO: 357355 - DNA, 17 bp, Homo sapiens
aatatactatatttatg

SEQ ID NO: 357356 - DNA, 18 bp, Homo sapiens
aatatagggtttgtttgc

SEQ ID NO: 357357 - DNA, 15 bp, Homo sapiens
aatatagttaattgt

SEQ ID NO: 357358 - DNA, 18 bp, Homo sapiens
aatatagttgaacaagat

SEQ ID NO: 357359 - DNA, 23 bp, Homo sapiens
aatatagttgaacaagatttccc

SEQ ID NO: 357360 - DNA, 18 bp, Homo sapiens
aatatagttgtctttctt

SEQ ID NO: 357361 - DNA, 14 bp, Homo sapiens
aatatataatggtt

SEQ ID NO: 357362 - DNA, 19 bp, Homo sapiens
aatatataatggtttactg

SEQ ID NO: 357363 - DNA, 13 bp, Homo sapiens
aatatatataata

SEQ ID NO: 357364 - DNA, 22 bp, Homo sapiens
aatatatcccagaaattagaaa

SEQ ID NO: 357365 - DNA, 11 bp, Homo sapiens
aatatatgttt

SEQ ID NO: 357366 - DNA, 14 bp, Homo sapiens
aatatatgtttggc

SEQ ID NO: 357367 - DNA, 13 bp, Homo sapiens
aatatatgttttg

SEQ ID NO: 357368 - DNA, 14 bp, Homo sapiens
aatatatgttttga

SEQ ID NO: 357369 - DNA, 16 bp, Homo sapiens
aatatatgttttgaga

SEQ ID NO: 357370 - DNA, 15 bp, Homo sapiens
aatatattaaaaata

SEQ ID NO: 357371 - DNA, 19 bp, Homo sapiens
aatatatttttatatttag

SEQ ID NO: 357372 - DNA, 17 bp, Homo sapiens
aatatcaaaaaggagct

SEQ ID NO: 357373 - DNA, 16 bp, Homo sapiens
aatatcaacaacaagt

SEQ ID NO: 357374 - DNA, 17 bp, Homo sapiens
aatatcatatgtatcta

SEQ ID NO: 357375 - DNA, 24 bp, Homo sapiens
aatatcatatgtatctaaatgaaa

SEQ ID NO: 357376 - DNA, 18 bp, Homo sapiens
aatatcattatagcatgt

SEQ ID NO: 357377 - DNA, 16 bp, Homo sapiens
aatatcattcagcaac

SEQ ID NO: 357378 - DNA, 21 bp, Homo sapiens
aatatcattctttgtatctta

SEQ ID NO: 357379 - DNA, 13 bp, Homo sapiens
aatatcattttat

SEQ ID NO: 357380 - DNA, 16 bp, Homo sapiens
aatatcattttattca

SEQ ID NO: 357381 - DNA, 19 bp, Homo sapiens
aatatccaaagactgtact

SEQ ID NO: 357382 - DNA, 16 bp, Homo sapiens
aatatccagtcaaaga

SEQ ID NO: 357383 - DNA, 14 bp, Homo sapiens
aatatcccagagaa

SEQ ID NO: 357384 - DNA, 20 bp, Homo sapiens
aatatcccagagaacaatca

SEQ ID NO: 357385 - DNA, 22 bp, Homo sapiens
aatatcccagagaacaatcact

SEQ ID NO: 357386 - DNA, 23 bp, Homo sapiens
aatatctatttatctgtctgagc

SEQ ID NO: 357387 - DNA, 13 bp, Homo sapiens
aatatctgctgta

SEQ ID NO: 357388 - DNA, 16 bp, Homo sapiens
aatatctgctgtatgt

SEQ ID NO: 357389 - DNA, 21 bp, Homo sapiens
aatatctgggattctacttta

SEQ ID NO: 357390 - DNA, 22 bp, Homo sapiens
aatatgaattcaagaaaggaaa

SEQ ID NO: 357391 - DNA, 17 bp, Homo sapiens
aatatgagtaatgttta

SEQ ID NO: 357392 - DNA, 12 bp, Homo sapiens
aatatgatttta

SEQ ID NO: 357393 - DNA, 18 bp, Homo sapiens
aatatgattttatatcca

SEQ ID NO: 357394 - DNA, 16 bp, Homo sapiens
aatatgcaatttgtta

SEQ ID NO: 357395 - DNA, 19 bp, Homo sapiens
aatatgcactttccctaga

SEQ ID NO: 357396 - DNA, 15 bp, Homo sapiens
aatatgcagttctgc

SEQ ID NO: 357397 - DNA, 22 bp, Homo sapiens
aatatgcatctttgagaatatt

SEQ ID NO: 357398 - DNA, 14 bp, Homo sapiens
aatatgcatgtact

SEQ ID NO: 357399 - DNA, 15 bp, Homo sapiens
aatatgcatgtactt

SEQ ID NO: 357400 - DNA, 19 bp, Homo sapiens
aatatgctgccaaattttg

SEQ ID NO: 357401 - DNA, 22 bp, Homo sapiens
aatatgctgccaaattttggcc

SEQ ID NO: 357402 - DNA, 18 bp, Homo sapiens
aatatggctataaatata

SEQ ID NO: 357403 - DNA, 15 bp, Homo sapiens
aatatgtattgtaaa

SEQ ID NO: 357404 - DNA, 18 bp, Homo sapiens
aatatgtgagcatgaaac

SEQ ID NO: 357405 - DNA, 20 bp, Homo sapiens
aatattaaatacagacacta

SEQ ID NO: 357406 - DNA, 18 bp, Homo sapiens
aatattaagaaacaattt

SEQ ID NO: 357407 - DNA, 12 bp, Homo sapiens
aatattaatccc

SEQ ID NO: 357408 - DNA, 12 bp, Homo sapiens
aatattaattta

SEQ ID NO: 357409 - DNA, 13 bp, Homo sapiens
aatattaatttat

SEQ ID NO: 357410 - DNA, 13 bp, Homo sapiens
aatattacattgc

SEQ ID NO: 357411 - DNA, 16 bp, Homo sapiens
aatattacattgcatt

SEQ ID NO: 357412 - DNA, 15 bp, Homo sapiens
aatattaccatctta

SEQ ID NO: 357413 - DNA, 21 bp, Homo sapiens
aatattactgatcttaccttt

SEQ ID NO: 357414 - DNA, 16 bp, Homo sapiens
aatattactgtcttta

SEQ ID NO: 357415 - DNA, 16 bp, Homo sapiens
aatattactttaacat

SEQ ID NO: 357416 - DNA, 15 bp, Homo sapiens
aatattataaatcca

SEQ ID NO: 357417 - DNA, 21 bp, Homo sapiens
aatattataaatccaaagtaa

SEQ ID NO: 357418 - DNA, 14 bp, Homo sapiens
aatattatacttct

SEQ ID NO: 357419 - DNA, 13 bp, Homo sapiens
aatattatattgt

SEQ ID NO: 357420 - DNA, 20 bp, Homo sapiens
aatattatctttgtaattat

SEQ ID NO: 357421 - DNA, 16 bp, Homo sapiens
aatattcaataaagct

SEQ ID NO: 357422 - DNA, 16 bp, Homo sapiens
aatattcaataagaag

SEQ ID NO: 357423 - DNA, 12 bp, Homo sapiens
aatattcctgaa

SEQ ID NO: 357424 - DNA, 15 bp, Homo sapiens
aatattcctgcattt

SEQ ID NO: 357425 - DNA, 23 bp, Homo sapiens
aatattcttgtccacattctact

SEQ ID NO: 357426 - DNA, 19 bp, Homo sapiens
aatattgagaaagaaacta

SEQ ID NO: 357427 - DNA, 11 bp, Homo sapiens
aatattgcttg

SEQ ID NO: 357428 - DNA, 23 bp, Homo sapiens
aatattgtgaagaaaaataaagt

SEQ ID NO: 357429 - DNA, 17 bp, Homo sapiens
aatattgtgttgtgaat

SEQ ID NO: 357430 - DNA, 15 bp, Homo sapiens
aatatttactcatca

SEQ ID NO: 357431 - DNA, 16 bp, Homo sapiens
aatatttatagggctt

SEQ ID NO: 357432 - DNA, 14 bp, Homo sapiens
aatatttattacct

SEQ ID NO: 357433 - DNA, 16 bp, Homo sapiens
aatatttattacctct

SEQ ID NO: 357434 - DNA, 18 bp, Homo sapiens
aatatttattacctctga

SEQ ID NO: 357435 - DNA, 12 bp, Homo sapiens
aatatttattat

SEQ ID NO: 357436 - DNA, 19 bp, Homo sapiens
aatatttattattttcacc

SEQ ID NO: 357437 - DNA, 19 bp, Homo sapiens
aatatttccttaaactgtg

SEQ ID NO: 357438 - DNA, 21 bp, Homo sapiens
aatatttccttaaactgtgtg

SEQ ID NO: 357439 - DNA, 15 bp, Homo sapiens
aatatttctaagctt

SEQ ID NO: 357440 - DNA, 21 bp, Homo sapiens
aatatttctaagcttatttct

SEQ ID NO: 357441 - DNA, 22 bp, Homo sapiens
aatatttctaagcttatttcta

SEQ ID NO: 357442 - DNA, 18 bp, Homo sapiens
aatatttctatgtaaatt

SEQ ID NO: 357443 - DNA, 15 bp, Homo sapiens
aatatttgcttattt

SEQ ID NO: 357444 - DNA, 19 bp, Homo sapiens
aatattttaccactgctgt

SEQ ID NO: 357445 - DNA, 17 bp, Homo sapiens
aatattttatctttcct

SEQ ID NO: 357446 - DNA, 16 bp, Homo sapiens
aatatttttccctccg

SEQ ID NO: 357447 - DNA, 23 bp, Homo sapiens
aatattttttatttctaagtatt

SEQ ID NO: 357448 - DNA, 17 bp, Homo sapiens
aatattttttttaactg

SEQ ID NO: 357449 - DNA, 19 bp, Homo sapiens
aatcaaagcaagggctcca

SEQ ID NO: 357450 - DNA, 20 bp, Homo sapiens
aatcaaatttgtagggtttc

SEQ ID NO: 357451 - DNA, 18 bp, Homo sapiens
aatcaacagcatgtctac

SEQ ID NO: 357452 - DNA, 14 bp, Homo sapiens
aatcaactctaata

SEQ ID NO: 357453 - DNA, 16 bp, Homo sapiens
aatcaacttgtgtact

SEQ ID NO: 357454 - DNA, 18 bp, Homo sapiens
aatcaagtctgtgaaagt

SEQ ID NO: 357455 - DNA, 20 bp, Homo sapiens
aatcaagtctgtgaaagtct

SEQ ID NO: 357456 - DNA, 21 bp, Homo sapiens
aatcaattctgatacagcctt

SEQ ID NO: 357457 - DNA, 14 bp, Homo sapiens
aatcaattttttaa

SEQ ID NO: 357458 - DNA, 14 bp, Homo sapiens
aatcacaactcagc

SEQ ID NO: 357459 - DNA, 15 bp, Homo sapiens
aatcacacctctggg

SEQ ID NO: 357460 - DNA, 22 bp, Homo sapiens
aatcacagatgggtattaaact

SEQ ID NO: 357461 - DNA, 16 bp, Homo sapiens
aatcaccttttctaaa

SEQ ID NO: 357462 - DNA, 18 bp, Homo sapiens
aatcacgagatcttcctt

SEQ ID NO: 357463 - DNA, 14 bp, Homo sapiens
aatcactattctta

SEQ ID NO: 357464 - DNA, 19 bp, Homo sapiens
aatcactgaggcattttta

SEQ ID NO: 357465 - DNA, 21 bp, Homo sapiens
aatgatatgtctttaaaatga

SEQ ID NO: 357466 - DNA, 17 bp, Homo sapiens
aatgatccttatgatgt

SEQ ID NO: 357467 - DNA, 16 bp, Homo sapiens
aatgatctaggtttaa

SEQ ID NO: 357468 - DNA, 22 bp, Homo sapiens
aatgatctctctgaatcctaag

SEQ ID NO: 357469 - DNA, 22 bp, Homo sapiens
aatgatggtaggaagaagctct

SEQ ID NO: 357470 - DNA, 19 bp, Homo sapiens
aatgatgtatgatttgttg

SEQ ID NO: 357471 - DNA, 12 bp, Homo sapiens
aatgatgtgtca

SEQ ID NO: 357472 - DNA, 13 bp, Homo sapiens
aatgattaattaa

SEQ ID NO: 357473 - DNA, 16 bp, Homo sapiens
aatgattaattaaaac

SEQ ID NO: 357474 - DNA, 18 bp, Homo sapiens
aatgattcataacaatgt

SEQ ID NO: 357475 - DNA, 20 bp, Homo sapiens
aatgattgtaaaatagcttg

SEQ ID NO: 357476 - DNA, 20 bp, Homo sapiens
aatgattttatctgtgaatt

SEQ ID NO: 357477 - DNA, 16 bp, Homo sapiens
aatgattttcatcaat

SEQ ID NO: 357478 - DNA, 14 bp, Homo sapiens
aatgatttttagat

SEQ ID NO: 357479 - DNA, 20 bp, Homo sapiens
aatgcaaaatttttttaatc

SEQ ID NO: 357480 - DNA, 16 bp, Homo sapiens
aatgcaaattaaaggg

SEQ ID NO: 357481 - DNA, 16 bp, Homo sapiens
aatgcaaattctcagg

SEQ ID NO: 357482 - DNA, 16 bp, Homo sapiens
aatgcacaagctcaga

SEQ ID NO: 357483 - DNA, 13 bp, Homo sapiens
aatgcagacacac

SEQ ID NO: 357484 - DNA, 16 bp, Homo sapiens
aatgcagacatttaca

SEQ ID NO: 357485 - DNA, 17 bp, Homo sapiens
aatgcagaggaggagaa

SEQ ID NO: 357486 - DNA, 20 bp, Homo sapiens
aatgcagattcctgggcctg

SEQ ID NO: 357487 - DNA, 15 bp, Homo sapiens
aatgcagtataaaat

SEQ ID NO: 357488 - DNA, 18 bp, Homo sapiens
aatgcagtataaaatgta

SEQ ID NO: 357489 - DNA, 14 bp, Homo sapiens
aatgcattcatgtt

SEQ ID NO: 357490 - DNA, 14 bp, Homo sapiens
aatgcattgaaaga

SEQ ID NO: 357491 - DNA, 21 bp, Homo sapiens
aatgcattttctacatgtatt

SEQ ID NO: 357492 - DNA, 18 bp, Homo sapiens
aatgccacagccaagccc

SEQ ID NO: 357493 - DNA, 19 bp, Homo sapiens
aatgccacagccaagccca

SEQ ID NO: 357494 - DNA, 11 bp, Homo sapiens
aatgccagccc

SEQ ID NO: 357495 - DNA, 23 bp, Homo sapiens
aatgccagtaacgcgtcttcctg

SEQ ID NO: 357496 - DNA, 13 bp, Homo sapiens
aatgccattctct

SEQ ID NO: 357497 - DNA, 17 bp, Homo sapiens
aatgccctcctaaatgt

SEQ ID NO: 357498 - DNA, 13 bp, Homo sapiens
aatgccctgccat

SEQ ID NO: 357499 - DNA, 18 bp, Homo sapiens
aatgcctcacgagatttg

SEQ ID NO: 357500 - DNA, 15 bp, Homo sapiens
aatgcctctgccttg

SEQ ID NO: 357501 - DNA, 12 bp, Homo sapiens
aatgcctgtgcc

SEQ ID NO: 357502 - DNA, 13 bp, Homo sapiens
aatgcctgtgcca

SEQ ID NO: 357503 - DNA, 14 bp, Homo sapiens
aatgcctgtgccaa

SEQ ID NO: 357504 - DNA, 17 bp, Homo sapiens
aatgccttgttgtattc

SEQ ID NO: 357505 - DNA, 18 bp, Homo sapiens
aatgccttgttgtattcc

SEQ ID NO: 357506 - DNA, 18 bp, Homo sapiens
aatgcgctcttcaccagg

SEQ ID NO: 357507 - DNA, 20 bp, Homo sapiens
aatgcgctcttcaccaggaa

SEQ ID NO: 357508 - DNA, 22 bp, Homo sapiens
aatgcgctcttcaccaggaaga

SEQ ID NO: 357509 - DNA, 20 bp, Homo sapiens
aatgcgctttattgcccatg

SEQ ID NO: 357510 - DNA, 20 bp, Homo sapiens
aatgcgtggcacatctaaat

SEQ ID NO: 357511 - DNA, 13 bp, Homo sapiens
aatgctaatgtaa

SEQ ID NO: 357512 - DNA, 22 bp, Homo sapiens
aatgctaatgtaatcatttatc

SEQ ID NO: 357513 - DNA, 14 bp, Homo sapiens
aatgctacctctga

SEQ ID NO: 357514 - DNA, 23 bp, Homo sapiens
aatgctacctctgatcaaagcac

SEQ ID NO: 357515 - DNA, 18 bp, Homo sapiens
aatgctaggttaattcca

SEQ ID NO: 357516 - DNA, 19 bp, Homo sapiens
aatgctaggttaattccaa

SEQ ID NO: 357517 - DNA, 21 bp, Homo sapiens
aatgctaggttaattccaatt

SEQ ID NO: 357518 - DNA, 13 bp, Homo sapiens
aatgctatggact

SEQ ID NO: 357519 - DNA, 21 bp, Homo sapiens
aatgctattgttgtgggcttt

SEQ ID NO: 357520 - DNA, 15 bp, Homo sapiens
aatgctcaatgtgct

SEQ ID NO: 357521 - DNA, 14 bp, Homo sapiens
aatgctcccccatc

SEQ ID NO: 357522 - DNA, 19 bp, Homo sapiens
aatgctccttgttcctaga

SEQ ID NO: 357523 - DNA, 14 bp, Homo sapiens
aatgctctgtgcca

SEQ ID NO: 357524 - DNA, 13 bp, Homo sapiens
aatgctgatttaa

SEQ ID NO: 357525 - DNA, 12 bp, Homo sapiens
aatgctgcctgc

SEQ ID NO: 357526 - DNA, 18 bp, Homo sapiens
aatgctgcctgcctgtct

SEQ ID NO: 357527 - DNA, 12 bp, Homo sapiens
aatgctggagcg

SEQ ID NO: 357528 - DNA, 18 bp, Homo sapiens
aatgctggttttcctaaa

SEQ ID NO: 357529 - DNA, 19 bp, Homo sapiens
aatgctggttttcctaaat

SEQ ID NO: 357530 - DNA, 22 bp, Homo sapiens
aatgctggttttcctaaatgca

SEQ ID NO: 357531 - DNA, 13 bp, Homo sapiens
aatgctgtgttaa

SEQ ID NO: 357532 - DNA, 19 bp, Homo sapiens
aatgctgttggtgagaatc

SEQ ID NO: 357533 - DNA, 15 bp, Homo sapiens
aatgcttaatttcta

SEQ ID NO: 357534 - DNA, 17 bp, Homo sapiens
aatgcttaatttctaaa

SEQ ID NO: 357535 - DNA, 20 bp, Homo sapiens
aatgcttatcatctaaagat

SEQ ID NO: 357536 - DNA, 15 bp, Homo sapiens
aatgcttatgtgttg

SEQ ID NO: 357537 - DNA, 21 bp, Homo sapiens
aatgcttcctgacaatcaact

SEQ ID NO: 357538 - DNA, 21 bp, Homo sapiens
aatgcttggaatatctgctgt

SEQ ID NO: 357539 - DNA, 23 bp, Homo sapiens
acaacaaagcatgctcagtattg

SEQ ID NO: 357540 - DNA, 15 bp, Homo sapiens
acaacaacaaaatga

SEQ ID NO: 357541 - DNA, 15 bp, Homo sapiens
acaacaacctggtca

SEQ ID NO: 357542 - DNA, 19 bp, Homo sapiens
acaacaagttgtttcaaac

SEQ ID NO: 357543 - DNA, 23 bp, Homo sapiens
acaacaagttgtttcaaacagca

SEQ ID NO: 357544 - DNA, 14 bp, Homo sapiens
acaacacacacaca

SEQ ID NO: 357545 - DNA, 17 bp, Homo sapiens
acaacacctaaaaccag

SEQ ID NO: 357546 - DNA, 19 bp, Homo sapiens
acaacacctaaaaccagtt

SEQ ID NO: 357547 - DNA, 12 bp, Homo sapiens
acaacattttat

SEQ ID NO: 357548 - DNA, 20 bp, Homo sapiens
acaaccaccgctccccagcc

SEQ ID NO: 357549 - DNA, 15 bp, Homo sapiens
acaaccactggtctg

SEQ ID NO: 357550 - DNA, 13 bp, Homo sapiens
acaaccagagccc

SEQ ID NO: 357551 - DNA, 17 bp, Homo sapiens
acaaccagagcccccca

SEQ ID NO: 357552 - DNA, 14 bp, Homo sapiens
acaaccaggtcttg

SEQ ID NO: 357553 - DNA, 23 bp, Homo sapiens
acaaccccccatcacaaacttaa

SEQ ID NO: 357554 - DNA, 14 bp, Homo sapiens
acaaccctgcaaag

SEQ ID NO: 357555 - DNA, 19 bp, Homo sapiens
acaaccctgcaaaggactg

SEQ ID NO: 357556 - DNA, 23 bp, Homo sapiens
acaaccctgttgagtatttgctg

SEQ ID NO: 357557 - DNA, 20 bp, Homo sapiens
acaaccgatgctccagccaa

SEQ ID NO: 357558 - DNA, 16 bp, Homo sapiens
acaaccggttatcagt

SEQ ID NO: 357559 - DNA, 13 bp, Homo sapiens
acaacctccacct

SEQ ID NO: 357560 - DNA, 20 bp, Homo sapiens
acaacctctctgatcttgtg

SEQ ID NO: 357561 - DNA, 18 bp, Homo sapiens
acaacctgccacaatgtg

SEQ ID NO: 357562 - DNA, 21 bp, Homo sapiens
acaacctgccacaatgtgata

SEQ ID NO: 357563 - DNA, 23 bp, Homo sapiens
acaacctgtgtgagagaatttat

SEQ ID NO: 357564 - DNA, 18 bp, Homo sapiens
acaaccttctgtggctca

SEQ ID NO: 357565 - DNA, 14 bp, Homo sapiens
acaacctttgtgta

SEQ ID NO: 357566 - DNA, 18 bp, Homo sapiens
acaacgaacatggcatgt

SEQ ID NO: 357567 - DNA, 14 bp, Homo sapiens
acaactaatcaaga

SEQ ID NO: 357568 - DNA, 13 bp, Homo sapiens
acaactccagcca

SEQ ID NO: 357569 - DNA, 19 bp, Homo sapiens
acaactccttccatccttg

SEQ ID NO: 357570 - DNA, 20 bp, Homo sapiens
acaactccttccatccttga

SEQ ID NO: 357571 - DNA, 17 bp, Homo sapiens
acaactgatcatttgca

SEQ ID NO: 357572 - DNA, 17 bp, Homo sapiens
acaactgtttttgaaga

SEQ ID NO: 357573 - DNA, 18 bp, Homo sapiens
acaactgtttttgaagaa

SEQ ID NO: 357574 - DNA, 14 bp, Homo sapiens
acaacttaaataat

SEQ ID NO: 357575 - DNA, 17 bp, Homo sapiens
acaacttcaatatccaa

SEQ ID NO: 357576 - DNA, 18 bp, Homo sapiens
acaactttctcttgtaaa

SEQ ID NO: 357577 - DNA, 13 bp, Homo sapiens
acaactttgccag

SEQ ID NO: 357578 - DNA, 17 bp, Homo sapiens
acaagaaagtttcccca

SEQ ID NO: 357579 - DNA, 18 bp, Homo sapiens
acaagaaatttgatttct

SEQ ID NO: 357580 - DNA, 20 bp, Homo sapiens
acaagaagccacagacctag

SEQ ID NO: 357581 - DNA, 15 bp, Homo sapiens
acaagacccctgctc

SEQ ID NO: 357582 - DNA, 15 bp, Homo sapiens
acaagactgcctccc

SEQ ID NO: 357583 - DNA, 15 bp, Homo sapiens
acaagagcagcctgt

SEQ ID NO: 357584 - DNA, 19 bp, Homo sapiens
acaagagccatgtaccagt

SEQ ID NO: 357585 - DNA, 20 bp, Homo sapiens
acaagaggaagagagagacc

SEQ ID NO: 357586 - DNA, 22 bp, Homo sapiens
acaagagggactgtatttctgt

SEQ ID NO: 357587 - DNA, 23 bp, Homo sapiens
acaagaggttaaggtgggtccag

SEQ ID NO: 357588 - DNA, 19 bp, Homo sapiens
acaagatgccaaggaggtc

SEQ ID NO: 357589 - DNA, 16 bp, Homo sapiens
acaagcaaaccttctc

SEQ ID NO: 357590 - DNA, 21 bp, Homo sapiens
acaagccaacttgtaaataca

SEQ ID NO: 357591 - DNA, 13 bp, Homo sapiens
acaagccctggca

SEQ ID NO: 357592 - DNA, 14 bp, Homo sapiens
acaagccctggcaa

SEQ ID NO: 357593 - DNA, 14 bp, Homo sapiens
acaagcctcttctg

SEQ ID NO: 357594 - DNA, 13 bp, Homo sapiens
acaagctgcctcc

SEQ ID NO: 357595 - DNA, 20 bp, Homo sapiens
acaagcttttttacacaaat

SEQ ID NO: 357596 - DNA, 13 bp, Homo sapiens
acaaggaataaat

SEQ ID NO: 357597 - DNA, 11 bp, Homo sapiens
acaaggaatgc

SEQ ID NO: 357598 - DNA, 19 bp, Homo sapiens
acaaggaatgcctgtgcca

SEQ ID NO: 357599 - DNA, 21 bp, Homo sapiens
acaaggagagcggaggaggaa

SEQ ID NO: 357600 - DNA, 13 bp, Homo sapiens
acaaggagtgccc

SEQ ID NO: 357601 - DNA, 15 bp, Homo sapiens
acaaggagtgcccgc

SEQ ID NO: 357602 - DNA, 15 bp, Homo sapiens
acaaggccccagaga

SEQ ID NO: 357603 - DNA, 18 bp, Homo sapiens
acaaggccccagagactc

SEQ ID NO: 357604 - DNA, 20 bp, Homo sapiens
acaaggctgaaaagtgcttt

SEQ ID NO: 357605 - DNA, 14 bp, Homo sapiens
acaaggctggccag

SEQ ID NO: 357606 - DNA, 11 bp, Homo sapiens
acaagggattc

SEQ ID NO: 357607 - DNA, 16 bp, Homo sapiens
acatgcactactgaaa

SEQ ID NO: 357608 - DNA, 23 bp, Homo sapiens
acatgcactactgaaatttacac

SEQ ID NO: 357609 - DNA, 17 bp, Homo sapiens
acatgcactatgaggaa

SEQ ID NO: 357610 - DNA, 16 bp, Homo sapiens
acatgcactcagtgtg

SEQ ID NO: 357611 - DNA, 15 bp, Homo sapiens
acatgcagcccatgc

SEQ ID NO: 357612 - DNA, 23 bp, Homo sapiens
acatgcagttcattattttgtgg

SEQ ID NO: 357613 - DNA, 17 bp, Homo sapiens
acatgcatttgaggtca

SEQ ID NO: 357614 - DNA, 14 bp, Homo sapiens
acatgcgaccccga

SEQ ID NO: 357615 - DNA, 19 bp, Homo sapiens
acatgcggcttccgagggc

SEQ ID NO: 357616 - DNA, 14 bp, Homo sapiens
acatgcgggctggg

SEQ ID NO: 357617 - DNA, 22 bp, Homo sapiens
acatgcgggctgggcagctgtt

SEQ ID NO: 357618 - DNA, 19 bp, Homo sapiens
acatgctcacctctagcct

SEQ ID NO: 357619 - DNA, 20 bp, Homo sapiens
acatgctcacctctagcctt

SEQ ID NO: 357620 - DNA, 18 bp, Homo sapiens
acatgctggacaggtctg

SEQ ID NO: 357621 - DNA, 23 bp, Homo sapiens
acatgctgtgctctttgaagaga

SEQ ID NO: 357622 - DNA, 22 bp, Homo sapiens
acatgctgttggcctcaagcaa

SEQ ID NO: 357623 - DNA, 20 bp, Homo sapiens
acatgcttcatgaaaatcct

SEQ ID NO: 357624 - DNA, 21 bp, Homo sapiens
acatgcttcatgaaaatccta

SEQ ID NO: 357625 - DNA, 19 bp, Homo sapiens
acatggaagaagtatattt

SEQ ID NO: 357626 - DNA, 12 bp, Homo sapiens
acatggacccgg

SEQ ID NO: 357627 - DNA, 13 bp, Homo sapiens
acatggacccgga

SEQ ID NO: 357628 - DNA, 17 bp, Homo sapiens
acatggagactcctgcc

SEQ ID NO: 357629 - DNA, 12 bp, Homo sapiens
acatggaggaat

SEQ ID NO: 357630 - DNA, 23 bp, Homo sapiens
acatggaggaattgggacctggt

SEQ ID NO: 357631 - DNA, 15 bp, Homo sapiens
acatggattccaaag

SEQ ID NO: 357632 - DNA, 20 bp, Homo sapiens
acatggattccaaagcattt

SEQ ID NO: 357633 - DNA, 19 bp, Homo sapiens
acatggattgattaaaagc

SEQ ID NO: 357634 - DNA, 21 bp, Homo sapiens
acatggccaatagtcatatgt

SEQ ID NO: 357635 - DNA, 23 bp, Homo sapiens
acatggccaatagtcatatgtga

SEQ ID NO: 357636 - DNA, 14 bp, Homo sapiens
acatggtactcttg

SEQ ID NO: 357637 - DNA, 20 bp, Homo sapiens
acatggtactcttgttgagt

SEQ ID NO: 357638 - DNA, 21 bp, Homo sapiens
acatggtccatttcatgtgat

SEQ ID NO: 357639 - DNA, 20 bp, Homo sapiens
acatggttgtgacctgagga

SEQ ID NO: 357640 - DNA, 16 bp, Homo sapiens
acatgtagaaaaatac

SEQ ID NO: 357641 - DNA, 11 bp, Homo sapiens
acatgtcatgt

SEQ ID NO: 357642 - DNA, 21 bp, Homo sapiens
acatgtgcaattgtgagggac

SEQ ID NO: 357643 - DNA, 17 bp, Homo sapiens
acatgtgccgaatgtgc

SEQ ID NO: 357644 - DNA, 20 bp, Homo sapiens
acatgtgccgaatgtgcagg

SEQ ID NO: 357645 - DNA, 18 bp, Homo sapiens
acatgtggggccaggtca

SEQ ID NO: 357646 - DNA, 13 bp, Homo sapiens
acatgtggtttat

SEQ ID NO: 357647 - DNA, 21 bp, Homo sapiens
acatgtgttttaattccaata

SEQ ID NO: 357648 - DNA, 15 bp, Homo sapiens
acatgttcccttctc

SEQ ID NO: 357649 - DNA, 21 bp, Homo sapiens
acatgtttccatcatttctgt

SEQ ID NO: 357650 - DNA, 16 bp, Homo sapiens
acattaaacactgtaa

SEQ ID NO: 357651 - DNA, 19 bp, Homo sapiens
acattaaacactgtaatct

SEQ ID NO: 357652 - DNA, 12 bp, Homo sapiens
acattaaataat

SEQ ID NO: 357653 - DNA, 12 bp, Homo sapiens
acattaacagtt

SEQ ID NO: 357654 - DNA, 16 bp, Homo sapiens
acattaacagttttcc

SEQ ID NO: 357655 - DNA, 17 bp, Homo sapiens
acattaacagttttcca

SEQ ID NO: 357656 - DNA, 20 bp, Homo sapiens
acattaacagttttccatga

SEQ ID NO: 357657 - DNA, 22 bp, Homo sapiens
acattaagtattccttggccca

SEQ ID NO: 357658 - DNA, 23 bp, Homo sapiens
acattaagtattccttggcccag

SEQ ID NO: 357659 - DNA, 21 bp, Homo sapiens
acattaatcaatcatctgtgt

SEQ ID NO: 357660 - DNA, 21 bp, Homo sapiens
acattaatgttaattcagcac

SEQ ID NO: 357661 - DNA, 16 bp, Homo sapiens
acattaattgaggctt

SEQ ID NO: 357662 - DNA, 13 bp, Homo sapiens
acattacaaacaa

SEQ ID NO: 357663 - DNA, 19 bp, Homo sapiens
acattagaagaaaacatat

SEQ ID NO: 357664 - DNA, 20 bp, Homo sapiens
acattagaagaaaacatata

SEQ ID NO: 357665 - DNA, 18 bp, Homo sapiens
acattaggaacagagtat

SEQ ID NO: 357666 - DNA, 19 bp, Homo sapiens
acattaggaacagagtata

SEQ ID NO: 357667 - DNA, 22 bp, Homo sapiens
acattagggtgggcgtgctgcg

SEQ ID NO: 357668 - DNA, 21 bp, Homo sapiens
acattatcgggagcagtgtct

SEQ ID NO: 357669 - DNA, 16 bp, Homo sapiens
acattatttattcagc

SEQ ID NO: 357670 - DNA, 14 bp, Homo sapiens
acattatttgcatg

SEQ ID NO: 357671 - DNA, 22 bp, Homo sapiens
acattcaagattaaactgagtg

SEQ ID NO: 357672 - DNA, 13 bp, Homo sapiens
acattcaaggcat

SEQ ID NO: 357673 - DNA, 14 bp, Homo sapiens
acattcacagcacg

SEQ ID NO: 357674 - DNA, 17 bp, Homo sapiens
acattcaccaacaacag

SEQ ID NO: 357675 - DNA, 14 bp, Homo sapiens
acattcaggcatgc

SEQ ID NO: 357676 - DNA, 18 bp, Homo sapiens
acattcagtactttatga

SEQ ID NO: 357677 - DNA, 22 bp, Homo sapiens
acattccaacttaggctacaga

SEQ ID NO: 357678 - DNA, 22 bp, Homo sapiens
acattccatcacagccagccca

SEQ ID NO: 357679 - DNA, 23 bp, Homo sapiens
acattccgtttacattttagaca

SEQ ID NO: 357680 - DNA, 19 bp, Homo sapiens
acattcctcatgaatgtaa

SEQ ID NO: 357681 - DNA, 13 bp, Homo sapiens
acattcctggccc

SEQ ID NO: 357682 - DNA, 14 bp, Homo sapiens
acattcctggcccc

SEQ ID NO: 357683 - DNA, 18 bp, Homo sapiens
acattccttgtcaccagc

SEQ ID NO: 357684 - DNA, 22 bp, Homo sapiens
acattcgaggtgtcaccctgca

SEQ ID NO: 357685 - DNA, 13 bp, Homo sapiens
acattctacttca

SEQ ID NO: 357686 - DNA, 18 bp, Homo sapiens
acattctacttcagcttt

SEQ ID NO: 357687 - DNA, 18 bp, Homo sapiens
acattctatttcaacttc

SEQ ID NO: 357688 - DNA, 23 bp, Homo sapiens
acattctctatttttgttaatca

SEQ ID NO: 357689 - DNA, 17 bp, Homo sapiens
acattctgctgccccca

SEQ ID NO: 357690 - DNA, 15 bp, Homo sapiens
acattcttaaggcaa

SEQ ID NO: 357691 - DNA, 14 bp, Homo sapiens
acattgaaagtgag

SEQ ID NO: 357692 - DNA, 16 bp, Homo sapiens
acattgaatgcgcttt

SEQ ID NO: 357693 - DNA, 18 bp, Homo sapiens
acattgaccaagaactgc

SEQ ID NO: 357694 - DNA, 22 bp, Homo sapiens
acattgcactttataaacactg

SEQ ID NO: 357695 - DNA, 17 bp, Homo sapiens
acattgcccacacctgc

SEQ ID NO: 357696 - DNA, 21 bp, Homo sapiens
acattgtaaatagtatttgag

SEQ ID NO: 357697 - DNA, 16 bp, Homo sapiens
acattgtaatctgctt

SEQ ID NO: 357698 - DNA, 18 bp, Homo sapiens
acattgtataggccatct

SEQ ID NO: 357699 - DNA, 13 bp, Homo sapiens
acattgtcaataa

SEQ ID NO: 357700 - DNA, 16 bp, Homo sapiens
acatttaaaacatttg

SEQ ID NO: 357701 - DNA, 18 bp, Homo sapiens
acatttaaaacatttgaa

SEQ ID NO: 357702 - DNA, 23 bp, Homo sapiens
acaccacttaatcttctctcttg

SEQ ID NO: 357703 - DNA, 13 bp, Homo sapiens
acaccagccctgc

SEQ ID NO: 357704 - DNA, 19 bp, Homo sapiens
acaccagccctgctgcttc

SEQ ID NO: 357705 - DNA, 21 bp, Homo sapiens
acaccaggccgtcctcccggg

SEQ ID NO: 357706 - DNA, 12 bp, Homo sapiens
acaccaggctgt

SEQ ID NO: 357707 - DNA, 23 bp, Homo sapiens
acaccagggccagtagagagtgc

SEQ ID NO: 357708 - DNA, 15 bp, Homo sapiens
acaccagtcacacat

SEQ ID NO: 357709 - DNA, 19 bp, Homo sapiens
acaccagttactgttcatg

SEQ ID NO: 357710 - DNA, 13 bp, Homo sapiens
acacccaacactt

SEQ ID NO: 357711 - DNA, 17 bp, Homo sapiens
acacccagtggaaccaa

SEQ ID NO: 357712 - DNA, 15 bp, Homo sapiens
acacccagttctgaa

SEQ ID NO: 357713 - DNA, 17 bp, Homo sapiens
acacccagttctgaata

SEQ ID NO: 357714 - DNA, 18 bp, Homo sapiens
acacccccacctcctgca

SEQ ID NO: 357715 - DNA, 22 bp, Homo sapiens
acaccctaactcttgctcactc

SEQ ID NO: 357716 - DNA, 22 bp, Homo sapiens
acaccctacaagttgatcatgc

SEQ ID NO: 357717 - DNA, 16 bp, Homo sapiens
acaccctccagcacag

SEQ ID NO: 357718 - DNA, 11 bp, Homo sapiens
acacccttccc

SEQ ID NO: 357719 - DNA, 15 bp, Homo sapiens
acacccttccccact

SEQ ID NO: 357720 - DNA, 17 bp, Homo sapiens
acacccttccccactcc

SEQ ID NO: 357721 - DNA, 16 bp, Homo sapiens
acacccttggacttga

SEQ ID NO: 357722 - DNA, 22 bp, Homo sapiens
acacctaagtgactaccactta

SEQ ID NO: 357723 - DNA, 18 bp, Homo sapiens
acacctaccatgctgctt

SEQ ID NO: 357724 - DNA, 21 bp, Homo sapiens
acacctactctatcagagaaa

SEQ ID NO: 357725 - DNA, 22 bp, Homo sapiens
acacctcagttcccttggcctc

SEQ ID NO: 357726 - DNA, 12 bp, Homo sapiens
acacctctgggc

SEQ ID NO: 357727 - DNA, 16 bp, Homo sapiens
acacctctgggccctg

SEQ ID NO: 357728 - DNA, 17 bp, Homo sapiens
acacctctgggccctgc

SEQ ID NO: 357729 - DNA, 12 bp, Homo sapiens
acacctgccctg

SEQ ID NO: 357730 - DNA, 14 bp, Homo sapiens
acacctgccctgcc

SEQ ID NO: 357731 - DNA, 21 bp, Homo sapiens
acacctgggcccgggcaggcc

SEQ ID NO: 357732 - DNA, 22 bp, Homo sapiens
acacctgggcccgggcaggcca

SEQ ID NO: 357733 - DNA, 16 bp, Homo sapiens
acacctggtctgtttt

SEQ ID NO: 357734 - DNA, 17 bp, Homo sapiens
acaccttcttggcttct

SEQ ID NO: 357735 - DNA, 22 bp, Homo sapiens
acacgcaagggcatcaggcact

SEQ ID NO: 357736 - DNA, 13 bp, Homo sapiens
acacgcacacaca

SEQ ID NO: 357737 - DNA, 20 bp, Homo sapiens
acacgcacacacacacacag

SEQ ID NO: 357738 - DNA, 14 bp, Homo sapiens
acacgcagacacac

SEQ ID NO: 357739 - DNA, 19 bp, Homo sapiens
acacgccggggctggccct

SEQ ID NO: 357740 - DNA, 21 bp, Homo sapiens
acacgccggggctggccctgc

SEQ ID NO: 357741 - DNA, 18 bp, Homo sapiens
acacgctgcccaggctct

SEQ ID NO: 357742 - DNA, 22 bp, Homo sapiens
acacgctgcccaggctctgctg

SEQ ID NO: 357743 - DNA, 23 bp, Homo sapiens
acacgctgcccaggctctgctga

SEQ ID NO: 357744 - DNA, 16 bp, Homo sapiens
acacggggtattttag

SEQ ID NO: 357745 - DNA, 19 bp, Homo sapiens
acacgtacctctcatcagt

SEQ ID NO: 357746 - DNA, 17 bp, Homo sapiens
acacgtctgaccctctc

SEQ ID NO: 357747 - DNA, 19 bp, Homo sapiens
acacgtctgaccctctcca

SEQ ID NO: 357748 - DNA, 21 bp, Homo sapiens
acacgtggaggaatgctcccc

SEQ ID NO: 357749 - DNA, 24 bp, Homo sapiens
acacgtggaggaatgctcccccat

SEQ ID NO: 357750 - DNA, 15 bp, Homo sapiens
acacgtgtgatgtat

SEQ ID NO: 357751 - DNA, 18 bp, Homo sapiens
acactaaaggtggaaata

SEQ ID NO: 357752 - DNA, 17 bp, Homo sapiens
acactaattcctttcta

SEQ ID NO: 357753 - DNA, 16 bp, Homo sapiens
acactacacgcaccca

SEQ ID NO: 357754 - DNA, 21 bp, Homo sapiens
acactacagagcagctcccca

SEQ ID NO: 357755 - DNA, 21 bp, Homo sapiens
acactacagaggattctgtct

SEQ ID NO: 357756 - DNA, 15 bp, Homo sapiens
acactacctcttttg

SEQ ID NO: 357757 - DNA, 23 bp, Homo sapiens
acactagtagagcaaagacttaa

SEQ ID NO: 357758 - DNA, 20 bp, Homo sapiens
acactcattttcaatttcta

SEQ ID NO: 357759 - DNA, 18 bp, Homo sapiens
acactcgaaaagagcact

SEQ ID NO: 357760 - DNA, 23 bp, Homo sapiens
acactcgcccgcccactgtcctg

SEQ ID NO: 357761 - DNA, 14 bp, Homo sapiens
acactcgtgtgcat

SEQ ID NO: 357762 - DNA, 15 bp, Homo sapiens
acactcgtgtgcatg

SEQ ID NO: 357763 - DNA, 16 bp, Homo sapiens
acactcgtgtgcatga

SEQ ID NO: 357764 - DNA, 19 bp, Homo sapiens
acactctagtgacttcctg

SEQ ID NO: 357765 - DNA, 23 bp, Homo sapiens
acactctagtgacttcctggtga

SEQ ID NO: 357766 - DNA, 11 bp, Homo sapiens
acactctcctg

SEQ ID NO: 357767 - DNA, 16 bp, Homo sapiens
acactctcctgggccc

SEQ ID NO: 357768 - DNA, 17 bp, Homo sapiens
acactctcctgggcccc

SEQ ID NO: 357769 - DNA, 18 bp, Homo sapiens
acactgaatatttatatt

SEQ ID NO: 357770 - DNA, 14 bp, Homo sapiens
acactgagccccac

SEQ ID NO: 357771 - DNA, 16 bp, Homo sapiens
acactgatgggtcctg

SEQ ID NO: 357772 - DNA, 22 bp, Homo sapiens
acactgatgggtcctgctgctc

SEQ ID NO: 357773 - DNA, 23 bp, Homo sapiens
acactgatgggtcctgctgctcg

SEQ ID NO: 357774 - DNA, 16 bp, Homo sapiens
acactgcagccctctc

SEQ ID NO: 357775 - DNA, 15 bp, Homo sapiens
acactgccctcttgt

SEQ ID NO: 357776 - DNA, 15 bp, Homo sapiens
acactgcgaactctc

SEQ ID NO: 357777 - DNA, 16 bp, Homo sapiens
acactgcgaactctca

SEQ ID NO: 357778 - DNA, 12 bp, Homo sapiens
acactgctacac

SEQ ID NO: 357779 - DNA, 13 bp, Homo sapiens
acactgctgcacc

SEQ ID NO: 357780 - DNA, 15 bp, Homo sapiens
acactgctgcaccag

SEQ ID NO: 357781 - DNA, 21 bp, Homo sapiens
acactgcttctcggaggccag

SEQ ID NO: 357782 - DNA, 12 bp, Homo sapiens
acactggagtgg

SEQ ID NO: 357783 - DNA, 21 bp, Homo sapiens
acactggctcatattcctgca

SEQ ID NO: 357784 - DNA, 16 bp, Homo sapiens
acactggtctcagagg

SEQ ID NO: 357785 - DNA, 16 bp, Homo sapiens
acactgtaaacccctg

SEQ ID NO: 357786 - DNA, 14 bp, Homo sapiens
acactgtaatctta

SEQ ID NO: 357787 - DNA, 15 bp, Homo sapiens
acactgtatctaaaa

SEQ ID NO: 357788 - DNA, 14 bp, Homo sapiens
acactgtcaatgag

SEQ ID NO: 357789 - DNA, 19 bp, Homo sapiens
acactgtgcgttttagagt

SEQ ID NO: 357790 - DNA, 15 bp, Homo sapiens
acactgtggaaagct

SEQ ID NO: 357791 - DNA, 15 bp, Homo sapiens
acactgttattttca

SEQ ID NO: 357792 - DNA, 16 bp, Homo sapiens
acacttaattctgttc

SEQ ID NO: 357793 - DNA, 17 bp, Homo sapiens
acacttacacccttttg

SEQ ID NO: 357794 - DNA, 16 bp, Homo sapiens
acacttacactttatg

SEQ ID NO: 357795 - DNA, 16 bp, Homo sapiens
acacttcagagagctg

SEQ ID NO: 357796 - DNA, 15 bp, Homo sapiens
acacttcaggctctt

SEQ ID NO: 357797 - DNA, 14 bp, Homo sapiens
acacttccataatc

SEQ ID NO: 357798 - DNA, 13 bp, Homo sapiens
acacttcctgtcc

SEQ ID NO: 357799 - DNA, 20 bp, Homo sapiens
acacttcttgaaacagcctg

SEQ ID NO: 357800 - DNA, 21 bp, Homo sapiens
acacttcttgaaacagcctgg

SEQ ID NO: 357801 - DNA, 18 bp, Homo sapiens
acacttgagaggatgaat

SEQ ID NO: 357802 - DNA, 14 bp, Homo sapiens
acacttgctcccaa

SEQ ID NO: 357803 - DNA, 13 bp, Homo sapiens
acacttgctgggg

SEQ ID NO: 357804 - DNA, 13 bp, Homo sapiens
acacttggagccc

SEQ ID NO: 357805 - DNA, 18 bp, Homo sapiens
acacttggagcccgtgca

SEQ ID NO: 357806 - DNA, 23 bp, Homo sapiens
acacttgggtaattaaaaataaa

SEQ ID NO: 357807 - DNA, 21 bp, Homo sapiens
acacttgtaattttgtatctt

SEQ ID NO: 357808 - DNA, 13 bp, Homo sapiens
acacttgtgtgtg

SEQ ID NO: 357809 - DNA, 16 bp, Homo sapiens
acacttgtgtgtgggc

SEQ ID NO: 357810 - DNA, 14 bp, Homo sapiens
acactttctgactg

SEQ ID NO: 357811 - DNA, 18 bp, Homo sapiens
acactttctgactgcaac

SEQ ID NO: 357812 - DNA, 23 bp, Homo sapiens
acactttgagcatttttaaggga

SEQ ID NO: 357813 - DNA, 22 bp, Homo sapiens
acactttttccatttcttcaga

SEQ ID NO: 357814 - DNA, 18 bp, Homo sapiens
acagaaaaaaaacacaca

SEQ ID NO: 357815 - DNA, 11 bp, Homo sapiens
acagaaaacaa

SEQ ID NO: 357816 - DNA, 12 bp, Homo sapiens
acagaaaacaac

SEQ ID NO: 357817 - DNA, 17 bp, Homo sapiens
acagaaaacaattgttc

SEQ ID NO: 357818 - DNA, 19 bp, Homo sapiens
acagaaaacctcaagggct

SEQ ID NO: 357819 - DNA, 20 bp, Homo sapiens
acagaaaacggttaaaactg

SEQ ID NO: 357820 - DNA, 20 bp, Homo sapiens
acagaaaagagaagaaagaa

SEQ ID NO: 357821 - DNA, 22 bp, Homo sapiens
acagaaaagagaagaaagaagc

SEQ ID NO: 357822 - DNA, 22 bp, Homo sapiens
acagaaaataatctggtgttct

SEQ ID NO: 357823 - DNA, 17 bp, Homo sapiens
actggcatctctggagt

SEQ ID NO: 357824 - DNA, 21 bp, Homo sapiens
actggcattgtccctgtgcct

SEQ ID NO: 357825 - DNA, 21 bp, Homo sapiens
actggcatttttagctccttg

SEQ ID NO: 357826 - DNA, 17 bp, Homo sapiens
actggccagagagggcc

SEQ ID NO: 357827 - DNA, 15 bp, Homo sapiens
actggccatgcaagt

SEQ ID NO: 357828 - DNA, 19 bp, Homo sapiens
actggcccacccctcttcc

SEQ ID NO: 357829 - DNA, 20 bp, Homo sapiens
actggcccacccctcttccc

SEQ ID NO: 357830 - DNA, 12 bp, Homo sapiens
actggccccagg

SEQ ID NO: 357831 - DNA, 14 bp, Homo sapiens
actggccccaggcg

SEQ ID NO: 357832 - DNA, 23 bp, Homo sapiens
actggcctgggtctccctggtgg

SEQ ID NO: 357833 - DNA, 22 bp, Homo sapiens
actggcctgttctgtaggagag

SEQ ID NO: 357834 - DNA, 15 bp, Homo sapiens
actggctctctccag

SEQ ID NO: 357835 - DNA, 17 bp, Homo sapiens
actggctctctccagga

SEQ ID NO: 357836 - DNA, 17 bp, Homo sapiens
actggctgcacagccca

SEQ ID NO: 357837 - DNA, 18 bp, Homo sapiens
actggctgctctgtcttg

SEQ ID NO: 357838 - DNA, 17 bp, Homo sapiens
actggctggggcagagg

SEQ ID NO: 357839 - DNA, 10 bp, Homo sapiens
actggctgta

SEQ ID NO: 357840 - DNA, 17 bp, Homo sapiens
actggctgtcagtatga

SEQ ID NO: 357841 - DNA, 13 bp, Homo sapiens
actggctgtgaga

SEQ ID NO: 357842 - DNA, 17 bp, Homo sapiens
actggctgtgcctcccc

SEQ ID NO: 357843 - DNA, 21 bp, Homo sapiens
acattttgttatagaatactt

SEQ ID NO: 357844 - DNA, 14 bp, Homo sapiens
acatttttaattga

SEQ ID NO: 357845 - DNA, 21 bp, Homo sapiens
acatttttatttagttgaaaa

SEQ ID NO: 357846 - DNA, 15 bp, Homo sapiens
acatttttgaataca

SEQ ID NO: 357847 - DNA, 22 bp, Homo sapiens
acatttttgtctttatctcaag

SEQ ID NO: 357848 - DNA, 14 bp, Homo sapiens
accaaaaaatgtga

SEQ ID NO: 357849 - DNA, 22 bp, Homo sapiens
accaaaacccatcgtggtatgt

SEQ ID NO: 357850 - DNA, 22 bp, Homo sapiens
accaaactgcacacacagctcc

SEQ ID NO: 357851 - DNA, 13 bp, Homo sapiens
accaaagaaagtg

SEQ ID NO: 357852 - DNA, 13 bp, Homo sapiens
accaaagatgcag

SEQ ID NO: 357853 - DNA, 21 bp, Homo sapiens
accaaagcagttgggagtaca

SEQ ID NO: 357854 - DNA, 21 bp, Homo sapiens
accaaagggaaaactcttcat

SEQ ID NO: 357855 - DNA, 12 bp, Homo sapiens
accaaagtttta

SEQ ID NO: 357856 - DNA, 17 bp, Homo sapiens
accaaatgcctctgcct

SEQ ID NO: 357857 - DNA, 13 bp, Homo sapiens
accaaatgtgtaa

SEQ ID NO: 357858 - DNA, 19 bp, Homo sapiens
accaaattaaaaatttttt

SEQ ID NO: 357859 - DNA, 12 bp, Homo sapiens
accaaattctga

SEQ ID NO: 357860 - DNA, 12 bp, Homo sapiens
accaaattttga

SEQ ID NO: 357861 - DNA, 19 bp, Homo sapiens
accaaattttgaggtcttt

SEQ ID NO: 357862 - DNA, 23 bp, Homo sapiens
accaacaattaggtctgcatttt

SEQ ID NO: 357863 - DNA, 16 bp, Homo sapiens
accaacaccatcacag

SEQ ID NO: 357864 - DNA, 22 bp, Homo sapiens
accaacaccatcacagcttgtt

SEQ ID NO: 357865 - DNA, 14 bp, Homo sapiens
accaacataaaaca

SEQ ID NO: 357866 - DNA, 20 bp, Homo sapiens
accaaccactgcgaccacaa

SEQ ID NO: 357867 - DNA, 22 bp, Homo sapiens
accaacgggtctgtgggactgg

SEQ ID NO: 357868 - DNA, 14 bp, Homo sapiens
accaactctgcact

SEQ ID NO: 357869 - DNA, 22 bp, Homo sapiens
accaactctgcactccatggcc

SEQ ID NO: 357870 - DNA, 15 bp, Homo sapiens
accaactgagccaaa

SEQ ID NO: 357871 - DNA, 20 bp, Homo sapiens
accaacttggttctgcttca

SEQ ID NO: 357872 - DNA, 13 bp, Homo sapiens
accaactttctgt

SEQ ID NO: 357873 - DNA, 14 bp, Homo sapiens
accaactttctgta

SEQ ID NO: 357874 - DNA, 13 bp, Homo sapiens
accaagaaagcct

SEQ ID NO: 357875 - DNA, 21 bp, Homo sapiens
accaagaattctccaaaacaa

SEQ ID NO: 357876 - DNA, 13 bp, Homo sapiens
accaagacataat

SEQ ID NO: 357877 - DNA, 17 bp, Homo sapiens
accaagagtatgagaaa

SEQ ID NO: 357878 - DNA, 17 bp, Homo sapiens
accaagatcacaaatag

SEQ ID NO: 357879 - DNA, 13 bp, Homo sapiens
aagtgctgggatt

SEQ ID NO: 357880 - DNA, 15 bp, Homo sapiens
aagtgcttggttgaa

SEQ ID NO: 357881 - DNA, 23 bp, Homo sapiens
aagtgcttttaaactggagaggc

SEQ ID NO: 357882 - DNA, 13 bp, Homo sapiens
aagtggaaaaaag

SEQ ID NO: 357883 - DNA, 16 bp, Homo sapiens
aagtggaaaatgcaat

SEQ ID NO: 357884 - DNA, 17 bp, Homo sapiens
aagtggcatgtgctgtg

SEQ ID NO: 357885 - DNA, 18 bp, Homo sapiens
aagtggcatgtgctgtga

SEQ ID NO: 357886 - DNA, 19 bp, Homo sapiens
aagtgggagaagtggcccc

SEQ ID NO: 357887 - DNA, 16 bp, Homo sapiens
aagtgggagtgggaga

SEQ ID NO: 357888 - DNA, 21 bp, Homo sapiens
aagtgggagtgggagaggaag

SEQ ID NO: 357889 - DNA, 19 bp, Homo sapiens
aagtgggctggtattctct

SEQ ID NO: 357890 - DNA, 20 bp, Homo sapiens
aagtggggagggacaaggga

SEQ ID NO: 357891 - DNA, 22 bp, Homo sapiens
aagtggggcctccttgtccagg

SEQ ID NO: 357892 - DNA, 14 bp, Homo sapiens
aagtggggtgttga

SEQ ID NO: 357893 - DNA, 21 bp, Homo sapiens
aagtgggttttttagttgaat

SEQ ID NO: 357894 - DNA, 14 bp, Homo sapiens
aagtgtaaaataga

SEQ ID NO: 357895 - DNA, 14 bp, Homo sapiens
aagtgtaacagctg

SEQ ID NO: 357896 - DNA, 11 bp, Homo sapiens
aagtgtacagt

SEQ ID NO: 357897 - DNA, 14 bp, Homo sapiens
aagtgtactaatta

SEQ ID NO: 357898 - DNA, 21 bp, Homo sapiens
aagtgtacttcataagatatt

SEQ ID NO: 357899 - DNA, 18 bp, Homo sapiens
aagtgtatgcacgtgtgc

SEQ ID NO: 357900 - DNA, 14 bp, Homo sapiens
aagtgtcatttctt

SEQ ID NO: 357901 - DNA, 17 bp, Homo sapiens
aagtgtccgagaactaa

SEQ ID NO: 357902 - DNA, 21 bp, Homo sapiens
aagtgtctaatgcattaactt

SEQ ID NO: 357903 - DNA, 14 bp, Homo sapiens
aagtgtctgtgtgc

SEQ ID NO: 357904 - DNA, 18 bp, Homo sapiens
aagtgtgagtaagagctg

SEQ ID NO: 357905 - DNA, 21 bp, Homo sapiens
aagtgtgctttatgctgaaac

SEQ ID NO: 357906 - DNA, 23 bp, Homo sapiens
aagtgtggctggtgtccccttcc

SEQ ID NO: 357907 - DNA, 13 bp, Homo sapiens
aagtgtggggcgg

SEQ ID NO: 357908 - DNA, 12 bp, Homo sapiens
aagtgtgtatgt

SEQ ID NO: 357909 - DNA, 11 bp, Homo sapiens
aagtgtgtgtg

SEQ ID NO: 357910 - DNA, 13 bp, Homo sapiens
aagtgtgtgtgcg

SEQ ID NO: 357911 - DNA, 16 bp, Homo sapiens
aagtgtgttgttgctt

SEQ ID NO: 357912 - DNA, 13 bp, Homo sapiens
aagtgttcaagaa

SEQ ID NO: 357913 - DNA, 21 bp, Homo sapiens
aagtgttcaagaaataaaaat

SEQ ID NO: 357914 - DNA, 18 bp, Homo sapiens
aagtgttgctcttggaaa

SEQ ID NO: 357915 - DNA, 17 bp, Homo sapiens
aagtgttggtctttcta

SEQ ID NO: 357916 - DNA, 22 bp, Homo sapiens
aagtgttggtctttctaatgta

SEQ ID NO: 357917 - DNA, 16 bp, Homo sapiens
aagtgtttatttttca

SEQ ID NO: 357918 - DNA, 21 bp, Homo sapiens
aagtgtttatttttcatattg

SEQ ID NO: 357919 - DNA, 19 bp, Homo sapiens
aagtgtttcgtaagacaaa

SEQ ID NO: 357920 - DNA, 16 bp, Homo sapiens
aagtgttttactcttt

SEQ ID NO: 357921 - DNA, 18 bp, Homo sapiens
aagtgttttactcttttt

SEQ ID NO: 357922 - DNA, 20 bp, Homo sapiens
aagtgttttactctttttct

SEQ ID NO: 357923 - DNA, 23 bp, Homo sapiens
aagtgtttttctttaatcaaaag

SEQ ID NO: 357924 - DNA, 16 bp, Homo sapiens
aataagttcattaaac

SEQ ID NO: 357925 - DNA, 17 bp, Homo sapiens
aataagttcattaaaca

SEQ ID NO: 357926 - DNA, 19 bp, Homo sapiens
aataagttcattaaacaga

SEQ ID NO: 357927 - DNA, 20 bp, Homo sapiens
aataagttcattaaacagaa

SEQ ID NO: 357928 - DNA, 13 bp, Homo sapiens
aataagtttcata

SEQ ID NO: 357929 - DNA, 16 bp, Homo sapiens
aataataaattaacat

SEQ ID NO: 357930 - DNA, 19 bp, Homo sapiens
aataataaattaacattat

SEQ ID NO: 357931 - DNA, 21 bp, Homo sapiens
aataataaattgcatgctgct

SEQ ID NO: 357932 - DNA, 16 bp, Homo sapiens
aataataatagtacta

SEQ ID NO: 357933 - DNA, 18 bp, Homo sapiens
aataatacctaagccttc

SEQ ID NO: 357934 - DNA, 21 bp, Homo sapiens
aataatgacgtattgtgaaat

SEQ ID NO: 357935 - DNA, 14 bp, Homo sapiens
aataatgatttaag

SEQ ID NO: 357936 - DNA, 18 bp, Homo sapiens
aataatgtgttaaacatg

SEQ ID NO: 357937 - DNA, 12 bp, Homo sapiens
aataattaaaac

SEQ ID NO: 357938 - DNA, 18 bp, Homo sapiens
aataattatttatttaat

SEQ ID NO: 357939 - DNA, 14 bp, Homo sapiens
aataattgtggaga

SEQ ID NO: 357940 - DNA, 17 bp, Homo sapiens
aataattgtggagagga

SEQ ID NO: 357941 - DNA, 20 bp, Homo sapiens
aataattgtggagaggagag

SEQ ID NO: 357942 - DNA, 22 bp, Homo sapiens
aataattgtggagaggagagaa

SEQ ID NO: 357943 - DNA, 13 bp, Homo sapiens
aataattgtgtac

SEQ ID NO: 357944 - DNA, 22 bp, Homo sapiens
aataattttatgaactgcatgt

SEQ ID NO: 357945 - DNA, 17 bp, Homo sapiens
aataatttttatattta

SEQ ID NO: 357946 - DNA, 21 bp, Homo sapiens
aataatttttgctgaattcct

SEQ ID NO: 357947 - DNA, 21 bp, Homo sapiens
aataattttttagttaaaatc

SEQ ID NO: 357948 - DNA, 20 bp, Homo sapiens
aatacaaaaattagccgggc

SEQ ID NO: 357949 - DNA, 20 bp, Homo sapiens
aatacaaaataaaattatgg

SEQ ID NO: 357950 - DNA, 22 bp, Homo sapiens
aatacaagccaagctagaagga

SEQ ID NO: 357951 - DNA, 22 bp, Homo sapiens
aatacaagccactaccttctga

SEQ ID NO: 357952 - DNA, 20 bp, Homo sapiens
aatacaagttctatttaagt

SEQ ID NO: 357953 - DNA, 11 bp, Homo sapiens
aatacaataaa

SEQ ID NO: 357954 - DNA, 12 bp, Homo sapiens
aatacaataaac

SEQ ID NO: 357955 - DNA, 23 bp, Homo sapiens
aatacaatagtatgcagctaaaa

SEQ ID NO: 357956 - DNA, 13 bp, Homo sapiens
aatacaattaaag

SEQ ID NO: 357957 - DNA, 14 bp, Homo sapiens
aatacaattaaagg

SEQ ID NO: 357958 - DNA, 16 bp, Homo sapiens
aatacaattaaaggtc

SEQ ID NO: 357959 - DNA, 22 bp, Homo sapiens
aatacaccacctcactcctgtt

SEQ ID NO: 357960 - DNA, 16 bp, Homo sapiens
aatacactacaaatgt

SEQ ID NO: 357961 - DNA, 16 bp, Homo sapiens
aatacagggcatgcat

SEQ ID NO: 357962 - DNA, 21 bp, Homo sapiens
aatacagtgctttatggctct

SEQ ID NO: 357963 - DNA, 18 bp, Homo sapiens
aatacagttgttggcctc

SEQ ID NO: 357964 - DNA, 12 bp, Homo sapiens
aataccaaggaa

SEQ ID NO: 357965 - DNA, 17 bp, Homo sapiens
aatacccttggcactga

SEQ ID NO: 357966 - DNA, 19 bp, Homo sapiens
aatacctctttgaaagaag

SEQ ID NO: 357967 - DNA, 12 bp, Homo sapiens
aatacctttaaa

SEQ ID NO: 357968 - DNA, 14 bp, Homo sapiens
aatacctttaaata

SEQ ID NO: 357969 - DNA, 18 bp, Homo sapiens
aatacctttaaatatcat

SEQ ID NO: 357970 - DNA, 22 bp, Homo sapiens
aatacctttaaatatcattctt

SEQ ID NO: 357971 - DNA, 18 bp, Homo sapiens
aatacgcactacatgtgg

SEQ ID NO: 357972 - DNA, 23 bp, Homo sapiens
aatactggttatcctgtgctaca

SEQ ID NO: 357973 - DNA, 18 bp, Homo sapiens
aatactgtattgttacag

SEQ ID NO: 357974 - DNA, 18 bp, Homo sapiens
aatacttaaaaatatgtg

SEQ ID NO: 357975 - DNA, 20 bp, Homo sapiens
aatacttcatttggtgctgg

SEQ ID NO: 357976 - DNA, 17 bp, Homo sapiens
aatacttgaatatggaa

SEQ ID NO: 357977 - DNA, 19 bp, Homo sapiens
aatacttgacaacattttt

SEQ ID NO: 357978 - DNA, 15 bp, Homo sapiens
aatactttgtgtctt

SEQ ID NO: 357979 - DNA, 15 bp, Homo sapiens
aatacttttttctag

SEQ ID NO: 357980 - DNA, 17 bp, Homo sapiens
aatagaaaacaggaaaa

SEQ ID NO: 357981 - DNA, 17 bp, Homo sapiens
aatagaaaactgaaaat

SEQ ID NO: 357982 - DNA, 19 bp, Homo sapiens
aatagaagcttcttgctcc

SEQ ID NO: 357983 - DNA, 14 bp, Homo sapiens
aatagacagaaaca

SEQ ID NO: 357984 - DNA, 14 bp, Homo sapiens
aatagagactgtag

SEQ ID NO: 357985 - DNA, 15 bp, Homo sapiens
aatagagactgtaga

SEQ ID NO: 357986 - DNA, 18 bp, Homo sapiens
aatagagactgtagattg

SEQ ID NO: 357987 - DNA, 15 bp, Homo sapiens
aatagagatgagctt

SEQ ID NO: 357988 - DNA, 20 bp, Homo sapiens
aatagagcaaaattgatgtg

SEQ ID NO: 357989 - DNA, 22 bp, Homo sapiens
aatagagcaaaattgatgtgtt

SEQ ID NO: 357990 - DNA, 15 bp, Homo sapiens
aatagagtacttaat

SEQ ID NO: 357991 - DNA, 18 bp, Homo sapiens
aatagagtatatgcactt

SEQ ID NO: 357992 - DNA, 22 bp, Homo sapiens
aatagagtttttatatttgtta

SEQ ID NO: 357993 - DNA, 20 bp, Homo sapiens
aatagataactgctctttta

SEQ ID NO: 357994 - DNA, 23 bp, Homo sapiens
aatagatacttttgataatagat

SEQ ID NO: 357995 - DNA, 15 bp, Homo sapiens
aatagcatgtcacta

SEQ ID NO: 357996 - DNA, 22 bp, Homo sapiens
aatagccagagaggagcacctg

SEQ ID NO: 357997 - DNA, 15 bp, Homo sapiens
aatagcctttcttat

SEQ ID NO: 357998 - DNA, 22 bp, Homo sapiens
aatagctataaatagtgaaaat

SEQ ID NO: 357999 - DNA, 17 bp, Homo sapiens
aatagctatatccatgt

SEQ ID NO: 358000 - DNA, 20 bp, Homo sapiens
aatagctatatccatgtact

SEQ ID NO: 358001 - DNA, 22 bp, Homo sapiens
aatagctatatccatgtactgt

SEQ ID NO: 358002 - DNA, 14 bp, Homo sapiens
aatagcttgtatag

SEQ ID NO: 358003 - DNA, 19 bp, Homo sapiens
aataggaaagatttaatgt

SEQ ID NO: 358004 - DNA, 22 bp, Homo sapiens
aataggaagaacagtacatttt

SEQ ID NO: 358005 - DNA, 11 bp, Homo sapiens
aataggaataa

SEQ ID NO: 358006 - DNA, 19 bp, Homo sapiens
aatagggaactgtaatggc

SEQ ID NO: 358007 - DNA, 17 bp, Homo sapiens
aatagtacatgcagaaa

SEQ ID NO: 358008 - DNA, 23 bp, Homo sapiens
aatagtaggctaaaaacatttta

SEQ ID NO: 358009 - DNA, 18 bp, Homo sapiens
aatagtcattccaaatat

SEQ ID NO: 358010 - DNA, 13 bp, Homo sapiens
aatagtgaaaatt

SEQ ID NO: 358011 - DNA, 21 bp, Homo sapiens
aatagtgaaaattttattgaa

SEQ ID NO: 358012 - DNA, 14 bp, Homo sapiens
aatagtgcctcagc

SEQ ID NO: 358013 - DNA, 23 bp, Homo sapiens
aatagtgcctcagcgctgcccac

SEQ ID NO: 358014 - DNA, 13 bp, Homo sapiens
aatagtgtgttct

SEQ ID NO: 358015 - DNA, 23 bp, Homo sapiens
aatagtgtgttctgattagaaat

SEQ ID NO: 358016 - DNA, 16 bp, Homo sapiens
aatagtgttcttttta

SEQ ID NO: 358017 - DNA, 20 bp, Homo sapiens
aagaaacaccacttaatctt

SEQ ID NO: 358018 - DNA, 19 bp, Homo sapiens
aagaaaccaagtgggctgg

SEQ ID NO: 358019 - DNA, 13 bp, Homo sapiens
aagaaacctttta

SEQ ID NO: 358020 - DNA, 22 bp, Homo sapiens
aagaaacgtacttaactgtgtg

SEQ ID NO: 358021 - DNA, 16 bp, Homo sapiens
aagaaagactctattc

SEQ ID NO: 358022 - DNA, 13 bp, Homo sapiens
aagaaagatacta

SEQ ID NO: 358023 - DNA, 17 bp, Homo sapiens
aagaaagatatctatga

SEQ ID NO: 358024 - DNA, 21 bp, Homo sapiens
aagaaagctatatatgaataa

SEQ ID NO: 358025 - DNA, 15 bp, Homo sapiens
aagaaagctgtgaaa

SEQ ID NO: 358026 - DNA, 18 bp, Homo sapiens
aagaaaggggcaggagct

SEQ ID NO: 358027 - DNA, 21 bp, Homo sapiens
aagaaaggggcaggagctcag

SEQ ID NO: 358028 - DNA, 23 bp, Homo sapiens
aagaaagtttccccaccagtgaa

SEQ ID NO: 358029 - DNA, 13 bp, Homo sapiens
aagaaataaaaat

SEQ ID NO: 358030 - DNA, 14 bp, Homo sapiens
aagaaatcaatttt

SEQ ID NO: 358031 - DNA, 13 bp, Homo sapiens
aagaaatgctaat

SEQ ID NO: 358032 - DNA, 17 bp, Homo sapiens
aagaaatggctttccac

SEQ ID NO: 358033 - DNA, 19 bp, Homo sapiens
aagaaattcattaaagaaa

SEQ ID NO: 358034 - DNA, 14 bp, Homo sapiens
aagaacaaacaaaa

SEQ ID NO: 358035 - DNA, 13 bp, Homo sapiens
aagaacaacactt

SEQ ID NO: 358036 - DNA, 21 bp, Homo sapiens
aagaacaccctatattttgca

SEQ ID NO: 358037 - DNA, 14 bp, Homo sapiens
aagaacccccctcc

SEQ ID NO: 358038 - DNA, 21 bp, Homo sapiens
aagaacccccctccccaagga

SEQ ID NO: 358039 - DNA, 22 bp, Homo sapiens
aagaacccccctccccaaggaa

SEQ ID NO: 358040 - DNA, 24 bp, Homo sapiens
aagaactaattcgtacataataag

SEQ ID NO: 358041 - DNA, 16 bp, Homo sapiens
aagaactccttatttt

SEQ ID NO: 358042 - DNA, 17 bp, Homo sapiens
aagaactccttattttg

SEQ ID NO: 358043 - DNA, 22 bp, Homo sapiens
aagaactctgggcacttttgaa

SEQ ID NO: 358044 - DNA, 14 bp, Homo sapiens
aagaactgaaaaca

SEQ ID NO: 358045 - DNA, 23 bp, Homo sapiens
aagaactgcatggacctaacatt

SEQ ID NO: 358046 - DNA, 21 bp, Homo sapiens
aagaacttctcgtagatgctg

SEQ ID NO: 358047 - DNA, 18 bp, Homo sapiens
aagaacttgatttgcatg

SEQ ID NO: 358048 - DNA, 12 bp, Homo sapiens
aagaagaaaaaa

SEQ ID NO: 358049 - DNA, 13 bp, Homo sapiens
aagaagaaaacac

SEQ ID NO: 358050 - DNA, 15 bp, Homo sapiens
aagaagaacagctgt

SEQ ID NO: 358051 - DNA, 23 bp, Homo sapiens
aagaagaacagctgttcctgtgt

SEQ ID NO: 358052 - DNA, 12 bp, Homo sapiens
aagaagaatata

SEQ ID NO: 358053 - DNA, 13 bp, Homo sapiens
aagaagattctaa

SEQ ID NO: 358054 - DNA, 21 bp, Homo sapiens
aagaagcaattatttaaagaa

SEQ ID NO: 358055 - DNA, 23 bp, Homo sapiens
aagaagcaattatttaaagaaag

SEQ ID NO: 358056 - DNA, 19 bp, Homo sapiens
aagaagcactctgctggcg

SEQ ID NO: 358057 - DNA, 19 bp, Homo sapiens
aagaagccacagacctagg

SEQ ID NO: 358058 - DNA, 14 bp, Homo sapiens
aagaaggaggaatt

SEQ ID NO: 358059 - DNA, 17 bp, Homo sapiens
aagaaggcccgggagga

SEQ ID NO: 358060 - DNA, 15 bp, Homo sapiens
aagaagggaaattca

SEQ ID NO: 358061 - DNA, 17 bp, Homo sapiens
aagaagggaaattcaca

SEQ ID NO: 358062 - DNA, 20 bp, Homo sapiens
aagaagtacaataagcagag

SEQ ID NO: 358063 - DNA, 13 bp, Homo sapiens
aagaagtgggagt

SEQ ID NO: 358064 - DNA, 20 bp, Homo sapiens
aagaagtgggagtgggagag

SEQ ID NO: 358065 - DNA, 19 bp, Homo sapiens
aagaagtggtgttccatga

SEQ ID NO: 358066 - DNA, 18 bp, Homo sapiens
aagaagtgtccgagaact

SEQ ID NO: 358067 - DNA, 12 bp, Homo sapiens
aagaagtttggg

SEQ ID NO: 358068 - DNA, 19 bp, Homo sapiens
aagaagtttgggctaacat

SEQ ID NO: 358069 - DNA, 17 bp, Homo sapiens
aagaataaataaagaag

SEQ ID NO: 358070 - DNA, 19 bp, Homo sapiens
aagaataaataaagaagaa

SEQ ID NO: 358071 - DNA, 21 bp, Homo sapiens
aagaataaataaagaagaaaa

SEQ ID NO: 358072 - DNA, 21 bp, Homo sapiens
aagaataatatgctgccaaat

SEQ ID NO: 358073 - DNA, 13 bp, Homo sapiens
aagaatacagtta

SEQ ID NO: 358074 - DNA, 23 bp, Homo sapiens
aagaatacagttaggcaccagaa

SEQ ID NO: 358075 - DNA, 20 bp, Homo sapiens
aagaatagggagacaatcta

SEQ ID NO: 358076 - DNA, 23 bp, Homo sapiens
aagaatagggagacaatctaaaa

SEQ ID NO: 358077 - DNA, 21 bp, Homo sapiens
aagaatagtgcctcagcgctg

SEQ ID NO: 358078 - DNA, 13 bp, Homo sapiens
aagaatagttcta

SEQ ID NO: 358079 - DNA, 19 bp, Homo sapiens
aagaatagttctaaaattg

SEQ ID NO: 358080 - DNA, 13 bp, Homo sapiens
aagaatattcagg

SEQ ID NO: 358081 - DNA, 21 bp, Homo sapiens
aagaatattgcccaaataata

SEQ ID NO: 358082 - DNA, 13 bp, Homo sapiens
aagaatattgtat

SEQ ID NO: 358083 - DNA, 13 bp, Homo sapiens
aagaatccatctg

SEQ ID NO: 358084 - DNA, 23 bp, Homo sapiens
aagaatcgatgggggatgcttca

SEQ ID NO: 358085 - DNA, 21 bp, Homo sapiens
aagaatcggcatgtatactta

SEQ ID NO: 358086 - DNA, 18 bp, Homo sapiens
aagaatgtcgattaaaat

SEQ ID NO: 358087 - DNA, 20 bp, Homo sapiens
aagaattaaacccacaagct

SEQ ID NO: 358088 - DNA, 22 bp, Homo sapiens
aagaattaaacccacaagctgc

SEQ ID NO: 358089 - DNA, 18 bp, Homo sapiens
aagaattaatgacaacaa

SEQ ID NO: 358090 - DNA, 20 bp, Homo sapiens
aagaattctccaaaacaatt

SEQ ID NO: 358091 - DNA, 23 bp, Homo sapiens
aagaattttttttttaagatatg

SEQ ID NO: 358092 - DNA, 13 bp, Homo sapiens
aagacacacagcc

SEQ ID NO: 358093 - DNA, 14 bp, Homo sapiens
aagacacacagcct

SEQ ID NO: 358094 - DNA, 16 bp, Homo sapiens
aagacacacagccttt

SEQ ID NO: 358095 - DNA, 14 bp, Homo sapiens
aagacacgtgtttt

SEQ ID NO: 358096 - DNA, 19 bp, Homo sapiens
aagacactagtagagcaaa

SEQ ID NO: 358097 - DNA, 21 bp, Homo sapiens
aagacagagacgcaggaatgg

SEQ ID NO: 358098 - DNA, 15 bp, Homo sapiens
aagacagtggcagca

SEQ ID NO: 358099 - DNA, 14 bp, Homo sapiens
aagacataatgcac

SEQ ID NO: 358100 - DNA, 23 bp, Homo sapiens
aagacatactccttccatcaaat

SEQ ID NO: 358101 - DNA, 18 bp, Homo sapiens
aagaccaaaatgacaatg

SEQ ID NO: 358102 - DNA, 16 bp, Homo sapiens
aagaccaatgtgaaga

SEQ ID NO: 358103 - DNA, 17 bp, Homo sapiens
aagaccacaaaaattga

SEQ ID NO: 358104 - DNA, 23 bp, Homo sapiens
aagaccagtcacagccatttcaa

SEQ ID NO: 358105 - DNA, 13 bp, Homo sapiens
aagaccccaccca

SEQ ID NO: 358106 - DNA, 16 bp, Homo sapiens
aagaccccacccaagc

SEQ ID NO: 358107 - DNA, 14 bp, Homo sapiens
aagaccctgagact

SEQ ID NO: 358108 - DNA, 13 bp, Homo sapiens
aagaccctgtctc

SEQ ID NO: 358109 - DNA, 17 bp, Homo sapiens
aagacccttttgggttt

SEQ ID NO: 358110 - DNA, 19 bp, Homo sapiens
aagaccggaagctcctggt

SEQ ID NO: 358111 - DNA, 15 bp, Homo sapiens
aagaccgtgtcccaa

SEQ ID NO: 358112 - DNA, 17 bp, Homo sapiens
aagacctacattccctc

SEQ ID NO: 358113 - DNA, 17 bp, Homo sapiens
aagacctccctgtgaga

SEQ ID NO: 358114 - DNA, 12 bp, Homo sapiens
aagcccacctga

SEQ ID NO: 358115 - DNA, 21 bp, Homo sapiens
aagcccacctgaaagcctgtc

SEQ ID NO: 358116 - DNA, 13 bp, Homo sapiens
aagcccaggagga

SEQ ID NO: 358117 - DNA, 12 bp, Homo sapiens
aagccccaggca

SEQ ID NO: 358118 - DNA, 17 bp, Homo sapiens
aagccccaggcaggctg

SEQ ID NO: 358119 - DNA, 14 bp, Homo sapiens
aagccccagggcct

SEQ ID NO: 358120 - DNA, 15 bp, Homo sapiens
aagccccagggcctg

SEQ ID NO: 358121 - DNA, 16 bp, Homo sapiens
aagccccagggcctgg

SEQ ID NO: 358122 - DNA, 13 bp, Homo sapiens
aagccccctttga

SEQ ID NO: 358123 - DNA, 14 bp, Homo sapiens
aagccccctttgat

SEQ ID NO: 358124 - DNA, 18 bp, Homo sapiens
aagccccctttgattgag

SEQ ID NO: 358125 - DNA, 17 bp, Homo sapiens
aagcccctcacctcagg

SEQ ID NO: 358126 - DNA, 12 bp, Homo sapiens
aagcccctcagc

SEQ ID NO: 358127 - DNA, 20 bp, Homo sapiens
aagcccctcagcccttgccc

SEQ ID NO: 358128 - DNA, 13 bp, Homo sapiens
aagcccctgtcta

SEQ ID NO: 358129 - DNA, 21 bp, Homo sapiens
aagccccttgctctcccctgc

SEQ ID NO: 358130 - DNA, 17 bp, Homo sapiens
aagcccgacttgctgtt

SEQ ID NO: 358131 - DNA, 16 bp, Homo sapiens
aagccctccttgccac

SEQ ID NO: 358132 - DNA, 14 bp, Homo sapiens
aagccctggcaaca

SEQ ID NO: 358133 - DNA, 18 bp, Homo sapiens
aagccctgtcgagacact

SEQ ID NO: 358134 - DNA, 19 bp, Homo sapiens
aagccctgtcgagacactt

SEQ ID NO: 358135 - DNA, 20 bp, Homo sapiens
aagcccttccatgtcgcctc

SEQ ID NO: 358136 - DNA, 13 bp, Homo sapiens
aagccgctgctgg

SEQ ID NO: 358137 - DNA, 19 bp, Homo sapiens
aagccggcggcccaagccc

SEQ ID NO: 358138 - DNA, 13 bp, Homo sapiens
aagccggtgccca

SEQ ID NO: 358139 - DNA, 20 bp, Homo sapiens
aagccgtctgactccagagt

SEQ ID NO: 358140 - DNA, 13 bp, Homo sapiens
aagccgtggcttc

SEQ ID NO: 358141 - DNA, 17 bp, Homo sapiens
aagcctaagaaaaagga

SEQ ID NO: 358142 - DNA, 14 bp, Homo sapiens
aagcctcagtccct

SEQ ID NO: 358143 - DNA, 19 bp, Homo sapiens
aagcctccatttagttctt

SEQ ID NO: 358144 - DNA, 13 bp, Homo sapiens
aagcctctgccct

SEQ ID NO: 358145 - DNA, 17 bp, Homo sapiens
aagcctctgccctgcct

SEQ ID NO: 358146 - DNA, 20 bp, Homo sapiens
aagcctctgccctgcctccc

SEQ ID NO: 358147 - DNA, 22 bp, Homo sapiens
aagcctctgccctgcctccctt

SEQ ID NO: 358148 - DNA, 13 bp, Homo sapiens
aagcctcttctga

SEQ ID NO: 358149 - DNA, 12 bp, Homo sapiens
aagcctgagtgg

SEQ ID NO: 358150 - DNA, 15 bp, Homo sapiens
aagcctgcctcccaa

SEQ ID NO: 358151 - DNA, 20 bp, Homo sapiens
aagcctgctgatttctacaa

SEQ ID NO: 358152 - DNA, 16 bp, Homo sapiens
aagcctggagcccctg

SEQ ID NO: 358153 - DNA, 21 bp, Homo sapiens
aagcctggcttgggttgaaaa

SEQ ID NO: 358154 - DNA, 16 bp, Homo sapiens
aagcctgttcccctca

SEQ ID NO: 358155 - DNA, 20 bp, Homo sapiens
aagcctgttcccctcactgg

SEQ ID NO: 358156 - DNA, 22 bp, Homo sapiens
aagccttatcaagtgtcttcca

SEQ ID NO: 358157 - DNA, 22 bp, Homo sapiens
aagccttggctcgttctcttct

SEQ ID NO: 358158 - DNA, 23 bp, Homo sapiens
aagccttgggttccaaccaggca

SEQ ID NO: 358159 - DNA, 16 bp, Homo sapiens
aatctcacacagctgg

SEQ ID NO: 358160 - DNA, 18 bp, Homo sapiens
aatctcacttaatacaga

SEQ ID NO: 358161 - DNA, 23 bp, Homo sapiens
aatctccagggctgcccctgtag

SEQ ID NO: 358162 - DNA, 20 bp, Homo sapiens
aatctcccagacttgtttcc

SEQ ID NO: 358163 - DNA, 18 bp, Homo sapiens
aatctctagcctctttgt

SEQ ID NO: 358164 - DNA, 20 bp, Homo sapiens
aatctctccccaatgctctc

SEQ ID NO: 358165 - DNA, 17 bp, Homo sapiens
aatctctgattaaattt

SEQ ID NO: 358166 - DNA, 15 bp, Homo sapiens
aatctgaaacacagt

SEQ ID NO: 358167 - DNA, 23 bp, Homo sapiens
aatctgacaaagtcatgaagctc

SEQ ID NO: 358168 - DNA, 18 bp, Homo sapiens
aatctgattggacatttt

SEQ ID NO: 358169 - DNA, 19 bp, Homo sapiens
aatctgattggacattttc

SEQ ID NO: 358170 - DNA, 11 bp, Homo sapiens
aatctgcaggg

SEQ ID NO: 358171 - DNA, 18 bp, Homo sapiens
aatctgcagggagcaact

SEQ ID NO: 358172 - DNA, 23 bp, Homo sapiens
aatctgcagggagcaactctcca

SEQ ID NO: 358173 - DNA, 21 bp, Homo sapiens
aatctgccatttcaaatttct

SEQ ID NO: 358174 - DNA, 23 bp, Homo sapiens
aatctgccctcagatgaaaataa

SEQ ID NO: 358175 - DNA, 17 bp, Homo sapiens
aatctgccttccagccc

SEQ ID NO: 358176 - DNA, 22 bp, Homo sapiens
aatctgccttccagcccagacc

SEQ ID NO: 358177 - DNA, 22 bp, Homo sapiens
aatctgctttgttaatgaaaat

SEQ ID NO: 358178 - DNA, 16 bp, Homo sapiens
aatctggactcctctg

SEQ ID NO: 358179 - DNA, 18 bp, Homo sapiens
aatctggactcctctgtc

SEQ ID NO: 358180 - DNA, 21 bp, Homo sapiens
aatctggctcctgtttccatg

SEQ ID NO: 358181 - DNA, 14 bp, Homo sapiens
aatctggcttctgc

SEQ ID NO: 358182 - DNA, 17 bp, Homo sapiens
aatctggtgttcttgct

SEQ ID NO: 358183 - DNA, 19 bp, Homo sapiens
aatctggtgttcttgctaa

SEQ ID NO: 358184 - DNA, 16 bp, Homo sapiens
aatctgtatatgttgt

SEQ ID NO: 358185 - DNA, 22 bp, Homo sapiens
aatctgtatatgttgtaataaa

SEQ ID NO: 358186 - DNA, 21 bp, Homo sapiens
aatctgtctagaatcctgctt

SEQ ID NO: 358187 - DNA, 16 bp, Homo sapiens
aatctgtctgattcta

SEQ ID NO: 358188 - DNA, 21 bp, Homo sapiens
aatctgtgaagcctttatcta

SEQ ID NO: 358189 - DNA, 23 bp, Homo sapiens
aatctgtgaagcctttatctatg

SEQ ID NO: 358190 - DNA, 15 bp, Homo sapiens
aatcttaaaagtgta

SEQ ID NO: 358191 - DNA, 15 bp, Homo sapiens
aatcttaccagatgc

SEQ ID NO: 358192 - DNA, 20 bp, Homo sapiens
aatcttagaacagatggctg

SEQ ID NO: 358193 - DNA, 16 bp, Homo sapiens
aatcttagctgccaag

SEQ ID NO: 358194 - DNA, 19 bp, Homo sapiens
aatcttaggggagagcttt

SEQ ID NO: 358195 - DNA, 15 bp, Homo sapiens
aatcttatcatggtc

SEQ ID NO: 358196 - DNA, 17 bp, Homo sapiens
aatcttcactgaatatc

SEQ ID NO: 358197 - DNA, 19 bp, Homo sapiens
aatcttcactgaatatcat

SEQ ID NO: 358198 - DNA, 22 bp, Homo sapiens
aatcttcactgaatatcatatg

SEQ ID NO: 358199 - DNA, 15 bp, Homo sapiens
aatcttcggccaatt

SEQ ID NO: 358200 - DNA, 22 bp, Homo sapiens
aatcttctctcttgattgattt

SEQ ID NO: 358201 - DNA, 13 bp, Homo sapiens
aatcttgaaaatg

SEQ ID NO: 358202 - DNA, 15 bp, Homo sapiens
aatcttgctgtgaaa

SEQ ID NO: 358203 - DNA, 18 bp, Homo sapiens
aatcttgtcatgtgtata

SEQ ID NO: 358204 - DNA, 16 bp, Homo sapiens
aatctttcagaataca

SEQ ID NO: 358205 - DNA, 21 bp, Homo sapiens
aatctttcagaatacaattca

SEQ ID NO: 358206 - DNA, 19 bp, Homo sapiens
aatctttctttacctgaga

SEQ ID NO: 358207 - DNA, 17 bp, Homo sapiens
aatctttttaaaaatga

SEQ ID NO: 358208 - DNA, 13 bp, Homo sapiens
aatctttttctcc

SEQ ID NO: 358209 - DNA, 18 bp, Homo sapiens
actactgaactgttacct

SEQ ID NO: 358210 - DNA, 18 bp, Homo sapiens
actactgcaaaaagtaca

SEQ ID NO: 358211 - DNA, 15 bp, Homo sapiens
actactggtctgtac

SEQ ID NO: 358212 - DNA, 18 bp, Homo sapiens
actactgtagaactgcaa

SEQ ID NO: 358213 - DNA, 13 bp, Homo sapiens
actactgtgttcc

SEQ ID NO: 358214 - DNA, 12 bp, Homo sapiens
actactttgcta

SEQ ID NO: 358215 - DNA, 16 bp, Homo sapiens
actagaaagctctgca

SEQ ID NO: 358216 - DNA, 18 bp, Homo sapiens
actagaaagtgaataaaa

SEQ ID NO: 358217 - DNA, 22 bp, Homo sapiens
actagaaagtgaataaaaatta

SEQ ID NO: 358218 - DNA, 19 bp, Homo sapiens
actagaagctgatctgatt

SEQ ID NO: 358219 - DNA, 13 bp, Homo sapiens
actagacaaataa

SEQ ID NO: 358220 - DNA, 14 bp, Homo sapiens
actagacaaataac

SEQ ID NO: 358221 - DNA, 17 bp, Homo sapiens
actagactactcaatat

SEQ ID NO: 358222 - DNA, 17 bp, Homo sapiens
actagactcttcactgt

SEQ ID NO: 358223 - DNA, 19 bp, Homo sapiens
actcttcctcatcctgctt

SEQ ID NO: 358224 - DNA, 16 bp, Homo sapiens
actcttgatgtgaaga

SEQ ID NO: 358225 - DNA, 12 bp, Homo sapiens
actcttgctcac

SEQ ID NO: 358226 - DNA, 15 bp, Homo sapiens
actcttgctcactcc

SEQ ID NO: 358227 - DNA, 20 bp, Homo sapiens
actcttgctcactccctaaa

SEQ ID NO: 358228 - DNA, 13 bp, Homo sapiens
actcttgctcttt

SEQ ID NO: 358229 - DNA, 15 bp, Homo sapiens
actcttggctcgttt

SEQ ID NO: 358230 - DNA, 19 bp, Homo sapiens
actcttgtcatttttaata

SEQ ID NO: 358231 - DNA, 16 bp, Homo sapiens
actcttgttgagttct

SEQ ID NO: 358232 - DNA, 21 bp, Homo sapiens
actcttgttgagttctgtaga

SEQ ID NO: 358233 - DNA, 23 bp, Homo sapiens
actcttgttgcccaggctggagt

SEQ ID NO: 358234 - DNA, 18 bp, Homo sapiens
actctttagttgatttaa

SEQ ID NO: 358235 - DNA, 22 bp, Homo sapiens
actctttcttctctctttgtcc

SEQ ID NO: 358236 - DNA, 21 bp, Homo sapiens
actctttgcccagttcatccc

SEQ ID NO: 358237 - DNA, 15 bp, Homo sapiens
actctttgctgttga

SEQ ID NO: 358238 - DNA, 13 bp, Homo sapiens
actctttgtaaga

SEQ ID NO: 358239 - DNA, 18 bp, Homo sapiens
actctttgttttctttcc

SEQ ID NO: 358240 - DNA, 23 bp, Homo sapiens
actctttttcccaactttggaaa

SEQ ID NO: 358241 - DNA, 14 bp, Homo sapiens
actctttttctaaa

SEQ ID NO: 358242 - DNA, 14 bp, Homo sapiens
actgaaaacataaa

SEQ ID NO: 358243 - DNA, 16 bp, Homo sapiens
actgaaaatctaatat

SEQ ID NO: 358244 - DNA, 14 bp, Homo sapiens
actgaaaatgtaaa

SEQ ID NO: 358245 - DNA, 16 bp, Homo sapiens
actgaaaatgtaaatt

SEQ ID NO: 358246 - DNA, 22 bp, Homo sapiens
actgaaacatttgacacataaa

SEQ ID NO: 358247 - DNA, 13 bp, Homo sapiens
actgaaacttccc

SEQ ID NO: 358248 - DNA, 13 bp, Homo sapiens
actgaaagaagaa

SEQ ID NO: 358249 - DNA, 12 bp, Homo sapiens
actgaaatttac

SEQ ID NO: 358250 - DNA, 23 bp, Homo sapiens
actgaaatttgttatacttcaaa

SEQ ID NO: 358251 - DNA, 14 bp, Homo sapiens
actgaacaaaaaaa

SEQ ID NO: 358252 - DNA, 19 bp, Homo sapiens
actgaagcaaataccaaag

SEQ ID NO: 358253 - DNA, 18 bp, Homo sapiens
actgaagcacgtgagaga

SEQ ID NO: 358254 - DNA, 15 bp, Homo sapiens
actgaagcctgcagg

SEQ ID NO: 358255 - DNA, 16 bp, Homo sapiens
actgaagcctgcagga

SEQ ID NO: 358256 - DNA, 14 bp, Homo sapiens
actgaaggctttca

SEQ ID NO: 358257 - DNA, 16 bp, Homo sapiens
actgaaggggcacacc

SEQ ID NO: 358258 - DNA, 19 bp, Homo sapiens
actgaagtcttttctgtca

SEQ ID NO: 358259 - DNA, 13 bp, Homo sapiens
actgaagtgaata

SEQ ID NO: 358260 - DNA, 14 bp, Homo sapiens
actgaagtgaatac

SEQ ID NO: 358261 - DNA, 16 bp, Homo sapiens
actgaagtttcacatg

SEQ ID NO: 358262 - DNA, 21 bp, Homo sapiens
actgaatacttgaagtaggaa

SEQ ID NO: 358263 - DNA, 15 bp, Homo sapiens
actgaatatttatat

SEQ ID NO: 358264 - DNA, 22 bp, Homo sapiens
actgaatatttatatttcacta

SEQ ID NO: 358265 - DNA, 19 bp, Homo sapiens
actgaatctcccctcctca

SEQ ID NO: 358266 - DNA, 21 bp, Homo sapiens
actgaatctcccctcctcaca

SEQ ID NO: 358267 - DNA, 19 bp, Homo sapiens
actgaatttctttgattta

SEQ ID NO: 358268 - DNA, 16 bp, Homo sapiens
actgaatttgggcctc

SEQ ID NO: 358269 - DNA, 23 bp, Homo sapiens
actgacacaaaggacaaaaatat

SEQ ID NO: 358270 - DNA, 18 bp, Homo sapiens
actgacagcctcccaccc

SEQ ID NO: 358271 - DNA, 22 bp, Homo sapiens
actgacatttcacttcctcgct

SEQ ID NO: 358272 - DNA, 18 bp, Homo sapiens
actgaccccctcccctga

SEQ ID NO: 358273 - DNA, 11 bp, Homo sapiens
actgacctgga

SEQ ID NO: 358274 - DNA, 16 bp, Homo sapiens
actgacggctgtgtat

SEQ ID NO: 358275 - DNA, 22 bp, Homo sapiens
actgacggctgtgtatttctgt

SEQ ID NO: 358276 - DNA, 14 bp, Homo sapiens
actgactaaccatt

SEQ ID NO: 358277 - DNA, 23 bp, Homo sapiens
actgactattcttgatgtaaaat

SEQ ID NO: 358278 - DNA, 24 bp, Homo sapiens
actgactattcttgatgtaaaatc

SEQ ID NO: 358279 - DNA, 12 bp, Homo sapiens
actgactttctc

SEQ ID NO: 358280 - DNA, 18 bp, Homo sapiens
actgactttttcccccca

SEQ ID NO: 358281 - DNA, 19 bp, Homo sapiens
actgagaggaggggtaaat

SEQ ID NO: 358282 - DNA, 22 bp, Homo sapiens
actgagaggaggggtaaatata

SEQ ID NO: 358283 - DNA, 23 bp, Homo sapiens
actgagagggcaatctttgcctt

SEQ ID NO: 358284 - DNA, 17 bp, Homo sapiens
actgagattttggtatt

SEQ ID NO: 358285 - DNA, 13 bp, Homo sapiens
actgagcagactg

SEQ ID NO: 358286 - DNA, 23 bp, Homo sapiens
actgagcagactggtgagcagac

SEQ ID NO: 358287 - DNA, 15 bp, Homo sapiens
actgaggcacgagca

SEQ ID NO: 358288 - DNA, 20 bp, Homo sapiens
actgaggcatttttactact

SEQ ID NO: 358289 - DNA, 22 bp, Homo sapiens
actgaggcatttttactactat

SEQ ID NO: 358290 - DNA, 20 bp, Homo sapiens
actgaggcccagagagctga

SEQ ID NO: 358291 - DNA, 19 bp, Homo sapiens
actgaggcttagagagagg

SEQ ID NO: 358292 - DNA, 22 bp, Homo sapiens
actgagggaccaactgggccca

SEQ ID NO: 358293 - DNA, 12 bp, Homo sapiens
actgagggccac

SEQ ID NO: 358294 - DNA, 22 bp, Homo sapiens
actgagggccacactattacca

SEQ ID NO: 358295 - DNA, 22 bp, Homo sapiens
actgagtctgtggacactgtgg

SEQ ID NO: 358296 - DNA, 11 bp, Homo sapiens
actgagtgcct

SEQ ID NO: 358297 - DNA, 19 bp, Homo sapiens
actgagttagaatgttgaa

SEQ ID NO: 358298 - DNA, 13 bp, Homo sapiens
actgagtttgtgg

SEQ ID NO: 358299 - DNA, 21 bp, Homo sapiens
actgataacttggggaggcaa

SEQ ID NO: 358300 - DNA, 20 bp, Homo sapiens
actgatatcacgggcccgct

SEQ ID NO: 358301 - DNA, 15 bp, Homo sapiens
actgatcatgcattg

SEQ ID NO: 358302 - DNA, 16 bp, Homo sapiens
actgatcatgcattgt

SEQ ID NO: 358303 - DNA, 17 bp, Homo sapiens
actgatcatgcattgtt

SEQ ID NO: 358304 - DNA, 17 bp, Homo sapiens
actgatctctactacca

SEQ ID NO: 358305 - DNA, 14 bp, Homo sapiens
actgatgagacaac

SEQ ID NO: 358306 - DNA, 20 bp, Homo sapiens
actgatgatagacttcgaaa

SEQ ID NO: 358307 - DNA, 15 bp, Homo sapiens
actgatgctgagatt

SEQ ID NO: 358308 - DNA, 21 bp, Homo sapiens
actgatggaccgggtgggcct

SEQ ID NO: 358309 - DNA, 22 bp, Homo sapiens
actgatggaccgggtgggcctg

SEQ ID NO: 358310 - DNA, 21 bp, Homo sapiens
actgatgggtcctgctgctcg

SEQ ID NO: 358311 - DNA, 22 bp, Homo sapiens
actgatgttaggctgggcccag

SEQ ID NO: 358312 - DNA, 14 bp, Homo sapiens
actgatttcctttg

SEQ ID NO: 358313 - DNA, 14 bp, Homo sapiens
actgatttttgtga

SEQ ID NO: 358314 - DNA, 15 bp, Homo sapiens
actgatttttgtgat

SEQ ID NO: 358315 - DNA, 16 bp, Homo sapiens
actgcaacctctgcct

SEQ ID NO: 358316 - DNA, 18 bp, Homo sapiens
actgcaacctctgcctcc

SEQ ID NO: 358317 - DNA, 15 bp, Homo sapiens
actgcacacacagct

SEQ ID NO: 358318 - DNA, 16 bp, Homo sapiens
actgcacacacagctc

SEQ ID NO: 358319 - DNA, 19 bp, Homo sapiens
actgcacacacagctcctc

SEQ ID NO: 358320 - DNA, 16 bp, Homo sapiens
actgcacagtgcatct

SEQ ID NO: 358321 - DNA, 13 bp, Homo sapiens
actgcacagtgct

SEQ ID NO: 358322 - DNA, 20 bp, Homo sapiens
actgcacagtgctgttggtg

SEQ ID NO: 358323 - DNA, 22 bp, Homo sapiens
actgcacccagcatcaccagct

SEQ ID NO: 358324 - DNA, 14 bp, Homo sapiens
actgcacccagctc

SEQ ID NO: 358325 - DNA, 22 bp, Homo sapiens
agaaataaatagctatatccat

SEQ ID NO: 358326 - DNA, 17 bp, Homo sapiens
agaaataagtggttatt

SEQ ID NO: 358327 - DNA, 15 bp, Homo sapiens
agaaatagcaagaga

SEQ ID NO: 358328 - DNA, 15 bp, Homo sapiens
agaaatatgatttta

SEQ ID NO: 358329 - DNA, 13 bp, Homo sapiens
agaaatcaatttt

SEQ ID NO: 358330 - DNA, 14 bp, Homo sapiens
agaaatcagaggag

SEQ ID NO: 358331 - DNA, 22 bp, Homo sapiens
agaaatcattgtagaaacacag

SEQ ID NO: 358332 - DNA, 13 bp, Homo sapiens
agaaatccagatc

SEQ ID NO: 358333 - DNA, 16 bp, Homo sapiens
agaaatccatatctta

SEQ ID NO: 358334 - DNA, 18 bp, Homo sapiens
agaaatcgccttatgaga

SEQ ID NO: 358335 - DNA, 14 bp, Homo sapiens
agaaatgaggaaga

SEQ ID NO: 358336 - DNA, 16 bp, Homo sapiens
agaaatgaggaagaat

SEQ ID NO: 358337 - DNA, 21 bp, Homo sapiens
agaaatgctaatgtaatcatt

SEQ ID NO: 358338 - DNA, 22 bp, Homo sapiens
agaaatgctaatgtaatcattt

SEQ ID NO: 358339 - DNA, 22 bp, Homo sapiens
agaaatgctgcctgcctgtctg

SEQ ID NO: 358340 - DNA, 21 bp, Homo sapiens
agaaatggggaattctctaat

SEQ ID NO: 358341 - DNA, 12 bp, Homo sapiens
agaaatgtattt

SEQ ID NO: 358342 - DNA, 23 bp, Homo sapiens
agaaatgtattttgaaaacactt

SEQ ID NO: 358343 - DNA, 19 bp, Homo sapiens
agaaatgtgctgcaaagag

SEQ ID NO: 358344 - DNA, 16 bp, Homo sapiens
agaaatgttgttcatt

SEQ ID NO: 358345 - DNA, 12 bp, Homo sapiens
agaaattacaag

SEQ ID NO: 358346 - DNA, 21 bp, Homo sapiens
agaaattacaagtttcagtaa

SEQ ID NO: 358347 - DNA, 13 bp, Homo sapiens
agaaattagggct

SEQ ID NO: 358348 - DNA, 20 bp, Homo sapiens
agaaattagggctctaattt

SEQ ID NO: 358349 - DNA, 23 bp, Homo sapiens
agaaattagggctctaatttcct

SEQ ID NO: 358350 - DNA, 17 bp, Homo sapiens
agaaattatttaataaa

SEQ ID NO: 358351 - DNA, 20 bp, Homo sapiens
agaaattatttaatatgcat

SEQ ID NO: 358352 - DNA, 15 bp, Homo sapiens
agaaattcattaaag

SEQ ID NO: 358353 - DNA, 18 bp, Homo sapiens
agaaattccctggaccag

SEQ ID NO: 358354 - DNA, 23 bp, Homo sapiens
agaaattccctggaccagatgct

SEQ ID NO: 358355 - DNA, 20 bp, Homo sapiens
agaaattcttcaatttgaaa

SEQ ID NO: 358356 - DNA, 20 bp, Homo sapiens
agaaattgcatttcctgaca

SEQ ID NO: 358357 - DNA, 17 bp, Homo sapiens
agaaattgcctccagtc

SEQ ID NO: 358358 - DNA, 15 bp, Homo sapiens
agaaattgcctcctt

SEQ ID NO: 358359 - DNA, 15 bp, Homo sapiens
agaaatttgatttct

SEQ ID NO: 358360 - DNA, 15 bp, Homo sapiens
agaaattttatctct

SEQ ID NO: 358361 - DNA, 14 bp, Homo sapiens
agaaatttttatca

SEQ ID NO: 358362 - DNA, 16 bp, Homo sapiens
agaaatttttatcagt

SEQ ID NO: 358363 - DNA, 13 bp, Homo sapiens
agaaatttttatt

SEQ ID NO: 358364 - DNA, 22 bp, Homo sapiens
agaaatttttatttttctaagg

SEQ ID NO: 358365 - DNA, 16 bp, Homo sapiens
agaaatttttttccag

SEQ ID NO: 358366 - DNA, 17 bp, Homo sapiens
agaaatttttttccaga

SEQ ID NO: 358367 - DNA, 18 bp, Homo sapiens
agaaatttttttccagaa

SEQ ID NO: 358368 - DNA, 10 bp, Homo sapiens
agaacaaaaa

SEQ ID NO: 358369 - DNA, 20 bp, Homo sapiens
agaacaaaacctcttctgta

SEQ ID NO: 358370 - DNA, 19 bp, Homo sapiens
agaacaaacctctatatgt

SEQ ID NO: 358371 - DNA, 12 bp, Homo sapiens
agaacaacaaca

SEQ ID NO: 358372 - DNA, 22 bp, Homo sapiens
agaacaacaacaaagcatgctc

SEQ ID NO: 358373 - DNA, 23 bp, Homo sapiens
agaacaacaacaaagcatgctca

SEQ ID NO: 358374 - DNA, 19 bp, Homo sapiens
agaacaaggtagtttttac

SEQ ID NO: 358375 - DNA, 21 bp, Homo sapiens
agaacaagtcacagctgcagc

SEQ ID NO: 358376 - DNA, 23 bp, Homo sapiens
agaacaagtcacagctgcagctg

SEQ ID NO: 358377 - DNA, 13 bp, Homo sapiens
agaacaatcacta

SEQ ID NO: 358378 - DNA, 16 bp, Homo sapiens
agaacaatcactattc

SEQ ID NO: 358379 - DNA, 15 bp, Homo sapiens
agaacacaaagcggg

SEQ ID NO: 358380 - DNA, 15 bp, Homo sapiens
agaacacagcatgtg

SEQ ID NO: 358381 - DNA, 18 bp, Homo sapiens
agaacacagcatgtgcca

SEQ ID NO: 358382 - DNA, 21 bp, Homo sapiens
agaacaccccgctctggcagt

SEQ ID NO: 358383 - DNA, 22 bp, Homo sapiens
agaacaccccgctctggcagta

SEQ ID NO: 358384 - DNA, 11 bp, Homo sapiens
agaacagaaaa

SEQ ID NO: 358385 - DNA, 19 bp, Homo sapiens
agaacagataatcagtgtg

SEQ ID NO: 358386 - DNA, 18 bp, Homo sapiens
agaacagatctccaaagc

SEQ ID NO: 358387 - DNA, 16 bp, Homo sapiens
agaacagatggctgtg

SEQ ID NO: 358388 - DNA, 13 bp, Homo sapiens
agaacagggatgc

SEQ ID NO: 358389 - DNA, 20 bp, Homo sapiens
agaacagttaagcagccgcc

SEQ ID NO: 358390 - DNA, 13 bp, Homo sapiens
agaacatcaagat

SEQ ID NO: 358391 - DNA, 19 bp, Homo sapiens
agaacatctgccttgctgc

SEQ ID NO: 358392 - DNA, 18 bp, Homo sapiens
agaacatggtgtgtgtct

SEQ ID NO: 358393 - DNA, 21 bp, Homo sapiens
agaacatggtgtgtgtctctg

SEQ ID NO: 358394 - DNA, 17 bp, Homo sapiens
agaacatttctcatgtg

SEQ ID NO: 358395 - DNA, 18 bp, Homo sapiens
agaaccaaaaagaggcta

SEQ ID NO: 358396 - DNA, 21 bp, Homo sapiens
agaaccaaaaagaggctatgt

SEQ ID NO: 358397 - DNA, 17 bp, Homo sapiens
agaaccaacgggtctgt

SEQ ID NO: 358398 - DNA, 21 bp, Homo sapiens
agaaccaagcttgtctttaaa

SEQ ID NO: 358399 - DNA, 16 bp, Homo sapiens
agaaccagcactccca

SEQ ID NO: 358400 - DNA, 22 bp, Homo sapiens
agaaccagcactcccagggccc

SEQ ID NO: 358401 - DNA, 19 bp, Homo sapiens
agaaccagtgtctgaacca

SEQ ID NO: 358402 - DNA, 22 bp, Homo sapiens
agaaccatccctattttgtatt

SEQ ID NO: 358403 - DNA, 10 bp, Homo sapiens
agaaccatct

SEQ ID NO: 358404 - DNA, 18 bp, Homo sapiens
agaaccccaactcccagc

SEQ ID NO: 358405 - DNA, 20 bp, Homo sapiens
agaaccctggtgaggaagct

SEQ ID NO: 358406 - DNA, 22 bp, Homo sapiens
agaaccctggtgaggaagctcc

SEQ ID NO: 358407 - DNA, 15 bp, Homo sapiens
agaacccttctgctt

SEQ ID NO: 358408 - DNA, 16 bp, Homo sapiens
agaaccgagcaaagat

SEQ ID NO: 358409 - DNA, 18 bp, Homo sapiens
agaaccgagcaaagatca

SEQ ID NO: 358410 - DNA, 21 bp, Homo sapiens
agaaccgagcaaagatcaaaa

SEQ ID NO: 358411 - DNA, 20 bp, Homo sapiens
agaacctcgttgacatgcac

SEQ ID NO: 358412 - DNA, 13 bp, Homo sapiens
agaaccttctaat

SEQ ID NO: 358413 - DNA, 13 bp, Homo sapiens
agaacctttgtca

SEQ ID NO: 358414 - DNA, 15 bp, Homo sapiens
agaacgccagtctcc

SEQ ID NO: 358415 - DNA, 15 bp, Homo sapiens
agaacgggcctcccc

SEQ ID NO: 358416 - DNA, 21 bp, Homo sapiens
agaacgtgtttaattaaattt

SEQ ID NO: 358417 - DNA, 14 bp, Homo sapiens
agaactaaatagat

SEQ ID NO: 358418 - DNA, 20 bp, Homo sapiens
agaactaaatagatttttag

SEQ ID NO: 358419 - DNA, 19 bp, Homo sapiens
agaactaacagaggagaaa

SEQ ID NO: 358420 - DNA, 16 bp, Homo sapiens
agaactcagcagttga

SEQ ID NO: 358421 - DNA, 18 bp, Homo sapiens
agaactccttattttgta

SEQ ID NO: 358422 - DNA, 19 bp, Homo sapiens
agaactccttattttgtat

SEQ ID NO: 358423 - DNA, 14 bp, Homo sapiens
agaactctcagact

SEQ ID NO: 358424 - DNA, 21 bp, Homo sapiens
agaactctcagactctaaaca

SEQ ID NO: 358425 - DNA, 15 bp, Homo sapiens
agaactctctagttc

SEQ ID NO: 358426 - DNA, 23 bp, Homo sapiens
agaactctctgtcttctctccac

SEQ ID NO: 358427 - DNA, 21 bp, Homo sapiens
agaactctgggcacttttgaa

SEQ ID NO: 358428 - DNA, 20 bp, Homo sapiens
agaactctgggctgccatgt

SEQ ID NO: 358429 - DNA, 17 bp, Homo sapiens
agaactgaaaacataaa

SEQ ID NO: 358430 - DNA, 21 bp, Homo sapiens
agaactgaaaacataaaaagt

SEQ ID NO: 358431 - DNA, 22 bp, Homo sapiens
agaactgaaggggagttttcac

SEQ ID NO: 358432 - DNA, 16 bp, Homo sapiens
agaactgcatggacct

SEQ ID NO: 358433 - DNA, 15 bp, Homo sapiens
actcactccagccca

SEQ ID NO: 358434 - DNA, 18 bp, Homo sapiens
actcactcttatgaaatg

SEQ ID NO: 358435 - DNA, 15 bp, Homo sapiens
actcactgctcaaga

SEQ ID NO: 358436 - DNA, 12 bp, Homo sapiens
actcactgtgct

SEQ ID NO: 358437 - DNA, 14 bp, Homo sapiens
actcagaatattgc

SEQ ID NO: 358438 - DNA, 15 bp, Homo sapiens
actcagacattccaa

SEQ ID NO: 358439 - DNA, 12 bp, Homo sapiens
actcagagcaga

SEQ ID NO: 358440 - DNA, 14 bp, Homo sapiens
actcagagggagga

SEQ ID NO: 358441 - DNA, 15 bp, Homo sapiens
actcagatcactact

SEQ ID NO: 358442 - DNA, 17 bp, Homo sapiens
actcagatcactactgc

SEQ ID NO: 358443 - DNA, 18 bp, Homo sapiens
actcagatcactactgca

SEQ ID NO: 358444 - DNA, 21 bp, Homo sapiens
actcagatcactactgcagtc

SEQ ID NO: 358445 - DNA, 13 bp, Homo sapiens
actcagcagttga

SEQ ID NO: 358446 - DNA, 19 bp, Homo sapiens
actcagcttggttcctgcc

SEQ ID NO: 358447 - DNA, 21 bp, Homo sapiens
actcagcttggttcctgcccc

SEQ ID NO: 358448 - DNA, 22 bp, Homo sapiens
actcaggatttaaaaactggaa

SEQ ID NO: 358449 - DNA, 14 bp, Homo sapiens
actcaggcccacat

SEQ ID NO: 358450 - DNA, 15 bp, Homo sapiens
actcaggcctgccaa

SEQ ID NO: 358451 - DNA, 22 bp, Homo sapiens
actcaggcctgccaatgccaca

SEQ ID NO: 358452 - DNA, 18 bp, Homo sapiens
actcagggccatgcctgc

SEQ ID NO: 358453 - DNA, 15 bp, Homo sapiens
actcagggctggccc

SEQ ID NO: 358454 - DNA, 23 bp, Homo sapiens
actcaggtggtgtccttcttcct

SEQ ID NO: 358455 - DNA, 14 bp, Homo sapiens
actcaggttccaga

SEQ ID NO: 358456 - DNA, 16 bp, Homo sapiens
actcagtcccccacca

SEQ ID NO: 358457 - DNA, 18 bp, Homo sapiens
actcagtcccccaccaca

SEQ ID NO: 358458 - DNA, 22 bp, Homo sapiens
actcagtcccccaccacactga

SEQ ID NO: 358459 - DNA, 11 bp, Homo sapiens
actcagtgttg

SEQ ID NO: 358460 - DNA, 14 bp, Homo sapiens
actcagtgttgact

SEQ ID NO: 358461 - DNA, 14 bp, Homo sapiens
actcagtttgtcag

SEQ ID NO: 358462 - DNA, 19 bp, Homo sapiens
actcagtttgtcagacttt

SEQ ID NO: 358463 - DNA, 21 bp, Homo sapiens
actcataaaaagcctgcaatt

SEQ ID NO: 358464 - DNA, 17 bp, Homo sapiens
actcatacctttaaagg

SEQ ID NO: 358465 - DNA, 23 bp, Homo sapiens
actcatactgtcatataatgcaa

SEQ ID NO: 358466 - DNA, 9 bp, Homo sapiens
actcatcat

SEQ ID NO: 358467 - DNA, 15 bp, Homo sapiens
actcatcataaaata

SEQ ID NO: 358468 - DNA, 23 bp, Homo sapiens
actcatctgttatcctgctagct

SEQ ID NO: 358469 - DNA, 18 bp, Homo sapiens
actcatcttagtgcctga

SEQ ID NO: 358470 - DNA, 16 bp, Homo sapiens
actcatgcggcccagc

SEQ ID NO: 358471 - DNA, 23 bp, Homo sapiens
actcatgcggcccagccatgggc

SEQ ID NO: 358472 - DNA, 13 bp, Homo sapiens
actcattaatttc

SEQ ID NO: 358473 - DNA, 21 bp, Homo sapiens
actcattttattcactaagct

SEQ ID NO: 358474 - DNA, 15 bp, Homo sapiens
actcatttttgccat

SEQ ID NO: 358475 - DNA, 17 bp, Homo sapiens
actccaaggcaaatgtc

SEQ ID NO: 358476 - DNA, 15 bp, Homo sapiens
actccactcccctca

SEQ ID NO: 358477 - DNA, 16 bp, Homo sapiens
actccactgacctgga

SEQ ID NO: 358478 - DNA, 16 bp, Homo sapiens
actccagaatctgctg

SEQ ID NO: 358479 - DNA, 17 bp, Homo sapiens
actccagaatctgctgt

SEQ ID NO: 358480 - DNA, 15 bp, Homo sapiens
actccagaatttccc

SEQ ID NO: 358481 - DNA, 23 bp, Homo sapiens
actccagaatttcccaaagcagt

SEQ ID NO: 358482 - DNA, 19 bp, Homo sapiens
actccagacccctggcttt

SEQ ID NO: 358483 - DNA, 21 bp, Homo sapiens
actccagccacccagccagga

SEQ ID NO: 358484 - DNA, 17 bp, Homo sapiens
actccaggaaaactgtt

SEQ ID NO: 358485 - DNA, 21 bp, Homo sapiens
actccaggatcctcctggagc

SEQ ID NO: 358486 - DNA, 18 bp, Homo sapiens
aattatgtaatgcaaaat

SEQ ID NO: 358487 - DNA, 14 bp, Homo sapiens
aattatgtcaaatg

SEQ ID NO: 358488 - DNA, 19 bp, Homo sapiens
aattatgtcaaatggatgt

SEQ ID NO: 358489 - DNA, 12 bp, Homo sapiens
aattatgtgaca

SEQ ID NO: 358490 - DNA, 13 bp, Homo sapiens
aattatgtgacaa

SEQ ID NO: 358491 - DNA, 23 bp, Homo sapiens
aattattaactacatttatgagt

SEQ ID NO: 358492 - DNA, 16 bp, Homo sapiens
aattattacatcttta

SEQ ID NO: 358493 - DNA, 18 bp, Homo sapiens
aattattacatttataca

SEQ ID NO: 358494 - DNA, 13 bp, Homo sapiens
aattattacttta

SEQ ID NO: 358495 - DNA, 16 bp, Homo sapiens
aattattactttaaat

SEQ ID NO: 358496 - DNA, 23 bp, Homo sapiens
aattattactttaaattatatga

SEQ ID NO: 358497 - DNA, 18 bp, Homo sapiens
aattattatttatatatg

SEQ ID NO: 358498 - DNA, 17 bp, Homo sapiens
aattattcagttaagaa

SEQ ID NO: 358499 - DNA, 16 bp, Homo sapiens
aattattccctgaatt

SEQ ID NO: 358500 - DNA, 16 bp, Homo sapiens
aattattgtaaacttt

SEQ ID NO: 358501 - DNA, 21 bp, Homo sapiens
aattattgtaaactttttcaa

SEQ ID NO: 358502 - DNA, 17 bp, Homo sapiens
aattatttaaagaaagt

SEQ ID NO: 358503 - DNA, 17 bp, Homo sapiens
aattatttaactaatta

SEQ ID NO: 358504 - DNA, 16 bp, Homo sapiens
aattatttaatatgca

SEQ ID NO: 358505 - DNA, 19 bp, Homo sapiens
aattatttatttaataaca

SEQ ID NO: 358506 - DNA, 18 bp, Homo sapiens
aattattttaaattataa

SEQ ID NO: 358507 - DNA, 20 bp, Homo sapiens
aattattttgaatgtcacaa

SEQ ID NO: 358508 - DNA, 22 bp, Homo sapiens
aattattttgaatgtcacaaat

SEQ ID NO: 358509 - DNA, 23 bp, Homo sapiens
aattattttgagtggcaaaataa

SEQ ID NO: 358510 - DNA, 18 bp, Homo sapiens
aattcaaagcatgtcaag

SEQ ID NO: 358511 - DNA, 15 bp, Homo sapiens
aattcacaaagttaa

SEQ ID NO: 358512 - DNA, 16 bp, Homo sapiens
aattcacaagctgcct

SEQ ID NO: 358513 - DNA, 15 bp, Homo sapiens
aattcagcaccctgg

SEQ ID NO: 358514 - DNA, 15 bp, Homo sapiens
aattcagcactgatt

SEQ ID NO: 358515 - DNA, 20 bp, Homo sapiens
aattcagcactgatttcaca

SEQ ID NO: 358516 - DNA, 16 bp, Homo sapiens
aattcatacctccctc

SEQ ID NO: 358517 - DNA, 21 bp, Homo sapiens
aattcatctagttaagtcgct

SEQ ID NO: 358518 - DNA, 17 bp, Homo sapiens
aattcattaaaagtttt

SEQ ID NO: 358519 - DNA, 18 bp, Homo sapiens
aattcattaaagaaaaac

SEQ ID NO: 358520 - DNA, 23 bp, Homo sapiens
aattccatccctaagaattccca

SEQ ID NO: 358521 - DNA, 20 bp, Homo sapiens
aattccatttacttgatcat

SEQ ID NO: 358522 - DNA, 23 bp, Homo sapiens
aattcccagatagtcccagcagc

SEQ ID NO: 358523 - DNA, 17 bp, Homo sapiens
aattccccttcccttat

SEQ ID NO: 358524 - DNA, 13 bp, Homo sapiens
aattccctggacc

SEQ ID NO: 358525 - DNA, 15 bp, Homo sapiens
aattcctcatttgtt

SEQ ID NO: 358526 - DNA, 14 bp, Homo sapiens
aattcctctgggaa

SEQ ID NO: 358527 - DNA, 17 bp, Homo sapiens
aattcctttacaactaa

SEQ ID NO: 358528 - DNA, 21 bp, Homo sapiens
aattcctttacaactaaataa

SEQ ID NO: 358529 - DNA, 19 bp, Homo sapiens
aattctaaatgaatgttta

SEQ ID NO: 358530 - DNA, 19 bp, Homo sapiens
aattctaagattgtacata

SEQ ID NO: 358531 - DNA, 17 bp, Homo sapiens
actcctgcctgtgtttg

SEQ ID NO: 358532 - DNA, 22 bp, Homo sapiens
actcctggcctcaagccatctt

SEQ ID NO: 358533 - DNA, 21 bp, Homo sapiens
actcctggtctgaaaatgttg

SEQ ID NO: 358534 - DNA, 18 bp, Homo sapiens
actcctgtacactgaata

SEQ ID NO: 358535 - DNA, 21 bp, Homo sapiens
actcctgtcccgccttcctcc

SEQ ID NO: 358536 - DNA, 16 bp, Homo sapiens
actcctgtgtgtggaa

SEQ ID NO: 358537 - DNA, 16 bp, Homo sapiens
actcctgttacttacc

SEQ ID NO: 358538 - DNA, 17 bp, Homo sapiens
actcctgttacttacct

SEQ ID NO: 358539 - DNA, 18 bp, Homo sapiens
actccttcctctttgctt

SEQ ID NO: 358540 - DNA, 16 bp, Homo sapiens
actccttctccccaat

SEQ ID NO: 358541 - DNA, 19 bp, Homo sapiens
actccttggatttgcattt

SEQ ID NO: 358542 - DNA, 17 bp, Homo sapiens
actcctttcctgcatct

SEQ ID NO: 358543 - DNA, 17 bp, Homo sapiens
actcgactctgctgctc

SEQ ID NO: 358544 - DNA, 20 bp, Homo sapiens
actcgagaccatcctggccc

SEQ ID NO: 358545 - DNA, 21 bp, Homo sapiens
actcgagagggctgagcccct

SEQ ID NO: 358546 - DNA, 22 bp, Homo sapiens
actcgagagggctgagcccctc

SEQ ID NO: 358547 - DNA, 23 bp, Homo sapiens
actcgagagggctgagcccctcc

SEQ ID NO: 358548 - DNA, 16 bp, Homo sapiens
actcgagttacagaca

SEQ ID NO: 358549 - DNA, 23 bp, Homo sapiens
actcgatgcaagtgtttctgttc

SEQ ID NO: 358550 - DNA, 13 bp, Homo sapiens
actcgatgcactg

SEQ ID NO: 358551 - DNA, 14 bp, Homo sapiens
actcgatgcactga

SEQ ID NO: 358552 - DNA, 15 bp, Homo sapiens
actcgcactgcaaat

SEQ ID NO: 358553 - DNA, 16 bp, Homo sapiens
actcgcagtcgcagga

SEQ ID NO: 358554 - DNA, 17 bp, Homo sapiens
actcgcccgcccactgt

SEQ ID NO: 358555 - DNA, 20 bp, Homo sapiens
actcgcccgcccactgtcct

SEQ ID NO: 358556 - DNA, 21 bp, Homo sapiens
actcgtctgatgttttgatgc

SEQ ID NO: 358557 - DNA, 13 bp, Homo sapiens
actcgtcttggca

SEQ ID NO: 358558 - DNA, 14 bp, Homo sapiens
actcgttctcgtga

SEQ ID NO: 358559 - DNA, 18 bp, Homo sapiens
actcgttctcgtgaccca

SEQ ID NO: 358560 - DNA, 22 bp, Homo sapiens
actcgttctcgtgacccagtgg

SEQ ID NO: 358561 - DNA, 20 bp, Homo sapiens
actctaaacacacaagtaga

SEQ ID NO: 358562 - DNA, 16 bp, Homo sapiens
actctaaatgcagttt

SEQ ID NO: 358563 - DNA, 21 bp, Homo sapiens
actctaaatgcagttttaaga

SEQ ID NO: 358564 - DNA, 22 bp, Homo sapiens
actctaaatgcagttttaagaa

SEQ ID NO: 358565 - DNA, 14 bp, Homo sapiens
actctaatagtgct

SEQ ID NO: 358566 - DNA, 19 bp, Homo sapiens
actctaattggtcattcct

SEQ ID NO: 358567 - DNA, 16 bp, Homo sapiens
actctacactgtgaac

SEQ ID NO: 358568 - DNA, 16 bp, Homo sapiens
actctacccctgctcc

SEQ ID NO: 358569 - DNA, 18 bp, Homo sapiens
actctacccctgctccca

SEQ ID NO: 358570 - DNA, 19 bp, Homo sapiens
actctacccctgctcccat

SEQ ID NO: 358571 - DNA, 18 bp, Homo sapiens
actctaccctcccacccc

SEQ ID NO: 358572 - DNA, 15 bp, Homo sapiens
actctacgccaaagt

SEQ ID NO: 358573 - DNA, 22 bp, Homo sapiens
actctacgccaaagtgcagccc

SEQ ID NO: 358574 - DNA, 19 bp, Homo sapiens
actctagaaaacgcgacct

SEQ ID NO: 358575 - DNA, 21 bp, Homo sapiens
actctaggggtcaggctccat

SEQ ID NO: 358576 - DNA, 20 bp, Homo sapiens
actctagtgacttcctggtg

SEQ ID NO: 358577 - DNA, 22 bp, Homo sapiens
actctagtgacttcctggtgag

SEQ ID NO: 358578 - DNA, 13 bp, Homo sapiens
actctagtgccat

SEQ ID NO: 358579 - DNA, 17 bp, Homo sapiens
actctagttctagatga

SEQ ID NO: 358580 - DNA, 15 bp, Homo sapiens
actctatagactcta

SEQ ID NO: 358581 - DNA, 15 bp, Homo sapiens
actctatctgggcct

SEQ ID NO: 358582 - DNA, 23 bp, Homo sapiens
actctatgggtatcaaacagctc

SEQ ID NO: 358583 - DNA, 19 bp, Homo sapiens
actctcaaaagtctatttt

SEQ ID NO: 358584 - DNA, 18 bp, Homo sapiens
actctcagagactcccag

SEQ ID NO: 358585 - DNA, 11 bp, Homo sapiens
actctcaggga

SEQ ID NO: 358586 - DNA, 16 bp, Homo sapiens
actctccaatgttcta

SEQ ID NO: 358587 - DNA, 18 bp, Homo sapiens
actctccaggattgtcca

SEQ ID NO: 358588 - DNA, 10 bp, Homo sapiens
actctcccca

SEQ ID NO: 358589 - DNA, 14 bp, Homo sapiens
actctccccagtgc

SEQ ID NO: 358590 - DNA, 16 bp, Homo sapiens
actctccccagtgcct

SEQ ID NO: 358591 - DNA, 21 bp, Homo sapiens
actctccccagtgcctgccac

SEQ ID NO: 358592 - DNA, 21 bp, Homo sapiens
actctcctagagacagaagca

SEQ ID NO: 358593 - DNA, 14 bp, Homo sapiens
actctcctcctccc

SEQ ID NO: 358594 - DNA, 17 bp, Homo sapiens
actctcctcctcccctc

SEQ ID NO: 358595 - DNA, 19 bp, Homo sapiens
actctcctgctcctcagga

SEQ ID NO: 358596 - DNA, 12 bp, Homo sapiens
actctcctgggc

SEQ ID NO: 358597 - DNA, 22 bp, Homo sapiens
actctcctttgatattatgtgg

SEQ ID NO: 358598 - DNA, 23 bp, Homo sapiens
actctcggggcccttggggcctg

SEQ ID NO: 358599 - DNA, 14 bp, Homo sapiens
actctctgccagct

SEQ ID NO: 358600 - DNA, 16 bp, Homo sapiens
actctctgccagctcc

SEQ ID NO: 358601 - DNA, 18 bp, Homo sapiens
actctctgccagctccac

SEQ ID NO: 358602 - DNA, 21 bp, Homo sapiens
actctctgccagctccacagg

SEQ ID NO: 358603 - DNA, 12 bp, Homo sapiens
actctctgccca

SEQ ID NO: 358604 - DNA, 14 bp, Homo sapiens
actctctgctctag

SEQ ID NO: 358605 - DNA, 12 bp, Homo sapiens
actctctgggac

SEQ ID NO: 358606 - DNA, 13 bp, Homo sapiens
actctctgggact

SEQ ID NO: 358607 - DNA, 17 bp, Homo sapiens
actctctgtcttctctc

SEQ ID NO: 358608 - DNA, 20 bp, Homo sapiens
actctcttcttactgtattt

SEQ ID NO: 358609 - DNA, 18 bp, Homo sapiens
actctctttcttccacta

SEQ ID NO: 358610 - DNA, 15 bp, Homo sapiens
actctgaaaaacatt

SEQ ID NO: 358611 - DNA, 23 bp, Homo sapiens
actctgaaaagcaattgccctgt

SEQ ID NO: 358612 - DNA, 9 bp, Homo sapiens
actctgaac

SEQ ID NO: 358613 - DNA, 11 bp, Homo sapiens
actctgagccc

SEQ ID NO: 358614 - DNA, 15 bp, Homo sapiens
actctgagcccaggc

SEQ ID NO: 358615 - DNA, 16 bp, Homo sapiens
actctgagcccaggcc

SEQ ID NO: 358616 - DNA, 17 bp, Homo sapiens
actctgagcccaggccg

SEQ ID NO: 358617 - DNA, 18 bp, Homo sapiens
actctgagcccaggccgt

SEQ ID NO: 358618 - DNA, 20 bp, Homo sapiens
actctgagtccactgctcca

SEQ ID NO: 358619 - DNA, 21 bp, Homo sapiens
actctgcaactgaatacttga

SEQ ID NO: 358620 - DNA, 11 bp, Homo sapiens
actctgcactc

SEQ ID NO: 358621 - DNA, 21 bp, Homo sapiens
actggctttgtcccacagctt

SEQ ID NO: 358622 - DNA, 22 bp, Homo sapiens
actgggagccacttctccccag

SEQ ID NO: 358623 - DNA, 14 bp, Homo sapiens
actgggagtcagag

SEQ ID NO: 358624 - DNA, 18 bp, Homo sapiens
actgggagtcagagccct

SEQ ID NO: 358625 - DNA, 21 bp, Homo sapiens
actgggagtcagagccctggc

SEQ ID NO: 358626 - DNA, 16 bp, Homo sapiens
actgggattcatggct

SEQ ID NO: 358627 - DNA, 21 bp, Homo sapiens
actgggccttgtgtgctggct

SEQ ID NO: 358628 - DNA, 20 bp, Homo sapiens
actgggctaatttgtatgtt

SEQ ID NO: 358629 - DNA, 15 bp, Homo sapiens
actggggagtgctgg

SEQ ID NO: 358630 - DNA, 22 bp, Homo sapiens
actggggatcccgtgctggaag

SEQ ID NO: 358631 - DNA, 21 bp, Homo sapiens
actggggattgggtgggcagg

SEQ ID NO: 358632 - DNA, 13 bp, Homo sapiens
actggggctgggg

SEQ ID NO: 358633 - DNA, 22 bp, Homo sapiens
actggggctggggtgagagagg

SEQ ID NO: 358634 - DNA, 19 bp, Homo sapiens
actgggggactgggagtca

SEQ ID NO: 358635 - DNA, 13 bp, Homo sapiens
actgggggcctct

SEQ ID NO: 358636 - DNA, 16 bp, Homo sapiens
actgggggcctctgcc

SEQ ID NO: 358637 - DNA, 18 bp, Homo sapiens
actgggggcctctgcctc

SEQ ID NO: 358638 - DNA, 19 bp, Homo sapiens
actgggggcctctgcctcc

SEQ ID NO: 358639 - DNA, 17 bp, Homo sapiens
actggggtaccacatgg

SEQ ID NO: 358640 - DNA, 19 bp, Homo sapiens
actggggtaccacatggtc

SEQ ID NO: 358641 - DNA, 14 bp, Homo sapiens
actgggttcttgtt

SEQ ID NO: 358642 - DNA, 17 bp, Homo sapiens
actggtcatcagtattg

SEQ ID NO: 358643 - DNA, 21 bp, Homo sapiens
actggtccaggcatgggtccc

SEQ ID NO: 358644 - DNA, 17 bp, Homo sapiens
actggtccaggccaggc

SEQ ID NO: 358645 - DNA, 19 bp, Homo sapiens
actggtccaggccaggcct

SEQ ID NO: 358646 - DNA, 20 bp, Homo sapiens
actggtcctgtgtgcagtga

SEQ ID NO: 358647 - DNA, 12 bp, Homo sapiens
actggtctcaga

SEQ ID NO: 358648 - DNA, 23 bp, Homo sapiens
actggtctcgaactcctggcctc

SEQ ID NO: 358649 - DNA, 21 bp, Homo sapiens
actggtggcccgacagcctgg

SEQ ID NO: 358650 - DNA, 23 bp, Homo sapiens
actggtggcccgacagcctggca

SEQ ID NO: 358651 - DNA, 17 bp, Homo sapiens
actggtggtttttgctc

SEQ ID NO: 358652 - DNA, 20 bp, Homo sapiens
actggttatcctgtgctaca

SEQ ID NO: 358653 - DNA, 14 bp, Homo sapiens
actggttcttgcct

SEQ ID NO: 358654 - DNA, 20 bp, Homo sapiens
actggttcttgccttcccct

SEQ ID NO: 358655 - DNA, 18 bp, Homo sapiens
actggtttgtatgatgta

SEQ ID NO: 358656 - DNA, 21 bp, Homo sapiens
actggtttgtatgatgtatta

SEQ ID NO: 358657 - DNA, 16 bp, Homo sapiens
actgtaaaatgaaatt

SEQ ID NO: 358658 - DNA, 16 bp, Homo sapiens
actgtaaaatgtggga

SEQ ID NO: 358659 - DNA, 22 bp, Homo sapiens
actgtaaaatgtgggattatgg

SEQ ID NO: 358660 - DNA, 14 bp, Homo sapiens
actgtaaacccctg

SEQ ID NO: 358661 - DNA, 17 bp, Homo sapiens
actgtaaggaaatgtta

SEQ ID NO: 358662 - DNA, 21 bp, Homo sapiens
actgtacctgtaggaaacaga

SEQ ID NO: 358663 - DNA, 22 bp, Homo sapiens
actgtacctgtaggaaacagaa

SEQ ID NO: 358664 - DNA, 13 bp, Homo sapiens
actgtactcctcc

SEQ ID NO: 358665 - DNA, 14 bp, Homo sapiens
actgtactcctccc

SEQ ID NO: 358666 - DNA, 22 bp, Homo sapiens
actgtactgagacattacagtt

SEQ ID NO: 358667 - DNA, 12 bp, Homo sapiens
actgtactggcc

SEQ ID NO: 358668 - DNA, 18 bp, Homo sapiens
actgtactggccagtgtc

SEQ ID NO: 358669 - DNA, 22 bp, Homo sapiens
actgtagattgcttctgtagta

SEQ ID NO: 358670 - DNA, 21 bp, Homo sapiens
actgtaggcgcccctggggtg

SEQ ID NO: 358671 - DNA, 20 bp, Homo sapiens
actgtagtttttcttcaaca

SEQ ID NO: 358672 - DNA, 21 bp, Homo sapiens
actgtagtttttcttcaacat

SEQ ID NO: 358673 - DNA, 22 bp, Homo sapiens
actgtatcaaatctgtatatgt

SEQ ID NO: 358674 - DNA, 19 bp, Homo sapiens
actgtatctaaaaaataac

SEQ ID NO: 358675 - DNA, 21 bp, Homo sapiens
actgtatctaaaaaataactg

SEQ ID NO: 358676 - DNA, 23 bp, Homo sapiens
actgtatgtcttataagaaaaca

SEQ ID NO: 358677 - DNA, 14 bp, Homo sapiens
actgtatttctgtg

SEQ ID NO: 358678 - DNA, 15 bp, Homo sapiens
actgtatttctgtgg

SEQ ID NO: 358679 - DNA, 16 bp, Homo sapiens
actgtatttctgtgga

SEQ ID NO: 358680 - DNA, 17 bp, Homo sapiens
actgtatttctgtggaa

SEQ ID NO: 358681 - DNA, 23 bp, Homo sapiens
actgtcaagtcatgatggagact

SEQ ID NO: 358682 - DNA, 14 bp, Homo sapiens
actgtcaataaaca

SEQ ID NO: 358683 - DNA, 20 bp, Homo sapiens
actgtcactgtttctctgct

SEQ ID NO: 358684 - DNA, 17 bp, Homo sapiens
actgtcagagaatatga

SEQ ID NO: 358685 - DNA, 22 bp, Homo sapiens
actgtcagctgagcttgagctc

SEQ ID NO: 358686 - DNA, 17 bp, Homo sapiens
actgtcatgtggcttgg

SEQ ID NO: 358687 - DNA, 22 bp, Homo sapiens
actgtccacttctagctcggaa

SEQ ID NO: 358688 - DNA, 16 bp, Homo sapiens
actgtcccattctcca

SEQ ID NO: 358689 - DNA, 20 bp, Homo sapiens
actgtccgcctctgcccgca

SEQ ID NO: 358690 - DNA, 19 bp, Homo sapiens
actgtcctgggcgccctgg

SEQ ID NO: 358691 - DNA, 20 bp, Homo sapiens
actgtcctgggcgccctgga

SEQ ID NO: 358692 - DNA, 14 bp, Homo sapiens
actgtcctttctcc

SEQ ID NO: 358693 - DNA, 18 bp, Homo sapiens
actgtcctttctccaggc

SEQ ID NO: 358694 - DNA, 19 bp, Homo sapiens
actgtctcaagagggcact

SEQ ID NO: 358695 - DNA, 15 bp, Homo sapiens
actgtctccttccca

SEQ ID NO: 358696 - DNA, 13 bp, Homo sapiens
actgtctggtttt

SEQ ID NO: 358697 - DNA, 18 bp, Homo sapiens
actgtctggttttaacaa

SEQ ID NO: 358698 - DNA, 17 bp, Homo sapiens
actgtctgtaagagaat

SEQ ID NO: 358699 - DNA, 17 bp, Homo sapiens
actgtctgtagtgtttt

SEQ ID NO: 358700 - DNA, 20 bp, Homo sapiens
actgtcttcaaccctgccct

SEQ ID NO: 358701 - DNA, 17 bp, Homo sapiens
actgtcttctccctgca

SEQ ID NO: 358702 - DNA, 13 bp, Homo sapiens
actgtgaaagtat

SEQ ID NO: 358703 - DNA, 20 bp, Homo sapiens
actgtgaaagtatgtgatat

SEQ ID NO: 358704 - DNA, 18 bp, Homo sapiens
actgtgaacctggagggc

SEQ ID NO: 358705 - DNA, 20 bp, Homo sapiens
actgtgaataataaatacac

SEQ ID NO: 358706 - DNA, 14 bp, Homo sapiens
actgtgaccacctt

SEQ ID NO: 358707 - DNA, 17 bp, Homo sapiens
actgtgagataaatatc

SEQ ID NO: 358708 - DNA, 18 bp, Homo sapiens
actgtgaggaagagcagg

SEQ ID NO: 358709 - DNA, 13 bp, Homo sapiens
actgtgatgccac

SEQ ID NO: 358710 - DNA, 23 bp, Homo sapiens
actgtgatgttgggaagctattt

SEQ ID NO: 358711 - DNA, 14 bp, Homo sapiens
actgtgcagagact

SEQ ID NO: 358712 - DNA, 17 bp, Homo sapiens
actgtgcatcaaccagg

SEQ ID NO: 358713 - DNA, 14 bp, Homo sapiens
actgtgcttgctcc

SEQ ID NO: 358714 - DNA, 14 bp, Homo sapiens
actgtggaggtggc

SEQ ID NO: 358715 - DNA, 15 bp, Homo sapiens
actgtggaggtggct

SEQ ID NO: 358716 - DNA, 16 bp, Homo sapiens
actgtggccagagctg

SEQ ID NO: 358717 - DNA, 21 bp, Homo sapiens
actgtggccagagctggaagg

SEQ ID NO: 358718 - DNA, 22 bp, Homo sapiens
actgtggccagagctggaaggc

SEQ ID NO: 358719 - DNA, 19 bp, Homo sapiens
actgtggccccctccgtga

SEQ ID NO: 358720 - DNA, 21 bp, Homo sapiens
actgtggtcccagctacaggg

SEQ ID NO: 358721 - DNA, 14 bp, Homo sapiens
actgtggtcctatg

SEQ ID NO: 358722 - DNA, 15 bp, Homo sapiens
actgtgtaaccagca

SEQ ID NO: 358723 - DNA, 12 bp, Homo sapiens
actgtgtaactg

SEQ ID NO: 358724 - DNA, 15 bp, Homo sapiens
actgtgtaactgccc

SEQ ID NO: 358725 - DNA, 14 bp, Homo sapiens
actgtgtacataat

SEQ ID NO: 358726 - DNA, 18 bp, Homo sapiens
actgtgtatgtacatata

SEQ ID NO: 358727 - DNA, 20 bp, Homo sapiens
actgtgtgtggaggagtcca

SEQ ID NO: 358728 - DNA, 19 bp, Homo sapiens
actgtgtttatatgtcttg

SEQ ID NO: 358729 - DNA, 16 bp, Homo sapiens
actgttaaaggaaaaa

SEQ ID NO: 358730 - DNA, 16 bp, Homo sapiens
actgttaatagtacta

SEQ ID NO: 358731 - DNA, 20 bp, Homo sapiens
actgttagaaaatggacact

SEQ ID NO: 358732 - DNA, 14 bp, Homo sapiens
actgttagatgctg

SEQ ID NO: 358733 - DNA, 17 bp, Homo sapiens
actgttagtattaacta

SEQ ID NO: 358734 - DNA, 16 bp, Homo sapiens
actgttccctccaagg

SEQ ID NO: 358735 - DNA, 18 bp, Homo sapiens
actgttgagttggacaca

SEQ ID NO: 358736 - DNA, 16 bp, Homo sapiens
actgttgcatttactt

SEQ ID NO: 358737 - DNA, 17 bp, Homo sapiens
actgttgcatttacttt

SEQ ID NO: 358738 - DNA, 21 bp, Homo sapiens
actgttgcatttacttttaat

SEQ ID NO: 358739 - DNA, 18 bp, Homo sapiens
actgttgccagagatgga

SEQ ID NO: 358740 - DNA, 15 bp, Homo sapiens
actgttgtgggcgct

SEQ ID NO: 358741 - DNA, 21 bp, Homo sapiens
actgttgtttgatgtgtatgt

SEQ ID NO: 358742 - DNA, 19 bp, Homo sapiens
actgtttatggtattttcg

SEQ ID NO: 358743 - DNA, 22 bp, Homo sapiens
actgtttatttctgtttctcat

SEQ ID NO: 358744 - DNA, 20 bp, Homo sapiens
actgtttcctattaatcttc

SEQ ID NO: 358745 - DNA, 21 bp, Homo sapiens
actgtttcctattaatcttca

SEQ ID NO: 358746 - DNA, 13 bp, Homo sapiens
actgtttctctgc

SEQ ID NO: 358747 - DNA, 22 bp, Homo sapiens
actgtttgccttctacttttaa

SEQ ID NO: 358748 - DNA, 21 bp, Homo sapiens
actgtttggcttataaacaca

SEQ ID NO: 358749 - DNA, 12 bp, Homo sapiens
actgtttgtaat

SEQ ID NO: 358750 - DNA, 13 bp, Homo sapiens
actgtttgtaata

SEQ ID NO: 358751 - DNA, 17 bp, Homo sapiens
actgtttgtaatataca

SEQ ID NO: 358752 - DNA, 17 bp, Homo sapiens
actgttttttcctgagc

SEQ ID NO: 358753 - DNA, 18 bp, Homo sapiens
actgttttttcctgagct

SEQ ID NO: 358754 - DNA, 20 bp, Homo sapiens
actttagggggtgggagggg

SEQ ID NO: 358755 - DNA, 24 bp, Homo sapiens
actttaggtagtagaatctcagca

SEQ ID NO: 358756 - DNA, 17 bp, Homo sapiens
actttataagccaatga

SEQ ID NO: 358757 - DNA, 19 bp, Homo sapiens
actttatttaatttcataa

SEQ ID NO: 358758 - DNA, 20 bp, Homo sapiens
actttatttaatttcataaa

SEQ ID NO: 358759 - DNA, 21 bp, Homo sapiens
actttatttaatttcataaat

SEQ ID NO: 358760 - DNA, 23 bp, Homo sapiens
actttatttaatttcataaattg

SEQ ID NO: 358761 - DNA, 15 bp, Homo sapiens
actttcacatagatg

SEQ ID NO: 358762 - DNA, 21 bp, Homo sapiens
actttcacatagatgtccctt

SEQ ID NO: 358763 - DNA, 16 bp, Homo sapiens
actttcactttgaaaa

SEQ ID NO: 358764 - DNA, 19 bp, Homo sapiens
actttccaccccctccctg

SEQ ID NO: 358765 - DNA, 13 bp, Homo sapiens
actttccatgaca

SEQ ID NO: 358766 - DNA, 15 bp, Homo sapiens
actttccatgacagt

SEQ ID NO: 358767 - DNA, 20 bp, Homo sapiens
actttccatgacagtagcat

SEQ ID NO: 358768 - DNA, 21 bp, Homo sapiens
actttccccatactctgtctc

SEQ ID NO: 358769 - DNA, 19 bp, Homo sapiens
actttccctagaaagccat

SEQ ID NO: 358770 - DNA, 15 bp, Homo sapiens
actttcccttcccct

SEQ ID NO: 358771 - DNA, 15 bp, Homo sapiens
actttcctctctctc

SEQ ID NO: 358772 - DNA, 14 bp, Homo sapiens
actttcctgcaact

SEQ ID NO: 358773 - DNA, 17 bp, Homo sapiens
actttctacacctgttg

SEQ ID NO: 358774 - DNA, 22 bp, Homo sapiens
actttctatagcagattgtgta

SEQ ID NO: 358775 - DNA, 20 bp, Homo sapiens
actttctcttaacttaattt

SEQ ID NO: 358776 - DNA, 19 bp, Homo sapiens
actttctcttcatactttt

SEQ ID NO: 358777 - DNA, 13 bp, Homo sapiens
actttctgatgca

SEQ ID NO: 358778 - DNA, 14 bp, Homo sapiens
actttctgtaaact

SEQ ID NO: 358779 - DNA, 18 bp, Homo sapiens
actttctgtaaactcaaa

SEQ ID NO: 358780 - DNA, 18 bp, Homo sapiens
actttcttctgaatattt

SEQ ID NO: 358781 - DNA, 17 bp, Homo sapiens
actttctttcagatgtt

SEQ ID NO: 358782 - DNA, 20 bp, Homo sapiens
actttcttttcgccgtggct

SEQ ID NO: 358783 - DNA, 14 bp, Homo sapiens
actttgaaaatatt

SEQ ID NO: 358784 - DNA, 20 bp, Homo sapiens
actttgaaaatatttctatg

SEQ ID NO: 358785 - DNA, 22 bp, Homo sapiens
actttgacgagtcaccttccag

SEQ ID NO: 358786 - DNA, 16 bp, Homo sapiens
actttgatctctgctt

SEQ ID NO: 358787 - DNA, 21 bp, Homo sapiens
actttgatttacagtgcctgt

SEQ ID NO: 358788 - DNA, 15 bp, Homo sapiens
actttgcacacttca

SEQ ID NO: 358789 - DNA, 22 bp, Homo sapiens
actttgctggaaaatctgtaaa

SEQ ID NO: 358790 - DNA, 12 bp, Homo sapiens
actttgggaggc

SEQ ID NO: 358791 - DNA, 17 bp, Homo sapiens
actttgtcccctcacct

SEQ ID NO: 358792 - DNA, 17 bp, Homo sapiens
actttgtgcaatatgag

SEQ ID NO: 358793 - DNA, 21 bp, Homo sapiens
actttgtggatgtcttccttg

SEQ ID NO: 358794 - DNA, 20 bp, Homo sapiens
actttgtgtcttttgttctc

SEQ ID NO: 358795 - DNA, 23 bp, Homo sapiens
actttgtgtcttttgttctctct

SEQ ID NO: 358796 - DNA, 20 bp, Homo sapiens
actttgttctttaggagatt

SEQ ID NO: 358797 - DNA, 22 bp, Homo sapiens
agaccctggaattcagcaccct

SEQ ID NO: 358798 - DNA, 12 bp, Homo sapiens
agaccctgtctt

SEQ ID NO: 358799 - DNA, 20 bp, Homo sapiens
agacccttgaagatgtagct

SEQ ID NO: 358800 - DNA, 21 bp, Homo sapiens
agacccttgaagatgtagctt

SEQ ID NO: 358801 - DNA, 16 bp, Homo sapiens
agacccttgcattaga

SEQ ID NO: 358802 - DNA, 17 bp, Homo sapiens
agacccttgcattagaa

SEQ ID NO: 358803 - DNA, 17 bp, Homo sapiens
agacccttttgggtttc

SEQ ID NO: 358804 - DNA, 18 bp, Homo sapiens
agaccgagtgtggagctg

SEQ ID NO: 358805 - DNA, 16 bp, Homo sapiens
agaccgatccttccca

SEQ ID NO: 358806 - DNA, 14 bp, Homo sapiens
agaccgcagaggga

SEQ ID NO: 358807 - DNA, 18 bp, Homo sapiens
agaccgcttcacccctgc

SEQ ID NO: 358808 - DNA, 18 bp, Homo sapiens
agaccgtcgggggctgag

SEQ ID NO: 358809 - DNA, 19 bp, Homo sapiens
agacctaatatcattttat

SEQ ID NO: 358810 - DNA, 18 bp, Homo sapiens
agacctaatgctccttgt

SEQ ID NO: 358811 - DNA, 15 bp, Homo sapiens
agacctacattccct

SEQ ID NO: 358812 - DNA, 23 bp, Homo sapiens
agacctacattccctctcctgcc

SEQ ID NO: 358813 - DNA, 14 bp, Homo sapiens
agacctatgataaa

SEQ ID NO: 358814 - DNA, 15 bp, Homo sapiens
agacctcagatgtgt

SEQ ID NO: 358815 - DNA, 17 bp, Homo sapiens
agacctcagatgtgttg

SEQ ID NO: 358816 - DNA, 14 bp, Homo sapiens
agacctcatctcca

SEQ ID NO: 358817 - DNA, 15 bp, Homo sapiens
agacctcccctcttc

SEQ ID NO: 358818 - DNA, 20 bp, Homo sapiens
agacctcccctcttcctgga

SEQ ID NO: 358819 - DNA, 23 bp, Homo sapiens
agacctccctccctccccagtgt

SEQ ID NO: 358820 - DNA, 20 bp, Homo sapiens
agacctctcaacagatctgt

SEQ ID NO: 358821 - DNA, 22 bp, Homo sapiens
agacctctcaacagatctgtgg

SEQ ID NO: 358822 - DNA, 16 bp, Homo sapiens
agacctgagctcccca

SEQ ID NO: 358823 - DNA, 14 bp, Homo sapiens
agacctgaggcaga

SEQ ID NO: 358824 - DNA, 15 bp, Homo sapiens
agacctggaaccaga

SEQ ID NO: 358825 - DNA, 16 bp, Homo sapiens
agacctggaaccagag

SEQ ID NO: 358826 - DNA, 16 bp, Homo sapiens
agacctgggccctggt

SEQ ID NO: 358827 - DNA, 13 bp, Homo sapiens
agacctgtaatca

SEQ ID NO: 358828 - DNA, 19 bp, Homo sapiens
agacctgtgctagttttac

SEQ ID NO: 358829 - DNA, 22 bp, Homo sapiens
agacctgtgctagttttacaga

SEQ ID NO: 358830 - DNA, 23 bp, Homo sapiens
agacctgtgctagttttacagat

SEQ ID NO: 358831 - DNA, 16 bp, Homo sapiens
agaccttctccaaatg

SEQ ID NO: 358832 - DNA, 18 bp, Homo sapiens
agaccttctgaagatctc

SEQ ID NO: 358833 - DNA, 19 bp, Homo sapiens
agaccttctgaagatctca

SEQ ID NO: 358834 - DNA, 20 bp, Homo sapiens
agaccttgcctcccctcctc

SEQ ID NO: 358835 - DNA, 23 bp, Homo sapiens
agaccttgcctcccctcctctcc

SEQ ID NO: 358836 - DNA, 23 bp, Homo sapiens
agacgacacctggagactgtccc

SEQ ID NO: 358837 - DNA, 23 bp, Homo sapiens
agacgacttatatatttgaaaga

SEQ ID NO: 358838 - DNA, 21 bp, Homo sapiens
agacgaggcaggggctctgct

SEQ ID NO: 358839 - DNA, 14 bp, Homo sapiens
agacgcaggaatgg

SEQ ID NO: 358840 - DNA, 14 bp, Homo sapiens
agacgcccctccca

SEQ ID NO: 358841 - DNA, 23 bp, Homo sapiens
agacggacgggacagcggcccgg

SEQ ID NO: 358842 - DNA, 16 bp, Homo sapiens
agacggagatgcatgg

SEQ ID NO: 358843 - DNA, 18 bp, Homo sapiens
agacgggggcagagaggg

SEQ ID NO: 358844 - DNA, 15 bp, Homo sapiens
agacggtgttgggag

SEQ ID NO: 358845 - DNA, 14 bp, Homo sapiens
agacgtccctccac

SEQ ID NO: 358846 - DNA, 15 bp, Homo sapiens
agactaagccctgtc

SEQ ID NO: 358847 - DNA, 16 bp, Homo sapiens
agactaggagaccaga

SEQ ID NO: 358848 - DNA, 18 bp, Homo sapiens
agactataaagcagtaga

SEQ ID NO: 358849 - DNA, 18 bp, Homo sapiens
agactatttaacttgagg

SEQ ID NO: 358850 - DNA, 16 bp, Homo sapiens
agactcaggttccaga

SEQ ID NO: 358851 - DNA, 20 bp, Homo sapiens
agactcaggttccagaacag

SEQ ID NO: 358852 - DNA, 12 bp, Homo sapiens
agactcagtttg

SEQ ID NO: 358853 - DNA, 16 bp, Homo sapiens
agactcagtttgtcag

SEQ ID NO: 358854 - DNA, 15 bp, Homo sapiens
agactcatctacaca

SEQ ID NO: 358855 - DNA, 24 bp, Homo sapiens
agactccagaatctgctgttgcca

SEQ ID NO: 358856 - DNA, 13 bp, Homo sapiens
agactcctcgggc

SEQ ID NO: 358857 - DNA, 15 bp, Homo sapiens
agactcctgccctgt

SEQ ID NO: 358858 - DNA, 16 bp, Homo sapiens
agactcctgccctgtt

SEQ ID NO: 358859 - DNA, 17 bp, Homo sapiens
agactccttctccccaa

SEQ ID NO: 358860 - DNA, 14 bp, Homo sapiens
agactcctttcctg

SEQ ID NO: 358861 - DNA, 17 bp, Homo sapiens
agactcgtcttggcaca

SEQ ID NO: 358862 - DNA, 16 bp, Homo sapiens
agactcgttctcgtga

SEQ ID NO: 358863 - DNA, 19 bp, Homo sapiens
agactctaaacacacaagt

SEQ ID NO: 358864 - DNA, 13 bp, Homo sapiens
agactctgtaacc

SEQ ID NO: 358865 - DNA, 22 bp, Homo sapiens
agactctgtaaccacctctctg

SEQ ID NO: 358866 - DNA, 23 bp, Homo sapiens
agactctgtaaccacctctctgt

SEQ ID NO: 358867 - DNA, 16 bp, Homo sapiens
agactgaaagcagcag

SEQ ID NO: 358868 - DNA, 21 bp, Homo sapiens
agactgaaagcagcagctagg

SEQ ID NO: 358869 - DNA, 19 bp, Homo sapiens
agactgaaatggcttctat

SEQ ID NO: 358870 - DNA, 19 bp, Homo sapiens
agactgagaggcagaagtc

SEQ ID NO: 358871 - DNA, 15 bp, Homo sapiens
agactgcccaccctg

SEQ ID NO: 358872 - DNA, 19 bp, Homo sapiens
agactgcccaccctgggcc

SEQ ID NO: 358873 - DNA, 20 bp, Homo sapiens
agactgcccaccctgggcct

SEQ ID NO: 358874 - DNA, 20 bp, Homo sapiens
agactgccccacggccctgt

SEQ ID NO: 358875 - DNA, 19 bp, Homo sapiens
agactgcctccctctcttc

SEQ ID NO: 358876 - DNA, 18 bp, Homo sapiens
agactggagactgtccac

SEQ ID NO: 358877 - DNA, 11 bp, Homo sapiens
agactggaggg

SEQ ID NO: 358878 - DNA, 21 bp, Homo sapiens
agactggagtgaggcttccag

SEQ ID NO: 358879 - DNA, 16 bp, Homo sapiens
agactggatactgccc

SEQ ID NO: 358880 - DNA, 15 bp, Homo sapiens
agactggcagccagg

SEQ ID NO: 358881 - DNA, 15 bp, Homo sapiens
agactggccagaggc

SEQ ID NO: 358882 - DNA, 11 bp, Homo sapiens
agactggctgc

SEQ ID NO: 358883 - DNA, 18 bp, Homo sapiens
agactgggagccacttct

SEQ ID NO: 358884 - DNA, 22 bp, Homo sapiens
agactgggagccacttctcccc

SEQ ID NO: 358885 - DNA, 17 bp, Homo sapiens
agactgtaagatgttgt

SEQ ID NO: 358886 - DNA, 21 bp, Homo sapiens
agactgtaagatgttgtttta

SEQ ID NO: 358887 - DNA, 22 bp, Homo sapiens
agactgtagattgcttctgtag

SEQ ID NO: 358888 - DNA, 15 bp, Homo sapiens
agactgtccacttct

SEQ ID NO: 358889 - DNA, 19 bp, Homo sapiens
agactgtgaggcggcagct

SEQ ID NO: 358890 - DNA, 20 bp, Homo sapiens
agactgtgaggcggcagctg

SEQ ID NO: 358891 - DNA, 22 bp, Homo sapiens
agactgtgaggcggcagctggg

SEQ ID NO: 358892 - DNA, 17 bp, Homo sapiens
agactgttccctccaag

SEQ ID NO: 358893 - DNA, 14 bp, Homo sapiens
agactgttgctcaa

SEQ ID NO: 358894 - DNA, 15 bp, Homo sapiens
agactgttgctcaaa

SEQ ID NO: 358895 - DNA, 14 bp, Homo sapiens
agacttaagattaa

SEQ ID NO: 358896 - DNA, 17 bp, Homo sapiens
agacttaatctttgctg

SEQ ID NO: 358897 - DNA, 12 bp, Homo sapiens
agacttactttc

SEQ ID NO: 358898 - DNA, 17 bp, Homo sapiens
agacttagatctgagcc

SEQ ID NO: 358899 - DNA, 17 bp, Homo sapiens
agacttcatttttccta

SEQ ID NO: 358900 - DNA, 19 bp, Homo sapiens
agacttccaaacctgacag

SEQ ID NO: 358901 - DNA, 18 bp, Homo sapiens
agacttcccaacagcctt

SEQ ID NO: 358902 - DNA, 12 bp, Homo sapiens
agacttccccat

SEQ ID NO: 358903 - DNA, 15 bp, Homo sapiens
agacttccccatccc

SEQ ID NO: 358904 - DNA, 16 bp, Homo sapiens
agacttcgaaaacaga

SEQ ID NO: 358905 - DNA, 16 bp, Homo sapiens
agacttcgactcagga

SEQ ID NO: 358906 - DNA, 19 bp, Homo sapiens
agacttcgctattcccagg

SEQ ID NO: 358907 - DNA, 22 bp, Homo sapiens
agacttcgctattcccaggcag

SEQ ID NO: 358908 - DNA, 23 bp, Homo sapiens
agacttcgctattcccaggcagg

SEQ ID NO: 358909 - DNA, 18 bp, Homo sapiens
agacttctggaaggctgg

SEQ ID NO: 358910 - DNA, 22 bp, Homo sapiens
agacttctggaaggctggctga

SEQ ID NO: 358911 - DNA, 20 bp, Homo sapiens
agacttctggttgtatttct

SEQ ID NO: 358912 - DNA, 15 bp, Homo sapiens
agacttgaaagtttt

SEQ ID NO: 358913 - DNA, 19 bp, Homo sapiens
agacttgaaagttttccag

SEQ ID NO: 358914 - DNA, 20 bp, Homo sapiens
agacttgaaagttttccagt

SEQ ID NO: 358915 - DNA, 18 bp, Homo sapiens
agacttgatgaataaaca

SEQ ID NO: 358916 - DNA, 13 bp, Homo sapiens
agacttggagctg

SEQ ID NO: 358917 - DNA, 14 bp, Homo sapiens
agacttggagctgt

SEQ ID NO: 358918 - DNA, 16 bp, Homo sapiens
agacttggcccaggaa

SEQ ID NO: 358919 - DNA, 22 bp, Homo sapiens
agacttggtgtcctttccctcc

SEQ ID NO: 358920 - DNA, 23 bp, Homo sapiens
agacttggtgtcctttccctcca

SEQ ID NO: 358921 - DNA, 11 bp, Homo sapiens
agacttgtaca

SEQ ID NO: 358922 - DNA, 13 bp, Homo sapiens
aagattgtgtctg

SEQ ID NO: 358923 - DNA, 21 bp, Homo sapiens
aagatttaagcacaaacttta

SEQ ID NO: 358924 - DNA, 14 bp, Homo sapiens
aagatttaattgta

SEQ ID NO: 358925 - DNA, 22 bp, Homo sapiens
aagatttaccttttctgttgta

SEQ ID NO: 358926 - DNA, 13 bp, Homo sapiens
aagatttagaaaa

SEQ ID NO: 358927 - DNA, 14 bp, Homo sapiens
aagatttattttgt

SEQ ID NO: 358928 - DNA, 23 bp, Homo sapiens
aagatttgatgctggagaggtta

SEQ ID NO: 358929 - DNA, 21 bp, Homo sapiens
aagattttgaatgcttcctga

SEQ ID NO: 358930 - DNA, 21 bp, Homo sapiens
aagatttttgttaagctcagg

SEQ ID NO: 358931 - DNA, 13 bp, Homo sapiens
aagcaaaaaataa

SEQ ID NO: 358932 - DNA, 21 bp, Homo sapiens
aagcaaaaaataaaataagtc

SEQ ID NO: 358933 - DNA, 13 bp, Homo sapiens
aagcaaaaaatga

SEQ ID NO: 358934 - DNA, 16 bp, Homo sapiens
aagcaaacatcaaata

SEQ ID NO: 358935 - DNA, 17 bp, Homo sapiens
aagcaaacatcaaataa

SEQ ID NO: 358936 - DNA, 16 bp, Homo sapiens
aagcaaaccttctcag

SEQ ID NO: 358937 - DNA, 12 bp, Homo sapiens
aagcaaagaacc

SEQ ID NO: 358938 - DNA, 22 bp, Homo sapiens
aagcaaatatatttaggccagg

SEQ ID NO: 358939 - DNA, 18 bp, Homo sapiens
aagcaaatatttatgacc

SEQ ID NO: 358940 - DNA, 14 bp, Homo sapiens
aagcaacatcagct

SEQ ID NO: 358941 - DNA, 20 bp, Homo sapiens
aagcaacatgaattaagaac

SEQ ID NO: 358942 - DNA, 19 bp, Homo sapiens
aagcaacctcccaacccag

SEQ ID NO: 358943 - DNA, 18 bp, Homo sapiens
aagcaaccttaaagcaat

SEQ ID NO: 358944 - DNA, 21 bp, Homo sapiens
aagcaaccttaaagcaataag

SEQ ID NO: 358945 - DNA, 21 bp, Homo sapiens
aagcaagacgtcctggaatga

SEQ ID NO: 358946 - DNA, 12 bp, Homo sapiens
aagcaagctctc

SEQ ID NO: 358947 - DNA, 14 bp, Homo sapiens
aagcaaggccagcc

SEQ ID NO: 358948 - DNA, 16 bp, Homo sapiens
aagcaagggctccagc

SEQ ID NO: 358949 - DNA, 19 bp, Homo sapiens
aagcaagtagctttccaca

SEQ ID NO: 358950 - DNA, 15 bp, Homo sapiens
aagcaagtatattta

SEQ ID NO: 358951 - DNA, 12 bp, Homo sapiens
aagcaagttcac

SEQ ID NO: 358952 - DNA, 16 bp, Homo sapiens
aagcaataaatgaatg

SEQ ID NO: 358953 - DNA, 23 bp, Homo sapiens
aagcaatgtgagtcccagagccc

SEQ ID NO: 358954 - DNA, 15 bp, Homo sapiens
aagcaattatttaaa

SEQ ID NO: 358955 - DNA, 18 bp, Homo sapiens
aagcaattatttaaagaa

SEQ ID NO: 358956 - DNA, 17 bp, Homo sapiens
aagcaattgctgcatct

SEQ ID NO: 358957 - DNA, 15 bp, Homo sapiens
aagcaatttcttgct

SEQ ID NO: 358958 - DNA, 17 bp, Homo sapiens
aagcacaaaccctgggg

SEQ ID NO: 358959 - DNA, 16 bp, Homo sapiens
aagcacacttgacatc

SEQ ID NO: 358960 - DNA, 11 bp, Homo sapiens
aagcacagctc

SEQ ID NO: 358961 - DNA, 18 bp, Homo sapiens
aagcacagctctcactgg

SEQ ID NO: 358962 - DNA, 18 bp, Homo sapiens
ccacaccaccgccctcct

SEQ ID NO: 358963 - DNA, 14 bp, Homo sapiens
ccacaccaggccgt

SEQ ID NO: 358964 - DNA, 15 bp, Homo sapiens
ccacaccagtggcct

SEQ ID NO: 358965 - DNA, 14 bp, Homo sapiens
ccacaccccagccc

SEQ ID NO: 358966 - DNA, 17 bp, Homo sapiens
ccacaccccagcccacc

SEQ ID NO: 358967 - DNA, 20 bp, Homo sapiens
ccacaccccagcccaccctg

SEQ ID NO: 358968 - DNA, 22 bp, Homo sapiens
ccacaccccagcgcctgtgctg

SEQ ID NO: 358969 - DNA, 14 bp, Homo sapiens
ccacacctccaccc

SEQ ID NO: 358970 - DNA, 17 bp, Homo sapiens
ccacacgccggggctgg

SEQ ID NO: 358971 - DNA, 19 bp, Homo sapiens
ccacacgccggggctggcc

SEQ ID NO: 358972 - DNA, 22 bp, Homo sapiens
ccacacgccggggctggccctg

SEQ ID NO: 358973 - DNA, 12 bp, Homo sapiens
ccacacgctcac

SEQ ID NO: 358974 - DNA, 15 bp, Homo sapiens
ccacacgctgcccag

SEQ ID NO: 358975 - DNA, 17 bp, Homo sapiens
ccacacgctgcccaggc

SEQ ID NO: 358976 - DNA, 19 bp, Homo sapiens
ccacacggactcccgggcc

SEQ ID NO: 358977 - DNA, 23 bp, Homo sapiens
ccacactaacctgggttcccttt

SEQ ID NO: 358978 - DNA, 14 bp, Homo sapiens
ccacactcagtccc

SEQ ID NO: 358979 - DNA, 15 bp, Homo sapiens
ccacactgaatctcc

SEQ ID NO: 358980 - DNA, 20 bp, Homo sapiens
ccacacttcaggctcttctc

SEQ ID NO: 358981 - DNA, 12 bp, Homo sapiens
ccacacttcctg

SEQ ID NO: 358982 - DNA, 18 bp, Homo sapiens
ccacacttcctgtccaga

SEQ ID NO: 358983 - DNA, 13 bp, Homo sapiens
ccacacttcttga

SEQ ID NO: 358984 - DNA, 21 bp, Homo sapiens
ccacacttcttgaaacagcct

SEQ ID NO: 358985 - DNA, 22 bp, Homo sapiens
ccacacttcttgaaacagcctg

SEQ ID NO: 358986 - DNA, 16 bp, Homo sapiens
ccacacttgctggggc

SEQ ID NO: 358987 - DNA, 18 bp, Homo sapiens
ccacacttgctggggctc

SEQ ID NO: 358988 - DNA, 14 bp, Homo sapiens
ccacagacacacac

SEQ ID NO: 358989 - DNA, 21 bp, Homo sapiens
ccacagacacacacacgcacg

SEQ ID NO: 358990 - DNA, 20 bp, Homo sapiens
ccacagacagatcccatcca

SEQ ID NO: 358991 - DNA, 17 bp, Homo sapiens
ccacagagacaaggagg

SEQ ID NO: 358992 - DNA, 13 bp, Homo sapiens
ccacagaggacag

SEQ ID NO: 358993 - DNA, 22 bp, Homo sapiens
ccacagagtctgtgtgtagcca

SEQ ID NO: 358994 - DNA, 18 bp, Homo sapiens
ccacagagtgtggtccct

SEQ ID NO: 358995 - DNA, 19 bp, Homo sapiens
ccacagcagcctctgaagt

SEQ ID NO: 358996 - DNA, 14 bp, Homo sapiens
ccacagccaagccc

SEQ ID NO: 358997 - DNA, 22 bp, Homo sapiens
ccacagccacctccacccccaa

SEQ ID NO: 358998 - DNA, 23 bp, Homo sapiens
ccacagccagaaccccgagccct

SEQ ID NO: 358999 - DNA, 18 bp, Homo sapiens
ccacagcccagccacgga

SEQ ID NO: 359000 - DNA, 20 bp, Homo sapiens
ccacagcccagccacggacg

SEQ ID NO: 359001 - DNA, 14 bp, Homo sapiens
ccacagccctgtca

SEQ ID NO: 359002 - DNA, 11 bp, Homo sapiens
ccacagctacc

SEQ ID NO: 359003 - DNA, 14 bp, Homo sapiens
ccacagctgctggc

SEQ ID NO: 359004 - DNA, 15 bp, Homo sapiens
ccacagctgctggcc

SEQ ID NO: 359005 - DNA, 18 bp, Homo sapiens
ccacagctgctggccagg

SEQ ID NO: 359006 - DNA, 19 bp, Homo sapiens
ccacagctgctggccaggg

SEQ ID NO: 359007 - DNA, 17 bp, Homo sapiens
ccacagcttcctgaggg

SEQ ID NO: 359008 - DNA, 23 bp, Homo sapiens
ccacaggatctgaactttgtttc

SEQ ID NO: 359009 - DNA, 11 bp, Homo sapiens
ccacagggcct

SEQ ID NO: 359010 - DNA, 21 bp, Homo sapiens
ccacagggcctgacttttaca

SEQ ID NO: 359011 - DNA, 22 bp, Homo sapiens
ccacagggcctgacttttacag

SEQ ID NO: 359012 - DNA, 16 bp, Homo sapiens
ccacaggggcaggcct

SEQ ID NO: 359013 - DNA, 15 bp, Homo sapiens
ccacagggtgggatg

SEQ ID NO: 359014 - DNA, 18 bp, Homo sapiens
ccacagggtgggatgagc

SEQ ID NO: 359015 - DNA, 15 bp, Homo sapiens
ccacaggtgtcccca

SEQ ID NO: 359016 - DNA, 22 bp, Homo sapiens
ccacaggttcatgccaccatgg

SEQ ID NO: 359017 - DNA, 14 bp, Homo sapiens
ccacagtcaaagaa

SEQ ID NO: 359018 - DNA, 18 bp, Homo sapiens
ccacagtcctcacagcct

SEQ ID NO: 359019 - DNA, 18 bp, Homo sapiens
ccacagtctctccctggg

SEQ ID NO: 359020 - DNA, 14 bp, Homo sapiens
ccacagtgaaagtt

SEQ ID NO: 359021 - DNA, 21 bp, Homo sapiens
ccacagtgctcagttgtactt

SEQ ID NO: 359022 - DNA, 20 bp, Homo sapiens
ccacagtggggcccatggcc

SEQ ID NO: 359023 - DNA, 22 bp, Homo sapiens
ccacagtggggcccatggcccc

SEQ ID NO: 359024 - DNA, 23 bp, Homo sapiens
ccacagtggggcccatggcccca

SEQ ID NO: 359025 - DNA, 24 bp, Homo sapiens
ccacagtggggcccatggccccag

SEQ ID NO: 359026 - DNA, 19 bp, Homo sapiens
ccacagtgggtggcacctc

SEQ ID NO: 359027 - DNA, 12 bp, Homo sapiens
ccacagtgtctg

SEQ ID NO: 359028 - DNA, 20 bp, Homo sapiens
ccacagttgctgctcctttg

SEQ ID NO: 359029 - DNA, 14 bp, Homo sapiens
ccacatcccactgg

SEQ ID NO: 359030 - DNA, 18 bp, Homo sapiens
ccacatcccactggatct

SEQ ID NO: 359031 - DNA, 15 bp, Homo sapiens
ccacatcccaggctt

SEQ ID NO: 359032 - DNA, 21 bp, Homo sapiens
ccacatccccaccctcccctc

SEQ ID NO: 359033 - DNA, 18 bp, Homo sapiens
ccacatccccaccttcca

SEQ ID NO: 359034 - DNA, 13 bp, Homo sapiens
ccacatcttgtct

SEQ ID NO: 359035 - DNA, 22 bp, Homo sapiens
ccacatgagtcccagtgggagg

SEQ ID NO: 359036 - DNA, 17 bp, Homo sapiens
ccacattctgctgcccc

SEQ ID NO: 359037 - DNA, 23 bp, Homo sapiens
ccacattctgctgcccccagacc

SEQ ID NO: 359038 - DNA, 12 bp, Homo sapiens
ccaccaactctg

SEQ ID NO: 359039 - DNA, 17 bp, Homo sapiens
ccaccaagacttgtttt

SEQ ID NO: 359040 - DNA, 18 bp, Homo sapiens
ccaccaagccctgcaaat

SEQ ID NO: 359041 - DNA, 14 bp, Homo sapiens
ccaccaagggcctc

SEQ ID NO: 359042 - DNA, 17 bp, Homo sapiens
ccaccacacacaccctt

SEQ ID NO: 359043 - DNA, 18 bp, Homo sapiens
ccaccacacccctgccgg

SEQ ID NO: 359044 - DNA, 13 bp, Homo sapiens
ccaccacactgaa

SEQ ID NO: 359045 - DNA, 14 bp, Homo sapiens
ccaccacgtctgcc

SEQ ID NO: 359046 - DNA, 15 bp, Homo sapiens
ccaccacgtctgcca

SEQ ID NO: 359047 - DNA, 15 bp, Homo sapiens
ccaccactgtcccta

SEQ ID NO: 359048 - DNA, 20 bp, Homo sapiens
ccaccagaacgcaccccact

SEQ ID NO: 359049 - DNA, 18 bp, Homo sapiens
ccaccagatgagaagtta

SEQ ID NO: 359050 - DNA, 15 bp, Homo sapiens
ccaccagcagcacaa

SEQ ID NO: 359051 - DNA, 18 bp, Homo sapiens
ccaccagccgccccagcc

SEQ ID NO: 359052 - DNA, 20 bp, Homo sapiens
ccaccagccgccccagcccc

SEQ ID NO: 359053 - DNA, 23 bp, Homo sapiens
ccaccaggattaatctctaaaat

SEQ ID NO: 359054 - DNA, 16 bp, Homo sapiens
ccaccagtctcaccca

SEQ ID NO: 359055 - DNA, 19 bp, Homo sapiens
ccaccagtctcacccacta

SEQ ID NO: 359056 - DNA, 12 bp, Homo sapiens
ccaccagtgcct

SEQ ID NO: 359057 - DNA, 17 bp, Homo sapiens
ccaccatctgtaccctg

SEQ ID NO: 359058 - DNA, 16 bp, Homo sapiens
ccaccatggccagcca

SEQ ID NO: 359059 - DNA, 17 bp, Homo sapiens
ccaccattccacatccc

SEQ ID NO: 359060 - DNA, 14 bp, Homo sapiens
ccaccattccttta

SEQ ID NO: 359061 - DNA, 21 bp, Homo sapiens
ccacccaaaccccttcccacg

SEQ ID NO: 359062 - DNA, 23 bp, Homo sapiens
ccacccaaaccccttcccacgac

SEQ ID NO: 359063 - DNA, 13 bp, Homo sapiens
ccacccacccctc

SEQ ID NO: 359064 - DNA, 14 bp, Homo sapiens
ccacccacccctcc

SEQ ID NO: 359065 - DNA, 15 bp, Homo sapiens
ccacccacccctcct

SEQ ID NO: 359066 - DNA, 16 bp, Homo sapiens
ccacccacccctcctg

SEQ ID NO: 359067 - DNA, 12 bp, Homo sapiens
ccacccaccctt

SEQ ID NO: 359068 - DNA, 16 bp, Homo sapiens
ccacccacctcagcct

SEQ ID NO: 359069 - DNA, 23 bp, Homo sapiens
ccacccaggagggagggggctat

SEQ ID NO: 359070 - DNA, 12 bp, Homo sapiens
ccacccaggctg

SEQ ID NO: 359071 - DNA, 13 bp, Homo sapiens
ccacccaggctgc

SEQ ID NO: 359072 - DNA, 22 bp, Homo sapiens
ccacccaggctgcactgcagtg

SEQ ID NO: 359073 - DNA, 15 bp, Homo sapiens
ccacccagggctccc

SEQ ID NO: 359074 - DNA, 14 bp, Homo sapiens
ccacccagtgctgc

SEQ ID NO: 359075 - DNA, 16 bp, Homo sapiens
ccacccagtgctgcca

SEQ ID NO: 359076 - DNA, 19 bp, Homo sapiens
ccacccagtgctgccatgc

SEQ ID NO: 359077 - DNA, 21 bp, Homo sapiens
ccacccatcctaccaatgcat

SEQ ID NO: 359078 - DNA, 17 bp, Homo sapiens
ccaccccagtgcaccca

SEQ ID NO: 359079 - DNA, 21 bp, Homo sapiens
ccacccccaaagacctgcctg

SEQ ID NO: 359080 - DNA, 16 bp, Homo sapiens
ccaccccccgccggca

SEQ ID NO: 359081 - DNA, 21 bp, Homo sapiens
ccaccccccgccggcaggggc

SEQ ID NO: 359082 - DNA, 21 bp, Homo sapiens
ccacccccgccacggccaccc

SEQ ID NO: 359083 - DNA, 22 bp, Homo sapiens
ccaccccctccctggcctgttc

SEQ ID NO: 359084 - DNA, 22 bp, Homo sapiens
ccaccccctgtcccattctaga

SEQ ID NO: 359085 - DNA, 24 bp, Homo sapiens
ccaccccctgtcccattctagatc

SEQ ID NO: 359086 - DNA, 20 bp, Homo sapiens
ccacccccttctctgctcca

SEQ ID NO: 359087 - DNA, 23 bp, Homo sapiens
ccacccccttctctgctccacca

SEQ ID NO: 359088 - DNA, 14 bp, Homo sapiens
ccaccccgctgcct

SEQ ID NO: 359089 - DNA, 15 bp, Homo sapiens
ccaccccgctgcctg

SEQ ID NO: 359090 - DNA, 17 bp, Homo sapiens
ccaccccgctgcctggc

SEQ ID NO: 359091 - DNA, 17 bp, Homo sapiens
ccaccccggcctccact

SEQ ID NO: 359092 - DNA, 16 bp, Homo sapiens
ccactttgttggccct

SEQ ID NO: 359093 - DNA, 22 bp, Homo sapiens
ccactttgttggcccttccagt

SEQ ID NO: 359094 - DNA, 13 bp, Homo sapiens
ccactttttgcag

SEQ ID NO: 359095 - DNA, 21 bp, Homo sapiens
ccagaaaatagggtggacaga

SEQ ID NO: 359096 - DNA, 20 bp, Homo sapiens
ccagaaacacctagatcaga

SEQ ID NO: 359097 - DNA, 22 bp, Homo sapiens
ccagaaacagtgggagccctga

SEQ ID NO: 359098 - DNA, 19 bp, Homo sapiens
ccagaaagcaggagcagct

SEQ ID NO: 359099 - DNA, 21 bp, Homo sapiens
ccagaaagcaggagcagctgt

SEQ ID NO: 359100 - DNA, 22 bp, Homo sapiens
ccagaaagcaggagcagctgtg

SEQ ID NO: 359101 - DNA, 15 bp, Homo sapiens
ccagaaagcctcctg

SEQ ID NO: 359102 - DNA, 21 bp, Homo sapiens
ccagaaagcctcctgccccct

SEQ ID NO: 359103 - DNA, 23 bp, Homo sapiens
ccagaaagcctcctgccccctgc

SEQ ID NO: 359104 - DNA, 14 bp, Homo sapiens
ccagaaaggagact

SEQ ID NO: 359105 - DNA, 16 bp, Homo sapiens
ccagaaaggagactag

SEQ ID NO: 359106 - DNA, 16 bp, Homo sapiens
ccagaaatgccgctgt

SEQ ID NO: 359107 - DNA, 17 bp, Homo sapiens
ccagaacaacaactatc

SEQ ID NO: 359108 - DNA, 13 bp, Homo sapiens
ccagaacagccct

SEQ ID NO: 359109 - DNA, 15 bp, Homo sapiens
ccagaacagccctcg

SEQ ID NO: 359110 - DNA, 17 bp, Homo sapiens
ccagaacagccctcggc

SEQ ID NO: 359111 - DNA, 13 bp, Homo sapiens
ccagaaccacact

SEQ ID NO: 359112 - DNA, 20 bp, Homo sapiens
ccagaaccccaactcccagc

SEQ ID NO: 359113 - DNA, 14 bp, Homo sapiens
ccagaaccccgagc

SEQ ID NO: 359114 - DNA, 16 bp, Homo sapiens
ccagaacgcaccccac

SEQ ID NO: 359115 - DNA, 15 bp, Homo sapiens
ccagaacgggcctcc

SEQ ID NO: 359116 - DNA, 20 bp, Homo sapiens
ccagaacgggcctccccggg

SEQ ID NO: 359117 - DNA, 14 bp, Homo sapiens
ccagaactgccccc

SEQ ID NO: 359118 - DNA, 17 bp, Homo sapiens
ccagaagaaattattta

SEQ ID NO: 359119 - DNA, 16 bp, Homo sapiens
ccagaagaatattcag

SEQ ID NO: 359120 - DNA, 21 bp, Homo sapiens
ccagaagatgtattcagagcc

SEQ ID NO: 359121 - DNA, 16 bp, Homo sapiens
ccagaagccaaagact

SEQ ID NO: 359122 - DNA, 20 bp, Homo sapiens
ccagaagcctctggctagag

SEQ ID NO: 359123 - DNA, 18 bp, Homo sapiens
ccagaagctcaaggctgc

SEQ ID NO: 359124 - DNA, 20 bp, Homo sapiens
ccagaagctcaaggctgcag

SEQ ID NO: 359125 - DNA, 12 bp, Homo sapiens
ccagaaggaacc

SEQ ID NO: 359126 - DNA, 22 bp, Homo sapiens
ccagaaggaacccggtcccagg

SEQ ID NO: 359127 - DNA, 20 bp, Homo sapiens
ccagaaggagggcagagcca

SEQ ID NO: 359128 - DNA, 22 bp, Homo sapiens
ccagaaggagggcagagccatg

SEQ ID NO: 359129 - DNA, 21 bp, Homo sapiens
ccagaagtcctccctcctgca

SEQ ID NO: 359130 - DNA, 17 bp, Homo sapiens
ccagaagtgaatgggaa

SEQ ID NO: 359131 - DNA, 15 bp, Homo sapiens
ccagaatctgctgtt

SEQ ID NO: 359132 - DNA, 18 bp, Homo sapiens
ccagaatctgctgttgcc

SEQ ID NO: 359133 - DNA, 15 bp, Homo sapiens
ccagaatgattttga

SEQ ID NO: 359134 - DNA, 23 bp, Homo sapiens
ccagaatggtctttctaatgtgt

SEQ ID NO: 359135 - DNA, 22 bp, Homo sapiens
ccagaattaaggtttgttttcc

SEQ ID NO: 359136 - DNA, 21 bp, Homo sapiens
ccagaattagtcctcacagcc

SEQ ID NO: 359137 - DNA, 19 bp, Homo sapiens
ccagaatttcccaaagcag

SEQ ID NO: 359138 - DNA, 20 bp, Homo sapiens
ccagaatttggaagctagaa

SEQ ID NO: 359139 - DNA, 13 bp, Homo sapiens
ccagacaaggaga

SEQ ID NO: 359140 - DNA, 15 bp, Homo sapiens
ccagacaaggagagc

SEQ ID NO: 359141 - DNA, 16 bp, Homo sapiens
ccagacaccacagacg

SEQ ID NO: 359142 - DNA, 23 bp, Homo sapiens
ccagacactgaccatccactcta

SEQ ID NO: 359143 - DNA, 15 bp, Homo sapiens
ccagacagagtggat

SEQ ID NO: 359144 - DNA, 19 bp, Homo sapiens
ccagacagagtggatctgg

SEQ ID NO: 359145 - DNA, 21 bp, Homo sapiens
ccagacagcaacggggaggcc

SEQ ID NO: 359146 - DNA, 12 bp, Homo sapiens
ccagacaggccc

SEQ ID NO: 359147 - DNA, 17 bp, Homo sapiens
ccagacaggccctccct

SEQ ID NO: 359148 - DNA, 19 bp, Homo sapiens
ccagacatcatgaatttta

SEQ ID NO: 359149 - DNA, 14 bp, Homo sapiens
ccagacattgtatt

SEQ ID NO: 359150 - DNA, 18 bp, Homo sapiens
ccagaccaccagccgccc

SEQ ID NO: 359151 - DNA, 14 bp, Homo sapiens
ccagaccagagctc

SEQ ID NO: 359152 - DNA, 15 bp, Homo sapiens
ccagacccagggcag

SEQ ID NO: 359153 - DNA, 14 bp, Homo sapiens
ccagaccccatcca

SEQ ID NO: 359154 - DNA, 20 bp, Homo sapiens
ccagaccccatccagccagg

SEQ ID NO: 359155 - DNA, 21 bp, Homo sapiens
ccagaccccatccagccaggg

SEQ ID NO: 359156 - DNA, 12 bp, Homo sapiens
ccagacccccac

SEQ ID NO: 359157 - DNA, 19 bp, Homo sapiens
ccagacccccagcaaccct

SEQ ID NO: 359158 - DNA, 23 bp, Homo sapiens
ccagacccctctggccaggatgg

SEQ ID NO: 359159 - DNA, 24 bp, Homo sapiens
ccagacccctggcttttcactgct

SEQ ID NO: 359160 - DNA, 13 bp, Homo sapiens
ccagaccctgcct

SEQ ID NO: 359161 - DNA, 18 bp, Homo sapiens
ccagaccctgcctgagcc

SEQ ID NO: 359162 - DNA, 21 bp, Homo sapiens
ccagaccctgcctgagcccag

SEQ ID NO: 359163 - DNA, 21 bp, Homo sapiens
ccagacctgaatgcttctgag

SEQ ID NO: 359164 - DNA, 13 bp, Homo sapiens
ccagacctgggcc

SEQ ID NO: 359165 - DNA, 14 bp, Homo sapiens
ccagacctgggccc

SEQ ID NO: 359166 - DNA, 12 bp, Homo sapiens
ccagactacagg

SEQ ID NO: 359167 - DNA, 20 bp, Homo sapiens
ccagactcagagaccgtgag

SEQ ID NO: 359168 - DNA, 18 bp, Homo sapiens
ccagactcaggttccaga

SEQ ID NO: 359169 - DNA, 13 bp, Homo sapiens
ccagactgcaggt

SEQ ID NO: 359170 - DNA, 22 bp, Homo sapiens
ccagactgcaggttggacccca

SEQ ID NO: 359171 - DNA, 22 bp, Homo sapiens
ccagactggctgcacagcccaa

SEQ ID NO: 359172 - DNA, 23 bp, Homo sapiens
ccagacttcgctattcccaggca

SEQ ID NO: 359173 - DNA, 18 bp, Homo sapiens
ccagactttctacacctg

SEQ ID NO: 359174 - DNA, 22 bp, Homo sapiens
ccagagaaatgaaagtcagttt

SEQ ID NO: 359175 - DNA, 18 bp, Homo sapiens
ccagagaacaatcactat

SEQ ID NO: 359176 - DNA, 19 bp, Homo sapiens
ccagagaacaatcactatt

SEQ ID NO: 359177 - DNA, 15 bp, Homo sapiens
ccagagaagcctcag

SEQ ID NO: 359178 - DNA, 24 bp, Homo sapiens
ccagagaatagatcagtatttcac

SEQ ID NO: 359179 - DNA, 14 bp, Homo sapiens
ccagagacaagact

SEQ ID NO: 359180 - DNA, 17 bp, Homo sapiens
ccagagacatgggcctc

SEQ ID NO: 359181 - DNA, 18 bp, Homo sapiens
ccagagacctgaggcaga

SEQ ID NO: 359182 - DNA, 21 bp, Homo sapiens
ccagagacctgaggcagatga

SEQ ID NO: 359183 - DNA, 16 bp, Homo sapiens
ccagagactgcccacc

SEQ ID NO: 359184 - DNA, 17 bp, Homo sapiens
ccagagactgcccaccc

SEQ ID NO: 359185 - DNA, 19 bp, Homo sapiens
ccagagactgcccaccctg

SEQ ID NO: 359186 - DNA, 21 bp, Homo sapiens
ccagagactgcccaccctggg

SEQ ID NO: 359187 - DNA, 23 bp, Homo sapiens
ccagagagaaagaagatttatta

SEQ ID NO: 359188 - DNA, 20 bp, Homo sapiens
ccagagagaagcaccccacc

SEQ ID NO: 359189 - DNA, 14 bp, Homo sapiens
ccagagagagaagt

SEQ ID NO: 359190 - DNA, 18 bp, Homo sapiens
ccagagagaggcgtcctg

SEQ ID NO: 359191 - DNA, 22 bp, Homo sapiens
ccagagagaggcgtcctggtga

SEQ ID NO: 359192 - DNA, 22 bp, Homo sapiens
ccagagagcctggtgctgctgc

SEQ ID NO: 359193 - DNA, 14 bp, Homo sapiens
ccagagagctgaag

SEQ ID NO: 359194 - DNA, 15 bp, Homo sapiens
ccagagaggagcacc

SEQ ID NO: 359195 - DNA, 16 bp, Homo sapiens
ccagagaggagcacct

SEQ ID NO: 359196 - DNA, 13 bp, Homo sapiens
ccagagagggccc

SEQ ID NO: 359197 - DNA, 17 bp, Homo sapiens
ccagagagggcccagct

SEQ ID NO: 359198 - DNA, 22 bp, Homo sapiens
ccagagatgggactgggagggc

SEQ ID NO: 359199 - DNA, 18 bp, Homo sapiens
ccagagcaaagggccagg

SEQ ID NO: 359200 - DNA, 13 bp, Homo sapiens
ccagagcacctca

SEQ ID NO: 359201 - DNA, 14 bp, Homo sapiens
ccagagcacctcag

SEQ ID NO: 359202 - DNA, 16 bp, Homo sapiens
ccagagcacctcagga

SEQ ID NO: 359203 - DNA, 20 bp, Homo sapiens
ccagagcacctcaggaccct

SEQ ID NO: 359204 - DNA, 22 bp, Homo sapiens
ccagagcactgggttgcagggg

SEQ ID NO: 359205 - DNA, 12 bp, Homo sapiens
ccagagcaggag

SEQ ID NO: 359206 - DNA, 14 bp, Homo sapiens
ccagagcaggagac

SEQ ID NO: 359207 - DNA, 15 bp, Homo sapiens
ccagagcaggaggcc

SEQ ID NO: 359208 - DNA, 19 bp, Homo sapiens
ccagagcaggaggcccctg

SEQ ID NO: 359209 - DNA, 22 bp, Homo sapiens
ccagagcatttccaacaccaca

SEQ ID NO: 359210 - DNA, 13 bp, Homo sapiens
ccagagccagcct

SEQ ID NO: 359211 - DNA, 18 bp, Homo sapiens
ccagagccagcctgggac

SEQ ID NO: 359212 - DNA, 19 bp, Homo sapiens
ccagagccagcctgggact

SEQ ID NO: 359213 - DNA, 16 bp, Homo sapiens
ccagagccagggctgt

SEQ ID NO: 359214 - DNA, 20 bp, Homo sapiens
ccagagccagggctgtcctt

SEQ ID NO: 359215 - DNA, 23 bp, Homo sapiens
ccagagccagggctgtccttaga

SEQ ID NO: 359216 - DNA, 15 bp, Homo sapiens
ccagagccatggact

SEQ ID NO: 359217 - DNA, 14 bp, Homo sapiens
ccagagccccccac

SEQ ID NO: 359218 - DNA, 17 bp, Homo sapiens
ccagagcccttcactgc

SEQ ID NO: 359219 - DNA, 19 bp, Homo sapiens
ccagagcctatggaaaggg

SEQ ID NO: 359220 - DNA, 21 bp, Homo sapiens
ccagagcctggtagagactag

SEQ ID NO: 359221 - DNA, 18 bp, Homo sapiens
ccaggaaggggctggact

SEQ ID NO: 359222 - DNA, 15 bp, Homo sapiens
ccaggaatgaagata

SEQ ID NO: 359223 - DNA, 14 bp, Homo sapiens
ccaggaatgtttca

SEQ ID NO: 359224 - DNA, 15 bp, Homo sapiens
ccaggaatgtttcag

SEQ ID NO: 359225 - DNA, 17 bp, Homo sapiens
ccaggaatgtttcagct

SEQ ID NO: 359226 - DNA, 14 bp, Homo sapiens
ccaggacagctgca

SEQ ID NO: 359227 - DNA, 15 bp, Homo sapiens
ccaggacagctgcag

SEQ ID NO: 359228 - DNA, 16 bp, Homo sapiens
ccaggacagctgcagg

SEQ ID NO: 359229 - DNA, 13 bp, Homo sapiens
ccaggaccctgag

SEQ ID NO: 359230 - DNA, 16 bp, Homo sapiens
ccaggaccctgagggt

SEQ ID NO: 359231 - DNA, 22 bp, Homo sapiens
ccaggacgcttctgaatgctgc

SEQ ID NO: 359232 - DNA, 20 bp, Homo sapiens
ccaggactaatgcatgtggt

SEQ ID NO: 359233 - DNA, 16 bp, Homo sapiens
ccaggactccctcctc

SEQ ID NO: 359234 - DNA, 17 bp, Homo sapiens
ccaggactccctcctca

SEQ ID NO: 359235 - DNA, 13 bp, Homo sapiens
ccaggactctctt

SEQ ID NO: 359236 - DNA, 20 bp, Homo sapiens
ccaggactctgccttccagg

SEQ ID NO: 359237 - DNA, 21 bp, Homo sapiens
ccaggactctgccttccaggc

SEQ ID NO: 359238 - DNA, 15 bp, Homo sapiens
ccaggactgtgactc

SEQ ID NO: 359239 - DNA, 23 bp, Homo sapiens
ccaggacttaagacaaatgggac

SEQ ID NO: 359240 - DNA, 17 bp, Homo sapiens
ccaggacttggggtcag

SEQ ID NO: 359241 - DNA, 20 bp, Homo sapiens
ccaggacttggggtcaggaa

SEQ ID NO: 359242 - DNA, 22 bp, Homo sapiens
ccaggagaaagaaggcttaaca

SEQ ID NO: 359243 - DNA, 19 bp, Homo sapiens
ccaggagaaccactacatg

SEQ ID NO: 359244 - DNA, 21 bp, Homo sapiens
ccaggagaaccactacatgca

SEQ ID NO: 359245 - DNA, 16 bp, Homo sapiens
ccaggagacagacaga

SEQ ID NO: 359246 - DNA, 13 bp, Homo sapiens
ccaggagaccctg

SEQ ID NO: 359247 - DNA, 17 bp, Homo sapiens
ccaggagaccctgtctt

SEQ ID NO: 359248 - DNA, 19 bp, Homo sapiens
ccaggagagcccccaccag

SEQ ID NO: 359249 - DNA, 22 bp, Homo sapiens
ccaggagagcccccaccagcag

SEQ ID NO: 359250 - DNA, 20 bp, Homo sapiens
ccaggagcaatgggactgga

SEQ ID NO: 359251 - DNA, 21 bp, Homo sapiens
ccaggagcaatgggactggag

SEQ ID NO: 359252 - DNA, 23 bp, Homo sapiens
ccaggagcaatgggactggagtc

SEQ ID NO: 359253 - DNA, 13 bp, Homo sapiens
ccaggagcagcct

SEQ ID NO: 359254 - DNA, 12 bp, Homo sapiens
ccaggagcccca

SEQ ID NO: 359255 - DNA, 13 bp, Homo sapiens
ccaggagccccag

SEQ ID NO: 359256 - DNA, 15 bp, Homo sapiens
ccaggagcctcctga

SEQ ID NO: 359257 - DNA, 19 bp, Homo sapiens
ccaggagctgagtcacctc

SEQ ID NO: 359258 - DNA, 23 bp, Homo sapiens
ccaggagctgagtcacctcctcc

SEQ ID NO: 359259 - DNA, 13 bp, Homo sapiens
ccaggaggacctg

SEQ ID NO: 359260 - DNA, 14 bp, Homo sapiens
ccaggaggacctgg

SEQ ID NO: 359261 - DNA, 22 bp, Homo sapiens
ccaggaggccggggggagcagg

SEQ ID NO: 359262 - DNA, 13 bp, Homo sapiens
ccaggaggcggca

SEQ ID NO: 359263 - DNA, 15 bp, Homo sapiens
ccaggaggctggcag

SEQ ID NO: 359264 - DNA, 21 bp, Homo sapiens
ccaggaggctggcagtacaga

SEQ ID NO: 359265 - DNA, 13 bp, Homo sapiens
ccaggaggggcct

SEQ ID NO: 359266 - DNA, 18 bp, Homo sapiens
ccaggaggggcctctgaa

SEQ ID NO: 359267 - DNA, 20 bp, Homo sapiens
ccaggaggggcctctgaaat

SEQ ID NO: 359268 - DNA, 19 bp, Homo sapiens
ccaggaggttggtgactga

SEQ ID NO: 359269 - DNA, 20 bp, Homo sapiens
ccaggaggttggtgactgaa

SEQ ID NO: 359270 - DNA, 13 bp, Homo sapiens
ccaggagtctgag

SEQ ID NO: 359271 - DNA, 17 bp, Homo sapiens
ccaggagtctgtgctct

SEQ ID NO: 359272 - DNA, 23 bp, Homo sapiens
ccaggagtttgagacaagccctg

SEQ ID NO: 359273 - DNA, 20 bp, Homo sapiens
ccaggataaggagactgagg

SEQ ID NO: 359274 - DNA, 13 bp, Homo sapiens
ccaggatcccctg

SEQ ID NO: 359275 - DNA, 20 bp, Homo sapiens
ccaggatcccctgctactcc

SEQ ID NO: 359276 - DNA, 15 bp, Homo sapiens
ccaggatcctcctgg

SEQ ID NO: 359277 - DNA, 15 bp, Homo sapiens
ccaggatcctgcagg

SEQ ID NO: 359278 - DNA, 21 bp, Homo sapiens
ccaggattgtacgtgggagag

SEQ ID NO: 359279 - DNA, 14 bp, Homo sapiens
ccaggatttggttg

SEQ ID NO: 359280 - DNA, 23 bp, Homo sapiens
ccaggattttaacaaaagcaaga

SEQ ID NO: 359281 - DNA, 16 bp, Homo sapiens
ccaggattttgtattg

SEQ ID NO: 359282 - DNA, 15 bp, Homo sapiens
ccaggattttgtgtt

SEQ ID NO: 359283 - DNA, 23 bp, Homo sapiens
ccaggcaatggcctaaacttcag

SEQ ID NO: 359284 - DNA, 15 bp, Homo sapiens
ccaggcacctggcct

SEQ ID NO: 359285 - DNA, 17 bp, Homo sapiens
ccaggcacctggcctgc

SEQ ID NO: 359286 - DNA, 13 bp, Homo sapiens
ccaggcactgcct

SEQ ID NO: 359287 - DNA, 17 bp, Homo sapiens
ccaggcaggcacctggg

SEQ ID NO: 359288 - DNA, 11 bp, Homo sapiens
ccaggcaggga

SEQ ID NO: 359289 - DNA, 13 bp, Homo sapiens
ccaggcagggagg

SEQ ID NO: 359290 - DNA, 17 bp, Homo sapiens
ccaggcagggagtgtct

SEQ ID NO: 359291 - DNA, 23 bp, Homo sapiens
ccaggcagggagtgtctgcagtc

SEQ ID NO: 359292 - DNA, 16 bp, Homo sapiens
ccaggcatgaccctgg

SEQ ID NO: 359293 - DNA, 19 bp, Homo sapiens
ccaggcatgaccctggagc

SEQ ID NO: 359294 - DNA, 22 bp, Homo sapiens
ccaggcatgaccctggagcccg

SEQ ID NO: 359295 - DNA, 16 bp, Homo sapiens
ccaggcatgctggcct

SEQ ID NO: 359296 - DNA, 17 bp, Homo sapiens
ccaggcatgctggcctc

SEQ ID NO: 359297 - DNA, 18 bp, Homo sapiens
ccaggcatgctggcctcc

SEQ ID NO: 359298 - DNA, 15 bp, Homo sapiens
ccaggcatggcccag

SEQ ID NO: 359299 - DNA, 21 bp, Homo sapiens
ccaggcatggcccagcctgga

SEQ ID NO: 359300 - DNA, 19 bp, Homo sapiens
ccaggcatgggtcccttcc

SEQ ID NO: 359301 - DNA, 10 bp, Homo sapiens
ccaggccacc

SEQ ID NO: 359302 - DNA, 13 bp, Homo sapiens
ccaggccacccac

SEQ ID NO: 359303 - DNA, 17 bp, Homo sapiens
ccaggccacccactgtg

SEQ ID NO: 359304 - DNA, 18 bp, Homo sapiens
ccaggccactctcagaga

SEQ ID NO: 359305 - DNA, 12 bp, Homo sapiens
ccaggccactgt

SEQ ID NO: 359306 - DNA, 19 bp, Homo sapiens
ccaggccactgtggccaga

SEQ ID NO: 359307 - DNA, 21 bp, Homo sapiens
ccaggccactgtggccagagc

SEQ ID NO: 359308 - DNA, 13 bp, Homo sapiens
ccaggccagcgag

SEQ ID NO: 359309 - DNA, 14 bp, Homo sapiens
ccaggccagcgagg

SEQ ID NO: 359310 - DNA, 15 bp, Homo sapiens
ccaggccagctcctt

SEQ ID NO: 359311 - DNA, 16 bp, Homo sapiens
ccaggccaggcctcat

SEQ ID NO: 359312 - DNA, 12 bp, Homo sapiens
ccaggccaggtc

SEQ ID NO: 359313 - DNA, 17 bp, Homo sapiens
ccaggccaggtccctgg

SEQ ID NO: 359314 - DNA, 21 bp, Homo sapiens
ccaggccatccggcccccaga

SEQ ID NO: 359315 - DNA, 12 bp, Homo sapiens
ccaggccatggc

SEQ ID NO: 359316 - DNA, 18 bp, Homo sapiens
ccaggcccagcctggccc

SEQ ID NO: 359317 - DNA, 23 bp, Homo sapiens
ccaggcccagtccactggggagt

SEQ ID NO: 359318 - DNA, 13 bp, Homo sapiens
ccaggcccatctc

SEQ ID NO: 359319 - DNA, 21 bp, Homo sapiens
ccaggcccatctcaggtgcca

SEQ ID NO: 359320 - DNA, 20 bp, Homo sapiens
ccaggccccaaaaccacagc

SEQ ID NO: 359321 - DNA, 21 bp, Homo sapiens
ccaggccccaaaaccacagcc

SEQ ID NO: 359322 - DNA, 17 bp, Homo sapiens
ccaggccccctgcatct

SEQ ID NO: 359323 - DNA, 15 bp, Homo sapiens
ccaggcccctgagga

SEQ ID NO: 359324 - DNA, 16 bp, Homo sapiens
ccaggcccctgaggac

SEQ ID NO: 359325 - DNA, 23 bp, Homo sapiens
ccaggcccctgaggactggagac

SEQ ID NO: 359326 - DNA, 16 bp, Homo sapiens
ccaggccctagaccct

SEQ ID NO: 359327 - DNA, 12 bp, Homo sapiens
ccaggccctcag

SEQ ID NO: 359328 - DNA, 17 bp, Homo sapiens
ccaggccctccatgggc

SEQ ID NO: 359329 - DNA, 21 bp, Homo sapiens
ccaggccctccatgggctagt

SEQ ID NO: 359330 - DNA, 19 bp, Homo sapiens
ccaggccctcctgctggct

SEQ ID NO: 359331 - DNA, 20 bp, Homo sapiens
ccaggccctcctgctggctg

SEQ ID NO: 359332 - DNA, 21 bp, Homo sapiens
ccaggccctcctgctggctga

SEQ ID NO: 359333 - DNA, 16 bp, Homo sapiens
ccaggccgcatggccc

SEQ ID NO: 359334 - DNA, 15 bp, Homo sapiens
ccaggccgccccagc

SEQ ID NO: 359335 - DNA, 16 bp, Homo sapiens
ccaggccgtggctgcc

SEQ ID NO: 359336 - DNA, 18 bp, Homo sapiens
ccaggccgtggctgccca

SEQ ID NO: 359337 - DNA, 21 bp, Homo sapiens
ccaggccgttccccttggctt

SEQ ID NO: 359338 - DNA, 21 bp, Homo sapiens
ccaggcctccagcctctcccg

SEQ ID NO: 359339 - DNA, 21 bp, Homo sapiens
ccaggcctcccgcatgctgcc

SEQ ID NO: 359340 - DNA, 19 bp, Homo sapiens
ccaggcctgaaagaggctg

SEQ ID NO: 359341 - DNA, 14 bp, Homo sapiens
ccaggcctgaggct

SEQ ID NO: 359342 - DNA, 15 bp, Homo sapiens
ccaggcctgaggctg

SEQ ID NO: 359343 - DNA, 17 bp, Homo sapiens
ccaggcctgccagcccc

SEQ ID NO: 359344 - DNA, 12 bp, Homo sapiens
ccaggcctggag

SEQ ID NO: 359345 - DNA, 15 bp, Homo sapiens
ccaggcctggcctcg

SEQ ID NO: 359346 - DNA, 15 bp, Homo sapiens
ccaggcgcctgcgct

SEQ ID NO: 359347 - DNA, 16 bp, Homo sapiens
ccaggcgtagggccag

SEQ ID NO: 359348 - DNA, 20 bp, Homo sapiens
ccaggcgtagggccagggct

SEQ ID NO: 359349 - DNA, 21 bp, Homo sapiens
ccaggcgtagggccagggctc

SEQ ID NO: 359350 - DNA, 19 bp, Homo sapiens
ccaggcgttggtgccactt

SEQ ID NO: 359351 - DNA, 19 bp, Homo sapiens
ccatcccctccctgcctgc

SEQ ID NO: 359352 - DNA, 22 bp, Homo sapiens
ccatcccctccctgcctgctcc

SEQ ID NO: 359353 - DNA, 14 bp, Homo sapiens
ccatcccctcctag

SEQ ID NO: 359354 - DNA, 17 bp, Homo sapiens
ccatcccctcctagcac

SEQ ID NO: 359355 - DNA, 16 bp, Homo sapiens
ccatcccgaaaatctc

SEQ ID NO: 359356 - DNA, 13 bp, Homo sapiens
ccatcccgaagcc

SEQ ID NO: 359357 - DNA, 20 bp, Homo sapiens
ccatcccgaagccatcactt

SEQ ID NO: 359358 - DNA, 22 bp, Homo sapiens
ccatcccgaagccatcacttct

SEQ ID NO: 359359 - DNA, 23 bp, Homo sapiens
ccatccctaagaattcccagata

SEQ ID NO: 359360 - DNA, 18 bp, Homo sapiens
ccatccctcggacccacc

SEQ ID NO: 359361 - DNA, 14 bp, Homo sapiens
ccatccgtcaccag

SEQ ID NO: 359362 - DNA, 13 bp, Homo sapiens
ccatcctccagct

SEQ ID NO: 359363 - DNA, 16 bp, Homo sapiens
ccatcctccagcttct

SEQ ID NO: 359364 - DNA, 14 bp, Homo sapiens
ccatcctccccttc

SEQ ID NO: 359365 - DNA, 19 bp, Homo sapiens
ccatcctgccaggagcagc

SEQ ID NO: 359366 - DNA, 22 bp, Homo sapiens
ccatcctgccaggagcagcctc

SEQ ID NO: 359367 - DNA, 18 bp, Homo sapiens
ccatcctggcccctccag

SEQ ID NO: 359368 - DNA, 12 bp, Homo sapiens
ccatccttcccg

SEQ ID NO: 359369 - DNA, 21 bp, Homo sapiens
ccatccttcccgcagcaccag

SEQ ID NO: 359370 - DNA, 14 bp, Homo sapiens
ccatcggtcagcag

SEQ ID NO: 359371 - DNA, 19 bp, Homo sapiens
ccatctaatgcttgtttat

SEQ ID NO: 359372 - DNA, 17 bp, Homo sapiens
ccatctcagcctcctga

SEQ ID NO: 359373 - DNA, 23 bp, Homo sapiens
ccatctcagcctcctgagcctgt

SEQ ID NO: 359374 - DNA, 17 bp, Homo sapiens
ccatctcaggccacctg

SEQ ID NO: 359375 - DNA, 14 bp, Homo sapiens
ccatctccagggag

SEQ ID NO: 359376 - DNA, 19 bp, Homo sapiens
ccatctccccaggcctcca

SEQ ID NO: 359377 - DNA, 20 bp, Homo sapiens
ccatctccccaggcctccag

SEQ ID NO: 359378 - DNA, 18 bp, Homo sapiens
ccatctcctcccatggcc

SEQ ID NO: 359379 - DNA, 17 bp, Homo sapiens
ccatctccttcccccag

SEQ ID NO: 359380 - DNA, 22 bp, Homo sapiens
ccatctccttcccccagcccaa

SEQ ID NO: 359381 - DNA, 15 bp, Homo sapiens
ccatctctactaaaa

SEQ ID NO: 359382 - DNA, 13 bp, Homo sapiens
ccatctctctccc

SEQ ID NO: 359383 - DNA, 21 bp, Homo sapiens
ccatctcttcctacccaacca

SEQ ID NO: 359384 - DNA, 13 bp, Homo sapiens
ccatctgtaaata

SEQ ID NO: 359385 - DNA, 17 bp, Homo sapiens
ccatctgtaccctgctt

SEQ ID NO: 359386 - DNA, 19 bp, Homo sapiens
ccatctgtaccctgcttcc

SEQ ID NO: 359387 - DNA, 17 bp, Homo sapiens
ccatctgtctgtcctac

SEQ ID NO: 359388 - DNA, 15 bp, Homo sapiens
ccatctgtgtcctgg

SEQ ID NO: 359389 - DNA, 17 bp, Homo sapiens
ccatcttaaatttctaa

SEQ ID NO: 359390 - DNA, 21 bp, Homo sapiens
ccatcttcccgcctcagcctc

SEQ ID NO: 359391 - DNA, 18 bp, Homo sapiens
ccatcttcctgctgctgt

SEQ ID NO: 359392 - DNA, 17 bp, Homo sapiens
ccatcttggtagttctg

SEQ ID NO: 359393 - DNA, 21 bp, Homo sapiens
ccatcttggtagttctgtgcc

SEQ ID NO: 359394 - DNA, 23 bp, Homo sapiens
ccatcttttgttaagttcaccgt

SEQ ID NO: 359395 - DNA, 19 bp, Homo sapiens
ccatgaaaacgttttattg

SEQ ID NO: 359396 - DNA, 14 bp, Homo sapiens
ccatgaactttgtc

SEQ ID NO: 359397 - DNA, 16 bp, Homo sapiens
ccatgacagtagcata

SEQ ID NO: 359398 - DNA, 14 bp, Homo sapiens
ccatgaccaggcca

SEQ ID NO: 359399 - DNA, 15 bp, Homo sapiens
ccatgaccaggccac

SEQ ID NO: 359400 - DNA, 20 bp, Homo sapiens
ccatgaccaggccaccatct

SEQ ID NO: 359401 - DNA, 14 bp, Homo sapiens
ccatgaccatactg

SEQ ID NO: 359402 - DNA, 19 bp, Homo sapiens
ccatgactgcacccagctc

SEQ ID NO: 359403 - DNA, 18 bp, Homo sapiens
ccatgactgccccttgct

SEQ ID NO: 359404 - DNA, 19 bp, Homo sapiens
ccatgactgccccttgctt

SEQ ID NO: 359405 - DNA, 23 bp, Homo sapiens
ccatgactgccccttgcttctca

SEQ ID NO: 359406 - DNA, 16 bp, Homo sapiens
ccatgactggctgtct

SEQ ID NO: 359407 - DNA, 17 bp, Homo sapiens
ccatgagaagagggcct

SEQ ID NO: 359408 - DNA, 18 bp, Homo sapiens
ccatgagaagagggcctg

SEQ ID NO: 359409 - DNA, 21 bp, Homo sapiens
ccatgagaagagggcctgtgg

SEQ ID NO: 359410 - DNA, 19 bp, Homo sapiens
ccatgagcacctccagctg

SEQ ID NO: 359411 - DNA, 20 bp, Homo sapiens
ccatgagcacctccagctgt

SEQ ID NO: 359412 - DNA, 12 bp, Homo sapiens
ccatgagcctgc

SEQ ID NO: 359413 - DNA, 13 bp, Homo sapiens
ccatgagcctgcc

SEQ ID NO: 359414 - DNA, 13 bp, Homo sapiens
ccatgagctccag

SEQ ID NO: 359415 - DNA, 15 bp, Homo sapiens
ccatgagctccagac

SEQ ID NO: 359416 - DNA, 16 bp, Homo sapiens
ccatgagctccagacc

SEQ ID NO: 359417 - DNA, 18 bp, Homo sapiens
ccatgagctccagacccc

SEQ ID NO: 359418 - DNA, 18 bp, Homo sapiens
ccatgaggaacaaggcaa

SEQ ID NO: 359419 - DNA, 20 bp, Homo sapiens
ccatgaggaacaaggcaagg

SEQ ID NO: 359420 - DNA, 21 bp, Homo sapiens
ccatgaggtaaaagagccaag

SEQ ID NO: 359421 - DNA, 13 bp, Homo sapiens
ccatgagttgagt

SEQ ID NO: 359422 - DNA, 18 bp, Homo sapiens
ccatgatagctggggctt

SEQ ID NO: 359423 - DNA, 22 bp, Homo sapiens
ccatgatccctgtgttgtctct

SEQ ID NO: 359424 - DNA, 23 bp, Homo sapiens
ccatgatgtcgttcattttctgt

SEQ ID NO: 359425 - DNA, 17 bp, Homo sapiens
ccatgatgtggagtggg

SEQ ID NO: 359426 - DNA, 20 bp, Homo sapiens
ccatgattccaagggcccag

SEQ ID NO: 359427 - DNA, 14 bp, Homo sapiens
ccatgattcgccca

SEQ ID NO: 359428 - DNA, 16 bp, Homo sapiens
ccatgattttggccac

SEQ ID NO: 359429 - DNA, 18 bp, Homo sapiens
ccatgattttggccactt

SEQ ID NO: 359430 - DNA, 17 bp, Homo sapiens
ccatgcaactccatgcc

SEQ ID NO: 359431 - DNA, 18 bp, Homo sapiens
ccatgcaactccatgcct

SEQ ID NO: 359432 - DNA, 13 bp, Homo sapiens
ccatgcaccaaac

SEQ ID NO: 359433 - DNA, 17 bp, Homo sapiens
ccatgcacccctgatgt

SEQ ID NO: 359434 - DNA, 15 bp, Homo sapiens
ccatgcagataacag

SEQ ID NO: 359435 - DNA, 16 bp, Homo sapiens
ccatgcagatctagcc

SEQ ID NO: 359436 - DNA, 22 bp, Homo sapiens
ccatgcagatctagccaggcct

SEQ ID NO: 359437 - DNA, 22 bp, Homo sapiens
ccatgccaatagttgctgtccc

SEQ ID NO: 359438 - DNA, 14 bp, Homo sapiens
ccatgccaccaccc

SEQ ID NO: 359439 - DNA, 19 bp, Homo sapiens
ccatgccaccacccacccc

SEQ ID NO: 359440 - DNA, 15 bp, Homo sapiens
ccatgccactgccag

SEQ ID NO: 359441 - DNA, 16 bp, Homo sapiens
ccatgccactgccagg

SEQ ID NO: 359442 - DNA, 18 bp, Homo sapiens
ccatgccactgccaggca

SEQ ID NO: 359443 - DNA, 19 bp, Homo sapiens
ccatgccactgccaggcac

SEQ ID NO: 359444 - DNA, 20 bp, Homo sapiens
ccatgccactgccaggcacc

SEQ ID NO: 359445 - DNA, 13 bp, Homo sapiens
ccatgcccacctg

SEQ ID NO: 359446 - DNA, 16 bp, Homo sapiens
ccatgcccacctgccc

SEQ ID NO: 359447 - DNA, 12 bp, Homo sapiens
ccatgccctccg

SEQ ID NO: 359448 - DNA, 12 bp, Homo sapiens
ccatgccctgcc

SEQ ID NO: 359449 - DNA, 15 bp, Homo sapiens
ccatgcctatttact

SEQ ID NO: 359450 - DNA, 21 bp, Homo sapiens
ccatgcctatttactggaaac

SEQ ID NO: 359451 - DNA, 14 bp, Homo sapiens
ccatgcctcatgcc

SEQ ID NO: 359452 - DNA, 15 bp, Homo sapiens
ccatgcctcatgcca

SEQ ID NO: 359453 - DNA, 16 bp, Homo sapiens
ccatgcctcatgccac

SEQ ID NO: 359454 - DNA, 18 bp, Homo sapiens
ccatgcctcatgccacac

SEQ ID NO: 359455 - DNA, 17 bp, Homo sapiens
ccatgcctgagggtgga

SEQ ID NO: 359456 - DNA, 21 bp, Homo sapiens
ccatgctcctcactgcccgca

SEQ ID NO: 359457 - DNA, 14 bp, Homo sapiens
ccatgctctgcccc

SEQ ID NO: 359458 - DNA, 17 bp, Homo sapiens
ccatgctctgccccaag

SEQ ID NO: 359459 - DNA, 17 bp, Homo sapiens
ccatgctgccttcaggg

SEQ ID NO: 359460 - DNA, 19 bp, Homo sapiens
ccatgctggcggcgcagag

SEQ ID NO: 359461 - DNA, 21 bp, Homo sapiens
ccatgctggcggcgcagaggg

SEQ ID NO: 359462 - DNA, 13 bp, Homo sapiens
ccatggaagctgg

SEQ ID NO: 359463 - DNA, 15 bp, Homo sapiens
ccatggaagctggca

SEQ ID NO: 359464 - DNA, 18 bp, Homo sapiens
ccatggaagctggcagga

SEQ ID NO: 359465 - DNA, 21 bp, Homo sapiens
ccatggaagctggcaggagac

SEQ ID NO: 359466 - DNA, 22 bp, Homo sapiens
ccatggaagctggcaggagaca

SEQ ID NO: 359467 - DNA, 14 bp, Homo sapiens
ccatggagcacgag

SEQ ID NO: 359468 - DNA, 17 bp, Homo sapiens
ccatggaggcacacagc

SEQ ID NO: 359469 - DNA, 21 bp, Homo sapiens
ccatggatttcgtttttcttg

SEQ ID NO: 359470 - DNA, 16 bp, Homo sapiens
ccatggcaccagcccc

SEQ ID NO: 359471 - DNA, 22 bp, Homo sapiens
ccatggcaccagccccctggat

SEQ ID NO: 359472 - DNA, 23 bp, Homo sapiens
ccatggccaaggggccagctgcc

SEQ ID NO: 359473 - DNA, 11 bp, Homo sapiens
ccatggccacc

SEQ ID NO: 359474 - DNA, 12 bp, Homo sapiens
ccatggccaccc

SEQ ID NO: 359475 - DNA, 14 bp, Homo sapiens
ccatggccaccccg

SEQ ID NO: 359476 - DNA, 21 bp, Homo sapiens
ccatggccaccccgtgccacc

SEQ ID NO: 359477 - DNA, 12 bp, Homo sapiens
ccatggcccagc

SEQ ID NO: 359478 - DNA, 19 bp, Homo sapiens
ccatggcccagcagcttgg

SEQ ID NO: 359479 - DNA, 21 bp, Homo sapiens
ccatggccccagctggctggg

SEQ ID NO: 359480 - DNA, 13 bp, Homo sapiens
ccatggcccttcc

SEQ ID NO: 359481 - DNA, 12 bp, Homo sapiens
cccacctttggt

SEQ ID NO: 359482 - DNA, 13 bp, Homo sapiens
cccacgacaaaaa

SEQ ID NO: 359483 - DNA, 14 bp, Homo sapiens
cccacgagtcacct

SEQ ID NO: 359484 - DNA, 16 bp, Homo sapiens
cccacgagtcacctgc

SEQ ID NO: 359485 - DNA, 19 bp, Homo sapiens
cccacgagtcacctgcaag

SEQ ID NO: 359486 - DNA, 12 bp, Homo sapiens
cccacgcagagc

SEQ ID NO: 359487 - DNA, 13 bp, Homo sapiens
cccacgcagagcc

SEQ ID NO: 359488 - DNA, 14 bp, Homo sapiens
cccacgcagagccc

SEQ ID NO: 359489 - DNA, 16 bp, Homo sapiens
cccacgcagagccccg

SEQ ID NO: 359490 - DNA, 18 bp, Homo sapiens
cccacgcagagccccgga

SEQ ID NO: 359491 - DNA, 22 bp, Homo sapiens
cccacgcagagccccggagcac

SEQ ID NO: 359492 - DNA, 13 bp, Homo sapiens
cccacgctcctgc

SEQ ID NO: 359493 - DNA, 21 bp, Homo sapiens
cccacgctgggacacagaccg

SEQ ID NO: 359494 - DNA, 14 bp, Homo sapiens
cccacggccaccca

SEQ ID NO: 359495 - DNA, 14 bp, Homo sapiens
cccacggccactgc

SEQ ID NO: 359496 - DNA, 13 bp, Homo sapiens
cccacggccgtcc

SEQ ID NO: 359497 - DNA, 14 bp, Homo sapiens
cccacgtctggcca

SEQ ID NO: 359498 - DNA, 18 bp, Homo sapiens
cccacgtggactctgtgc

SEQ ID NO: 359499 - DNA, 19 bp, Homo sapiens
cccacgtggactctgtgct

SEQ ID NO: 359500 - DNA, 20 bp, Homo sapiens
cccacgtggcacctcctcac

SEQ ID NO: 359501 - DNA, 19 bp, Homo sapiens
cccactaagctttctcctt

SEQ ID NO: 359502 - DNA, 20 bp, Homo sapiens
cccactaagctttctccttt

SEQ ID NO: 359503 - DNA, 22 bp, Homo sapiens
cccactaagctttctcctttga

SEQ ID NO: 359504 - DNA, 15 bp, Homo sapiens
cccactagccctctt

SEQ ID NO: 359505 - DNA, 19 bp, Homo sapiens
cccactagccctctttctc

SEQ ID NO: 359506 - DNA, 13 bp, Homo sapiens
cccactcaccccc

SEQ ID NO: 359507 - DNA, 13 bp, Homo sapiens
cccactcagcatt

SEQ ID NO: 359508 - DNA, 22 bp, Homo sapiens
cccactcagcatttcggtgctt

SEQ ID NO: 359509 - DNA, 12 bp, Homo sapiens
cccactcccgtg

SEQ ID NO: 359510 - DNA, 21 bp, Homo sapiens
cccactctaggggtcaggctc

SEQ ID NO: 359511 - DNA, 21 bp, Homo sapiens
cccactctgctcccagcccct

SEQ ID NO: 359512 - DNA, 20 bp, Homo sapiens
cccactgatatcacgggccc

SEQ ID NO: 359513 - DNA, 21 bp, Homo sapiens
cccactgatatcacgggcccg

SEQ ID NO: 359514 - DNA, 23 bp, Homo sapiens
cccactgcacttggtgctgcttt

SEQ ID NO: 359515 - DNA, 15 bp, Homo sapiens
cccactgcctgccca

SEQ ID NO: 359516 - DNA, 15 bp, Homo sapiens
cccactggcagcatc

SEQ ID NO: 359517 - DNA, 21 bp, Homo sapiens
cccactgtccccctacccacc

SEQ ID NO: 359518 - DNA, 22 bp, Homo sapiens
cccactgtccccctacccaccg

SEQ ID NO: 359519 - DNA, 17 bp, Homo sapiens
cccactgtcctgggcgc

SEQ ID NO: 359520 - DNA, 18 bp, Homo sapiens
cccactgtcctgggcgcc

SEQ ID NO: 359521 - DNA, 21 bp, Homo sapiens
cccactgtcctttctccaggc

SEQ ID NO: 359522 - DNA, 17 bp, Homo sapiens
cccactgtggggcaagc

SEQ ID NO: 359523 - DNA, 17 bp, Homo sapiens
cccacttatgctgctgt

SEQ ID NO: 359524 - DNA, 22 bp, Homo sapiens
cccacttatgctgctgtgaatt

SEQ ID NO: 359525 - DNA, 20 bp, Homo sapiens
cccagaaagcctcctgcccc

SEQ ID NO: 359526 - DNA, 14 bp, Homo sapiens
cccagaaaggagac

SEQ ID NO: 359527 - DNA, 17 bp, Homo sapiens
cccagaaccccaactcc

SEQ ID NO: 359528 - DNA, 21 bp, Homo sapiens
cccagaaccccaactcccagc

SEQ ID NO: 359529 - DNA, 17 bp, Homo sapiens
cccagaacctttttata

SEQ ID NO: 359530 - DNA, 13 bp, Homo sapiens
cccagaacgggcc

SEQ ID NO: 359531 - DNA, 16 bp, Homo sapiens
cccagaacgggcctcc

SEQ ID NO: 359532 - DNA, 17 bp, Homo sapiens
cccagaacgggcctccc

SEQ ID NO: 359533 - DNA, 18 bp, Homo sapiens
cccagaacgggcctcccc

SEQ ID NO: 359534 - DNA, 14 bp, Homo sapiens
cccagaactgcccc

SEQ ID NO: 359535 - DNA, 18 bp, Homo sapiens
cccagaactgcccccact

SEQ ID NO: 359536 - DNA, 22 bp, Homo sapiens
cccagaagatgtattcagagcc

SEQ ID NO: 359537 - DNA, 16 bp, Homo sapiens
cccagacaaggagagc

SEQ ID NO: 359538 - DNA, 16 bp, Homo sapiens
cccagacaccacagac

SEQ ID NO: 359539 - DNA, 14 bp, Homo sapiens
cccagacaggccct

SEQ ID NO: 359540 - DNA, 22 bp, Homo sapiens
cccagacaggccctccctgtct

SEQ ID NO: 359541 - DNA, 15 bp, Homo sapiens
cccagacccagggca

SEQ ID NO: 359542 - DNA, 14 bp, Homo sapiens
cccagaccccaggg

SEQ ID NO: 359543 - DNA, 21 bp, Homo sapiens
cccagaccccatccagccagg

SEQ ID NO: 359544 - DNA, 23 bp, Homo sapiens
cccagacctcccctcttcctgga

SEQ ID NO: 359545 - DNA, 13 bp, Homo sapiens
cccagactacagg

SEQ ID NO: 359546 - DNA, 15 bp, Homo sapiens
cccagactacagggc

SEQ ID NO: 359547 - DNA, 19 bp, Homo sapiens
cccagacttgtttcctgtg

SEQ ID NO: 359548 - DNA, 16 bp, Homo sapiens
cccagagaacaatcac

SEQ ID NO: 359549 - DNA, 18 bp, Homo sapiens
cccagagaagcctcagtc

SEQ ID NO: 359550 - DNA, 15 bp, Homo sapiens
cccagagactgccca

SEQ ID NO: 359551 - DNA, 14 bp, Homo sapiens
cccagagagaaaaa

SEQ ID NO: 359552 - DNA, 17 bp, Homo sapiens
cccagagagaaaaagag

SEQ ID NO: 359553 - DNA, 19 bp, Homo sapiens
cccagagagaccctgccaa

SEQ ID NO: 359554 - DNA, 12 bp, Homo sapiens
cccagagagctg

SEQ ID NO: 359555 - DNA, 21 bp, Homo sapiens
cccagagagctgaagtactgc

SEQ ID NO: 359556 - DNA, 16 bp, Homo sapiens
cccagagcaggaggcc

SEQ ID NO: 359557 - DNA, 19 bp, Homo sapiens
cccagagccagggctgtcc

SEQ ID NO: 359558 - DNA, 20 bp, Homo sapiens
cccagagccagggctgtcct

SEQ ID NO: 359559 - DNA, 15 bp, Homo sapiens
cccagagccccactc

SEQ ID NO: 359560 - DNA, 14 bp, Homo sapiens
cccagagctgggtg

SEQ ID NO: 359561 - DNA, 11 bp, Homo sapiens
cccagagctgt

SEQ ID NO: 359562 - DNA, 20 bp, Homo sapiens
cccagagctgtttatggcct

SEQ ID NO: 359563 - DNA, 21 bp, Homo sapiens
cccagagctgtttatggcctc

SEQ ID NO: 359564 - DNA, 22 bp, Homo sapiens
cccagagctgtttatggcctca

SEQ ID NO: 359565 - DNA, 23 bp, Homo sapiens
cccagagcttattggccactggg

SEQ ID NO: 359566 - DNA, 16 bp, Homo sapiens
cccagaggctcccaat

SEQ ID NO: 359567 - DNA, 14 bp, Homo sapiens
cccagaggctcctg

SEQ ID NO: 359568 - DNA, 16 bp, Homo sapiens
cccagaggctcctgga

SEQ ID NO: 359569 - DNA, 18 bp, Homo sapiens
cccagaggctcctggagc

SEQ ID NO: 359570 - DNA, 19 bp, Homo sapiens
cccagaggctcctggagcc

SEQ ID NO: 359571 - DNA, 21 bp, Homo sapiens
cccagaggctcctggagccag

SEQ ID NO: 359572 - DNA, 16 bp, Homo sapiens
cccagagggaccagct

SEQ ID NO: 359573 - DNA, 19 bp, Homo sapiens
cccagagggaccagctggg

SEQ ID NO: 359574 - DNA, 21 bp, Homo sapiens
cccagagggaccagctggggg

SEQ ID NO: 359575 - DNA, 20 bp, Homo sapiens
cccagaggtgggatcctccc

SEQ ID NO: 359576 - DNA, 15 bp, Homo sapiens
cccagaggtggggaa

SEQ ID NO: 359577 - DNA, 19 bp, Homo sapiens
cccagaggttatctgcctg

SEQ ID NO: 359578 - DNA, 20 bp, Homo sapiens
cccagaggttatctgcctgg

SEQ ID NO: 359579 - DNA, 15 bp, Homo sapiens
cccagagtagcccag

SEQ ID NO: 359580 - DNA, 18 bp, Homo sapiens
cccagataccagcccctg

SEQ ID NO: 359581 - DNA, 20 bp, Homo sapiens
cccagatagagctgggtggc

SEQ ID NO: 359582 - DNA, 14 bp, Homo sapiens
cccagatagtccca

SEQ ID NO: 359583 - DNA, 17 bp, Homo sapiens
cccagatagtcccagca

SEQ ID NO: 359584 - DNA, 21 bp, Homo sapiens
cccagatcgttctgccacttg

SEQ ID NO: 359585 - DNA, 22 bp, Homo sapiens
cccagatcgttctgccacttgc

SEQ ID NO: 359586 - DNA, 15 bp, Homo sapiens
cccagatctgcctgg

SEQ ID NO: 359587 - DNA, 18 bp, Homo sapiens
cccagatctgcctgggcc

SEQ ID NO: 359588 - DNA, 18 bp, Homo sapiens
cccagatctggtcccttg

SEQ ID NO: 359589 - DNA, 19 bp, Homo sapiens
cccagatctggtcccttgc

SEQ ID NO: 359590 - DNA, 23 bp, Homo sapiens
cccagatgccctttggaaagcca

SEQ ID NO: 359591 - DNA, 13 bp, Homo sapiens
cccagcaaccctc

SEQ ID NO: 359592 - DNA, 14 bp, Homo sapiens
cccagcaaggcaca

SEQ ID NO: 359593 - DNA, 14 bp, Homo sapiens
cccagcacactgct

SEQ ID NO: 359594 - DNA, 18 bp, Homo sapiens
cccagcacactgcttctc

SEQ ID NO: 359595 - DNA, 13 bp, Homo sapiens
cccagcacctgcc

SEQ ID NO: 359596 - DNA, 16 bp, Homo sapiens
cccagcacctgccagg

SEQ ID NO: 359597 - DNA, 19 bp, Homo sapiens
cccagcacctgccagggcc

SEQ ID NO: 359598 - DNA, 20 bp, Homo sapiens
cccagcacctgccagggccc

SEQ ID NO: 359599 - DNA, 14 bp, Homo sapiens
cccagcacctggca

SEQ ID NO: 359600 - DNA, 16 bp, Homo sapiens
cccagcacctggcaca

SEQ ID NO: 359601 - DNA, 12 bp, Homo sapiens
cccagcagagcc

SEQ ID NO: 359602 - DNA, 22 bp, Homo sapiens
cccagcagagccgttcctggga

SEQ ID NO: 359603 - DNA, 22 bp, Homo sapiens
cccagcagccctaaggatctct

SEQ ID NO: 359604 - DNA, 14 bp, Homo sapiens
cccagcaggggcag

SEQ ID NO: 359605 - DNA, 19 bp, Homo sapiens
cccagcaggtggggagggg

SEQ ID NO: 359606 - DNA, 15 bp, Homo sapiens
cccagcattccagct

SEQ ID NO: 359607 - DNA, 22 bp, Homo sapiens
cccagcattccagctctgcccc

SEQ ID NO: 359608 - DNA, 17 bp, Homo sapiens
cccagcatttgtccacc

SEQ ID NO: 359609 - DNA, 14 bp, Homo sapiens
cccagccaccacca

SEQ ID NO: 359610 - DNA, 21 bp, Homo sapiens
cccagccaccaccactgtccc

SEQ ID NO: 359611 - DNA, 22 bp, Homo sapiens
ccccagggtgcaggcgcgcacc

SEQ ID NO: 359612 - DNA, 17 bp, Homo sapiens
ccccaggtgccaccaat

SEQ ID NO: 359613 - DNA, 23 bp, Homo sapiens
ccccaggtgtgttggggccttgg

SEQ ID NO: 359614 - DNA, 14 bp, Homo sapiens
ccccagtacctcca

SEQ ID NO: 359615 - DNA, 16 bp, Homo sapiens
ccccagtcctggttca

SEQ ID NO: 359616 - DNA, 16 bp, Homo sapiens
ccccagtgaggacctc

SEQ ID NO: 359617 - DNA, 16 bp, Homo sapiens
ccccagtgcacccact

SEQ ID NO: 359618 - DNA, 24 bp, Homo sapiens
ccccagtgcctgccactctctggg

SEQ ID NO: 359619 - DNA, 18 bp, Homo sapiens
ccccagtgtattttgtcc

SEQ ID NO: 359620 - DNA, 17 bp, Homo sapiens
ccccagttggggctgcg

SEQ ID NO: 359621 - DNA, 17 bp, Homo sapiens
ccccatatataaattat

SEQ ID NO: 359622 - DNA, 18 bp, Homo sapiens
ccccatcagttcccccag

SEQ ID NO: 359623 - DNA, 12 bp, Homo sapiens
ccccatccccac

SEQ ID NO: 359624 - DNA, 14 bp, Homo sapiens
ccccatccccacca

SEQ ID NO: 359625 - DNA, 15 bp, Homo sapiens
ccccatccccaccag

SEQ ID NO: 359626 - DNA, 14 bp, Homo sapiens
ccccatcctccagc

SEQ ID NO: 359627 - DNA, 16 bp, Homo sapiens
ccccatcctccagctt

SEQ ID NO: 359628 - DNA, 13 bp, Homo sapiens
ccccatcctcccc

SEQ ID NO: 359629 - DNA, 17 bp, Homo sapiens
ccccatcctccccttcc

SEQ ID NO: 359630 - DNA, 17 bp, Homo sapiens
ccccatctccccaggcc

SEQ ID NO: 359631 - DNA, 19 bp, Homo sapiens
ccccatctccccaggcctc

SEQ ID NO: 359632 - DNA, 12 bp, Homo sapiens
ccccatctctcc

SEQ ID NO: 359633 - DNA, 19 bp, Homo sapiens
ccccatctctccctcccct

SEQ ID NO: 359634 - DNA, 14 bp, Homo sapiens
ccccatctctgctg

SEQ ID NO: 359635 - DNA, 22 bp, Homo sapiens
ccccatctctgctgcttctggg

SEQ ID NO: 359636 - DNA, 14 bp, Homo sapiens
ccccatctgctgag

SEQ ID NO: 359637 - DNA, 13 bp, Homo sapiens
ccccatgcctgtc

SEQ ID NO: 359638 - DNA, 15 bp, Homo sapiens
ccccatgcctgtcca

SEQ ID NO: 359639 - DNA, 20 bp, Homo sapiens
ccccatgcctgtccagcctg

SEQ ID NO: 359640 - DNA, 23 bp, Homo sapiens
ccccatgcctgtccagcctgggc

SEQ ID NO: 359641 - DNA, 14 bp, Homo sapiens
ccccatgctctgcc

SEQ ID NO: 359642 - DNA, 15 bp, Homo sapiens
ccccatgctctgccc

SEQ ID NO: 359643 - DNA, 18 bp, Homo sapiens
ccccatgctgccttcagg

SEQ ID NO: 359644 - DNA, 12 bp, Homo sapiens
ccccatgggctt

SEQ ID NO: 359645 - DNA, 15 bp, Homo sapiens
ccccatgggcttgga

SEQ ID NO: 359646 - DNA, 17 bp, Homo sapiens
ccccatgggcttggact

SEQ ID NO: 359647 - DNA, 19 bp, Homo sapiens
ccccatggtgcagtgaaga

SEQ ID NO: 359648 - DNA, 21 bp, Homo sapiens
ccccatgtttaaactttgtgc

SEQ ID NO: 359649 - DNA, 20 bp, Homo sapiens
ccccattagtatcctgttag

SEQ ID NO: 359650 - DNA, 13 bp, Homo sapiens
ccccattctccct

SEQ ID NO: 359651 - DNA, 18 bp, Homo sapiens
ccccattgtgaatgttgt

SEQ ID NO: 359652 - DNA, 16 bp, Homo sapiens
ccccatttcctcttcc

SEQ ID NO: 359653 - DNA, 18 bp, Homo sapiens
ccccatttcctcttcctt

SEQ ID NO: 359654 - DNA, 20 bp, Homo sapiens
ccccatttctatttatttac

SEQ ID NO: 359655 - DNA, 15 bp, Homo sapiens
cccccaaagacctgc

SEQ ID NO: 359656 - DNA, 16 bp, Homo sapiens
cccccaaatcttcctc

SEQ ID NO: 359657 - DNA, 21 bp, Homo sapiens
cccccaacttcaccaccccct

SEQ ID NO: 359658 - DNA, 21 bp, Homo sapiens
cccccaacttgagatgtatga

SEQ ID NO: 359659 - DNA, 17 bp, Homo sapiens
cccccacacctcagttc

SEQ ID NO: 359660 - DNA, 13 bp, Homo sapiens
cccccacccctac

SEQ ID NO: 359661 - DNA, 22 bp, Homo sapiens
cccccacccctacagcctgcac

SEQ ID NO: 359662 - DNA, 12 bp, Homo sapiens
cccccacccttt

SEQ ID NO: 359663 - DNA, 12 bp, Homo sapiens
cccccacggccg

SEQ ID NO: 359664 - DNA, 16 bp, Homo sapiens
cccccagaaagcctcc

SEQ ID NO: 359665 - DNA, 19 bp, Homo sapiens
cccccagaaagcctcctgc

SEQ ID NO: 359666 - DNA, 23 bp, Homo sapiens
cccccagaccccgcccctgggga

SEQ ID NO: 359667 - DNA, 12 bp, Homo sapiens
cccccagagcca

SEQ ID NO: 359668 - DNA, 16 bp, Homo sapiens
cccccagagccagggc

SEQ ID NO: 359669 - DNA, 17 bp, Homo sapiens
cccccagagccagggct

SEQ ID NO: 359670 - DNA, 20 bp, Homo sapiens
cccccagatagagctgggtg

SEQ ID NO: 359671 - DNA, 13 bp, Homo sapiens
cccccagccagga

SEQ ID NO: 359672 - DNA, 12 bp, Homo sapiens
cccccagcccaa

SEQ ID NO: 359673 - DNA, 14 bp, Homo sapiens
cccccagccctgtg

SEQ ID NO: 359674 - DNA, 15 bp, Homo sapiens
cccccaggctgcgcc

SEQ ID NO: 359675 - DNA, 20 bp, Homo sapiens
cccccaggctgcgcctgccc

SEQ ID NO: 359676 - DNA, 23 bp, Homo sapiens
cccccatccccatcctccagctt

SEQ ID NO: 359677 - DNA, 19 bp, Homo sapiens
cccccatcctccccttccc

SEQ ID NO: 359678 - DNA, 11 bp, Homo sapiens
cccccatgctg

SEQ ID NO: 359679 - DNA, 20 bp, Homo sapiens
cccccatgctgccttcaggg

SEQ ID NO: 359680 - DNA, 13 bp, Homo sapiens
cccccatgtggct

SEQ ID NO: 359681 - DNA, 12 bp, Homo sapiens
ccccccaaatct

SEQ ID NO: 359682 - DNA, 16 bp, Homo sapiens
ccccccagagccaggg

SEQ ID NO: 359683 - DNA, 14 bp, Homo sapiens
ccccccaggtgctg

SEQ ID NO: 359684 - DNA, 13 bp, Homo sapiens
cccccccccccgc

SEQ ID NO: 359685 - DNA, 13 bp, Homo sapiens
cccccctccccaa

SEQ ID NO: 359686 - DNA, 12 bp, Homo sapiens
ccccccttccca

SEQ ID NO: 359687 - DNA, 17 bp, Homo sapiens
cccccgacactgctgca

SEQ ID NO: 359688 - DNA, 22 bp, Homo sapiens
cccccgcagtccccagcccttc

SEQ ID NO: 359689 - DNA, 23 bp, Homo sapiens
cccccgcagtccccagcccttct

SEQ ID NO: 359690 - DNA, 17 bp, Homo sapiens
cccccgccacggccacc

SEQ ID NO: 359691 - DNA, 12 bp, Homo sapiens
cccccgcccacc

SEQ ID NO: 359692 - DNA, 18 bp, Homo sapiens
cccccgccccgccccaca

SEQ ID NO: 359693 - DNA, 15 bp, Homo sapiens
cccccggaggcgccc

SEQ ID NO: 359694 - DNA, 17 bp, Homo sapiens
cccccggaggcgcccac

SEQ ID NO: 359695 - DNA, 20 bp, Homo sapiens
cccccggaggcgcccacctg

SEQ ID NO: 359696 - DNA, 21 bp, Homo sapiens
cccccggcctccaggctgggg

SEQ ID NO: 359697 - DNA, 24 bp, Homo sapiens
cccccgggtttggcgggccaagga

SEQ ID NO: 359698 - DNA, 15 bp, Homo sapiens
cccccgtctcctgcc

SEQ ID NO: 359699 - DNA, 21 bp, Homo sapiens
cccccgtctcctgccgggcag

SEQ ID NO: 359700 - DNA, 16 bp, Homo sapiens
ccccctaactttcttg

SEQ ID NO: 359701 - DNA, 19 bp, Homo sapiens
ccccctaactttcttgctt

SEQ ID NO: 359702 - DNA, 12 bp, Homo sapiens
ccccctccccaa

SEQ ID NO: 359703 - DNA, 13 bp, Homo sapiens
ccccctcctccag

SEQ ID NO: 359704 - DNA, 14 bp, Homo sapiens
ccccctcctccagt

SEQ ID NO: 359705 - DNA, 15 bp, Homo sapiens
ccccctcctccagta

SEQ ID NO: 359706 - DNA, 13 bp, Homo sapiens
ccccctcggagcc

SEQ ID NO: 359707 - DNA, 14 bp, Homo sapiens
ccccctcggagcct

SEQ ID NO: 359708 - DNA, 19 bp, Homo sapiens
ccccctcggagcctgtgtt

SEQ ID NO: 359709 - DNA, 11 bp, Homo sapiens
ccccctgagtg

SEQ ID NO: 359710 - DNA, 14 bp, Homo sapiens
ccccctgcacccac

SEQ ID NO: 359711 - DNA, 16 bp, Homo sapiens
ccccctgcacccaccc

SEQ ID NO: 359712 - DNA, 23 bp, Homo sapiens
ccccctgccccttctacactctc

SEQ ID NO: 359713 - DNA, 23 bp, Homo sapiens
ccccctggatgggcattgggctg

SEQ ID NO: 359714 - DNA, 20 bp, Homo sapiens
ccccctggggcttctcctga

SEQ ID NO: 359715 - DNA, 21 bp, Homo sapiens
ccccctggggcttctcctgac

SEQ ID NO: 359716 - DNA, 21 bp, Homo sapiens
ccccctggggggcacagccag

SEQ ID NO: 359717 - DNA, 12 bp, Homo sapiens
ccccctgtccca

SEQ ID NO: 359718 - DNA, 13 bp, Homo sapiens
cccccttcccctg

SEQ ID NO: 359719 - DNA, 19 bp, Homo sapiens
cccccttcccctgcgccct

SEQ ID NO: 359720 - DNA, 17 bp, Homo sapiens
cccccttctcccacact

SEQ ID NO: 359721 - DNA, 18 bp, Homo sapiens
cccccttgaatctgcagg

SEQ ID NO: 359722 - DNA, 20 bp, Homo sapiens
cccccttgaatctgcaggga

SEQ ID NO: 359723 - DNA, 15 bp, Homo sapiens
ccccctttgctgtga

SEQ ID NO: 359724 - DNA, 14 bp, Homo sapiens
ccccgacactgctg

SEQ ID NO: 359725 - DNA, 15 bp, Homo sapiens
ccccgacagtggctc

SEQ ID NO: 359726 - DNA, 21 bp, Homo sapiens
ccccgacgccacagcccagcc

SEQ ID NO: 359727 - DNA, 20 bp, Homo sapiens
ccccgagccgagctctcctg

SEQ ID NO: 359728 - DNA, 22 bp, Homo sapiens
ccccgagccgagctctcctggg

SEQ ID NO: 359729 - DNA, 22 bp, Homo sapiens
ccccgatccccgacagtggctc

SEQ ID NO: 359730 - DNA, 13 bp, Homo sapiens
ccccgcagcccgc

SEQ ID NO: 359731 - DNA, 14 bp, Homo sapiens
ccccgcagcccgtg

SEQ ID NO: 359732 - DNA, 12 bp, Homo sapiens
ccccgcagtccc

SEQ ID NO: 359733 - DNA, 19 bp, Homo sapiens
ccccgcagtccccagccct

SEQ ID NO: 359734 - DNA, 16 bp, Homo sapiens
ccccgccccacattcc

SEQ ID NO: 359735 - DNA, 12 bp, Homo sapiens
ccccgccccaga

SEQ ID NO: 359736 - DNA, 13 bp, Homo sapiens
ccccgccccagag

SEQ ID NO: 359737 - DNA, 15 bp, Homo sapiens
ccccgccccagagct

SEQ ID NO: 359738 - DNA, 13 bp, Homo sapiens
ccccgccccgccc

SEQ ID NO: 359739 - DNA, 23 bp, Homo sapiens
ccccgcccgccctcctctgcccc

SEQ ID NO: 359740 - DNA, 14 bp, Homo sapiens
ccccgccctctgcc

SEQ ID NO: 359741 - DNA, 14 bp, Homo sapiens
ccccgcctccactc

SEQ ID NO: 359742 - DNA, 13 bp, Homo sapiens
ccccgccttccct

SEQ ID NO: 359743 - DNA, 22 bp, Homo sapiens
cccgtcggactgcccccagaaa

SEQ ID NO: 359744 - DNA, 19 bp, Homo sapiens
cccgtcttcaatctctgtt

SEQ ID NO: 359745 - DNA, 22 bp, Homo sapiens
cccgtgaactcaccgctcaccc

SEQ ID NO: 359746 - DNA, 18 bp, Homo sapiens
cccgtgaagcagtgcctc

SEQ ID NO: 359747 - DNA, 18 bp, Homo sapiens
cccgtgcaaaacatgcta

SEQ ID NO: 359748 - DNA, 13 bp, Homo sapiens
cccgtgcagactg

SEQ ID NO: 359749 - DNA, 15 bp, Homo sapiens
cccgtgccaggagca

SEQ ID NO: 359750 - DNA, 20 bp, Homo sapiens
cccgtgcggcccgtgcgcag

SEQ ID NO: 359751 - DNA, 22 bp, Homo sapiens
cccgtgcggcccgtgcgcagcc

SEQ ID NO: 359752 - DNA, 14 bp, Homo sapiens
cccgtgtggcccct

SEQ ID NO: 359753 - DNA, 19 bp, Homo sapiens
cccgttctgctggcctgga

SEQ ID NO: 359754 - DNA, 19 bp, Homo sapiens
cccgttgccgggcctggac

SEQ ID NO: 359755 - DNA, 23 bp, Homo sapiens
cccgttgtgtgggtttactctgt

SEQ ID NO: 359756 - DNA, 20 bp, Homo sapiens
ccctaactttcttgcttcaa

SEQ ID NO: 359757 - DNA, 19 bp, Homo sapiens
ccctaagctccaggtgccc

SEQ ID NO: 359758 - DNA, 16 bp, Homo sapiens
ccctaagtgcccaaag

SEQ ID NO: 359759 - DNA, 17 bp, Homo sapiens
ccctaagtgcccaaagt

SEQ ID NO: 359760 - DNA, 14 bp, Homo sapiens
ccctaatcctccaa

SEQ ID NO: 359761 - DNA, 13 bp, Homo sapiens
ccctaattctctt

SEQ ID NO: 359762 - DNA, 17 bp, Homo sapiens
ccctaattctcttcgct

SEQ ID NO: 359763 - DNA, 19 bp, Homo sapiens
ccctacacctctgggccct

SEQ ID NO: 359764 - DNA, 14 bp, Homo sapiens
ccctacagcctgca

SEQ ID NO: 359765 - DNA, 17 bp, Homo sapiens
ccctacagcctgcacac

SEQ ID NO: 359766 - DNA, 19 bp, Homo sapiens
ccctacagcctgcacacac

SEQ ID NO: 359767 - DNA, 20 bp, Homo sapiens
ccctacagcctgcacacacc

SEQ ID NO: 359768 - DNA, 13 bp, Homo sapiens
ccctacagtatat

SEQ ID NO: 359769 - DNA, 16 bp, Homo sapiens
ccctaccactgagccc

SEQ ID NO: 359770 - DNA, 18 bp, Homo sapiens
ccctaccactgagccctt

SEQ ID NO: 359771 - DNA, 19 bp, Homo sapiens
ccctaccactgagcccttg

SEQ ID NO: 359772 - DNA, 20 bp, Homo sapiens
ccctaccagcgcccgctggg

SEQ ID NO: 359773 - DNA, 22 bp, Homo sapiens
ccctaccagcgcccgctgggct

SEQ ID NO: 359774 - DNA, 23 bp, Homo sapiens
ccctaccagcgcccgctgggctg

SEQ ID NO: 359775 - DNA, 12 bp, Homo sapiens
ccctacccaccg

SEQ ID NO: 359776 - DNA, 19 bp, Homo sapiens
ccctaccccacaccaggcc

SEQ ID NO: 359777 - DNA, 21 bp, Homo sapiens
ccctaccgagtctcttctcca

SEQ ID NO: 359778 - DNA, 18 bp, Homo sapiens
ccctacctcaacctgtaa

SEQ ID NO: 359779 - DNA, 19 bp, Homo sapiens
ccctacctcaacctgtaaa

SEQ ID NO: 359780 - DNA, 20 bp, Homo sapiens
ccctaccttgagaccctctt

SEQ ID NO: 359781 - DNA, 14 bp, Homo sapiens
ccctactggctgta

SEQ ID NO: 359782 - DNA, 23 bp, Homo sapiens
ccctacttaggaaatactcagca

SEQ ID NO: 359783 - DNA, 23 bp, Homo sapiens
ccctagaaagccatattccagca

SEQ ID NO: 359784 - DNA, 19 bp, Homo sapiens
ccctagaatcagcctaggg

SEQ ID NO: 359785 - DNA, 20 bp, Homo sapiens
ccctagaccctcccccacca

SEQ ID NO: 359786 - DNA, 21 bp, Homo sapiens
ccctagaggcgagccaggcaa

SEQ ID NO: 359787 - DNA, 19 bp, Homo sapiens
ccctagagggttcctgtag

SEQ ID NO: 359788 - DNA, 21 bp, Homo sapiens
ccctaggcatactctccagga

SEQ ID NO: 359789 - DNA, 15 bp, Homo sapiens
ccctaggcgcggttc

SEQ ID NO: 359790 - DNA, 13 bp, Homo sapiens
ccctagggctggg

SEQ ID NO: 359791 - DNA, 16 bp, Homo sapiens
ccctagggctgggtgt

SEQ ID NO: 359792 - DNA, 22 bp, Homo sapiens
ccctaggtcagcttgctgccct

SEQ ID NO: 359793 - DNA, 23 bp, Homo sapiens
ccctaggtgggtcaactccaagg

SEQ ID NO: 359794 - DNA, 16 bp, Homo sapiens
ccctagtcccttcccc

SEQ ID NO: 359795 - DNA, 16 bp, Homo sapiens
ccctagtgatttttgg

SEQ ID NO: 359796 - DNA, 13 bp, Homo sapiens
ccctagttctttg

SEQ ID NO: 359797 - DNA, 21 bp, Homo sapiens
ccctataccctaggtctccac

SEQ ID NO: 359798 - DNA, 17 bp, Homo sapiens
ccctatcctgcaccctc

SEQ ID NO: 359799 - DNA, 16 bp, Homo sapiens
ccctatccttggcacc

SEQ ID NO: 359800 - DNA, 17 bp, Homo sapiens
ccctatctaaccctccc

SEQ ID NO: 359801 - DNA, 16 bp, Homo sapiens
ccctatggggatggtc

SEQ ID NO: 359802 - DNA, 14 bp, Homo sapiens
ccctatgtcccagc

SEQ ID NO: 359803 - DNA, 15 bp, Homo sapiens
ccctatgtcccagcc

SEQ ID NO: 359804 - DNA, 17 bp, Homo sapiens
ccctatgtcccagcccc

SEQ ID NO: 359805 - DNA, 23 bp, Homo sapiens
ccctcaagccaggagaccctgtc

SEQ ID NO: 359806 - DNA, 14 bp, Homo sapiens
ccctcaccccaagg

SEQ ID NO: 359807 - DNA, 23 bp, Homo sapiens
ccctcacccgctgcccagccctc

SEQ ID NO: 359808 - DNA, 21 bp, Homo sapiens
ccctcacctcaggaccccaga

SEQ ID NO: 359809 - DNA, 23 bp, Homo sapiens
ccctcacctcaggaccccagagg

SEQ ID NO: 359810 - DNA, 14 bp, Homo sapiens
ccctcacctgggca

SEQ ID NO: 359811 - DNA, 15 bp, Homo sapiens
ccctcacctgggcac

SEQ ID NO: 359812 - DNA, 13 bp, Homo sapiens
ccctcactccact

SEQ ID NO: 359813 - DNA, 15 bp, Homo sapiens
ccctcactccactcc

SEQ ID NO: 359814 - DNA, 13 bp, Homo sapiens
ccctcactctgcc

SEQ ID NO: 359815 - DNA, 17 bp, Homo sapiens
ccctcactctgccaggg

SEQ ID NO: 359816 - DNA, 18 bp, Homo sapiens
ccctcactctgccagggc

SEQ ID NO: 359817 - DNA, 17 bp, Homo sapiens
ccctcactgctggggag

SEQ ID NO: 359818 - DNA, 14 bp, Homo sapiens
ccctcagagccctg

SEQ ID NO: 359819 - DNA, 13 bp, Homo sapiens
ccctcagatggca

SEQ ID NO: 359820 - DNA, 12 bp, Homo sapiens
ccctcagcccct

SEQ ID NO: 359821 - DNA, 12 bp, Homo sapiens
ccctcagccctt

SEQ ID NO: 359822 - DNA, 12 bp, Homo sapiens
ccctcagcgctc

SEQ ID NO: 359823 - DNA, 20 bp, Homo sapiens
ccctcaggcataggcctggg

SEQ ID NO: 359824 - DNA, 22 bp, Homo sapiens
ccctcagtcagttcccggagca

SEQ ID NO: 359825 - DNA, 13 bp, Homo sapiens
ccctcatccacta

SEQ ID NO: 359826 - DNA, 21 bp, Homo sapiens
ccctcatcttgaagggcccag

SEQ ID NO: 359827 - DNA, 23 bp, Homo sapiens
ccctcatcttgaagggcccagga

SEQ ID NO: 359828 - DNA, 16 bp, Homo sapiens
ccctcatgttctcatg

SEQ ID NO: 359829 - DNA, 15 bp, Homo sapiens
ccctccaaaagcact

SEQ ID NO: 359830 - DNA, 17 bp, Homo sapiens
ccctccacacctccacc

SEQ ID NO: 359831 - DNA, 18 bp, Homo sapiens
ccctccacacctccaccc

SEQ ID NO: 359832 - DNA, 19 bp, Homo sapiens
ccctccacacctccacccg

SEQ ID NO: 359833 - DNA, 15 bp, Homo sapiens
ccctccacatccctg

SEQ ID NO: 359834 - DNA, 14 bp, Homo sapiens
ccctccaccccagt

SEQ ID NO: 359835 - DNA, 19 bp, Homo sapiens
ccctccacctcctctcttg

SEQ ID NO: 359836 - DNA, 20 bp, Homo sapiens
ccctccagacacccagaatg

SEQ ID NO: 359837 - DNA, 14 bp, Homo sapiens
ccctccagaccctg

SEQ ID NO: 359838 - DNA, 15 bp, Homo sapiens
ccctccagcacagac

SEQ ID NO: 359839 - DNA, 16 bp, Homo sapiens
ccctccagcacagact

SEQ ID NO: 359840 - DNA, 13 bp, Homo sapiens
ccctccaggaaca

SEQ ID NO: 359841 - DNA, 15 bp, Homo sapiens
ccctccaggcatgct

SEQ ID NO: 359842 - DNA, 19 bp, Homo sapiens
ccctccaggcatgctggcc

SEQ ID NO: 359843 - DNA, 16 bp, Homo sapiens
ccctccagtgcttggc

SEQ ID NO: 359844 - DNA, 15 bp, Homo sapiens
ccctccatcccgaca

SEQ ID NO: 359845 - DNA, 14 bp, Homo sapiens
ccctccatctgggg

SEQ ID NO: 359846 - DNA, 23 bp, Homo sapiens
ccctccatgattccaagggccca

SEQ ID NO: 359847 - DNA, 12 bp, Homo sapiens
ccctccatggca

SEQ ID NO: 359848 - DNA, 13 bp, Homo sapiens
ccctccatgggct

SEQ ID NO: 359849 - DNA, 21 bp, Homo sapiens
ccctccatgtagaagagggag

SEQ ID NO: 359850 - DNA, 22 bp, Homo sapiens
ccctccatgtagaagagggaga

SEQ ID NO: 359851 - DNA, 12 bp, Homo sapiens
ccctcccaacct

SEQ ID NO: 359852 - DNA, 12 bp, Homo sapiens
ccctcccacaca

SEQ ID NO: 359853 - DNA, 14 bp, Homo sapiens
ccctcccaccacag

SEQ ID NO: 359854 - DNA, 15 bp, Homo sapiens
ccctcccacctccag

SEQ ID NO: 359855 - DNA, 15 bp, Homo sapiens
ccctcccagtcctcc

SEQ ID NO: 359856 - DNA, 14 bp, Homo sapiens
ccctccccaaggaa

SEQ ID NO: 359857 - DNA, 16 bp, Homo sapiens
ccctccccaaggaaga

SEQ ID NO: 359858 - DNA, 16 bp, Homo sapiens
ccctccccacagtcct

SEQ ID NO: 359859 - DNA, 18 bp, Homo sapiens
ccctccccacagtcctca

SEQ ID NO: 359860 - DNA, 12 bp, Homo sapiens
ccctccccaccc

SEQ ID NO: 359861 - DNA, 13 bp, Homo sapiens
ccctccccacccc

SEQ ID NO: 359862 - DNA, 19 bp, Homo sapiens
ccctccccaccccaaccac

SEQ ID NO: 359863 - DNA, 14 bp, Homo sapiens
ccctccccacccct

SEQ ID NO: 359864 - DNA, 15 bp, Homo sapiens
ccctccccagagcac

SEQ ID NO: 359865 - DNA, 14 bp, Homo sapiens
ccctccccagccag

SEQ ID NO: 359866 - DNA, 13 bp, Homo sapiens
ccctccccagtgt

SEQ ID NO: 359867 - DNA, 13 bp, Homo sapiens
ccctcccccgcag

SEQ ID NO: 359868 - DNA, 14 bp, Homo sapiens
ccctcccccgcaga

SEQ ID NO: 359869 - DNA, 16 bp, Homo sapiens
ccctccccctcaacct

SEQ ID NO: 359870 - DNA, 14 bp, Homo sapiens
ccctccccggccct

SEQ ID NO: 359871 - DNA, 17 bp, Homo sapiens
ccctcccctctcctgag

SEQ ID NO: 359872 - DNA, 16 bp, Homo sapiens
ccctcccggcatggga

SEQ ID NO: 359873 - DNA, 12 bp, Homo sapiens
ccctccctacct

SEQ ID NO: 359874 - DNA, 19 bp, Homo sapiens
cccttgctcagtgcctcct

SEQ ID NO: 359875 - DNA, 16 bp, Homo sapiens
cccttgctgggtccag

SEQ ID NO: 359876 - DNA, 17 bp, Homo sapiens
cccttgctgggtccagg

SEQ ID NO: 359877 - DNA, 18 bp, Homo sapiens
cccttggaaacctgccct

SEQ ID NO: 359878 - DNA, 22 bp, Homo sapiens
cccttggaaacctgccctgcct

SEQ ID NO: 359879 - DNA, 23 bp, Homo sapiens
cccttggaaacctgccctgcctg

SEQ ID NO: 359880 - DNA, 16 bp, Homo sapiens
cccttggacttgagga

SEQ ID NO: 359881 - DNA, 16 bp, Homo sapiens
cccttggccacggcct

SEQ ID NO: 359882 - DNA, 12 bp, Homo sapiens
cccttggcctgt

SEQ ID NO: 359883 - DNA, 17 bp, Homo sapiens
cccttgggacagccaga

SEQ ID NO: 359884 - DNA, 12 bp, Homo sapiens
cccttgggatgg

SEQ ID NO: 359885 - DNA, 19 bp, Homo sapiens
cccttgggatgggcacagg

SEQ ID NO: 359886 - DNA, 12 bp, Homo sapiens
cccttgggcagt

SEQ ID NO: 359887 - DNA, 15 bp, Homo sapiens
cccttggtagagttt

SEQ ID NO: 359888 - DNA, 22 bp, Homo sapiens
cccttgtacagtgtctgtgcca

SEQ ID NO: 359889 - DNA, 15 bp, Homo sapiens
cccttgtcctgccag

SEQ ID NO: 359890 - DNA, 16 bp, Homo sapiens
cccttgtctgctgctc

SEQ ID NO: 359891 - DNA, 17 bp, Homo sapiens
cccttgtgcgtgggtga

SEQ ID NO: 359892 - DNA, 19 bp, Homo sapiens
cccttgttctaatgctgca

SEQ ID NO: 359893 - DNA, 14 bp, Homo sapiens
ccctttccccactc

SEQ ID NO: 359894 - DNA, 18 bp, Homo sapiens
ccctttccttccatccct

SEQ ID NO: 359895 - DNA, 17 bp, Homo sapiens
ccctttcttggccagtt

SEQ ID NO: 359896 - DNA, 15 bp, Homo sapiens
ccctttgacttcagc

SEQ ID NO: 359897 - DNA, 14 bp, Homo sapiens
ccctttgctgtgag

SEQ ID NO: 359898 - DNA, 16 bp, Homo sapiens
ccctttggttttacta

SEQ ID NO: 359899 - DNA, 17 bp, Homo sapiens
ccctttgttgctgtctg

SEQ ID NO: 359900 - DNA, 21 bp, Homo sapiens
ccctttgttgctgtctggctt

SEQ ID NO: 359901 - DNA, 16 bp, Homo sapiens
cccttttacagctctt

SEQ ID NO: 359902 - DNA, 11 bp, Homo sapiens
cccttttcctg

SEQ ID NO: 359903 - DNA, 16 bp, Homo sapiens
cccttttctacagtta

SEQ ID NO: 359904 - DNA, 18 bp, Homo sapiens
cccttttctggctcctgt

SEQ ID NO: 359905 - DNA, 14 bp, Homo sapiens
cccttttgcctggc

SEQ ID NO: 359906 - DNA, 19 bp, Homo sapiens
cccttttgcctggctgtgg

SEQ ID NO: 359907 - DNA, 22 bp, Homo sapiens
cccttttgtgggtttctctgtg

SEQ ID NO: 359908 - DNA, 21 bp, Homo sapiens
ccctttttgagtaattttctg

SEQ ID NO: 359909 - DNA, 16 bp, Homo sapiens
ccgaaccccccactcc

SEQ ID NO: 359910 - DNA, 18 bp, Homo sapiens
ccgaatcccctccctgtc

SEQ ID NO: 359911 - DNA, 19 bp, Homo sapiens
ccgaatcccctccctgtca

SEQ ID NO: 359912 - DNA, 20 bp, Homo sapiens
ccgaatgtgcaggtttgtta

SEQ ID NO: 359913 - DNA, 20 bp, Homo sapiens
ccgacaccagccctgctgct

SEQ ID NO: 359914 - DNA, 12 bp, Homo sapiens
ccgacagcctgg

SEQ ID NO: 359915 - DNA, 22 bp, Homo sapiens
ccgacagcctggcacagggcag

SEQ ID NO: 359916 - DNA, 16 bp, Homo sapiens
ccgaccgcctgcttca

SEQ ID NO: 359917 - DNA, 16 bp, Homo sapiens
ccgaccttcaccaagc

SEQ ID NO: 359918 - DNA, 14 bp, Homo sapiens
ccgactggctgtga

SEQ ID NO: 359919 - DNA, 16 bp, Homo sapiens
ccgactggctgtgaga

SEQ ID NO: 359920 - DNA, 16 bp, Homo sapiens
ccgacttgctgttttg

SEQ ID NO: 359921 - DNA, 16 bp, Homo sapiens
ccgagaccgcagaggg

SEQ ID NO: 359922 - DNA, 13 bp, Homo sapiens
ccgagagaggcgc

SEQ ID NO: 359923 - DNA, 22 bp, Homo sapiens
ccgagagaggcgcgtctgcccc

SEQ ID NO: 359924 - DNA, 12 bp, Homo sapiens
ccgagagctctt

SEQ ID NO: 359925 - DNA, 15 bp, Homo sapiens
ccgagcccagacctc

SEQ ID NO: 359926 - DNA, 12 bp, Homo sapiens
ccgagcccagct

SEQ ID NO: 359927 - DNA, 16 bp, Homo sapiens
ccgagcccagctacat

SEQ ID NO: 359928 - DNA, 20 bp, Homo sapiens
ccgagcccagctacattcct

SEQ ID NO: 359929 - DNA, 17 bp, Homo sapiens
ccgagccgagctctcct

SEQ ID NO: 359930 - DNA, 14 bp, Homo sapiens
ccgagcctaatgaa

SEQ ID NO: 359931 - DNA, 18 bp, Homo sapiens
ccgagcgacggctcctcc

SEQ ID NO: 359932 - DNA, 19 bp, Homo sapiens
ccgagcgacggctcctccc

SEQ ID NO: 359933 - DNA, 20 bp, Homo sapiens
ccgagcgacggctcctcccc

SEQ ID NO: 359934 - DNA, 19 bp, Homo sapiens
ccgagcgcgtgccttcccc

SEQ ID NO: 359935 - DNA, 21 bp, Homo sapiens
ccgagctcgtgtatcctgggg

SEQ ID NO: 359936 - DNA, 17 bp, Homo sapiens
ccgagctctcctgggcc

SEQ ID NO: 359937 - DNA, 16 bp, Homo sapiens
ccgagctgggggccat

SEQ ID NO: 359938 - DNA, 21 bp, Homo sapiens
ccgagctgggggccatgagct

SEQ ID NO: 359939 - DNA, 17 bp, Homo sapiens
ccgagctggtgcattac

SEQ ID NO: 359940 - DNA, 21 bp, Homo sapiens
ccgaggaagggccagagcctg

SEQ ID NO: 359941 - DNA, 15 bp, Homo sapiens
ccgaggcagcaacag

SEQ ID NO: 359942 - DNA, 20 bp, Homo sapiens
ccgaggcagcaacaggacca

SEQ ID NO: 359943 - DNA, 13 bp, Homo sapiens
ccgaggctccccg

SEQ ID NO: 359944 - DNA, 12 bp, Homo sapiens
ccgagggcggcc

SEQ ID NO: 359945 - DNA, 19 bp, Homo sapiens
ccgagggtcctggctcctg

SEQ ID NO: 359946 - DNA, 21 bp, Homo sapiens
ccgagggtcctggctcctgag

SEQ ID NO: 359947 - DNA, 14 bp, Homo sapiens
ccgaggttcccagg

SEQ ID NO: 359948 - DNA, 20 bp, Homo sapiens
ccgagtagctgggactacag

SEQ ID NO: 359949 - DNA, 15 bp, Homo sapiens
ccgagtatctgtaac

SEQ ID NO: 359950 - DNA, 22 bp, Homo sapiens
ccgagtatctgtaacccttgaa

SEQ ID NO: 359951 - DNA, 22 bp, Homo sapiens
ccgagtccaggagccccagcca

SEQ ID NO: 359952 - DNA, 21 bp, Homo sapiens
ccgagtggatagatgccctgc

SEQ ID NO: 359953 - DNA, 18 bp, Homo sapiens
ccgagtgtggagctgctt

SEQ ID NO: 359954 - DNA, 20 bp, Homo sapiens
ccgatccccgacagtggctc

SEQ ID NO: 359955 - DNA, 19 bp, Homo sapiens
ccgatgctccagccaaccc

SEQ ID NO: 359956 - DNA, 18 bp, Homo sapiens
ccgatggtcccaggaagc

SEQ ID NO: 359957 - DNA, 13 bp, Homo sapiens
ccgattgtaactc

SEQ ID NO: 359958 - DNA, 16 bp, Homo sapiens
ccgattgtaactcaaa

SEQ ID NO: 359959 - DNA, 22 bp, Homo sapiens
ccgcacaccctcactctgccag

SEQ ID NO: 359960 - DNA, 12 bp, Homo sapiens
ccgcacagcagc

SEQ ID NO: 359961 - DNA, 16 bp, Homo sapiens
ccgcacagcagcctgc

SEQ ID NO: 359962 - DNA, 21 bp, Homo sapiens
ccgcacagcagcctgcttccc

SEQ ID NO: 359963 - DNA, 17 bp, Homo sapiens
ccgcaccagctgctctg

SEQ ID NO: 359964 - DNA, 18 bp, Homo sapiens
ccgcaccagctgctctgc

SEQ ID NO: 359965 - DNA, 22 bp, Homo sapiens
ccgcaccagctgctctgcccct

SEQ ID NO: 359966 - DNA, 16 bp, Homo sapiens
ccgcacccccaccctt

SEQ ID NO: 359967 - DNA, 19 bp, Homo sapiens
ccgcacctaaagcagccag

SEQ ID NO: 359968 - DNA, 22 bp, Homo sapiens
ccgcagcaccagcctgagccac

SEQ ID NO: 359969 - DNA, 17 bp, Homo sapiens
ccgcagcccgcctgccg

SEQ ID NO: 359970 - DNA, 22 bp, Homo sapiens
ccgcagcccgtgaagcagtgcc

SEQ ID NO: 359971 - DNA, 23 bp, Homo sapiens
ccgcagcccgtgaagcagtgcct

SEQ ID NO: 359972 - DNA, 23 bp, Homo sapiens
ccgcagggcgctccggcagaggc

SEQ ID NO: 359973 - DNA, 16 bp, Homo sapiens
ccgcagtccccagccc

SEQ ID NO: 359974 - DNA, 17 bp, Homo sapiens
ccgcatatgcatgccag

SEQ ID NO: 359975 - DNA, 14 bp, Homo sapiens
ccgcatggcccctc

SEQ ID NO: 359976 - DNA, 14 bp, Homo sapiens
ccgcatgtctgcat

SEQ ID NO: 359977 - DNA, 17 bp, Homo sapiens
ccgcatgtctgcatggc

SEQ ID NO: 359978 - DNA, 16 bp, Homo sapiens
ccgcatgtgtctgtat

SEQ ID NO: 359979 - DNA, 13 bp, Homo sapiens
ccgcattggtggc

SEQ ID NO: 359980 - DNA, 17 bp, Homo sapiens
ccgccacctatctcgtg

SEQ ID NO: 359981 - DNA, 14 bp, Homo sapiens
ccgccacctgtgtg

SEQ ID NO: 359982 - DNA, 19 bp, Homo sapiens
ccgccaccttggtcctagt

SEQ ID NO: 359983 - DNA, 14 bp, Homo sapiens
ccgccacggccacc

SEQ ID NO: 359984 - DNA, 16 bp, Homo sapiens
ccgccagactgttaga

SEQ ID NO: 359985 - DNA, 12 bp, Homo sapiens
ccgccagcctca

SEQ ID NO: 359986 - DNA, 16 bp, Homo sapiens
ccgccagcctcagtgc

SEQ ID NO: 359987 - DNA, 21 bp, Homo sapiens
ccgccatgcaactccatgcct

SEQ ID NO: 359988 - DNA, 16 bp, Homo sapiens
ccgccattgccaccag

SEQ ID NO: 359989 - DNA, 16 bp, Homo sapiens
ccgcccaccccgctgc

SEQ ID NO: 359990 - DNA, 21 bp, Homo sapiens
ccgcccacctctgctgcccac

SEQ ID NO: 359991 - DNA, 13 bp, Homo sapiens
ccgcccacctgca

SEQ ID NO: 359992 - DNA, 14 bp, Homo sapiens
ccgcccacctgggc

SEQ ID NO: 359993 - DNA, 20 bp, Homo sapiens
ccgcccacctgggccctagg

SEQ ID NO: 359994 - DNA, 18 bp, Homo sapiens
ccgcccactgtcctgggc

SEQ ID NO: 359995 - DNA, 19 bp, Homo sapiens
ccgcccactgtcctgggcg

SEQ ID NO: 359996 - DNA, 12 bp, Homo sapiens
ccgcccagctct

SEQ ID NO: 359997 - DNA, 10 bp, Homo sapiens
ccgccccaga

SEQ ID NO: 359998 - DNA, 21 bp, Homo sapiens
ccgccccagagactgcccacc

SEQ ID NO: 359999 - DNA, 15 bp, Homo sapiens
ccgccccagagctcc

SEQ ID NO: 360000 - DNA, 15 bp, Homo sapiens
ccgcccccaccccta

SEQ ID NO: 360001 - DNA, 17 bp, Homo sapiens
ccgcccccacccctaca

SEQ ID NO: 360002 - DNA, 13 bp, Homo sapiens
ccgccccccagag

SEQ ID NO: 360003 - DNA, 14 bp, Homo sapiens
ccgccccccagagc

SEQ ID NO: 360004 - DNA, 16 bp, Homo sapiens
ccgccccccagagcca

SEQ ID NO: 360005 - DNA, 20 bp, Homo sapiens
cctaagctccaggtgccctg

SEQ ID NO: 360006 - DNA, 14 bp, Homo sapiens
cctaaggacacact

SEQ ID NO: 360007 - DNA, 17 bp, Homo sapiens
cctaaggacacactaat

SEQ ID NO: 360008 - DNA, 22 bp, Homo sapiens
cctaaggatctctcaggagcac

SEQ ID NO: 360009 - DNA, 23 bp, Homo sapiens
cctaaggatctctcaggagcaca

SEQ ID NO: 360010 - DNA, 24 bp, Homo sapiens
cctaaggatctctcaggagcacag

SEQ ID NO: 360011 - DNA, 14 bp, Homo sapiens
cctaaggctgctgt

SEQ ID NO: 360012 - DNA, 12 bp, Homo sapiens
cctaagtgccca

SEQ ID NO: 360013 - DNA, 20 bp, Homo sapiens
cctaatatcattttattcac

SEQ ID NO: 360014 - DNA, 22 bp, Homo sapiens
cctaatgagatatatctttata

SEQ ID NO: 360015 - DNA, 18 bp, Homo sapiens
cctaatgtggcagctgtc

SEQ ID NO: 360016 - DNA, 17 bp, Homo sapiens
cctaattaatttcagta

SEQ ID NO: 360017 - DNA, 14 bp, Homo sapiens
cctaattagagcag

SEQ ID NO: 360018 - DNA, 14 bp, Homo sapiens
cctaattcctggca

SEQ ID NO: 360019 - DNA, 21 bp, Homo sapiens
cctaattcctggcatgacact

SEQ ID NO: 360020 - DNA, 19 bp, Homo sapiens
cctaattctcttcgctgtg

SEQ ID NO: 360021 - DNA, 21 bp, Homo sapiens
cctaattcttattttataatt

SEQ ID NO: 360022 - DNA, 22 bp, Homo sapiens
cctaattcttattttataattt

SEQ ID NO: 360023 - DNA, 15 bp, Homo sapiens
cctaatttgcccttc

SEQ ID NO: 360024 - DNA, 22 bp, Homo sapiens
cctacaaaaaaacctttattct

SEQ ID NO: 360025 - DNA, 20 bp, Homo sapiens
cctacaagatttagaaaaaa

SEQ ID NO: 360026 - DNA, 15 bp, Homo sapiens
cctacacctctgggc

SEQ ID NO: 360027 - DNA, 15 bp, Homo sapiens
cctacagaggtctct

SEQ ID NO: 360028 - DNA, 17 bp, Homo sapiens
cctacagaggtctctgc

SEQ ID NO: 360029 - DNA, 14 bp, Homo sapiens
cctacagcctgcac

SEQ ID NO: 360030 - DNA, 15 bp, Homo sapiens
cctacagcctgcaca

SEQ ID NO: 360031 - DNA, 17 bp, Homo sapiens
cctacaggcgctccagg

SEQ ID NO: 360032 - DNA, 18 bp, Homo sapiens
cctacattccctctcctg

SEQ ID NO: 360033 - DNA, 11 bp, Homo sapiens
cctaccaaagt

SEQ ID NO: 360034 - DNA, 14 bp, Homo sapiens
cctaccaacctctg

SEQ ID NO: 360035 - DNA, 15 bp, Homo sapiens
cctaccaacctctga

SEQ ID NO: 360036 - DNA, 22 bp, Homo sapiens
cctaccaatgcatgcagccact

SEQ ID NO: 360037 - DNA, 15 bp, Homo sapiens
cctaccacagtgtct

SEQ ID NO: 360038 - DNA, 13 bp, Homo sapiens
cctaccactgagc

SEQ ID NO: 360039 - DNA, 15 bp, Homo sapiens
cctaccactgagccc

SEQ ID NO: 360040 - DNA, 16 bp, Homo sapiens
cctaccactgagccct

SEQ ID NO: 360041 - DNA, 16 bp, Homo sapiens
cctaccagcgcccgct

SEQ ID NO: 360042 - DNA, 21 bp, Homo sapiens
cctaccagcgcccgctgggct

SEQ ID NO: 360043 - DNA, 19 bp, Homo sapiens
cctaccccacctcatgcct

SEQ ID NO: 360044 - DNA, 19 bp, Homo sapiens
cctacccccttgtctgctg

SEQ ID NO: 360045 - DNA, 13 bp, Homo sapiens
cctacccgcccgc

SEQ ID NO: 360046 - DNA, 24 bp, Homo sapiens
cctaccctcttattgttcctctta

SEQ ID NO: 360047 - DNA, 15 bp, Homo sapiens
cctaccctcttctca

SEQ ID NO: 360048 - DNA, 20 bp, Homo sapiens
cctaccgagtctcttctcca

SEQ ID NO: 360049 - DNA, 22 bp, Homo sapiens
cctaccgagtctcttctccact

SEQ ID NO: 360050 - DNA, 16 bp, Homo sapiens
cctaccgatggtccca

SEQ ID NO: 360051 - DNA, 20 bp, Homo sapiens
cctaccggcaatttccggcc

SEQ ID NO: 360052 - DNA, 20 bp, Homo sapiens
cctacctcaacctgtaaatt

SEQ ID NO: 360053 - DNA, 21 bp, Homo sapiens
cctacctggtcaacccgctgc

SEQ ID NO: 360054 - DNA, 23 bp, Homo sapiens
cctacctgttcagtgtcccgggc

SEQ ID NO: 360055 - DNA, 21 bp, Homo sapiens
cctaccttttgataaaatgtt

SEQ ID NO: 360056 - DNA, 14 bp, Homo sapiens
cctacgaccccaga

SEQ ID NO: 360057 - DNA, 15 bp, Homo sapiens
cctacgaggagtgtt

SEQ ID NO: 360058 - DNA, 18 bp, Homo sapiens
cctactacatcgccctcc

SEQ ID NO: 360059 - DNA, 19 bp, Homo sapiens
cctactatgtgctgggtgc

SEQ ID NO: 360060 - DNA, 15 bp, Homo sapiens
cctactcctacctgg

SEQ ID NO: 360061 - DNA, 15 bp, Homo sapiens
cctactctgggaaga

SEQ ID NO: 360062 - DNA, 23 bp, Homo sapiens
cctactgccacccgcttcctgtt

SEQ ID NO: 360063 - DNA, 14 bp, Homo sapiens
cctactgtctcctt

SEQ ID NO: 360064 - DNA, 16 bp, Homo sapiens
cctactgtctccttcc

SEQ ID NO: 360065 - DNA, 20 bp, Homo sapiens
cctactgtctccttcccact

SEQ ID NO: 360066 - DNA, 23 bp, Homo sapiens
cctactgtctccttcccactgtc

SEQ ID NO: 360067 - DNA, 15 bp, Homo sapiens
cctacttaaacaaaa

SEQ ID NO: 360068 - DNA, 17 bp, Homo sapiens
cctacttcctcctcctc

SEQ ID NO: 360069 - DNA, 14 bp, Homo sapiens
cctacttgtgactg

SEQ ID NO: 360070 - DNA, 21 bp, Homo sapiens
cctagacttcccaacagcctt

SEQ ID NO: 360071 - DNA, 20 bp, Homo sapiens
cctagagattcttagctctt

SEQ ID NO: 360072 - DNA, 18 bp, Homo sapiens
cctagaggtgggcagctg

SEQ ID NO: 360073 - DNA, 19 bp, Homo sapiens
cctagaggtgggcagctgg

SEQ ID NO: 360074 - DNA, 21 bp, Homo sapiens
cctagcacaaggagtgcccgc

SEQ ID NO: 360075 - DNA, 18 bp, Homo sapiens
cctagcactcacatgctg

SEQ ID NO: 360076 - DNA, 13 bp, Homo sapiens
cctagctgacgcc

SEQ ID NO: 360077 - DNA, 17 bp, Homo sapiens
cctagctgtgtgcagtc

SEQ ID NO: 360078 - DNA, 17 bp, Homo sapiens
cctagcttatctccctg

SEQ ID NO: 360079 - DNA, 16 bp, Homo sapiens
cctaggagctggggag

SEQ ID NO: 360080 - DNA, 17 bp, Homo sapiens
cctaggcatactctcca

SEQ ID NO: 360081 - DNA, 20 bp, Homo sapiens
cctaggccaaatgcacaagc

SEQ ID NO: 360082 - DNA, 23 bp, Homo sapiens
cctaggccaaatgcacaagctca

SEQ ID NO: 360083 - DNA, 18 bp, Homo sapiens
cctaggctacccttgcca

SEQ ID NO: 360084 - DNA, 14 bp, Homo sapiens
cctagggaaaagtt

SEQ ID NO: 360085 - DNA, 14 bp, Homo sapiens
cctagggcctggtc

SEQ ID NO: 360086 - DNA, 16 bp, Homo sapiens
cctagggcctggtcca

SEQ ID NO: 360087 - DNA, 15 bp, Homo sapiens
cctagggctgggtgt

SEQ ID NO: 360088 - DNA, 18 bp, Homo sapiens
cctaggggtcagggacca

SEQ ID NO: 360089 - DNA, 18 bp, Homo sapiens
cctaggtctccacccctc

SEQ ID NO: 360090 - DNA, 24 bp, Homo sapiens
cctaggtgggtcaactccaaggca

SEQ ID NO: 360091 - DNA, 22 bp, Homo sapiens
cctaggttaacaaccctgttga

SEQ ID NO: 360092 - DNA, 17 bp, Homo sapiens
cctagtatctggctggg

SEQ ID NO: 360093 - DNA, 16 bp, Homo sapiens
cctagtcccttcccct

SEQ ID NO: 360094 - DNA, 21 bp, Homo sapiens
cctagtcccttcccctccctg

SEQ ID NO: 360095 - DNA, 15 bp, Homo sapiens
cctagtgatgtagaa

SEQ ID NO: 360096 - DNA, 15 bp, Homo sapiens
cctagtgatttttgg

SEQ ID NO: 360097 - DNA, 18 bp, Homo sapiens
cctagtgggagcccagca

SEQ ID NO: 360098 - DNA, 18 bp, Homo sapiens
cctagtggggaggggcct

SEQ ID NO: 360099 - DNA, 22 bp, Homo sapiens
cctagtggggaggggcctggcc

SEQ ID NO: 360100 - DNA, 23 bp, Homo sapiens
cctagtggggaggggcctggcct

SEQ ID NO: 360101 - DNA, 17 bp, Homo sapiens
cctagtgtctattccct

SEQ ID NO: 360102 - DNA, 15 bp, Homo sapiens
cctagttacccaccc

SEQ ID NO: 360103 - DNA, 18 bp, Homo sapiens
cctagttccattcttggt

SEQ ID NO: 360104 - DNA, 17 bp, Homo sapiens
cctagttcctgtggcca

SEQ ID NO: 360105 - DNA, 13 bp, Homo sapiens
cctagttctttgc

SEQ ID NO: 360106 - DNA, 20 bp, Homo sapiens
cctagttttagacctcatct

SEQ ID NO: 360107 - DNA, 17 bp, Homo sapiens
cctataaagtaaagcta

SEQ ID NO: 360108 - DNA, 11 bp, Homo sapiens
cctataaatgg

SEQ ID NO: 360109 - DNA, 18 bp, Homo sapiens
cctatactggttatagtt

SEQ ID NO: 360110 - DNA, 21 bp, Homo sapiens
cctatagaaatgtattttgaa

SEQ ID NO: 360111 - DNA, 18 bp, Homo sapiens
cctatataataaagctac

SEQ ID NO: 360112 - DNA, 17 bp, Homo sapiens
cctatcacctcccctcc

SEQ ID NO: 360113 - DNA, 18 bp, Homo sapiens
cctatcacctcccctcct

SEQ ID NO: 360114 - DNA, 17 bp, Homo sapiens
cctatccccaggccagg

SEQ ID NO: 360115 - DNA, 18 bp, Homo sapiens
cctatccccaggccaggt

SEQ ID NO: 360116 - DNA, 19 bp, Homo sapiens
cctatccccaggccaggtc

SEQ ID NO: 360117 - DNA, 17 bp, Homo sapiens
cctatctcgtgggagag

SEQ ID NO: 360118 - DNA, 18 bp, Homo sapiens
cctatctcgtgggagagc

SEQ ID NO: 360119 - DNA, 18 bp, Homo sapiens
cctatcttttagttttag

SEQ ID NO: 360120 - DNA, 19 bp, Homo sapiens
cctatgagatggccatgct

SEQ ID NO: 360121 - DNA, 16 bp, Homo sapiens
cctatgccacctgcag

SEQ ID NO: 360122 - DNA, 21 bp, Homo sapiens
cctatgcccaggtaccaccct

SEQ ID NO: 360123 - DNA, 13 bp, Homo sapiens
cctatgcctgtgg

SEQ ID NO: 360124 - DNA, 19 bp, Homo sapiens
cctatgcctgtggtgaagt

SEQ ID NO: 360125 - DNA, 23 bp, Homo sapiens
cctatgcttctagaaagcccctc

SEQ ID NO: 360126 - DNA, 20 bp, Homo sapiens
cctatggagcctctgcagac

SEQ ID NO: 360127 - DNA, 17 bp, Homo sapiens
cctatggggatggtcca

SEQ ID NO: 360128 - DNA, 15 bp, Homo sapiens
cctatgtcctaagga

SEQ ID NO: 360129 - DNA, 21 bp, Homo sapiens
cctatgtcctaaggacacact

SEQ ID NO: 360130 - DNA, 14 bp, Homo sapiens
cctatgtggcagct

SEQ ID NO: 360131 - DNA, 17 bp, Homo sapiens
cctatgtggcagctggg

SEQ ID NO: 360132 - DNA, 21 bp, Homo sapiens
cctattgctgtaaataaaaat

SEQ ID NO: 360133 - DNA, 23 bp, Homo sapiens
cctattgctgtaaataaaaatag

SEQ ID NO: 360134 - DNA, 14 bp, Homo sapiens
cctcggtcagcacc

SEQ ID NO: 360135 - DNA, 14 bp, Homo sapiens
cctcgtccacaggg

SEQ ID NO: 360136 - DNA, 18 bp, Homo sapiens
cctcgtccacaggggcag

SEQ ID NO: 360137 - DNA, 16 bp, Homo sapiens
cctcgtcccgttctcc

SEQ ID NO: 360138 - DNA, 17 bp, Homo sapiens
cctcgtccggcctgcag

SEQ ID NO: 360139 - DNA, 14 bp, Homo sapiens
cctcgtcctgtccc

SEQ ID NO: 360140 - DNA, 15 bp, Homo sapiens
cctcgtcctgtccca

SEQ ID NO: 360141 - DNA, 18 bp, Homo sapiens
cctcgtcctgtcccagag

SEQ ID NO: 360142 - DNA, 16 bp, Homo sapiens
cctcgtggacacctgc

SEQ ID NO: 360143 - DNA, 17 bp, Homo sapiens
cctcgtggacacctgcc

SEQ ID NO: 360144 - DNA, 18 bp, Homo sapiens
cctcgtggacacctgccc

SEQ ID NO: 360145 - DNA, 22 bp, Homo sapiens
cctcgtggacacctgccctgcc

SEQ ID NO: 360146 - DNA, 14 bp, Homo sapiens
cctctaacaccaca

SEQ ID NO: 360147 - DNA, 17 bp, Homo sapiens
cctctaacaccacactg

SEQ ID NO: 360148 - DNA, 20 bp, Homo sapiens
cctctaacaccacactgacc

SEQ ID NO: 360149 - DNA, 23 bp, Homo sapiens
cctctaacaccacactgaccaca

SEQ ID NO: 360150 - DNA, 18 bp, Homo sapiens
cctctaactcattcttca

SEQ ID NO: 360151 - DNA, 14 bp, Homo sapiens
cctctaaggccaag

SEQ ID NO: 360152 - DNA, 18 bp, Homo sapiens
cctctaatgctcacgctc

SEQ ID NO: 360153 - DNA, 14 bp, Homo sapiens
cctctacagccgtc

SEQ ID NO: 360154 - DNA, 20 bp, Homo sapiens
cctctacggttatttcctgc

SEQ ID NO: 360155 - DNA, 20 bp, Homo sapiens
cctctacttaatgagatagt

SEQ ID NO: 360156 - DNA, 17 bp, Homo sapiens
cctctaggcctcagtgt

SEQ ID NO: 360157 - DNA, 23 bp, Homo sapiens
cctctatatctttaaataaatgt

SEQ ID NO: 360158 - DNA, 14 bp, Homo sapiens
cctctattgatgta

SEQ ID NO: 360159 - DNA, 23 bp, Homo sapiens
cctctattgatgtacagtctgtc

SEQ ID NO: 360160 - DNA, 14 bp, Homo sapiens
cctctatttcttta

SEQ ID NO: 360161 - DNA, 22 bp, Homo sapiens
cctctcaatattcaataaagct

SEQ ID NO: 360162 - DNA, 16 bp, Homo sapiens
cctctcactaaacttt

SEQ ID NO: 360163 - DNA, 17 bp, Homo sapiens
cctctcagaactcctgt

SEQ ID NO: 360164 - DNA, 18 bp, Homo sapiens
cctctcagaactcctgtg

SEQ ID NO: 360165 - DNA, 19 bp, Homo sapiens
cctctcagatccctcggtc

SEQ ID NO: 360166 - DNA, 20 bp, Homo sapiens
cctctcaggcatgcctgtgt

SEQ ID NO: 360167 - DNA, 22 bp, Homo sapiens
cctctcatccaggtcctttcct

SEQ ID NO: 360168 - DNA, 13 bp, Homo sapiens
cctctccacaccc

SEQ ID NO: 360169 - DNA, 19 bp, Homo sapiens
cctctccacacccatgact

SEQ ID NO: 360170 - DNA, 16 bp, Homo sapiens
cctctccactccatgt

SEQ ID NO: 360171 - DNA, 12 bp, Homo sapiens
cctctccactgc

SEQ ID NO: 360172 - DNA, 16 bp, Homo sapiens
cctctccactgccttc

SEQ ID NO: 360173 - DNA, 14 bp, Homo sapiens
cctctcccaaataa

SEQ ID NO: 360174 - DNA, 24 bp, Homo sapiens
cctctcccacccggccacagctgc

SEQ ID NO: 360175 - DNA, 14 bp, Homo sapiens
cctctcccaggccc

SEQ ID NO: 360176 - DNA, 18 bp, Homo sapiens
cctctcccaggcccgaga

SEQ ID NO: 360177 - DNA, 12 bp, Homo sapiens
cctctcccggct

SEQ ID NO: 360178 - DNA, 14 bp, Homo sapiens
cctctcccggctgc

SEQ ID NO: 360179 - DNA, 16 bp, Homo sapiens
cctctcccggctgcct

SEQ ID NO: 360180 - DNA, 19 bp, Homo sapiens
cctctcccggctgcctgcc

SEQ ID NO: 360181 - DNA, 23 bp, Homo sapiens
cctctcccggctgcctgccgccc

SEQ ID NO: 360182 - DNA, 14 bp, Homo sapiens
cctctccctgggga

SEQ ID NO: 360183 - DNA, 21 bp, Homo sapiens
cctctcctcgtccggcctgca

SEQ ID NO: 360184 - DNA, 22 bp, Homo sapiens
cctctcctcgtccggcctgcag

SEQ ID NO: 360185 - DNA, 19 bp, Homo sapiens
cctctcctgagcctgtctc

SEQ ID NO: 360186 - DNA, 14 bp, Homo sapiens
cctctcctgcccag

SEQ ID NO: 360187 - DNA, 16 bp, Homo sapiens
cctctcctgcccagat

SEQ ID NO: 360188 - DNA, 16 bp, Homo sapiens
cctctccttgggctcc

SEQ ID NO: 360189 - DNA, 18 bp, Homo sapiens
cctctccttgggctcctg

SEQ ID NO: 360190 - DNA, 17 bp, Homo sapiens
cctctccttttgaggct

SEQ ID NO: 360191 - DNA, 15 bp, Homo sapiens
cctctcgccccatcc

SEQ ID NO: 360192 - DNA, 17 bp, Homo sapiens
cctctcgctcccctctg

SEQ ID NO: 360193 - DNA, 21 bp, Homo sapiens
cctctcggctggaagaacatc

SEQ ID NO: 360194 - DNA, 19 bp, Homo sapiens
cctctctactggagtggaa

SEQ ID NO: 360195 - DNA, 14 bp, Homo sapiens
cctctctccctgcc

SEQ ID NO: 360196 - DNA, 10 bp, Homo sapiens
cctctctctc

SEQ ID NO: 360197 - DNA, 12 bp, Homo sapiens
cctctctctcac

SEQ ID NO: 360198 - DNA, 15 bp, Homo sapiens
cctctctctccctcc

SEQ ID NO: 360199 - DNA, 16 bp, Homo sapiens
cctctctctccctcca

SEQ ID NO: 360200 - DNA, 20 bp, Homo sapiens
cctctctctccctccactcc

SEQ ID NO: 360201 - DNA, 13 bp, Homo sapiens
cctctctctctct

SEQ ID NO: 360202 - DNA, 20 bp, Homo sapiens
cctctctctctctctctctg

SEQ ID NO: 360203 - DNA, 15 bp, Homo sapiens
cctctctctgctcct

SEQ ID NO: 360204 - DNA, 18 bp, Homo sapiens
cctctctctgctcctcac

SEQ ID NO: 360205 - DNA, 23 bp, Homo sapiens
cctctctctgggcccaggggctg

SEQ ID NO: 360206 - DNA, 16 bp, Homo sapiens
cctctctcttctgctc

SEQ ID NO: 360207 - DNA, 19 bp, Homo sapiens
cctctctcttctgctccac

SEQ ID NO: 360208 - DNA, 20 bp, Homo sapiens
cctctctcttctgctccacc

SEQ ID NO: 360209 - DNA, 23 bp, Homo sapiens
cctctctgatcttgtgctcagca

SEQ ID NO: 360210 - DNA, 16 bp, Homo sapiens
cctctctgcacctgtc

SEQ ID NO: 360211 - DNA, 12 bp, Homo sapiens
cctctctgggcc

SEQ ID NO: 360212 - DNA, 13 bp, Homo sapiens
cctctctgggcct

SEQ ID NO: 360213 - DNA, 18 bp, Homo sapiens
cctctctgtctttttcct

SEQ ID NO: 360214 - DNA, 20 bp, Homo sapiens
cctctctgtctttttccttc

SEQ ID NO: 360215 - DNA, 24 bp, Homo sapiens
cctctctgtctttttccttcctga

SEQ ID NO: 360216 - DNA, 22 bp, Homo sapiens
cctctcttaccccgtccctttc

SEQ ID NO: 360217 - DNA, 19 bp, Homo sapiens
cctctcttccgggagctgg

SEQ ID NO: 360218 - DNA, 24 bp, Homo sapiens
cctctctttcaattgcagatgcca

SEQ ID NO: 360219 - DNA, 22 bp, Homo sapiens
cctctgaaaatatttttttcta

SEQ ID NO: 360220 - DNA, 18 bp, Homo sapiens
cctctgaactgctgctgg

SEQ ID NO: 360221 - DNA, 20 bp, Homo sapiens
cctctgaactgctgctggtc

SEQ ID NO: 360222 - DNA, 16 bp, Homo sapiens
cctctgacagcagcct

SEQ ID NO: 360223 - DNA, 19 bp, Homo sapiens
cctctgacagcagcctgtg

SEQ ID NO: 360224 - DNA, 20 bp, Homo sapiens
cctctgacagcagcctgtga

SEQ ID NO: 360225 - DNA, 14 bp, Homo sapiens
cctctgactcccaa

SEQ ID NO: 360226 - DNA, 14 bp, Homo sapiens
cctctgactctgag

SEQ ID NO: 360227 - DNA, 20 bp, Homo sapiens
cctctgagcaactgtgcagc

SEQ ID NO: 360228 - DNA, 12 bp, Homo sapiens
cctctgcagcct

SEQ ID NO: 360229 - DNA, 13 bp, Homo sapiens
cctctgcagcctg

SEQ ID NO: 360230 - DNA, 17 bp, Homo sapiens
cctctgcagcctgagct

SEQ ID NO: 360231 - DNA, 18 bp, Homo sapiens
cctctgcagcctgagctc

SEQ ID NO: 360232 - DNA, 15 bp, Homo sapiens
cctctgcagctgacc

SEQ ID NO: 360233 - DNA, 16 bp, Homo sapiens
cctctgcagctgacct

SEQ ID NO: 360234 - DNA, 17 bp, Homo sapiens
cctctgcaggacacaga

SEQ ID NO: 360235 - DNA, 19 bp, Homo sapiens
cctctgcagggcagcctgt

SEQ ID NO: 360236 - DNA, 17 bp, Homo sapiens
cctctgcagtgccttgg

SEQ ID NO: 360237 - DNA, 13 bp, Homo sapiens
cctctgccaggcc

SEQ ID NO: 360238 - DNA, 23 bp, Homo sapiens
cctctgcccagcttgggcccagc

SEQ ID NO: 360239 - DNA, 15 bp, Homo sapiens
cctctgccccaagca

SEQ ID NO: 360240 - DNA, 16 bp, Homo sapiens
cctctgccccaagcag

SEQ ID NO: 360241 - DNA, 18 bp, Homo sapiens
cctctgccccaagcagcc

SEQ ID NO: 360242 - DNA, 13 bp, Homo sapiens
cctctgccccctc

SEQ ID NO: 360243 - DNA, 16 bp, Homo sapiens
cctctgccccctcccc

SEQ ID NO: 360244 - DNA, 21 bp, Homo sapiens
cctctgccgaccgcctgcttc

SEQ ID NO: 360245 - DNA, 11 bp, Homo sapiens
cctctgcctcc

SEQ ID NO: 360246 - DNA, 20 bp, Homo sapiens
cctctgcctccaggagggca

SEQ ID NO: 360247 - DNA, 22 bp, Homo sapiens
cctctgcctccaggagggcatc

SEQ ID NO: 360248 - DNA, 14 bp, Homo sapiens
cctctgcctgtccc

SEQ ID NO: 360249 - DNA, 22 bp, Homo sapiens
cctctgcctgtccctctcaggc

SEQ ID NO: 360250 - DNA, 19 bp, Homo sapiens
cctctgcctgtctccccca

SEQ ID NO: 360251 - DNA, 19 bp, Homo sapiens
cctctgccttgatggagaa

SEQ ID NO: 360252 - DNA, 13 bp, Homo sapiens
cctctgccttgga

SEQ ID NO: 360253 - DNA, 15 bp, Homo sapiens
cctctgccttggaca

SEQ ID NO: 360254 - DNA, 18 bp, Homo sapiens
cctctgctatgtctgtga

SEQ ID NO: 360255 - DNA, 18 bp, Homo sapiens
cctctgctccgtgtgtct

SEQ ID NO: 360256 - DNA, 11 bp, Homo sapiens
cctctgctctc

SEQ ID NO: 360257 - DNA, 14 bp, Homo sapiens
cctctgctgcccac

SEQ ID NO: 360258 - DNA, 23 bp, Homo sapiens
cctctgctgcccacggccaccca

SEQ ID NO: 360259 - DNA, 17 bp, Homo sapiens
cctctgctgctttccaa

SEQ ID NO: 360260 - DNA, 19 bp, Homo sapiens
cctctgctggccgggcaca

SEQ ID NO: 360261 - DNA, 16 bp, Homo sapiens
cctctggactggctag

SEQ ID NO: 360262 - DNA, 15 bp, Homo sapiens
cctctggaggcctct

SEQ ID NO: 360263 - DNA, 20 bp, Homo sapiens
cctctggaggcctctgggcc

SEQ ID NO: 360264 - DNA, 17 bp, Homo sapiens
cctgctggcccctcacc

SEQ ID NO: 360265 - DNA, 18 bp, Homo sapiens
cctgctggcccctcacct

SEQ ID NO: 360266 - DNA, 21 bp, Homo sapiens
cctgctggcccctcacctggg

SEQ ID NO: 360267 - DNA, 14 bp, Homo sapiens
cctgctggctgagg

SEQ ID NO: 360268 - DNA, 22 bp, Homo sapiens
cctgctgggtgggaatgcgctc

SEQ ID NO: 360269 - DNA, 19 bp, Homo sapiens
cctgctggttgttgccagg

SEQ ID NO: 360270 - DNA, 21 bp, Homo sapiens
cctgctggttgttgccaggtt

SEQ ID NO: 360271 - DNA, 23 bp, Homo sapiens
cctgctggttgttgccaggttgc

SEQ ID NO: 360272 - DNA, 21 bp, Homo sapiens
cctgctgtcagaccttcttcc

SEQ ID NO: 360273 - DNA, 19 bp, Homo sapiens
cctgctgtgggtcagtgtg

SEQ ID NO: 360274 - DNA, 22 bp, Homo sapiens
cctgcttagaacccttctgctt

SEQ ID NO: 360275 - DNA, 13 bp, Homo sapiens
cctgcttcacacc

SEQ ID NO: 360276 - DNA, 17 bp, Homo sapiens
cctgcttcacacccctc

SEQ ID NO: 360277 - DNA, 18 bp, Homo sapiens
cctgcttcacacccctca

SEQ ID NO: 360278 - DNA, 20 bp, Homo sapiens
cctgcttcacacccctcagc

SEQ ID NO: 360279 - DNA, 14 bp, Homo sapiens
cctgcttcatatct

SEQ ID NO: 360280 - DNA, 21 bp, Homo sapiens
cctgcttcatatctctccctt

SEQ ID NO: 360281 - DNA, 18 bp, Homo sapiens
cctgcttcccacctccct

SEQ ID NO: 360282 - DNA, 14 bp, Homo sapiens
cctgcttctgctgc

SEQ ID NO: 360283 - DNA, 15 bp, Homo sapiens
cctgcttctgctgcc

SEQ ID NO: 360284 - DNA, 17 bp, Homo sapiens
cctgcttcttccccagg

SEQ ID NO: 360285 - DNA, 15 bp, Homo sapiens
cctgcttggggcctg

SEQ ID NO: 360286 - DNA, 21 bp, Homo sapiens
cctgcttggggcctggcgtgg

SEQ ID NO: 360287 - DNA, 19 bp, Homo sapiens
cctgcttgtactaagccag

SEQ ID NO: 360288 - DNA, 23 bp, Homo sapiens
cctgcttgtactaagccaggagg

SEQ ID NO: 360289 - DNA, 21 bp, Homo sapiens
cctgcttgtgttgggccccag

SEQ ID NO: 360290 - DNA, 22 bp, Homo sapiens
cctgcttgtgttgggccccagg

SEQ ID NO: 360291 - DNA, 23 bp, Homo sapiens
cctgctttacaggatcatgtaaa

SEQ ID NO: 360292 - DNA, 19 bp, Homo sapiens
cctgcttttccaggatcct

SEQ ID NO: 360293 - DNA, 13 bp, Homo sapiens
cctggaaagccct

SEQ ID NO: 360294 - DNA, 14 bp, Homo sapiens
cctggaaaggggag

SEQ ID NO: 360295 - DNA, 14 bp, Homo sapiens
cctggaaccaatcc

SEQ ID NO: 360296 - DNA, 15 bp, Homo sapiens
cctggaaccagagcc

SEQ ID NO: 360297 - DNA, 15 bp, Homo sapiens
cctggaaccagggag

SEQ ID NO: 360298 - DNA, 13 bp, Homo sapiens
cctggaagagctg

SEQ ID NO: 360299 - DNA, 19 bp, Homo sapiens
cctggaattcagcaccctg

SEQ ID NO: 360300 - DNA, 22 bp, Homo sapiens
cctggaattcagcaccctgggt

SEQ ID NO: 360301 - DNA, 13 bp, Homo sapiens
cctggacaaaccc

SEQ ID NO: 360302 - DNA, 15 bp, Homo sapiens
cctggaccaaagctg

SEQ ID NO: 360303 - DNA, 16 bp, Homo sapiens
cctggaccacacctcc

SEQ ID NO: 360304 - DNA, 13 bp, Homo sapiens
cctggacctgagt

SEQ ID NO: 360305 - DNA, 20 bp, Homo sapiens
cctggacctgcctcctgcct

SEQ ID NO: 360306 - DNA, 22 bp, Homo sapiens
cctggacctgcctcctgcctgc

SEQ ID NO: 360307 - DNA, 12 bp, Homo sapiens
cctggactctgt

SEQ ID NO: 360308 - DNA, 22 bp, Homo sapiens
cctggactctgtggggccacac

SEQ ID NO: 360309 - DNA, 17 bp, Homo sapiens
cctggactctgtgtgag

SEQ ID NO: 360310 - DNA, 17 bp, Homo sapiens
cctggactggtggcccc

SEQ ID NO: 360311 - DNA, 22 bp, Homo sapiens
cctggactggtggcccctgcct

SEQ ID NO: 360312 - DNA, 14 bp, Homo sapiens
cctggactttcctg

SEQ ID NO: 360313 - DNA, 15 bp, Homo sapiens
cctggagaaaggatg

SEQ ID NO: 360314 - DNA, 13 bp, Homo sapiens
cctggagaactag

SEQ ID NO: 360315 - DNA, 19 bp, Homo sapiens
cctggagacagtaacattt

SEQ ID NO: 360316 - DNA, 17 bp, Homo sapiens
cctggagagtctcactc

SEQ ID NO: 360317 - DNA, 17 bp, Homo sapiens
cctggagcatcccaggc

SEQ ID NO: 360318 - DNA, 14 bp, Homo sapiens
cctggagccccaga

SEQ ID NO: 360319 - DNA, 22 bp, Homo sapiens
cctggagccccagaaccccaac

SEQ ID NO: 360320 - DNA, 21 bp, Homo sapiens
cctggagcgtttgctgtgcca

SEQ ID NO: 360321 - DNA, 16 bp, Homo sapiens
cctggagctcctggga

SEQ ID NO: 360322 - DNA, 18 bp, Homo sapiens
cctggagctcctgggaag

SEQ ID NO: 360323 - DNA, 11 bp, Homo sapiens
cctggagctgt

SEQ ID NO: 360324 - DNA, 12 bp, Homo sapiens
cctggaggatga

SEQ ID NO: 360325 - DNA, 15 bp, Homo sapiens
cctggataaaaaaga

SEQ ID NO: 360326 - DNA, 14 bp, Homo sapiens
cctggataattata

SEQ ID NO: 360327 - DNA, 21 bp, Homo sapiens
cctggatccatcaggccactt

SEQ ID NO: 360328 - DNA, 18 bp, Homo sapiens
cctggatcccctctgtct

SEQ ID NO: 360329 - DNA, 16 bp, Homo sapiens
cctggatctaccagca

SEQ ID NO: 360330 - DNA, 19 bp, Homo sapiens
cctggatctccccactcta

SEQ ID NO: 360331 - DNA, 13 bp, Homo sapiens
cctggatgccaag

SEQ ID NO: 360332 - DNA, 21 bp, Homo sapiens
cctggatgccaaggagcccct

SEQ ID NO: 360333 - DNA, 19 bp, Homo sapiens
cctggatggatctgctcca

SEQ ID NO: 360334 - DNA, 21 bp, Homo sapiens
cctggatgggcattgggctga

SEQ ID NO: 360335 - DNA, 14 bp, Homo sapiens
cctggatgggggtg

SEQ ID NO: 360336 - DNA, 23 bp, Homo sapiens
cctggatgggggtgcaggcagcc

SEQ ID NO: 360337 - DNA, 20 bp, Homo sapiens
cctggatgtcccctgtccca

SEQ ID NO: 360338 - DNA, 23 bp, Homo sapiens
cctggatgtcccctgtcccacca

SEQ ID NO: 360339 - DNA, 21 bp, Homo sapiens
cctggatgtgtggggcatggt

SEQ ID NO: 360340 - DNA, 13 bp, Homo sapiens
cctggatgttata

SEQ ID NO: 360341 - DNA, 13 bp, Homo sapiens
cctggattttctt

SEQ ID NO: 360342 - DNA, 21 bp, Homo sapiens
cctggattttctttctatgta

SEQ ID NO: 360343 - DNA, 18 bp, Homo sapiens
cctggcacagggcagtgg

SEQ ID NO: 360344 - DNA, 14 bp, Homo sapiens
cctggcacccactc

SEQ ID NO: 360345 - DNA, 16 bp, Homo sapiens
cctggcacgtcctcca

SEQ ID NO: 360346 - DNA, 17 bp, Homo sapiens
cctggcacgtcctccac

SEQ ID NO: 360347 - DNA, 19 bp, Homo sapiens
cctggcacgtcctccaccg

SEQ ID NO: 360348 - DNA, 17 bp, Homo sapiens
cctggcagaactgagct

SEQ ID NO: 360349 - DNA, 12 bp, Homo sapiens
cctggcagccgt

SEQ ID NO: 360350 - DNA, 18 bp, Homo sapiens
cctggcagccgtgccttc

SEQ ID NO: 360351 - DNA, 22 bp, Homo sapiens
cctggcagggaggtcaggccct

SEQ ID NO: 360352 - DNA, 12 bp, Homo sapiens
cctggcagggca

SEQ ID NO: 360353 - DNA, 12 bp, Homo sapiens
cctggcaggtgg

SEQ ID NO: 360354 - DNA, 17 bp, Homo sapiens
cctggcatgggaatgaa

SEQ ID NO: 360355 - DNA, 18 bp, Homo sapiens
cctggcatgggaatgaat

SEQ ID NO: 360356 - DNA, 13 bp, Homo sapiens
cctggccaccctt

SEQ ID NO: 360357 - DNA, 13 bp, Homo sapiens
cctggccacctct

SEQ ID NO: 360358 - DNA, 14 bp, Homo sapiens
cctggccacctctc

SEQ ID NO: 360359 - DNA, 15 bp, Homo sapiens
cctggccacctctct

SEQ ID NO: 360360 - DNA, 18 bp, Homo sapiens
cctggccacctctctcct

SEQ ID NO: 360361 - DNA, 15 bp, Homo sapiens
cctggccacgcagcc

SEQ ID NO: 360362 - DNA, 18 bp, Homo sapiens
cctggccacgcagccagg

SEQ ID NO: 360363 - DNA, 20 bp, Homo sapiens
cctggccacgcagccaggac

SEQ ID NO: 360364 - DNA, 14 bp, Homo sapiens
cctggccaggagct

SEQ ID NO: 360365 - DNA, 19 bp, Homo sapiens
cctggccaggagctcttca

SEQ ID NO: 360366 - DNA, 20 bp, Homo sapiens
cctggccaggagctcttcag

SEQ ID NO: 360367 - DNA, 22 bp, Homo sapiens
cctggccaggagctcttcaggc

SEQ ID NO: 360368 - DNA, 18 bp, Homo sapiens
cctggcccacgccctccc

SEQ ID NO: 360369 - DNA, 15 bp, Homo sapiens
cctggcccagcggcc

SEQ ID NO: 360370 - DNA, 13 bp, Homo sapiens
cctggcccaggga

SEQ ID NO: 360371 - DNA, 17 bp, Homo sapiens
cctggcccatctcagcc

SEQ ID NO: 360372 - DNA, 18 bp, Homo sapiens
cctggcccatctcagcct

SEQ ID NO: 360373 - DNA, 20 bp, Homo sapiens
cctggcccatctcagcctcc

SEQ ID NO: 360374 - DNA, 21 bp, Homo sapiens
cctggccccgggctctggcca

SEQ ID NO: 360375 - DNA, 23 bp, Homo sapiens
cctggcccctccagaccctgcct

SEQ ID NO: 360376 - DNA, 20 bp, Homo sapiens
cctggcccctcccacatccc

SEQ ID NO: 360377 - DNA, 12 bp, Homo sapiens
cctggccctctg

SEQ ID NO: 360378 - DNA, 13 bp, Homo sapiens
cctggccctctgt

SEQ ID NO: 360379 - DNA, 14 bp, Homo sapiens
cctggccctcttct

SEQ ID NO: 360380 - DNA, 17 bp, Homo sapiens
cctggccctgccctgag

SEQ ID NO: 360381 - DNA, 20 bp, Homo sapiens
cctggccgggtcaccctgtg

SEQ ID NO: 360382 - DNA, 14 bp, Homo sapiens
cctggcctatttaa

SEQ ID NO: 360383 - DNA, 15 bp, Homo sapiens
cctggcctatttaag

SEQ ID NO: 360384 - DNA, 20 bp, Homo sapiens
cctggcctatttaagccccc

SEQ ID NO: 360385 - DNA, 21 bp, Homo sapiens
cctggcctatttaagccccct

SEQ ID NO: 360386 - DNA, 13 bp, Homo sapiens
cctggcctcactg

SEQ ID NO: 360387 - DNA, 23 bp, Homo sapiens
cctggcctcactggctggggcag

SEQ ID NO: 360388 - DNA, 13 bp, Homo sapiens
cctggcctccttt

SEQ ID NO: 360389 - DNA, 13 bp, Homo sapiens
cctggcctgagct

SEQ ID NO: 360390 - DNA, 13 bp, Homo sapiens
cctggcctggccc

SEQ ID NO: 360391 - DNA, 14 bp, Homo sapiens
cctggcctggccct

SEQ ID NO: 360392 - DNA, 15 bp, Homo sapiens
cctggcctggccctg

SEQ ID NO: 360393 - DNA, 22 bp, Homo sapiens
cctggcctggccctgccctgag

SEQ ID NO: 360394 - DNA, 13 bp, Homo sapiens
cctgtgctacaga

SEQ ID NO: 360395 - DNA, 14 bp, Homo sapiens
cctgtgctgaggac

SEQ ID NO: 360396 - DNA, 16 bp, Homo sapiens
cctgtgctgaggactc

SEQ ID NO: 360397 - DNA, 14 bp, Homo sapiens
cctgtgctgcatgc

SEQ ID NO: 360398 - DNA, 19 bp, Homo sapiens
cctgtgctgcatgcgacag

SEQ ID NO: 360399 - DNA, 24 bp, Homo sapiens
cctgtggaagggactaggagcact

SEQ ID NO: 360400 - DNA, 23 bp, Homo sapiens
cctgtggcagaaaagaggagacc

SEQ ID NO: 360401 - DNA, 12 bp, Homo sapiens
cctgtggccagg

SEQ ID NO: 360402 - DNA, 15 bp, Homo sapiens
cctgtggcctctcag

SEQ ID NO: 360403 - DNA, 18 bp, Homo sapiens
cctgtggcctctcagtca

SEQ ID NO: 360404 - DNA, 15 bp, Homo sapiens
cctgtggccttgccc

SEQ ID NO: 360405 - DNA, 17 bp, Homo sapiens
cctgtggccttgcccgc

SEQ ID NO: 360406 - DNA, 11 bp, Homo sapiens
cctgtggctct

SEQ ID NO: 360407 - DNA, 19 bp, Homo sapiens
cctgtgggagaagggacag

SEQ ID NO: 360408 - DNA, 17 bp, Homo sapiens
cctgtgggagtccactt

SEQ ID NO: 360409 - DNA, 19 bp, Homo sapiens
cctgtgggagtccactttc

SEQ ID NO: 360410 - DNA, 22 bp, Homo sapiens
cctgtggggatttctcccagct

SEQ ID NO: 360411 - DNA, 15 bp, Homo sapiens
cctgtgggtccccac

SEQ ID NO: 360412 - DNA, 17 bp, Homo sapiens
cctgtgggtccccactc

SEQ ID NO: 360413 - DNA, 16 bp, Homo sapiens
cctgtggtaccctggc

SEQ ID NO: 360414 - DNA, 23 bp, Homo sapiens
cctgtggtaccctggcagagaag

SEQ ID NO: 360415 - DNA, 15 bp, Homo sapiens
cctgtggtgaagtgt

SEQ ID NO: 360416 - DNA, 19 bp, Homo sapiens
cctgtggtgaagtgtggct

SEQ ID NO: 360417 - DNA, 21 bp, Homo sapiens
cctgtggtgaagtgtggctgg

SEQ ID NO: 360418 - DNA, 19 bp, Homo sapiens
cctgtggtgatgtgcctgt

SEQ ID NO: 360419 - DNA, 19 bp, Homo sapiens
cctgtggttacagtgcaga

SEQ ID NO: 360420 - DNA, 21 bp, Homo sapiens
cctgtggttacagtgcagaca

SEQ ID NO: 360421 - DNA, 20 bp, Homo sapiens
cctgtggtttgctccagaat

SEQ ID NO: 360422 - DNA, 13 bp, Homo sapiens
cctgtggtttgtt

SEQ ID NO: 360423 - DNA, 21 bp, Homo sapiens
cctgtggtttgttatcagtac

SEQ ID NO: 360424 - DNA, 21 bp, Homo sapiens
cctgtgtaatcatttcttggg

SEQ ID NO: 360425 - DNA, 12 bp, Homo sapiens
cctgtgtccaca

SEQ ID NO: 360426 - DNA, 17 bp, Homo sapiens
cctgtgtccagcagctg

SEQ ID NO: 360427 - DNA, 21 bp, Homo sapiens
cctgtgtcccctgacctgtcc

SEQ ID NO: 360428 - DNA, 22 bp, Homo sapiens
cctgtgtcccctgacctgtcca

SEQ ID NO: 360429 - DNA, 22 bp, Homo sapiens
cctgtgtcggggggcgagggag

SEQ ID NO: 360430 - DNA, 14 bp, Homo sapiens
cctgtgtgctccgg

SEQ ID NO: 360431 - DNA, 12 bp, Homo sapiens
cctgtgtggaga

SEQ ID NO: 360432 - DNA, 21 bp, Homo sapiens
cctgtgtggagagggaatgtg

SEQ ID NO: 360433 - DNA, 22 bp, Homo sapiens
cctgtgtgtcgttcccttgtgt

SEQ ID NO: 360434 - DNA, 15 bp, Homo sapiens
cctgtgtgtggaagg

SEQ ID NO: 360435 - DNA, 16 bp, Homo sapiens
cctgtgtgtggaaggc

SEQ ID NO: 360436 - DNA, 16 bp, Homo sapiens
cctgtgttagtgtctg

SEQ ID NO: 360437 - DNA, 20 bp, Homo sapiens
cctgtgttagtgtctgtcca

SEQ ID NO: 360438 - DNA, 15 bp, Homo sapiens
cctgtgttcttgctg

SEQ ID NO: 360439 - DNA, 20 bp, Homo sapiens
cctgtgttgtctctagagca

SEQ ID NO: 360440 - DNA, 13 bp, Homo sapiens
cctgttaaccctc

SEQ ID NO: 360441 - DNA, 15 bp, Homo sapiens
cctgttaagtctgag

SEQ ID NO: 360442 - DNA, 22 bp, Homo sapiens
cctgttacttaaatagcatctg

SEQ ID NO: 360443 - DNA, 18 bp, Homo sapiens
cctgttaggggaaaatag

SEQ ID NO: 360444 - DNA, 21 bp, Homo sapiens
cctgttcactctacttagcat

SEQ ID NO: 360445 - DNA, 19 bp, Homo sapiens
cctgttcagtgtcccgggc

SEQ ID NO: 360446 - DNA, 19 bp, Homo sapiens
cctgttcatgacagctact

SEQ ID NO: 360447 - DNA, 17 bp, Homo sapiens
cctgttcccctcactgg

SEQ ID NO: 360448 - DNA, 18 bp, Homo sapiens
cctgttcccctcactgga

SEQ ID NO: 360449 - DNA, 22 bp, Homo sapiens
cctgttcccctcactggatgaa

SEQ ID NO: 360450 - DNA, 18 bp, Homo sapiens
cctgttcctgccttctct

SEQ ID NO: 360451 - DNA, 21 bp, Homo sapiens
cctgttccttgaatctgaaag

SEQ ID NO: 360452 - DNA, 12 bp, Homo sapiens
cctgttctcaga

SEQ ID NO: 360453 - DNA, 13 bp, Homo sapiens
cctgttctcagag

SEQ ID NO: 360454 - DNA, 15 bp, Homo sapiens
cctgttctcagagct

SEQ ID NO: 360455 - DNA, 16 bp, Homo sapiens
cctgttctcagagctc

SEQ ID NO: 360456 - DNA, 17 bp, Homo sapiens
cctgttctgtaggagag

SEQ ID NO: 360457 - DNA, 13 bp, Homo sapiens
cctgttctgtgtc

SEQ ID NO: 360458 - DNA, 14 bp, Homo sapiens
cctgttctgtgtct

SEQ ID NO: 360459 - DNA, 19 bp, Homo sapiens
cctgttctgtgtctgctgt

SEQ ID NO: 360460 - DNA, 20 bp, Homo sapiens
cctgttctgtgtctgctgta

SEQ ID NO: 360461 - DNA, 18 bp, Homo sapiens
cctgttgagtatttgctg

SEQ ID NO: 360462 - DNA, 19 bp, Homo sapiens
cctgttgagtatttgctgt

SEQ ID NO: 360463 - DNA, 21 bp, Homo sapiens
cctgttgagtatttgctgttt

SEQ ID NO: 360464 - DNA, 14 bp, Homo sapiens
cctgttgcacctca

SEQ ID NO: 360465 - DNA, 22 bp, Homo sapiens
cctgttgccacactttcactgg

SEQ ID NO: 360466 - DNA, 17 bp, Homo sapiens
cctgttggctgctgcca

SEQ ID NO: 360467 - DNA, 18 bp, Homo sapiens
cctgtttaactccctagt

SEQ ID NO: 360468 - DNA, 23 bp, Homo sapiens
cctgtttacggtacttggtaaga

SEQ ID NO: 360469 - DNA, 16 bp, Homo sapiens
cctgtttctgcagcca

SEQ ID NO: 360470 - DNA, 13 bp, Homo sapiens
cctgtttgggagg

SEQ ID NO: 360471 - DNA, 17 bp, Homo sapiens
cctgtttgggaggctgg

SEQ ID NO: 360472 - DNA, 18 bp, Homo sapiens
cctgtttgggaggctgga

SEQ ID NO: 360473 - DNA, 20 bp, Homo sapiens
cctgtttgggaggctggagt

SEQ ID NO: 360474 - DNA, 23 bp, Homo sapiens
cctgttttattgagttctgaagg

SEQ ID NO: 360475 - DNA, 21 bp, Homo sapiens
cctgttttcaccatctttcta

SEQ ID NO: 360476 - DNA, 19 bp, Homo sapiens
cctgtttttaagctgtttc

SEQ ID NO: 360477 - DNA, 16 bp, Homo sapiens
ccttaaaataatgatt

SEQ ID NO: 360478 - DNA, 23 bp, Homo sapiens
ccttaaacagggcatctccagga

SEQ ID NO: 360479 - DNA, 16 bp, Homo sapiens
ccttaaactgacgcta

SEQ ID NO: 360480 - DNA, 23 bp, Homo sapiens
ccttaaagaaagtcgaattaata

SEQ ID NO: 360481 - DNA, 22 bp, Homo sapiens
ccttaaaggcaccatctaatag

SEQ ID NO: 360482 - DNA, 18 bp, Homo sapiens
ccttaaattaaacaattt

SEQ ID NO: 360483 - DNA, 22 bp, Homo sapiens
ccttaaccaccgcatatgcatg

SEQ ID NO: 360484 - DNA, 15 bp, Homo sapiens
ccttaagaaagctat

SEQ ID NO: 360485 - DNA, 19 bp, Homo sapiens
ccttaagaacacaaagcgg

SEQ ID NO: 360486 - DNA, 19 bp, Homo sapiens
ccttaagccataggcccag

SEQ ID NO: 360487 - DNA, 22 bp, Homo sapiens
ccttaagccataggcccaggat

SEQ ID NO: 360488 - DNA, 22 bp, Homo sapiens
ccttaaggaattgacttcagca

SEQ ID NO: 360489 - DNA, 23 bp, Homo sapiens
ccttaaggaattgacttcagcag

SEQ ID NO: 360490 - DNA, 12 bp, Homo sapiens
ccttaataaata

SEQ ID NO: 360491 - DNA, 23 bp, Homo sapiens
ccttaataaatatagttgtcttt

SEQ ID NO: 360492 - DNA, 20 bp, Homo sapiens
ccttacaaccacatttctgg

SEQ ID NO: 360493 - DNA, 19 bp, Homo sapiens
ccttacatttgtgagattc

SEQ ID NO: 360494 - DNA, 18 bp, Homo sapiens
ccttaccaactttctgta

SEQ ID NO: 360495 - DNA, 14 bp, Homo sapiens
ccttactctgagcc

SEQ ID NO: 360496 - DNA, 15 bp, Homo sapiens
ccttactctgagccc

SEQ ID NO: 360497 - DNA, 16 bp, Homo sapiens
ccttactctgagccca

SEQ ID NO: 360498 - DNA, 17 bp, Homo sapiens
ccttactctgagcccag

SEQ ID NO: 360499 - DNA, 19 bp, Homo sapiens
ccttactctgagcccaggc

SEQ ID NO: 360500 - DNA, 19 bp, Homo sapiens
ccttagaaaagactgacct

SEQ ID NO: 360501 - DNA, 15 bp, Homo sapiens
ccttagaacctttct

SEQ ID NO: 360502 - DNA, 16 bp, Homo sapiens
ccttagaacctttctt

SEQ ID NO: 360503 - DNA, 23 bp, Homo sapiens
ccttagcccggatgcccacccct

SEQ ID NO: 360504 - DNA, 12 bp, Homo sapiens
ccttagcctctc

SEQ ID NO: 360505 - DNA, 17 bp, Homo sapiens
ccttagcctctcccacc

SEQ ID NO: 360506 - DNA, 16 bp, Homo sapiens
ccttagccttgctgta

SEQ ID NO: 360507 - DNA, 23 bp, Homo sapiens
ccttagccttgctgtagagactt

SEQ ID NO: 360508 - DNA, 16 bp, Homo sapiens
ccttaggaagtgactt

SEQ ID NO: 360509 - DNA, 23 bp, Homo sapiens
ccttataaacagataatgctttt

SEQ ID NO: 360510 - DNA, 12 bp, Homo sapiens
ccttatcaagtg

SEQ ID NO: 360511 - DNA, 14 bp, Homo sapiens
ccttatcataaatt

SEQ ID NO: 360512 - DNA, 20 bp, Homo sapiens
ccttattagctaaaaatata

SEQ ID NO: 360513 - DNA, 16 bp, Homo sapiens
ccttattgtacctctc

SEQ ID NO: 360514 - DNA, 13 bp, Homo sapiens
ccttatttatcaa

SEQ ID NO: 360515 - DNA, 22 bp, Homo sapiens
ccttatttatcaacatcttttt

SEQ ID NO: 360516 - DNA, 14 bp, Homo sapiens
ccttatttattatt

SEQ ID NO: 360517 - DNA, 17 bp, Homo sapiens
ccttatttttatttatt

SEQ ID NO: 360518 - DNA, 12 bp, Homo sapiens
ccttcaaagctg

SEQ ID NO: 360519 - DNA, 18 bp, Homo sapiens
ccttcacaccataactag

SEQ ID NO: 360520 - DNA, 14 bp, Homo sapiens
ccttcacatctccc

SEQ ID NO: 360521 - DNA, 15 bp, Homo sapiens
ccttcacatctccca

SEQ ID NO: 360522 - DNA, 18 bp, Homo sapiens
ccttcacgctggcttcca

SEQ ID NO: 360523 - DNA, 13 bp, Homo sapiens
ccttgactgaagc

SEQ ID NO: 360524 - DNA, 14 bp, Homo sapiens
ccttgagaccctct

SEQ ID NO: 360525 - DNA, 20 bp, Homo sapiens
ccttgagaccctcttctctg

SEQ ID NO: 360526 - DNA, 16 bp, Homo sapiens
ccttgagaggcatgac

SEQ ID NO: 360527 - DNA, 23 bp, Homo sapiens
ccttgagctgcctgctctgcagc

SEQ ID NO: 360528 - DNA, 13 bp, Homo sapiens
ccttgaggtcttt

SEQ ID NO: 360529 - DNA, 19 bp, Homo sapiens
ccttgagtgacatgcggct

SEQ ID NO: 360530 - DNA, 14 bp, Homo sapiens
ccttgatcccaatc

SEQ ID NO: 360531 - DNA, 16 bp, Homo sapiens
ccttgatggagaagga

SEQ ID NO: 360532 - DNA, 22 bp, Homo sapiens
ccttgatgtcttgagagcgctg

SEQ ID NO: 360533 - DNA, 17 bp, Homo sapiens
ccttgcaacttcatgtc

SEQ ID NO: 360534 - DNA, 12 bp, Homo sapiens
ccttgcacaggc

SEQ ID NO: 360535 - DNA, 14 bp, Homo sapiens
ccttgcacaggcca

SEQ ID NO: 360536 - DNA, 13 bp, Homo sapiens
ccttgcactggtc

SEQ ID NO: 360537 - DNA, 15 bp, Homo sapiens
ccttgcagctagttt

SEQ ID NO: 360538 - DNA, 17 bp, Homo sapiens
ccttgcagttcagcacc

SEQ ID NO: 360539 - DNA, 19 bp, Homo sapiens
ccttgcagttcagcaccac

SEQ ID NO: 360540 - DNA, 14 bp, Homo sapiens
ccttgcattagaaa

SEQ ID NO: 360541 - DNA, 21 bp, Homo sapiens
ccttgcattttagctaattta

SEQ ID NO: 360542 - DNA, 16 bp, Homo sapiens
ccttgccaagctttct

SEQ ID NO: 360543 - DNA, 19 bp, Homo sapiens
ccttgccaaggccgcccac

SEQ ID NO: 360544 - DNA, 21 bp, Homo sapiens
ccttgccaaggccgcccacct

SEQ ID NO: 360545 - DNA, 23 bp, Homo sapiens
ccttgccatcctaaaagccaccc

SEQ ID NO: 360546 - DNA, 17 bp, Homo sapiens
ccttgcccaactcccag

SEQ ID NO: 360547 - DNA, 18 bp, Homo sapiens
ccttgcccaactcccagc

SEQ ID NO: 360548 - DNA, 20 bp, Homo sapiens
ccttgcccagactacagggc

SEQ ID NO: 360549 - DNA, 16 bp, Homo sapiens
ccttgccccagtcctg

SEQ ID NO: 360550 - DNA, 22 bp, Homo sapiens
ccttgcccgccagccagtggcc

SEQ ID NO: 360551 - DNA, 11 bp, Homo sapiens
ccttgccctgg

SEQ ID NO: 360552 - DNA, 12 bp, Homo sapiens
ccttgccctggg

SEQ ID NO: 360553 - DNA, 21 bp, Homo sapiens
ccttgccctgggccagcccag

SEQ ID NO: 360554 - DNA, 16 bp, Homo sapiens
ccttgccgctgggaga

SEQ ID NO: 360555 - DNA, 17 bp, Homo sapiens
ccttgccgctgggagag

SEQ ID NO: 360556 - DNA, 23 bp, Homo sapiens
ccttgccgctgggagagccaagg

SEQ ID NO: 360557 - DNA, 19 bp, Homo sapiens
ccttgcctcccctcctctc

SEQ ID NO: 360558 - DNA, 21 bp, Homo sapiens
ccttgcgcttttgctggtcac

SEQ ID NO: 360559 - DNA, 13 bp, Homo sapiens
ccttgctctccct

SEQ ID NO: 360560 - DNA, 15 bp, Homo sapiens
ccttgctctccctct

SEQ ID NO: 360561 - DNA, 12 bp, Homo sapiens
ccttgctgccaa

SEQ ID NO: 360562 - DNA, 14 bp, Homo sapiens
ccttgctgccaagt

SEQ ID NO: 360563 - DNA, 14 bp, Homo sapiens
ccttgctgtagaga

SEQ ID NO: 360564 - DNA, 19 bp, Homo sapiens
ccttgctgtagagacttcc

SEQ ID NO: 360565 - DNA, 14 bp, Homo sapiens
ccttgcttcacttt

SEQ ID NO: 360566 - DNA, 18 bp, Homo sapiens
ccttgctttgggctttgc

SEQ ID NO: 360567 - DNA, 21 bp, Homo sapiens
ccttggacggggacacggcct

SEQ ID NO: 360568 - DNA, 13 bp, Homo sapiens
ccttggacttgag

SEQ ID NO: 360569 - DNA, 15 bp, Homo sapiens
ccttggacttgagga

SEQ ID NO: 360570 - DNA, 18 bp, Homo sapiens
ccttggatgtagtctgag

SEQ ID NO: 360571 - DNA, 23 bp, Homo sapiens
ccttggcaccaaagatgcagccg

SEQ ID NO: 360572 - DNA, 21 bp, Homo sapiens
ccttggcacccccatgctgcc

SEQ ID NO: 360573 - DNA, 15 bp, Homo sapiens
ccttggccacggcct

SEQ ID NO: 360574 - DNA, 20 bp, Homo sapiens
ccttggccacggcctgggag

SEQ ID NO: 360575 - DNA, 13 bp, Homo sapiens
ccttggcccagca

SEQ ID NO: 360576 - DNA, 15 bp, Homo sapiens
ccttggcccagcagc

SEQ ID NO: 360577 - DNA, 22 bp, Homo sapiens
ccttggcccagcagcggcccag

SEQ ID NO: 360578 - DNA, 13 bp, Homo sapiens
ccttggcccctct

SEQ ID NO: 360579 - DNA, 18 bp, Homo sapiens
ccttggcccctctctgtt

SEQ ID NO: 360580 - DNA, 15 bp, Homo sapiens
ccttggccgcaccta

SEQ ID NO: 360581 - DNA, 23 bp, Homo sapiens
ccttggcctagcccaccctgctg

SEQ ID NO: 360582 - DNA, 14 bp, Homo sapiens
ccttggcctgacct

SEQ ID NO: 360583 - DNA, 15 bp, Homo sapiens
ccttggcctgacctg

SEQ ID NO: 360584 - DNA, 23 bp, Homo sapiens
ccttggcctgtctcatccccagg

SEQ ID NO: 360585 - DNA, 20 bp, Homo sapiens
ccttggccttggggccagac

SEQ ID NO: 360586 - DNA, 13 bp, Homo sapiens
ccttggcttcctc

SEQ ID NO: 360587 - DNA, 15 bp, Homo sapiens
ccttgggacagccag

SEQ ID NO: 360588 - DNA, 20 bp, Homo sapiens
ccttgggacagccagagctg

SEQ ID NO: 360589 - DNA, 20 bp, Homo sapiens
ccttgggatgggcacaggct

SEQ ID NO: 360590 - DNA, 21 bp, Homo sapiens
ccttgggcaagtcccttgacc

SEQ ID NO: 360591 - DNA, 17 bp, Homo sapiens
ccttgggcacgggagag

SEQ ID NO: 360592 - DNA, 23 bp, Homo sapiens
ccttgggcatccacccagtgctg

SEQ ID NO: 360593 - DNA, 13 bp, Homo sapiens
ccttgggcctttc

SEQ ID NO: 360594 - DNA, 17 bp, Homo sapiens
ccttgggcggctgagag

SEQ ID NO: 360595 - DNA, 14 bp, Homo sapiens
ccttgggctcctgg

SEQ ID NO: 360596 - DNA, 19 bp, Homo sapiens
ccttgggctcctggctgcc

SEQ ID NO: 360597 - DNA, 23 bp, Homo sapiens
ccttgggctcctggctgccaggc

SEQ ID NO: 360598 - DNA, 15 bp, Homo sapiens
ccttgggctgctcct

SEQ ID NO: 360599 - DNA, 18 bp, Homo sapiens
ccttgggctgctcctcat

SEQ ID NO: 360600 - DNA, 17 bp, Homo sapiens
ccttggggaatttcctc

SEQ ID NO: 360601 - DNA, 14 bp, Homo sapiens
ccttggggagcagg

SEQ ID NO: 360602 - DNA, 21 bp, Homo sapiens
ccttggggaggggtcagctct

SEQ ID NO: 360603 - DNA, 14 bp, Homo sapiens
ccttggggcctggc

SEQ ID NO: 360604 - DNA, 21 bp, Homo sapiens
ccttgggggtctgctctgtgc

SEQ ID NO: 360605 - DNA, 21 bp, Homo sapiens
ccttgggttccaaccaggcag

SEQ ID NO: 360606 - DNA, 22 bp, Homo sapiens
ccttggtgtttctttttccacc

SEQ ID NO: 360607 - DNA, 17 bp, Homo sapiens
ccttggttcatcagtgt

SEQ ID NO: 360608 - DNA, 18 bp, Homo sapiens
ccttggttcatcagtgtt

SEQ ID NO: 360609 - DNA, 14 bp, Homo sapiens
ccttggttcctcca

SEQ ID NO: 360610 - DNA, 17 bp, Homo sapiens
ccttggttcctccagca

SEQ ID NO: 360611 - DNA, 18 bp, Homo sapiens
ccttggttcctccagcaa

SEQ ID NO: 360612 - DNA, 14 bp, Homo sapiens
ccttggtttatgag

SEQ ID NO: 360613 - DNA, 16 bp, Homo sapiens
ccttgtaattctaaat

SEQ ID NO: 360614 - DNA, 22 bp, Homo sapiens
ccttgtacagaaccagcactcc

SEQ ID NO: 360615 - DNA, 20 bp, Homo sapiens
ccttgtagatggagcaagtg

SEQ ID NO: 360616 - DNA, 14 bp, Homo sapiens
ccttgtcaccagca

SEQ ID NO: 360617 - DNA, 20 bp, Homo sapiens
ccttgtcaccagcaacatct

SEQ ID NO: 360618 - DNA, 16 bp, Homo sapiens
ccttgtcctgccagct

SEQ ID NO: 360619 - DNA, 21 bp, Homo sapiens
ccttgtcctgccagctgcctt

SEQ ID NO: 360620 - DNA, 18 bp, Homo sapiens
ccttgtgatcactttctg

SEQ ID NO: 360621 - DNA, 16 bp, Homo sapiens
ccttgtgccctgcccc

SEQ ID NO: 360622 - DNA, 17 bp, Homo sapiens
ccttgtgccctgccccc

SEQ ID NO: 360623 - DNA, 18 bp, Homo sapiens
ccttgtgccctgccccca

SEQ ID NO: 360624 - DNA, 21 bp, Homo sapiens
ccttgtgcttggtggggctcg

SEQ ID NO: 360625 - DNA, 15 bp, Homo sapiens
ccttgtgtcagagct

SEQ ID NO: 360626 - DNA, 21 bp, Homo sapiens
ccttgtgtcagagctgggagt

SEQ ID NO: 360627 - DNA, 15 bp, Homo sapiens
ccttgtgtctgttgc

SEQ ID NO: 360628 - DNA, 23 bp, Homo sapiens
ccttgtgtgagtgtgacgggggt

SEQ ID NO: 360629 - DNA, 23 bp, Homo sapiens
ccttgttgatgccagctgtactg

SEQ ID NO: 360630 - DNA, 16 bp, Homo sapiens
ccttgttggtcagagg

SEQ ID NO: 360631 - DNA, 20 bp, Homo sapiens
ccttgtttctttctgaagtg

SEQ ID NO: 360632 - DNA, 15 bp, Homo sapiens
ccttgtttttgatgt

SEQ ID NO: 360633 - DNA, 20 bp, Homo sapiens
cctttaaagacttaagatta

SEQ ID NO: 360634 - DNA, 11 bp, Homo sapiens
cctttaaatat

SEQ ID NO: 360635 - DNA, 17 bp, Homo sapiens
cctttaataatgttata

SEQ ID NO: 360636 - DNA, 21 bp, Homo sapiens
cctttagaaactgagtcctgt

SEQ ID NO: 360637 - DNA, 19 bp, Homo sapiens
cctttaggcagcctgccgc

SEQ ID NO: 360638 - DNA, 20 bp, Homo sapiens
cctttatccctgcttatctg

SEQ ID NO: 360639 - DNA, 13 bp, Homo sapiens
cctttattcttta

SEQ ID NO: 360640 - DNA, 21 bp, Homo sapiens
cctttatttattaaacttcag

SEQ ID NO: 360641 - DNA, 13 bp, Homo sapiens
cctttattttaga

SEQ ID NO: 360642 - DNA, 16 bp, Homo sapiens
cctttcacagcttctt

SEQ ID NO: 360643 - DNA, 21 bp, Homo sapiens
cctttcagatgtcttctgcct

SEQ ID NO: 360644 - DNA, 17 bp, Homo sapiens
cctttccaattccaaaa

SEQ ID NO: 360645 - DNA, 20 bp, Homo sapiens
cctttccagggcataaaact

SEQ ID NO: 360646 - DNA, 20 bp, Homo sapiens
cctttccagtggcctggctc

SEQ ID NO: 360647 - DNA, 16 bp, Homo sapiens
cctttcccacagtctc

SEQ ID NO: 360648 - DNA, 17 bp, Homo sapiens
cctttcccatcacccct

SEQ ID NO: 360649 - DNA, 23 bp, Homo sapiens
cctttccccattcattcctgatg

SEQ ID NO: 360650 - DNA, 20 bp, Homo sapiens
cctttccctccactccttcc

SEQ ID NO: 360651 - DNA, 14 bp, Homo sapiens
cctttccctgcatc

SEQ ID NO: 360652 - DNA, 13 bp, Homo sapiens
cctttccctggag

SEQ ID NO: 360653 - DNA, 16 bp, Homo sapiens
cgccactaggtgtccc

SEQ ID NO: 360654 - DNA, 17 bp, Homo sapiens
cgccagattctccctta

SEQ ID NO: 360655 - DNA, 16 bp, Homo sapiens
cgccagccctaggcta

SEQ ID NO: 360656 - DNA, 17 bp, Homo sapiens
cgccagcctcagtgcca

SEQ ID NO: 360657 - DNA, 19 bp, Homo sapiens
cgccagcctcagtgccact

SEQ ID NO: 360658 - DNA, 18 bp, Homo sapiens
cgccaggaccgccaaaga

SEQ ID NO: 360659 - DNA, 20 bp, Homo sapiens
cgccaggaccgccaaagaat

SEQ ID NO: 360660 - DNA, 14 bp, Homo sapiens
cgccagtctcccag

SEQ ID NO: 360661 - DNA, 13 bp, Homo sapiens
cgccatcagccca

SEQ ID NO: 360662 - DNA, 14 bp, Homo sapiens
cgccatcagcccaa

SEQ ID NO: 360663 - DNA, 20 bp, Homo sapiens
cgccatgcaactccatgcct

SEQ ID NO: 360664 - DNA, 14 bp, Homo sapiens
cgccattctcctgc

SEQ ID NO: 360665 - DNA, 22 bp, Homo sapiens
cgccattctcctgcctcagcct

SEQ ID NO: 360666 - DNA, 17 bp, Homo sapiens
cgcccaaagccagacag

SEQ ID NO: 360667 - DNA, 17 bp, Homo sapiens
cgcccaacccccacctc

SEQ ID NO: 360668 - DNA, 14 bp, Homo sapiens
cgcccaccccgctg

SEQ ID NO: 360669 - DNA, 14 bp, Homo sapiens
cgcccacctctgct

SEQ ID NO: 360670 - DNA, 16 bp, Homo sapiens
cgcccacctctgctgc

SEQ ID NO: 360671 - DNA, 19 bp, Homo sapiens
cgcccacctctgctgccca

SEQ ID NO: 360672 - DNA, 20 bp, Homo sapiens
cgcccacctctgctgcccac

SEQ ID NO: 360673 - DNA, 12 bp, Homo sapiens
cgcccacctgca

SEQ ID NO: 360674 - DNA, 14 bp, Homo sapiens
cgcccacctgccca

SEQ ID NO: 360675 - DNA, 18 bp, Homo sapiens
cgcccacctgcccagtta

SEQ ID NO: 360676 - DNA, 15 bp, Homo sapiens
cgcccacctgggccc

SEQ ID NO: 360677 - DNA, 16 bp, Homo sapiens
cgcccacctgggccct

SEQ ID NO: 360678 - DNA, 20 bp, Homo sapiens
cgcccacctgggccctaggc

SEQ ID NO: 360679 - DNA, 21 bp, Homo sapiens
cgcccacctgggccctaggca

SEQ ID NO: 360680 - DNA, 16 bp, Homo sapiens
cgcccactgtcctggg

SEQ ID NO: 360681 - DNA, 17 bp, Homo sapiens
cgcccagctctcccaca

SEQ ID NO: 360682 - DNA, 20 bp, Homo sapiens
cgcccaggctggagtgcagt

SEQ ID NO: 360683 - DNA, 14 bp, Homo sapiens
cgccccacccaggg

SEQ ID NO: 360684 - DNA, 11 bp, Homo sapiens
cgccccagaga

SEQ ID NO: 360685 - DNA, 19 bp, Homo sapiens
cgccccagagactgcccac

SEQ ID NO: 360686 - DNA, 20 bp, Homo sapiens
cgccccagataccagcccct

SEQ ID NO: 360687 - DNA, 16 bp, Homo sapiens
cgccccatccctgctt

SEQ ID NO: 360688 - DNA, 13 bp, Homo sapiens
cgcccccagtgtg

SEQ ID NO: 360689 - DNA, 15 bp, Homo sapiens
cgccccccagagcca

SEQ ID NO: 360690 - DNA, 16 bp, Homo sapiens
cgccccccagagccag

SEQ ID NO: 360691 - DNA, 19 bp, Homo sapiens
cgccccccagagccagggc

SEQ ID NO: 360692 - DNA, 20 bp, Homo sapiens
cgccccccagagccagggct

SEQ ID NO: 360693 - DNA, 23 bp, Homo sapiens
cgcccccgggtttggcgggccaa

SEQ ID NO: 360694 - DNA, 11 bp, Homo sapiens
cgccccctccc

SEQ ID NO: 360695 - DNA, 14 bp, Homo sapiens
cgccccctccctat

SEQ ID NO: 360696 - DNA, 13 bp, Homo sapiens
cgcccccttggct

SEQ ID NO: 360697 - DNA, 13 bp, Homo sapiens
cgccccgccccag

SEQ ID NO: 360698 - DNA, 15 bp, Homo sapiens
cgccccgccccagag

SEQ ID NO: 360699 - DNA, 16 bp, Homo sapiens
cgccccgccccagagc

SEQ ID NO: 360700 - DNA, 11 bp, Homo sapiens
cgcccctcctc

SEQ ID NO: 360701 - DNA, 12 bp, Homo sapiens
cgcccctcctcg

SEQ ID NO: 360702 - DNA, 14 bp, Homo sapiens
cgcccctgccacct

SEQ ID NO: 360703 - DNA, 13 bp, Homo sapiens
cgcccgcccaccc

SEQ ID NO: 360704 - DNA, 15 bp, Homo sapiens
cgcccgcccaccccg

SEQ ID NO: 360705 - DNA, 23 bp, Homo sapiens
cgcccgcccaccccgctgcctgg

SEQ ID NO: 360706 - DNA, 16 bp, Homo sapiens
cgcccgcccactgtcc

SEQ ID NO: 360707 - DNA, 18 bp, Homo sapiens
cgcccgcccactgtcctg

SEQ ID NO: 360708 - DNA, 19 bp, Homo sapiens
cgcccgcccactgtcctgg

SEQ ID NO: 360709 - DNA, 16 bp, Homo sapiens
cgcccgccggttggcc

SEQ ID NO: 360710 - DNA, 21 bp, Homo sapiens
cgcccgccggttggccggctg

SEQ ID NO: 360711 - DNA, 13 bp, Homo sapiens
cgcccgctgggct

SEQ ID NO: 360712 - DNA, 16 bp, Homo sapiens
cgcccgctgggctgag

SEQ ID NO: 360713 - DNA, 11 bp, Homo sapiens
cgccctcaggc

SEQ ID NO: 360714 - DNA, 17 bp, Homo sapiens
cgccctccctccctcca

SEQ ID NO: 360715 - DNA, 21 bp, Homo sapiens
cgccctccctctcccaggccc

SEQ ID NO: 360716 - DNA, 20 bp, Homo sapiens
cgccctcctcgctgtgccac

SEQ ID NO: 360717 - DNA, 16 bp, Homo sapiens
cgccctcctctgcccc

SEQ ID NO: 360718 - DNA, 21 bp, Homo sapiens
cgccctcctctgccccctccc

SEQ ID NO: 360719 - DNA, 12 bp, Homo sapiens
cgccctctgtgc

SEQ ID NO: 360720 - DNA, 13 bp, Homo sapiens
cgccctctgtgcc

SEQ ID NO: 360721 - DNA, 13 bp, Homo sapiens
cgccctcttcccc

SEQ ID NO: 360722 - DNA, 15 bp, Homo sapiens
cgccctgcccttccc

SEQ ID NO: 360723 - DNA, 18 bp, Homo sapiens
cgccctgcgttggagcca

SEQ ID NO: 360724 - DNA, 12 bp, Homo sapiens
cgccctggaagc

SEQ ID NO: 360725 - DNA, 13 bp, Homo sapiens
cgccctgggctct

SEQ ID NO: 360726 - DNA, 17 bp, Homo sapiens
cgccctttccttgcctt

SEQ ID NO: 360727 - DNA, 19 bp, Homo sapiens
cgccctttccttgccttct

SEQ ID NO: 360728 - DNA, 22 bp, Homo sapiens
cgccctttccttgccttcttta

SEQ ID NO: 360729 - DNA, 15 bp, Homo sapiens
cgccctttttgtcct

SEQ ID NO: 360730 - DNA, 19 bp, Homo sapiens
cgccggaagtggctccgtg

SEQ ID NO: 360731 - DNA, 17 bp, Homo sapiens
cgccggggctggccctg

SEQ ID NO: 360732 - DNA, 18 bp, Homo sapiens
cgccggggctggccctgc

SEQ ID NO: 360733 - DNA, 21 bp, Homo sapiens
cgccggttggccggctggccg

SEQ ID NO: 360734 - DNA, 19 bp, Homo sapiens
cgccgtctggcgagccctt

SEQ ID NO: 360735 - DNA, 21 bp, Homo sapiens
cgccgtgccggcggcagcccc

SEQ ID NO: 360736 - DNA, 12 bp, Homo sapiens
cgccgtgcctgc

SEQ ID NO: 360737 - DNA, 15 bp, Homo sapiens
cgcctaggcctgtga

SEQ ID NO: 360738 - DNA, 12 bp, Homo sapiens
cgcctcagcctc

SEQ ID NO: 360739 - DNA, 14 bp, Homo sapiens
cgcctccactctag

SEQ ID NO: 360740 - DNA, 16 bp, Homo sapiens
cgcctccactctagtt

SEQ ID NO: 360741 - DNA, 16 bp, Homo sapiens
cgcctcccgccgcctc

SEQ ID NO: 360742 - DNA, 20 bp, Homo sapiens
cgcctcccgccgcctcgggc

SEQ ID NO: 360743 - DNA, 15 bp, Homo sapiens
cgcctccgcccaaat

SEQ ID NO: 360744 - DNA, 23 bp, Homo sapiens
cgcctcgggccgcctcctccaga

SEQ ID NO: 360745 - DNA, 19 bp, Homo sapiens
cgcctctgcccgcagagcc

SEQ ID NO: 360746 - DNA, 13 bp, Homo sapiens
cgcctgcacctgc

SEQ ID NO: 360747 - DNA, 24 bp, Homo sapiens
cgcctgcacctgcgcctggctctg

SEQ ID NO: 360748 - DNA, 20 bp, Homo sapiens
cgcctgccctccccagagca

SEQ ID NO: 360749 - DNA, 15 bp, Homo sapiens
cgcctgccttctggg

SEQ ID NO: 360750 - DNA, 18 bp, Homo sapiens
cgcctgcgctcctctgca

SEQ ID NO: 360751 - DNA, 19 bp, Homo sapiens
cgcctgcgctcctctgcag

SEQ ID NO: 360752 - DNA, 14 bp, Homo sapiens
cgcctgcggactcc

SEQ ID NO: 360753 - DNA, 15 bp, Homo sapiens
cgcctgcggactcca

SEQ ID NO: 360754 - DNA, 17 bp, Homo sapiens
cgcctgcggactccatg

SEQ ID NO: 360755 - DNA, 18 bp, Homo sapiens
cgcctgcggactccatgg

SEQ ID NO: 360756 - DNA, 19 bp, Homo sapiens
cgcctgcggactccatggc

SEQ ID NO: 360757 - DNA, 14 bp, Homo sapiens
cgcctgcttcacac

SEQ ID NO: 360758 - DNA, 20 bp, Homo sapiens
cgcctgcttcacacccctca

SEQ ID NO: 360759 - DNA, 13 bp, Homo sapiens
cgcctggcaggtg

SEQ ID NO: 360760 - DNA, 14 bp, Homo sapiens
cgcctggctccagg

SEQ ID NO: 360761 - DNA, 14 bp, Homo sapiens
cgcctggctctgtc

SEQ ID NO: 360762 - DNA, 12 bp, Homo sapiens
cgccttccctca

SEQ ID NO: 360763 - DNA, 18 bp, Homo sapiens
cgccttcctcctccacag

SEQ ID NO: 360764 - DNA, 15 bp, Homo sapiens
cgcgagactgagagg

SEQ ID NO: 360765 - DNA, 21 bp, Homo sapiens
cgcgcaccgcccaacccccac

SEQ ID NO: 360766 - DNA, 20 bp, Homo sapiens
cgcgcagcccgggagatccg

SEQ ID NO: 360767 - DNA, 13 bp, Homo sapiens
cgcgcgtgccccc

SEQ ID NO: 360768 - DNA, 15 bp, Homo sapiens
cgcgcgtgcccccag

SEQ ID NO: 360769 - DNA, 16 bp, Homo sapiens
cgcgcgtgcccccagc

SEQ ID NO: 360770 - DNA, 14 bp, Homo sapiens
cgcgctctgcccct

SEQ ID NO: 360771 - DNA, 18 bp, Homo sapiens
cgcgctggaatccagaag

SEQ ID NO: 360772 - DNA, 22 bp, Homo sapiens
cgcgctggaatccagaaggaag

SEQ ID NO: 360773 - DNA, 19 bp, Homo sapiens
cgcggctcccggggcaggg

SEQ ID NO: 360774 - DNA, 21 bp, Homo sapiens
cgcgggagagagtgagagaga

SEQ ID NO: 360775 - DNA, 22 bp, Homo sapiens
cgcgggagagagtgagagagag

SEQ ID NO: 360776 - DNA, 16 bp, Homo sapiens
cgcgggaggcaccagc

SEQ ID NO: 360777 - DNA, 14 bp, Homo sapiens
cgcggtgctctggc

SEQ ID NO: 360778 - DNA, 15 bp, Homo sapiens
cgcggtgctctggcg

SEQ ID NO: 360779 - DNA, 18 bp, Homo sapiens
cgcggtgctctggcggct

SEQ ID NO: 360780 - DNA, 20 bp, Homo sapiens
cgcggttcaggtcagggcta

SEQ ID NO: 360781 - DNA, 14 bp, Homo sapiens
cgcgtctgccccac

SEQ ID NO: 360782 - DNA, 15 bp, Homo sapiens
cgcgtctgccccacc

SEQ ID NO: 360783 - DNA, 19 bp, Homo sapiens
cgcgtctgccccaccctca

SEQ ID NO: 360784 - DNA, 14 bp, Homo sapiens
cgcgtcttcctgag

SEQ ID NO: 360785 - DNA, 16 bp, Homo sapiens
cgggcagggctcccac

SEQ ID NO: 360786 - DNA, 20 bp, Homo sapiens
cgggcagtgacgtgagtggg

SEQ ID NO: 360787 - DNA, 20 bp, Homo sapiens
cgggccaaggactgccgacc

SEQ ID NO: 360788 - DNA, 16 bp, Homo sapiens
cgggccacgccccagc

SEQ ID NO: 360789 - DNA, 18 bp, Homo sapiens
cgggccacgccccagccc

SEQ ID NO: 360790 - DNA, 23 bp, Homo sapiens
cgggccacgccccagcccgacaa

SEQ ID NO: 360791 - DNA, 14 bp, Homo sapiens
cgggcccagaggag

SEQ ID NO: 360792 - DNA, 13 bp, Homo sapiens
cgggcccagctga

SEQ ID NO: 360793 - DNA, 13 bp, Homo sapiens
cgggcccttcagt

SEQ ID NO: 360794 - DNA, 13 bp, Homo sapiens
cgggccgcctcct

SEQ ID NO: 360795 - DNA, 14 bp, Homo sapiens
cgggccgcctcctc

SEQ ID NO: 360796 - DNA, 17 bp, Homo sapiens
cgggccgcctcctccag

SEQ ID NO: 360797 - DNA, 18 bp, Homo sapiens
cgggccgcctcctccaga

SEQ ID NO: 360798 - DNA, 21 bp, Homo sapiens
cgggccgcctcctccagactc

SEQ ID NO: 360799 - DNA, 13 bp, Homo sapiens
cgggcctggactg

SEQ ID NO: 360800 - DNA, 22 bp, Homo sapiens
cgggcgcctgcgctcctctgca

SEQ ID NO: 360801 - DNA, 15 bp, Homo sapiens
cgggcggccaggcaa

SEQ ID NO: 360802 - DNA, 21 bp, Homo sapiens
cgggcggtcaggggttcgaga

SEQ ID NO: 360803 - DNA, 13 bp, Homo sapiens
cgggctctggcca

SEQ ID NO: 360804 - DNA, 18 bp, Homo sapiens
cgggctctggccaccctg

SEQ ID NO: 360805 - DNA, 17 bp, Homo sapiens
cgggctggcctgtgcct

SEQ ID NO: 360806 - DNA, 21 bp, Homo sapiens
cgggctttcccccaggcgcct

SEQ ID NO: 360807 - DNA, 13 bp, Homo sapiens
cggggacacaggc

SEQ ID NO: 360808 - DNA, 17 bp, Homo sapiens
cggggacacggcctctg

SEQ ID NO: 360809 - DNA, 17 bp, Homo sapiens
cggggaggagccttgga

SEQ ID NO: 360810 - DNA, 21 bp, Homo sapiens
cggggaggccaagtgcaggct

SEQ ID NO: 360811 - DNA, 12 bp, Homo sapiens
cggggagtgaga

SEQ ID NO: 360812 - DNA, 17 bp, Homo sapiens
cggggcaagagggaagg

SEQ ID NO: 360813 - DNA, 17 bp, Homo sapiens
cggggcactggctgctc

SEQ ID NO: 360814 - DNA, 15 bp, Homo sapiens
cggggcagagctcag

SEQ ID NO: 360815 - DNA, 16 bp, Homo sapiens
cggggcagagctcaga

SEQ ID NO: 360816 - DNA, 18 bp, Homo sapiens
cggggcagagctcagagg

SEQ ID NO: 360817 - DNA, 13 bp, Homo sapiens
cggggcagagctg

SEQ ID NO: 360818 - DNA, 19 bp, Homo sapiens
cggggcagctgccagagaa

SEQ ID NO: 360819 - DNA, 17 bp, Homo sapiens
cggggcaggaagtccct

SEQ ID NO: 360820 - DNA, 20 bp, Homo sapiens
cggggcatggacagggccag

SEQ ID NO: 360821 - DNA, 22 bp, Homo sapiens
cggggccagcatccatgcggcc

SEQ ID NO: 360822 - DNA, 19 bp, Homo sapiens
cggggcccttggggcctgg

SEQ ID NO: 360823 - DNA, 20 bp, Homo sapiens
cggggcccttggggcctggc

SEQ ID NO: 360824 - DNA, 21 bp, Homo sapiens
cggggcccttggggcctggct

SEQ ID NO: 360825 - DNA, 11 bp, Homo sapiens
cggggctggcc

SEQ ID NO: 360826 - DNA, 16 bp, Homo sapiens
cgggggagcctggagc

SEQ ID NO: 360827 - DNA, 18 bp, Homo sapiens
cgggggagcctggagccc

SEQ ID NO: 360828 - DNA, 16 bp, Homo sapiens
cgggggaggagcaccc

SEQ ID NO: 360829 - DNA, 17 bp, Homo sapiens
cgggggaggagcacccc

SEQ ID NO: 360830 - DNA, 24 bp, Homo sapiens
cgggggaggagcacccccagcctc

SEQ ID NO: 360831 - DNA, 17 bp, Homo sapiens
cgggggatcctggagcc

SEQ ID NO: 360832 - DNA, 22 bp, Homo sapiens
cgggggcatctgagtccagctc

SEQ ID NO: 360833 - DNA, 19 bp, Homo sapiens
cgggggcctagtggcttca

SEQ ID NO: 360834 - DNA, 18 bp, Homo sapiens
cgggggctaactggcccc

SEQ ID NO: 360835 - DNA, 20 bp, Homo sapiens
cgggggctaactggccccag

SEQ ID NO: 360836 - DNA, 22 bp, Homo sapiens
cgggggctaactggccccaggc

SEQ ID NO: 360837 - DNA, 23 bp, Homo sapiens
cgggggctaactggccccaggcg

SEQ ID NO: 360838 - DNA, 11 bp, Homo sapiens
cggggggaggg

SEQ ID NO: 360839 - DNA, 22 bp, Homo sapiens
cggggggagggttggggagggg

SEQ ID NO: 360840 - DNA, 22 bp, Homo sapiens
cgggggtccccggacgctggct

SEQ ID NO: 360841 - DNA, 22 bp, Homo sapiens
cgggggttgtggcccccgcccc

SEQ ID NO: 360842 - DNA, 16 bp, Homo sapiens
cggggtattttaggca

SEQ ID NO: 360843 - DNA, 19 bp, Homo sapiens
cggggtcctgaggctgggg

SEQ ID NO: 360844 - DNA, 20 bp, Homo sapiens
cggggtctgtgctgtgcctg

SEQ ID NO: 360845 - DNA, 17 bp, Homo sapiens
cggggtggacgagggag

SEQ ID NO: 360846 - DNA, 12 bp, Homo sapiens
cggggtggagca

SEQ ID NO: 360847 - DNA, 21 bp, Homo sapiens
cggggtggggtgcctgagccc

SEQ ID NO: 360848 - DNA, 16 bp, Homo sapiens
cggggtggtggacagg

SEQ ID NO: 360849 - DNA, 17 bp, Homo sapiens
cggggtggtggacaggg

SEQ ID NO: 360850 - DNA, 21 bp, Homo sapiens
cggggttggctgttccagact

SEQ ID NO: 360851 - DNA, 17 bp, Homo sapiens
cgggtccagagaccaca

SEQ ID NO: 360852 - DNA, 22 bp, Homo sapiens
cgggtctgtgggactggcccac

SEQ ID NO: 360853 - DNA, 18 bp, Homo sapiens
cgggtgcgtgaccggccc

SEQ ID NO: 360854 - DNA, 19 bp, Homo sapiens
cgggtgcgtgaccggcccg

SEQ ID NO: 360855 - DNA, 15 bp, Homo sapiens
cgggtgctcagggct

SEQ ID NO: 360856 - DNA, 18 bp, Homo sapiens
cgggtgctcagggctgac

SEQ ID NO: 360857 - DNA, 16 bp, Homo sapiens
cgggtgggcctggcct

SEQ ID NO: 360858 - DNA, 22 bp, Homo sapiens
cgggtgggcctggcctgagctg

SEQ ID NO: 360859 - DNA, 19 bp, Homo sapiens
cgggtggggtgcttgctgt

SEQ ID NO: 360860 - DNA, 16 bp, Homo sapiens
cgggtgggtatcccac

SEQ ID NO: 360861 - DNA, 19 bp, Homo sapiens
cgggtgggtatcccacctc

SEQ ID NO: 360862 - DNA, 19 bp, Homo sapiens
cgggtgtggcacgcacctg

SEQ ID NO: 360863 - DNA, 13 bp, Homo sapiens
cgggttagcctgg

SEQ ID NO: 360864 - DNA, 19 bp, Homo sapiens
cgggttagcctggtgacag

SEQ ID NO: 360865 - DNA, 20 bp, Homo sapiens
cgggttcacgccattctcct

SEQ ID NO: 360866 - DNA, 22 bp, Homo sapiens
cgggttctagacgcccctccca

SEQ ID NO: 360867 - DNA, 15 bp, Homo sapiens
cgggttggaggcctc

SEQ ID NO: 360868 - DNA, 17 bp, Homo sapiens
cgggttggaggcctcac

SEQ ID NO: 360869 - DNA, 17 bp, Homo sapiens
cggtaggtgctggcctc

SEQ ID NO: 360870 - DNA, 14 bp, Homo sapiens
cggtatccagaggt

SEQ ID NO: 360871 - DNA, 14 bp, Homo sapiens
cggtcccaggccgc

SEQ ID NO: 360872 - DNA, 12 bp, Homo sapiens
cggtccccatcc

SEQ ID NO: 360873 - DNA, 14 bp, Homo sapiens
cggtccccatcccc

SEQ ID NO: 360874 - DNA, 21 bp, Homo sapiens
cggtcctttaggcagcctgcc

SEQ ID NO: 360875 - DNA, 22 bp, Homo sapiens
cggtcctttaggcagcctgccg

SEQ ID NO: 360876 - DNA, 21 bp, Homo sapiens
cggtcctttgagtgtcaggct

SEQ ID NO: 360877 - DNA, 17 bp, Homo sapiens
cggtgaggcaggggagt

SEQ ID NO: 360878 - DNA, 15 bp, Homo sapiens
cggtgatcagcagag

SEQ ID NO: 360879 - DNA, 17 bp, Homo sapiens
cggtgatcagcagagag

SEQ ID NO: 360880 - DNA, 13 bp, Homo sapiens
cggtgccctgtgt

SEQ ID NO: 360881 - DNA, 20 bp, Homo sapiens
cggtgcgtggctgtggcaca

SEQ ID NO: 360882 - DNA, 13 bp, Homo sapiens
cggtgctctggcg

SEQ ID NO: 360883 - DNA, 14 bp, Homo sapiens
cggtgctctggcgg

SEQ ID NO: 360884 - DNA, 14 bp, Homo sapiens
cggtgggcagccat

SEQ ID NO: 360885 - DNA, 15 bp, Homo sapiens
cggtgggcagccatg

SEQ ID NO: 360886 - DNA, 15 bp, Homo sapiens
cggtgggccgaggcc

SEQ ID NO: 360887 - DNA, 16 bp, Homo sapiens
cggtggtttgccatgt

SEQ ID NO: 360888 - DNA, 20 bp, Homo sapiens
cggtggtttgccatgtcgct

SEQ ID NO: 360889 - DNA, 21 bp, Homo sapiens
cggtggtttgccatgtcgctt

SEQ ID NO: 360890 - DNA, 16 bp, Homo sapiens
cggtgtatgcagtggt

SEQ ID NO: 360891 - DNA, 15 bp, Homo sapiens
cggtgtccatttata

SEQ ID NO: 360892 - DNA, 22 bp, Homo sapiens
cggtgtgagatggtgccccctg

SEQ ID NO: 360893 - DNA, 17 bp, Homo sapiens
cggttcagacccctgcc

SEQ ID NO: 360894 - DNA, 19 bp, Homo sapiens
cggttcagacccctgcctg

SEQ ID NO: 360895 - DNA, 16 bp, Homo sapiens
cggttcaggtcagggc

SEQ ID NO: 360896 - DNA, 17 bp, Homo sapiens
cggttcaggtcagggct

SEQ ID NO: 360897 - DNA, 20 bp, Homo sapiens
cggttccacgtccccctggg

SEQ ID NO: 360898 - DNA, 14 bp, Homo sapiens
cggttccctgccta

SEQ ID NO: 360899 - DNA, 17 bp, Homo sapiens
cggttggccggctggcc

SEQ ID NO: 360900 - DNA, 12 bp, Homo sapiens
cggtttcagaag

SEQ ID NO: 360901 - DNA, 14 bp, Homo sapiens
cggtttcagaagct

SEQ ID NO: 360902 - DNA, 14 bp, Homo sapiens
cgtaatgggcctgc

SEQ ID NO: 360903 - DNA, 18 bp, Homo sapiens
cgtaattcaatttctcac

SEQ ID NO: 360904 - DNA, 14 bp, Homo sapiens
cgtactctcacatg

SEQ ID NO: 360905 - DNA, 14 bp, Homo sapiens
cgtacttaactgtg

SEQ ID NO: 360906 - DNA, 15 bp, Homo sapiens
cgtagatgctgccta

SEQ ID NO: 360907 - DNA, 16 bp, Homo sapiens
cgtagatgctgcctag

SEQ ID NO: 360908 - DNA, 18 bp, Homo sapiens
cgtagcgtttccgtgagc

SEQ ID NO: 360909 - DNA, 12 bp, Homo sapiens
cgtagggccagg

SEQ ID NO: 360910 - DNA, 13 bp, Homo sapiens
cgtagggccaggg

SEQ ID NO: 360911 - DNA, 13 bp, Homo sapiens
cgtataaggaaat

SEQ ID NO: 360912 - DNA, 13 bp, Homo sapiens
cgtatatttcatt

SEQ ID NO: 360913 - DNA, 16 bp, Homo sapiens
cgtatcacctttccca

SEQ ID NO: 360914 - DNA, 17 bp, Homo sapiens
cgtatgaatgatatctt

SEQ ID NO: 360915 - DNA, 14 bp, Homo sapiens
cgtatgtaaacatt

SEQ ID NO: 360916 - DNA, 17 bp, Homo sapiens
ctaattaatttcagtaa

SEQ ID NO: 360917 - DNA, 14 bp, Homo sapiens
ctaattagagcaga

SEQ ID NO: 360918 - DNA, 14 bp, Homo sapiens
ctaattcaactctg

SEQ ID NO: 360919 - DNA, 22 bp, Homo sapiens
ctaattcacaaaaaaagtaatt

SEQ ID NO: 360920 - DNA, 18 bp, Homo sapiens
ctaattcccattttgcaa

SEQ ID NO: 360921 - DNA, 18 bp, Homo sapiens
ctaattctctaggaaagt

SEQ ID NO: 360922 - DNA, 19 bp, Homo sapiens
ctaattctgggaagggaga

SEQ ID NO: 360923 - DNA, 21 bp, Homo sapiens
ctaatttatcttgtctctggg

SEQ ID NO: 360924 - DNA, 13 bp, Homo sapiens
ctaatttctgtcc

SEQ ID NO: 360925 - DNA, 15 bp, Homo sapiens
ctaatttgaatgaaa

SEQ ID NO: 360926 - DNA, 14 bp, Homo sapiens
ctaatttgctgctg

SEQ ID NO: 360927 - DNA, 18 bp, Homo sapiens
ctaatttggtttttactc

SEQ ID NO: 360928 - DNA, 13 bp, Homo sapiens
ctaattttctcaa

SEQ ID NO: 360929 - DNA, 18 bp, Homo sapiens
ctaattttgtatttttag

SEQ ID NO: 360930 - DNA, 15 bp, Homo sapiens
ctaattttgtgctct

SEQ ID NO: 360931 - DNA, 12 bp, Homo sapiens
ctaatttttaag

SEQ ID NO: 360932 - DNA, 15 bp, Homo sapiens
ctaatttttttgtat

SEQ ID NO: 360933 - DNA, 13 bp, Homo sapiens
ctacaaaagcaaa

SEQ ID NO: 360934 - DNA, 23 bp, Homo sapiens
ctacaaagctgaagaaaatgaag

SEQ ID NO: 360935 - DNA, 15 bp, Homo sapiens
ctacaaccagagccc

SEQ ID NO: 360936 - DNA, 16 bp, Homo sapiens
ctacaaccagagcccc

SEQ ID NO: 360937 - DNA, 22 bp, Homo sapiens
ctacaaccaggtcttgacctga

SEQ ID NO: 360938 - DNA, 20 bp, Homo sapiens
ctacaacctccaccttccag

SEQ ID NO: 360939 - DNA, 23 bp, Homo sapiens
ctacaactgatcatttgcagctg

SEQ ID NO: 360940 - DNA, 17 bp, Homo sapiens
ctacaagagcagcctgt

SEQ ID NO: 360941 - DNA, 21 bp, Homo sapiens
ctacaagagcagcctgtggca

SEQ ID NO: 360942 - DNA, 19 bp, Homo sapiens
ctacaagctaaaattagat

SEQ ID NO: 360943 - DNA, 23 bp, Homo sapiens
ctacaatatcattttcctgggag

SEQ ID NO: 360944 - DNA, 13 bp, Homo sapiens
ctacacaacatgt

SEQ ID NO: 360945 - DNA, 19 bp, Homo sapiens
ctacacagcagctgttcaa

SEQ ID NO: 360946 - DNA, 16 bp, Homo sapiens
ctacacccttggactt

SEQ ID NO: 360947 - DNA, 14 bp, Homo sapiens
ctacacctctgggc

SEQ ID NO: 360948 - DNA, 20 bp, Homo sapiens
ctacacctctgggccctgca

SEQ ID NO: 360949 - DNA, 15 bp, Homo sapiens
ctacacgcacccaat

SEQ ID NO: 360950 - DNA, 20 bp, Homo sapiens
ctacactgtgaacttgggga

SEQ ID NO: 360951 - DNA, 21 bp, Homo sapiens
ctacacttacaagtaatgaat

SEQ ID NO: 360952 - DNA, 21 bp, Homo sapiens
ctacagaaagcaaatcagaca

SEQ ID NO: 360953 - DNA, 20 bp, Homo sapiens
ctacagagcagctccccagg

SEQ ID NO: 360954 - DNA, 20 bp, Homo sapiens
ctacagaggtctctgccggc

SEQ ID NO: 360955 - DNA, 23 bp, Homo sapiens
ctacagaggtctctgccggctct

SEQ ID NO: 360956 - DNA, 13 bp, Homo sapiens
ctacagattttag

SEQ ID NO: 360957 - DNA, 14 bp, Homo sapiens
ctacagattttaga

SEQ ID NO: 360958 - DNA, 21 bp, Homo sapiens
ctacagcatcaatagaaagtc

SEQ ID NO: 360959 - DNA, 13 bp, Homo sapiens
ctacagcctgcac

SEQ ID NO: 360960 - DNA, 19 bp, Homo sapiens
ctacagctaatcagcattc

SEQ ID NO: 360961 - DNA, 21 bp, Homo sapiens
ctacagctaatcagcattctc

SEQ ID NO: 360962 - DNA, 22 bp, Homo sapiens
ctacaggaagcaccccatgcca

SEQ ID NO: 360963 - DNA, 13 bp, Homo sapiens
ctacagggaactg

SEQ ID NO: 360964 - DNA, 23 bp, Homo sapiens
ctacagtagctgtggggagctgg

SEQ ID NO: 360965 - DNA, 14 bp, Homo sapiens
ctacagtatataag

SEQ ID NO: 360966 - DNA, 23 bp, Homo sapiens
ctacagttagggttgagttactt

SEQ ID NO: 360967 - DNA, 12 bp, Homo sapiens
ctacataaactg

SEQ ID NO: 360968 - DNA, 15 bp, Homo sapiens
ctacataaactgact

SEQ ID NO: 360969 - DNA, 18 bp, Homo sapiens
ctacataaactgacttta

SEQ ID NO: 360970 - DNA, 20 bp, Homo sapiens
ctacataaactgactttatc

SEQ ID NO: 360971 - DNA, 14 bp, Homo sapiens
ctacataggcaaag

SEQ ID NO: 360972 - DNA, 21 bp, Homo sapiens
ctacataggcaaagttttcca

SEQ ID NO: 360973 - DNA, 15 bp, Homo sapiens
ctacatcccagcctg

SEQ ID NO: 360974 - DNA, 15 bp, Homo sapiens
ctacatcgccctcca

SEQ ID NO: 360975 - DNA, 22 bp, Homo sapiens
ctacatgcaaggcactgtacta

SEQ ID NO: 360976 - DNA, 22 bp, Homo sapiens
ctacattaccctaatggctgct

SEQ ID NO: 360977 - DNA, 10 bp, Homo sapiens
ctacattcct

SEQ ID NO: 360978 - DNA, 14 bp, Homo sapiens
ctacattcctcagc

SEQ ID NO: 360979 - DNA, 15 bp, Homo sapiens
ctacattcctcagct

SEQ ID NO: 360980 - DNA, 16 bp, Homo sapiens
ctacattcctcagctg

SEQ ID NO: 360981 - DNA, 19 bp, Homo sapiens
ctacattcctcagctgcca

SEQ ID NO: 360982 - DNA, 22 bp, Homo sapiens
ctacattcctcagctgccaagc

SEQ ID NO: 360983 - DNA, 11 bp, Homo sapiens
ctacatttgca

SEQ ID NO: 360984 - DNA, 14 bp, Homo sapiens
ctacatttgcatgc

SEQ ID NO: 360985 - DNA, 22 bp, Homo sapiens
ctaccaagacataatgcactgg

SEQ ID NO: 360986 - DNA, 13 bp, Homo sapiens
ctaccacaaggaa

SEQ ID NO: 360987 - DNA, 14 bp, Homo sapiens
ctaccacagtgtct

SEQ ID NO: 360988 - DNA, 14 bp, Homo sapiens
ctaccactgagccc

SEQ ID NO: 360989 - DNA, 15 bp, Homo sapiens
ctaccactgagccct

SEQ ID NO: 360990 - DNA, 19 bp, Homo sapiens
ctaccaggaataatgatac

SEQ ID NO: 360991 - DNA, 19 bp, Homo sapiens
ctaccagtcgccctctgtg

SEQ ID NO: 360992 - DNA, 22 bp, Homo sapiens
ctaccagtcgccctctgtgcct

SEQ ID NO: 360993 - DNA, 11 bp, Homo sapiens
ctaccatctcc

SEQ ID NO: 360994 - DNA, 16 bp, Homo sapiens
ctacccaaatctaaat

SEQ ID NO: 360995 - DNA, 13 bp, Homo sapiens
ctacccaaccact

SEQ ID NO: 360996 - DNA, 15 bp, Homo sapiens
ctacccacagagcaa

SEQ ID NO: 360997 - DNA, 13 bp, Homo sapiens
ctacccacagggc

SEQ ID NO: 360998 - DNA, 15 bp, Homo sapiens
ctacccacagggcct

SEQ ID NO: 360999 - DNA, 18 bp, Homo sapiens
ctacccagtcatgtactg

SEQ ID NO: 361000 - DNA, 16 bp, Homo sapiens
ctacccatgagcctgc

SEQ ID NO: 361001 - DNA, 18 bp, Homo sapiens
ctacccatgagcctgccc

SEQ ID NO: 361002 - DNA, 22 bp, Homo sapiens
ctaccccagttcatctctgctg

SEQ ID NO: 361003 - DNA, 14 bp, Homo sapiens
ctacccgagcccag

SEQ ID NO: 361004 - DNA, 16 bp, Homo sapiens
ctacccgagcccagct

SEQ ID NO: 361005 - DNA, 19 bp, Homo sapiens
ctaccctcccacccccttc

SEQ ID NO: 361006 - DNA, 23 bp, Homo sapiens
ctaccctcttattgttcctctta

SEQ ID NO: 361007 - DNA, 16 bp, Homo sapiens
ctaccctcttctcagc

SEQ ID NO: 361008 - DNA, 19 bp, Homo sapiens
ctaccctcttctcagctcc

SEQ ID NO: 361009 - DNA, 16 bp, Homo sapiens
ctaccctgagtgaaca

SEQ ID NO: 361010 - DNA, 22 bp, Homo sapiens
ctacccttgttagttattttag

SEQ ID NO: 361011 - DNA, 15 bp, Homo sapiens
ctaccctttcccaaa

SEQ ID NO: 361012 - DNA, 23 bp, Homo sapiens
ctaccgagtctcttctccactgg

SEQ ID NO: 361013 - DNA, 13 bp, Homo sapiens
ctacctataaatg

SEQ ID NO: 361014 - DNA, 18 bp, Homo sapiens
ctacctataaatggactt

SEQ ID NO: 361015 - DNA, 15 bp, Homo sapiens
ctacctcaacctgta

SEQ ID NO: 361016 - DNA, 18 bp, Homo sapiens
ctacctcaacctgtaaat

SEQ ID NO: 361017 - DNA, 21 bp, Homo sapiens
ctacctcaacctgtaaattat

SEQ ID NO: 361018 - DNA, 18 bp, Homo sapiens
ctacctctaacaccacac

SEQ ID NO: 361019 - DNA, 18 bp, Homo sapiens
ctacctgaaaattcaaca

SEQ ID NO: 361020 - DNA, 23 bp, Homo sapiens
ctacctgaacacttattgctttg

SEQ ID NO: 361021 - DNA, 15 bp, Homo sapiens
ctacctgaggccagg

SEQ ID NO: 361022 - DNA, 11 bp, Homo sapiens
ctacctgcagg

SEQ ID NO: 361023 - DNA, 20 bp, Homo sapiens
ctacctggtcaacccgctgc

SEQ ID NO: 361024 - DNA, 22 bp, Homo sapiens
ctacctggtcaacccgctgctt

SEQ ID NO: 361025 - DNA, 16 bp, Homo sapiens
ctacctgttcagtgtc

SEQ ID NO: 361026 - DNA, 16 bp, Homo sapiens
ctaccttcaaagctga

SEQ ID NO: 361027 - DNA, 13 bp, Homo sapiens
ctacgccaaagtg

SEQ ID NO: 361028 - DNA, 22 bp, Homo sapiens
ctacgccaaagtgcagcccttc

SEQ ID NO: 361029 - DNA, 18 bp, Homo sapiens
ctacggagggaccaggtg

SEQ ID NO: 361030 - DNA, 13 bp, Homo sapiens
ctacgtataaata

SEQ ID NO: 361031 - DNA, 16 bp, Homo sapiens
ctacgtataaatatga

SEQ ID NO: 361032 - DNA, 19 bp, Homo sapiens
ctacgtataaatatgaaat

SEQ ID NO: 361033 - DNA, 18 bp, Homo sapiens
ctactaaagtgcctaccc

SEQ ID NO: 361034 - DNA, 13 bp, Homo sapiens
ctactaagaataa

SEQ ID NO: 361035 - DNA, 17 bp, Homo sapiens
ctactaagaataaataa

SEQ ID NO: 361036 - DNA, 21 bp, Homo sapiens
ctactaagaataaataaagaa

SEQ ID NO: 361037 - DNA, 13 bp, Homo sapiens
ctactaatgatgt

SEQ ID NO: 361038 - DNA, 12 bp, Homo sapiens
ctactaattttt

SEQ ID NO: 361039 - DNA, 21 bp, Homo sapiens
ctactaatttttagatattca

SEQ ID NO: 361040 - DNA, 18 bp, Homo sapiens
ctactacatcgccctcca

SEQ ID NO: 361041 - DNA, 16 bp, Homo sapiens
ctactaccacaaggaa

SEQ ID NO: 361042 - DNA, 17 bp, Homo sapiens
ctactacccgagcccag

SEQ ID NO: 361043 - DNA, 15 bp, Homo sapiens
ctactagatgtcttt

SEQ ID NO: 361044 - DNA, 18 bp, Homo sapiens
ctactaggagaggggggc

SEQ ID NO: 361045 - DNA, 13 bp, Homo sapiens
ctactatgtgctg

SEQ ID NO: 361046 - DNA, 14 bp, Homo sapiens
ctataaattaagaa

SEQ ID NO: 361047 - DNA, 14 bp, Homo sapiens
ctataacatttgct

SEQ ID NO: 361048 - DNA, 20 bp, Homo sapiens
ctataacatttgctgaatat

SEQ ID NO: 361049 - DNA, 16 bp, Homo sapiens
ctataacccctgcctg

SEQ ID NO: 361050 - DNA, 18 bp, Homo sapiens
ctataacccctgcctgga

SEQ ID NO: 361051 - DNA, 14 bp, Homo sapiens
ctatacatagagct

SEQ ID NO: 361052 - DNA, 14 bp, Homo sapiens
ctatacattcctga

SEQ ID NO: 361053 - DNA, 22 bp, Homo sapiens
ctatacattcctgagattctgg

SEQ ID NO: 361054 - DNA, 20 bp, Homo sapiens
ctataccccttacttagcat

SEQ ID NO: 361055 - DNA, 20 bp, Homo sapiens
ctatagaaatgtattttgaa

SEQ ID NO: 361056 - DNA, 12 bp, Homo sapiens
ctatagaataaa

SEQ ID NO: 361057 - DNA, 14 bp, Homo sapiens
ctatagagaggggg

SEQ ID NO: 361058 - DNA, 21 bp, Homo sapiens
ctatagagagggggctctcca

SEQ ID NO: 361059 - DNA, 14 bp, Homo sapiens
ctatagcagggctg

SEQ ID NO: 361060 - DNA, 19 bp, Homo sapiens
ctataggtaattaaggcag

SEQ ID NO: 361061 - DNA, 20 bp, Homo sapiens
ctataggtttttaaatggaa

SEQ ID NO: 361062 - DNA, 18 bp, Homo sapiens
ctatagtatagaatgaac

SEQ ID NO: 361063 - DNA, 21 bp, Homo sapiens
ctatagtgtataccacctgta

SEQ ID NO: 361064 - DNA, 13 bp, Homo sapiens
ctatataaaatgt

SEQ ID NO: 361065 - DNA, 19 bp, Homo sapiens
ctatataaaatgtattcaa

SEQ ID NO: 361066 - DNA, 21 bp, Homo sapiens
ctatataaaatgtattcaagc

SEQ ID NO: 361067 - DNA, 14 bp, Homo sapiens
ctatatagagatgt

SEQ ID NO: 361068 - DNA, 20 bp, Homo sapiens
ctatatagtacctttgctct

SEQ ID NO: 361069 - DNA, 17 bp, Homo sapiens
ctatatatacatataca

SEQ ID NO: 361070 - DNA, 21 bp, Homo sapiens
ctatatatacatatacacaaa

SEQ ID NO: 361071 - DNA, 13 bp, Homo sapiens
ctatatatacatg

SEQ ID NO: 361072 - DNA, 16 bp, Homo sapiens
ctatatatacatgtat

SEQ ID NO: 361073 - DNA, 19 bp, Homo sapiens
ctatatatacatgtatagt

SEQ ID NO: 361074 - DNA, 13 bp, Homo sapiens
ctatatccatgta

SEQ ID NO: 361075 - DNA, 19 bp, Homo sapiens
ctatatccatgtactgtag

SEQ ID NO: 361076 - DNA, 21 bp, Homo sapiens
ctatatccatgtactgtagtt

SEQ ID NO: 361077 - DNA, 22 bp, Homo sapiens
ctatatctgttttactgctttt

SEQ ID NO: 361078 - DNA, 23 bp, Homo sapiens
ctatatctgttttactgctttta

SEQ ID NO: 361079 - DNA, 19 bp, Homo sapiens
ctatatctttaaataaatg

SEQ ID NO: 361080 - DNA, 20 bp, Homo sapiens
ctatatctttaaataaatgt

SEQ ID NO: 361081 - DNA, 13 bp, Homo sapiens
ctatatgatttat

SEQ ID NO: 361082 - DNA, 17 bp, Homo sapiens
ctatatgatttatagtt

SEQ ID NO: 361083 - DNA, 21 bp, Homo sapiens
ctatatgcacccctggaacca

SEQ ID NO: 361084 - DNA, 16 bp, Homo sapiens
ctatatgcataaacaa

SEQ ID NO: 361085 - DNA, 18 bp, Homo sapiens
ctatatgcataaacaaca

SEQ ID NO: 361086 - DNA, 15 bp, Homo sapiens
ctatatgtatatctt

SEQ ID NO: 361087 - DNA, 18 bp, Homo sapiens
ctatattaggcctgtgtg

SEQ ID NO: 361088 - DNA, 23 bp, Homo sapiens
ctatatttattttcagtatactg

SEQ ID NO: 361089 - DNA, 13 bp, Homo sapiens
ctatatttcatat

SEQ ID NO: 361090 - DNA, 15 bp, Homo sapiens
ctatatttcatattg

SEQ ID NO: 361091 - DNA, 14 bp, Homo sapiens
ctatcacctcccct

SEQ ID NO: 361092 - DNA, 19 bp, Homo sapiens
ctatcacctcccctccttg

SEQ ID NO: 361093 - DNA, 16 bp, Homo sapiens
ctatcacctgtcatca

SEQ ID NO: 361094 - DNA, 24 bp, Homo sapiens
ctatcagtgttcttctcaaggaca

SEQ ID NO: 361095 - DNA, 18 bp, Homo sapiens
ctatccaaagaacttgat

SEQ ID NO: 361096 - DNA, 14 bp, Homo sapiens
ctatccatcctgcg

SEQ ID NO: 361097 - DNA, 15 bp, Homo sapiens
ctatccatgcaccaa

SEQ ID NO: 361098 - DNA, 15 bp, Homo sapiens
ctatccccaagctgg

SEQ ID NO: 361099 - DNA, 13 bp, Homo sapiens
ctatcccttctca

SEQ ID NO: 361100 - DNA, 20 bp, Homo sapiens
ctatccggacagagcacgtt

SEQ ID NO: 361101 - DNA, 19 bp, Homo sapiens
ctatcctgaaaattctgta

SEQ ID NO: 361102 - DNA, 13 bp, Homo sapiens
ctatcctggcttt

SEQ ID NO: 361103 - DNA, 14 bp, Homo sapiens
ctatcctggctttg

SEQ ID NO: 361104 - DNA, 19 bp, Homo sapiens
ctatcctggctttgcccaa

SEQ ID NO: 361105 - DNA, 18 bp, Homo sapiens
ctatcctgttaacactgt

SEQ ID NO: 361106 - DNA, 20 bp, Homo sapiens
ctatccttggagagcagctg

SEQ ID NO: 361107 - DNA, 11 bp, Homo sapiens
ctatccttggc

SEQ ID NO: 361108 - DNA, 20 bp, Homo sapiens
ctatcgagtttgcaatgtca

SEQ ID NO: 361109 - DNA, 17 bp, Homo sapiens
ctatcgatctggaaaga

SEQ ID NO: 361110 - DNA, 16 bp, Homo sapiens
ctatctaaccctccca

SEQ ID NO: 361111 - DNA, 17 bp, Homo sapiens
ctatctactctcctcat

SEQ ID NO: 361112 - DNA, 22 bp, Homo sapiens
ctatctaggtattttcttcaaa

SEQ ID NO: 361113 - DNA, 15 bp, Homo sapiens
ctatctgcaaatagt

SEQ ID NO: 361114 - DNA, 15 bp, Homo sapiens
ctatctgcaatgttt

SEQ ID NO: 361115 - DNA, 18 bp, Homo sapiens
ctatctgcatttataaat

SEQ ID NO: 361116 - DNA, 12 bp, Homo sapiens
ctatctgggcct

SEQ ID NO: 361117 - DNA, 14 bp, Homo sapiens
ctatctgtgttttg

SEQ ID NO: 361118 - DNA, 20 bp, Homo sapiens
ctatcttgcatctacctgct

SEQ ID NO: 361119 - DNA, 17 bp, Homo sapiens
ctatgagaacaagtcac

SEQ ID NO: 361120 - DNA, 22 bp, Homo sapiens
ctatgagatggccatgctcaac

SEQ ID NO: 361121 - DNA, 23 bp, Homo sapiens
ctatgagcatctctgtttggtaa

SEQ ID NO: 361122 - DNA, 17 bp, Homo sapiens
ctatgcaaaatgtctgt

SEQ ID NO: 361123 - DNA, 15 bp, Homo sapiens
ctatgcacaccaaat

SEQ ID NO: 361124 - DNA, 18 bp, Homo sapiens
ctatgcacagattaaact

SEQ ID NO: 361125 - DNA, 16 bp, Homo sapiens
ctatgcacctataaat

SEQ ID NO: 361126 - DNA, 19 bp, Homo sapiens
ctatgcattttaaagttaa

SEQ ID NO: 361127 - DNA, 15 bp, Homo sapiens
ctatgccacctgcag

SEQ ID NO: 361128 - DNA, 15 bp, Homo sapiens
ctatgcccaggtacc

SEQ ID NO: 361129 - DNA, 17 bp, Homo sapiens
ctatgcctgtatttcca

SEQ ID NO: 361130 - DNA, 23 bp, Homo sapiens
ctatgctggggtacacagtgaga

SEQ ID NO: 361131 - DNA, 16 bp, Homo sapiens
ctatggattcacttct

SEQ ID NO: 361132 - DNA, 20 bp, Homo sapiens
ctatggattcacttctattt

SEQ ID NO: 361133 - DNA, 15 bp, Homo sapiens
ctatggctgtatttt

SEQ ID NO: 361134 - DNA, 16 bp, Homo sapiens
ctatgggaagctctgt

SEQ ID NO: 361135 - DNA, 15 bp, Homo sapiens
ctatgggagcctcag

SEQ ID NO: 361136 - DNA, 22 bp, Homo sapiens
ctatggggagaggaactccttg

SEQ ID NO: 361137 - DNA, 15 bp, Homo sapiens
ctatggggatggtcc

SEQ ID NO: 361138 - DNA, 15 bp, Homo sapiens
ctatggtgaggtgtg

SEQ ID NO: 361139 - DNA, 13 bp, Homo sapiens
ctatgtaaattat

SEQ ID NO: 361140 - DNA, 14 bp, Homo sapiens
ctatgtaaattatt

SEQ ID NO: 361141 - DNA, 15 bp, Homo sapiens
ctatgtaaattattg

SEQ ID NO: 361142 - DNA, 20 bp, Homo sapiens
ctatgtaaattattgtaaac

SEQ ID NO: 361143 - DNA, 15 bp, Homo sapiens
ctatgtagaactgtt

SEQ ID NO: 361144 - DNA, 18 bp, Homo sapiens
ctatgtattaccagcccc

SEQ ID NO: 361145 - DNA, 21 bp, Homo sapiens
ctatgtcatttctactttgac

SEQ ID NO: 361146 - DNA, 18 bp, Homo sapiens
ctatgtccaacagagtgg

SEQ ID NO: 361147 - DNA, 20 bp, Homo sapiens
ctatgtccaacagagtggac

SEQ ID NO: 361148 - DNA, 13 bp, Homo sapiens
ctatgtcccagcc

SEQ ID NO: 361149 - DNA, 19 bp, Homo sapiens
ctatgtcccagcccctggt

SEQ ID NO: 361150 - DNA, 20 bp, Homo sapiens
ctatgtcccagcccctggta

SEQ ID NO: 361151 - DNA, 15 bp, Homo sapiens
ctatgtcctaaggac

SEQ ID NO: 361152 - DNA, 21 bp, Homo sapiens
ctatgtcctaaggacacacta

SEQ ID NO: 361153 - DNA, 13 bp, Homo sapiens
ctatgtctgtgat

SEQ ID NO: 361154 - DNA, 14 bp, Homo sapiens
ctatgtgagaccat

SEQ ID NO: 361155 - DNA, 17 bp, Homo sapiens
ctatgtgcgagacattg

SEQ ID NO: 361156 - DNA, 16 bp, Homo sapiens
ctatgtttctcagact

SEQ ID NO: 361157 - DNA, 11 bp, Homo sapiens
ctatgtttgct

SEQ ID NO: 361158 - DNA, 13 bp, Homo sapiens
ctattaagaaact

SEQ ID NO: 361159 - DNA, 14 bp, Homo sapiens
ctattaatcttcag

SEQ ID NO: 361160 - DNA, 19 bp, Homo sapiens
ctattactctgacataaac

SEQ ID NO: 361161 - DNA, 14 bp, Homo sapiens
ctattactgatgtg

SEQ ID NO: 361162 - DNA, 21 bp, Homo sapiens
ctattagactttagaaataaa

SEQ ID NO: 361163 - DNA, 22 bp, Homo sapiens
ctattagactttagaaataaat

SEQ ID NO: 361164 - DNA, 18 bp, Homo sapiens
ctattaggctataagaag

SEQ ID NO: 361165 - DNA, 21 bp, Homo sapiens
ctattatttttttaaagaaaa

SEQ ID NO: 361166 - DNA, 13 bp, Homo sapiens
ctattcacacaca

SEQ ID NO: 361167 - DNA, 15 bp, Homo sapiens
ctattcacacacaca

SEQ ID NO: 361168 - DNA, 20 bp, Homo sapiens
ctattcagaatcaaaccttt

SEQ ID NO: 361169 - DNA, 15 bp, Homo sapiens
ctattcagacaagca

SEQ ID NO: 361170 - DNA, 16 bp, Homo sapiens
ctattcccactttcat

SEQ ID NO: 361171 - DNA, 18 bp, Homo sapiens
ctattcccaggcagggag

SEQ ID NO: 361172 - DNA, 16 bp, Homo sapiens
ctattcccatcgctgg

SEQ ID NO: 361173 - DNA, 23 bp, Homo sapiens
ctattccctaactctcgggacct

SEQ ID NO: 361174 - DNA, 17 bp, Homo sapiens
ctattccctttgacttc

SEQ ID NO: 361175 - DNA, 21 bp, Homo sapiens
ctattccctttgacttcagct

SEQ ID NO: 361176 - DNA, 14 bp, Homo sapiens
ctcagctctctggg

SEQ ID NO: 361177 - DNA, 19 bp, Homo sapiens
ctcagctctggctcacaga

SEQ ID NO: 361178 - DNA, 20 bp, Homo sapiens
ctcagctgcacattcctggc

SEQ ID NO: 361179 - DNA, 12 bp, Homo sapiens
ctcagctgccaa

SEQ ID NO: 361180 - DNA, 16 bp, Homo sapiens
ctcagctgccaagcac

SEQ ID NO: 361181 - DNA, 16 bp, Homo sapiens
ctcagctgcctcactt

SEQ ID NO: 361182 - DNA, 16 bp, Homo sapiens
ctcagctggccgggtt

SEQ ID NO: 361183 - DNA, 13 bp, Homo sapiens
ctcagctggcgga

SEQ ID NO: 361184 - DNA, 18 bp, Homo sapiens
ctcagctggcggaacctg

SEQ ID NO: 361185 - DNA, 22 bp, Homo sapiens
ctcagctggcggaacctggctg

SEQ ID NO: 361186 - DNA, 19 bp, Homo sapiens
ctcagctgttcagattgga

SEQ ID NO: 361187 - DNA, 13 bp, Homo sapiens
ctcaggacccagg

SEQ ID NO: 361188 - DNA, 14 bp, Homo sapiens
ctcaggacccaggc

SEQ ID NO: 361189 - DNA, 12 bp, Homo sapiens
ctcaggacccca

SEQ ID NO: 361190 - DNA, 16 bp, Homo sapiens
ctcaggaccccagagg

SEQ ID NO: 361191 - DNA, 18 bp, Homo sapiens
ctcaggaccccagaggga

SEQ ID NO: 361192 - DNA, 19 bp, Homo sapiens
ctcaggagaaggcctgccc

SEQ ID NO: 361193 - DNA, 17 bp, Homo sapiens
ctcaggagcacaggcag

SEQ ID NO: 361194 - DNA, 18 bp, Homo sapiens
ctcaggagcacaggcagc

SEQ ID NO: 361195 - DNA, 22 bp, Homo sapiens
ctcaggagcacaggcagctgga

SEQ ID NO: 361196 - DNA, 12 bp, Homo sapiens
ctcaggaggagg

SEQ ID NO: 361197 - DNA, 17 bp, Homo sapiens
ctcaggaggtgtctcct

SEQ ID NO: 361198 - DNA, 16 bp, Homo sapiens
ctcaggcataggcctg

SEQ ID NO: 361199 - DNA, 20 bp, Homo sapiens
ctcaggcataggcctgggtg

SEQ ID NO: 361200 - DNA, 23 bp, Homo sapiens
ctcaggcataggcctgggtgctg

SEQ ID NO: 361201 - DNA, 15 bp, Homo sapiens
ctcaggcatgcctgt

SEQ ID NO: 361202 - DNA, 16 bp, Homo sapiens
ctcaggcatgcctgtg

SEQ ID NO: 361203 - DNA, 16 bp, Homo sapiens
ctcaggccacctgccc

SEQ ID NO: 361204 - DNA, 22 bp, Homo sapiens
ctcaggcccacattgcccacac

SEQ ID NO: 361205 - DNA, 17 bp, Homo sapiens
ctcaggcctcacctggc

SEQ ID NO: 361206 - DNA, 19 bp, Homo sapiens
ctcaggcctcacctggctt

SEQ ID NO: 361207 - DNA, 21 bp, Homo sapiens
ctcaggcctgccaatgccaca

SEQ ID NO: 361208 - DNA, 16 bp, Homo sapiens
ctcaggcgcagcccta

SEQ ID NO: 361209 - DNA, 11 bp, Homo sapiens
ctcaggctgct

SEQ ID NO: 361210 - DNA, 15 bp, Homo sapiens
ctcaggctgctggag

SEQ ID NO: 361211 - DNA, 12 bp, Homo sapiens
ctcagggctgga

SEQ ID NO: 361212 - DNA, 13 bp, Homo sapiens
ctcagggcttcct

SEQ ID NO: 361213 - DNA, 14 bp, Homo sapiens
ctcaggggcagctc

SEQ ID NO: 361214 - DNA, 17 bp, Homo sapiens
ctcaggggcgtgtggct

SEQ ID NO: 361215 - DNA, 20 bp, Homo sapiens
ctcagggggtcagcagagtt

SEQ ID NO: 361216 - DNA, 17 bp, Homo sapiens
ctcagggtccctcagga

SEQ ID NO: 361217 - DNA, 20 bp, Homo sapiens
ctcagggtccctcaggacca

SEQ ID NO: 361218 - DNA, 22 bp, Homo sapiens
ctcagggtgctccctcctcagt

SEQ ID NO: 361219 - DNA, 13 bp, Homo sapiens
ctcagggtggggg

SEQ ID NO: 361220 - DNA, 15 bp, Homo sapiens
ctcaggtagtactgg

SEQ ID NO: 361221 - DNA, 18 bp, Homo sapiens
ctcaggtattgattgaaa

SEQ ID NO: 361222 - DNA, 14 bp, Homo sapiens
ctcaggtgaataac

SEQ ID NO: 361223 - DNA, 14 bp, Homo sapiens
ctcaggtgatccac

SEQ ID NO: 361224 - DNA, 14 bp, Homo sapiens
ctcaggtgccactc

SEQ ID NO: 361225 - DNA, 16 bp, Homo sapiens
ctcaggtgccactccc

SEQ ID NO: 361226 - DNA, 17 bp, Homo sapiens
ctcaggtgccactccct

SEQ ID NO: 361227 - DNA, 24 bp, Homo sapiens
ctcaggtggggagtccagggctcc

SEQ ID NO: 361228 - DNA, 12 bp, Homo sapiens
ctcaggttccag

SEQ ID NO: 361229 - DNA, 13 bp, Homo sapiens
ctcaggttccaga

SEQ ID NO: 361230 - DNA, 14 bp, Homo sapiens
ctcaggttgtctga

SEQ ID NO: 361231 - DNA, 20 bp, Homo sapiens
ctcaggtttgcctgagggcg

SEQ ID NO: 361232 - DNA, 21 bp, Homo sapiens
ctcagtattgagacactgtca

SEQ ID NO: 361233 - DNA, 20 bp, Homo sapiens
ctcagtcagttcccggagca

SEQ ID NO: 361234 - DNA, 22 bp, Homo sapiens
ctcagtcagttcccggagcaca

SEQ ID NO: 361235 - DNA, 20 bp, Homo sapiens
ctcagtccctccctcctggc

SEQ ID NO: 361236 - DNA, 21 bp, Homo sapiens
ctcagtccctccctcctggct

SEQ ID NO: 361237 - DNA, 13 bp, Homo sapiens
ctcagtctccctt

SEQ ID NO: 361238 - DNA, 13 bp, Homo sapiens
ctcagtcttccct

SEQ ID NO: 361239 - DNA, 22 bp, Homo sapiens
ctcagtcttccctagggctggg

SEQ ID NO: 361240 - DNA, 23 bp, Homo sapiens
ctcagtcttccctagggctgggt

SEQ ID NO: 361241 - DNA, 18 bp, Homo sapiens
ctcagtgccacctatgcc

SEQ ID NO: 361242 - DNA, 21 bp, Homo sapiens
ctcagtgccacttgacattcc

SEQ ID NO: 361243 - DNA, 20 bp, Homo sapiens
ctcagtggactttccacccc

SEQ ID NO: 361244 - DNA, 22 bp, Homo sapiens
ctcagtggactttccaccccct

SEQ ID NO: 361245 - DNA, 12 bp, Homo sapiens
ctcagtgtattt

SEQ ID NO: 361246 - DNA, 13 bp, Homo sapiens
ctcagtgtgaagc

SEQ ID NO: 361247 - DNA, 19 bp, Homo sapiens
ctcagtgtgaagcctgtcg

SEQ ID NO: 361248 - DNA, 15 bp, Homo sapiens
ctcagttctctccct

SEQ ID NO: 361249 - DNA, 20 bp, Homo sapiens
ctcagttctctcccttcctc

SEQ ID NO: 361250 - DNA, 23 bp, Homo sapiens
ctcagttctctcccttcctctct

SEQ ID NO: 361251 - DNA, 16 bp, Homo sapiens
ctcagttgtacttttt

SEQ ID NO: 361252 - DNA, 14 bp, Homo sapiens
ctcagtttctctgg

SEQ ID NO: 361253 - DNA, 13 bp, Homo sapiens
ctcagtttgtcag

SEQ ID NO: 361254 - DNA, 21 bp, Homo sapiens
ctcataaaaagcctgcaattt

SEQ ID NO: 361255 - DNA, 20 bp, Homo sapiens
ctcataaacagagtccctcc

SEQ ID NO: 361256 - DNA, 14 bp, Homo sapiens
ctcatactgtcata

SEQ ID NO: 361257 - DNA, 16 bp, Homo sapiens
ctcatagcattaacta

SEQ ID NO: 361258 - DNA, 20 bp, Homo sapiens
ctcatagccccggtgtgcgg

SEQ ID NO: 361259 - DNA, 13 bp, Homo sapiens
ctcatatggccca

SEQ ID NO: 361260 - DNA, 18 bp, Homo sapiens
ctcatatggcccagtgtc

SEQ ID NO: 361261 - DNA, 20 bp, Homo sapiens
ctcatattcctgcagcctgg

SEQ ID NO: 361262 - DNA, 12 bp, Homo sapiens
ctcatattttgt

SEQ ID NO: 361263 - DNA, 13 bp, Homo sapiens
ctcatattttgta

SEQ ID NO: 361264 - DNA, 21 bp, Homo sapiens
ctcatattttgtatatatctg

SEQ ID NO: 361265 - DNA, 18 bp, Homo sapiens
ctcatcacatttgtaaat

SEQ ID NO: 361266 - DNA, 16 bp, Homo sapiens
ctcatcaggatgaacc

SEQ ID NO: 361267 - DNA, 20 bp, Homo sapiens
ctcatcaggatgaacccagg

SEQ ID NO: 361268 - DNA, 15 bp, Homo sapiens
ctcatcataaaataa

SEQ ID NO: 361269 - DNA, 17 bp, Homo sapiens
ctcatccacagaggcca

SEQ ID NO: 361270 - DNA, 20 bp, Homo sapiens
ctcatccacagaggccaggc

SEQ ID NO: 361271 - DNA, 15 bp, Homo sapiens
ctcatccaggtcctt

SEQ ID NO: 361272 - DNA, 18 bp, Homo sapiens
ctcatccaggtcctttcc

SEQ ID NO: 361273 - DNA, 23 bp, Homo sapiens
ctcatccccaggggtcccagcca

SEQ ID NO: 361274 - DNA, 17 bp, Homo sapiens
ctcatcccctcgtcctg

SEQ ID NO: 361275 - DNA, 22 bp, Homo sapiens
ctcatcccctcgtcctgtccca

SEQ ID NO: 361276 - DNA, 16 bp, Homo sapiens
ctcatcctgcttctct

SEQ ID NO: 361277 - DNA, 22 bp, Homo sapiens
ctcatcctgcttctcttttcct

SEQ ID NO: 361278 - DNA, 21 bp, Homo sapiens
ctcatctccaaggatcctctc

SEQ ID NO: 361279 - DNA, 22 bp, Homo sapiens
ctcatctctaacagctcaggat

SEQ ID NO: 361280 - DNA, 24 bp, Homo sapiens
ctcatctctaacagctcaggatct

SEQ ID NO: 361281 - DNA, 18 bp, Homo sapiens
ctcatcttagtgcctgag

SEQ ID NO: 361282 - DNA, 20 bp, Homo sapiens
ctcatcttgaagggcccagg

SEQ ID NO: 361283 - DNA, 16 bp, Homo sapiens
ctcatgaatgtaaatt

SEQ ID NO: 361284 - DNA, 21 bp, Homo sapiens
ctcatgaatgtaaatttgtac

SEQ ID NO: 361285 - DNA, 22 bp, Homo sapiens
ctcatgaggggcccgagcagaa

SEQ ID NO: 361286 - DNA, 12 bp, Homo sapiens
ctcatgccacac

SEQ ID NO: 361287 - DNA, 17 bp, Homo sapiens
ctcatgccacaccttct

SEQ ID NO: 361288 - DNA, 16 bp, Homo sapiens
ctcatgccagcagcac

SEQ ID NO: 361289 - DNA, 21 bp, Homo sapiens
ctcatgccattccgaccttca

SEQ ID NO: 361290 - DNA, 23 bp, Homo sapiens
ctcatgcctggcccccctccagg

SEQ ID NO: 361291 - DNA, 21 bp, Homo sapiens
ctcatgcggcccagccatggg

SEQ ID NO: 361292 - DNA, 19 bp, Homo sapiens
ctcatggcgtaatgggcct

SEQ ID NO: 361293 - DNA, 22 bp, Homo sapiens
ctcatggcgtaatgggcctgcc

SEQ ID NO: 361294 - DNA, 19 bp, Homo sapiens
ctcatgggagtcagggagc

SEQ ID NO: 361295 - DNA, 22 bp, Homo sapiens
ctcatgggagtcagggagccct

SEQ ID NO: 361296 - DNA, 17 bp, Homo sapiens
ctcatgggcccctctga

SEQ ID NO: 361297 - DNA, 23 bp, Homo sapiens
ctcatggtgaggcttaacaatgt

SEQ ID NO: 361298 - DNA, 17 bp, Homo sapiens
ctcatgtcatttctcat

SEQ ID NO: 361299 - DNA, 12 bp, Homo sapiens
ctcatgtgcttt

SEQ ID NO: 361300 - DNA, 15 bp, Homo sapiens
ctcatgtgctttgta

SEQ ID NO: 361301 - DNA, 13 bp, Homo sapiens
ctcatgtttgtgc

SEQ ID NO: 361302 - DNA, 20 bp, Homo sapiens
ctcattaaatggtgatttct

SEQ ID NO: 361303 - DNA, 19 bp, Homo sapiens
ctcattacagatttagttt

SEQ ID NO: 361304 - DNA, 22 bp, Homo sapiens
ctcattacagctcattcgctcc

SEQ ID NO: 361305 - DNA, 13 bp, Homo sapiens
ctcattagctctc

SEQ ID NO: 361306 - DNA, 22 bp, Homo sapiens
ctcccatctccttcccccagcc

SEQ ID NO: 361307 - DNA, 16 bp, Homo sapiens
ctcccatgaccatact

SEQ ID NO: 361308 - DNA, 21 bp, Homo sapiens
ctcccatgttgcatgcctatg

SEQ ID NO: 361309 - DNA, 22 bp, Homo sapiens
ctccccaactccttcctctttg

SEQ ID NO: 361310 - DNA, 17 bp, Homo sapiens
ctccccaatgctctcct

SEQ ID NO: 361311 - DNA, 14 bp, Homo sapiens
ctccccacagtcct

SEQ ID NO: 361312 - DNA, 15 bp, Homo sapiens
ctccccaccagtctc

SEQ ID NO: 361313 - DNA, 20 bp, Homo sapiens
ctccccaccagtctcaccca

SEQ ID NO: 361314 - DNA, 20 bp, Homo sapiens
ctccccaccccaaccactct

SEQ ID NO: 361315 - DNA, 16 bp, Homo sapiens
ctccccacgagtcacc

SEQ ID NO: 361316 - DNA, 12 bp, Homo sapiens
ctccccactgaa

SEQ ID NO: 361317 - DNA, 15 bp, Homo sapiens
ctccccagcaggtgg

SEQ ID NO: 361318 - DNA, 14 bp, Homo sapiens
ctccccagccagcc

SEQ ID NO: 361319 - DNA, 17 bp, Homo sapiens
ctccccagccagccctt

SEQ ID NO: 361320 - DNA, 21 bp, Homo sapiens
ctccccaggccgtggctgccc

SEQ ID NO: 361321 - DNA, 11 bp, Homo sapiens
ctccccagtgc

SEQ ID NO: 361322 - DNA, 14 bp, Homo sapiens
ctccccagtgcctg

SEQ ID NO: 361323 - DNA, 17 bp, Homo sapiens
ctccccagtgcctgcca

SEQ ID NO: 361324 - DNA, 12 bp, Homo sapiens
ctccccagtgtt

SEQ ID NO: 361325 - DNA, 20 bp, Homo sapiens
ctccccatatataaattatt

SEQ ID NO: 361326 - DNA, 20 bp, Homo sapiens
ctccccatgtgcctgcacca

SEQ ID NO: 361327 - DNA, 12 bp, Homo sapiens
ctcccccaaagc

SEQ ID NO: 361328 - DNA, 21 bp, Homo sapiens
ctcccccaacccccaccccac

SEQ ID NO: 361329 - DNA, 23 bp, Homo sapiens
ctcccccaacccccaccccacac

SEQ ID NO: 361330 - DNA, 22 bp, Homo sapiens
ctcccccacggccgtccctgac

SEQ ID NO: 361331 - DNA, 13 bp, Homo sapiens
ctcccccagagcc

SEQ ID NO: 361332 - DNA, 15 bp, Homo sapiens
ctcccccagccagga

SEQ ID NO: 361333 - DNA, 11 bp, Homo sapiens
ctcccccaggc

SEQ ID NO: 361334 - DNA, 17 bp, Homo sapiens
ctcccccaggctgcgcc

SEQ ID NO: 361335 - DNA, 15 bp, Homo sapiens
ctcccccatcctccc

SEQ ID NO: 361336 - DNA, 17 bp, Homo sapiens
ctcccccatcctcccct

SEQ ID NO: 361337 - DNA, 14 bp, Homo sapiens
ctccccctcttggt

SEQ ID NO: 361338 - DNA, 13 bp, Homo sapiens
ctccccctgccag

SEQ ID NO: 361339 - DNA, 14 bp, Homo sapiens
ctccccctgccagc

SEQ ID NO: 361340 - DNA, 21 bp, Homo sapiens
ctccccgcccgccctcctctg

SEQ ID NO: 361341 - DNA, 22 bp, Homo sapiens
ctccccgcccgccctcctctgc

SEQ ID NO: 361342 - DNA, 20 bp, Homo sapiens
ctccccgcctccactctagt

SEQ ID NO: 361343 - DNA, 13 bp, Homo sapiens
ctccccggcccta

SEQ ID NO: 361344 - DNA, 14 bp, Homo sapiens
ctccccggctcgag

SEQ ID NO: 361345 - DNA, 20 bp, Homo sapiens
ctccccgtagccactctctg

SEQ ID NO: 361346 - DNA, 20 bp, Homo sapiens
ctcccctaacctcttttctg

SEQ ID NO: 361347 - DNA, 16 bp, Homo sapiens
ctcccctcacccgctg

SEQ ID NO: 361348 - DNA, 23 bp, Homo sapiens
ctcccctcacccgctgcccagcc

SEQ ID NO: 361349 - DNA, 14 bp, Homo sapiens
ctcccctccagacc

SEQ ID NO: 361350 - DNA, 14 bp, Homo sapiens
ctcccctcccagtc

SEQ ID NO: 361351 - DNA, 22 bp, Homo sapiens
ctcccctcccagtcctccagac

SEQ ID NO: 361352 - DNA, 13 bp, Homo sapiens
ctcccctcccctg

SEQ ID NO: 361353 - DNA, 15 bp, Homo sapiens
ctcccctcccctggg

SEQ ID NO: 361354 - DNA, 23 bp, Homo sapiens
ctcccctcctcttcccttagcct

SEQ ID NO: 361355 - DNA, 16 bp, Homo sapiens
ctcccctccttgcctc

SEQ ID NO: 361356 - DNA, 22 bp, Homo sapiens
ctcccctccttgcctcctgtgt

SEQ ID NO: 361357 - DNA, 16 bp, Homo sapiens
ctcccctcctttccca

SEQ ID NO: 361358 - DNA, 10 bp, Homo sapiens
ctcccctcta

SEQ ID NO: 361359 - DNA, 14 bp, Homo sapiens
ctcccctctcctga

SEQ ID NO: 361360 - DNA, 12 bp, Homo sapiens
ctcccctgatcc

SEQ ID NO: 361361 - DNA, 11 bp, Homo sapiens
ctcccctgccc

SEQ ID NO: 361362 - DNA, 12 bp, Homo sapiens
ctcccctgcccc

SEQ ID NO: 361363 - DNA, 16 bp, Homo sapiens
ctcccctgccctgctg

SEQ ID NO: 361364 - DNA, 23 bp, Homo sapiens
ctcccctggagccagcagggctg

SEQ ID NO: 361365 - DNA, 13 bp, Homo sapiens
ctcccctggtctc

SEQ ID NO: 361366 - DNA, 11 bp, Homo sapiens
ctccccttccc

SEQ ID NO: 361367 - DNA, 16 bp, Homo sapiens
ctcccctttcccatca

SEQ ID NO: 361368 - DNA, 15 bp, Homo sapiens
ctcccctttgaccct

SEQ ID NO: 361369 - DNA, 21 bp, Homo sapiens
ctcccgcatgctgcctgcctc

SEQ ID NO: 361370 - DNA, 17 bp, Homo sapiens
ctcccggcatgggaaag

SEQ ID NO: 361371 - DNA, 19 bp, Homo sapiens
ctcccggctttgcagggag

SEQ ID NO: 361372 - DNA, 23 bp, Homo sapiens
ctcccggctttgcagggagacca

SEQ ID NO: 361373 - DNA, 21 bp, Homo sapiens
ctcccgggccacgccccagcc

SEQ ID NO: 361374 - DNA, 17 bp, Homo sapiens
ctcccggggcagggcag

SEQ ID NO: 361375 - DNA, 18 bp, Homo sapiens
ctcccggggcagggcagc

SEQ ID NO: 361376 - DNA, 21 bp, Homo sapiens
ctcccggtgcccaagaataga

SEQ ID NO: 361377 - DNA, 22 bp, Homo sapiens
ctcccgtccgtccgcccgccca

SEQ ID NO: 361378 - DNA, 20 bp, Homo sapiens
ctccctaaagccctcttcag

SEQ ID NO: 361379 - DNA, 16 bp, Homo sapiens
ctccctacctcaacct

SEQ ID NO: 361380 - DNA, 17 bp, Homo sapiens
ctccctacctcaacctg

SEQ ID NO: 361381 - DNA, 16 bp, Homo sapiens
ctccctagttacccac

SEQ ID NO: 361382 - DNA, 19 bp, Homo sapiens
ctccctagttacccaccct

SEQ ID NO: 361383 - DNA, 22 bp, Homo sapiens
ctccctatatgcacccctggaa

SEQ ID NO: 361384 - DNA, 16 bp, Homo sapiens
ctccctatcagttcta

SEQ ID NO: 361385 - DNA, 23 bp, Homo sapiens
ctccctatctaaccctcccatgg

SEQ ID NO: 361386 - DNA, 13 bp, Homo sapiens
ctccctcagcccc

SEQ ID NO: 361387 - DNA, 18 bp, Homo sapiens
ctccctcagctctctggg

SEQ ID NO: 361388 - DNA, 10 bp, Homo sapiens
ctccctccac

SEQ ID NO: 361389 - DNA, 14 bp, Homo sapiens
ctccctccactcct

SEQ ID NO: 361390 - DNA, 15 bp, Homo sapiens
ctccctccatggcag

SEQ ID NO: 361391 - DNA, 14 bp, Homo sapiens
ctccctccccaccc

SEQ ID NO: 361392 - DNA, 15 bp, Homo sapiens
ctccctccccagtgt

SEQ ID NO: 361393 - DNA, 17 bp, Homo sapiens
ctccctcccctcacccg

SEQ ID NO: 361394 - DNA, 15 bp, Homo sapiens
ctccctcccctgccc

SEQ ID NO: 361395 - DNA, 18 bp, Homo sapiens
ctccctcccctgccctcg

SEQ ID NO: 361396 - DNA, 13 bp, Homo sapiens
ctccctcccgcac

SEQ ID NO: 361397 - DNA, 13 bp, Homo sapiens
ctccctccctcca

SEQ ID NO: 361398 - DNA, 14 bp, Homo sapiens
ctccctcctcacct

SEQ ID NO: 361399 - DNA, 14 bp, Homo sapiens
ctccctcctcccat

SEQ ID NO: 361400 - DNA, 11 bp, Homo sapiens
ctccctcctcg

SEQ ID NO: 361401 - DNA, 21 bp, Homo sapiens
ctccctcctgatgtttttccc

SEQ ID NO: 361402 - DNA, 14 bp, Homo sapiens
ctccctcctgcagg

SEQ ID NO: 361403 - DNA, 17 bp, Homo sapiens
ctccctcctgcaggctg

SEQ ID NO: 361404 - DNA, 19 bp, Homo sapiens
ctccctcctggagcatccc

SEQ ID NO: 361405 - DNA, 17 bp, Homo sapiens
ctccctcctggctcaca

SEQ ID NO: 361406 - DNA, 21 bp, Homo sapiens
ctccctcctggctcacagcca

SEQ ID NO: 361407 - DNA, 23 bp, Homo sapiens
ctccctcctggctcacagccacc

SEQ ID NO: 361408 - DNA, 22 bp, Homo sapiens
ctccctcgaacccacactgcaa

SEQ ID NO: 361409 - DNA, 12 bp, Homo sapiens
ctccctcgctgt

SEQ ID NO: 361410 - DNA, 14 bp, Homo sapiens
ctccctcgctgtat

SEQ ID NO: 361411 - DNA, 12 bp, Homo sapiens
ctccctctccca

SEQ ID NO: 361412 - DNA, 17 bp, Homo sapiens
ctccctctcccaggccc

SEQ ID NO: 361413 - DNA, 22 bp, Homo sapiens
ctccctctcctgtagccactgg

SEQ ID NO: 361414 - DNA, 15 bp, Homo sapiens
ctccctctctcttct

SEQ ID NO: 361415 - DNA, 18 bp, Homo sapiens
ctccctctcttccgggag

SEQ ID NO: 361416 - DNA, 20 bp, Homo sapiens
ctccctctcttccgggagct

SEQ ID NO: 361417 - DNA, 13 bp, Homo sapiens
ctccctctgcccc

SEQ ID NO: 361418 - DNA, 22 bp, Homo sapiens
ctccctctgccccaagcagcca

SEQ ID NO: 361419 - DNA, 23 bp, Homo sapiens
ctccctctgccccaagcagccag

SEQ ID NO: 361420 - DNA, 16 bp, Homo sapiens
ctccctctgctctcat

SEQ ID NO: 361421 - DNA, 21 bp, Homo sapiens
ctccctgaaaatgtttttctg

SEQ ID NO: 361422 - DNA, 13 bp, Homo sapiens
ctccctgagcctg

SEQ ID NO: 361423 - DNA, 15 bp, Homo sapiens
ctccctgagcctgcc

SEQ ID NO: 361424 - DNA, 20 bp, Homo sapiens
ctccctgagcctgccccagc

SEQ ID NO: 361425 - DNA, 17 bp, Homo sapiens
ctccctgagctttgggg

SEQ ID NO: 361426 - DNA, 20 bp, Homo sapiens
ctccctgcacaagccagggt

SEQ ID NO: 361427 - DNA, 12 bp, Homo sapiens
ctccctgcaggg

SEQ ID NO: 361428 - DNA, 11 bp, Homo sapiens
ctccctgccac

SEQ ID NO: 361429 - DNA, 13 bp, Homo sapiens
ctccctgcccctc

SEQ ID NO: 361430 - DNA, 21 bp, Homo sapiens
ctccctgcccctcccttcaac

SEQ ID NO: 361431 - DNA, 10 bp, Homo sapiens
ctccctgcct

SEQ ID NO: 361432 - DNA, 20 bp, Homo sapiens
ctccctgcctcacatctccc

SEQ ID NO: 361433 - DNA, 12 bp, Homo sapiens
ctccctgctcag

SEQ ID NO: 361434 - DNA, 13 bp, Homo sapiens
ctccctgcttcat

SEQ ID NO: 361435 - DNA, 14 bp, Homo sapiens
ctccctgcttcata

SEQ ID NO: 361436 - DNA, 19 bp, Homo sapiens
ctccctggaaagcaggcaa

SEQ ID NO: 361437 - DNA, 16 bp, Homo sapiens
ctcgagagggctgagc

SEQ ID NO: 361438 - DNA, 18 bp, Homo sapiens
ctcgagagggctgagccc

SEQ ID NO: 361439 - DNA, 20 bp, Homo sapiens
ctcgagagggctgagcccct

SEQ ID NO: 361440 - DNA, 23 bp, Homo sapiens
ctcgaggcaccggcgctgcaggt

SEQ ID NO: 361441 - DNA, 16 bp, Homo sapiens
ctcgagttacagacaa

SEQ ID NO: 361442 - DNA, 22 bp, Homo sapiens
ctcgatgcaagtgtttctgttc

SEQ ID NO: 361443 - DNA, 13 bp, Homo sapiens
ctcgatgcactga

SEQ ID NO: 361444 - DNA, 15 bp, Homo sapiens
ctcgatgcctttgct

SEQ ID NO: 361445 - DNA, 21 bp, Homo sapiens
ctcgcaaaatgatgtgaaagg

SEQ ID NO: 361446 - DNA, 17 bp, Homo sapiens
ctcgcagcacccacagc

SEQ ID NO: 361447 - DNA, 20 bp, Homo sapiens
ctcgcagcacccacagcacc

SEQ ID NO: 361448 - DNA, 18 bp, Homo sapiens
ctcgcagtcgcaggatcc

SEQ ID NO: 361449 - DNA, 18 bp, Homo sapiens
ctcgcatccgcctctgag

SEQ ID NO: 361450 - DNA, 22 bp, Homo sapiens
ctcgcatccgcctctgagccag

SEQ ID NO: 361451 - DNA, 15 bp, Homo sapiens
ctcgcccctccagtg

SEQ ID NO: 361452 - DNA, 17 bp, Homo sapiens
ctcgcccctccagtgtt

SEQ ID NO: 361453 - DNA, 16 bp, Homo sapiens
ctcgcccgcccactgt

SEQ ID NO: 361454 - DNA, 20 bp, Homo sapiens
ctcgcccgcccactgtcctg

SEQ ID NO: 361455 - DNA, 23 bp, Homo sapiens
ctcgcccgcccactgtcctgggc

SEQ ID NO: 361456 - DNA, 15 bp, Homo sapiens
ctcgctgctgctact

SEQ ID NO: 361457 - DNA, 18 bp, Homo sapiens
ctcgctgtgccaccaccc

SEQ ID NO: 361458 - DNA, 17 bp, Homo sapiens
ctcgcttcataggcaga

SEQ ID NO: 361459 - DNA, 21 bp, Homo sapiens
ctcgcttcataggcagagccc

SEQ ID NO: 361460 - DNA, 17 bp, Homo sapiens
ctcgctttgttgcccag

SEQ ID NO: 361461 - DNA, 19 bp, Homo sapiens
ctcggaagccgtctgactc

SEQ ID NO: 361462 - DNA, 13 bp, Homo sapiens
ctcggacacagtt

SEQ ID NO: 361463 - DNA, 17 bp, Homo sapiens
ctcggacccaccccaac

SEQ ID NO: 361464 - DNA, 19 bp, Homo sapiens
ctcggagccaatgaacagc

SEQ ID NO: 361465 - DNA, 15 bp, Homo sapiens
ctcggagcctgtgtt

SEQ ID NO: 361466 - DNA, 13 bp, Homo sapiens
ctcggaggccagg

SEQ ID NO: 361467 - DNA, 18 bp, Homo sapiens
ctcggaggccaggccctc

SEQ ID NO: 361468 - DNA, 20 bp, Homo sapiens
ctcggcagaactctctgtct

SEQ ID NO: 361469 - DNA, 24 bp, Homo sapiens
ctcggccccacccaccctctggtc

SEQ ID NO: 361470 - DNA, 17 bp, Homo sapiens
ctcggccccctccatcg

SEQ ID NO: 361471 - DNA, 18 bp, Homo sapiens
ctcggcctccgaggctcc

SEQ ID NO: 361472 - DNA, 17 bp, Homo sapiens
ctcggctggaagaacat

SEQ ID NO: 361473 - DNA, 17 bp, Homo sapiens
ctcggctgtggagaaca

SEQ ID NO: 361474 - DNA, 16 bp, Homo sapiens
ctcggcttgtgggctg

SEQ ID NO: 361475 - DNA, 22 bp, Homo sapiens
ctcgggcaagggccgtgcccgc

SEQ ID NO: 361476 - DNA, 12 bp, Homo sapiens
ctcgggccgcct

SEQ ID NO: 361477 - DNA, 19 bp, Homo sapiens
ctcgggccgcctcctccag

SEQ ID NO: 361478 - DNA, 20 bp, Homo sapiens
ctcgggccgcctcctccaga

SEQ ID NO: 361479 - DNA, 22 bp, Homo sapiens
ctcgggccgcctcctccagact

SEQ ID NO: 361480 - DNA, 20 bp, Homo sapiens
ctcgggcgcctgcgctcctc

SEQ ID NO: 361481 - DNA, 15 bp, Homo sapiens
ctcggggcaggaagt

SEQ ID NO: 361482 - DNA, 18 bp, Homo sapiens
ctcggggcaggaagtccc

SEQ ID NO: 361483 - DNA, 21 bp, Homo sapiens
ctcggggcaggaagtccctga

SEQ ID NO: 361484 - DNA, 16 bp, Homo sapiens
ctcggggcagggcagg

SEQ ID NO: 361485 - DNA, 13 bp, Homo sapiens
ctcggtggcattt

SEQ ID NO: 361486 - DNA, 18 bp, Homo sapiens
ctcggtggcatttgctga

SEQ ID NO: 361487 - DNA, 19 bp, Homo sapiens
ctcggtggcatttgctgaa

SEQ ID NO: 361488 - DNA, 19 bp, Homo sapiens
ctcgtccacaggggcaggc

SEQ ID NO: 361489 - DNA, 22 bp, Homo sapiens
ctcgtccacaggggcaggcctg

SEQ ID NO: 361490 - DNA, 17 bp, Homo sapiens
ctcgtccggcctgcagc

SEQ ID NO: 361491 - DNA, 20 bp, Homo sapiens
ctcgtccggcctgcagccca

SEQ ID NO: 361492 - DNA, 18 bp, Homo sapiens
ctcgtctccctggccacc

SEQ ID NO: 361493 - DNA, 18 bp, Homo sapiens
ctcgtctgatgttttgat

SEQ ID NO: 361494 - DNA, 13 bp, Homo sapiens
ctcgtcttcctct

SEQ ID NO: 361495 - DNA, 16 bp, Homo sapiens
ctcgtcttcctctctc

SEQ ID NO: 361496 - DNA, 14 bp, Homo sapiens
ctcgtgacccagtg

SEQ ID NO: 361497 - DNA, 17 bp, Homo sapiens
ctcgtgacccagtggca

SEQ ID NO: 361498 - DNA, 22 bp, Homo sapiens
ctcgtgacctacagggaactgg

SEQ ID NO: 361499 - DNA, 15 bp, Homo sapiens
ctcgtggacacctgc

SEQ ID NO: 361500 - DNA, 19 bp, Homo sapiens
ctcgtggacacctgccctg

SEQ ID NO: 361501 - DNA, 16 bp, Homo sapiens
ctcgtgggctctggct

SEQ ID NO: 361502 - DNA, 14 bp, Homo sapiens
ctcgtgggttcttc

SEQ ID NO: 361503 - DNA, 16 bp, Homo sapiens
ctcgtgggttcttcct

SEQ ID NO: 361504 - DNA, 16 bp, Homo sapiens
ctcgtggtagaagcca

SEQ ID NO: 361505 - DNA, 16 bp, Homo sapiens
ctcgtgtatcctgggg

SEQ ID NO: 361506 - DNA, 18 bp, Homo sapiens
ctcgtgtatcctggggct

SEQ ID NO: 361507 - DNA, 19 bp, Homo sapiens
ctcgtgtatcctggggctc

SEQ ID NO: 361508 - DNA, 13 bp, Homo sapiens
ctcgttgacatgc

SEQ ID NO: 361509 - DNA, 16 bp, Homo sapiens
ctcgtttttcagcacc

SEQ ID NO: 361510 - DNA, 20 bp, Homo sapiens
ctcgtttttcagcaccccca

SEQ ID NO: 361511 - DNA, 23 bp, Homo sapiens
ctcgtttttcagcacccccaccc

SEQ ID NO: 361512 - DNA, 13 bp, Homo sapiens
ctctaaaaaagaa

SEQ ID NO: 361513 - DNA, 18 bp, Homo sapiens
ctctaaaaataaaatgat

SEQ ID NO: 361514 - DNA, 13 bp, Homo sapiens
ctctaaaagcacc

SEQ ID NO: 361515 - DNA, 14 bp, Homo sapiens
ctctaaaattctag

SEQ ID NO: 361516 - DNA, 16 bp, Homo sapiens
ctctaaaattctagtc

SEQ ID NO: 361517 - DNA, 22 bp, Homo sapiens
ctctaacagctcaggatctctt

SEQ ID NO: 361518 - DNA, 19 bp, Homo sapiens
ctctaacattactgccttc

SEQ ID NO: 361519 - DNA, 16 bp, Homo sapiens
ctctaaggccaaggcc

SEQ ID NO: 361520 - DNA, 18 bp, Homo sapiens
ctctaaggccaaggcctc

SEQ ID NO: 361521 - DNA, 21 bp, Homo sapiens
ctctaaggccaaggcctcagg

SEQ ID NO: 361522 - DNA, 22 bp, Homo sapiens
ctctaaggccaaggcctcagga

SEQ ID NO: 361523 - DNA, 23 bp, Homo sapiens
ctctaaggccaaggcctcaggag

SEQ ID NO: 361524 - DNA, 17 bp, Homo sapiens
ctctaagtgtaaaaaaa

SEQ ID NO: 361525 - DNA, 17 bp, Homo sapiens
ctctaatcgaaagaaaa

SEQ ID NO: 361526 - DNA, 15 bp, Homo sapiens
ctctacaaaaaaaat

SEQ ID NO: 361527 - DNA, 17 bp, Homo sapiens
ctctacaactgagtcct

SEQ ID NO: 361528 - DNA, 15 bp, Homo sapiens
ctctacacaacatgt

SEQ ID NO: 361529 - DNA, 16 bp, Homo sapiens
ctctacacaacatgta

SEQ ID NO: 361530 - DNA, 17 bp, Homo sapiens
ctctacccagcccatct

SEQ ID NO: 361531 - DNA, 16 bp, Homo sapiens
ctctacccatattaca

SEQ ID NO: 361532 - DNA, 19 bp, Homo sapiens
ctctacccatattacagat

SEQ ID NO: 361533 - DNA, 15 bp, Homo sapiens
ctctacccatgagcc

SEQ ID NO: 361534 - DNA, 16 bp, Homo sapiens
ctctacccccaacacc

SEQ ID NO: 361535 - DNA, 16 bp, Homo sapiens
ctctacccctgctccc

SEQ ID NO: 361536 - DNA, 16 bp, Homo sapiens
ctctaccctcccaccc

SEQ ID NO: 361537 - DNA, 17 bp, Homo sapiens
ctctaccctggtaggaa

SEQ ID NO: 361538 - DNA, 21 bp, Homo sapiens
ctctacttctttttctttgag

SEQ ID NO: 361539 - DNA, 20 bp, Homo sapiens
ctctactttgtcccctcacc

SEQ ID NO: 361540 - DNA, 22 bp, Homo sapiens
ctctactttgtcccctcacctc

SEQ ID NO: 361541 - DNA, 23 bp, Homo sapiens
ctctagacaaccctgcaaaggac

SEQ ID NO: 361542 - DNA, 20 bp, Homo sapiens
ctctagccaggagtctgtgc

SEQ ID NO: 361543 - DNA, 23 bp, Homo sapiens
ctctagccaggagtctgtgctct

SEQ ID NO: 361544 - DNA, 15 bp, Homo sapiens
ctctagcctgggcca

SEQ ID NO: 361545 - DNA, 20 bp, Homo sapiens
ctctagcctgggccagagaa

SEQ ID NO: 361546 - DNA, 12 bp, Homo sapiens
ctctagctggca

SEQ ID NO: 361547 - DNA, 13 bp, Homo sapiens
ctctagctggcag

SEQ ID NO: 361548 - DNA, 15 bp, Homo sapiens
ctctagctggcagga

SEQ ID NO: 361549 - DNA, 20 bp, Homo sapiens
ctctagggaaggccacctgc

SEQ ID NO: 361550 - DNA, 22 bp, Homo sapiens
ctctagggaaggccacctgcag

SEQ ID NO: 361551 - DNA, 23 bp, Homo sapiens
ctctagggaaggccacctgcagg

SEQ ID NO: 361552 - DNA, 14 bp, Homo sapiens
ctctagggttgctg

SEQ ID NO: 361553 - DNA, 18 bp, Homo sapiens
ctctagggttgctggagc

SEQ ID NO: 361554 - DNA, 21 bp, Homo sapiens
ctctagggttgctggagcctg

SEQ ID NO: 361555 - DNA, 14 bp, Homo sapiens
ctctaggtggggcg

SEQ ID NO: 361556 - DNA, 17 bp, Homo sapiens
ctctagttccctcagtg

SEQ ID NO: 361557 - DNA, 22 bp, Homo sapiens
ctctagttccctcagtgtgaag

SEQ ID NO: 361558 - DNA, 15 bp, Homo sapiens
ctctagttctagatg

SEQ ID NO: 361559 - DNA, 17 bp, Homo sapiens
ctctatatatacatgta

SEQ ID NO: 361560 - DNA, 17 bp, Homo sapiens
ctctatcttgcatctac

SEQ ID NO: 361561 - DNA, 23 bp, Homo sapiens
ctctattgatgtacagtctgtca

SEQ ID NO: 361562 - DNA, 19 bp, Homo sapiens
ctctattgggcacagccta

SEQ ID NO: 361563 - DNA, 14 bp, Homo sapiens
ctctattttttact

SEQ ID NO: 361564 - DNA, 23 bp, Homo sapiens
ctctcaaaacttggtatttttca

SEQ ID NO: 361565 - DNA, 19 bp, Homo sapiens
ctctcaaaagtctattttt

SEQ ID NO: 361566 - DNA, 13 bp, Homo sapiens
ctcttcccccttc

SEQ ID NO: 361567 - DNA, 16 bp, Homo sapiens
ctcttcccttagcctc

SEQ ID NO: 361568 - DNA, 22 bp, Homo sapiens
ctcttcccttagcctctcccac

SEQ ID NO: 361569 - DNA, 23 bp, Homo sapiens
ctcttcccttagcctctcccacc

SEQ ID NO: 361570 - DNA, 22 bp, Homo sapiens
ctcttccggagatgtagcaaaa

SEQ ID NO: 361571 - DNA, 22 bp, Homo sapiens
ctcttcctacccaaccactcaa

SEQ ID NO: 361572 - DNA, 22 bp, Homo sapiens
ctcttcctcatcctgcttctct

SEQ ID NO: 361573 - DNA, 20 bp, Homo sapiens
ctcttcctggaatgcattca

SEQ ID NO: 361574 - DNA, 13 bp, Homo sapiens
ctcttccttctct

SEQ ID NO: 361575 - DNA, 18 bp, Homo sapiens
ctcttccttgctgtgtca

SEQ ID NO: 361576 - DNA, 16 bp, Homo sapiens
ctcttcgctgtgatgc

SEQ ID NO: 361577 - DNA, 14 bp, Homo sapiens
ctcttctcaagtgc

SEQ ID NO: 361578 - DNA, 12 bp, Homo sapiens
ctcttctccact

SEQ ID NO: 361579 - DNA, 13 bp, Homo sapiens
ctcttctcctttc

SEQ ID NO: 361580 - DNA, 18 bp, Homo sapiens
ctcttctctccccttttc

SEQ ID NO: 361581 - DNA, 13 bp, Homo sapiens
ctcttctctgggc

SEQ ID NO: 361582 - DNA, 16 bp, Homo sapiens
ctcttctctgggccca

SEQ ID NO: 361583 - DNA, 10 bp, Homo sapiens
ctcttctgac

SEQ ID NO: 361584 - DNA, 10 bp, Homo sapiens
ctcttctggg

SEQ ID NO: 361585 - DNA, 13 bp, Homo sapiens
ctcttctgtccat

SEQ ID NO: 361586 - DNA, 19 bp, Homo sapiens
ctcttctgtccatcagtgc

SEQ ID NO: 361587 - DNA, 22 bp, Homo sapiens
ctcttctgtccatcagtgcatg

SEQ ID NO: 361588 - DNA, 22 bp, Homo sapiens
ctcttcttattcatgctttctc

SEQ ID NO: 361589 - DNA, 20 bp, Homo sapiens
ctcttcttccaggtagctga

SEQ ID NO: 361590 - DNA, 20 bp, Homo sapiens
ctcttcttccttttgtatcc

SEQ ID NO: 361591 - DNA, 14 bp, Homo sapiens
ctcttgactcaggt

SEQ ID NO: 361592 - DNA, 15 bp, Homo sapiens
ctcttgagcagtggc

SEQ ID NO: 361593 - DNA, 18 bp, Homo sapiens
ctcttgagcagtggctgg

SEQ ID NO: 361594 - DNA, 13 bp, Homo sapiens
ctcttgatgtgaa

SEQ ID NO: 361595 - DNA, 23 bp, Homo sapiens
ctcttgatgtgaagataatttgc

SEQ ID NO: 361596 - DNA, 18 bp, Homo sapiens
ctcttgattgatttttaa

SEQ ID NO: 361597 - DNA, 21 bp, Homo sapiens
ctcttgattgatttttaaagt

SEQ ID NO: 361598 - DNA, 17 bp, Homo sapiens
ctcttgcagagaagcct

SEQ ID NO: 361599 - DNA, 20 bp, Homo sapiens
ctcttgccccccaccccagc

SEQ ID NO: 361600 - DNA, 21 bp, Homo sapiens
ctcttgccgaggagccaggca

SEQ ID NO: 361601 - DNA, 13 bp, Homo sapiens
ctcttgctcactc

SEQ ID NO: 361602 - DNA, 16 bp, Homo sapiens
ctcttgctcactccct

SEQ ID NO: 361603 - DNA, 12 bp, Homo sapiens
ctcttgctcttt

SEQ ID NO: 361604 - DNA, 15 bp, Homo sapiens
ctcttgctctttcta

SEQ ID NO: 361605 - DNA, 22 bp, Homo sapiens
ctcttgcttgtgggactagcct

SEQ ID NO: 361606 - DNA, 22 bp, Homo sapiens
ctcttgctttggtcttcttcca

SEQ ID NO: 361607 - DNA, 21 bp, Homo sapiens
ctcttggactccctccccacc

SEQ ID NO: 361608 - DNA, 23 bp, Homo sapiens
ctcttggagctgagatgagcccc

SEQ ID NO: 361609 - DNA, 14 bp, Homo sapiens
ctcttggcaggagt

SEQ ID NO: 361610 - DNA, 16 bp, Homo sapiens
ctcttgggctgagact

SEQ ID NO: 361611 - DNA, 18 bp, Homo sapiens
ctcttgggctgagactgg

SEQ ID NO: 361612 - DNA, 16 bp, Homo sapiens
ctcttggtcacctcaa

SEQ ID NO: 361613 - DNA, 18 bp, Homo sapiens
ctcttggtctctttcttt

SEQ ID NO: 361614 - DNA, 23 bp, Homo sapiens
ctcttggtctctttctttccaaa

SEQ ID NO: 361615 - DNA, 12 bp, Homo sapiens
ctcttgtagaag

SEQ ID NO: 361616 - DNA, 16 bp, Homo sapiens
ctcttgtccctttccc

SEQ ID NO: 361617 - DNA, 20 bp, Homo sapiens
ctcttgtccctttccctacc

SEQ ID NO: 361618 - DNA, 19 bp, Homo sapiens
ctcttgtgctcacgctccc

SEQ ID NO: 361619 - DNA, 20 bp, Homo sapiens
ctcttgtgctgagtcccctc

SEQ ID NO: 361620 - DNA, 23 bp, Homo sapiens
ctcttgtggtgcattgaaagaag

SEQ ID NO: 361621 - DNA, 20 bp, Homo sapiens
ctctttactcccttcctggc

SEQ ID NO: 361622 - DNA, 22 bp, Homo sapiens
ctctttactcccttcctggcct

SEQ ID NO: 361623 - DNA, 23 bp, Homo sapiens
ctctttagttgatttaaactctt

SEQ ID NO: 361624 - DNA, 21 bp, Homo sapiens
ctctttcagaaaacagaaaaa

SEQ ID NO: 361625 - DNA, 17 bp, Homo sapiens
ctctttcccccaaatct

SEQ ID NO: 361626 - DNA, 18 bp, Homo sapiens
ctctttcccctcctttgt

SEQ ID NO: 361627 - DNA, 16 bp, Homo sapiens
ctctttcctccttcca

SEQ ID NO: 361628 - DNA, 10 bp, Homo sapiens
ctctttcctg

SEQ ID NO: 361629 - DNA, 17 bp, Homo sapiens
ctctttcctgccctttt

SEQ ID NO: 361630 - DNA, 12 bp, Homo sapiens
ctctttcctgtg

SEQ ID NO: 361631 - DNA, 22 bp, Homo sapiens
ctctttcctgttgttgttaatg

SEQ ID NO: 361632 - DNA, 21 bp, Homo sapiens
ctctttctacatgactgggcc

SEQ ID NO: 361633 - DNA, 17 bp, Homo sapiens
ctctttctatgcccgtg

SEQ ID NO: 361634 - DNA, 18 bp, Homo sapiens
ctctttctccttagtctt

SEQ ID NO: 361635 - DNA, 19 bp, Homo sapiens
ctctttctctcctttcttt

SEQ ID NO: 361636 - DNA, 12 bp, Homo sapiens
ctctttctctgc

SEQ ID NO: 361637 - DNA, 16 bp, Homo sapiens
ctctttctctgccagt

SEQ ID NO: 361638 - DNA, 17 bp, Homo sapiens
ctctttctctgccagtg

SEQ ID NO: 361639 - DNA, 22 bp, Homo sapiens
ctctttcttccactaccctccc

SEQ ID NO: 361640 - DNA, 19 bp, Homo sapiens
ctctttcttcttccacaca

SEQ ID NO: 361641 - DNA, 14 bp, Homo sapiens
ctctttcttctttg

SEQ ID NO: 361642 - DNA, 15 bp, Homo sapiens
ctctttctttccaaa

SEQ ID NO: 361643 - DNA, 16 bp, Homo sapiens
ctctttctttccaaag

SEQ ID NO: 361644 - DNA, 19 bp, Homo sapiens
ctctttgccttgatgttgt

SEQ ID NO: 361645 - DNA, 20 bp, Homo sapiens
ctctttgccttgatgttgtg

SEQ ID NO: 361646 - DNA, 13 bp, Homo sapiens
ctctttgctgttg

SEQ ID NO: 361647 - DNA, 12 bp, Homo sapiens
ctctttggtgcc

SEQ ID NO: 361648 - DNA, 22 bp, Homo sapiens
ctctttgtaaggacttgtgcct

SEQ ID NO: 361649 - DNA, 20 bp, Homo sapiens
ctctttgtctcaccagctca

SEQ ID NO: 361650 - DNA, 23 bp, Homo sapiens
ctctttgtggcagtggccaggca

SEQ ID NO: 361651 - DNA, 16 bp, Homo sapiens
ctcttttcctagtttt

SEQ ID NO: 361652 - DNA, 13 bp, Homo sapiens
ctcttttctcttt

SEQ ID NO: 361653 - DNA, 14 bp, Homo sapiens
ctcttttctgcatc

SEQ ID NO: 361654 - DNA, 16 bp, Homo sapiens
ctcttttcttctcagg

SEQ ID NO: 361655 - DNA, 21 bp, Homo sapiens
ctcttttgagactttgcccag

SEQ ID NO: 361656 - DNA, 13 bp, Homo sapiens
ctctttttctcac

SEQ ID NO: 361657 - DNA, 14 bp, Homo sapiens
ctctttttcttttc

SEQ ID NO: 361658 - DNA, 22 bp, Homo sapiens
ctctttttttaaaaagttgata

SEQ ID NO: 361659 - DNA, 21 bp, Homo sapiens
ctctttttttttttttttaaa

SEQ ID NO: 361660 - DNA, 18 bp, Homo sapiens
ctgaaaaaaagtttacaa

SEQ ID NO: 361661 - DNA, 21 bp, Homo sapiens
ctgaaaaccagtcttctccct

SEQ ID NO: 361662 - DNA, 19 bp, Homo sapiens
ctgaaaaccatctggcctg

SEQ ID NO: 361663 - DNA, 23 bp, Homo sapiens
ctgaaaacccaggccacaaatgt

SEQ ID NO: 361664 - DNA, 16 bp, Homo sapiens
ctgaaaactgtaaata

SEQ ID NO: 361665 - DNA, 14 bp, Homo sapiens
ctgaaaactgttta

SEQ ID NO: 361666 - DNA, 20 bp, Homo sapiens
ctgaaaagcaattgccctgt

SEQ ID NO: 361667 - DNA, 20 bp, Homo sapiens
ctgaaaataacagaattctg

SEQ ID NO: 361668 - DNA, 19 bp, Homo sapiens
ctgaaaatatttttttcta

SEQ ID NO: 361669 - DNA, 12 bp, Homo sapiens
ctgaaaatgtaa

SEQ ID NO: 361670 - DNA, 13 bp, Homo sapiens
ctgaaaatgtaaa

SEQ ID NO: 361671 - DNA, 12 bp, Homo sapiens
ctgaaaatgttg

SEQ ID NO: 361672 - DNA, 12 bp, Homo sapiens
ctgaaacacttt

SEQ ID NO: 361673 - DNA, 13 bp, Homo sapiens
ctgaaacactttt

SEQ ID NO: 361674 - DNA, 22 bp, Homo sapiens
ctgaaacattccgaagagggaa

SEQ ID NO: 361675 - DNA, 21 bp, Homo sapiens
ctgaaacatttgacacataaa

SEQ ID NO: 361676 - DNA, 20 bp, Homo sapiens
ctgaaacttcaagcaccagg

SEQ ID NO: 361677 - DNA, 13 bp, Homo sapiens
ctgaaacttccct

SEQ ID NO: 361678 - DNA, 14 bp, Homo sapiens
ctgaaagaaacagt

SEQ ID NO: 361679 - DNA, 20 bp, Homo sapiens
ctgaaagaaacagttaactt

SEQ ID NO: 361680 - DNA, 23 bp, Homo sapiens
ctgaaagaagaacagctgttcct

SEQ ID NO: 361681 - DNA, 22 bp, Homo sapiens
ctgaaagaggctgaggcctgga

SEQ ID NO: 361682 - DNA, 22 bp, Homo sapiens
ctgaaagcagcagctaggactg

SEQ ID NO: 361683 - DNA, 12 bp, Homo sapiens
ctgaaagcctgt

SEQ ID NO: 361684 - DNA, 14 bp, Homo sapiens
ctgaaagctgcttc

SEQ ID NO: 361685 - DNA, 17 bp, Homo sapiens
ctgaaagctgcttctgg

SEQ ID NO: 361686 - DNA, 15 bp, Homo sapiens
ctgaaagtgttttac

SEQ ID NO: 361687 - DNA, 21 bp, Homo sapiens
ctgaaagtgttttactctttt

SEQ ID NO: 361688 - DNA, 22 bp, Homo sapiens
ctgaaagtgttttactcttttt

SEQ ID NO: 361689 - DNA, 15 bp, Homo sapiens
ctgaaataaactagg

SEQ ID NO: 361690 - DNA, 18 bp, Homo sapiens
ctgaaataaactagggtt

SEQ ID NO: 361691 - DNA, 18 bp, Homo sapiens
ctgaaatgaaacaaataa

SEQ ID NO: 361692 - DNA, 14 bp, Homo sapiens
ctgaaatgtttcca

SEQ ID NO: 361693 - DNA, 23 bp, Homo sapiens
ctgaaattatgtcaaatggatgt

SEQ ID NO: 361694 - DNA, 23 bp, Homo sapiens
ctgaaatttgttatacttcaaaa

SEQ ID NO: 361695 - DNA, 13 bp, Homo sapiens
ctgaacaaaaaaa

SEQ ID NO: 361696 - DNA, 16 bp, Homo sapiens
ctgagcttggccagaa

SEQ ID NO: 361697 - DNA, 17 bp, Homo sapiens
ctgagctttccggggag

SEQ ID NO: 361698 - DNA, 21 bp, Homo sapiens
ctgagctttccggggaggagc

SEQ ID NO: 361699 - DNA, 22 bp, Homo sapiens
ctgagctttccggggaggagcc

SEQ ID NO: 361700 - DNA, 21 bp, Homo sapiens
ctgagctttggacgcacacag

SEQ ID NO: 361701 - DNA, 17 bp, Homo sapiens
ctgagctttggggacag

SEQ ID NO: 361702 - DNA, 20 bp, Homo sapiens
ctgaggaagcacagcagcat

SEQ ID NO: 361703 - DNA, 16 bp, Homo sapiens
ctgaggacaggccccc

SEQ ID NO: 361704 - DNA, 14 bp, Homo sapiens
ctgaggaccagcca

SEQ ID NO: 361705 - DNA, 19 bp, Homo sapiens
ctgaggacctttctgagga

SEQ ID NO: 361706 - DNA, 18 bp, Homo sapiens
ctgaggacggggcagagc

SEQ ID NO: 361707 - DNA, 22 bp, Homo sapiens
ctgaggacttaaaatattcctg

SEQ ID NO: 361708 - DNA, 14 bp, Homo sapiens
ctgaggagggggag

SEQ ID NO: 361709 - DNA, 22 bp, Homo sapiens
ctgaggagtattaagaatgcag

SEQ ID NO: 361710 - DNA, 14 bp, Homo sapiens
ctgaggagtccaaa

SEQ ID NO: 361711 - DNA, 15 bp, Homo sapiens
ctgaggatgagctgg

SEQ ID NO: 361712 - DNA, 22 bp, Homo sapiens
ctgaggatttaagggatggaaa

SEQ ID NO: 361713 - DNA, 14 bp, Homo sapiens
ctgaggcaaccccc

SEQ ID NO: 361714 - DNA, 22 bp, Homo sapiens
ctgaggcaaccccctcggagcc

SEQ ID NO: 361715 - DNA, 23 bp, Homo sapiens
ctgaggcaaccccctcggagcct

SEQ ID NO: 361716 - DNA, 15 bp, Homo sapiens
ctgaggcacctgcat

SEQ ID NO: 361717 - DNA, 18 bp, Homo sapiens
ctgaggcagaacctggtg

SEQ ID NO: 361718 - DNA, 18 bp, Homo sapiens
ctgaggcccagcagagcc

SEQ ID NO: 361719 - DNA, 22 bp, Homo sapiens
ctgaggccccagggctgtgggt

SEQ ID NO: 361720 - DNA, 19 bp, Homo sapiens
ctgaggccccttaactcat

SEQ ID NO: 361721 - DNA, 17 bp, Homo sapiens
ctgaggcctcatccctc

SEQ ID NO: 361722 - DNA, 12 bp, Homo sapiens
ctgaggctgctg

SEQ ID NO: 361723 - DNA, 13 bp, Homo sapiens
ctgaggctggggc

SEQ ID NO: 361724 - DNA, 15 bp, Homo sapiens
ctgaggctggggctt

SEQ ID NO: 361725 - DNA, 18 bp, Homo sapiens
ctgaggcttagagagagg

SEQ ID NO: 361726 - DNA, 13 bp, Homo sapiens
ctgaggcttgggc

SEQ ID NO: 361727 - DNA, 14 bp, Homo sapiens
ctgaggcttgggcc

SEQ ID NO: 361728 - DNA, 16 bp, Homo sapiens
ctgaggcttgggccca

SEQ ID NO: 361729 - DNA, 19 bp, Homo sapiens
ctgaggcttgggcccagta

SEQ ID NO: 361730 - DNA, 21 bp, Homo sapiens
ctgaggcttgggcccagtagc

SEQ ID NO: 361731 - DNA, 23 bp, Homo sapiens
ctgaggcttgggcccagtagccc

SEQ ID NO: 361732 - DNA, 14 bp, Homo sapiens
ctgagggaagccca

SEQ ID NO: 361733 - DNA, 17 bp, Homo sapiens
ctgagggaagcccaccc

SEQ ID NO: 361734 - DNA, 18 bp, Homo sapiens
ctgagggaagcccacccg

SEQ ID NO: 361735 - DNA, 19 bp, Homo sapiens
ctgagggaagcccacccgc

SEQ ID NO: 361736 - DNA, 19 bp, Homo sapiens
ctgagggcactctctgcca

SEQ ID NO: 361737 - DNA, 13 bp, Homo sapiens
ctgagggcagggt

SEQ ID NO: 361738 - DNA, 15 bp, Homo sapiens
ctgagggccacacta

SEQ ID NO: 361739 - DNA, 15 bp, Homo sapiens
ctgagggcccctctg

SEQ ID NO: 361740 - DNA, 17 bp, Homo sapiens
ctgagggcccctctgcc

SEQ ID NO: 361741 - DNA, 19 bp, Homo sapiens
ctgagggcccctctgccca

SEQ ID NO: 361742 - DNA, 21 bp, Homo sapiens
ctgagggcccctctgcccagc

SEQ ID NO: 361743 - DNA, 21 bp, Homo sapiens
ctgagggctaattctgggaag

SEQ ID NO: 361744 - DNA, 19 bp, Homo sapiens
ctgaggggcatctgcccct

SEQ ID NO: 361745 - DNA, 20 bp, Homo sapiens
ctgaggggcatctgcccctc

SEQ ID NO: 361746 - DNA, 19 bp, Homo sapiens
ctgagggtggagactaagc

SEQ ID NO: 361747 - DNA, 20 bp, Homo sapiens
ctgagggtttccaccttggc

SEQ ID NO: 361748 - DNA, 17 bp, Homo sapiens
ctgaggtgaaagggagc

SEQ ID NO: 361749 - DNA, 16 bp, Homo sapiens
ctgaggttaaggggat

SEQ ID NO: 361750 - DNA, 16 bp, Homo sapiens
ctgagtactcaggcca

SEQ ID NO: 361751 - DNA, 17 bp, Homo sapiens
ctgagtagctctcctga

SEQ ID NO: 361752 - DNA, 13 bp, Homo sapiens
ctgagtatgtgga

SEQ ID NO: 361753 - DNA, 18 bp, Homo sapiens
ctgagtatgtggaaggca

SEQ ID NO: 361754 - DNA, 20 bp, Homo sapiens
ctgagtatgttaagctcttt

SEQ ID NO: 361755 - DNA, 14 bp, Homo sapiens
ctgagtcacctcct

SEQ ID NO: 361756 - DNA, 19 bp, Homo sapiens
ctgagtcacctcctccact

SEQ ID NO: 361757 - DNA, 16 bp, Homo sapiens
ctgagtcagggcccag

SEQ ID NO: 361758 - DNA, 22 bp, Homo sapiens
ctgagtcagggcccagaggctg

SEQ ID NO: 361759 - DNA, 17 bp, Homo sapiens
ctgagtcatcaaaaaga

SEQ ID NO: 361760 - DNA, 15 bp, Homo sapiens
ctgagtccagctccc

SEQ ID NO: 361761 - DNA, 16 bp, Homo sapiens
ctgagtccagctcccc

SEQ ID NO: 361762 - DNA, 16 bp, Homo sapiens
ctgagtcccctcagct

SEQ ID NO: 361763 - DNA, 21 bp, Homo sapiens
ctgagtccttaaacagggcat

SEQ ID NO: 361764 - DNA, 24 bp, Homo sapiens
ctgagtcgattaacctgcatgcag

SEQ ID NO: 361765 - DNA, 14 bp, Homo sapiens
ctgagtctcattcc

SEQ ID NO: 361766 - DNA, 13 bp, Homo sapiens
ctgagtctcctgt

SEQ ID NO: 361767 - DNA, 21 bp, Homo sapiens
ctgagtctgctatattttcat

SEQ ID NO: 361768 - DNA, 14 bp, Homo sapiens
ctgagtctggcaaa

SEQ ID NO: 361769 - DNA, 15 bp, Homo sapiens
ctgagtctggcaaac

SEQ ID NO: 361770 - DNA, 17 bp, Homo sapiens
ctgagtctggcaaacat

SEQ ID NO: 361771 - DNA, 18 bp, Homo sapiens
ctgagtctggcaaacatg

SEQ ID NO: 361772 - DNA, 20 bp, Homo sapiens
ctgagtctggcaaacatgtg

SEQ ID NO: 361773 - DNA, 23 bp, Homo sapiens
ctgagtctgtggacactgtggaa

SEQ ID NO: 361774 - DNA, 12 bp, Homo sapiens
ctgagtgagagg

SEQ ID NO: 361775 - DNA, 20 bp, Homo sapiens
ctgagtgcagaggctgagca

SEQ ID NO: 361776 - DNA, 13 bp, Homo sapiens
ctgagtgcctgca

SEQ ID NO: 361777 - DNA, 16 bp, Homo sapiens
ctgagtgcctgcagca

SEQ ID NO: 361778 - DNA, 20 bp, Homo sapiens
ctgagtggaatgcagggaag

SEQ ID NO: 361779 - DNA, 13 bp, Homo sapiens
ctgagtgggctgg

SEQ ID NO: 361780 - DNA, 18 bp, Homo sapiens
ctgagtggtccacattct

SEQ ID NO: 361781 - DNA, 15 bp, Homo sapiens
ctgagtggtgagggg

SEQ ID NO: 361782 - DNA, 21 bp, Homo sapiens
ctgagtggtgaggggccactg

SEQ ID NO: 361783 - DNA, 14 bp, Homo sapiens
ctgagtggtgtttt

SEQ ID NO: 361784 - DNA, 16 bp, Homo sapiens
ctgagtgttcaaacta

SEQ ID NO: 361785 - DNA, 22 bp, Homo sapiens
ctgagtgttcaaactactgtac

SEQ ID NO: 361786 - DNA, 15 bp, Homo sapiens
ctgagtgtttggaaa

SEQ ID NO: 361787 - DNA, 16 bp, Homo sapiens
ctgagttacttgtctg

SEQ ID NO: 361788 - DNA, 18 bp, Homo sapiens
ctgagttacttgtctgag

SEQ ID NO: 361789 - DNA, 21 bp, Homo sapiens
ctgagttacttgtctgaggcc

SEQ ID NO: 361790 - DNA, 15 bp, Homo sapiens
ctgagttctcatcca

SEQ ID NO: 361791 - DNA, 22 bp, Homo sapiens
ctgagttggcgttgtgggcagg

SEQ ID NO: 361792 - DNA, 20 bp, Homo sapiens
ctgagtttaccatttgtaat

SEQ ID NO: 361793 - DNA, 19 bp, Homo sapiens
ctgataaacacagaggttt

SEQ ID NO: 361794 - DNA, 12 bp, Homo sapiens
ctgataaacatt

SEQ ID NO: 361795 - DNA, 18 bp, Homo sapiens
ctgataaccgtccttcat

SEQ ID NO: 361796 - DNA, 24 bp, Homo sapiens
ctgataactagatggtgctgagaa

SEQ ID NO: 361797 - DNA, 14 bp, Homo sapiens
ctgataataattga

SEQ ID NO: 361798 - DNA, 21 bp, Homo sapiens
ctgatacagccttacaataca

SEQ ID NO: 361799 - DNA, 16 bp, Homo sapiens
ctgatagcgttggaat

SEQ ID NO: 361800 - DNA, 20 bp, Homo sapiens
ctgatatacttgagtgtgca

SEQ ID NO: 361801 - DNA, 22 bp, Homo sapiens
ctgatatacttgagtgtgcaag

SEQ ID NO: 361802 - DNA, 20 bp, Homo sapiens
ctgatatctgtttgcttcta

SEQ ID NO: 361803 - DNA, 22 bp, Homo sapiens
ctgatatctgtttgcttctaaa

SEQ ID NO: 361804 - DNA, 20 bp, Homo sapiens
ctgatattaatttatcagat

SEQ ID NO: 361805 - DNA, 20 bp, Homo sapiens
ctgatattcaaacacacagt

SEQ ID NO: 361806 - DNA, 18 bp, Homo sapiens
ctgatattccatgaatgt

SEQ ID NO: 361807 - DNA, 20 bp, Homo sapiens
ctgatattggtgtgaatgct

SEQ ID NO: 361808 - DNA, 18 bp, Homo sapiens
ctgatatttgctggagtg

SEQ ID NO: 361809 - DNA, 15 bp, Homo sapiens
ctgatcaaagcacct

SEQ ID NO: 361810 - DNA, 17 bp, Homo sapiens
ctgatcaagcttcagac

SEQ ID NO: 361811 - DNA, 19 bp, Homo sapiens
ctgatcagtctaagatggg

SEQ ID NO: 361812 - DNA, 20 bp, Homo sapiens
ctgatcattacatggctgtg

SEQ ID NO: 361813 - DNA, 21 bp, Homo sapiens
ctgatcatttgcagctgctgg

SEQ ID NO: 361814 - DNA, 17 bp, Homo sapiens
ctgatcccactcctagg

SEQ ID NO: 361815 - DNA, 18 bp, Homo sapiens
ctgatcccactcctagga

SEQ ID NO: 361816 - DNA, 18 bp, Homo sapiens
ctgatccctgatcaagct

SEQ ID NO: 361817 - DNA, 18 bp, Homo sapiens
ctgatcctgaacaagaaa

SEQ ID NO: 361818 - DNA, 17 bp, Homo sapiens
ctgatcgtgctaaattt

SEQ ID NO: 361819 - DNA, 17 bp, Homo sapiens
ctgatctctcgtgattg

SEQ ID NO: 361820 - DNA, 19 bp, Homo sapiens
ctgatgagacaacacacac

SEQ ID NO: 361821 - DNA, 17 bp, Homo sapiens
ctgatgagggcacctct

SEQ ID NO: 361822 - DNA, 16 bp, Homo sapiens
ctgatgatataaacaa

SEQ ID NO: 361823 - DNA, 19 bp, Homo sapiens
ctgatgatcaaaacctgtg

SEQ ID NO: 361824 - DNA, 18 bp, Homo sapiens
ctgatgctccctcccctg

SEQ ID NO: 361825 - DNA, 13 bp, Homo sapiens
ctgccaggctcct

SEQ ID NO: 361826 - DNA, 20 bp, Homo sapiens
ctgccaggctctccctctct

SEQ ID NO: 361827 - DNA, 13 bp, Homo sapiens
ctgccagggagct

SEQ ID NO: 361828 - DNA, 22 bp, Homo sapiens
ctgccagtccccctgccccagg

SEQ ID NO: 361829 - DNA, 17 bp, Homo sapiens
ctgccagtgaagtcctt

SEQ ID NO: 361830 - DNA, 19 bp, Homo sapiens
ctgccagtgaagtccttca

SEQ ID NO: 361831 - DNA, 19 bp, Homo sapiens
ctgccagtgacagacaggc

SEQ ID NO: 361832 - DNA, 21 bp, Homo sapiens
ctgccagtgacagacaggctc

SEQ ID NO: 361833 - DNA, 23 bp, Homo sapiens
ctgccagtggggtcgtgaggcaa

SEQ ID NO: 361834 - DNA, 17 bp, Homo sapiens
ctgccatcagcccctgc

SEQ ID NO: 361835 - DNA, 21 bp, Homo sapiens
ctgccatcagcccctgctgct

SEQ ID NO: 361836 - DNA, 18 bp, Homo sapiens
ctgccatgatagctgggg

SEQ ID NO: 361837 - DNA, 21 bp, Homo sapiens
ctgccatgattttggccactt

SEQ ID NO: 361838 - DNA, 21 bp, Homo sapiens
ctgccatgccactgccaggca

SEQ ID NO: 361839 - DNA, 15 bp, Homo sapiens
ctgccatgtggcaga

SEQ ID NO: 361840 - DNA, 13 bp, Homo sapiens
ctgccatttccct

SEQ ID NO: 361841 - DNA, 23 bp, Homo sapiens
ctgccatttcccttctggacact

SEQ ID NO: 361842 - DNA, 23 bp, Homo sapiens
ctgcccaaagcagcacttataaa

SEQ ID NO: 361843 - DNA, 21 bp, Homo sapiens
ctgcccaaatcccctccctgt

SEQ ID NO: 361844 - DNA, 22 bp, Homo sapiens
ctgcccaagggcctcccaccag

SEQ ID NO: 361845 - DNA, 21 bp, Homo sapiens
ctgcccaatatgcagttctgc

SEQ ID NO: 361846 - DNA, 21 bp, Homo sapiens
ctgcccaatgctttgggaggc

SEQ ID NO: 361847 - DNA, 22 bp, Homo sapiens
ctgcccaatgctttgggaggcc

SEQ ID NO: 361848 - DNA, 16 bp, Homo sapiens
ctgcccacaagccata

SEQ ID NO: 361849 - DNA, 22 bp, Homo sapiens
ctgcccacaagccataaaccaa

SEQ ID NO: 361850 - DNA, 20 bp, Homo sapiens
ctgcccaccctgggcctccc

SEQ ID NO: 361851 - DNA, 21 bp, Homo sapiens
ctgcccaccctgggcctcccg

SEQ ID NO: 361852 - DNA, 13 bp, Homo sapiens
ctgcccaccgacc

SEQ ID NO: 361853 - DNA, 17 bp, Homo sapiens
ctgcccactacctatgc

SEQ ID NO: 361854 - DNA, 19 bp, Homo sapiens
ctgcccacttagccgtcca

SEQ ID NO: 361855 - DNA, 21 bp, Homo sapiens
ctgcccagacccctctggcca

SEQ ID NO: 361856 - DNA, 22 bp, Homo sapiens
ctgcccagacccctctggccag

SEQ ID NO: 361857 - DNA, 18 bp, Homo sapiens
ctgcccagatgccctttg

SEQ ID NO: 361858 - DNA, 12 bp, Homo sapiens
ctgcccagccct

SEQ ID NO: 361859 - DNA, 13 bp, Homo sapiens
ctgcccagccctc

SEQ ID NO: 361860 - DNA, 18 bp, Homo sapiens
ctgcccagctctgaccct

SEQ ID NO: 361861 - DNA, 21 bp, Homo sapiens
ctgcccagctctgaccctgat

SEQ ID NO: 361862 - DNA, 15 bp, Homo sapiens
ctgcccagcttgggc

SEQ ID NO: 361863 - DNA, 20 bp, Homo sapiens
ctgcccagcttgggcccagc

SEQ ID NO: 361864 - DNA, 22 bp, Homo sapiens
ctgcccagcttgggcccagctg

SEQ ID NO: 361865 - DNA, 22 bp, Homo sapiens
ctgcccaggccggccagcctca

SEQ ID NO: 361866 - DNA, 18 bp, Homo sapiens
ctgcccaggcctgcctgt

SEQ ID NO: 361867 - DNA, 19 bp, Homo sapiens
ctgcccaggcctgcctgtt

SEQ ID NO: 361868 - DNA, 23 bp, Homo sapiens
ctgcccagtgttgtttgtaaata

SEQ ID NO: 361869 - DNA, 15 bp, Homo sapiens
ctgcccatcacaggg

SEQ ID NO: 361870 - DNA, 15 bp, Homo sapiens
ctgccccaaacaaat

SEQ ID NO: 361871 - DNA, 21 bp, Homo sapiens
ctgccccaaacaaatatgcaa

SEQ ID NO: 361872 - DNA, 19 bp, Homo sapiens
ctgccccaaaggaagcttt

SEQ ID NO: 361873 - DNA, 19 bp, Homo sapiens
ctgccccaagcagccagcc

SEQ ID NO: 361874 - DNA, 20 bp, Homo sapiens
ctgccccaagcagccagcca

SEQ ID NO: 361875 - DNA, 22 bp, Homo sapiens
ctgccccaagcagccagccagt

SEQ ID NO: 361876 - DNA, 15 bp, Homo sapiens
ctgccccaatcgggt

SEQ ID NO: 361877 - DNA, 20 bp, Homo sapiens
ctgccccaatcgggtccaga

SEQ ID NO: 361878 - DNA, 22 bp, Homo sapiens
ctgccccaatcgggtccagaga

SEQ ID NO: 361879 - DNA, 15 bp, Homo sapiens
ctgccccacaacaca

SEQ ID NO: 361880 - DNA, 14 bp, Homo sapiens
ctgccccacacgga

SEQ ID NO: 361881 - DNA, 13 bp, Homo sapiens
ctgccccacaggc

SEQ ID NO: 361882 - DNA, 11 bp, Homo sapiens
ctgccccaccc

SEQ ID NO: 361883 - DNA, 18 bp, Homo sapiens
ctgccccacccctccatg

SEQ ID NO: 361884 - DNA, 20 bp, Homo sapiens
ctgccccacggccctgtcag

SEQ ID NO: 361885 - DNA, 13 bp, Homo sapiens
ctgccccagagaa

SEQ ID NO: 361886 - DNA, 16 bp, Homo sapiens
ctgccccagctgactg

SEQ ID NO: 361887 - DNA, 21 bp, Homo sapiens
ctgccccagctgactgtggcc

SEQ ID NO: 361888 - DNA, 19 bp, Homo sapiens
ctgccccagggctcccggc

SEQ ID NO: 361889 - DNA, 12 bp, Homo sapiens
ctgcccccactg

SEQ ID NO: 361890 - DNA, 14 bp, Homo sapiens
ctgcccccactgtc

SEQ ID NO: 361891 - DNA, 20 bp, Homo sapiens
ctgcccccagaaagcctcct

SEQ ID NO: 361892 - DNA, 22 bp, Homo sapiens
ctgcccccagaaagcctcctgc

SEQ ID NO: 361893 - DNA, 15 bp, Homo sapiens
ctgcccccagacccc

SEQ ID NO: 361894 - DNA, 23 bp, Homo sapiens
ctgcccccagctgctcctcgcag

SEQ ID NO: 361895 - DNA, 24 bp, Homo sapiens
ctgcccccagctgctcctcgcagt

SEQ ID NO: 361896 - DNA, 14 bp, Homo sapiens
ctgcccccatctcc

SEQ ID NO: 361897 - DNA, 20 bp, Homo sapiens
ctgcccccatctccccaggc

SEQ ID NO: 361898 - DNA, 12 bp, Homo sapiens
ctgccccccttc

SEQ ID NO: 361899 - DNA, 15 bp, Homo sapiens
ctgccccccttccca

SEQ ID NO: 361900 - DNA, 22 bp, Homo sapiens
ctgcccccgcgggttctagacg

SEQ ID NO: 361901 - DNA, 18 bp, Homo sapiens
ctgcccccgtcccacctc

SEQ ID NO: 361902 - DNA, 16 bp, Homo sapiens
ctgcccccgttccagc

SEQ ID NO: 361903 - DNA, 20 bp, Homo sapiens
ctgcccccgttccagctgac

SEQ ID NO: 361904 - DNA, 21 bp, Homo sapiens
ctgcccccgttccagctgaca

SEQ ID NO: 361905 - DNA, 14 bp, Homo sapiens
ctgcccccttctcc

SEQ ID NO: 361906 - DNA, 19 bp, Homo sapiens
ctgcccccttctcccacac

SEQ ID NO: 361907 - DNA, 23 bp, Homo sapiens
ctgcccccttctcccacactgct

SEQ ID NO: 361908 - DNA, 16 bp, Homo sapiens
ctgccccgccccccag

SEQ ID NO: 361909 - DNA, 21 bp, Homo sapiens
ctgccccgccccccagagcca

SEQ ID NO: 361910 - DNA, 22 bp, Homo sapiens
ctgccccgtcccctgggccacc

SEQ ID NO: 361911 - DNA, 23 bp, Homo sapiens
ctgccccgtcccctgggccaccc

SEQ ID NO: 361912 - DNA, 16 bp, Homo sapiens
ctgccccgttccctgt

SEQ ID NO: 361913 - DNA, 18 bp, Homo sapiens
ctgcccctccccagccct

SEQ ID NO: 361914 - DNA, 13 bp, Homo sapiens
ctgcccctccctt

SEQ ID NO: 361915 - DNA, 18 bp, Homo sapiens
ctgcccctccgtccccag

SEQ ID NO: 361916 - DNA, 21 bp, Homo sapiens
ctgcccctccgtccccagggt

SEQ ID NO: 361917 - DNA, 10 bp, Homo sapiens
ctgcccctgc

SEQ ID NO: 361918 - DNA, 13 bp, Homo sapiens
ctgcccctgcccc

SEQ ID NO: 361919 - DNA, 14 bp, Homo sapiens
ctgcccctgccccg

SEQ ID NO: 361920 - DNA, 16 bp, Homo sapiens
ctgcccctgccccgtc

SEQ ID NO: 361921 - DNA, 17 bp, Homo sapiens
ctgcccctgccccgtca

SEQ ID NO: 361922 - DNA, 12 bp, Homo sapiens
ctgcccctgtct

SEQ ID NO: 361923 - DNA, 17 bp, Homo sapiens
ctgcccctgtctggaag

SEQ ID NO: 361924 - DNA, 19 bp, Homo sapiens
ctgccccttctacactctc

SEQ ID NO: 361925 - DNA, 21 bp, Homo sapiens
ctgccccttctacactctcct

SEQ ID NO: 361926 - DNA, 22 bp, Homo sapiens
ctgccccttctacactctcctg

SEQ ID NO: 361927 - DNA, 17 bp, Homo sapiens
ctgccccttgaccccac

SEQ ID NO: 361928 - DNA, 19 bp, Homo sapiens
ctgccccttgaccccacac

SEQ ID NO: 361929 - DNA, 22 bp, Homo sapiens
ctgccccttgaccccacacgcc

SEQ ID NO: 361930 - DNA, 13 bp, Homo sapiens
ctgccccttgctt

SEQ ID NO: 361931 - DNA, 15 bp, Homo sapiens
ctgccccttgcttct

SEQ ID NO: 361932 - DNA, 17 bp, Homo sapiens
ctgccccttgcttctca

SEQ ID NO: 361933 - DNA, 13 bp, Homo sapiens
ctgccccttgggc

SEQ ID NO: 361934 - DNA, 18 bp, Homo sapiens
ctgccccttgggcatcca

SEQ ID NO: 361935 - DNA, 22 bp, Homo sapiens
ctgcccgagagctcttagtttt

SEQ ID NO: 361936 - DNA, 15 bp, Homo sapiens
ctgcccgagctggtg

SEQ ID NO: 361937 - DNA, 16 bp, Homo sapiens
ctgcccgcacaccctc

SEQ ID NO: 361938 - DNA, 18 bp, Homo sapiens
ctgcccgcacagcagcct

SEQ ID NO: 361939 - DNA, 21 bp, Homo sapiens
ctgcccgcacagcagcctgct

SEQ ID NO: 361940 - DNA, 14 bp, Homo sapiens
ctgcccgcagagcc

SEQ ID NO: 361941 - DNA, 15 bp, Homo sapiens
ctgcccgcagagccc

SEQ ID NO: 361942 - DNA, 21 bp, Homo sapiens
ctgcccgctgcaatgcctaga

SEQ ID NO: 361943 - DNA, 13 bp, Homo sapiens
ctgcccggggcag

SEQ ID NO: 361944 - DNA, 21 bp, Homo sapiens
ctgcccggggcagctgccaga

SEQ ID NO: 361945 - DNA, 20 bp, Homo sapiens
ctgcccggtggtttgccatg

SEQ ID NO: 361946 - DNA, 21 bp, Homo sapiens
ctgcccggtggtttgccatgt

SEQ ID NO: 361947 - DNA, 20 bp, Homo sapiens
ctgccctcactccactcccc

SEQ ID NO: 361948 - DNA, 16 bp, Homo sapiens
ctgccctcagatgaaa

SEQ ID NO: 361949 - DNA, 23 bp, Homo sapiens
ctgccctcccatgttgcatgcct

SEQ ID NO: 361950 - DNA, 21 bp, Homo sapiens
ctgccctccccagagcactgg

SEQ ID NO: 361951 - DNA, 13 bp, Homo sapiens
ctgccctccccca

SEQ ID NO: 361952 - DNA, 20 bp, Homo sapiens
ctgccctccctcggccccac

SEQ ID NO: 361953 - DNA, 15 bp, Homo sapiens
ctgctgagctctgac

SEQ ID NO: 361954 - DNA, 20 bp, Homo sapiens
ctgctgatgctgaaataaac

SEQ ID NO: 361955 - DNA, 17 bp, Homo sapiens
ctgctgatgtaggagct

SEQ ID NO: 361956 - DNA, 18 bp, Homo sapiens
ctgctgatgtaggagctg

SEQ ID NO: 361957 - DNA, 23 bp, Homo sapiens
ctgctgcaccaacctcactgccc

SEQ ID NO: 361958 - DNA, 15 bp, Homo sapiens
ctgctgcaccagagt

SEQ ID NO: 361959 - DNA, 21 bp, Homo sapiens
ctgctgccatgattttggcca

SEQ ID NO: 361960 - DNA, 23 bp, Homo sapiens
ctgctgccatgattttggccact

SEQ ID NO: 361961 - DNA, 12 bp, Homo sapiens
ctgctgcccacg

SEQ ID NO: 361962 - DNA, 22 bp, Homo sapiens
ctgctgcccacggccacccacc

SEQ ID NO: 361963 - DNA, 12 bp, Homo sapiens
ctgctgcccagc

SEQ ID NO: 361964 - DNA, 22 bp, Homo sapiens
ctgctgcccagcctccaagctc

SEQ ID NO: 361965 - DNA, 18 bp, Homo sapiens
ctgctgccccaaaggaag

SEQ ID NO: 361966 - DNA, 22 bp, Homo sapiens
ctgctgccccagctgactgtgg

SEQ ID NO: 361967 - DNA, 12 bp, Homo sapiens
ctgctgccctcc

SEQ ID NO: 361968 - DNA, 13 bp, Homo sapiens
ctgctgccctcca

SEQ ID NO: 361969 - DNA, 17 bp, Homo sapiens
ctgctgccgcctcccag

SEQ ID NO: 361970 - DNA, 20 bp, Homo sapiens
ctgctgccgcctcccagcct

SEQ ID NO: 361971 - DNA, 14 bp, Homo sapiens
ctgctgcctcccca

SEQ ID NO: 361972 - DNA, 21 bp, Homo sapiens
ctgctgcctccctggggacca

SEQ ID NO: 361973 - DNA, 20 bp, Homo sapiens
ctgctgcgcccttaccttcc

SEQ ID NO: 361974 - DNA, 16 bp, Homo sapiens
ctgctgcgtcagacca

SEQ ID NO: 361975 - DNA, 14 bp, Homo sapiens
ctgctgctcccagc

SEQ ID NO: 361976 - DNA, 15 bp, Homo sapiens
ctgctgctcccagcc

SEQ ID NO: 361977 - DNA, 13 bp, Homo sapiens
ctgctgctcccca

SEQ ID NO: 361978 - DNA, 12 bp, Homo sapiens
ctgctgctcctc

SEQ ID NO: 361979 - DNA, 15 bp, Homo sapiens
ctgctgctcctcttt

SEQ ID NO: 361980 - DNA, 17 bp, Homo sapiens
ctgctgctcctctttcc

SEQ ID NO: 361981 - DNA, 19 bp, Homo sapiens
ctgctgctcctctttcccc

SEQ ID NO: 361982 - DNA, 17 bp, Homo sapiens
ctgctgctcgggaaggc

SEQ ID NO: 361983 - DNA, 22 bp, Homo sapiens
ctgctgctcgggaaggcctgag

SEQ ID NO: 361984 - DNA, 14 bp, Homo sapiens
ctgctgctgcctgc

SEQ ID NO: 361985 - DNA, 15 bp, Homo sapiens
ctgctgctgcctgcc

SEQ ID NO: 361986 - DNA, 15 bp, Homo sapiens
ctgctgctgcgccct

SEQ ID NO: 361987 - DNA, 14 bp, Homo sapiens
ctgctgctggtcac

SEQ ID NO: 361988 - DNA, 10 bp, Homo sapiens
ctgctgctgt

SEQ ID NO: 361989 - DNA, 21 bp, Homo sapiens
ctgctgctgtaactgctgagc

SEQ ID NO: 361990 - DNA, 23 bp, Homo sapiens
ctgctgctgtaactgctgagcca

SEQ ID NO: 361991 - DNA, 20 bp, Homo sapiens
ctgctgcttctgggcctgat

SEQ ID NO: 361992 - DNA, 19 bp, Homo sapiens
ctgctggaccaaggtgcgg

SEQ ID NO: 361993 - DNA, 22 bp, Homo sapiens
ctgctggaccaaggtgcggacc

SEQ ID NO: 361994 - DNA, 22 bp, Homo sapiens
ctgctggagaataaatttggga

SEQ ID NO: 361995 - DNA, 15 bp, Homo sapiens
ctgctggccaaagtc

SEQ ID NO: 361996 - DNA, 18 bp, Homo sapiens
ctgctggccaaagtcagt

SEQ ID NO: 361997 - DNA, 15 bp, Homo sapiens
ctgctggcccagcca

SEQ ID NO: 361998 - DNA, 23 bp, Homo sapiens
ctgctggcccctcacctgggcac

SEQ ID NO: 361999 - DNA, 12 bp, Homo sapiens
ctgctggcctgg

SEQ ID NO: 362000 - DNA, 15 bp, Homo sapiens
ctgctggcctggatc

SEQ ID NO: 362001 - DNA, 16 bp, Homo sapiens
ctgctggcgggaatac

SEQ ID NO: 362002 - DNA, 11 bp, Homo sapiens
ctgctggctga

SEQ ID NO: 362003 - DNA, 17 bp, Homo sapiens
ctgctggctgaggcttg

SEQ ID NO: 362004 - DNA, 12 bp, Homo sapiens
ctgctggctgcc

SEQ ID NO: 362005 - DNA, 14 bp, Homo sapiens
ctgctggctgcctt

SEQ ID NO: 362006 - DNA, 15 bp, Homo sapiens
ctgctgggaagtggc

SEQ ID NO: 362007 - DNA, 15 bp, Homo sapiens
ctgctgggagcagaa

SEQ ID NO: 362008 - DNA, 23 bp, Homo sapiens
ctgctggggcatgtgtgcctgtg

SEQ ID NO: 362009 - DNA, 14 bp, Homo sapiens
ctgctgggtttcca

SEQ ID NO: 362010 - DNA, 20 bp, Homo sapiens
ctgctgggtttccacacagc

SEQ ID NO: 362011 - DNA, 21 bp, Homo sapiens
ctgctgggtttccacacagcc

SEQ ID NO: 362012 - DNA, 17 bp, Homo sapiens
ctgctggtcttcaatta

SEQ ID NO: 362013 - DNA, 19 bp, Homo sapiens
ctgctggttttggtttcca

SEQ ID NO: 362014 - DNA, 20 bp, Homo sapiens
ctgctggttttggtttccac

SEQ ID NO: 362015 - DNA, 20 bp, Homo sapiens
ctgctgtaagacggccttgg

SEQ ID NO: 362016 - DNA, 19 bp, Homo sapiens
ctgctgtatccagaagaaa

SEQ ID NO: 362017 - DNA, 20 bp, Homo sapiens
ctgctgtcagaccttcttcc

SEQ ID NO: 362018 - DNA, 22 bp, Homo sapiens
ctgctgtcattgtccatgccta

SEQ ID NO: 362019 - DNA, 16 bp, Homo sapiens
ctgctgtccctcctga

SEQ ID NO: 362020 - DNA, 14 bp, Homo sapiens
ctgctgtgcctgcg

SEQ ID NO: 362021 - DNA, 14 bp, Homo sapiens
ctgctgtgctctgg

SEQ ID NO: 362022 - DNA, 13 bp, Homo sapiens
ctgctgtggaaag

SEQ ID NO: 362023 - DNA, 23 bp, Homo sapiens
ctgctgtggcatcaggaaaggaa

SEQ ID NO: 362024 - DNA, 20 bp, Homo sapiens
ctgctgttgccatagcccca

SEQ ID NO: 362025 - DNA, 17 bp, Homo sapiens
ctgctgttttatgtcat

SEQ ID NO: 362026 - DNA, 17 bp, Homo sapiens
ctgcttaccaaaacata

SEQ ID NO: 362027 - DNA, 21 bp, Homo sapiens
ctgcttagaacccttctgctt

SEQ ID NO: 362028 - DNA, 15 bp, Homo sapiens
ctgcttaggagagac

SEQ ID NO: 362029 - DNA, 13 bp, Homo sapiens
ctgcttatctgaa

SEQ ID NO: 362030 - DNA, 21 bp, Homo sapiens
ctgcttcacggactctttgct

SEQ ID NO: 362031 - DNA, 20 bp, Homo sapiens
ctgcttcatatctctccctt

SEQ ID NO: 362032 - DNA, 22 bp, Homo sapiens
ctgcttcatatctctcccttct

SEQ ID NO: 362033 - DNA, 23 bp, Homo sapiens
ctgcttcatatctctcccttctt

SEQ ID NO: 362034 - DNA, 22 bp, Homo sapiens
ctgcttccaggtatgggacctg

SEQ ID NO: 362035 - DNA, 22 bp, Homo sapiens
ctgcttccagttggactgtggc

SEQ ID NO: 362036 - DNA, 15 bp, Homo sapiens
ctgcttcccaaactc

SEQ ID NO: 362037 - DNA, 23 bp, Homo sapiens
ctgcttcccaaactcccaggacc

SEQ ID NO: 362038 - DNA, 22 bp, Homo sapiens
ctgcttccctctgcctgtccct

SEQ ID NO: 362039 - DNA, 13 bp, Homo sapiens
ctgcttctccacc

SEQ ID NO: 362040 - DNA, 17 bp, Homo sapiens
ctgcttctccacctccc

SEQ ID NO: 362041 - DNA, 17 bp, Homo sapiens
ctgcttctcggaggcca

SEQ ID NO: 362042 - DNA, 22 bp, Homo sapiens
ctgcttctcggaggccaggccc

SEQ ID NO: 362043 - DNA, 15 bp, Homo sapiens
ctgcttctgctgccc

SEQ ID NO: 362044 - DNA, 18 bp, Homo sapiens
ctgcttctgctgccctga

SEQ ID NO: 362045 - DNA, 14 bp, Homo sapiens
ctgcttctgctttt

SEQ ID NO: 362046 - DNA, 15 bp, Homo sapiens
ctgcttctgggcctg

SEQ ID NO: 362047 - DNA, 12 bp, Homo sapiens
ctgcttctgggg

SEQ ID NO: 362048 - DNA, 20 bp, Homo sapiens
ctgcttctgtgcatttgtgt

SEQ ID NO: 362049 - DNA, 18 bp, Homo sapiens
ctgcttcttccccagggt

SEQ ID NO: 362050 - DNA, 19 bp, Homo sapiens
ctgcttcttccccagggtt

SEQ ID NO: 362051 - DNA, 12 bp, Homo sapiens
ctgcttgcattt

SEQ ID NO: 362052 - DNA, 14 bp, Homo sapiens
ctgcttgcatttct

SEQ ID NO: 362053 - DNA, 19 bp, Homo sapiens
ctgcttgcccgctcccaca

SEQ ID NO: 362054 - DNA, 20 bp, Homo sapiens
ctgcttggacctcgtgcttt

SEQ ID NO: 362055 - DNA, 13 bp, Homo sapiens
ctgcttggatcca

SEQ ID NO: 362056 - DNA, 15 bp, Homo sapiens
ctgcttggctgtccc

SEQ ID NO: 362057 - DNA, 22 bp, Homo sapiens
ctgcttggctgtcccctccatc

SEQ ID NO: 362058 - DNA, 24 bp, Homo sapiens
ctgcttgtactaagccaggaggct

SEQ ID NO: 362059 - DNA, 14 bp, Homo sapiens
ctgcttgtcttaga

SEQ ID NO: 362060 - DNA, 16 bp, Homo sapiens
ctgcttgtgcctccct

SEQ ID NO: 362061 - DNA, 21 bp, Homo sapiens
ctgcttgtgcctcccttccca

SEQ ID NO: 362062 - DNA, 19 bp, Homo sapiens
ctgctttcaacttaaatca

SEQ ID NO: 362063 - DNA, 21 bp, Homo sapiens
ctgctttcaacttaaatcact

SEQ ID NO: 362064 - DNA, 21 bp, Homo sapiens
ctgctttctattacccctcat

SEQ ID NO: 362065 - DNA, 13 bp, Homo sapiens
ctgctttctcttt

SEQ ID NO: 362066 - DNA, 17 bp, Homo sapiens
ctgctttctctttcagt

SEQ ID NO: 362067 - DNA, 18 bp, Homo sapiens
ctgctttcttgccacaca

SEQ ID NO: 362068 - DNA, 20 bp, Homo sapiens
ctgctttgactgagcagact

SEQ ID NO: 362069 - DNA, 10 bp, Homo sapiens
ctgctttgct

SEQ ID NO: 362070 - DNA, 17 bp, Homo sapiens
ctgctttgggctgccct

SEQ ID NO: 362071 - DNA, 18 bp, Homo sapiens
ctgctttgggctgccctg

SEQ ID NO: 362072 - DNA, 19 bp, Homo sapiens
ctgctttgggctgccctgg

SEQ ID NO: 362073 - DNA, 20 bp, Homo sapiens
ctgctttgggctgccctggt

SEQ ID NO: 362074 - DNA, 18 bp, Homo sapiens
ctgctttgttaatgaaaa

SEQ ID NO: 362075 - DNA, 13 bp, Homo sapiens
ctgcttttccagg

SEQ ID NO: 362076 - DNA, 21 bp, Homo sapiens
ctgcttttccaggatcctgca

SEQ ID NO: 362077 - DNA, 22 bp, Homo sapiens
ctgcttttccaggatcctgcag

SEQ ID NO: 362078 - DNA, 15 bp, Homo sapiens
ctgcttttccctaag

SEQ ID NO: 362079 - DNA, 21 bp, Homo sapiens
ctgcttttccctaagccaagg

SEQ ID NO: 362080 - DNA, 13 bp, Homo sapiens
ctgcttttgatgg

SEQ ID NO: 362081 - DNA, 19 bp, Homo sapiens
ctgcttttttttttccagc

SEQ ID NO: 362082 - DNA, 18 bp, Homo sapiens
ctggaaaaaaaaaaatat

SEQ ID NO: 362083 - DNA, 16 bp, Homo sapiens
ctggcggcgcagaggg

SEQ ID NO: 362084 - DNA, 15 bp, Homo sapiens
ctggcggcttcctgt

SEQ ID NO: 362085 - DNA, 20 bp, Homo sapiens
ctggcgggcagcccctgctg

SEQ ID NO: 362086 - DNA, 14 bp, Homo sapiens
ctggcgtctgtctt

SEQ ID NO: 362087 - DNA, 23 bp, Homo sapiens
ctggcgtctgtcttcaagggctt

SEQ ID NO: 362088 - DNA, 19 bp, Homo sapiens
ctggctacatcccagcctg

SEQ ID NO: 362089 - DNA, 20 bp, Homo sapiens
ctggctagaggccagcccca

SEQ ID NO: 362090 - DNA, 21 bp, Homo sapiens
ctggctagaggccagccccac

SEQ ID NO: 362091 - DNA, 23 bp, Homo sapiens
ctggctagaggccagccccaccc

SEQ ID NO: 362092 - DNA, 16 bp, Homo sapiens
ctggctagagtcctca

SEQ ID NO: 362093 - DNA, 20 bp, Homo sapiens
ctggctagagtcctcactcc

SEQ ID NO: 362094 - DNA, 14 bp, Homo sapiens
ctggctcacagcca

SEQ ID NO: 362095 - DNA, 21 bp, Homo sapiens
ctggctcagcctcaaatgcag

SEQ ID NO: 362096 - DNA, 11 bp, Homo sapiens
ctggctcaggg

SEQ ID NO: 362097 - DNA, 23 bp, Homo sapiens
ctggctcagggatcttctccctc

SEQ ID NO: 362098 - DNA, 23 bp, Homo sapiens
ctggctcatattcctgcagcctg

SEQ ID NO: 362099 - DNA, 13 bp, Homo sapiens
ctggctcatctct

SEQ ID NO: 362100 - DNA, 17 bp, Homo sapiens
ctggctccacgccctgg

SEQ ID NO: 362101 - DNA, 19 bp, Homo sapiens
ctggctccacgccctgggg

SEQ ID NO: 362102 - DNA, 20 bp, Homo sapiens
ctggctccacgccctgggga

SEQ ID NO: 362103 - DNA, 14 bp, Homo sapiens
ctggctccaggctc

SEQ ID NO: 362104 - DNA, 18 bp, Homo sapiens
ctggctccaggctccagg

SEQ ID NO: 362105 - DNA, 15 bp, Homo sapiens
ctggctcccaggaca

SEQ ID NO: 362106 - DNA, 16 bp, Homo sapiens
ctggctcccaggacac

SEQ ID NO: 362107 - DNA, 15 bp, Homo sapiens
ctggctcccagggcc

SEQ ID NO: 362108 - DNA, 16 bp, Homo sapiens
ctggctcccagggcca

SEQ ID NO: 362109 - DNA, 18 bp, Homo sapiens
ctggctcccagggccatg

SEQ ID NO: 362110 - DNA, 17 bp, Homo sapiens
ctggctccgctgtgtgg

SEQ ID NO: 362111 - DNA, 12 bp, Homo sapiens
ctggctcctcaa

SEQ ID NO: 362112 - DNA, 15 bp, Homo sapiens
ctggctctctccagg

SEQ ID NO: 362113 - DNA, 14 bp, Homo sapiens
ctggctctgtggct

SEQ ID NO: 362114 - DNA, 12 bp, Homo sapiens
ctggctgaaaat

SEQ ID NO: 362115 - DNA, 18 bp, Homo sapiens
ctggctgaaaatcactat

SEQ ID NO: 362116 - DNA, 12 bp, Homo sapiens
ctggctgaggct

SEQ ID NO: 362117 - DNA, 15 bp, Homo sapiens
ctggctgcacagccc

SEQ ID NO: 362118 - DNA, 18 bp, Homo sapiens
ctggctgcacagcccaac

SEQ ID NO: 362119 - DNA, 12 bp, Homo sapiens
ctggctgccagg

SEQ ID NO: 362120 - DNA, 22 bp, Homo sapiens
ctggctgccaggcgttggtgcc

SEQ ID NO: 362121 - DNA, 23 bp, Homo sapiens
ctggctgccaggcgttggtgcca

SEQ ID NO: 362122 - DNA, 12 bp, Homo sapiens
ctggctgcccag

SEQ ID NO: 362123 - DNA, 21 bp, Homo sapiens
ctggctgccccaacctgctga

SEQ ID NO: 362124 - DNA, 15 bp, Homo sapiens
ctggctgcctggccc

SEQ ID NO: 362125 - DNA, 14 bp, Homo sapiens
ctggctgccttaga

SEQ ID NO: 362126 - DNA, 15 bp, Homo sapiens
ctggctgctctgtct

SEQ ID NO: 362127 - DNA, 16 bp, Homo sapiens
ctggctgctctgtctt

SEQ ID NO: 362128 - DNA, 15 bp, Homo sapiens
ctggctggagaggaa

SEQ ID NO: 362129 - DNA, 15 bp, Homo sapiens
ctggctggggacttg

SEQ ID NO: 362130 - DNA, 13 bp, Homo sapiens
ctggctggggatg

SEQ ID NO: 362131 - DNA, 17 bp, Homo sapiens
ctggctggggcagaggg

SEQ ID NO: 362132 - DNA, 22 bp, Homo sapiens
ctggctggggcagaggggcagc

SEQ ID NO: 362133 - DNA, 18 bp, Homo sapiens
ctggctgggtcgcccctc

SEQ ID NO: 362134 - DNA, 19 bp, Homo sapiens
ctggctgggttcaggtccc

SEQ ID NO: 362135 - DNA, 16 bp, Homo sapiens
ctggctgtaaatccta

SEQ ID NO: 362136 - DNA, 19 bp, Homo sapiens
ctggctgtcagtatgacat

SEQ ID NO: 362137 - DNA, 15 bp, Homo sapiens
ctggctgtctgcctg

SEQ ID NO: 362138 - DNA, 14 bp, Homo sapiens
ctggctgtgagcag

SEQ ID NO: 362139 - DNA, 17 bp, Homo sapiens
ctggctgtgagcagcct

SEQ ID NO: 362140 - DNA, 19 bp, Homo sapiens
ctggctgtgcctcccccgc

SEQ ID NO: 362141 - DNA, 15 bp, Homo sapiens
ctggctgtggaggcc

SEQ ID NO: 362142 - DNA, 18 bp, Homo sapiens
ctggctgtggaggcctga

SEQ ID NO: 362143 - DNA, 20 bp, Homo sapiens
ctggctgtggaggcctgatg

SEQ ID NO: 362144 - DNA, 21 bp, Homo sapiens
ctggctgtggaggcctgatgc

SEQ ID NO: 362145 - DNA, 17 bp, Homo sapiens
ctggctgtggcccctcc

SEQ ID NO: 362146 - DNA, 18 bp, Homo sapiens
ctggctgtggcccctcct

SEQ ID NO: 362147 - DNA, 16 bp, Homo sapiens
ctggctgtgtgacttt

SEQ ID NO: 362148 - DNA, 19 bp, Homo sapiens
ctggcttagcgttctgttt

SEQ ID NO: 362149 - DNA, 15 bp, Homo sapiens
ctggcttcccaggac

SEQ ID NO: 362150 - DNA, 21 bp, Homo sapiens
ctggcttccgctgtcacccag

SEQ ID NO: 362151 - DNA, 14 bp, Homo sapiens
ctggcttctccctg

SEQ ID NO: 362152 - DNA, 19 bp, Homo sapiens
ctggcttctccctggactc

SEQ ID NO: 362153 - DNA, 13 bp, Homo sapiens
ctggcttgctcca

SEQ ID NO: 362154 - DNA, 15 bp, Homo sapiens
ctggcttgctccagg

SEQ ID NO: 362155 - DNA, 18 bp, Homo sapiens
ctggcttgctccagggtc

SEQ ID NO: 362156 - DNA, 23 bp, Homo sapiens
ctggcttgggactaaatgccctg

SEQ ID NO: 362157 - DNA, 18 bp, Homo sapiens
ctggctttacattttatt

SEQ ID NO: 362158 - DNA, 15 bp, Homo sapiens
ctggctttgcccaac

SEQ ID NO: 362159 - DNA, 17 bp, Homo sapiens
ctggctttgcccaacct

SEQ ID NO: 362160 - DNA, 19 bp, Homo sapiens
ctggctttgcccaacctca

SEQ ID NO: 362161 - DNA, 14 bp, Homo sapiens
ctggctttgtccca

SEQ ID NO: 362162 - DNA, 20 bp, Homo sapiens
ctggctttgtcccacagctt

SEQ ID NO: 362163 - DNA, 21 bp, Homo sapiens
ctggctttgtcccacagcttg

SEQ ID NO: 362164 - DNA, 18 bp, Homo sapiens
ctggctttgttcttgtca

SEQ ID NO: 362165 - DNA, 20 bp, Homo sapiens
ctggcttttcactgctggct

SEQ ID NO: 362166 - DNA, 17 bp, Homo sapiens
ctggctttttcccagcc

SEQ ID NO: 362167 - DNA, 19 bp, Homo sapiens
ctggctttttgtcaaataa

SEQ ID NO: 362168 - DNA, 18 bp, Homo sapiens
ctgggaaaacagtgaatc

SEQ ID NO: 362169 - DNA, 11 bp, Homo sapiens
ctgggaaaggt

SEQ ID NO: 362170 - DNA, 14 bp, Homo sapiens
ctgggaaaggtgct

SEQ ID NO: 362171 - DNA, 23 bp, Homo sapiens
ctgggaaatggcttgaagccaag

SEQ ID NO: 362172 - DNA, 20 bp, Homo sapiens
ctgggaacaccccataacta

SEQ ID NO: 362173 - DNA, 18 bp, Homo sapiens
ctgggaacccgactgtga

SEQ ID NO: 362174 - DNA, 19 bp, Homo sapiens
ctgggaaccttcctgtctt

SEQ ID NO: 362175 - DNA, 15 bp, Homo sapiens
ctgggaacggggtgg

SEQ ID NO: 362176 - DNA, 18 bp, Homo sapiens
ctgggaactcccaagaac

SEQ ID NO: 362177 - DNA, 22 bp, Homo sapiens
ctgggaagataggctctgcaca

SEQ ID NO: 362178 - DNA, 18 bp, Homo sapiens
ctgggaagatgctggccc

SEQ ID NO: 362179 - DNA, 20 bp, Homo sapiens
ctgggaagatgctggcccca

SEQ ID NO: 362180 - DNA, 20 bp, Homo sapiens
ctgggaagctgtactcagag

SEQ ID NO: 362181 - DNA, 21 bp, Homo sapiens
ctgggaagctgtactcagagc

SEQ ID NO: 362182 - DNA, 22 bp, Homo sapiens
ctgggaagcttgagcctccccc

SEQ ID NO: 362183 - DNA, 17 bp, Homo sapiens
ctgggaaggagggagct

SEQ ID NO: 362184 - DNA, 20 bp, Homo sapiens
ctgggaaggagggagctgct

SEQ ID NO: 362185 - DNA, 13 bp, Homo sapiens
ctgggaagggaag

SEQ ID NO: 362186 - DNA, 12 bp, Homo sapiens
ctgggaaggggt

SEQ ID NO: 362187 - DNA, 13 bp, Homo sapiens
ctgggaatgtatt

SEQ ID NO: 362188 - DNA, 22 bp, Homo sapiens
ctgggaatgtattattctgcag

SEQ ID NO: 362189 - DNA, 22 bp, Homo sapiens
ctgggaccacaggttcatgcca

SEQ ID NO: 362190 - DNA, 14 bp, Homo sapiens
ctgggacccagcta

SEQ ID NO: 362191 - DNA, 21 bp, Homo sapiens
ctgggacccagctactctgtc

SEQ ID NO: 362192 - DNA, 22 bp, Homo sapiens
ctgggacccagctactctgtcc

SEQ ID NO: 362193 - DNA, 23 bp, Homo sapiens
ctgggacccctcccaacctcaat

SEQ ID NO: 362194 - DNA, 22 bp, Homo sapiens
ctgggaccctcggggcaggaag

SEQ ID NO: 362195 - DNA, 13 bp, Homo sapiens
ctgggactctcct

SEQ ID NO: 362196 - DNA, 19 bp, Homo sapiens
ctgggactctcctcctccc

SEQ ID NO: 362197 - DNA, 20 bp, Homo sapiens
ctgggactctcctcctcccc

SEQ ID NO: 362198 - DNA, 21 bp, Homo sapiens
ctgggactctcctcctcccct

SEQ ID NO: 362199 - DNA, 16 bp, Homo sapiens
ctgggacttccttgct

SEQ ID NO: 362200 - DNA, 15 bp, Homo sapiens
ctgggagaaggtgct

SEQ ID NO: 362201 - DNA, 19 bp, Homo sapiens
ctgggagaaggtgcttggg

SEQ ID NO: 362202 - DNA, 14 bp, Homo sapiens
ctgggagagccaag

SEQ ID NO: 362203 - DNA, 17 bp, Homo sapiens
ctgggagaggcagagtg

SEQ ID NO: 362204 - DNA, 15 bp, Homo sapiens
ctgggagcagaacag

SEQ ID NO: 362205 - DNA, 17 bp, Homo sapiens
ctgggagccacttctcc

SEQ ID NO: 362206 - DNA, 18 bp, Homo sapiens
ctgggagccacttctccc

SEQ ID NO: 362207 - DNA, 19 bp, Homo sapiens
ctgggagccacttctcccc

SEQ ID NO: 362208 - DNA, 15 bp, Homo sapiens
ctgggagcctcgccc

SEQ ID NO: 362209 - DNA, 21 bp, Homo sapiens
ctgggagcctcgcccctccag

SEQ ID NO: 362210 - DNA, 14 bp, Homo sapiens
ctgggagctctgca

SEQ ID NO: 362211 - DNA, 22 bp, Homo sapiens
ctgggaggcaggtcccgagccc

SEQ ID NO: 362212 - DNA, 19 bp, Homo sapiens
ctgggagggcaagggtcct

SEQ ID NO: 362213 - DNA, 17 bp, Homo sapiens
ctgtaggagtaaagata

SEQ ID NO: 362214 - DNA, 18 bp, Homo sapiens
ctgtaggcgcccctgggg

SEQ ID NO: 362215 - DNA, 14 bp, Homo sapiens
ctgtagggctggac

SEQ ID NO: 362216 - DNA, 16 bp, Homo sapiens
ctgtagggctggacct

SEQ ID NO: 362217 - DNA, 18 bp, Homo sapiens
ctgtagggctggacctat

SEQ ID NO: 362218 - DNA, 18 bp, Homo sapiens
ctgtagtactccttaaga

SEQ ID NO: 362219 - DNA, 23 bp, Homo sapiens
ctgtagtactccttaagaacaca

SEQ ID NO: 362220 - DNA, 18 bp, Homo sapiens
ctgtagtagccctttctg

SEQ ID NO: 362221 - DNA, 17 bp, Homo sapiens
ctgtagtgagaaactga

SEQ ID NO: 362222 - DNA, 13 bp, Homo sapiens
ctgtagtgcccct

SEQ ID NO: 362223 - DNA, 15 bp, Homo sapiens
ctgtagtgcccctcc

SEQ ID NO: 362224 - DNA, 13 bp, Homo sapiens
ctgtagtgttttg

SEQ ID NO: 362225 - DNA, 13 bp, Homo sapiens
ctgtagtttatgg

SEQ ID NO: 362226 - DNA, 14 bp, Homo sapiens
ctgtataaacaagc

SEQ ID NO: 362227 - DNA, 14 bp, Homo sapiens
ctgtatacaaacag

SEQ ID NO: 362228 - DNA, 20 bp, Homo sapiens
ctgtatacaaacaggtgcta

SEQ ID NO: 362229 - DNA, 16 bp, Homo sapiens
ctgtatagttaggata

SEQ ID NO: 362230 - DNA, 21 bp, Homo sapiens
ctgtatagttaggatagcatt

SEQ ID NO: 362231 - DNA, 15 bp, Homo sapiens
ctgtatcaagcccct

SEQ ID NO: 362232 - DNA, 17 bp, Homo sapiens
ctgtatcaagcccctgt

SEQ ID NO: 362233 - DNA, 17 bp, Homo sapiens
ctgtatctaaaaaataa

SEQ ID NO: 362234 - DNA, 20 bp, Homo sapiens
ctgtatctaaaaaataactg

SEQ ID NO: 362235 - DNA, 21 bp, Homo sapiens
ctgtatgatttaggcttctat

SEQ ID NO: 362236 - DNA, 20 bp, Homo sapiens
ctgtatgtcaactttatgca

SEQ ID NO: 362237 - DNA, 20 bp, Homo sapiens
ctgtattaactgaattctga

SEQ ID NO: 362238 - DNA, 17 bp, Homo sapiens
ctgtattcatacagcac

SEQ ID NO: 362239 - DNA, 18 bp, Homo sapiens
ctgtattcatacagcact

SEQ ID NO: 362240 - DNA, 20 bp, Homo sapiens
ctgtattctgcaacagcctg

SEQ ID NO: 362241 - DNA, 20 bp, Homo sapiens
ctgtattgcagctaagctca

SEQ ID NO: 362242 - DNA, 18 bp, Homo sapiens
ctgtatttatgtgtgagg

SEQ ID NO: 362243 - DNA, 23 bp, Homo sapiens
ctgtatttatgtgtgaggagctg

SEQ ID NO: 362244 - DNA, 17 bp, Homo sapiens
ctgtatttctgtggaaa

SEQ ID NO: 362245 - DNA, 14 bp, Homo sapiens
ctgtatttgagact

SEQ ID NO: 362246 - DNA, 16 bp, Homo sapiens
ctgtattttcaggaag

SEQ ID NO: 362247 - DNA, 12 bp, Homo sapiens
ctgtattttctt

SEQ ID NO: 362248 - DNA, 21 bp, Homo sapiens
ctgtattttcttttatatctg

SEQ ID NO: 362249 - DNA, 19 bp, Homo sapiens
ctgtatttttaaattctgc

SEQ ID NO: 362250 - DNA, 14 bp, Homo sapiens
ctgtcaagtacaag

SEQ ID NO: 362251 - DNA, 18 bp, Homo sapiens
ctgtcaagtcatgatgga

SEQ ID NO: 362252 - DNA, 12 bp, Homo sapiens
ctgtcaataaac

SEQ ID NO: 362253 - DNA, 15 bp, Homo sapiens
ctgtcaccacatctt

SEQ ID NO: 362254 - DNA, 15 bp, Homo sapiens
ctgtcacccagcaag

SEQ ID NO: 362255 - DNA, 19 bp, Homo sapiens
ctgtcacgctctggtgcag

SEQ ID NO: 362256 - DNA, 14 bp, Homo sapiens
ctgtcactcagctg

SEQ ID NO: 362257 - DNA, 18 bp, Homo sapiens
ctgtcactcagctgagaa

SEQ ID NO: 362258 - DNA, 19 bp, Homo sapiens
ctgtcactcagctgagaag

SEQ ID NO: 362259 - DNA, 14 bp, Homo sapiens
ctgtcactgtttct

SEQ ID NO: 362260 - DNA, 19 bp, Homo sapiens
ctgtcactgtttctctgct

SEQ ID NO: 362261 - DNA, 18 bp, Homo sapiens
ctgtcactttgctctggg

SEQ ID NO: 362262 - DNA, 21 bp, Homo sapiens
ctgtcagaccttcttccacag

SEQ ID NO: 362263 - DNA, 18 bp, Homo sapiens
ctgtcagagaatatgacc

SEQ ID NO: 362264 - DNA, 13 bp, Homo sapiens
ctgtcagaggcta

SEQ ID NO: 362265 - DNA, 19 bp, Homo sapiens
ctgtcagataatcggtgca

SEQ ID NO: 362266 - DNA, 21 bp, Homo sapiens
ctgtcagataatcggtgcagc

SEQ ID NO: 362267 - DNA, 20 bp, Homo sapiens
ctgtcagccaacattgcctt

SEQ ID NO: 362268 - DNA, 18 bp, Homo sapiens
ctgtcagccattcctgtt

SEQ ID NO: 362269 - DNA, 13 bp, Homo sapiens
ctgtcagctgagc

SEQ ID NO: 362270 - DNA, 14 bp, Homo sapiens
ctgtcagggccttg

SEQ ID NO: 362271 - DNA, 12 bp, Homo sapiens
ctgtcagtcatg

SEQ ID NO: 362272 - DNA, 17 bp, Homo sapiens
ctgtcagtcatgcgtcc

SEQ ID NO: 362273 - DNA, 14 bp, Homo sapiens
ctgtcagtgtcctc

SEQ ID NO: 362274 - DNA, 20 bp, Homo sapiens
ctgtcagtgtcctcagggct

SEQ ID NO: 362275 - DNA, 14 bp, Homo sapiens
ctgtcagtttgtga

SEQ ID NO: 362276 - DNA, 16 bp, Homo sapiens
ctgtcagtttgtgaag

SEQ ID NO: 362277 - DNA, 20 bp, Homo sapiens
ctgtcagtttgtgaagtgat

SEQ ID NO: 362278 - DNA, 16 bp, Homo sapiens
ctgtcatcactccctg

SEQ ID NO: 362279 - DNA, 19 bp, Homo sapiens
ctgtcatcactccctggat

SEQ ID NO: 362280 - DNA, 20 bp, Homo sapiens
ctgtcatcactccctggatg

SEQ ID NO: 362281 - DNA, 13 bp, Homo sapiens
ctgtcatctgggc

SEQ ID NO: 362282 - DNA, 14 bp, Homo sapiens
ctgtcatctgggcc

SEQ ID NO: 362283 - DNA, 15 bp, Homo sapiens
ctgtcatctgggcca

SEQ ID NO: 362284 - DNA, 14 bp, Homo sapiens
ctgtcattgtccat

SEQ ID NO: 362285 - DNA, 23 bp, Homo sapiens
ctgtcattgtccatgcctacaga

SEQ ID NO: 362286 - DNA, 17 bp, Homo sapiens
ctgtccaaaggaggctg

SEQ ID NO: 362287 - DNA, 21 bp, Homo sapiens
ctgtccaaaggaggctggcag

SEQ ID NO: 362288 - DNA, 17 bp, Homo sapiens
ctgtccaatcacattca

SEQ ID NO: 362289 - DNA, 20 bp, Homo sapiens
ctgtccacctgtgctgctgc

SEQ ID NO: 362290 - DNA, 12 bp, Homo sapiens
ctgtccactctc

SEQ ID NO: 362291 - DNA, 22 bp, Homo sapiens
ctgtccactctcggggcccttg

SEQ ID NO: 362292 - DNA, 23 bp, Homo sapiens
ctgtccactctcggggcccttgg

SEQ ID NO: 362293 - DNA, 15 bp, Homo sapiens
ctgtccagcctgggc

SEQ ID NO: 362294 - DNA, 16 bp, Homo sapiens
ctgtccaggccactgt

SEQ ID NO: 362295 - DNA, 21 bp, Homo sapiens
ctgtccaggccactgtggcca

SEQ ID NO: 362296 - DNA, 18 bp, Homo sapiens
ctgtccatctgtctgtcc

SEQ ID NO: 362297 - DNA, 19 bp, Homo sapiens
ctgtccatctgtctgtcct

SEQ ID NO: 362298 - DNA, 21 bp, Homo sapiens
ctgtccatctgtctgtcctac

SEQ ID NO: 362299 - DNA, 16 bp, Homo sapiens
ctgtcccacaaaatat

SEQ ID NO: 362300 - DNA, 17 bp, Homo sapiens
ctgtcccacaaaatatt

SEQ ID NO: 362301 - DNA, 14 bp, Homo sapiens
ctgtcccaccaact

SEQ ID NO: 362302 - DNA, 18 bp, Homo sapiens
ctgtcccaccaactctgc

SEQ ID NO: 362303 - DNA, 15 bp, Homo sapiens
ctgtcccactgggac

SEQ ID NO: 362304 - DNA, 21 bp, Homo sapiens
ctgtcccagagcttattggcc

SEQ ID NO: 362305 - DNA, 22 bp, Homo sapiens
ctgtcccagagcttattggcca

SEQ ID NO: 362306 - DNA, 23 bp, Homo sapiens
ctgtcccaggggtctccctgagc

SEQ ID NO: 362307 - DNA, 14 bp, Homo sapiens
ctgtcccattctag

SEQ ID NO: 362308 - DNA, 17 bp, Homo sapiens
ctgtcccattctagatc

SEQ ID NO: 362309 - DNA, 21 bp, Homo sapiens
ctgtcccattctagatcctgc

SEQ ID NO: 362310 - DNA, 22 bp, Homo sapiens
ctgtcccattctagatcctgca

SEQ ID NO: 362311 - DNA, 17 bp, Homo sapiens
ctgtcccattctccact

SEQ ID NO: 362312 - DNA, 15 bp, Homo sapiens
ctgtccccctaccca

SEQ ID NO: 362313 - DNA, 21 bp, Homo sapiens
ctgtccccgccttccctcact

SEQ ID NO: 362314 - DNA, 23 bp, Homo sapiens
ctgtcccctccatctggggatgg

SEQ ID NO: 362315 - DNA, 18 bp, Homo sapiens
ctgtcccctccttccagc

SEQ ID NO: 362316 - DNA, 16 bp, Homo sapiens
ctgtcccctctgtcat

SEQ ID NO: 362317 - DNA, 18 bp, Homo sapiens
ctgtcccctctgtcatca

SEQ ID NO: 362318 - DNA, 16 bp, Homo sapiens
ctgtcccgacacagcg

SEQ ID NO: 362319 - DNA, 20 bp, Homo sapiens
ctgtccctaccactgagccc

SEQ ID NO: 362320 - DNA, 21 bp, Homo sapiens
ctgtccctaccactgagccct

SEQ ID NO: 362321 - DNA, 14 bp, Homo sapiens
ctgtccctcctgag

SEQ ID NO: 362322 - DNA, 15 bp, Homo sapiens
ctgtccctcctgagg

SEQ ID NO: 362323 - DNA, 15 bp, Homo sapiens
ctgtccctctcaggc

SEQ ID NO: 362324 - DNA, 16 bp, Homo sapiens
ctgtccctctcaggca

SEQ ID NO: 362325 - DNA, 22 bp, Homo sapiens
ctgtccctctcctatgtggcag

SEQ ID NO: 362326 - DNA, 16 bp, Homo sapiens
ctgtccctgccccgcc

SEQ ID NO: 362327 - DNA, 21 bp, Homo sapiens
ctgtccctgccccgcccccca

SEQ ID NO: 362328 - DNA, 14 bp, Homo sapiens
ctgtccctggccat

SEQ ID NO: 362329 - DNA, 17 bp, Homo sapiens
ctgtccctggccatctc

SEQ ID NO: 362330 - DNA, 11 bp, Homo sapiens
ctgtccctgtc

SEQ ID NO: 362331 - DNA, 12 bp, Homo sapiens
ctgtccctgtcc

SEQ ID NO: 362332 - DNA, 16 bp, Homo sapiens
ctgtccctgtccctgc

SEQ ID NO: 362333 - DNA, 13 bp, Homo sapiens
ctgtcccttgcct

SEQ ID NO: 362334 - DNA, 15 bp, Homo sapiens
ctgtcccttgcctca

SEQ ID NO: 362335 - DNA, 16 bp, Homo sapiens
ctgtcccttgcctcaa

SEQ ID NO: 362336 - DNA, 18 bp, Homo sapiens
ctgtcccttgtttttgat

SEQ ID NO: 362337 - DNA, 14 bp, Homo sapiens
ctgtcctacccgcc

SEQ ID NO: 362338 - DNA, 14 bp, Homo sapiens
ctgtcctcaccgtc

SEQ ID NO: 362339 - DNA, 15 bp, Homo sapiens
ctgtcctcagcttct

SEQ ID NO: 362340 - DNA, 21 bp, Homo sapiens
ctgtcctcttaagacactagt

SEQ ID NO: 362341 - DNA, 19 bp, Homo sapiens
ctgtcctgatggtcagctc

SEQ ID NO: 362342 - DNA, 20 bp, Homo sapiens
ctgtcctgatggtcagctcc

SEQ ID NO: 362343 - DNA, 14 bp, Homo sapiens
ctgtgtccagcagc

SEQ ID NO: 362344 - DNA, 15 bp, Homo sapiens
ctgtgtccagcagct

SEQ ID NO: 362345 - DNA, 17 bp, Homo sapiens
ctgtgtccagcagctgc

SEQ ID NO: 362346 - DNA, 18 bp, Homo sapiens
ctgtgtccagcagctgcg

SEQ ID NO: 362347 - DNA, 21 bp, Homo sapiens
ctgtgtcccagcacctggcac

SEQ ID NO: 362348 - DNA, 13 bp, Homo sapiens
ctgtgtcccctga

SEQ ID NO: 362349 - DNA, 19 bp, Homo sapiens
ctgtgtccctctctctgga

SEQ ID NO: 362350 - DNA, 22 bp, Homo sapiens
ctgtgtcggggggcgagggagg

SEQ ID NO: 362351 - DNA, 12 bp, Homo sapiens
ctgtgtctctgt

SEQ ID NO: 362352 - DNA, 18 bp, Homo sapiens
ctgtgtctctgtatatag

SEQ ID NO: 362353 - DNA, 17 bp, Homo sapiens
ctgtgtctcttttctct

SEQ ID NO: 362354 - DNA, 14 bp, Homo sapiens
ctgtgtctgctgta

SEQ ID NO: 362355 - DNA, 21 bp, Homo sapiens
ctgtgtctggtccacacacca

SEQ ID NO: 362356 - DNA, 15 bp, Homo sapiens
ctgtgtgaagaaatg

SEQ ID NO: 362357 - DNA, 16 bp, Homo sapiens
ctgtgtgaagaaatgg

SEQ ID NO: 362358 - DNA, 22 bp, Homo sapiens
ctgtgtgactttgaacacatct

SEQ ID NO: 362359 - DNA, 18 bp, Homo sapiens
ctgtgtgatgaactttct

SEQ ID NO: 362360 - DNA, 18 bp, Homo sapiens
ctgtgtgcaagtgtgtgc

SEQ ID NO: 362361 - DNA, 21 bp, Homo sapiens
ctgtgtgcaccttaccaactt

SEQ ID NO: 362362 - DNA, 13 bp, Homo sapiens
ctgtgtgctgtgg

SEQ ID NO: 362363 - DNA, 13 bp, Homo sapiens
ctgtgtggcaaac

SEQ ID NO: 362364 - DNA, 16 bp, Homo sapiens
ctgtgtggcaaacatt

SEQ ID NO: 362365 - DNA, 16 bp, Homo sapiens
ctgtgtgggagggcga

SEQ ID NO: 362366 - DNA, 24 bp, Homo sapiens
ctgtgtgggatacttagtggtatg

SEQ ID NO: 362367 - DNA, 18 bp, Homo sapiens
ctgtgtgtaagctgactg

SEQ ID NO: 362368 - DNA, 14 bp, Homo sapiens
ctgtgtgtctccat

SEQ ID NO: 362369 - DNA, 20 bp, Homo sapiens
ctgtgtgtctccataaaagt

SEQ ID NO: 362370 - DNA, 16 bp, Homo sapiens
ctgtgtgtctggtggg

SEQ ID NO: 362371 - DNA, 20 bp, Homo sapiens
ctgtgtgtctggtgggtgga

SEQ ID NO: 362372 - DNA, 12 bp, Homo sapiens
ctgtgtgttctt

SEQ ID NO: 362373 - DNA, 14 bp, Homo sapiens
ctgtgtgttctttt

SEQ ID NO: 362374 - DNA, 15 bp, Homo sapiens
ctgtgtgttcttttg

SEQ ID NO: 362375 - DNA, 22 bp, Homo sapiens
ctgtgtgttcttttgatacatt

SEQ ID NO: 362376 - DNA, 13 bp, Homo sapiens
ctgtgtgttgcca

SEQ ID NO: 362377 - DNA, 20 bp, Homo sapiens
ctgtgtgttgccacaggaca

SEQ ID NO: 362378 - DNA, 22 bp, Homo sapiens
ctgtgtgttgccacaggacaca

SEQ ID NO: 362379 - DNA, 19 bp, Homo sapiens
ctgtgtgttttcataataa

SEQ ID NO: 362380 - DNA, 15 bp, Homo sapiens
ctgtgttagtgtctg

SEQ ID NO: 362381 - DNA, 13 bp, Homo sapiens
ctgtgttcctggc

SEQ ID NO: 362382 - DNA, 15 bp, Homo sapiens
ctgtgttcttgctga

SEQ ID NO: 362383 - DNA, 18 bp, Homo sapiens
ctgtgttgactgctgctc

SEQ ID NO: 362384 - DNA, 19 bp, Homo sapiens
ctgtgttgactgctgctcc

SEQ ID NO: 362385 - DNA, 14 bp, Homo sapiens
ctgtgttgccatgt

SEQ ID NO: 362386 - DNA, 22 bp, Homo sapiens
ctgtgttttgaatggtgttgta

SEQ ID NO: 362387 - DNA, 15 bp, Homo sapiens
ctgtgttttgtgagg

SEQ ID NO: 362388 - DNA, 20 bp, Homo sapiens
ctgttaaccaaataaaacat

SEQ ID NO: 362389 - DNA, 19 bp, Homo sapiens
ctgttaaccctccacctcc

SEQ ID NO: 362390 - DNA, 21 bp, Homo sapiens
ctgttaaggcatccacttcac

SEQ ID NO: 362391 - DNA, 15 bp, Homo sapiens
ctgttaatgttaatt

SEQ ID NO: 362392 - DNA, 18 bp, Homo sapiens
ctgttacatcctgctaca

SEQ ID NO: 362393 - DNA, 15 bp, Homo sapiens
ctgttaccatgtcac

SEQ ID NO: 362394 - DNA, 18 bp, Homo sapiens
ctgttaccatgtcactgt

SEQ ID NO: 362395 - DNA, 15 bp, Homo sapiens
ctgttacttacctaa

SEQ ID NO: 362396 - DNA, 23 bp, Homo sapiens
ctgttactttctttcagatgttt

SEQ ID NO: 362397 - DNA, 13 bp, Homo sapiens
ctgttagtcattt

SEQ ID NO: 362398 - DNA, 14 bp, Homo sapiens
ctgttataactctg

SEQ ID NO: 362399 - DNA, 15 bp, Homo sapiens
ctgttatctgtcttt

SEQ ID NO: 362400 - DNA, 15 bp, Homo sapiens
ctgttcacggcagac

SEQ ID NO: 362401 - DNA, 15 bp, Homo sapiens
ctgttcactctactt

SEQ ID NO: 362402 - DNA, 16 bp, Homo sapiens
ctgttcagattggaca

SEQ ID NO: 362403 - DNA, 16 bp, Homo sapiens
ctgttcagtgtcccgg

SEQ ID NO: 362404 - DNA, 13 bp, Homo sapiens
ctgttcattgtaa

SEQ ID NO: 362405 - DNA, 14 bp, Homo sapiens
ctgttccaagtgtg

SEQ ID NO: 362406 - DNA, 17 bp, Homo sapiens
ctgttccaagtgtgtgt

SEQ ID NO: 362407 - DNA, 11 bp, Homo sapiens
ctgttccagac

SEQ ID NO: 362408 - DNA, 15 bp, Homo sapiens
ctgttccagactcag

SEQ ID NO: 362409 - DNA, 15 bp, Homo sapiens
ctgttcccccaccct

SEQ ID NO: 362410 - DNA, 17 bp, Homo sapiens
ctgttcccctcacccaa

SEQ ID NO: 362411 - DNA, 14 bp, Homo sapiens
ctgttcccctcact

SEQ ID NO: 362412 - DNA, 15 bp, Homo sapiens
ctgttcccctcactg

SEQ ID NO: 362413 - DNA, 16 bp, Homo sapiens
ctgttccctccaaggt

SEQ ID NO: 362414 - DNA, 14 bp, Homo sapiens
ctgttccctctgct

SEQ ID NO: 362415 - DNA, 20 bp, Homo sapiens
ctgttccctctgctcctgga

SEQ ID NO: 362416 - DNA, 12 bp, Homo sapiens
ctgttccctgct

SEQ ID NO: 362417 - DNA, 14 bp, Homo sapiens
ctgttccctgctgg

SEQ ID NO: 362418 - DNA, 12 bp, Homo sapiens
ctgttcctgcct

SEQ ID NO: 362419 - DNA, 16 bp, Homo sapiens
ctgttcctgctccatg

SEQ ID NO: 362420 - DNA, 11 bp, Homo sapiens
ctgttcctgtg

SEQ ID NO: 362421 - DNA, 14 bp, Homo sapiens
ctgttcctgtgttc

SEQ ID NO: 362422 - DNA, 22 bp, Homo sapiens
ctgttccttcgagggttccagg

SEQ ID NO: 362423 - DNA, 20 bp, Homo sapiens
ctgttccttgaatctgaaag

SEQ ID NO: 362424 - DNA, 15 bp, Homo sapiens
ctgttctaacatgta

SEQ ID NO: 362425 - DNA, 16 bp, Homo sapiens
ctgttctaacatgtaa

SEQ ID NO: 362426 - DNA, 19 bp, Homo sapiens
ctgttctcagagctccaca

SEQ ID NO: 362427 - DNA, 21 bp, Homo sapiens
ctgttctcagagctccacaga

SEQ ID NO: 362428 - DNA, 16 bp, Homo sapiens
ctgttctcagcatcca

SEQ ID NO: 362429 - DNA, 18 bp, Homo sapiens
ctgttctgatattaattt

SEQ ID NO: 362430 - DNA, 14 bp, Homo sapiens
ctgttctggcctca

SEQ ID NO: 362431 - DNA, 17 bp, Homo sapiens
ctgttctggtggcccca

SEQ ID NO: 362432 - DNA, 21 bp, Homo sapiens
ctgttctggtggccccagctg

SEQ ID NO: 362433 - DNA, 17 bp, Homo sapiens
ctgttctgtaggagaga

SEQ ID NO: 362434 - DNA, 17 bp, Homo sapiens
ctgttcttgttacggca

SEQ ID NO: 362435 - DNA, 20 bp, Homo sapiens
ctgttgacatccaagcttcc

SEQ ID NO: 362436 - DNA, 15 bp, Homo sapiens
ctgttgagctgtttt

SEQ ID NO: 362437 - DNA, 15 bp, Homo sapiens
ctgttgaggcatcaa

SEQ ID NO: 362438 - DNA, 16 bp, Homo sapiens
ctgttgaggcatcaaa

SEQ ID NO: 362439 - DNA, 17 bp, Homo sapiens
ctgttgagtatttgctg

SEQ ID NO: 362440 - DNA, 18 bp, Homo sapiens
ctgttgagtatttgctgt

SEQ ID NO: 362441 - DNA, 23 bp, Homo sapiens
ctgttgattctttcaatccacag

SEQ ID NO: 362442 - DNA, 18 bp, Homo sapiens
ctgttgcacctcaggcag

SEQ ID NO: 362443 - DNA, 16 bp, Homo sapiens
ctgttgcatttacttt

SEQ ID NO: 362444 - DNA, 19 bp, Homo sapiens
ctgttgcatttacttttaa

SEQ ID NO: 362445 - DNA, 17 bp, Homo sapiens
ctgttgccagagatgga

SEQ ID NO: 362446 - DNA, 18 bp, Homo sapiens
ctgttgccatagccccat

SEQ ID NO: 362447 - DNA, 16 bp, Homo sapiens
ctgttgcccaggctgg

SEQ ID NO: 362448 - DNA, 21 bp, Homo sapiens
ctgttgccctttctgtaccat

SEQ ID NO: 362449 - DNA, 22 bp, Homo sapiens
ctgttgctcaaatctattcaga

SEQ ID NO: 362450 - DNA, 22 bp, Homo sapiens
ctgttggcccctctgctgtcct

SEQ ID NO: 362451 - DNA, 19 bp, Homo sapiens
ctgttggcctcaagcaagg

SEQ ID NO: 362452 - DNA, 16 bp, Homo sapiens
ctgttggctgctcccc

SEQ ID NO: 362453 - DNA, 19 bp, Homo sapiens
ctgttggttagctggacat

SEQ ID NO: 362454 - DNA, 23 bp, Homo sapiens
ctgttgtaaacaacgtgtatagt

SEQ ID NO: 362455 - DNA, 16 bp, Homo sapiens
ctgttgtacacttggg

SEQ ID NO: 362456 - DNA, 20 bp, Homo sapiens
ctgttgtcctccccttgggc

SEQ ID NO: 362457 - DNA, 22 bp, Homo sapiens
ctgttgtctgccgtgagagccc

SEQ ID NO: 362458 - DNA, 23 bp, Homo sapiens
ctgttgtctgccgtgagagccca

SEQ ID NO: 362459 - DNA, 21 bp, Homo sapiens
ctgttgtgtatagatgcaaga

SEQ ID NO: 362460 - DNA, 15 bp, Homo sapiens
ctgttgtgttcgttc

SEQ ID NO: 362461 - DNA, 17 bp, Homo sapiens
ctgttgtgtttgtcaaa

SEQ ID NO: 362462 - DNA, 17 bp, Homo sapiens
ctgttgttatggaaact

SEQ ID NO: 362463 - DNA, 17 bp, Homo sapiens
ctgttgttgttaatgaa

SEQ ID NO: 362464 - DNA, 22 bp, Homo sapiens
ctgttgttgttaatgaaaatgt

SEQ ID NO: 362465 - DNA, 17 bp, Homo sapiens
ctgttgtttgatgtgta

SEQ ID NO: 362466 - DNA, 14 bp, Homo sapiens
ctgtttaccctccc

SEQ ID NO: 362467 - DNA, 15 bp, Homo sapiens
ctgtttaccctccct

SEQ ID NO: 362468 - DNA, 17 bp, Homo sapiens
ctgtttaccctccctgt

SEQ ID NO: 362469 - DNA, 21 bp, Homo sapiens
ctgtttagcttcctccagagg

SEQ ID NO: 362470 - DNA, 15 bp, Homo sapiens
ctgtttatatatata

SEQ ID NO: 362471 - DNA, 13 bp, Homo sapiens
ctgtttatggcct

SEQ ID NO: 362472 - DNA, 18 bp, Homo sapiens
ctgtttatggcctcagct

SEQ ID NO: 362473 - DNA, 19 bp, Homo sapiens
ctgtttatggcctcagctg

SEQ ID NO: 362474 - DNA, 14 bp, Homo sapiens
cttcccagtgggct

SEQ ID NO: 362475 - DNA, 16 bp, Homo sapiens
cttcccagtgggctgt

SEQ ID NO: 362476 - DNA, 23 bp, Homo sapiens
cttcccatgactgcacccagctc

SEQ ID NO: 362477 - DNA, 13 bp, Homo sapiens
cttcccatttgta

SEQ ID NO: 362478 - DNA, 21 bp, Homo sapiens
cttcccatttgtaatgtatct

SEQ ID NO: 362479 - DNA, 17 bp, Homo sapiens
cttccccactctgctcc

SEQ ID NO: 362480 - DNA, 19 bp, Homo sapiens
cttccccactctgctccca

SEQ ID NO: 362481 - DNA, 16 bp, Homo sapiens
cttccccactgcctgc

SEQ ID NO: 362482 - DNA, 19 bp, Homo sapiens
cttccccactgcctgccca

SEQ ID NO: 362483 - DNA, 19 bp, Homo sapiens
cttccccagaaaggagact

SEQ ID NO: 362484 - DNA, 14 bp, Homo sapiens
cttccccagcgtcc

SEQ ID NO: 362485 - DNA, 15 bp, Homo sapiens
cttcccccagcccaa

SEQ ID NO: 362486 - DNA, 16 bp, Homo sapiens
cttcccccagcccaat

SEQ ID NO: 362487 - DNA, 18 bp, Homo sapiens
cttcccccagcccaataa

SEQ ID NO: 362488 - DNA, 19 bp, Homo sapiens
cttcccccagcccaataaa

SEQ ID NO: 362489 - DNA, 17 bp, Homo sapiens
cttcccccgctaattca

SEQ ID NO: 362490 - DNA, 12 bp, Homo sapiens
cttccccctcca

SEQ ID NO: 362491 - DNA, 17 bp, Homo sapiens
cttccccctctcccagt

SEQ ID NO: 362492 - DNA, 18 bp, Homo sapiens
cttccccctctcccagtt

SEQ ID NO: 362493 - DNA, 12 bp, Homo sapiens
cttcccccttcc

SEQ ID NO: 362494 - DNA, 15 bp, Homo sapiens
cttcccccttcccct

SEQ ID NO: 362495 - DNA, 16 bp, Homo sapiens
cttcccccttttttgt

SEQ ID NO: 362496 - DNA, 18 bp, Homo sapiens
cttcccccttttttgtcc

SEQ ID NO: 362497 - DNA, 21 bp, Homo sapiens
cttcccctccccgctcctaat

SEQ ID NO: 362498 - DNA, 14 bp, Homo sapiens
cttcccctccctgg

SEQ ID NO: 362499 - DNA, 20 bp, Homo sapiens
cttcccctccctggctccca

SEQ ID NO: 362500 - DNA, 21 bp, Homo sapiens
cttcccctctaatgctcacgc

SEQ ID NO: 362501 - DNA, 14 bp, Homo sapiens
cttcccctgaggac

SEQ ID NO: 362502 - DNA, 15 bp, Homo sapiens
cttcccctgcctggt

SEQ ID NO: 362503 - DNA, 15 bp, Homo sapiens
cttcccctgcgccct

SEQ ID NO: 362504 - DNA, 13 bp, Homo sapiens
cttccccttccaa

SEQ ID NO: 362505 - DNA, 20 bp, Homo sapiens
cttccccttgaacctcatta

SEQ ID NO: 362506 - DNA, 14 bp, Homo sapiens
cttcccgcagcacc

SEQ ID NO: 362507 - DNA, 18 bp, Homo sapiens
cttcccgcagcaccagcc

SEQ ID NO: 362508 - DNA, 21 bp, Homo sapiens
cttcccgcagcaccagcctga

SEQ ID NO: 362509 - DNA, 22 bp, Homo sapiens
cttcccgcagcaccagcctgag

SEQ ID NO: 362510 - DNA, 16 bp, Homo sapiens
cttcccgcctcagcct

SEQ ID NO: 362511 - DNA, 16 bp, Homo sapiens
cttcccgctcagccct

SEQ ID NO: 362512 - DNA, 18 bp, Homo sapiens
cttcccgctcagccctcc

SEQ ID NO: 362513 - DNA, 22 bp, Homo sapiens
cttccctaatcctccaagtctt

SEQ ID NO: 362514 - DNA, 13 bp, Homo sapiens
cttccctacccac

SEQ ID NO: 362515 - DNA, 14 bp, Homo sapiens
cttccctacccaca

SEQ ID NO: 362516 - DNA, 16 bp, Homo sapiens
cttccctacccacagg

SEQ ID NO: 362517 - DNA, 18 bp, Homo sapiens
cttccctacccacagggc

SEQ ID NO: 362518 - DNA, 21 bp, Homo sapiens
cttccctacccacagggcctg

SEQ ID NO: 362519 - DNA, 15 bp, Homo sapiens
cttccctagaagtct

SEQ ID NO: 362520 - DNA, 20 bp, Homo sapiens
cttccctagagggttcctgt

SEQ ID NO: 362521 - DNA, 20 bp, Homo sapiens
cttccctcactcttcctcat

SEQ ID NO: 362522 - DNA, 12 bp, Homo sapiens
cttccctcaggc

SEQ ID NO: 362523 - DNA, 13 bp, Homo sapiens
cttccctctcgct

SEQ ID NO: 362524 - DNA, 15 bp, Homo sapiens
cttccctctcgctcc

SEQ ID NO: 362525 - DNA, 16 bp, Homo sapiens
cttccctctgcctgtc

SEQ ID NO: 362526 - DNA, 17 bp, Homo sapiens
cttccctctgcctgtcc

SEQ ID NO: 362527 - DNA, 19 bp, Homo sapiens
cttccctctgcctgtccct

SEQ ID NO: 362528 - DNA, 18 bp, Homo sapiens
cttccctgacttgcttta

SEQ ID NO: 362529 - DNA, 20 bp, Homo sapiens
cttccctgcttcacgattct

SEQ ID NO: 362530 - DNA, 17 bp, Homo sapiens
cttccctgctttgagga

SEQ ID NO: 362531 - DNA, 19 bp, Homo sapiens
cttccctgggggtcccagg

SEQ ID NO: 362532 - DNA, 14 bp, Homo sapiens
cttccctggtccag

SEQ ID NO: 362533 - DNA, 22 bp, Homo sapiens
cttccctgtatgattccttgat

SEQ ID NO: 362534 - DNA, 12 bp, Homo sapiens
cttccctgttct

SEQ ID NO: 362535 - DNA, 13 bp, Homo sapiens
cttccctgttctt

SEQ ID NO: 362536 - DNA, 15 bp, Homo sapiens
cttccctgttcttta

SEQ ID NO: 362537 - DNA, 20 bp, Homo sapiens
cttcccttagcctctcccac

SEQ ID NO: 362538 - DNA, 13 bp, Homo sapiens
cttcccttatttt

SEQ ID NO: 362539 - DNA, 19 bp, Homo sapiens
cttcccttatttttattta

SEQ ID NO: 362540 - DNA, 13 bp, Homo sapiens
cttccctttctgc

SEQ ID NO: 362541 - DNA, 16 bp, Homo sapiens
cttccgctgtcaccca

SEQ ID NO: 362542 - DNA, 14 bp, Homo sapiens
cttccggagatgta

SEQ ID NO: 362543 - DNA, 15 bp, Homo sapiens
cttccggagatgtag

SEQ ID NO: 362544 - DNA, 14 bp, Homo sapiens
cttccgggagctgg

SEQ ID NO: 362545 - DNA, 17 bp, Homo sapiens
cttcctaaatatccaaa

SEQ ID NO: 362546 - DNA, 14 bp, Homo sapiens
cttcctaacttatt

SEQ ID NO: 362547 - DNA, 21 bp, Homo sapiens
cttcctaacttattgcctggg

SEQ ID NO: 362548 - DNA, 23 bp, Homo sapiens
cttcctaacttattgcctgggca

SEQ ID NO: 362549 - DNA, 19 bp, Homo sapiens
cttcctagagcatctgtcc

SEQ ID NO: 362550 - DNA, 23 bp, Homo sapiens
cttcctagcttatctccctgctt

SEQ ID NO: 362551 - DNA, 20 bp, Homo sapiens
cttcctatgcccaggtacca

SEQ ID NO: 362552 - DNA, 14 bp, Homo sapiens
cttcctcatcccct

SEQ ID NO: 362553 - DNA, 14 bp, Homo sapiens
cttcctcatcctgc

SEQ ID NO: 362554 - DNA, 16 bp, Homo sapiens
cttcctccaaagcctg

SEQ ID NO: 362555 - DNA, 22 bp, Homo sapiens
cttcctccaaagcctgggcaga

SEQ ID NO: 362556 - DNA, 13 bp, Homo sapiens
cttcctccagagg

SEQ ID NO: 362557 - DNA, 13 bp, Homo sapiens
cttcctccagtct

SEQ ID NO: 362558 - DNA, 19 bp, Homo sapiens
cttcctccctccctgcagg

SEQ ID NO: 362559 - DNA, 21 bp, Homo sapiens
cttcctccgctcccctttccc

SEQ ID NO: 362560 - DNA, 22 bp, Homo sapiens
cttcctccgctcccctttccca

SEQ ID NO: 362561 - DNA, 13 bp, Homo sapiens
cttcctccgtcca

SEQ ID NO: 362562 - DNA, 23 bp, Homo sapiens
cttcctccgtccacccaggctgc

SEQ ID NO: 362563 - DNA, 15 bp, Homo sapiens
cttcctcctccacag

SEQ ID NO: 362564 - DNA, 19 bp, Homo sapiens
cttcctcctccacagtgct

SEQ ID NO: 362565 - DNA, 21 bp, Homo sapiens
cttcctcctccacagtgctgc

SEQ ID NO: 362566 - DNA, 19 bp, Homo sapiens
cttcctcctcctcctcctg

SEQ ID NO: 362567 - DNA, 11 bp, Homo sapiens
cttcctcctga

SEQ ID NO: 362568 - DNA, 17 bp, Homo sapiens
cttcctcctgaagcctc

SEQ ID NO: 362569 - DNA, 18 bp, Homo sapiens
cttcctcctgaagcctct

SEQ ID NO: 362570 - DNA, 20 bp, Homo sapiens
cttcctcctgaagcctctgc

SEQ ID NO: 362571 - DNA, 15 bp, Homo sapiens
cttcctcctgatggc

SEQ ID NO: 362572 - DNA, 21 bp, Homo sapiens
cttcctctccactgccttcga

SEQ ID NO: 362573 - DNA, 15 bp, Homo sapiens
cttcctctctctcac

SEQ ID NO: 362574 - DNA, 22 bp, Homo sapiens
cttcctctgcagctgacctctg

SEQ ID NO: 362575 - DNA, 20 bp, Homo sapiens
cttcctctgcaggacacaga

SEQ ID NO: 362576 - DNA, 12 bp, Homo sapiens
cttcctctgctg

SEQ ID NO: 362577 - DNA, 13 bp, Homo sapiens
cttcctcttacct

SEQ ID NO: 362578 - DNA, 15 bp, Homo sapiens
cttcctgactgggaa

SEQ ID NO: 362579 - DNA, 12 bp, Homo sapiens
cttcctgcagag

SEQ ID NO: 362580 - DNA, 21 bp, Homo sapiens
cttcctgcagaggcccagcca

SEQ ID NO: 362581 - DNA, 17 bp, Homo sapiens
cttcctgccacctgctg

SEQ ID NO: 362582 - DNA, 10 bp, Homo sapiens
cttcctgccc

SEQ ID NO: 362583 - DNA, 17 bp, Homo sapiens
cttcctgccctacagag

SEQ ID NO: 362584 - DNA, 12 bp, Homo sapiens
cttcctgccctg

SEQ ID NO: 362585 - DNA, 13 bp, Homo sapiens
cttcctgctgctg

SEQ ID NO: 362586 - DNA, 15 bp, Homo sapiens
cttcctggactggcc

SEQ ID NO: 362587 - DNA, 17 bp, Homo sapiens
cttcctggactggccct

SEQ ID NO: 362588 - DNA, 21 bp, Homo sapiens
cttcctggattttctttctat

SEQ ID NO: 362589 - DNA, 13 bp, Homo sapiens
cttcctggcctca

SEQ ID NO: 362590 - DNA, 19 bp, Homo sapiens
cttcctgggcagcccagag

SEQ ID NO: 362591 - DNA, 20 bp, Homo sapiens
cttcctgggcagcccagaga

SEQ ID NO: 362592 - DNA, 17 bp, Homo sapiens
cttcctggggccccgct

SEQ ID NO: 362593 - DNA, 18 bp, Homo sapiens
cttcctggtgaggcccag

SEQ ID NO: 362594 - DNA, 20 bp, Homo sapiens
cttcctggtgaggcccagcc

SEQ ID NO: 362595 - DNA, 16 bp, Homo sapiens
cttcctgtccactctc

SEQ ID NO: 362596 - DNA, 23 bp, Homo sapiens
cttcctgtccactctcggggccc

SEQ ID NO: 362597 - DNA, 15 bp, Homo sapiens
cttcctgtccagaga

SEQ ID NO: 362598 - DNA, 19 bp, Homo sapiens
cttcctgtccagagagaga

SEQ ID NO: 362599 - DNA, 13 bp, Homo sapiens
cttcctgtcctgc

SEQ ID NO: 362600 - DNA, 15 bp, Homo sapiens
cttcctgtcctgctc

SEQ ID NO: 362601 - DNA, 15 bp, Homo sapiens
cttcctgtctggccc

SEQ ID NO: 362602 - DNA, 16 bp, Homo sapiens
cttcctgtctggccca

SEQ ID NO: 362603 - DNA, 17 bp, Homo sapiens
cttcctgtctggcccaa

SEQ ID NO: 362604 - DNA, 16 bp, Homo sapiens
cttcctgttctgtgtc

SEQ ID NO: 362605 - DNA, 18 bp, Homo sapiens
cttggcttctgggacctg

SEQ ID NO: 362606 - DNA, 19 bp, Homo sapiens
cttgggaaaatatcacttt

SEQ ID NO: 362607 - DNA, 22 bp, Homo sapiens
cttgggaaaatatcactttgta

SEQ ID NO: 362608 - DNA, 17 bp, Homo sapiens
cttgggacggaagtggc

SEQ ID NO: 362609 - DNA, 23 bp, Homo sapiens
cttgggacggaagtggcctgaga

SEQ ID NO: 362610 - DNA, 19 bp, Homo sapiens
cttgggactaaatgccctg

SEQ ID NO: 362611 - DNA, 18 bp, Homo sapiens
cttgggagagcccctggg

SEQ ID NO: 362612 - DNA, 22 bp, Homo sapiens
cttgggagagcccctggggcct

SEQ ID NO: 362613 - DNA, 14 bp, Homo sapiens
cttgggagcctgag

SEQ ID NO: 362614 - DNA, 15 bp, Homo sapiens
cttgggagcctgagg

SEQ ID NO: 362615 - DNA, 19 bp, Homo sapiens
cttgggagcctgaggcagg

SEQ ID NO: 362616 - DNA, 21 bp, Homo sapiens
cttgggagcctgaggcaggag

SEQ ID NO: 362617 - DNA, 20 bp, Homo sapiens
cttgggatgggcacaggctg

SEQ ID NO: 362618 - DNA, 17 bp, Homo sapiens
cttgggcacgggagagc

SEQ ID NO: 362619 - DNA, 20 bp, Homo sapiens
cttgggcacgggagagcgcc

SEQ ID NO: 362620 - DNA, 24 bp, Homo sapiens
cttgggcatccacccagtgctgcc

SEQ ID NO: 362621 - DNA, 15 bp, Homo sapiens
cttgggcccagctgg

SEQ ID NO: 362622 - DNA, 16 bp, Homo sapiens
cttgggcccagctggg

SEQ ID NO: 362623 - DNA, 18 bp, Homo sapiens
cttgggcccagctgggct

SEQ ID NO: 362624 - DNA, 20 bp, Homo sapiens
cttgggcccagctgggctct

SEQ ID NO: 362625 - DNA, 22 bp, Homo sapiens
cttgggcccagctgggctctgc

SEQ ID NO: 362626 - DNA, 14 bp, Homo sapiens
cttgggccctcctg

SEQ ID NO: 362627 - DNA, 16 bp, Homo sapiens
cttgggccgctgcacc

SEQ ID NO: 362628 - DNA, 18 bp, Homo sapiens
cttgggctactggcagct

SEQ ID NO: 362629 - DNA, 19 bp, Homo sapiens
cttgggctactggcagctc

SEQ ID NO: 362630 - DNA, 14 bp, Homo sapiens
cttgggctcctggc

SEQ ID NO: 362631 - DNA, 19 bp, Homo sapiens
cttgggctcctggctgcca

SEQ ID NO: 362632 - DNA, 14 bp, Homo sapiens
cttgggctgagact

SEQ ID NO: 362633 - DNA, 14 bp, Homo sapiens
cttgggctgctcct

SEQ ID NO: 362634 - DNA, 13 bp, Homo sapiens
cttgggcttctgc

SEQ ID NO: 362635 - DNA, 23 bp, Homo sapiens
cttggggccagactggctgcaca

SEQ ID NO: 362636 - DNA, 13 bp, Homo sapiens
cttggggcctggc

SEQ ID NO: 362637 - DNA, 15 bp, Homo sapiens
cttggggcctggctt

SEQ ID NO: 362638 - DNA, 15 bp, Homo sapiens
cttggggctcgcccc

SEQ ID NO: 362639 - DNA, 19 bp, Homo sapiens
cttggggctcgccccaccc

SEQ ID NO: 362640 - DNA, 18 bp, Homo sapiens
cttgggggaggccacccc

SEQ ID NO: 362641 - DNA, 22 bp, Homo sapiens
cttgggggtctgctctgtgcct

SEQ ID NO: 362642 - DNA, 23 bp, Homo sapiens
cttgggggttcagggaactgctt

SEQ ID NO: 362643 - DNA, 19 bp, Homo sapiens
cttggggtgtggggtgggg

SEQ ID NO: 362644 - DNA, 23 bp, Homo sapiens
cttgggtcccccacgtgacagtg

SEQ ID NO: 362645 - DNA, 17 bp, Homo sapiens
cttggtaagagggagcc

SEQ ID NO: 362646 - DNA, 23 bp, Homo sapiens
cttggtaagagggagccggtttg

SEQ ID NO: 362647 - DNA, 14 bp, Homo sapiens
cttggtagttctgt

SEQ ID NO: 362648 - DNA, 17 bp, Homo sapiens
cttggtagtttggaaag

SEQ ID NO: 362649 - DNA, 21 bp, Homo sapiens
cttggtatttggatatctgtt

SEQ ID NO: 362650 - DNA, 15 bp, Homo sapiens
cttggtcatgcttca

SEQ ID NO: 362651 - DNA, 13 bp, Homo sapiens
cttggtccctggt

SEQ ID NO: 362652 - DNA, 11 bp, Homo sapiens
cttggtctctt

SEQ ID NO: 362653 - DNA, 20 bp, Homo sapiens
cttggtctctttctttccaa

SEQ ID NO: 362654 - DNA, 21 bp, Homo sapiens
cttggtctctttctttccaaa

SEQ ID NO: 362655 - DNA, 18 bp, Homo sapiens
cttggtgaggaggaggca

SEQ ID NO: 362656 - DNA, 19 bp, Homo sapiens
cttggtgaggaggaggcag

SEQ ID NO: 362657 - DNA, 19 bp, Homo sapiens
cttggtgcctaatgttcca

SEQ ID NO: 362658 - DNA, 23 bp, Homo sapiens
cttggtgcggtaggtgctggcct

SEQ ID NO: 362659 - DNA, 12 bp, Homo sapiens
cttggtgctgcg

SEQ ID NO: 362660 - DNA, 20 bp, Homo sapiens
cttggtgtcctttccctcca

SEQ ID NO: 362661 - DNA, 17 bp, Homo sapiens
cttggtgttgttatggc

SEQ ID NO: 362662 - DNA, 20 bp, Homo sapiens
cttggttcccatttgctcct

SEQ ID NO: 362663 - DNA, 14 bp, Homo sapiens
cttggttgaaaaga

SEQ ID NO: 362664 - DNA, 20 bp, Homo sapiens
cttggttggacctattgcca

SEQ ID NO: 362665 - DNA, 15 bp, Homo sapiens
cttggttgttccttt

SEQ ID NO: 362666 - DNA, 22 bp, Homo sapiens
cttggtttgttatatcagggaa

SEQ ID NO: 362667 - DNA, 14 bp, Homo sapiens
cttggttttgtatt

SEQ ID NO: 362668 - DNA, 16 bp, Homo sapiens
cttgtaaaactgtgac

SEQ ID NO: 362669 - DNA, 20 bp, Homo sapiens
cttgtaaaactgtgacattc

SEQ ID NO: 362670 - DNA, 16 bp, Homo sapiens
cttgtaaacctggagg

SEQ ID NO: 362671 - DNA, 22 bp, Homo sapiens
cttgtaaattgatgggagaaat

SEQ ID NO: 362672 - DNA, 24 bp, Homo sapiens
cttgtaaattgatgggagaaatga

SEQ ID NO: 362673 - DNA, 13 bp, Homo sapiens
cttgtaactaaag

SEQ ID NO: 362674 - DNA, 15 bp, Homo sapiens
cttgtaatatttctt

SEQ ID NO: 362675 - DNA, 20 bp, Homo sapiens
cttgtacagtgtctgtgcca

SEQ ID NO: 362676 - DNA, 22 bp, Homo sapiens
cttgtacagttgactggctttc

SEQ ID NO: 362677 - DNA, 18 bp, Homo sapiens
cttgtactaagccaggag

SEQ ID NO: 362678 - DNA, 17 bp, Homo sapiens
cttgtaggaatctgcct

SEQ ID NO: 362679 - DNA, 13 bp, Homo sapiens
cttgtagggtgag

SEQ ID NO: 362680 - DNA, 19 bp, Homo sapiens
cttgtagggtgaggcgtgg

SEQ ID NO: 362681 - DNA, 23 bp, Homo sapiens
cttgtattttcttcccatttgta

SEQ ID NO: 362682 - DNA, 19 bp, Homo sapiens
cttgtcactacaaaaatac

SEQ ID NO: 362683 - DNA, 12 bp, Homo sapiens
cttgtcatcttt

SEQ ID NO: 362684 - DNA, 17 bp, Homo sapiens
cttgtcatgtaccatca

SEQ ID NO: 362685 - DNA, 13 bp, Homo sapiens
cttgtcatgtgta

SEQ ID NO: 362686 - DNA, 18 bp, Homo sapiens
cttgtcatgtgtataaaa

SEQ ID NO: 362687 - DNA, 14 bp, Homo sapiens
cttgtccaggtctc

SEQ ID NO: 362688 - DNA, 22 bp, Homo sapiens
cttgtccaggtctcactgcttt

SEQ ID NO: 362689 - DNA, 14 bp, Homo sapiens
cttgtccctctcac

SEQ ID NO: 362690 - DNA, 18 bp, Homo sapiens
cttgtccctttccctacc

SEQ ID NO: 362691 - DNA, 13 bp, Homo sapiens
cttgtcctgccag

SEQ ID NO: 362692 - DNA, 15 bp, Homo sapiens
cttgtcctgccagct

SEQ ID NO: 362693 - DNA, 20 bp, Homo sapiens
cttgtcctgccagctgcctt

SEQ ID NO: 362694 - DNA, 19 bp, Homo sapiens
cttgtcctgtatagcaacc

SEQ ID NO: 362695 - DNA, 17 bp, Homo sapiens
cttgtctaaccccaggt

SEQ ID NO: 362696 - DNA, 17 bp, Homo sapiens
cttgtctatttttgtct

SEQ ID NO: 362697 - DNA, 16 bp, Homo sapiens
cttgtctcttcctctg

SEQ ID NO: 362698 - DNA, 17 bp, Homo sapiens
cttgtctgaggcctcat

SEQ ID NO: 362699 - DNA, 21 bp, Homo sapiens
cttgtctgaggcctcatccct

SEQ ID NO: 362700 - DNA, 22 bp, Homo sapiens
cttgtctgaggcctcatccctc

SEQ ID NO: 362701 - DNA, 12 bp, Homo sapiens
cttgtctgctgc

SEQ ID NO: 362702 - DNA, 13 bp, Homo sapiens
cttgtctgctgct

SEQ ID NO: 362703 - DNA, 14 bp, Homo sapiens
cttgtctgctgctc

SEQ ID NO: 362704 - DNA, 15 bp, Homo sapiens
cttgtcttttcccct

SEQ ID NO: 362705 - DNA, 18 bp, Homo sapiens
cttgtcttttcccctcat

SEQ ID NO: 362706 - DNA, 14 bp, Homo sapiens
cttgtgactgaagg

SEQ ID NO: 362707 - DNA, 15 bp, Homo sapiens
cttgtgactgaaggg

SEQ ID NO: 362708 - DNA, 19 bp, Homo sapiens
cttgtgagagcccattccc

SEQ ID NO: 362709 - DNA, 22 bp, Homo sapiens
cttgtgagagcccattcccacc

SEQ ID NO: 362710 - DNA, 16 bp, Homo sapiens
cttgtgatctgggaac

SEQ ID NO: 362711 - DNA, 16 bp, Homo sapiens
cttgtgattgctgcca

SEQ ID NO: 362712 - DNA, 17 bp, Homo sapiens
cttgtgccctgccccca

SEQ ID NO: 362713 - DNA, 23 bp, Homo sapiens
cttgtgccctgcccccatctccc

SEQ ID NO: 362714 - DNA, 17 bp, Homo sapiens
cttgtgcctcccttccc

SEQ ID NO: 362715 - DNA, 21 bp, Homo sapiens
cttgtgcctcccttcccagtg

SEQ ID NO: 362716 - DNA, 22 bp, Homo sapiens
cttgtgcttggtggggctcgtg

SEQ ID NO: 362717 - DNA, 24 bp, Homo sapiens
cttgtgcttggtggggctcgtggc

SEQ ID NO: 362718 - DNA, 22 bp, Homo sapiens
cttgtggaggatgaatagatgt

SEQ ID NO: 362719 - DNA, 12 bp, Homo sapiens
cttgtgggctgg

SEQ ID NO: 362720 - DNA, 16 bp, Homo sapiens
cttgtgttcaatctgt

SEQ ID NO: 362721 - DNA, 19 bp, Homo sapiens
cttgtgttgctttctgact

SEQ ID NO: 362722 - DNA, 21 bp, Homo sapiens
cttgtgttgctttctgactga

SEQ ID NO: 362723 - DNA, 13 bp, Homo sapiens
cttgtgtttgctt

SEQ ID NO: 362724 - DNA, 19 bp, Homo sapiens
cttgtgtttgtatataaat

SEQ ID NO: 362725 - DNA, 21 bp, Homo sapiens
cttgttcatgttttgctaatg

SEQ ID NO: 362726 - DNA, 13 bp, Homo sapiens
cttgttcatttct

SEQ ID NO: 362727 - DNA, 16 bp, Homo sapiens
cttgttcatttctgtc

SEQ ID NO: 362728 - DNA, 20 bp, Homo sapiens
cttgttcatttctgtctccc

SEQ ID NO: 362729 - DNA, 22 bp, Homo sapiens
cttgttcatttctgtctcccct

SEQ ID NO: 362730 - DNA, 13 bp, Homo sapiens
cttgttccagctc

SEQ ID NO: 362731 - DNA, 21 bp, Homo sapiens
cttgttccccactgacagcct

SEQ ID NO: 362732 - DNA, 14 bp, Homo sapiens
cttgttccctctcc

SEQ ID NO: 362733 - DNA, 12 bp, Homo sapiens
cttgttctgttt

SEQ ID NO: 362734 - DNA, 18 bp, Homo sapiens
ctttgctccaccccactc

SEQ ID NO: 362735 - DNA, 14 bp, Homo sapiens
ctttgctcccagtt

SEQ ID NO: 362736 - DNA, 16 bp, Homo sapiens
ctttgctgaatgtcat

SEQ ID NO: 362737 - DNA, 16 bp, Homo sapiens
ctttgctgcccctgtc

SEQ ID NO: 362738 - DNA, 17 bp, Homo sapiens
ctttgctgcccctgtct

SEQ ID NO: 362739 - DNA, 22 bp, Homo sapiens
ctttgctgcccctgtctggaag

SEQ ID NO: 362740 - DNA, 14 bp, Homo sapiens
ctttgctgctgtgg

SEQ ID NO: 362741 - DNA, 15 bp, Homo sapiens
ctttgctggaaaatc

SEQ ID NO: 362742 - DNA, 14 bp, Homo sapiens
ctttgctggagtcc

SEQ ID NO: 362743 - DNA, 18 bp, Homo sapiens
ctttgctggagtcctgtt

SEQ ID NO: 362744 - DNA, 22 bp, Homo sapiens
ctttgctggagtcctgttctca

SEQ ID NO: 362745 - DNA, 14 bp, Homo sapiens
ctttgctggttgct

SEQ ID NO: 362746 - DNA, 15 bp, Homo sapiens
ctttgctggttgctg

SEQ ID NO: 362747 - DNA, 23 bp, Homo sapiens
ctttgctgtgaggaatgctctgt

SEQ ID NO: 362748 - DNA, 17 bp, Homo sapiens
ctttgctgtgccaaagc

SEQ ID NO: 362749 - DNA, 13 bp, Homo sapiens
ctttgctgtttat

SEQ ID NO: 362750 - DNA, 19 bp, Homo sapiens
ctttgcttatgaatattta

SEQ ID NO: 362751 - DNA, 23 bp, Homo sapiens
ctttgcttatgaatatttataac

SEQ ID NO: 362752 - DNA, 20 bp, Homo sapiens
ctttgcttccttgcttttat

SEQ ID NO: 362753 - DNA, 22 bp, Homo sapiens
ctttggaaatttggaagatggt

SEQ ID NO: 362754 - DNA, 21 bp, Homo sapiens
ctttggacacacacagcttct

SEQ ID NO: 362755 - DNA, 16 bp, Homo sapiens
ctttggacgcacacag

SEQ ID NO: 362756 - DNA, 18 bp, Homo sapiens
ctttggacgcacacagct

SEQ ID NO: 362757 - DNA, 20 bp, Homo sapiens
ctttggagaacgccagtctc

SEQ ID NO: 362758 - DNA, 13 bp, Homo sapiens
ctttggagctttt

SEQ ID NO: 362759 - DNA, 15 bp, Homo sapiens
ctttggctcccgctt

SEQ ID NO: 362760 - DNA, 16 bp, Homo sapiens
ctttggcttaattcca

SEQ ID NO: 362761 - DNA, 21 bp, Homo sapiens
ctttggcttaattccaatcat

SEQ ID NO: 362762 - DNA, 18 bp, Homo sapiens
ctttgggagcaaaataag

SEQ ID NO: 362763 - DNA, 18 bp, Homo sapiens
ctttgggcctctgcttct

SEQ ID NO: 362764 - DNA, 12 bp, Homo sapiens
ctttgggctttg

SEQ ID NO: 362765 - DNA, 21 bp, Homo sapiens
ctttgggggattcaaatgcat

SEQ ID NO: 362766 - DNA, 22 bp, Homo sapiens
ctttggtcacaagtaggagaca

SEQ ID NO: 362767 - DNA, 18 bp, Homo sapiens
ctttggtgaacagttttg

SEQ ID NO: 362768 - DNA, 21 bp, Homo sapiens
ctttgtaagtaaactgccctg

SEQ ID NO: 362769 - DNA, 14 bp, Homo sapiens
ctttgtaatgcttg

SEQ ID NO: 362770 - DNA, 20 bp, Homo sapiens
ctttgtaatgcttgtacagt

SEQ ID NO: 362771 - DNA, 13 bp, Homo sapiens
ctttgtaatggga

SEQ ID NO: 362772 - DNA, 12 bp, Homo sapiens
ctttgtacttgt

SEQ ID NO: 362773 - DNA, 14 bp, Homo sapiens
ctttgtacttgtgt

SEQ ID NO: 362774 - DNA, 16 bp, Homo sapiens
ctttgtacttgtgttt

SEQ ID NO: 362775 - DNA, 21 bp, Homo sapiens
ctttgtacttgtgtttgctta

SEQ ID NO: 362776 - DNA, 22 bp, Homo sapiens
ctttgtagatgtattttcaata

SEQ ID NO: 362777 - DNA, 15 bp, Homo sapiens
ctttgtagcttaaaa

SEQ ID NO: 362778 - DNA, 14 bp, Homo sapiens
ctttgtagttaatg

SEQ ID NO: 362779 - DNA, 13 bp, Homo sapiens
ctttgtatcttaa

SEQ ID NO: 362780 - DNA, 12 bp, Homo sapiens
ctttgtatgcac

SEQ ID NO: 362781 - DNA, 11 bp, Homo sapiens
ctttgtattct

SEQ ID NO: 362782 - DNA, 13 bp, Homo sapiens
ctttgtattctct

SEQ ID NO: 362783 - DNA, 22 bp, Homo sapiens
ctttgtccaccattcctttaaa

SEQ ID NO: 362784 - DNA, 14 bp, Homo sapiens
ctttgtcccacagc

SEQ ID NO: 362785 - DNA, 15 bp, Homo sapiens
ctttgtcccggggct

SEQ ID NO: 362786 - DNA, 19 bp, Homo sapiens
ctttgtgagtattctatgt

SEQ ID NO: 362787 - DNA, 22 bp, Homo sapiens
ctttgtgcttggggctatttgt

SEQ ID NO: 362788 - DNA, 14 bp, Homo sapiens
ctttgtgcttgttc

SEQ ID NO: 362789 - DNA, 15 bp, Homo sapiens
ctttgtggactttat

SEQ ID NO: 362790 - DNA, 20 bp, Homo sapiens
ctttgtggactttatttaat

SEQ ID NO: 362791 - DNA, 16 bp, Homo sapiens
ctttgtggatgtcttc

SEQ ID NO: 362792 - DNA, 23 bp, Homo sapiens
ctttgtgggaaacagagtccaat

SEQ ID NO: 362793 - DNA, 19 bp, Homo sapiens
ctttgtgtcttttgttctc

SEQ ID NO: 362794 - DNA, 20 bp, Homo sapiens
ctttgtgtcttttgttctct

SEQ ID NO: 362795 - DNA, 22 bp, Homo sapiens
ctttgtgtcttttgttctctct

SEQ ID NO: 362796 - DNA, 19 bp, Homo sapiens
ctttgttaccttaaaacta

SEQ ID NO: 362797 - DNA, 13 bp, Homo sapiens
ctttgttcctgct

SEQ ID NO: 362798 - DNA, 14 bp, Homo sapiens
ctttgttcctgctt

SEQ ID NO: 362799 - DNA, 17 bp, Homo sapiens
ctttgttcctgctttct

SEQ ID NO: 362800 - DNA, 20 bp, Homo sapiens
ctttgttgctcagcaagggg

SEQ ID NO: 362801 - DNA, 21 bp, Homo sapiens
ctttgttgcttaatctagagc

SEQ ID NO: 362802 - DNA, 15 bp, Homo sapiens
ctttgttgtacgcag

SEQ ID NO: 362803 - DNA, 18 bp, Homo sapiens
ctttgtttcttttgctta

SEQ ID NO: 362804 - DNA, 15 bp, Homo sapiens
ctttgtttggctggg

SEQ ID NO: 362805 - DNA, 20 bp, Homo sapiens
ctttgtttgtttgttttctt

SEQ ID NO: 362806 - DNA, 23 bp, Homo sapiens
ctttgttttgatgtttgtggcct

SEQ ID NO: 362807 - DNA, 24 bp, Homo sapiens
ctttgttttgatgtttgtggcctc

SEQ ID NO: 362808 - DNA, 17 bp, Homo sapiens
ctttgtttttccatgtg

SEQ ID NO: 362809 - DNA, 18 bp, Homo sapiens
ctttgtttttccatgtgt

SEQ ID NO: 362810 - DNA, 12 bp, Homo sapiens
cttttaaaaaaa

SEQ ID NO: 362811 - DNA, 13 bp, Homo sapiens
cttttaaaaatac

SEQ ID NO: 362812 - DNA, 10 bp, Homo sapiens
cttttaaatg

SEQ ID NO: 362813 - DNA, 13 bp, Homo sapiens
cttttaaatggca

SEQ ID NO: 362814 - DNA, 15 bp, Homo sapiens
cttttaaatggcatg

SEQ ID NO: 362815 - DNA, 12 bp, Homo sapiens
cttttaaatggg

SEQ ID NO: 362816 - DNA, 14 bp, Homo sapiens
cttttaacttcacc

SEQ ID NO: 362817 - DNA, 17 bp, Homo sapiens
cttttaacttcacctta

SEQ ID NO: 362818 - DNA, 18 bp, Homo sapiens
cttttaatatgctgtggg

SEQ ID NO: 362819 - DNA, 18 bp, Homo sapiens
cttttacagcttttctct

SEQ ID NO: 362820 - DNA, 19 bp, Homo sapiens
cttttaccactatttaagt

SEQ ID NO: 362821 - DNA, 15 bp, Homo sapiens
cttttactgtggagg

SEQ ID NO: 362822 - DNA, 18 bp, Homo sapiens
cttttacttgttcatttc

SEQ ID NO: 362823 - DNA, 14 bp, Homo sapiens
cttttactttttta

SEQ ID NO: 362824 - DNA, 19 bp, Homo sapiens
cttttagatcaacaataaa

SEQ ID NO: 362825 - DNA, 13 bp, Homo sapiens
cttttagcctagt

SEQ ID NO: 362826 - DNA, 16 bp, Homo sapiens
cttttaggtcatccaa

SEQ ID NO: 362827 - DNA, 15 bp, Homo sapiens
cttttagtacccacc

SEQ ID NO: 362828 - DNA, 18 bp, Homo sapiens
cttttagtacccacctga

SEQ ID NO: 362829 - DNA, 19 bp, Homo sapiens
cttttagtcacgtgtattt

SEQ ID NO: 362830 - DNA, 21 bp, Homo sapiens
cttttagttttagttgcagaa

SEQ ID NO: 362831 - DNA, 16 bp, Homo sapiens
cttttataaattaaat

SEQ ID NO: 362832 - DNA, 18 bp, Homo sapiens
cttttataaattaaatat

SEQ ID NO: 362833 - DNA, 18 bp, Homo sapiens
cttttataccagagacct

SEQ ID NO: 362834 - DNA, 14 bp, Homo sapiens
cttttatagctatt

SEQ ID NO: 362835 - DNA, 19 bp, Homo sapiens
cttttatagctattactgt

SEQ ID NO: 362836 - DNA, 10 bp, Homo sapiens
cttttatata

SEQ ID NO: 362837 - DNA, 14 bp, Homo sapiens
cttttatatataaa

SEQ ID NO: 362838 - DNA, 16 bp, Homo sapiens
cttttatatataaaat

SEQ ID NO: 362839 - DNA, 14 bp, Homo sapiens
cttttatatctgta

SEQ ID NO: 362840 - DNA, 21 bp, Homo sapiens
cttttatatggcccagccttg

SEQ ID NO: 362841 - DNA, 21 bp, Homo sapiens
cttttatgcagatagaatcaa

SEQ ID NO: 362842 - DNA, 21 bp, Homo sapiens
cttttatgtttgtaatctgta

SEQ ID NO: 362843 - DNA, 23 bp, Homo sapiens
cttttattaatggcatgtaatat

SEQ ID NO: 362844 - DNA, 20 bp, Homo sapiens
cttttattacattagttaag

SEQ ID NO: 362845 - DNA, 19 bp, Homo sapiens
cttttattgtataaactat

SEQ ID NO: 362846 - DNA, 17 bp, Homo sapiens
cttttattgtataatta

SEQ ID NO: 362847 - DNA, 14 bp, Homo sapiens
cttttatttcattc

SEQ ID NO: 362848 - DNA, 15 bp, Homo sapiens
cttttatttcattca

SEQ ID NO: 362849 - DNA, 19 bp, Homo sapiens
cttttatttgcaacattta

SEQ ID NO: 362850 - DNA, 17 bp, Homo sapiens
cttttattttcctgtct

SEQ ID NO: 362851 - DNA, 20 bp, Homo sapiens
cttttattttttaagttcaa

SEQ ID NO: 362852 - DNA, 12 bp, Homo sapiens
cttttcagaaga

SEQ ID NO: 362853 - DNA, 21 bp, Homo sapiens
cttttcagccaatttgtctcc

SEQ ID NO: 362854 - DNA, 18 bp, Homo sapiens
cttttcagcttgtttcta

SEQ ID NO: 362855 - DNA, 18 bp, Homo sapiens
cttttcatgcgtgtgtgt

SEQ ID NO: 362856 - DNA, 19 bp, Homo sapiens
cttttcatgtagaactcag

SEQ ID NO: 362857 - DNA, 13 bp, Homo sapiens
cttttccaaaaat

SEQ ID NO: 362858 - DNA, 16 bp, Homo sapiens
cttttccaggatcctg

SEQ ID NO: 362859 - DNA, 20 bp, Homo sapiens
cttttccaggatcctgcagg

SEQ ID NO: 362860 - DNA, 15 bp, Homo sapiens
cttttcccaccagct

SEQ ID NO: 362861 - DNA, 17 bp, Homo sapiens
cttttcccctcattgca

SEQ ID NO: 362862 - DNA, 14 bp, Homo sapiens
cttttccctctcta

SEQ ID NO: 362863 - DNA, 15 bp, Homo sapiens
cttttcctagtttta

SEQ ID NO: 362864 - DNA, 22 bp, Homo sapiens
cttttcctagttttatgtttct

SEQ ID NO: 362865 - DNA, 21 bp, Homo sapiens
gaaaaaggagcttacctccca

SEQ ID NO: 362866 - DNA, 22 bp, Homo sapiens
gaaaaataccatgtctctaagc

SEQ ID NO: 362867 - DNA, 17 bp, Homo sapiens
gaaaaatgcttttgtgt

SEQ ID NO: 362868 - DNA, 20 bp, Homo sapiens
gaaaaatgggagacagcctc

SEQ ID NO: 362869 - DNA, 15 bp, Homo sapiens
gaaaaatgttcttta

SEQ ID NO: 362870 - DNA, 17 bp, Homo sapiens
gaaaaatttaagcattg

SEQ ID NO: 362871 - DNA, 22 bp, Homo sapiens
gaaaaatttaagcattgtttgc

SEQ ID NO: 362872 - DNA, 14 bp, Homo sapiens
gaaaacaaaatcta

SEQ ID NO: 362873 - DNA, 15 bp, Homo sapiens
gaaaacaaaatctaa

SEQ ID NO: 362874 - DNA, 19 bp, Homo sapiens
gaaaacaaaatctaaaaca

SEQ ID NO: 362875 - DNA, 15 bp, Homo sapiens
gaaaacaacaaaaaa

SEQ ID NO: 362876 - DNA, 14 bp, Homo sapiens
gaaaacaatttgca

SEQ ID NO: 362877 - DNA, 17 bp, Homo sapiens
gaaaacacacaaaagat

SEQ ID NO: 362878 - DNA, 17 bp, Homo sapiens
gaaaacacacgctcctc

SEQ ID NO: 362879 - DNA, 16 bp, Homo sapiens
gaaaacaccaagagta

SEQ ID NO: 362880 - DNA, 11 bp, Homo sapiens
gaaaacactta

SEQ ID NO: 362881 - DNA, 14 bp, Homo sapiens
gaaaacagaaaaaa

SEQ ID NO: 362882 - DNA, 13 bp, Homo sapiens
gaaaacagaccta

SEQ ID NO: 362883 - DNA, 19 bp, Homo sapiens
gaaaacaggaaaaaaactt

SEQ ID NO: 362884 - DNA, 12 bp, Homo sapiens
gaaaacataaaa

SEQ ID NO: 362885 - DNA, 13 bp, Homo sapiens
gaaaacataaaaa

SEQ ID NO: 362886 - DNA, 21 bp, Homo sapiens
gaaaacataatatcttgaaga

SEQ ID NO: 362887 - DNA, 22 bp, Homo sapiens
gaaaacatagagtagacctgag

SEQ ID NO: 362888 - DNA, 15 bp, Homo sapiens
gaaaacatgtaataa

SEQ ID NO: 362889 - DNA, 18 bp, Homo sapiens
gaaaacatttcaaagctg

SEQ ID NO: 362890 - DNA, 18 bp, Homo sapiens
gaaaaccaagccgtggct

SEQ ID NO: 362891 - DNA, 21 bp, Homo sapiens
gaaaaccaagccgtggcttcc

SEQ ID NO: 362892 - DNA, 19 bp, Homo sapiens
gaaaaccagtcttctccct

SEQ ID NO: 362893 - DNA, 18 bp, Homo sapiens
gaaaaccatctggcctgg

SEQ ID NO: 362894 - DNA, 19 bp, Homo sapiens
gaaaacccgacaacatttc

SEQ ID NO: 362895 - DNA, 16 bp, Homo sapiens
gaaaacctcaagggct

SEQ ID NO: 362896 - DNA, 18 bp, Homo sapiens
gaaaacgatttaatttat

SEQ ID NO: 362897 - DNA, 21 bp, Homo sapiens
gaaaacgtatcacctttccca

SEQ ID NO: 362898 - DNA, 14 bp, Homo sapiens
gaaaacgttttatt

SEQ ID NO: 362899 - DNA, 20 bp, Homo sapiens
gaaaacgttttattgtgttt

SEQ ID NO: 362900 - DNA, 18 bp, Homo sapiens
gaaaactcccatttacgt

SEQ ID NO: 362901 - DNA, 13 bp, Homo sapiens
gaaaacttagttt

SEQ ID NO: 362902 - DNA, 15 bp, Homo sapiens
gaaaacttatttgag

SEQ ID NO: 362903 - DNA, 13 bp, Homo sapiens
gaaaacttcaaag

SEQ ID NO: 362904 - DNA, 22 bp, Homo sapiens
gaaaagaaacaatatgctttac

SEQ ID NO: 362905 - DNA, 18 bp, Homo sapiens
gaaaagaaatcaattttt

SEQ ID NO: 362906 - DNA, 15 bp, Homo sapiens
gaaaagaaatgctaa

SEQ ID NO: 362907 - DNA, 16 bp, Homo sapiens
gaaaagaacaaacaaa

SEQ ID NO: 362908 - DNA, 22 bp, Homo sapiens
gaaaagaactgcttgcatttct

SEQ ID NO: 362909 - DNA, 19 bp, Homo sapiens
gaaaagaagaaagtctatg

SEQ ID NO: 362910 - DNA, 16 bp, Homo sapiens
gaaaagaccctgagac

SEQ ID NO: 362911 - DNA, 23 bp, Homo sapiens
gaaaagagtatcaaaggcagaaa

SEQ ID NO: 362912 - DNA, 20 bp, Homo sapiens
gaaaagatacgactttattt

SEQ ID NO: 362913 - DNA, 18 bp, Homo sapiens
gaaaagatgttgtgtctt

SEQ ID NO: 362914 - DNA, 16 bp, Homo sapiens
gaaaaggaatgcaaga

SEQ ID NO: 362915 - DNA, 18 bp, Homo sapiens
gaaaaggaatgcaagaga

SEQ ID NO: 362916 - DNA, 19 bp, Homo sapiens
gaaaaggaatgcaagagaa

SEQ ID NO: 362917 - DNA, 18 bp, Homo sapiens
gaaaaggctggcaaggtg

SEQ ID NO: 362918 - DNA, 21 bp, Homo sapiens
gaaaagtaaggtgcagttccc

SEQ ID NO: 362919 - DNA, 16 bp, Homo sapiens
gaaaagtacatttaat

SEQ ID NO: 362920 - DNA, 12 bp, Homo sapiens
gaaaagtgcttt

SEQ ID NO: 362921 - DNA, 15 bp, Homo sapiens
gaaaataaaactaag

SEQ ID NO: 362922 - DNA, 21 bp, Homo sapiens
gaaaataaaataaacgaaaca

SEQ ID NO: 362923 - DNA, 14 bp, Homo sapiens
gaaaataaatttaa

SEQ ID NO: 362924 - DNA, 19 bp, Homo sapiens
gaaaatacaacttaaataa

SEQ ID NO: 362925 - DNA, 16 bp, Homo sapiens
gaaaatacaataaact

SEQ ID NO: 362926 - DNA, 18 bp, Homo sapiens
gaaaatagggtccttgaa

SEQ ID NO: 362927 - DNA, 18 bp, Homo sapiens
gaaaatagggtggacaga

SEQ ID NO: 362928 - DNA, 22 bp, Homo sapiens
gaaaatagggtggacagaagct

SEQ ID NO: 362929 - DNA, 17 bp, Homo sapiens
gaaaatatcactttgta

SEQ ID NO: 362930 - DNA, 15 bp, Homo sapiens
gaaaatatgatatat

SEQ ID NO: 362931 - DNA, 21 bp, Homo sapiens
gaaaatattatgtgtttccat

SEQ ID NO: 362932 - DNA, 13 bp, Homo sapiens
gaaaatcaaagca

SEQ ID NO: 362933 - DNA, 14 bp, Homo sapiens
gaaaatccttttaa

SEQ ID NO: 362934 - DNA, 22 bp, Homo sapiens
gaaaatccttttaaccatttta

SEQ ID NO: 362935 - DNA, 19 bp, Homo sapiens
gaaaatcgagttggcaaaa

SEQ ID NO: 362936 - DNA, 21 bp, Homo sapiens
gaaaatctaatattaaaaata

SEQ ID NO: 362937 - DNA, 23 bp, Homo sapiens
gaaaatgccacattttgctttat

SEQ ID NO: 362938 - DNA, 14 bp, Homo sapiens
gaaaatggaacatt

SEQ ID NO: 362939 - DNA, 19 bp, Homo sapiens
gaaaatggaagtggcaata

SEQ ID NO: 362940 - DNA, 19 bp, Homo sapiens
gaaaatggacgtgttatga

SEQ ID NO: 362941 - DNA, 11 bp, Homo sapiens
gaaaatgtaaa

SEQ ID NO: 362942 - DNA, 16 bp, Homo sapiens
gaaaatgtaagtaaat

SEQ ID NO: 362943 - DNA, 19 bp, Homo sapiens
gaaaatgtactgagatttt

SEQ ID NO: 362944 - DNA, 21 bp, Homo sapiens
gaaaatgtcagaaaccagtta

SEQ ID NO: 362945 - DNA, 22 bp, Homo sapiens
gaaaatgtcagaaaccagttat

SEQ ID NO: 362946 - DNA, 21 bp, Homo sapiens
gaaaatgtgccatttttttca

SEQ ID NO: 362947 - DNA, 12 bp, Homo sapiens
gaaaatgtgtct

SEQ ID NO: 362948 - DNA, 15 bp, Homo sapiens
gaaaatgtgtgtttt

SEQ ID NO: 362949 - DNA, 20 bp, Homo sapiens
gaaaatgtttttctgccagg

SEQ ID NO: 362950 - DNA, 18 bp, Homo sapiens
gaaaattacaacagatat

SEQ ID NO: 362951 - DNA, 17 bp, Homo sapiens
gaaaattattttaaaca

SEQ ID NO: 362952 - DNA, 22 bp, Homo sapiens
gaaaattcaaaaagtgtttatt

SEQ ID NO: 362953 - DNA, 14 bp, Homo sapiens
gaaaattccagaaa

SEQ ID NO: 362954 - DNA, 20 bp, Homo sapiens
gaaaattccagaaaggatat

SEQ ID NO: 362955 - DNA, 19 bp, Homo sapiens
gaaaattttattgaatata

SEQ ID NO: 362956 - DNA, 19 bp, Homo sapiens
gaaacaaataatcacattg

SEQ ID NO: 362957 - DNA, 17 bp, Homo sapiens
gaaacaatatgctttac

SEQ ID NO: 362958 - DNA, 15 bp, Homo sapiens
gaaacacaaccactc

SEQ ID NO: 362959 - DNA, 20 bp, Homo sapiens
gaaacacaaccactcaccag

SEQ ID NO: 362960 - DNA, 22 bp, Homo sapiens
gaaacacagtcatgtgtcagct

SEQ ID NO: 362961 - DNA, 20 bp, Homo sapiens
gaaacactcgtgtgcatgag

SEQ ID NO: 362962 - DNA, 21 bp, Homo sapiens
gaaacactcgtgtgcatgaga

SEQ ID NO: 362963 - DNA, 23 bp, Homo sapiens
gaaacactttcttgagcaccagg

SEQ ID NO: 362964 - DNA, 17 bp, Homo sapiens
gaaacagaaaagagaag

SEQ ID NO: 362965 - DNA, 18 bp, Homo sapiens
gaaacagaaaagagaaga

SEQ ID NO: 362966 - DNA, 20 bp, Homo sapiens
gaaacagaaaagagaagaaa

SEQ ID NO: 362967 - DNA, 16 bp, Homo sapiens
gaaacagagtccaatt

SEQ ID NO: 362968 - DNA, 12 bp, Homo sapiens
gaaacagcctgg

SEQ ID NO: 362969 - DNA, 16 bp, Homo sapiens
gaaacagctttcaagt

SEQ ID NO: 362970 - DNA, 20 bp, Homo sapiens
gaaacagggggaaaatgttt

SEQ ID NO: 362971 - DNA, 20 bp, Homo sapiens
gaaacatgactcgtatatgt

SEQ ID NO: 362972 - DNA, 19 bp, Homo sapiens
gaaacattccgaagaggga

SEQ ID NO: 362973 - DNA, 23 bp, Homo sapiens
gaaacatttgacacataaaagta

SEQ ID NO: 362974 - DNA, 17 bp, Homo sapiens
gaaaccaagtgggctgg

SEQ ID NO: 362975 - DNA, 18 bp, Homo sapiens
gaaaccaagtgggctggt

SEQ ID NO: 362976 - DNA, 21 bp, Homo sapiens
gaaaccacacttcttgaaaca

SEQ ID NO: 362977 - DNA, 16 bp, Homo sapiens
gaaaccactgggcata

SEQ ID NO: 362978 - DNA, 22 bp, Homo sapiens
gaaaccagaatgattttgacat

SEQ ID NO: 362979 - DNA, 15 bp, Homo sapiens
gaaaccccacttcca

SEQ ID NO: 362980 - DNA, 17 bp, Homo sapiens
gaaaccccgtctctact

SEQ ID NO: 362981 - DNA, 15 bp, Homo sapiens
gaaaccctatttccc

SEQ ID NO: 362982 - DNA, 17 bp, Homo sapiens
gaaaccgtaattttatt

SEQ ID NO: 362983 - DNA, 13 bp, Homo sapiens
gaaacctccatcc

SEQ ID NO: 362984 - DNA, 15 bp, Homo sapiens
gaaacctccatcctg

SEQ ID NO: 362985 - DNA, 18 bp, Homo sapiens
gaaacctgaaaaaaagtt

SEQ ID NO: 362986 - DNA, 13 bp, Homo sapiens
gaaacctgccctg

SEQ ID NO: 362987 - DNA, 13 bp, Homo sapiens
gaaaccttaatat

SEQ ID NO: 362988 - DNA, 20 bp, Homo sapiens
gaaaccttattgtacctctc

SEQ ID NO: 362989 - DNA, 19 bp, Homo sapiens
gaaacctttatccctgctt

SEQ ID NO: 362990 - DNA, 21 bp, Homo sapiens
gaaacctttatccctgcttat

SEQ ID NO: 362991 - DNA, 18 bp, Homo sapiens
gaaacgagatttgccaaa

SEQ ID NO: 362992 - DNA, 18 bp, Homo sapiens
gaaactaccagtgggcat

SEQ ID NO: 362993 - DNA, 22 bp, Homo sapiens
gaaactagacttgaggaaacca

SEQ ID NO: 362994 - DNA, 21 bp, Homo sapiens
gaacgacaatagctttaccct

SEQ ID NO: 362995 - DNA, 13 bp, Homo sapiens
gaacgcaccccac

SEQ ID NO: 362996 - DNA, 22 bp, Homo sapiens
gaacggcatgtgaattctgtga

SEQ ID NO: 362997 - DNA, 20 bp, Homo sapiens
gaacggggtggacgagggag

SEQ ID NO: 362998 - DNA, 13 bp, Homo sapiens
gaacgtttctggc

SEQ ID NO: 362999 - DNA, 21 bp, Homo sapiens
gaactaatttggtttttactc

SEQ ID NO: 363000 - DNA, 22 bp, Homo sapiens
gaactacgcttgctcatttttt

SEQ ID NO: 363001 - DNA, 16 bp, Homo sapiens
gaactagggaagctca

SEQ ID NO: 363002 - DNA, 19 bp, Homo sapiens
gaactagtggtggctctga

SEQ ID NO: 363003 - DNA, 15 bp, Homo sapiens
gaactataaagaagt

SEQ ID NO: 363004 - DNA, 15 bp, Homo sapiens
gaactatgaactaca

SEQ ID NO: 363005 - DNA, 14 bp, Homo sapiens
gaactcagccttaa

SEQ ID NO: 363006 - DNA, 21 bp, Homo sapiens
gaactcagccttaagaaagct

SEQ ID NO: 363007 - DNA, 14 bp, Homo sapiens
gaactccatacagc

SEQ ID NO: 363008 - DNA, 20 bp, Homo sapiens
gaactcccaagaacagcagg

SEQ ID NO: 363009 - DNA, 11 bp, Homo sapiens
gaactcctggg

SEQ ID NO: 363010 - DNA, 20 bp, Homo sapiens
gaactccttattttgtatta

SEQ ID NO: 363011 - DNA, 16 bp, Homo sapiens
gaactcgatgcactga

SEQ ID NO: 363012 - DNA, 21 bp, Homo sapiens
gaactctaccctggtaggaaa

SEQ ID NO: 363013 - DNA, 17 bp, Homo sapiens
gaactctcaaaagtcta

SEQ ID NO: 363014 - DNA, 12 bp, Homo sapiens
gaactctcagac

SEQ ID NO: 363015 - DNA, 12 bp, Homo sapiens
gaactctcagga

SEQ ID NO: 363016 - DNA, 16 bp, Homo sapiens
gaactctcctcttttt

SEQ ID NO: 363017 - DNA, 22 bp, Homo sapiens
gaactctcctctttttttaaaa

SEQ ID NO: 363018 - DNA, 21 bp, Homo sapiens
gaactctcctgctcctcagga

SEQ ID NO: 363019 - DNA, 21 bp, Homo sapiens
gaactctctagttccctcagt

SEQ ID NO: 363020 - DNA, 13 bp, Homo sapiens
gaactctctgtct

SEQ ID NO: 363021 - DNA, 21 bp, Homo sapiens
gaactctctgtcttctctcca

SEQ ID NO: 363022 - DNA, 13 bp, Homo sapiens
gaactcttaatca

SEQ ID NO: 363023 - DNA, 22 bp, Homo sapiens
gaactcttcctggaatgcattc

SEQ ID NO: 363024 - DNA, 23 bp, Homo sapiens
gaactcttcctggaatgcattca

SEQ ID NO: 363025 - DNA, 18 bp, Homo sapiens
gaactctttctggcctgc

SEQ ID NO: 363026 - DNA, 15 bp, Homo sapiens
gaactgaaaacataa

SEQ ID NO: 363027 - DNA, 18 bp, Homo sapiens
gaactgaaaacataaaaa

SEQ ID NO: 363028 - DNA, 19 bp, Homo sapiens
gaactgaaaacataaaaag

SEQ ID NO: 363029 - DNA, 14 bp, Homo sapiens
gaactgagaccttg

SEQ ID NO: 363030 - DNA, 17 bp, Homo sapiens
gaactgcaatttccatt

SEQ ID NO: 363031 - DNA, 23 bp, Homo sapiens
gaactgcatggacctaacattcg

SEQ ID NO: 363032 - DNA, 20 bp, Homo sapiens
gaactgcatgtataaatgaa

SEQ ID NO: 363033 - DNA, 13 bp, Homo sapiens
gaactgcccccac

SEQ ID NO: 363034 - DNA, 15 bp, Homo sapiens
gaactgcccccactg

SEQ ID NO: 363035 - DNA, 17 bp, Homo sapiens
gaactgcctctttcctg

SEQ ID NO: 363036 - DNA, 12 bp, Homo sapiens
gaactgctgcca

SEQ ID NO: 363037 - DNA, 14 bp, Homo sapiens
gaactgctgctggt

SEQ ID NO: 363038 - DNA, 21 bp, Homo sapiens
gaactgctgctggtcaccccc

SEQ ID NO: 363039 - DNA, 16 bp, Homo sapiens
gaactgcttgcatttc

SEQ ID NO: 363040 - DNA, 18 bp, Homo sapiens
gaactggccgctgggaga

SEQ ID NO: 363041 - DNA, 18 bp, Homo sapiens
gaactgggaagatgctgg

SEQ ID NO: 363042 - DNA, 21 bp, Homo sapiens
gaactgggaagatgctggccc

SEQ ID NO: 363043 - DNA, 16 bp, Homo sapiens
gaactggttcttgcct

SEQ ID NO: 363044 - DNA, 17 bp, Homo sapiens
gaactgtcccacaaaat

SEQ ID NO: 363045 - DNA, 18 bp, Homo sapiens
gaactgtcccacaaaata

SEQ ID NO: 363046 - DNA, 20 bp, Homo sapiens
gaactgtctagatggatgaa

SEQ ID NO: 363047 - DNA, 13 bp, Homo sapiens
gaactgtgacagg

SEQ ID NO: 363048 - DNA, 16 bp, Homo sapiens
gaactgtgacaggaag

SEQ ID NO: 363049 - DNA, 17 bp, Homo sapiens
gaactgtgacaggaagc

SEQ ID NO: 363050 - DNA, 15 bp, Homo sapiens
gaactgttagatgct

SEQ ID NO: 363051 - DNA, 16 bp, Homo sapiens
gaactgttcatttcca

SEQ ID NO: 363052 - DNA, 18 bp, Homo sapiens
gaacttacacttggagcc

SEQ ID NO: 363053 - DNA, 23 bp, Homo sapiens
gaacttacacttggagcccgtgc

SEQ ID NO: 363054 - DNA, 20 bp, Homo sapiens
gaacttactgtgtaaataaa

SEQ ID NO: 363055 - DNA, 20 bp, Homo sapiens
gaacttatcctaaaacaaat

SEQ ID NO: 363056 - DNA, 14 bp, Homo sapiens
gaacttctaatata

SEQ ID NO: 363057 - DNA, 16 bp, Homo sapiens
gaacttgaggacacat

SEQ ID NO: 363058 - DNA, 18 bp, Homo sapiens
gaacttgaggacacatgt

SEQ ID NO: 363059 - DNA, 21 bp, Homo sapiens
gaacttgaggacacatgtcca

SEQ ID NO: 363060 - DNA, 13 bp, Homo sapiens
gaacttgatttgc

SEQ ID NO: 363061 - DNA, 17 bp, Homo sapiens
gaacttgatttgcatgg

SEQ ID NO: 363062 - DNA, 16 bp, Homo sapiens
gaacttgctgctgtgc

SEQ ID NO: 363063 - DNA, 17 bp, Homo sapiens
gaacttggggaacaagg

SEQ ID NO: 363064 - DNA, 19 bp, Homo sapiens
gaacttggtgcctaatgtt

SEQ ID NO: 363065 - DNA, 23 bp, Homo sapiens
gaacttggttcccatttgctcct

SEQ ID NO: 363066 - DNA, 14 bp, Homo sapiens
gaactttctgcttt

SEQ ID NO: 363067 - DNA, 17 bp, Homo sapiens
gaactttgcacacttca

SEQ ID NO: 363068 - DNA, 16 bp, Homo sapiens
gaactttgtttccaga

SEQ ID NO: 363069 - DNA, 17 bp, Homo sapiens
gaactttgtttccagaa

SEQ ID NO: 363070 - DNA, 17 bp, Homo sapiens
gaagaaaagcactggga

SEQ ID NO: 363071 - DNA, 13 bp, Homo sapiens
gaagaaaataacc

SEQ ID NO: 363072 - DNA, 12 bp, Homo sapiens
gaagaaacaaaa

SEQ ID NO: 363073 - DNA, 14 bp, Homo sapiens
gaagaaagaagcac

SEQ ID NO: 363074 - DNA, 18 bp, Homo sapiens
gaagaacacagcatgtgc

SEQ ID NO: 363075 - DNA, 20 bp, Homo sapiens
gaagaacagctgttcctgtg

SEQ ID NO: 363076 - DNA, 14 bp, Homo sapiens
gaagaacatcaaga

SEQ ID NO: 363077 - DNA, 13 bp, Homo sapiens
gaagaagaaaaca

SEQ ID NO: 363078 - DNA, 22 bp, Homo sapiens
gaagaagggaaattcacactgt

SEQ ID NO: 363079 - DNA, 19 bp, Homo sapiens
gaagaatattcaggactta

SEQ ID NO: 363080 - DNA, 17 bp, Homo sapiens
gaagaatgtctcctgcc

SEQ ID NO: 363081 - DNA, 15 bp, Homo sapiens
gaagaattaatgaca

SEQ ID NO: 363082 - DNA, 23 bp, Homo sapiens
gaagacacacagccaacgttcat

SEQ ID NO: 363083 - DNA, 15 bp, Homo sapiens
gaagacatggagact

SEQ ID NO: 363084 - DNA, 20 bp, Homo sapiens
gaagacatggagactcctgc

SEQ ID NO: 363085 - DNA, 21 bp, Homo sapiens
gaagacatggagactcctgcc

SEQ ID NO: 363086 - DNA, 22 bp, Homo sapiens
gaagaccaaggcctcggcagaa

SEQ ID NO: 363087 - DNA, 20 bp, Homo sapiens
gaagaccagctttgcagtga

SEQ ID NO: 363088 - DNA, 18 bp, Homo sapiens
gaagaccagtcacagcca

SEQ ID NO: 363089 - DNA, 21 bp, Homo sapiens
gaagaccagtcacagccattt

SEQ ID NO: 363090 - DNA, 15 bp, Homo sapiens
gaagaccccacccaa

SEQ ID NO: 363091 - DNA, 16 bp, Homo sapiens
gaagaccccacccaag

SEQ ID NO: 363092 - DNA, 21 bp, Homo sapiens
gaagactgtattttcaggaag

SEQ ID NO: 363093 - DNA, 19 bp, Homo sapiens
gaagacttagatctgagcc

SEQ ID NO: 363094 - DNA, 20 bp, Homo sapiens
gaagacttggcccaggaaaa

SEQ ID NO: 363095 - DNA, 13 bp, Homo sapiens
gaagagagcctgc

SEQ ID NO: 363096 - DNA, 22 bp, Homo sapiens
gaagagaggagttcaatgatct

SEQ ID NO: 363097 - DNA, 12 bp, Homo sapiens
gaagagaggcac

SEQ ID NO: 363098 - DNA, 22 bp, Homo sapiens
gaagagatgtggcaaagtgctg

SEQ ID NO: 363099 - DNA, 23 bp, Homo sapiens
gaagagcactgggctaatttgta

SEQ ID NO: 363100 - DNA, 18 bp, Homo sapiens
gaagagcagcctgatggc

SEQ ID NO: 363101 - DNA, 22 bp, Homo sapiens
gaagagcagcctgatggccaag

SEQ ID NO: 363102 - DNA, 19 bp, Homo sapiens
gaagagcgctcctctgcct

SEQ ID NO: 363103 - DNA, 10 bp, Homo sapiens
gaagagctga

SEQ ID NO: 363104 - DNA, 23 bp, Homo sapiens
gaagagctgagtactcaggccac

SEQ ID NO: 363105 - DNA, 17 bp, Homo sapiens
gaagaggaactgggcct

SEQ ID NO: 363106 - DNA, 22 bp, Homo sapiens
gaagagggaatggatggggaga

SEQ ID NO: 363107 - DNA, 23 bp, Homo sapiens
gaagaggggaggggcctagggag

SEQ ID NO: 363108 - DNA, 17 bp, Homo sapiens
gaagaggggccagatga

SEQ ID NO: 363109 - DNA, 15 bp, Homo sapiens
gaagagttttagaga

SEQ ID NO: 363110 - DNA, 16 bp, Homo sapiens
gaagataatttgcata

SEQ ID NO: 363111 - DNA, 16 bp, Homo sapiens
gaagataggctctgca

SEQ ID NO: 363112 - DNA, 20 bp, Homo sapiens
gaagataggctctgcacaga

SEQ ID NO: 363113 - DNA, 19 bp, Homo sapiens
gaagatcactttgctctga

SEQ ID NO: 363114 - DNA, 22 bp, Homo sapiens
gaagatccgagcgacggctcct

SEQ ID NO: 363115 - DNA, 16 bp, Homo sapiens
gaagatcttgagagct

SEQ ID NO: 363116 - DNA, 22 bp, Homo sapiens
gaagatcttgagagctgctgag

SEQ ID NO: 363117 - DNA, 19 bp, Homo sapiens
gaagatgaaaccgtccctg

SEQ ID NO: 363118 - DNA, 16 bp, Homo sapiens
gaagatgctggcccca

SEQ ID NO: 363119 - DNA, 21 bp, Homo sapiens
gaagatgtattcagagccacc

SEQ ID NO: 363120 - DNA, 23 bp, Homo sapiens
gaagatgttgaagaatacagtta

SEQ ID NO: 363121 - DNA, 15 bp, Homo sapiens
gaagattatttttta

SEQ ID NO: 363122 - DNA, 12 bp, Homo sapiens
gaagatttacct

SEQ ID NO: 363123 - DNA, 22 bp, Homo sapiens
gaatgaaatataaactgtgaga

SEQ ID NO: 363124 - DNA, 23 bp, Homo sapiens
gaatgaaatataaactgtgagat

SEQ ID NO: 363125 - DNA, 21 bp, Homo sapiens
gaatgaactgtctagatggat

SEQ ID NO: 363126 - DNA, 18 bp, Homo sapiens
gaatgaatgtcagtgtga

SEQ ID NO: 363127 - DNA, 16 bp, Homo sapiens
gaatgagaaagaaaag

SEQ ID NO: 363128 - DNA, 12 bp, Homo sapiens
gaatgagagagt

SEQ ID NO: 363129 - DNA, 20 bp, Homo sapiens
gaatgaggaggaaggagaga

SEQ ID NO: 363130 - DNA, 23 bp, Homo sapiens
gaatgagtaaataaactcttcaa

SEQ ID NO: 363131 - DNA, 23 bp, Homo sapiens
gaatgattctaatttttaagcaa

SEQ ID NO: 363132 - DNA, 15 bp, Homo sapiens
gaatgcaaaaagata

SEQ ID NO: 363133 - DNA, 18 bp, Homo sapiens
gaatgcagattcctgggc

SEQ ID NO: 363134 - DNA, 22 bp, Homo sapiens
gaatgcagattcctgggcctgt

SEQ ID NO: 363135 - DNA, 23 bp, Homo sapiens
gaatgcagattcctgggcctgtc

SEQ ID NO: 363136 - DNA, 21 bp, Homo sapiens
gaatgcagggaagagggcagt

SEQ ID NO: 363137 - DNA, 14 bp, Homo sapiens
gaatgcatgtaagg

SEQ ID NO: 363138 - DNA, 13 bp, Homo sapiens
gaatgcattcaaa

SEQ ID NO: 363139 - DNA, 14 bp, Homo sapiens
gaatgccctcaggg

SEQ ID NO: 363140 - DNA, 15 bp, Homo sapiens
gaatgcctgtgccaa

SEQ ID NO: 363141 - DNA, 13 bp, Homo sapiens
gaatgctccccca

SEQ ID NO: 363142 - DNA, 21 bp, Homo sapiens
gaatgctcccccatcctcccc

SEQ ID NO: 363143 - DNA, 14 bp, Homo sapiens
gaatgctgtacctt

SEQ ID NO: 363144 - DNA, 16 bp, Homo sapiens
gaatgcttctgagagc

SEQ ID NO: 363145 - DNA, 13 bp, Homo sapiens
gaatgcttggaat

SEQ ID NO: 363146 - DNA, 22 bp, Homo sapiens
gaatggaagggttctggctgcc

SEQ ID NO: 363147 - DNA, 18 bp, Homo sapiens
gaatggagtccagacctg

SEQ ID NO: 363148 - DNA, 15 bp, Homo sapiens
gaatggatggggaga

SEQ ID NO: 363149 - DNA, 14 bp, Homo sapiens
gaatggctctggct

SEQ ID NO: 363150 - DNA, 14 bp, Homo sapiens
gaatgggagccaga

SEQ ID NO: 363151 - DNA, 17 bp, Homo sapiens
gaatggggacctggggt

SEQ ID NO: 363152 - DNA, 17 bp, Homo sapiens
gaatggggcttccatgg

SEQ ID NO: 363153 - DNA, 18 bp, Homo sapiens
gaatggtaaccgagccag

SEQ ID NO: 363154 - DNA, 14 bp, Homo sapiens
gaatggtgcagaaa

SEQ ID NO: 363155 - DNA, 17 bp, Homo sapiens
gaatggttaataaaact

SEQ ID NO: 363156 - DNA, 20 bp, Homo sapiens
gaatggttaataaaactgca

SEQ ID NO: 363157 - DNA, 16 bp, Homo sapiens
gaatggttccatgcct

SEQ ID NO: 363158 - DNA, 20 bp, Homo sapiens
gaatggttccatgcctgagg

SEQ ID NO: 363159 - DNA, 16 bp, Homo sapiens
gaatggtttttgttga

SEQ ID NO: 363160 - DNA, 17 bp, Homo sapiens
gaatgtaaatttgtact

SEQ ID NO: 363161 - DNA, 19 bp, Homo sapiens
gaatgtaatcaatgtttct

SEQ ID NO: 363162 - DNA, 14 bp, Homo sapiens
gaatgtacaaagat

SEQ ID NO: 363163 - DNA, 14 bp, Homo sapiens
gaatgtactctgtt

SEQ ID NO: 363164 - DNA, 16 bp, Homo sapiens
gaatgtagcatctgag

SEQ ID NO: 363165 - DNA, 15 bp, Homo sapiens
gaatgtagctggttt

SEQ ID NO: 363166 - DNA, 17 bp, Homo sapiens
gaatgtatcaggaaata

SEQ ID NO: 363167 - DNA, 15 bp, Homo sapiens
gaatgtcatttgcta

SEQ ID NO: 363168 - DNA, 16 bp, Homo sapiens
gaatgtcatttgctaa

SEQ ID NO: 363169 - DNA, 17 bp, Homo sapiens
gaatgtcatttgctaat

SEQ ID NO: 363170 - DNA, 18 bp, Homo sapiens
gaatgtccccattctata

SEQ ID NO: 363171 - DNA, 21 bp, Homo sapiens
gaatgtgatcatctttgctga

SEQ ID NO: 363172 - DNA, 21 bp, Homo sapiens
gaatgtgcaggtttgttacat

SEQ ID NO: 363173 - DNA, 16 bp, Homo sapiens
gaatgtgcccctggcc

SEQ ID NO: 363174 - DNA, 18 bp, Homo sapiens
gaatgtgcccctggccca

SEQ ID NO: 363175 - DNA, 14 bp, Homo sapiens
gaatgttaagcaga

SEQ ID NO: 363176 - DNA, 15 bp, Homo sapiens
gaatgttaagcagat

SEQ ID NO: 363177 - DNA, 20 bp, Homo sapiens
gaatgttacattgtttgtct

SEQ ID NO: 363178 - DNA, 22 bp, Homo sapiens
gaatgttactttggaatgacta

SEQ ID NO: 363179 - DNA, 17 bp, Homo sapiens
gaatgttatatcatcaa

SEQ ID NO: 363180 - DNA, 22 bp, Homo sapiens
gaatgttatatcatcaatactt

SEQ ID NO: 363181 - DNA, 16 bp, Homo sapiens
gaatgttccctgcacc

SEQ ID NO: 363182 - DNA, 17 bp, Homo sapiens
gaatgttccctgcaccc

SEQ ID NO: 363183 - DNA, 22 bp, Homo sapiens
gaatgttccctgcaccctggaa

SEQ ID NO: 363184 - DNA, 15 bp, Homo sapiens
gaatgttctgacatt

SEQ ID NO: 363185 - DNA, 21 bp, Homo sapiens
gaatgtttacactctttgtaa

SEQ ID NO: 363186 - DNA, 16 bp, Homo sapiens
gaatgtttatagcaaa

SEQ ID NO: 363187 - DNA, 20 bp, Homo sapiens
gaatgtttcagctgcagttg

SEQ ID NO: 363188 - DNA, 13 bp, Homo sapiens
gaattaaaacaat

SEQ ID NO: 363189 - DNA, 23 bp, Homo sapiens
gaattaaacccacaagctgcctc

SEQ ID NO: 363190 - DNA, 22 bp, Homo sapiens
gaattaaactcctactgcttcc

SEQ ID NO: 363191 - DNA, 13 bp, Homo sapiens
gaattaaatttaa

SEQ ID NO: 363192 - DNA, 18 bp, Homo sapiens
gaattaacctggtgctgg

SEQ ID NO: 363193 - DNA, 21 bp, Homo sapiens
gaattacatgtaaaacattat

SEQ ID NO: 363194 - DNA, 22 bp, Homo sapiens
gaattacatgtaaaacattatc

SEQ ID NO: 363195 - DNA, 22 bp, Homo sapiens
gaattatacagacctaatatca

SEQ ID NO: 363196 - DNA, 16 bp, Homo sapiens
gaattatgtataacaa

SEQ ID NO: 363197 - DNA, 17 bp, Homo sapiens
gaattattacatcttta

SEQ ID NO: 363198 - DNA, 20 bp, Homo sapiens
gaattattttgaatgtcaca

SEQ ID NO: 363199 - DNA, 16 bp, Homo sapiens
gaattattttgttact

SEQ ID NO: 363200 - DNA, 16 bp, Homo sapiens
gaattattttttttct

SEQ ID NO: 363201 - DNA, 18 bp, Homo sapiens
gaattcagcaccctgggt

SEQ ID NO: 363202 - DNA, 12 bp, Homo sapiens
gaattcataaaa

SEQ ID NO: 363203 - DNA, 15 bp, Homo sapiens
gaattcataaaaata

SEQ ID NO: 363204 - DNA, 17 bp, Homo sapiens
gaattcatactctgttg

SEQ ID NO: 363205 - DNA, 22 bp, Homo sapiens
gaattcatactctgttgcctcc

SEQ ID NO: 363206 - DNA, 20 bp, Homo sapiens
gaattccctgaagcaacact

SEQ ID NO: 363207 - DNA, 18 bp, Homo sapiens
gaattctaagattgtaca

SEQ ID NO: 363208 - DNA, 15 bp, Homo sapiens
gaattctatttgctg

SEQ ID NO: 363209 - DNA, 20 bp, Homo sapiens
gaattctctctaaaaataaa

SEQ ID NO: 363210 - DNA, 18 bp, Homo sapiens
gaattctgcaactagcca

SEQ ID NO: 363211 - DNA, 23 bp, Homo sapiens
gaattctgcaactagccaaggct

SEQ ID NO: 363212 - DNA, 13 bp, Homo sapiens
gaattctgtgaag

SEQ ID NO: 363213 - DNA, 17 bp, Homo sapiens
gaattctgtgaagaatg

SEQ ID NO: 363214 - DNA, 18 bp, Homo sapiens
gaattctgtgaagaatga

SEQ ID NO: 363215 - DNA, 17 bp, Homo sapiens
gaattgagagatgtttt

SEQ ID NO: 363216 - DNA, 19 bp, Homo sapiens
gaattgagaggtgggggat

SEQ ID NO: 363217 - DNA, 15 bp, Homo sapiens
gaattgataataaac

SEQ ID NO: 363218 - DNA, 23 bp, Homo sapiens
gaattgataataaactgtcctct

SEQ ID NO: 363219 - DNA, 21 bp, Homo sapiens
gaattgatcattttcccccca

SEQ ID NO: 363220 - DNA, 21 bp, Homo sapiens
gaattgcattttttaaaacaa

SEQ ID NO: 363221 - DNA, 14 bp, Homo sapiens
gaattggtgtatat

SEQ ID NO: 363222 - DNA, 15 bp, Homo sapiens
gaattgtaaggaatg

SEQ ID NO: 363223 - DNA, 16 bp, Homo sapiens
gaatttaaataaagtt

SEQ ID NO: 363224 - DNA, 17 bp, Homo sapiens
gaatttaaatataattc

SEQ ID NO: 363225 - DNA, 21 bp, Homo sapiens
gaatttagggagaaatgttgt

SEQ ID NO: 363226 - DNA, 14 bp, Homo sapiens
gaatttagtcatta

SEQ ID NO: 363227 - DNA, 22 bp, Homo sapiens
gaatttatcacacttctgtgag

SEQ ID NO: 363228 - DNA, 15 bp, Homo sapiens
gaatttcccaaagca

SEQ ID NO: 363229 - DNA, 15 bp, Homo sapiens
gaatttgaaaggaaa

SEQ ID NO: 363230 - DNA, 16 bp, Homo sapiens
gaatttgaatgaaaaa

SEQ ID NO: 363231 - DNA, 21 bp, Homo sapiens
gaatttgtaacctcagctctg

SEQ ID NO: 363232 - DNA, 14 bp, Homo sapiens
gaattttaaaatgt

SEQ ID NO: 363233 - DNA, 21 bp, Homo sapiens
gaattttaaaatgtagaagaa

SEQ ID NO: 363234 - DNA, 15 bp, Homo sapiens
gaattttaagtgctt

SEQ ID NO: 363235 - DNA, 12 bp, Homo sapiens
gaattttatatt

SEQ ID NO: 363236 - DNA, 14 bp, Homo sapiens
gaattttatctttt

SEQ ID NO: 363237 - DNA, 23 bp, Homo sapiens
gaattttggctgtgtctcccttc

SEQ ID NO: 363238 - DNA, 13 bp, Homo sapiens
gaattttttgatc

SEQ ID NO: 363239 - DNA, 15 bp, Homo sapiens
gacaaaaacaagact

SEQ ID NO: 363240 - DNA, 17 bp, Homo sapiens
gacaaaaagaacaaaaa

SEQ ID NO: 363241 - DNA, 15 bp, Homo sapiens
gacaaaggatgaaga

SEQ ID NO: 363242 - DNA, 15 bp, Homo sapiens
gacaaaggcccagaa

SEQ ID NO: 363243 - DNA, 17 bp, Homo sapiens
gacaaaggccttaacaa

SEQ ID NO: 363244 - DNA, 17 bp, Homo sapiens
gacaaatgggactgatg

SEQ ID NO: 363245 - DNA, 21 bp, Homo sapiens
gacaaatgggactgatgtcat

SEQ ID NO: 363246 - DNA, 20 bp, Homo sapiens
gacaacacacacacacacaa

SEQ ID NO: 363247 - DNA, 23 bp, Homo sapiens
gacaacagagatgccatgatatc

SEQ ID NO: 363248 - DNA, 16 bp, Homo sapiens
gacaacattttattac

SEQ ID NO: 363249 - DNA, 19 bp, Homo sapiens
gacaaccaccgctccccag

SEQ ID NO: 363250 - DNA, 15 bp, Homo sapiens
gacaaccactggtct

SEQ ID NO: 363251 - DNA, 20 bp, Homo sapiens
gacaaccctgcaaaggactg

SEQ ID NO: 363252 - DNA, 20 bp, Homo sapiens
gacaaccgatgctccagcca

SEQ ID NO: 363253 - DNA, 18 bp, Homo sapiens
gaccctgccaactttcca

SEQ ID NO: 363254 - DNA, 16 bp, Homo sapiens
gaccctgccgaggggg

SEQ ID NO: 363255 - DNA, 17 bp, Homo sapiens
gaccctgccgagggggc

SEQ ID NO: 363256 - DNA, 15 bp, Homo sapiens
gaccctgcctgagcc

SEQ ID NO: 363257 - DNA, 17 bp, Homo sapiens
gaccctgcctgagccca

SEQ ID NO: 363258 - DNA, 19 bp, Homo sapiens
gaccctggaattcagcacc

SEQ ID NO: 363259 - DNA, 16 bp, Homo sapiens
gaccctggagcccggc

SEQ ID NO: 363260 - DNA, 18 bp, Homo sapiens
gaccctggagcccggcag

SEQ ID NO: 363261 - DNA, 20 bp, Homo sapiens
gaccctgggtcaccttcctg

SEQ ID NO: 363262 - DNA, 21 bp, Homo sapiens
gaccctgggtcaccttcctgg

SEQ ID NO: 363263 - DNA, 17 bp, Homo sapiens
gaccctgtctttgctgt

SEQ ID NO: 363264 - DNA, 22 bp, Homo sapiens
gaccctgtgatgcctgacacag

SEQ ID NO: 363265 - DNA, 14 bp, Homo sapiens
gacccttcagggcc

SEQ ID NO: 363266 - DNA, 15 bp, Homo sapiens
gacccttcagggcca

SEQ ID NO: 363267 - DNA, 13 bp, Homo sapiens
gacccttctactt

SEQ ID NO: 363268 - DNA, 15 bp, Homo sapiens
gacccttgcattaga

SEQ ID NO: 363269 - DNA, 18 bp, Homo sapiens
gacccttttgggtttctg

SEQ ID NO: 363270 - DNA, 17 bp, Homo sapiens
gaccgaggctggagctg

SEQ ID NO: 363271 - DNA, 16 bp, Homo sapiens
gaccgccagatggggc

SEQ ID NO: 363272 - DNA, 16 bp, Homo sapiens
gaccgcgtagagagcc

SEQ ID NO: 363273 - DNA, 19 bp, Homo sapiens
gaccgcttcacccctgcac

SEQ ID NO: 363274 - DNA, 16 bp, Homo sapiens
gaccggaattgagagg

SEQ ID NO: 363275 - DNA, 17 bp, Homo sapiens
gaccggaattgagaggt

SEQ ID NO: 363276 - DNA, 19 bp, Homo sapiens
gaccggaattgagaggtgg

SEQ ID NO: 363277 - DNA, 17 bp, Homo sapiens
gaccggggtcctgaggc

SEQ ID NO: 363278 - DNA, 14 bp, Homo sapiens
gaccgtactctcac

SEQ ID NO: 363279 - DNA, 20 bp, Homo sapiens
gaccgtactctcacatgtgg

SEQ ID NO: 363280 - DNA, 21 bp, Homo sapiens
gaccgttttcatcctggcctc

SEQ ID NO: 363281 - DNA, 14 bp, Homo sapiens
gacctaatatcatt

SEQ ID NO: 363282 - DNA, 15 bp, Homo sapiens
gacctaatatcattt

SEQ ID NO: 363283 - DNA, 19 bp, Homo sapiens
gacctacattccctctcct

SEQ ID NO: 363284 - DNA, 21 bp, Homo sapiens
gacctactaggagaggggggc

SEQ ID NO: 363285 - DNA, 17 bp, Homo sapiens
gacctagggaggacctt

SEQ ID NO: 363286 - DNA, 19 bp, Homo sapiens
gacctatgataaataacca

SEQ ID NO: 363287 - DNA, 22 bp, Homo sapiens
gacctatgtcctaaggacacac

SEQ ID NO: 363288 - DNA, 23 bp, Homo sapiens
gacctatgtcctaaggacacact

SEQ ID NO: 363289 - DNA, 22 bp, Homo sapiens
gacctatgtttgctcagaacac

SEQ ID NO: 363290 - DNA, 23 bp, Homo sapiens
gacctattgccaggaatgtttca

SEQ ID NO: 363291 - DNA, 15 bp, Homo sapiens
gacctcaacaaagaa

SEQ ID NO: 363292 - DNA, 15 bp, Homo sapiens
gacctcaagcaacca

SEQ ID NO: 363293 - DNA, 21 bp, Homo sapiens
gacctcagagtccaggcccca

SEQ ID NO: 363294 - DNA, 15 bp, Homo sapiens
gacctcagctgcaca

SEQ ID NO: 363295 - DNA, 19 bp, Homo sapiens
gacctcagctgcacattcc

SEQ ID NO: 363296 - DNA, 20 bp, Homo sapiens
gacctcagctgcacattcct

SEQ ID NO: 363297 - DNA, 17 bp, Homo sapiens
gacctcagtttctgttg

SEQ ID NO: 363298 - DNA, 22 bp, Homo sapiens
gacctcagtttctgttgtttct

SEQ ID NO: 363299 - DNA, 10 bp, Homo sapiens
gacctcatca

SEQ ID NO: 363300 - DNA, 13 bp, Homo sapiens
gacctcatcagga

SEQ ID NO: 363301 - DNA, 16 bp, Homo sapiens
gacctccacctgggag

SEQ ID NO: 363302 - DNA, 20 bp, Homo sapiens
gacctccctccctccccagt

SEQ ID NO: 363303 - DNA, 19 bp, Homo sapiens
gacctccttagccctgtct

SEQ ID NO: 363304 - DNA, 19 bp, Homo sapiens
gacctcgatgtccagctgc

SEQ ID NO: 363305 - DNA, 22 bp, Homo sapiens
gacctcggctgtgtggggaggg

SEQ ID NO: 363306 - DNA, 15 bp, Homo sapiens
gacctcgtgctttaa

SEQ ID NO: 363307 - DNA, 17 bp, Homo sapiens
gacctcgtttgggagtg

SEQ ID NO: 363308 - DNA, 18 bp, Homo sapiens
gacctctactttccaggc

SEQ ID NO: 363309 - DNA, 19 bp, Homo sapiens
gacctctgaagagctgagt

SEQ ID NO: 363310 - DNA, 11 bp, Homo sapiens
gacctctgggc

SEQ ID NO: 363311 - DNA, 14 bp, Homo sapiens
gacctctgttgtcc

SEQ ID NO: 363312 - DNA, 22 bp, Homo sapiens
gacctgaactctgcaactgaat

SEQ ID NO: 363313 - DNA, 23 bp, Homo sapiens
gacctgaagagcgctcctctgcc

SEQ ID NO: 363314 - DNA, 23 bp, Homo sapiens
gacctgaagggtgacatcccagg

SEQ ID NO: 363315 - DNA, 16 bp, Homo sapiens
gacctgaatgcttctg

SEQ ID NO: 363316 - DNA, 23 bp, Homo sapiens
gacctgatcattacatggctgtg

SEQ ID NO: 363317 - DNA, 19 bp, Homo sapiens
gacctgcccccgctctgcc

SEQ ID NO: 363318 - DNA, 22 bp, Homo sapiens
gacctgcctcctgcctgcccct

SEQ ID NO: 363319 - DNA, 13 bp, Homo sapiens
gacctgcctgtgt

SEQ ID NO: 363320 - DNA, 17 bp, Homo sapiens
gacctgctccgccagga

SEQ ID NO: 363321 - DNA, 11 bp, Homo sapiens
gacctgctgct

SEQ ID NO: 363322 - DNA, 14 bp, Homo sapiens
gacctggaaccaga

SEQ ID NO: 363323 - DNA, 15 bp, Homo sapiens
gacctggaagagctg

SEQ ID NO: 363324 - DNA, 15 bp, Homo sapiens
gacctgggccctggt

SEQ ID NO: 363325 - DNA, 11 bp, Homo sapiens
gacctgtccag

SEQ ID NO: 363326 - DNA, 13 bp, Homo sapiens
gacctgtcttcca

SEQ ID NO: 363327 - DNA, 17 bp, Homo sapiens
gacctgtgaccagcact

SEQ ID NO: 363328 - DNA, 20 bp, Homo sapiens
gacctgtgctagttttacag

SEQ ID NO: 363329 - DNA, 23 bp, Homo sapiens
gacctgtgttcttgctgagcacc

SEQ ID NO: 363330 - DNA, 22 bp, Homo sapiens
gaccttacaaccacatttctgg

SEQ ID NO: 363331 - DNA, 13 bp, Homo sapiens
gaccttagaaatc

SEQ ID NO: 363332 - DNA, 19 bp, Homo sapiens
gaccttagaaatcattgta

SEQ ID NO: 363333 - DNA, 17 bp, Homo sapiens
gaccttagcgttctgga

SEQ ID NO: 363334 - DNA, 12 bp, Homo sapiens
gaccttatctgt

SEQ ID NO: 363335 - DNA, 22 bp, Homo sapiens
gaccttcacagggacagatctg

SEQ ID NO: 363336 - DNA, 12 bp, Homo sapiens
gaccttcctctg

SEQ ID NO: 363337 - DNA, 21 bp, Homo sapiens
gaccttgatgtcttgagagcg

SEQ ID NO: 363338 - DNA, 16 bp, Homo sapiens
gaccttgcctcccctc

SEQ ID NO: 363339 - DNA, 19 bp, Homo sapiens
gaccttgggcaagtccctt

SEQ ID NO: 363340 - DNA, 23 bp, Homo sapiens
gacctttatttattaaacttcag

SEQ ID NO: 363341 - DNA, 18 bp, Homo sapiens
gaccttttggcctttgta

SEQ ID NO: 363342 - DNA, 19 bp, Homo sapiens
gaccttttggcctttgtaa

SEQ ID NO: 363343 - DNA, 21 bp, Homo sapiens
gacgacacctggagactgtcc

SEQ ID NO: 363344 - DNA, 15 bp, Homo sapiens
gacgagactcctcgg

SEQ ID NO: 363345 - DNA, 13 bp, Homo sapiens
gacgaggcagggg

SEQ ID NO: 363346 - DNA, 18 bp, Homo sapiens
gacgagggatgggatttc

SEQ ID NO: 363347 - DNA, 13 bp, Homo sapiens
gacgcaggaatgg

SEQ ID NO: 363348 - DNA, 12 bp, Homo sapiens
gacgcagggaga

SEQ ID NO: 363349 - DNA, 22 bp, Homo sapiens
gacgccacagcccagccacgga

SEQ ID NO: 363350 - DNA, 13 bp, Homo sapiens
gacgcttctgaat

SEQ ID NO: 363351 - DNA, 21 bp, Homo sapiens
gacggaagtggcctgagaaga

SEQ ID NO: 363352 - DNA, 15 bp, Homo sapiens
gacggacgggacagc

SEQ ID NO: 363353 - DNA, 15 bp, Homo sapiens
gacggagagaaaaaa

SEQ ID NO: 363354 - DNA, 15 bp, Homo sapiens
gacggagttcagagg

SEQ ID NO: 363355 - DNA, 16 bp, Homo sapiens
gacggatggaaggaga

SEQ ID NO: 363356 - DNA, 17 bp, Homo sapiens
gacggatggaaggagag

SEQ ID NO: 363357 - DNA, 18 bp, Homo sapiens
gacggatggaaggagaga

SEQ ID NO: 363358 - DNA, 14 bp, Homo sapiens
gacggcagccccat

SEQ ID NO: 363359 - DNA, 16 bp, Homo sapiens
gacggcagccccatcc

SEQ ID NO: 363360 - DNA, 17 bp, Homo sapiens
gacggcgtttcaccatg

SEQ ID NO: 363361 - DNA, 18 bp, Homo sapiens
gacggctgtgtatttctg

SEQ ID NO: 363362 - DNA, 21 bp, Homo sapiens
gacggctgtgtatttctgtag

SEQ ID NO: 363363 - DNA, 18 bp, Homo sapiens
gacgggggttggggtggg

SEQ ID NO: 363364 - DNA, 14 bp, Homo sapiens
gacggttgtaagca

SEQ ID NO: 363365 - DNA, 21 bp, Homo sapiens
gacggtttcaaaccaggattt

SEQ ID NO: 363366 - DNA, 21 bp, Homo sapiens
gacgtagctgcaaaggacaga

SEQ ID NO: 363367 - DNA, 22 bp, Homo sapiens
gacgtccctccacgttcacccc

SEQ ID NO: 363368 - DNA, 23 bp, Homo sapiens
gacgtcttcaagaacttctcgta

SEQ ID NO: 363369 - DNA, 19 bp, Homo sapiens
gacgtgaccaattgccctg

SEQ ID NO: 363370 - DNA, 21 bp, Homo sapiens
gacgtgaccaattgccctgcc

SEQ ID NO: 363371 - DNA, 19 bp, Homo sapiens
gacgtgagtggggaggaga

SEQ ID NO: 363372 - DNA, 12 bp, Homo sapiens
gacgtgtgtggt

SEQ ID NO: 363373 - DNA, 11 bp, Homo sapiens
gacgtgttatg

SEQ ID NO: 363374 - DNA, 14 bp, Homo sapiens
gacgtgttatgact

SEQ ID NO: 363375 - DNA, 17 bp, Homo sapiens
gacgtgttatgactcca

SEQ ID NO: 363376 - DNA, 22 bp, Homo sapiens
gacgtgttatgactccagaatt

SEQ ID NO: 363377 - DNA, 20 bp, Homo sapiens
gacgttcatttgtgtgctca

SEQ ID NO: 363378 - DNA, 13 bp, Homo sapiens
gactaaagagaga

SEQ ID NO: 363379 - DNA, 17 bp, Homo sapiens
gactaaagagagaatgt

SEQ ID NO: 363380 - DNA, 21 bp, Homo sapiens
gactaacataaaatctgtgaa

SEQ ID NO: 363381 - DNA, 10 bp, Homo sapiens
gactaacctt

SEQ ID NO: 363382 - DNA, 13 bp, Homo sapiens
gactacagggctt

SEQ ID NO: 363383 - DNA, 19 bp, Homo sapiens
gagagggcccagctgtagc

SEQ ID NO: 363384 - DNA, 12 bp, Homo sapiens
gagagggctgag

SEQ ID NO: 363385 - DNA, 16 bp, Homo sapiens
gagagggctgagcccc

SEQ ID NO: 363386 - DNA, 17 bp, Homo sapiens
gagagggctgagcccct

SEQ ID NO: 363387 - DNA, 20 bp, Homo sapiens
gagagggctgagcccctcct

SEQ ID NO: 363388 - DNA, 21 bp, Homo sapiens
gagagggctgtggctgggtgg

SEQ ID NO: 363389 - DNA, 16 bp, Homo sapiens
gagaggggaagggcca

SEQ ID NO: 363390 - DNA, 21 bp, Homo sapiens
gagaggggacaaaacccacct

SEQ ID NO: 363391 - DNA, 22 bp, Homo sapiens
gagaggggacaaaacccacctt

SEQ ID NO: 363392 - DNA, 19 bp, Homo sapiens
gagaggggcctctggctgc

SEQ ID NO: 363393 - DNA, 18 bp, Homo sapiens
gagagggggccacctccc

SEQ ID NO: 363394 - DNA, 18 bp, Homo sapiens
gagaggtcaagcccagga

SEQ ID NO: 363395 - DNA, 13 bp, Homo sapiens
gagaggttgagga

SEQ ID NO: 363396 - DNA, 22 bp, Homo sapiens
gagaggttgaggatgcactggc

SEQ ID NO: 363397 - DNA, 15 bp, Homo sapiens
gagagtaaaaattca

SEQ ID NO: 363398 - DNA, 19 bp, Homo sapiens
gagagtacccccctgagag

SEQ ID NO: 363399 - DNA, 17 bp, Homo sapiens
gagagtcccagagcagg

SEQ ID NO: 363400 - DNA, 13 bp, Homo sapiens
gagagtgagaata

SEQ ID NO: 363401 - DNA, 24 bp, Homo sapiens
gagagtgagaataattgtgtacaa

SEQ ID NO: 363402 - DNA, 15 bp, Homo sapiens
gagagtgagagagag

SEQ ID NO: 363403 - DNA, 20 bp, Homo sapiens
gagagtgagagcacaaagat

SEQ ID NO: 363404 - DNA, 21 bp, Homo sapiens
gagagtgcccttttgtatctt

SEQ ID NO: 363405 - DNA, 16 bp, Homo sapiens
gagagtggctcctccc

SEQ ID NO: 363406 - DNA, 16 bp, Homo sapiens
gagagttgctcctcag

SEQ ID NO: 363407 - DNA, 14 bp, Homo sapiens
gagataacttcctt

SEQ ID NO: 363408 - DNA, 23 bp, Homo sapiens
gagataatttaaccctgcctctc

SEQ ID NO: 363409 - DNA, 18 bp, Homo sapiens
gagatacccagagagaaa

SEQ ID NO: 363410 - DNA, 19 bp, Homo sapiens
gagatacccagagagaaaa

SEQ ID NO: 363411 - DNA, 21 bp, Homo sapiens
gagatagtgccaggtggctca

SEQ ID NO: 363412 - DNA, 22 bp, Homo sapiens
gagatatttaaaagacaaacac

SEQ ID NO: 363413 - DNA, 13 bp, Homo sapiens
gagatatttttat

SEQ ID NO: 363414 - DNA, 15 bp, Homo sapiens
gagatcacagcctcc

SEQ ID NO: 363415 - DNA, 17 bp, Homo sapiens
gagatcacagcctccag

SEQ ID NO: 363416 - DNA, 11 bp, Homo sapiens
gagatcagcat

SEQ ID NO: 363417 - DNA, 14 bp, Homo sapiens
gagatcagcattca

SEQ ID NO: 363418 - DNA, 15 bp, Homo sapiens
gagatcagcattcaa

SEQ ID NO: 363419 - DNA, 17 bp, Homo sapiens
gagatccttcacaggca

SEQ ID NO: 363420 - DNA, 17 bp, Homo sapiens
gagatcggggtggcaga

SEQ ID NO: 363421 - DNA, 13 bp, Homo sapiens
gagatcttccttc

SEQ ID NO: 363422 - DNA, 16 bp, Homo sapiens
gagatgaattaaattt

SEQ ID NO: 363423 - DNA, 22 bp, Homo sapiens
gagatgagaaatgatgaaaagg

SEQ ID NO: 363424 - DNA, 21 bp, Homo sapiens
gagatgatgccatgggccctc

SEQ ID NO: 363425 - DNA, 20 bp, Homo sapiens
gagatggaagttgcagtgag

SEQ ID NO: 363426 - DNA, 22 bp, Homo sapiens
gagatggacagttcacaccctg

SEQ ID NO: 363427 - DNA, 18 bp, Homo sapiens
gagatggacccctccctt

SEQ ID NO: 363428 - DNA, 13 bp, Homo sapiens
gagatggaggagg

SEQ ID NO: 363429 - DNA, 16 bp, Homo sapiens
gagatggaggaggagg

SEQ ID NO: 363430 - DNA, 15 bp, Homo sapiens
gagatggccatgctc

SEQ ID NO: 363431 - DNA, 16 bp, Homo sapiens
gagatggccatgctca

SEQ ID NO: 363432 - DNA, 16 bp, Homo sapiens
gagatgggaagggctt

SEQ ID NO: 363433 - DNA, 18 bp, Homo sapiens
gagatgggcttgttttct

SEQ ID NO: 363434 - DNA, 17 bp, Homo sapiens
gagatggtgccccctgg

SEQ ID NO: 363435 - DNA, 21 bp, Homo sapiens
gagatgtaccatgttaaagag

SEQ ID NO: 363436 - DNA, 18 bp, Homo sapiens
gagatgtatgaaggcttt

SEQ ID NO: 363437 - DNA, 22 bp, Homo sapiens
gagatgtcttcgtacagttctt

SEQ ID NO: 363438 - DNA, 18 bp, Homo sapiens
gagatgtgacccaccagt

SEQ ID NO: 363439 - DNA, 20 bp, Homo sapiens
gagatgtgacccaccagtgc

SEQ ID NO: 363440 - DNA, 19 bp, Homo sapiens
gagatgtttttaaaagttt

SEQ ID NO: 363441 - DNA, 21 bp, Homo sapiens
gagattcaaaaaaaaaatata

SEQ ID NO: 363442 - DNA, 22 bp, Homo sapiens
gagattcaaaaaaaaaatataa

SEQ ID NO: 363443 - DNA, 14 bp, Homo sapiens
gagattcccaagcc

SEQ ID NO: 363444 - DNA, 14 bp, Homo sapiens
gagattgctctggg

SEQ ID NO: 363445 - DNA, 19 bp, Homo sapiens
gagattggaaaaaattaga

SEQ ID NO: 363446 - DNA, 16 bp, Homo sapiens
gagattggcatggctt

SEQ ID NO: 363447 - DNA, 13 bp, Homo sapiens
gagattggctttg

SEQ ID NO: 363448 - DNA, 17 bp, Homo sapiens
gagattgggggggcttg

SEQ ID NO: 363449 - DNA, 19 bp, Homo sapiens
gagattgggggggcttggg

SEQ ID NO: 363450 - DNA, 19 bp, Homo sapiens
gagatttgccagcacaggg

SEQ ID NO: 363451 - DNA, 15 bp, Homo sapiens
gagatttgtatttat

SEQ ID NO: 363452 - DNA, 16 bp, Homo sapiens
gagcaaaaggcagctc

SEQ ID NO: 363453 - DNA, 14 bp, Homo sapiens
gagcaaacctgccc

SEQ ID NO: 363454 - DNA, 22 bp, Homo sapiens
gagcaaagatcaaaataaaaag

SEQ ID NO: 363455 - DNA, 20 bp, Homo sapiens
gagcaaaggagacaaagcag

SEQ ID NO: 363456 - DNA, 16 bp, Homo sapiens
gagcaaatcctggcaa

SEQ ID NO: 363457 - DNA, 22 bp, Homo sapiens
gagcaaatcctggcaagtgacc

SEQ ID NO: 363458 - DNA, 16 bp, Homo sapiens
gagcaaatgagggagg

SEQ ID NO: 363459 - DNA, 17 bp, Homo sapiens
gagcaaatgagggaggg

SEQ ID NO: 363460 - DNA, 13 bp, Homo sapiens
gagcaacccctgt

SEQ ID NO: 363461 - DNA, 20 bp, Homo sapiens
gagcaacccctgtacccagc

SEQ ID NO: 363462 - DNA, 22 bp, Homo sapiens
gagcaacccctgtacccagctc

SEQ ID NO: 363463 - DNA, 15 bp, Homo sapiens
gagcaactgtgcagc

SEQ ID NO: 363464 - DNA, 22 bp, Homo sapiens
gagcaagaccctgtcttaaaaa

SEQ ID NO: 363465 - DNA, 12 bp, Homo sapiens
gagcaagactct

SEQ ID NO: 363466 - DNA, 23 bp, Homo sapiens
gagcaaggacattgccccaagat

SEQ ID NO: 363467 - DNA, 20 bp, Homo sapiens
gagcaaggcaagaagtggga

SEQ ID NO: 363468 - DNA, 17 bp, Homo sapiens
gagcaagtcccatctca

SEQ ID NO: 363469 - DNA, 20 bp, Homo sapiens
gagcaatcttgctgtgaaac

SEQ ID NO: 363470 - DNA, 12 bp, Homo sapiens
gagcaatgggac

SEQ ID NO: 363471 - DNA, 15 bp, Homo sapiens
gagcaatgggactgg

SEQ ID NO: 363472 - DNA, 17 bp, Homo sapiens
gagcaatgggactggag

SEQ ID NO: 363473 - DNA, 13 bp, Homo sapiens
gagcacaaagata

SEQ ID NO: 363474 - DNA, 12 bp, Homo sapiens
gagcacagccct

SEQ ID NO: 363475 - DNA, 16 bp, Homo sapiens
gagcacagccctggga

SEQ ID NO: 363476 - DNA, 19 bp, Homo sapiens
gagcacagccctgggaggg

SEQ ID NO: 363477 - DNA, 15 bp, Homo sapiens
gagcaccacggggtc

SEQ ID NO: 363478 - DNA, 22 bp, Homo sapiens
gagcaccacggggtcgggggag

SEQ ID NO: 363479 - DNA, 15 bp, Homo sapiens
gagcacccccagcct

SEQ ID NO: 363480 - DNA, 21 bp, Homo sapiens
gagcacccccagcctccccca

SEQ ID NO: 363481 - DNA, 15 bp, Homo sapiens
gagcaccgaggccag

SEQ ID NO: 363482 - DNA, 13 bp, Homo sapiens
gagcacctgaacc

SEQ ID NO: 363483 - DNA, 16 bp, Homo sapiens
gagcaccttcctcact

SEQ ID NO: 363484 - DNA, 19 bp, Homo sapiens
gagcaccttcctcacttcc

SEQ ID NO: 363485 - DNA, 21 bp, Homo sapiens
gagcacgtggagatagtgcca

SEQ ID NO: 363486 - DNA, 12 bp, Homo sapiens
gagcactggcca

SEQ ID NO: 363487 - DNA, 13 bp, Homo sapiens
gagcactggccag

SEQ ID NO: 363488 - DNA, 14 bp, Homo sapiens
gagcactggccaga

SEQ ID NO: 363489 - DNA, 18 bp, Homo sapiens
gagcacttgcgtcctgca

SEQ ID NO: 363490 - DNA, 19 bp, Homo sapiens
gagcacttgcgtcctgcag

SEQ ID NO: 363491 - DNA, 17 bp, Homo sapiens
gagcagaagtggagctg

SEQ ID NO: 363492 - DNA, 18 bp, Homo sapiens
gagcagactggtgagcag

SEQ ID NO: 363493 - DNA, 20 bp, Homo sapiens
gagcagactggtgagcagac

SEQ ID NO: 363494 - DNA, 17 bp, Homo sapiens
gagcagagaaggccagg

SEQ ID NO: 363495 - DNA, 12 bp, Homo sapiens
gagcagagacac

SEQ ID NO: 363496 - DNA, 13 bp, Homo sapiens
gagcagagacact

SEQ ID NO: 363497 - DNA, 18 bp, Homo sapiens
gagcagagacggcagccc

SEQ ID NO: 363498 - DNA, 24 bp, Homo sapiens
gagcagagacggcagccccatcct

SEQ ID NO: 363499 - DNA, 14 bp, Homo sapiens
gagcagagtctggg

SEQ ID NO: 363500 - DNA, 22 bp, Homo sapiens
gagcagcctccactgtgtccag

SEQ ID NO: 363501 - DNA, 15 bp, Homo sapiens
gagcagcctctgcca

SEQ ID NO: 363502 - DNA, 17 bp, Homo sapiens
gagcagcctctgccagg

SEQ ID NO: 363503 - DNA, 16 bp, Homo sapiens
gagcagcctctgtcct

SEQ ID NO: 363504 - DNA, 17 bp, Homo sapiens
gagcagcctctgtcctg

SEQ ID NO: 363505 - DNA, 13 bp, Homo sapiens
gagcagcctgatg

SEQ ID NO: 363506 - DNA, 14 bp, Homo sapiens
gagcagcctgatgg

SEQ ID NO: 363507 - DNA, 16 bp, Homo sapiens
gagcagcctgtggcat

SEQ ID NO: 363508 - DNA, 20 bp, Homo sapiens
gagcagctccccaggagctc

SEQ ID NO: 363509 - DNA, 16 bp, Homo sapiens
gagcagctggctctcc

SEQ ID NO: 363510 - DNA, 16 bp, Homo sapiens
gagcagctgggcactg

SEQ ID NO: 363511 - DNA, 18 bp, Homo sapiens
gagcagctgggcactggg

SEQ ID NO: 363512 - DNA, 15 bp, Homo sapiens
gagcaggaaggcctg

SEQ ID NO: 363513 - DNA, 21 bp, Homo sapiens
gaggaagcacaagaagtggga

SEQ ID NO: 363514 - DNA, 23 bp, Homo sapiens
gaggaagccacgtgctggagagt

SEQ ID NO: 363515 - DNA, 13 bp, Homo sapiens
gaggaagccttgc

SEQ ID NO: 363516 - DNA, 21 bp, Homo sapiens
gaggaaggcatgcctggacaa

SEQ ID NO: 363517 - DNA, 17 bp, Homo sapiens
gaggaagggactggtcc

SEQ ID NO: 363518 - DNA, 18 bp, Homo sapiens
gaggaataattatttatt

SEQ ID NO: 363519 - DNA, 21 bp, Homo sapiens
gaggaataattatttatttaa

SEQ ID NO: 363520 - DNA, 17 bp, Homo sapiens
gaggaatgatgaagctt

SEQ ID NO: 363521 - DNA, 13 bp, Homo sapiens
gaggaatgtgctt

SEQ ID NO: 363522 - DNA, 11 bp, Homo sapiens
gaggacacatg

SEQ ID NO: 363523 - DNA, 12 bp, Homo sapiens
gaggacacatgt

SEQ ID NO: 363524 - DNA, 13 bp, Homo sapiens
gaggacacatgtc

SEQ ID NO: 363525 - DNA, 14 bp, Homo sapiens
gaggacacatgtcc

SEQ ID NO: 363526 - DNA, 13 bp, Homo sapiens
gaggacagggagg

SEQ ID NO: 363527 - DNA, 12 bp, Homo sapiens
gaggacagtgct

SEQ ID NO: 363528 - DNA, 16 bp, Homo sapiens
gaggaccaaagataca

SEQ ID NO: 363529 - DNA, 15 bp, Homo sapiens
gaggaccttatctgt

SEQ ID NO: 363530 - DNA, 12 bp, Homo sapiens
gaggacctttct

SEQ ID NO: 363531 - DNA, 17 bp, Homo sapiens
gaggacggagttcagag

SEQ ID NO: 363532 - DNA, 18 bp, Homo sapiens
gaggacggggcagagctg

SEQ ID NO: 363533 - DNA, 22 bp, Homo sapiens
gaggacgtgggcggcagagagg

SEQ ID NO: 363534 - DNA, 22 bp, Homo sapiens
gaggacttgggggcagagcagc

SEQ ID NO: 363535 - DNA, 23 bp, Homo sapiens
gaggagaaaggtgaaacacacac

SEQ ID NO: 363536 - DNA, 12 bp, Homo sapiens
gaggagaccctg

SEQ ID NO: 363537 - DNA, 16 bp, Homo sapiens
gaggagactcaggccc

SEQ ID NO: 363538 - DNA, 22 bp, Homo sapiens
gaggagactcaggcccacattg

SEQ ID NO: 363539 - DNA, 19 bp, Homo sapiens
gaggagagaatgagagagt

SEQ ID NO: 363540 - DNA, 19 bp, Homo sapiens
gaggagagcatctgctctg

SEQ ID NO: 363541 - DNA, 21 bp, Homo sapiens
gaggagagcatctgctctgag

SEQ ID NO: 363542 - DNA, 20 bp, Homo sapiens
gaggagaggggaagggccag

SEQ ID NO: 363543 - DNA, 21 bp, Homo sapiens
gaggagagtacccccctgaga

SEQ ID NO: 363544 - DNA, 15 bp, Homo sapiens
gaggagagtcccaga

SEQ ID NO: 363545 - DNA, 10 bp, Homo sapiens
gaggagcacc

SEQ ID NO: 363546 - DNA, 17 bp, Homo sapiens
gaggagcacccccagcc

SEQ ID NO: 363547 - DNA, 16 bp, Homo sapiens
gaggagcacctgaacc

SEQ ID NO: 363548 - DNA, 19 bp, Homo sapiens
gaggagcaggaagcaaggc

SEQ ID NO: 363549 - DNA, 20 bp, Homo sapiens
gaggagccacctgggctggg

SEQ ID NO: 363550 - DNA, 14 bp, Homo sapiens
gaggagccttggag

SEQ ID NO: 363551 - DNA, 11 bp, Homo sapiens
gaggagctgct

SEQ ID NO: 363552 - DNA, 19 bp, Homo sapiens
gaggagctgggagccgggc

SEQ ID NO: 363553 - DNA, 18 bp, Homo sapiens
gaggaggcaattgggatg

SEQ ID NO: 363554 - DNA, 17 bp, Homo sapiens
gaggaggggtaaatata

SEQ ID NO: 363555 - DNA, 22 bp, Homo sapiens
gaggaggggtaaatatatgttt

SEQ ID NO: 363556 - DNA, 11 bp, Homo sapiens
gaggagtccaa

SEQ ID NO: 363557 - DNA, 13 bp, Homo sapiens
gaggagtccaaaa

SEQ ID NO: 363558 - DNA, 19 bp, Homo sapiens
gaggagtctgggaaggggc

SEQ ID NO: 363559 - DNA, 21 bp, Homo sapiens
gaggagtgtgctcaggccggg

SEQ ID NO: 363560 - DNA, 14 bp, Homo sapiens
gaggagttcaatga

SEQ ID NO: 363561 - DNA, 24 bp, Homo sapiens
gaggatcatatgaattagccaaaa

SEQ ID NO: 363562 - DNA, 18 bp, Homo sapiens
gaggatgcactggcctgt

SEQ ID NO: 363563 - DNA, 13 bp, Homo sapiens
gaggatgctgaag

SEQ ID NO: 363564 - DNA, 13 bp, Homo sapiens
gaggatgctgtgc

SEQ ID NO: 363565 - DNA, 14 bp, Homo sapiens
gaggattctgtctt

SEQ ID NO: 363566 - DNA, 13 bp, Homo sapiens
gaggattctttcc

SEQ ID NO: 363567 - DNA, 20 bp, Homo sapiens
gaggatttaagggatggaaa

SEQ ID NO: 363568 - DNA, 22 bp, Homo sapiens
gaggatttaagggatggaaaag

SEQ ID NO: 363569 - DNA, 17 bp, Homo sapiens
gaggatttttttctgag

SEQ ID NO: 363570 - DNA, 14 bp, Homo sapiens
gaggcaagagactg

SEQ ID NO: 363571 - DNA, 24 bp, Homo sapiens
gaggcacacagctgcagagacaga

SEQ ID NO: 363572 - DNA, 13 bp, Homo sapiens
gaggcaccagctc

SEQ ID NO: 363573 - DNA, 22 bp, Homo sapiens
gaggcaccagctctgtggcctg

SEQ ID NO: 363574 - DNA, 19 bp, Homo sapiens
gaggcaccggcgctgcagg

SEQ ID NO: 363575 - DNA, 20 bp, Homo sapiens
gaggcagaaagcagaggctg

SEQ ID NO: 363576 - DNA, 21 bp, Homo sapiens
gaggcagaaagcagaggctgg

SEQ ID NO: 363577 - DNA, 23 bp, Homo sapiens
gaggcagaaccctggtgaggaag

SEQ ID NO: 363578 - DNA, 14 bp, Homo sapiens
gaggcagaacctgg

SEQ ID NO: 363579 - DNA, 15 bp, Homo sapiens
gaggcagaatggtgg

SEQ ID NO: 363580 - DNA, 16 bp, Homo sapiens
gaggcagaatggtggg

SEQ ID NO: 363581 - DNA, 15 bp, Homo sapiens
gaggcagactcgagg

SEQ ID NO: 363582 - DNA, 13 bp, Homo sapiens
gaggcagaggaca

SEQ ID NO: 363583 - DNA, 22 bp, Homo sapiens
gaggcagagtgccccacctgcc

SEQ ID NO: 363584 - DNA, 18 bp, Homo sapiens
gaggcagcaacaggacca

SEQ ID NO: 363585 - DNA, 19 bp, Homo sapiens
gaggcagcaacaggaccag

SEQ ID NO: 363586 - DNA, 22 bp, Homo sapiens
gaggcagcaacaggaccaggag

SEQ ID NO: 363587 - DNA, 15 bp, Homo sapiens
gaggcagccccctcc

SEQ ID NO: 363588 - DNA, 16 bp, Homo sapiens
gaggcaggaaggattg

SEQ ID NO: 363589 - DNA, 12 bp, Homo sapiens
gaggcaggagaa

SEQ ID NO: 363590 - DNA, 14 bp, Homo sapiens
gaggcaggctccag

SEQ ID NO: 363591 - DNA, 17 bp, Homo sapiens
gaggcaggggagtctgc

SEQ ID NO: 363592 - DNA, 20 bp, Homo sapiens
gaggcaggggctgggcagag

SEQ ID NO: 363593 - DNA, 16 bp, Homo sapiens
gaggcaggtcccgagc

SEQ ID NO: 363594 - DNA, 22 bp, Homo sapiens
gaggcaggtcccgagccccctg

SEQ ID NO: 363595 - DNA, 16 bp, Homo sapiens
gaggcagtggcagcaa

SEQ ID NO: 363596 - DNA, 20 bp, Homo sapiens
gaggcatgacagctgttcca

SEQ ID NO: 363597 - DNA, 20 bp, Homo sapiens
gaggcattcccagaggtggg

SEQ ID NO: 363598 - DNA, 22 bp, Homo sapiens
gaggcattcccagaggtgggga

SEQ ID NO: 363599 - DNA, 12 bp, Homo sapiens
gaggcattgttt

SEQ ID NO: 363600 - DNA, 12 bp, Homo sapiens
gaggccaagcct

SEQ ID NO: 363601 - DNA, 17 bp, Homo sapiens
gaggccaaggtgggcgg

SEQ ID NO: 363602 - DNA, 22 bp, Homo sapiens
gaggccacatgagtcccagtgg

SEQ ID NO: 363603 - DNA, 23 bp, Homo sapiens
gaggccacatgagtcccagtggg

SEQ ID NO: 363604 - DNA, 13 bp, Homo sapiens
gaggccaccccaa

SEQ ID NO: 363605 - DNA, 10 bp, Homo sapiens
gaggccacgg

SEQ ID NO: 363606 - DNA, 20 bp, Homo sapiens
gaggccacgggggaggccga

SEQ ID NO: 363607 - DNA, 14 bp, Homo sapiens
gaggccagccccac

SEQ ID NO: 363608 - DNA, 21 bp, Homo sapiens
gaggccagccccacccaggag

SEQ ID NO: 363609 - DNA, 19 bp, Homo sapiens
gaggccaggcatggcccag

SEQ ID NO: 363610 - DNA, 18 bp, Homo sapiens
gaggccaggccctcctgc

SEQ ID NO: 363611 - DNA, 13 bp, Homo sapiens
gaggccatggggg

SEQ ID NO: 363612 - DNA, 19 bp, Homo sapiens
gaggccattccctgtagga

SEQ ID NO: 363613 - DNA, 11 bp, Homo sapiens
gaggcccagag

SEQ ID NO: 363614 - DNA, 13 bp, Homo sapiens
gaggcccagagag

SEQ ID NO: 363615 - DNA, 15 bp, Homo sapiens
gaggcccagcagagc

SEQ ID NO: 363616 - DNA, 12 bp, Homo sapiens
gaggcccaggga

SEQ ID NO: 363617 - DNA, 18 bp, Homo sapiens
gaggccccagggctgtgg

SEQ ID NO: 363618 - DNA, 13 bp, Homo sapiens
gaggcccccggag

SEQ ID NO: 363619 - DNA, 19 bp, Homo sapiens
gaggcccccggaggcgccc

SEQ ID NO: 363620 - DNA, 16 bp, Homo sapiens
gaggcccttttctggc

SEQ ID NO: 363621 - DNA, 16 bp, Homo sapiens
gaggccgaggcagggg

SEQ ID NO: 363622 - DNA, 19 bp, Homo sapiens
gaggccgaggcaggggctg

SEQ ID NO: 363623 - DNA, 20 bp, Homo sapiens
gaggccgctagaggcctgag

SEQ ID NO: 363624 - DNA, 18 bp, Homo sapiens
gaggccggggggagcagg

SEQ ID NO: 363625 - DNA, 19 bp, Homo sapiens
gaggccgggtgctcagggc

SEQ ID NO: 363626 - DNA, 21 bp, Homo sapiens
gaggcctagtcagccacatgg

SEQ ID NO: 363627 - DNA, 14 bp, Homo sapiens
gaggcctcaccctg

SEQ ID NO: 363628 - DNA, 17 bp, Homo sapiens
gaggcctcaccctgctt

SEQ ID NO: 363629 - DNA, 16 bp, Homo sapiens
gaggcctcagtggact

SEQ ID NO: 363630 - DNA, 19 bp, Homo sapiens
gaggcctcccccagccagg

SEQ ID NO: 363631 - DNA, 13 bp, Homo sapiens
gaggcctctgggc

SEQ ID NO: 363632 - DNA, 22 bp, Homo sapiens
gaggcctgaggatgagctggaa

SEQ ID NO: 363633 - DNA, 13 bp, Homo sapiens
gaggcctggactt

SEQ ID NO: 363634 - DNA, 18 bp, Homo sapiens
gaggcctggactttcctg

SEQ ID NO: 363635 - DNA, 20 bp, Homo sapiens
gaggcctggactttcctgca

SEQ ID NO: 363636 - DNA, 21 bp, Homo sapiens
gaggcctgggggtgggggagg

SEQ ID NO: 363637 - DNA, 12 bp, Homo sapiens
gaggcctggtct

SEQ ID NO: 363638 - DNA, 13 bp, Homo sapiens
gaggcgagccagg

SEQ ID NO: 363639 - DNA, 23 bp, Homo sapiens
gaggcgaggctgcctctgggtga

SEQ ID NO: 363640 - DNA, 15 bp, Homo sapiens
gaggcgcccacctgc

SEQ ID NO: 363641 - DNA, 18 bp, Homo sapiens
gaggcgcccacctgccca

SEQ ID NO: 363642 - DNA, 14 bp, Homo sapiens
gaggcgcgtctgcc

SEQ ID NO: 363643 - DNA, 17 bp, Homo sapiens
gaggcggtatccacctg

SEQ ID NO: 363644 - DNA, 14 bp, Homo sapiens
gagttcatcttgaa

SEQ ID NO: 363645 - DNA, 20 bp, Homo sapiens
gagttctatccccaagctgg

SEQ ID NO: 363646 - DNA, 20 bp, Homo sapiens
gagttctcactatgtttctc

SEQ ID NO: 363647 - DNA, 22 bp, Homo sapiens
gagttgaggggcttccctctgc

SEQ ID NO: 363648 - DNA, 20 bp, Homo sapiens
gagttgagtgggtatttctt

SEQ ID NO: 363649 - DNA, 20 bp, Homo sapiens
gagttgcaccattctttctt

SEQ ID NO: 363650 - DNA, 16 bp, Homo sapiens
gagttggcattgcatt

SEQ ID NO: 363651 - DNA, 17 bp, Homo sapiens
gagttggggaaggcaag

SEQ ID NO: 363652 - DNA, 11 bp, Homo sapiens
gagttgggggt

SEQ ID NO: 363653 - DNA, 19 bp, Homo sapiens
gagtttaaaaaaataacat

SEQ ID NO: 363654 - DNA, 23 bp, Homo sapiens
gagtttaaaaaaataacatctga

SEQ ID NO: 363655 - DNA, 13 bp, Homo sapiens
gagtttaaagcaa

SEQ ID NO: 363656 - DNA, 23 bp, Homo sapiens
gagtttaccatttgtaataaagt

SEQ ID NO: 363657 - DNA, 23 bp, Homo sapiens
gagtttatttttttgatggctaa

SEQ ID NO: 363658 - DNA, 15 bp, Homo sapiens
gagtttcctcaggct

SEQ ID NO: 363659 - DNA, 23 bp, Homo sapiens
gagtttcctcaggctgctggagg

SEQ ID NO: 363660 - DNA, 19 bp, Homo sapiens
gagtttctggctgaaaatg

SEQ ID NO: 363661 - DNA, 17 bp, Homo sapiens
gagtttgagacaagccc

SEQ ID NO: 363662 - DNA, 22 bp, Homo sapiens
gagtttgctgtatacaaacagg

SEQ ID NO: 363663 - DNA, 17 bp, Homo sapiens
gataaaacattagaaga

SEQ ID NO: 363664 - DNA, 16 bp, Homo sapiens
gataaaagatacattt

SEQ ID NO: 363665 - DNA, 13 bp, Homo sapiens
gataaacattaaa

SEQ ID NO: 363666 - DNA, 19 bp, Homo sapiens
gataaacattaaacactgt

SEQ ID NO: 363667 - DNA, 16 bp, Homo sapiens
gataaaccaataaatc

SEQ ID NO: 363668 - DNA, 21 bp, Homo sapiens
gataaagatgtcaaatatctc

SEQ ID NO: 363669 - DNA, 15 bp, Homo sapiens
gataaagtgaccagg

SEQ ID NO: 363670 - DNA, 15 bp, Homo sapiens
gataaatcatttcag

SEQ ID NO: 363671 - DNA, 17 bp, Homo sapiens
gataacactggagtggt

SEQ ID NO: 363672 - DNA, 13 bp, Homo sapiens
gataacagaggca

SEQ ID NO: 363673 - DNA, 17 bp, Homo sapiens
gataacgcaggagagag

SEQ ID NO: 363674 - DNA, 13 bp, Homo sapiens
gataactagatgg

SEQ ID NO: 363675 - DNA, 20 bp, Homo sapiens
gataactagatggtgctgag

SEQ ID NO: 363676 - DNA, 14 bp, Homo sapiens
gataacttaaataa

SEQ ID NO: 363677 - DNA, 16 bp, Homo sapiens
gataacttaaataatt

SEQ ID NO: 363678 - DNA, 16 bp, Homo sapiens
gataacttggggaggc

SEQ ID NO: 363679 - DNA, 22 bp, Homo sapiens
gataagaaccttttgagtgcct

SEQ ID NO: 363680 - DNA, 23 bp, Homo sapiens
gataagaactttgcacacttcaa

SEQ ID NO: 363681 - DNA, 22 bp, Homo sapiens
gataagaatgctggttttccta

SEQ ID NO: 363682 - DNA, 19 bp, Homo sapiens
gataaggagactgaggctt

SEQ ID NO: 363683 - DNA, 12 bp, Homo sapiens
gataagtggaaa

SEQ ID NO: 363684 - DNA, 22 bp, Homo sapiens
gataagtggaaaaaagagaaaa

SEQ ID NO: 363685 - DNA, 13 bp, Homo sapiens
gataatatgtttg

SEQ ID NO: 363686 - DNA, 23 bp, Homo sapiens
gataatattactgtttatttctg

SEQ ID NO: 363687 - DNA, 20 bp, Homo sapiens
gataatgagttttacattac

SEQ ID NO: 363688 - DNA, 13 bp, Homo sapiens
gataatgtattgc

SEQ ID NO: 363689 - DNA, 14 bp, Homo sapiens
gataattaaatgaa

SEQ ID NO: 363690 - DNA, 19 bp, Homo sapiens
gataattaaatgaaatact

SEQ ID NO: 363691 - DNA, 14 bp, Homo sapiens
gataattataatat

SEQ ID NO: 363692 - DNA, 12 bp, Homo sapiens
gataatttgcat

SEQ ID NO: 363693 - DNA, 12 bp, Homo sapiens
gataattttgca

SEQ ID NO: 363694 - DNA, 16 bp, Homo sapiens
gataatttttaaaaga

SEQ ID NO: 363695 - DNA, 21 bp, Homo sapiens
gataatttttaaaagaggaaa

SEQ ID NO: 363696 - DNA, 22 bp, Homo sapiens
gatacaagtttcagacagggtc

SEQ ID NO: 363697 - DNA, 16 bp, Homo sapiens
gatacaatcagctgct

SEQ ID NO: 363698 - DNA, 17 bp, Homo sapiens
gatacaatcagctgctt

SEQ ID NO: 363699 - DNA, 14 bp, Homo sapiens
gatacactcctgct

SEQ ID NO: 363700 - DNA, 14 bp, Homo sapiens
gatacagtcattat

SEQ ID NO: 363701 - DNA, 22 bp, Homo sapiens
gatacagtcattatttaaagca

SEQ ID NO: 363702 - DNA, 19 bp, Homo sapiens
gatacagtccctaaagaaa

SEQ ID NO: 363703 - DNA, 17 bp, Homo sapiens
gatacatttatcttctg

SEQ ID NO: 363704 - DNA, 20 bp, Homo sapiens
gatacatttatcttctgttt

SEQ ID NO: 363705 - DNA, 21 bp, Homo sapiens
gatacatttgtatgttgtgaa

SEQ ID NO: 363706 - DNA, 12 bp, Homo sapiens
gataccagcccc

SEQ ID NO: 363707 - DNA, 20 bp, Homo sapiens
gataccaggttgaaagacct

SEQ ID NO: 363708 - DNA, 16 bp, Homo sapiens
gataccattttgaaat

SEQ ID NO: 363709 - DNA, 14 bp, Homo sapiens
gatacccagagaga

SEQ ID NO: 363710 - DNA, 15 bp, Homo sapiens
gatacccagagagaa

SEQ ID NO: 363711 - DNA, 13 bp, Homo sapiens
gatacccagtccc

SEQ ID NO: 363712 - DNA, 19 bp, Homo sapiens
gatactggaagttttgcat

SEQ ID NO: 363713 - DNA, 17 bp, Homo sapiens
gatactgtctaagaata

SEQ ID NO: 363714 - DNA, 16 bp, Homo sapiens
gatacttgatgcactt

SEQ ID NO: 363715 - DNA, 18 bp, Homo sapiens
gatactttgatattttca

SEQ ID NO: 363716 - DNA, 18 bp, Homo sapiens
gatagacttcgaaaacag

SEQ ID NO: 363717 - DNA, 19 bp, Homo sapiens
gatagagattcccctggac

SEQ ID NO: 363718 - DNA, 13 bp, Homo sapiens
gatagagcctttg

SEQ ID NO: 363719 - DNA, 14 bp, Homo sapiens
gatagagcctttga

SEQ ID NO: 363720 - DNA, 13 bp, Homo sapiens
gatagcattgctt

SEQ ID NO: 363721 - DNA, 23 bp, Homo sapiens
gatagcatttttgatttatgcat

SEQ ID NO: 363722 - DNA, 11 bp, Homo sapiens
gatagcctttg

SEQ ID NO: 363723 - DNA, 18 bp, Homo sapiens
gatagctaacattttaaa

SEQ ID NO: 363724 - DNA, 20 bp, Homo sapiens
gatagctttattttttaagt

SEQ ID NO: 363725 - DNA, 14 bp, Homo sapiens
gataggaaaactga

SEQ ID NO: 363726 - DNA, 16 bp, Homo sapiens
gataggaactgggcct

SEQ ID NO: 363727 - DNA, 15 bp, Homo sapiens
gataggcagcactga

SEQ ID NO: 363728 - DNA, 11 bp, Homo sapiens
gataggctaat

SEQ ID NO: 363729 - DNA, 20 bp, Homo sapiens
gataggctctgcacagatgg

SEQ ID NO: 363730 - DNA, 14 bp, Homo sapiens
gatagtctttcagt

SEQ ID NO: 363731 - DNA, 14 bp, Homo sapiens
gatagtgccaggtg

SEQ ID NO: 363732 - DNA, 20 bp, Homo sapiens
gatagtgtcccacggtgcct

SEQ ID NO: 363733 - DNA, 15 bp, Homo sapiens
gatataaatggctgg

SEQ ID NO: 363734 - DNA, 18 bp, Homo sapiens
gatatacacggatgactt

SEQ ID NO: 363735 - DNA, 21 bp, Homo sapiens
gatatacagatgaaaatttga

SEQ ID NO: 363736 - DNA, 18 bp, Homo sapiens
gatatatggaggattctt

SEQ ID NO: 363737 - DNA, 22 bp, Homo sapiens
gatatccctatgctgcctaggc

SEQ ID NO: 363738 - DNA, 17 bp, Homo sapiens
gatatctgttagatgct

SEQ ID NO: 363739 - DNA, 17 bp, Homo sapiens
gatatgattgtaacata

SEQ ID NO: 363740 - DNA, 19 bp, Homo sapiens
gatatgattgtaacatatt

SEQ ID NO: 363741 - DNA, 22 bp, Homo sapiens
gatatgattgtaacatatttct

SEQ ID NO: 363742 - DNA, 20 bp, Homo sapiens
gatatgcatgtagcatataa

SEQ ID NO: 363743 - DNA, 22 bp, Homo sapiens
gatatgtattacttttctgcaa

SEQ ID NO: 363744 - DNA, 13 bp, Homo sapiens
gatatgtctttaa

SEQ ID NO: 363745 - DNA, 13 bp, Homo sapiens
gatatgtggtgta

SEQ ID NO: 363746 - DNA, 23 bp, Homo sapiens
gatattatgtggcttttatttca

SEQ ID NO: 363747 - DNA, 17 bp, Homo sapiens
gatattcaaacacacag

SEQ ID NO: 363748 - DNA, 13 bp, Homo sapiens
gatattctttaca

SEQ ID NO: 363749 - DNA, 20 bp, Homo sapiens
gatattgttataaataaaat

SEQ ID NO: 363750 - DNA, 21 bp, Homo sapiens
gatattgttataaataaaatt

SEQ ID NO: 363751 - DNA, 17 bp, Homo sapiens
gatattgttttctgtaa

SEQ ID NO: 363752 - DNA, 20 bp, Homo sapiens
gatattgttttctgtaaata

SEQ ID NO: 363753 - DNA, 22 bp, Homo sapiens
gatattgttttctgtaaataac

SEQ ID NO: 363754 - DNA, 20 bp, Homo sapiens
gatatttaaaagacaaacac

SEQ ID NO: 363755 - DNA, 13 bp, Homo sapiens
gatatttaagaaa

SEQ ID NO: 363756 - DNA, 14 bp, Homo sapiens
gatatttgatgtag

SEQ ID NO: 363757 - DNA, 12 bp, Homo sapiens
gatattttcaaa

SEQ ID NO: 363758 - DNA, 20 bp, Homo sapiens
gatattttcaaattgtatct

SEQ ID NO: 363759 - DNA, 16 bp, Homo sapiens
gatattttcacatctt

SEQ ID NO: 363760 - DNA, 15 bp, Homo sapiens
gatatttttaattta

SEQ ID NO: 363761 - DNA, 22 bp, Homo sapiens
gatcaaaacctgtgccaggctg

SEQ ID NO: 363762 - DNA, 20 bp, Homo sapiens
gatcaaaataaaaagtgaca

SEQ ID NO: 363763 - DNA, 22 bp, Homo sapiens
gatcaaaataaaaagtgacaca

SEQ ID NO: 363764 - DNA, 17 bp, Homo sapiens
gatcaaagctaggaaag

SEQ ID NO: 363765 - DNA, 13 bp, Homo sapiens
gatcaactgttca

SEQ ID NO: 363766 - DNA, 19 bp, Homo sapiens
gatcaaggcaaaaatatca

SEQ ID NO: 363767 - DNA, 14 bp, Homo sapiens
gatcaataaaatgt

SEQ ID NO: 363768 - DNA, 22 bp, Homo sapiens
gatcaatggcgcagtgcctctg

SEQ ID NO: 363769 - DNA, 15 bp, Homo sapiens
gatcacaaggtcagg

SEQ ID NO: 363770 - DNA, 11 bp, Homo sapiens
gatcacagcct

SEQ ID NO: 363771 - DNA, 14 bp, Homo sapiens
gatcacagcctcca

SEQ ID NO: 363772 - DNA, 15 bp, Homo sapiens
gatcaccagcccggc

SEQ ID NO: 363773 - DNA, 18 bp, Homo sapiens
gatcactatgcattttaa

SEQ ID NO: 363774 - DNA, 16 bp, Homo sapiens
gatgtttccagctgcc

SEQ ID NO: 363775 - DNA, 17 bp, Homo sapiens
gatgtttccagctgcca

SEQ ID NO: 363776 - DNA, 14 bp, Homo sapiens
gatgtttgtggcct

SEQ ID NO: 363777 - DNA, 15 bp, Homo sapiens
gatgtttgtggcctc

SEQ ID NO: 363778 - DNA, 18 bp, Homo sapiens
gatgtttgtggcctcaga

SEQ ID NO: 363779 - DNA, 16 bp, Homo sapiens
gatgttttagaatgat

SEQ ID NO: 363780 - DNA, 18 bp, Homo sapiens
gattaaacacctgacaca

SEQ ID NO: 363781 - DNA, 21 bp, Homo sapiens
gattaaagcaagagaattatt

SEQ ID NO: 363782 - DNA, 13 bp, Homo sapiens
gattaaatattta

SEQ ID NO: 363783 - DNA, 11 bp, Homo sapiens
gattaaatggc

SEQ ID NO: 363784 - DNA, 17 bp, Homo sapiens
gattaaatggcacctgt

SEQ ID NO: 363785 - DNA, 21 bp, Homo sapiens
gattaaatggcacctgtatac

SEQ ID NO: 363786 - DNA, 20 bp, Homo sapiens
gattaaattatatctgaggc

SEQ ID NO: 363787 - DNA, 18 bp, Homo sapiens
gattaatatattgaacac

SEQ ID NO: 363788 - DNA, 19 bp, Homo sapiens
gattaatctctaaaattct

SEQ ID NO: 363789 - DNA, 16 bp, Homo sapiens
gattaatttgtgtaga

SEQ ID NO: 363790 - DNA, 13 bp, Homo sapiens
gattacagaggaa

SEQ ID NO: 363791 - DNA, 18 bp, Homo sapiens
gattacaggtgcccacca

SEQ ID NO: 363792 - DNA, 14 bp, Homo sapiens
gattagacaatgtg

SEQ ID NO: 363793 - DNA, 20 bp, Homo sapiens
gattatcttgaaaaagtatt

SEQ ID NO: 363794 - DNA, 13 bp, Homo sapiens
gattatgggtcac

SEQ ID NO: 363795 - DNA, 17 bp, Homo sapiens
gattatgggtcacagga

SEQ ID NO: 363796 - DNA, 18 bp, Homo sapiens
gattatgggtcacaggaa

SEQ ID NO: 363797 - DNA, 20 bp, Homo sapiens
gattattgaatgttatatca

SEQ ID NO: 363798 - DNA, 22 bp, Homo sapiens
gattatttgttatttgtacagt

SEQ ID NO: 363799 - DNA, 13 bp, Homo sapiens
gattcaaatgcat

SEQ ID NO: 363800 - DNA, 22 bp, Homo sapiens
gattcaagactcaatgtggaaa

SEQ ID NO: 363801 - DNA, 14 bp, Homo sapiens
gattcacctgtaaa

SEQ ID NO: 363802 - DNA, 19 bp, Homo sapiens
gattcacctgtaaaacttt

SEQ ID NO: 363803 - DNA, 20 bp, Homo sapiens
gattcacctgtaaaacttta

SEQ ID NO: 363804 - DNA, 16 bp, Homo sapiens
gattcactattagaga

SEQ ID NO: 363805 - DNA, 12 bp, Homo sapiens
gattcaggctgc

SEQ ID NO: 363806 - DNA, 13 bp, Homo sapiens
gattcaggctgct

SEQ ID NO: 363807 - DNA, 16 bp, Homo sapiens
gattcaggctgcttgg

SEQ ID NO: 363808 - DNA, 11 bp, Homo sapiens
gattcataaca

SEQ ID NO: 363809 - DNA, 16 bp, Homo sapiens
gattcatggctttgta

SEQ ID NO: 363810 - DNA, 18 bp, Homo sapiens
gattccaaagcattttca

SEQ ID NO: 363811 - DNA, 23 bp, Homo sapiens
gattccaaataaaacttgagccc

SEQ ID NO: 363812 - DNA, 15 bp, Homo sapiens
gattcccagagcaga

SEQ ID NO: 363813 - DNA, 21 bp, Homo sapiens
gattcccataacataaaagtg

SEQ ID NO: 363814 - DNA, 14 bp, Homo sapiens
gattcccattgaaa

SEQ ID NO: 363815 - DNA, 16 bp, Homo sapiens
gattcccattgaaaat

SEQ ID NO: 363816 - DNA, 23 bp, Homo sapiens
gattcccattgaaaatgtaagta

SEQ ID NO: 363817 - DNA, 15 bp, Homo sapiens
gattccccggagctg

SEQ ID NO: 363818 - DNA, 21 bp, Homo sapiens
gattccccggagctgggaagg

SEQ ID NO: 363819 - DNA, 21 bp, Homo sapiens
gattcccctaacctcattccc

SEQ ID NO: 363820 - DNA, 21 bp, Homo sapiens
gattcccctggaccacacctc

SEQ ID NO: 363821 - DNA, 15 bp, Homo sapiens
gattcctacttaaac

SEQ ID NO: 363822 - DNA, 21 bp, Homo sapiens
gattcctacttaaacaaaaac

SEQ ID NO: 363823 - DNA, 17 bp, Homo sapiens
gattcctcccccagagc

SEQ ID NO: 363824 - DNA, 18 bp, Homo sapiens
gattcgcccaaagccaga

SEQ ID NO: 363825 - DNA, 20 bp, Homo sapiens
gattcgtctgcgattttatc

SEQ ID NO: 363826 - DNA, 12 bp, Homo sapiens
gattctaaaaca

SEQ ID NO: 363827 - DNA, 15 bp, Homo sapiens
gattctaaaggggac

SEQ ID NO: 363828 - DNA, 15 bp, Homo sapiens
gattctaatgtcttc

SEQ ID NO: 363829 - DNA, 14 bp, Homo sapiens
gattctactttaag

SEQ ID NO: 363830 - DNA, 18 bp, Homo sapiens
gattctactttaagcact

SEQ ID NO: 363831 - DNA, 23 bp, Homo sapiens
gattctactttaagcactacata

SEQ ID NO: 363832 - DNA, 18 bp, Homo sapiens
gattctatatttcatatt

SEQ ID NO: 363833 - DNA, 11 bp, Homo sapiens
gattctcagat

SEQ ID NO: 363834 - DNA, 15 bp, Homo sapiens
gattctctcttctct

SEQ ID NO: 363835 - DNA, 20 bp, Homo sapiens
gattctgggaaaggtgctca

SEQ ID NO: 363836 - DNA, 23 bp, Homo sapiens
gattctgggaagcttgagcctcc

SEQ ID NO: 363837 - DNA, 22 bp, Homo sapiens
gattctgtgtgttttcataata

SEQ ID NO: 363838 - DNA, 18 bp, Homo sapiens
gattctgttctacttgat

SEQ ID NO: 363839 - DNA, 23 bp, Homo sapiens
gattctttccccagaggctccca

SEQ ID NO: 363840 - DNA, 15 bp, Homo sapiens
gattgaaaaaagaga

SEQ ID NO: 363841 - DNA, 22 bp, Homo sapiens
gattgaaaagaagaaagtctat

SEQ ID NO: 363842 - DNA, 16 bp, Homo sapiens
gattgaacacaggcaa

SEQ ID NO: 363843 - DNA, 19 bp, Homo sapiens
gattgaagtatctgtacct

SEQ ID NO: 363844 - DNA, 15 bp, Homo sapiens
gattgccccagagcc

SEQ ID NO: 363845 - DNA, 22 bp, Homo sapiens
gattgcctttgtagttaatgta

SEQ ID NO: 363846 - DNA, 21 bp, Homo sapiens
gattgctctggaagcctgctg

SEQ ID NO: 363847 - DNA, 22 bp, Homo sapiens
gattgctctggaagcctgctga

SEQ ID NO: 363848 - DNA, 18 bp, Homo sapiens
gattggggcctcacccag

SEQ ID NO: 363849 - DNA, 20 bp, Homo sapiens
gattggggcctcacccagaa

SEQ ID NO: 363850 - DNA, 13 bp, Homo sapiens
gattgggggccct

SEQ ID NO: 363851 - DNA, 18 bp, Homo sapiens
gattgggggctggtgcca

SEQ ID NO: 363852 - DNA, 16 bp, Homo sapiens
gattgggggggcttgg

SEQ ID NO: 363853 - DNA, 16 bp, Homo sapiens
gattgggtcgtggtgg

SEQ ID NO: 363854 - DNA, 19 bp, Homo sapiens
gattggtcattaaatacta

SEQ ID NO: 363855 - DNA, 12 bp, Homo sapiens
gattgtaaaata

SEQ ID NO: 363856 - DNA, 23 bp, Homo sapiens
gattgtaaaatagcttgtatagt

SEQ ID NO: 363857 - DNA, 23 bp, Homo sapiens
gattgtgggaattaaggaagtga

SEQ ID NO: 363858 - DNA, 20 bp, Homo sapiens
gattgttttattttggaatt

SEQ ID NO: 363859 - DNA, 16 bp, Homo sapiens
gatttaaaaactggaa

SEQ ID NO: 363860 - DNA, 18 bp, Homo sapiens
gatttaaatagaacttga

SEQ ID NO: 363861 - DNA, 19 bp, Homo sapiens
gatttacagcctcacttga

SEQ ID NO: 363862 - DNA, 16 bp, Homo sapiens
gatttaccttttctgt

SEQ ID NO: 363863 - DNA, 17 bp, Homo sapiens
gatttaccttttctgtt

SEQ ID NO: 363864 - DNA, 12 bp, Homo sapiens
gatttagaaaaa

SEQ ID NO: 363865 - DNA, 20 bp, Homo sapiens
gatttagaaaaaagtttaca

SEQ ID NO: 363866 - DNA, 18 bp, Homo sapiens
gatttagggaagcaggga

SEQ ID NO: 363867 - DNA, 21 bp, Homo sapiens
gatttataaagatttttgtta

SEQ ID NO: 363868 - DNA, 15 bp, Homo sapiens
gatttataaatttga

SEQ ID NO: 363869 - DNA, 20 bp, Homo sapiens
gatttatcacacaaagcaga

SEQ ID NO: 363870 - DNA, 17 bp, Homo sapiens
gatttatttatttctac

SEQ ID NO: 363871 - DNA, 12 bp, Homo sapiens
gatttatttgga

SEQ ID NO: 363872 - DNA, 15 bp, Homo sapiens
gatttcatgattaga

SEQ ID NO: 363873 - DNA, 18 bp, Homo sapiens
gatttcatgattagacaa

SEQ ID NO: 363874 - DNA, 13 bp, Homo sapiens
gatttcatgattt

SEQ ID NO: 363875 - DNA, 22 bp, Homo sapiens
gatttcatgtaaccaagagtat

SEQ ID NO: 363876 - DNA, 20 bp, Homo sapiens
gatttcatttcaactgtttg

SEQ ID NO: 363877 - DNA, 13 bp, Homo sapiens
gatttccaggccc

SEQ ID NO: 363878 - DNA, 18 bp, Homo sapiens
gatttccaggcccctgag

SEQ ID NO: 363879 - DNA, 20 bp, Homo sapiens
gatttctcccagctctagac

SEQ ID NO: 363880 - DNA, 11 bp, Homo sapiens
gatttctggga

SEQ ID NO: 363881 - DNA, 12 bp, Homo sapiens
gatttctgggat

SEQ ID NO: 363882 - DNA, 17 bp, Homo sapiens
gatttcttcgctgctct

SEQ ID NO: 363883 - DNA, 20 bp, Homo sapiens
gatttgaagtggaaaaagaa

SEQ ID NO: 363884 - DNA, 23 bp, Homo sapiens
gatttgaggagcagcttcagttg

SEQ ID NO: 363885 - DNA, 18 bp, Homo sapiens
gatttgagtccattgcaa

SEQ ID NO: 363886 - DNA, 23 bp, Homo sapiens
gatttgagtccattgcaaaaggt

SEQ ID NO: 363887 - DNA, 15 bp, Homo sapiens
gatttgatgctggag

SEQ ID NO: 363888 - DNA, 21 bp, Homo sapiens
gatttgatgctggagaggtta

SEQ ID NO: 363889 - DNA, 17 bp, Homo sapiens
gatttgcaaatgcacat

SEQ ID NO: 363890 - DNA, 21 bp, Homo sapiens
gatttgcaaatgcacatttgt

SEQ ID NO: 363891 - DNA, 13 bp, Homo sapiens
gatttgcatggat

SEQ ID NO: 363892 - DNA, 19 bp, Homo sapiens
gatttgcatttttgtattt

SEQ ID NO: 363893 - DNA, 23 bp, Homo sapiens
gatttgccaaaaactaaaattca

SEQ ID NO: 363894 - DNA, 15 bp, Homo sapiens
gatttgccagcacag

SEQ ID NO: 363895 - DNA, 19 bp, Homo sapiens
gatttggaagagaggcacc

SEQ ID NO: 363896 - DNA, 17 bp, Homo sapiens
gatttgggagctctgct

SEQ ID NO: 363897 - DNA, 16 bp, Homo sapiens
gatttgggggaggctt

SEQ ID NO: 363898 - DNA, 13 bp, Homo sapiens
gatttgtatttat

SEQ ID NO: 363899 - DNA, 18 bp, Homo sapiens
gatttgtgtttttctttt

SEQ ID NO: 363900 - DNA, 12 bp, Homo sapiens
gatttgttcatt

SEQ ID NO: 363901 - DNA, 12 bp, Homo sapiens
gattttaacaat

SEQ ID NO: 363902 - DNA, 14 bp, Homo sapiens
gattttaacaataa

SEQ ID NO: 363903 - DNA, 16 bp, Homo sapiens
gattttacaaaagatg

SEQ ID NO: 363904 - DNA, 18 bp, Homo sapiens
gcagaaacccccaggagg

SEQ ID NO: 363905 - DNA, 16 bp, Homo sapiens
gcagaaagcagaggct

SEQ ID NO: 363906 - DNA, 18 bp, Homo sapiens
gcagaaatcccagttcat

SEQ ID NO: 363907 - DNA, 20 bp, Homo sapiens
gcagaaatgtggatgctctt

SEQ ID NO: 363908 - DNA, 14 bp, Homo sapiens
gcagaagatagaga

SEQ ID NO: 363909 - DNA, 13 bp, Homo sapiens
gcagaagcattaa

SEQ ID NO: 363910 - DNA, 17 bp, Homo sapiens
gcagaagcgtctccctt

SEQ ID NO: 363911 - DNA, 21 bp, Homo sapiens
gcagaagcgtctcccttggcc

SEQ ID NO: 363912 - DNA, 20 bp, Homo sapiens
gcagaaggaggaagggactg

SEQ ID NO: 363913 - DNA, 14 bp, Homo sapiens
gcagaagtgtttca

SEQ ID NO: 363914 - DNA, 19 bp, Homo sapiens
gcagaatggtgggctccag

SEQ ID NO: 363915 - DNA, 21 bp, Homo sapiens
gcagaatggtgggctccagag

SEQ ID NO: 363916 - DNA, 19 bp, Homo sapiens
gcagacacacaacatcaag

SEQ ID NO: 363917 - DNA, 15 bp, Homo sapiens
gcagacagcaagggc

SEQ ID NO: 363918 - DNA, 18 bp, Homo sapiens
gcagacagcaagggcttg

SEQ ID NO: 363919 - DNA, 22 bp, Homo sapiens
gcagacaggccatgtgagccac

SEQ ID NO: 363920 - DNA, 17 bp, Homo sapiens
gcagacagttaagagaa

SEQ ID NO: 363921 - DNA, 15 bp, Homo sapiens
gcagacatttacatg

SEQ ID NO: 363922 - DNA, 17 bp, Homo sapiens
gcagaccgtgatttgga

SEQ ID NO: 363923 - DNA, 16 bp, Homo sapiens
gcagactcctcagatc

SEQ ID NO: 363924 - DNA, 24 bp, Homo sapiens
gcagactcgttctcgtgacccagt

SEQ ID NO: 363925 - DNA, 15 bp, Homo sapiens
gcagactggagggga

SEQ ID NO: 363926 - DNA, 17 bp, Homo sapiens
gcagactggtgagcaga

SEQ ID NO: 363927 - DNA, 16 bp, Homo sapiens
gcagagaagccttggt

SEQ ID NO: 363928 - DNA, 15 bp, Homo sapiens
gcagagaaggcctct

SEQ ID NO: 363929 - DNA, 21 bp, Homo sapiens
gcagagaattctcttatccaa

SEQ ID NO: 363930 - DNA, 18 bp, Homo sapiens
gcagagacaataaaacat

SEQ ID NO: 363931 - DNA, 22 bp, Homo sapiens
gcagagacgaggtgtcttcctt

SEQ ID NO: 363932 - DNA, 17 bp, Homo sapiens
gcagagacggcagcccc

SEQ ID NO: 363933 - DNA, 22 bp, Homo sapiens
gcagagattgggggggcttggg

SEQ ID NO: 363934 - DNA, 17 bp, Homo sapiens
gcagagcaaatgaggga

SEQ ID NO: 363935 - DNA, 12 bp, Homo sapiens
gcagagccatgg

SEQ ID NO: 363936 - DNA, 19 bp, Homo sapiens
gcagagccatgggcctggg

SEQ ID NO: 363937 - DNA, 16 bp, Homo sapiens
gcagagccccggagca

SEQ ID NO: 363938 - DNA, 19 bp, Homo sapiens
gcagagccccggagcacca

SEQ ID NO: 363939 - DNA, 20 bp, Homo sapiens
gcagagccgttcctgggact

SEQ ID NO: 363940 - DNA, 13 bp, Homo sapiens
gcagagcctgtcc

SEQ ID NO: 363941 - DNA, 19 bp, Homo sapiens
gcagagcctgtccccgcct

SEQ ID NO: 363942 - DNA, 12 bp, Homo sapiens
gcagagctcaga

SEQ ID NO: 363943 - DNA, 14 bp, Homo sapiens
gcagagctcagagg

SEQ ID NO: 363944 - DNA, 22 bp, Homo sapiens
gcagagctcagaggagtctggg

SEQ ID NO: 363945 - DNA, 17 bp, Homo sapiens
gcagagctggggggaag

SEQ ID NO: 363946 - DNA, 19 bp, Homo sapiens
gcagaggcagcaggagcca

SEQ ID NO: 363947 - DNA, 14 bp, Homo sapiens
gcagaggctggcct

SEQ ID NO: 363948 - DNA, 19 bp, Homo sapiens
gcagaggctggcctcagac

SEQ ID NO: 363949 - DNA, 22 bp, Homo sapiens
gcagagggaatgttccctgcac

SEQ ID NO: 363950 - DNA, 13 bp, Homo sapiens
gcagaggggacag

SEQ ID NO: 363951 - DNA, 14 bp, Homo sapiens
gcagaggggagagg

SEQ ID NO: 363952 - DNA, 16 bp, Homo sapiens
gcagaggggagaggaa

SEQ ID NO: 363953 - DNA, 15 bp, Homo sapiens
gcagagtctgggcct

SEQ ID NO: 363954 - DNA, 18 bp, Homo sapiens
gcagagtctgggcctctg

SEQ ID NO: 363955 - DNA, 19 bp, Homo sapiens
gcagagttctttgcaagct

SEQ ID NO: 363956 - DNA, 18 bp, Homo sapiens
gcagatatgtattacttt

SEQ ID NO: 363957 - DNA, 19 bp, Homo sapiens
gcagatctagccaggcctc

SEQ ID NO: 363958 - DNA, 13 bp, Homo sapiens
gcagatctgtgcc

SEQ ID NO: 363959 - DNA, 13 bp, Homo sapiens
gcagatgatccat

SEQ ID NO: 363960 - DNA, 14 bp, Homo sapiens
gcagatgccagagc

SEQ ID NO: 363961 - DNA, 18 bp, Homo sapiens
gcagatggaatgctgtgt

SEQ ID NO: 363962 - DNA, 22 bp, Homo sapiens
gcagatggaatgctgtgttaaa

SEQ ID NO: 363963 - DNA, 15 bp, Homo sapiens
gcagattcctgggcc

SEQ ID NO: 363964 - DNA, 15 bp, Homo sapiens
gcagattctagcaca

SEQ ID NO: 363965 - DNA, 17 bp, Homo sapiens
gcagattttacaaaaga

SEQ ID NO: 363966 - DNA, 15 bp, Homo sapiens
gcagcaacacccaag

SEQ ID NO: 363967 - DNA, 18 bp, Homo sapiens
gcagcaacacccaagtcc

SEQ ID NO: 363968 - DNA, 11 bp, Homo sapiens
gcagcacaatt

SEQ ID NO: 363969 - DNA, 18 bp, Homo sapiens
gcagcacaattctgtccc

SEQ ID NO: 363970 - DNA, 15 bp, Homo sapiens
gcagcaccagcctga

SEQ ID NO: 363971 - DNA, 17 bp, Homo sapiens
gcagcaccagcctgagc

SEQ ID NO: 363972 - DNA, 21 bp, Homo sapiens
gcagcaccagcctgagccaca

SEQ ID NO: 363973 - DNA, 22 bp, Homo sapiens
gcagcaccagcctgagccacag

SEQ ID NO: 363974 - DNA, 23 bp, Homo sapiens
gcagcaccagcctgagccacagt

SEQ ID NO: 363975 - DNA, 18 bp, Homo sapiens
gcagcactgggaagctgg

SEQ ID NO: 363976 - DNA, 19 bp, Homo sapiens
gcagcactgggaagctgga

SEQ ID NO: 363977 - DNA, 18 bp, Homo sapiens
gcagcagagcctggaaga

SEQ ID NO: 363978 - DNA, 13 bp, Homo sapiens
gcagcagcccagc

SEQ ID NO: 363979 - DNA, 15 bp, Homo sapiens
gcagcagcccagctt

SEQ ID NO: 363980 - DNA, 12 bp, Homo sapiens
gcagcagctagg

SEQ ID NO: 363981 - DNA, 23 bp, Homo sapiens
gcagcagctaggactgaggagtg

SEQ ID NO: 363982 - DNA, 14 bp, Homo sapiens
gcagcagctccgcc

SEQ ID NO: 363983 - DNA, 15 bp, Homo sapiens
gcagcagctccgcct

SEQ ID NO: 363984 - DNA, 20 bp, Homo sapiens
gcagcagctccgcctggcac

SEQ ID NO: 363985 - DNA, 16 bp, Homo sapiens
gcagcagctgaggccc

SEQ ID NO: 363986 - DNA, 20 bp, Homo sapiens
gcagcagctgaggccccagg

SEQ ID NO: 363987 - DNA, 17 bp, Homo sapiens
gcagcaggagcggtaga

SEQ ID NO: 363988 - DNA, 17 bp, Homo sapiens
gcagcaggcagaggaga

SEQ ID NO: 363989 - DNA, 14 bp, Homo sapiens
gcagcaggcctgtt

SEQ ID NO: 363990 - DNA, 16 bp, Homo sapiens
gcagcagtaccatccc

SEQ ID NO: 363991 - DNA, 21 bp, Homo sapiens
gcagcagtaccatcccactga

SEQ ID NO: 363992 - DNA, 17 bp, Homo sapiens
gcagcagtgagtctctt

SEQ ID NO: 363993 - DNA, 14 bp, Homo sapiens
gcagcatacaaaaa

SEQ ID NO: 363994 - DNA, 19 bp, Homo sapiens
gcagcatcttcacttctaa

SEQ ID NO: 363995 - DNA, 19 bp, Homo sapiens
gcagcatgtggggaagcaa

SEQ ID NO: 363996 - DNA, 23 bp, Homo sapiens
gcagccagccagtcttgcctagg

SEQ ID NO: 363997 - DNA, 17 bp, Homo sapiens
gcagccaggctgccaag

SEQ ID NO: 363998 - DNA, 23 bp, Homo sapiens
gcagccagggcttacctgtacac

SEQ ID NO: 363999 - DNA, 18 bp, Homo sapiens
gcagccatgcctcatgcc

SEQ ID NO: 364000 - DNA, 19 bp, Homo sapiens
gcagcccagaacgggcctc

SEQ ID NO: 364001 - DNA, 20 bp, Homo sapiens
gcagcccagaacgggcctcc

SEQ ID NO: 364002 - DNA, 21 bp, Homo sapiens
gcagcccagaacgggcctccc

SEQ ID NO: 364003 - DNA, 22 bp, Homo sapiens
gcagcccagaacgggcctcccc

SEQ ID NO: 364004 - DNA, 14 bp, Homo sapiens
gcagcccagagaga

SEQ ID NO: 364005 - DNA, 22 bp, Homo sapiens
gcagcccagagagaccctgcca

SEQ ID NO: 364006 - DNA, 16 bp, Homo sapiens
gcagcccagcttcctg

SEQ ID NO: 364007 - DNA, 17 bp, Homo sapiens
gcagcccagcttcctgg

SEQ ID NO: 364008 - DNA, 20 bp, Homo sapiens
gcagcccagcttcctggtgt

SEQ ID NO: 364009 - DNA, 13 bp, Homo sapiens
gcagcccatgccc

SEQ ID NO: 364010 - DNA, 15 bp, Homo sapiens
gcagcccatgcccac

SEQ ID NO: 364011 - DNA, 13 bp, Homo sapiens
gcagccccacttc

SEQ ID NO: 364012 - DNA, 17 bp, Homo sapiens
gcagccccatccttccc

SEQ ID NO: 364013 - DNA, 16 bp, Homo sapiens
gcagccccctccacac

SEQ ID NO: 364014 - DNA, 18 bp, Homo sapiens
gcagccccgttttgggga

SEQ ID NO: 364015 - DNA, 12 bp, Homo sapiens
gcagcccctccc

SEQ ID NO: 364016 - DNA, 14 bp, Homo sapiens
gcagcccctcccca

SEQ ID NO: 364017 - DNA, 17 bp, Homo sapiens
gcagcccgtgtggcccc

SEQ ID NO: 364018 - DNA, 21 bp, Homo sapiens
gcagcccgtgtggccccttca

SEQ ID NO: 364019 - DNA, 22 bp, Homo sapiens
gcagccctaaggatctctcagg

SEQ ID NO: 364020 - DNA, 14 bp, Homo sapiens
gcagccctagtggg

SEQ ID NO: 364021 - DNA, 22 bp, Homo sapiens
gcagccctagtgggagcccagc

SEQ ID NO: 364022 - DNA, 23 bp, Homo sapiens
gcagccctagtgggagcccagca

SEQ ID NO: 364023 - DNA, 12 bp, Homo sapiens
gcagccctctcc

SEQ ID NO: 364024 - DNA, 21 bp, Homo sapiens
gcagccctgctgctgcctgcc

SEQ ID NO: 364025 - DNA, 21 bp, Homo sapiens
gcagcccttcctcctgaagcc

SEQ ID NO: 364026 - DNA, 15 bp, Homo sapiens
gcagcccttgggcag

SEQ ID NO: 364027 - DNA, 14 bp, Homo sapiens
gcagccgcgctctg

SEQ ID NO: 364028 - DNA, 16 bp, Homo sapiens
gcagccgcgctctgcc

SEQ ID NO: 364029 - DNA, 17 bp, Homo sapiens
gcagccgcgctctgccc

SEQ ID NO: 364030 - DNA, 16 bp, Homo sapiens
gcagccgctaggagag

SEQ ID NO: 364031 - DNA, 19 bp, Homo sapiens
gcagccgctaggagagact

SEQ ID NO: 364032 - DNA, 21 bp, Homo sapiens
gcagccgctaggagagactga

SEQ ID NO: 364033 - DNA, 14 bp, Homo sapiens
gcagccgtgccttc

SEQ ID NO: 364034 - DNA, 20 bp, Homo sapiens
gcatgtaaaatcttcagctg

SEQ ID NO: 364035 - DNA, 21 bp, Homo sapiens
gcatgtaaaatcttcagctgg

SEQ ID NO: 364036 - DNA, 23 bp, Homo sapiens
gcatgtaaaatcttcagctggtg

SEQ ID NO: 364037 - DNA, 15 bp, Homo sapiens
gcatgtaagaaataa

SEQ ID NO: 364038 - DNA, 17 bp, Homo sapiens
gcatgtaatattaaatt

SEQ ID NO: 364039 - DNA, 21 bp, Homo sapiens
gcatgtactttatattttcta

SEQ ID NO: 364040 - DNA, 22 bp, Homo sapiens
gcatgtactttatattttctat

SEQ ID NO: 364041 - DNA, 17 bp, Homo sapiens
gcatgtagcatataaat

SEQ ID NO: 364042 - DNA, 16 bp, Homo sapiens
gcatgtattggcctgg

SEQ ID NO: 364043 - DNA, 20 bp, Homo sapiens
gcatgtattggcctggaggt

SEQ ID NO: 364044 - DNA, 17 bp, Homo sapiens
gcatgtcctcatccttt

SEQ ID NO: 364045 - DNA, 22 bp, Homo sapiens
gcatgtctctgcttccatggct

SEQ ID NO: 364046 - DNA, 19 bp, Homo sapiens
gcatgtgaagcatgctttg

SEQ ID NO: 364047 - DNA, 22 bp, Homo sapiens
gcatgtgaattctgtgaagaat

SEQ ID NO: 364048 - DNA, 22 bp, Homo sapiens
gcatgtgattggcagcttcaaa

SEQ ID NO: 364049 - DNA, 23 bp, Homo sapiens
gcatgtgccaagattctactctt

SEQ ID NO: 364050 - DNA, 12 bp, Homo sapiens
gcatgtggggga

SEQ ID NO: 364051 - DNA, 16 bp, Homo sapiens
gcatgtgggttgtgat

SEQ ID NO: 364052 - DNA, 20 bp, Homo sapiens
gcatgtgtatttccagtgca

SEQ ID NO: 364053 - DNA, 14 bp, Homo sapiens
gcatgtgtcagagt

SEQ ID NO: 364054 - DNA, 17 bp, Homo sapiens
gcatgtgtctgtattca

SEQ ID NO: 364055 - DNA, 17 bp, Homo sapiens
gcatgtgtgcctgtggc

SEQ ID NO: 364056 - DNA, 20 bp, Homo sapiens
gcatgtgtttggttctgggg

SEQ ID NO: 364057 - DNA, 18 bp, Homo sapiens
gcatgttacctcctataa

SEQ ID NO: 364058 - DNA, 14 bp, Homo sapiens
gcatgttgaatgta

SEQ ID NO: 364059 - DNA, 15 bp, Homo sapiens
gcatgttgagaggct

SEQ ID NO: 364060 - DNA, 23 bp, Homo sapiens
gcatgtttgtctgtgtgctgtaa

SEQ ID NO: 364061 - DNA, 16 bp, Homo sapiens
gcattaacttctctgg

SEQ ID NO: 364062 - DNA, 13 bp, Homo sapiens
gcattactctgca

SEQ ID NO: 364063 - DNA, 18 bp, Homo sapiens
gcattatccttttatctc

SEQ ID NO: 364064 - DNA, 14 bp, Homo sapiens
gcattcacacacag

SEQ ID NO: 364065 - DNA, 15 bp, Homo sapiens
gcattcacacacagc

SEQ ID NO: 364066 - DNA, 22 bp, Homo sapiens
gcattcacacacagcctggcct

SEQ ID NO: 364067 - DNA, 15 bp, Homo sapiens
gcattcatgttttaa

SEQ ID NO: 364068 - DNA, 23 bp, Homo sapiens
gcattcatgttttaaaagtttgt

SEQ ID NO: 364069 - DNA, 14 bp, Homo sapiens
gcattccagctctg

SEQ ID NO: 364070 - DNA, 18 bp, Homo sapiens
gcattccagctctgcccc

SEQ ID NO: 364071 - DNA, 21 bp, Homo sapiens
gcattccttagcagctcaggc

SEQ ID NO: 364072 - DNA, 16 bp, Homo sapiens
gcattctgcctgcctg

SEQ ID NO: 364073 - DNA, 20 bp, Homo sapiens
gcattctgcctgcctgggaa

SEQ ID NO: 364074 - DNA, 19 bp, Homo sapiens
gcattcttgtcacaataaa

SEQ ID NO: 364075 - DNA, 22 bp, Homo sapiens
gcattcttgtcacaataaatgt

SEQ ID NO: 364076 - DNA, 20 bp, Homo sapiens
gcattcttttaaagttttat

SEQ ID NO: 364077 - DNA, 21 bp, Homo sapiens
gcattgaaagaagagatgaga

SEQ ID NO: 364078 - DNA, 11 bp, Homo sapiens
gcattgaaatt

SEQ ID NO: 364079 - DNA, 17 bp, Homo sapiens
gcattgagtcattgtca

SEQ ID NO: 364080 - DNA, 15 bp, Homo sapiens
gcattgcactaaaag

SEQ ID NO: 364081 - DNA, 21 bp, Homo sapiens
gcattgcactaaaagtgatgt

SEQ ID NO: 364082 - DNA, 23 bp, Homo sapiens
gcattgcactaaaagtgatgtga

SEQ ID NO: 364083 - DNA, 18 bp, Homo sapiens
gcattgcttttggacaag

SEQ ID NO: 364084 - DNA, 12 bp, Homo sapiens
gcattggtggct

SEQ ID NO: 364085 - DNA, 17 bp, Homo sapiens
gcattggttccctttgc

SEQ ID NO: 364086 - DNA, 14 bp, Homo sapiens
gcattgtcttgtgg

SEQ ID NO: 364087 - DNA, 17 bp, Homo sapiens
gcattgttattgtggaa

SEQ ID NO: 364088 - DNA, 19 bp, Homo sapiens
gcattgttattgtggaaga

SEQ ID NO: 364089 - DNA, 16 bp, Homo sapiens
gcattgttgaggtggt

SEQ ID NO: 364090 - DNA, 20 bp, Homo sapiens
gcattgtttgcttattgttc

SEQ ID NO: 364091 - DNA, 21 bp, Homo sapiens
gcattgtttgcttattgttcc

SEQ ID NO: 364092 - DNA, 17 bp, Homo sapiens
gcatttataaatgtgtg

SEQ ID NO: 364093 - DNA, 19 bp, Homo sapiens
gcatttataaatgtgtggt

SEQ ID NO: 364094 - DNA, 14 bp, Homo sapiens
gcatttatgcatga

SEQ ID NO: 364095 - DNA, 16 bp, Homo sapiens
gcatttatgcatgaga

SEQ ID NO: 364096 - DNA, 19 bp, Homo sapiens
gcatttatggtcaacactt

SEQ ID NO: 364097 - DNA, 14 bp, Homo sapiens
gcatttattgcagt

SEQ ID NO: 364098 - DNA, 16 bp, Homo sapiens
gcatttattgcagttt

SEQ ID NO: 364099 - DNA, 18 bp, Homo sapiens
gcatttatttatgtgcaa

SEQ ID NO: 364100 - DNA, 23 bp, Homo sapiens
gcatttccaacaccacagacaca

SEQ ID NO: 364101 - DNA, 18 bp, Homo sapiens
gcatttctttatttctgt

SEQ ID NO: 364102 - DNA, 19 bp, Homo sapiens
gcatttctttatttctgtc

SEQ ID NO: 364103 - DNA, 12 bp, Homo sapiens
gcatttgctgaa

SEQ ID NO: 364104 - DNA, 20 bp, Homo sapiens
gcatttggtaggtagtgatt

SEQ ID NO: 364105 - DNA, 18 bp, Homo sapiens
gcatttgtaaatattaaa

SEQ ID NO: 364106 - DNA, 20 bp, Homo sapiens
gcatttgtaaatattaaacc

SEQ ID NO: 364107 - DNA, 20 bp, Homo sapiens
gcatttgtcttagagagaga

SEQ ID NO: 364108 - DNA, 19 bp, Homo sapiens
gcatttgtgagccaaagag

SEQ ID NO: 364109 - DNA, 18 bp, Homo sapiens
gcatttgtgtctgcctgc

SEQ ID NO: 364110 - DNA, 18 bp, Homo sapiens
gcattttcaccccaccct

SEQ ID NO: 364111 - DNA, 15 bp, Homo sapiens
gcattttcagcatca

SEQ ID NO: 364112 - DNA, 16 bp, Homo sapiens
gcattttcctcgccta

SEQ ID NO: 364113 - DNA, 13 bp, Homo sapiens
gcattttctcagg

SEQ ID NO: 364114 - DNA, 18 bp, Homo sapiens
gcattttctttctgtttt

SEQ ID NO: 364115 - DNA, 14 bp, Homo sapiens
gcattttgtgtctt

SEQ ID NO: 364116 - DNA, 21 bp, Homo sapiens
gcatttttaaaggacaaacag

SEQ ID NO: 364117 - DNA, 16 bp, Homo sapiens
gcatttttaagggagt

SEQ ID NO: 364118 - DNA, 21 bp, Homo sapiens
gcatttttactactattctgt

SEQ ID NO: 364119 - DNA, 23 bp, Homo sapiens
gcatttttactactattctgtta

SEQ ID NO: 364120 - DNA, 20 bp, Homo sapiens
gcatttttgatttatgcatg

SEQ ID NO: 364121 - DNA, 17 bp, Homo sapiens
gcattttttaaaacaag

SEQ ID NO: 364122 - DNA, 21 bp, Homo sapiens
gccaaaaactaaaattcaaca

SEQ ID NO: 364123 - DNA, 22 bp, Homo sapiens
gccaaacagttgtaccactgct

SEQ ID NO: 364124 - DNA, 18 bp, Homo sapiens
gccaaacccttgtcagtg

SEQ ID NO: 364125 - DNA, 19 bp, Homo sapiens
gccaaagacttagtatatt

SEQ ID NO: 364126 - DNA, 12 bp, Homo sapiens
gccaaagagctc

SEQ ID NO: 364127 - DNA, 16 bp, Homo sapiens
gccaaagctagggtgg

SEQ ID NO: 364128 - DNA, 23 bp, Homo sapiens
gccaaagtcagtaggagaggatg

SEQ ID NO: 364129 - DNA, 19 bp, Homo sapiens
gccaaataaagttaaaagt

SEQ ID NO: 364130 - DNA, 23 bp, Homo sapiens
gccaaatagagtttttatatttg

SEQ ID NO: 364131 - DNA, 16 bp, Homo sapiens
gccaaatatgcacttt

SEQ ID NO: 364132 - DNA, 17 bp, Homo sapiens
gccaaatatgcactttc

SEQ ID NO: 364133 - DNA, 22 bp, Homo sapiens
gccaaatatgcactttccctag

SEQ ID NO: 364134 - DNA, 24 bp, Homo sapiens
gccaaatatgcactttccctagaa

SEQ ID NO: 364135 - DNA, 21 bp, Homo sapiens
gccaaatcctgggcatcccca

SEQ ID NO: 364136 - DNA, 14 bp, Homo sapiens
gccaaatgcacaag

SEQ ID NO: 364137 - DNA, 22 bp, Homo sapiens
gccaaatggtttaacttctgcc

SEQ ID NO: 364138 - DNA, 11 bp, Homo sapiens
gccaaattatt

SEQ ID NO: 364139 - DNA, 14 bp, Homo sapiens
gccaacaccaggga

SEQ ID NO: 364140 - DNA, 21 bp, Homo sapiens
gccaacacttgtgttgctttc

SEQ ID NO: 364141 - DNA, 19 bp, Homo sapiens
gccaacagaagcttccatt

SEQ ID NO: 364142 - DNA, 23 bp, Homo sapiens
gccaaccacctctggccctgttg

SEQ ID NO: 364143 - DNA, 21 bp, Homo sapiens
gccaacctcggcttgtgggct

SEQ ID NO: 364144 - DNA, 14 bp, Homo sapiens
gccaacctgatgcc

SEQ ID NO: 364145 - DNA, 17 bp, Homo sapiens
gccaacctgatgcccct

SEQ ID NO: 364146 - DNA, 14 bp, Homo sapiens
gccaacgttcatgc

SEQ ID NO: 364147 - DNA, 15 bp, Homo sapiens
gccaactaagccctc

SEQ ID NO: 364148 - DNA, 16 bp, Homo sapiens
gccaactaagccctcg

SEQ ID NO: 364149 - DNA, 23 bp, Homo sapiens
gccaactaagccctcgaaccaag

SEQ ID NO: 364150 - DNA, 20 bp, Homo sapiens
gccaactcactcttatgaaa

SEQ ID NO: 364151 - DNA, 21 bp, Homo sapiens
gccaactccatgaccaggcca

SEQ ID NO: 364152 - DNA, 22 bp, Homo sapiens
gccaactccatgaccaggccac

SEQ ID NO: 364153 - DNA, 16 bp, Homo sapiens
gccaactcgggagcat

SEQ ID NO: 364154 - DNA, 15 bp, Homo sapiens
gccaacttgtaaata

SEQ ID NO: 364155 - DNA, 17 bp, Homo sapiens
gccaactttccagactt

SEQ ID NO: 364156 - DNA, 23 bp, Homo sapiens
gccaagaaatcgccttatgagaa

SEQ ID NO: 364157 - DNA, 19 bp, Homo sapiens
gccaagaagtgaggcctgg

SEQ ID NO: 364158 - DNA, 20 bp, Homo sapiens
gccaagagcatcgtgaccct

SEQ ID NO: 364159 - DNA, 20 bp, Homo sapiens
gccaagatcacgccactgca

SEQ ID NO: 364160 - DNA, 12 bp, Homo sapiens
gccaagccaggg

SEQ ID NO: 364161 - DNA, 13 bp, Homo sapiens
gccaagccaggga

SEQ ID NO: 364162 - DNA, 22 bp, Homo sapiens
gccaagccagggttccagacag

SEQ ID NO: 364163 - DNA, 16 bp, Homo sapiens
gccaagcccaccctgg

SEQ ID NO: 364164 - DNA, 15 bp, Homo sapiens
gccaagcctgcagct

SEQ ID NO: 364165 - DNA, 16 bp, Homo sapiens
gccaagcctgcagctt

SEQ ID NO: 364166 - DNA, 12 bp, Homo sapiens
gccaagcctgga

SEQ ID NO: 364167 - DNA, 18 bp, Homo sapiens
gccaagcctggagcccct

SEQ ID NO: 364168 - DNA, 14 bp, Homo sapiens
gccaaggagcccct

SEQ ID NO: 364169 - DNA, 18 bp, Homo sapiens
gccaaggaggtcccagga

SEQ ID NO: 364170 - DNA, 21 bp, Homo sapiens
gccaaggccagagtggcctgg

SEQ ID NO: 364171 - DNA, 13 bp, Homo sapiens
gccaaggcctcag

SEQ ID NO: 364172 - DNA, 16 bp, Homo sapiens
gccaaggcctcaggag

SEQ ID NO: 364173 - DNA, 14 bp, Homo sapiens
gccaaggccttctc

SEQ ID NO: 364174 - DNA, 17 bp, Homo sapiens
gccaaggctctcccctc

SEQ ID NO: 364175 - DNA, 19 bp, Homo sapiens
gccaaggctctcccctctc

SEQ ID NO: 364176 - DNA, 23 bp, Homo sapiens
gccaagggctccagggccagggt

SEQ ID NO: 364177 - DNA, 19 bp, Homo sapiens
gccaaggggccagctgccc

SEQ ID NO: 364178 - DNA, 15 bp, Homo sapiens
gccaaggtgggcgga

SEQ ID NO: 364179 - DNA, 16 bp, Homo sapiens
gccaagtcctgccttt

SEQ ID NO: 364180 - DNA, 13 bp, Homo sapiens
gccaagtgctctt

SEQ ID NO: 364181 - DNA, 15 bp, Homo sapiens
gccaagtgctctttg

SEQ ID NO: 364182 - DNA, 18 bp, Homo sapiens
gccaataaataatattat

SEQ ID NO: 364183 - DNA, 22 bp, Homo sapiens
gccaataataaaaaacaagaaa

SEQ ID NO: 364184 - DNA, 15 bp, Homo sapiens
gccaatactgagtgc

SEQ ID NO: 364185 - DNA, 17 bp, Homo sapiens
gccaatactgagtgcct

SEQ ID NO: 364186 - DNA, 23 bp, Homo sapiens
gccaatactgagtgcctgcagca

SEQ ID NO: 364187 - DNA, 13 bp, Homo sapiens
gccaatatgtatt

SEQ ID NO: 364188 - DNA, 17 bp, Homo sapiens
gccaatatgtattgtaa

SEQ ID NO: 364189 - DNA, 17 bp, Homo sapiens
gccaatattgagatgta

SEQ ID NO: 364190 - DNA, 23 bp, Homo sapiens
gccaatctcttctaaaaaaaaac

SEQ ID NO: 364191 - DNA, 12 bp, Homo sapiens
gccaatgaggtc

SEQ ID NO: 364192 - DNA, 16 bp, Homo sapiens
gccaatgccacagcca

SEQ ID NO: 364193 - DNA, 19 bp, Homo sapiens
gccaatgccacagccaagc

SEQ ID NO: 364194 - DNA, 13 bp, Homo sapiens
gccaatttgtctc

SEQ ID NO: 364195 - DNA, 22 bp, Homo sapiens
gccaattttgtcacagctcttg

SEQ ID NO: 364196 - DNA, 20 bp, Homo sapiens
gccacaaatcaaagcaaggg

SEQ ID NO: 364197 - DNA, 23 bp, Homo sapiens
gccacaaatcaaagcaagggctc

SEQ ID NO: 364198 - DNA, 14 bp, Homo sapiens
gccacaaggctggc

SEQ ID NO: 364199 - DNA, 16 bp, Homo sapiens
gccacaaggctggcca

SEQ ID NO: 364200 - DNA, 17 bp, Homo sapiens
gccacaatcctccccac

SEQ ID NO: 364201 - DNA, 17 bp, Homo sapiens
gccacaatgtgatatgt

SEQ ID NO: 364202 - DNA, 19 bp, Homo sapiens
gccacaatgtgatatgtgt

SEQ ID NO: 364203 - DNA, 23 bp, Homo sapiens
gccacacagtgggccggccccag

SEQ ID NO: 364204 - DNA, 20 bp, Homo sapiens
gccacaccacagcaagccgg

SEQ ID NO: 364205 - DNA, 16 bp, Homo sapiens
gccacacccaggaagg

SEQ ID NO: 364206 - DNA, 17 bp, Homo sapiens
gccacacccaggaaggg

SEQ ID NO: 364207 - DNA, 14 bp, Homo sapiens
gccacacgctgccc

SEQ ID NO: 364208 - DNA, 20 bp, Homo sapiens
gccacacgctgcccaggctc

SEQ ID NO: 364209 - DNA, 21 bp, Homo sapiens
gccacactattaccatgagaa

SEQ ID NO: 364210 - DNA, 20 bp, Homo sapiens
gccacacttcaggctcttct

SEQ ID NO: 364211 - DNA, 23 bp, Homo sapiens
gccacacttcaggctcttctcct

SEQ ID NO: 364212 - DNA, 17 bp, Homo sapiens
gccacagcagcctctga

SEQ ID NO: 364213 - DNA, 13 bp, Homo sapiens
gccacagccaagc

SEQ ID NO: 364214 - DNA, 19 bp, Homo sapiens
gccacagcccagccacgga

SEQ ID NO: 364215 - DNA, 13 bp, Homo sapiens
gccacagctgctg

SEQ ID NO: 364216 - DNA, 15 bp, Homo sapiens
gccacagctgctgga

SEQ ID NO: 364217 - DNA, 23 bp, Homo sapiens
gccacaggccactgcaaaccctg

SEQ ID NO: 364218 - DNA, 23 bp, Homo sapiens
gccacaggctgcaagctgcaggg

SEQ ID NO: 364219 - DNA, 14 bp, Homo sapiens
gccacatgagtccc

SEQ ID NO: 364220 - DNA, 18 bp, Homo sapiens
gccacatgagtcccagtg

SEQ ID NO: 364221 - DNA, 17 bp, Homo sapiens
gccacattttgctttat

SEQ ID NO: 364222 - DNA, 22 bp, Homo sapiens
gccaccaacataaaacaaaacc

SEQ ID NO: 364223 - DNA, 16 bp, Homo sapiens
gccaccaagctgctct

SEQ ID NO: 364224 - DNA, 13 bp, Homo sapiens
gccaccaataaaa

SEQ ID NO: 364225 - DNA, 14 bp, Homo sapiens
gccaccaataaaaa

SEQ ID NO: 364226 - DNA, 13 bp, Homo sapiens
gccaccacccctc

SEQ ID NO: 364227 - DNA, 14 bp, Homo sapiens
gccaccacccctcc

SEQ ID NO: 364228 - DNA, 17 bp, Homo sapiens
gccaccacgccctgcct

SEQ ID NO: 364229 - DNA, 17 bp, Homo sapiens
gccaccacgtctgccag

SEQ ID NO: 364230 - DNA, 19 bp, Homo sapiens
gccaccacgtctgccaggc

SEQ ID NO: 364231 - DNA, 20 bp, Homo sapiens
gccaccacgtctgccaggcc

SEQ ID NO: 364232 - DNA, 21 bp, Homo sapiens
gccaccacgtctgccaggccc

SEQ ID NO: 364233 - DNA, 12 bp, Homo sapiens
gccaccatcctg

SEQ ID NO: 364234 - DNA, 20 bp, Homo sapiens
gccaccatgcactcaataaa

SEQ ID NO: 364235 - DNA, 17 bp, Homo sapiens
gccaccatggccagcca

SEQ ID NO: 364236 - DNA, 23 bp, Homo sapiens
gccaccatgtatgtggaagcagg

SEQ ID NO: 364237 - DNA, 21 bp, Homo sapiens
gccacccaccagggctcagct

SEQ ID NO: 364238 - DNA, 14 bp, Homo sapiens
gccacccacccttc

SEQ ID NO: 364239 - DNA, 20 bp, Homo sapiens
gccacccacccttctcccct

SEQ ID NO: 364240 - DNA, 24 bp, Homo sapiens
gccacccactgtggggcaagcctg

SEQ ID NO: 364241 - DNA, 15 bp, Homo sapiens
gccacccagccagga

SEQ ID NO: 364242 - DNA, 23 bp, Homo sapiens
gccaccccaaaccccagccccaa

SEQ ID NO: 364243 - DNA, 23 bp, Homo sapiens
gccaccccagcctggccacgcag

SEQ ID NO: 364244 - DNA, 23 bp, Homo sapiens
gccaccccccgccggcaggggcc

SEQ ID NO: 364245 - DNA, 18 bp, Homo sapiens
gccaccccgggctctctg

SEQ ID NO: 364246 - DNA, 12 bp, Homo sapiens
gccacccgcccg

SEQ ID NO: 364247 - DNA, 18 bp, Homo sapiens
gccacccggatctccagg

SEQ ID NO: 364248 - DNA, 20 bp, Homo sapiens
gccacccgtaggcagcctct

SEQ ID NO: 364249 - DNA, 23 bp, Homo sapiens
gccacccgttctgctggcctgga

SEQ ID NO: 364250 - DNA, 18 bp, Homo sapiens
gccaccctccttcccgcc

SEQ ID NO: 364251 - DNA, 13 bp, Homo sapiens
gccaccctctgca

SEQ ID NO: 364252 - DNA, 20 bp, Homo sapiens
gccaccctctgcagggcagc

SEQ ID NO: 364253 - DNA, 18 bp, Homo sapiens
gccacccttggcctgtcc

SEQ ID NO: 364254 - DNA, 17 bp, Homo sapiens
gccaccgcgagggcctg

SEQ ID NO: 364255 - DNA, 17 bp, Homo sapiens
gccaccgcgcctggccg

SEQ ID NO: 364256 - DNA, 23 bp, Homo sapiens
gccaccggggcaagagggaaggt

SEQ ID NO: 364257 - DNA, 19 bp, Homo sapiens
gccacctatctcgtgggag

SEQ ID NO: 364258 - DNA, 20 bp, Homo sapiens
gccacctatctcgtgggaga

SEQ ID NO: 364259 - DNA, 21 bp, Homo sapiens
gccacctatctcgtgggagag

SEQ ID NO: 364260 - DNA, 12 bp, Homo sapiens
gccacctatgcc

SEQ ID NO: 364261 - DNA, 15 bp, Homo sapiens
gccacctccccaggc

SEQ ID NO: 364262 - DNA, 20 bp, Homo sapiens
gccacctccctgacccgtct

SEQ ID NO: 364263 - DNA, 16 bp, Homo sapiens
gccacctctctccttt

SEQ ID NO: 364264 - DNA, 22 bp, Homo sapiens
gccacctctggccaaatatgca

SEQ ID NO: 364265 - DNA, 12 bp, Homo sapiens
gccacctgcagc

SEQ ID NO: 364266 - DNA, 16 bp, Homo sapiens
gccacctgcaggtcac

SEQ ID NO: 364267 - DNA, 22 bp, Homo sapiens
gccacctggcggccctaagcca

SEQ ID NO: 364268 - DNA, 14 bp, Homo sapiens
gccacctggggcag

SEQ ID NO: 364269 - DNA, 10 bp, Homo sapiens
gccacctgtc

SEQ ID NO: 364270 - DNA, 13 bp, Homo sapiens
gccacctgtccca

SEQ ID NO: 364271 - DNA, 19 bp, Homo sapiens
gccaccttgtacagaacca

SEQ ID NO: 364272 - DNA, 15 bp, Homo sapiens
gccacctttcctgtt

SEQ ID NO: 364273 - DNA, 13 bp, Homo sapiens
gccacgaggtggt

SEQ ID NO: 364274 - DNA, 14 bp, Homo sapiens
gccacgccccagcc

SEQ ID NO: 364275 - DNA, 19 bp, Homo sapiens
gccacgctccctctcctgt

SEQ ID NO: 364276 - DNA, 16 bp, Homo sapiens
gccacggacgctggct

SEQ ID NO: 364277 - DNA, 17 bp, Homo sapiens
gccacggccaccctcct

SEQ ID NO: 364278 - DNA, 12 bp, Homo sapiens
gccacgggggag

SEQ ID NO: 364279 - DNA, 23 bp, Homo sapiens
gccacgggggaggccgaggcagg

SEQ ID NO: 364280 - DNA, 14 bp, Homo sapiens
gccacgtgaatggc

SEQ ID NO: 364281 - DNA, 14 bp, Homo sapiens
gccactaaggtcag

SEQ ID NO: 364282 - DNA, 15 bp, Homo sapiens
gccactacctttgtc

SEQ ID NO: 364283 - DNA, 15 bp, Homo sapiens
gccactaggctgggt

SEQ ID NO: 364284 - DNA, 20 bp, Homo sapiens
gccactaggctgggtgccca

SEQ ID NO: 364285 - DNA, 21 bp, Homo sapiens
gccactaggctgggtgcccac

SEQ ID NO: 364286 - DNA, 16 bp, Homo sapiens
gccactaggtgtcccc

SEQ ID NO: 364287 - DNA, 21 bp, Homo sapiens
gccactattgttagtctcttg

SEQ ID NO: 364288 - DNA, 18 bp, Homo sapiens
gccactccagacccctgg

SEQ ID NO: 364289 - DNA, 21 bp, Homo sapiens
gccactccagacccctggctt

SEQ ID NO: 364290 - DNA, 22 bp, Homo sapiens
gccactccagacccctggcttt

SEQ ID NO: 364291 - DNA, 19 bp, Homo sapiens
gccactccctgagctttgg

SEQ ID NO: 364292 - DNA, 16 bp, Homo sapiens
gcccaaggtcccctcc

SEQ ID NO: 364293 - DNA, 20 bp, Homo sapiens
gcccaaggtcccctccacat

SEQ ID NO: 364294 - DNA, 12 bp, Homo sapiens
gcccaataaagg

SEQ ID NO: 364295 - DNA, 12 bp, Homo sapiens
gcccaatattat

SEQ ID NO: 364296 - DNA, 14 bp, Homo sapiens
gcccaatcactgcc

SEQ ID NO: 364297 - DNA, 22 bp, Homo sapiens
gcccaatgctttgggaggccaa

SEQ ID NO: 364298 - DNA, 21 bp, Homo sapiens
gcccacaataatgaataatca

SEQ ID NO: 364299 - DNA, 15 bp, Homo sapiens
gcccacacctgcctc

SEQ ID NO: 364300 - DNA, 16 bp, Homo sapiens
gcccacaggaggcaag

SEQ ID NO: 364301 - DNA, 22 bp, Homo sapiens
gcccacaggaggcaagcaagct

SEQ ID NO: 364302 - DNA, 19 bp, Homo sapiens
gcccaccagggactgcagc

SEQ ID NO: 364303 - DNA, 19 bp, Homo sapiens
gcccacccagggcccggca

SEQ ID NO: 364304 - DNA, 15 bp, Homo sapiens
gcccacccccctcat

SEQ ID NO: 364305 - DNA, 20 bp, Homo sapiens
gcccaccccgctgcctggcg

SEQ ID NO: 364306 - DNA, 21 bp, Homo sapiens
gcccacccctcttcccccttc

SEQ ID NO: 364307 - DNA, 13 bp, Homo sapiens
gcccacccctgct

SEQ ID NO: 364308 - DNA, 22 bp, Homo sapiens
gcccacccctgctgccgccact

SEQ ID NO: 364309 - DNA, 13 bp, Homo sapiens
gcccacccgcccc

SEQ ID NO: 364310 - DNA, 21 bp, Homo sapiens
gcccacccgccccagagactg

SEQ ID NO: 364311 - DNA, 23 bp, Homo sapiens
gcccacccgtcttcaatctctgt

SEQ ID NO: 364312 - DNA, 12 bp, Homo sapiens
gcccaccctgct

SEQ ID NO: 364313 - DNA, 20 bp, Homo sapiens
gcccaccctgggcctcccgt

SEQ ID NO: 364314 - DNA, 20 bp, Homo sapiens
gcccaccgaccccctttcta

SEQ ID NO: 364315 - DNA, 23 bp, Homo sapiens
gcccacctaagggctaaggcctc

SEQ ID NO: 364316 - DNA, 21 bp, Homo sapiens
gcccacctaccttcaaagctg

SEQ ID NO: 364317 - DNA, 14 bp, Homo sapiens
gcccacctctgctg

SEQ ID NO: 364318 - DNA, 15 bp, Homo sapiens
gcccacctctgctgc

SEQ ID NO: 364319 - DNA, 16 bp, Homo sapiens
gcccacctctgctgcc

SEQ ID NO: 364320 - DNA, 20 bp, Homo sapiens
gcccacctctgctgcccacg

SEQ ID NO: 364321 - DNA, 23 bp, Homo sapiens
gcccacctctgctgcccacggcc

SEQ ID NO: 364322 - DNA, 16 bp, Homo sapiens
gcccacctgaaagcct

SEQ ID NO: 364323 - DNA, 23 bp, Homo sapiens
gcccacctgcatcagcctctggc

SEQ ID NO: 364324 - DNA, 14 bp, Homo sapiens
gcccacctgcccag

SEQ ID NO: 364325 - DNA, 13 bp, Homo sapiens
gcccacctgggcc

SEQ ID NO: 364326 - DNA, 15 bp, Homo sapiens
gcccacctgggctgg

SEQ ID NO: 364327 - DNA, 19 bp, Homo sapiens
gcccacctgggctgggcgc

SEQ ID NO: 364328 - DNA, 15 bp, Homo sapiens
gcccacgcagagccc

SEQ ID NO: 364329 - DNA, 23 bp, Homo sapiens
gcccacgcagagccccggagcac

SEQ ID NO: 364330 - DNA, 18 bp, Homo sapiens
gcccacgccctccctctc

SEQ ID NO: 364331 - DNA, 20 bp, Homo sapiens
gcccacgccctccctctccc

SEQ ID NO: 364332 - DNA, 14 bp, Homo sapiens
gcccacgctcctgc

SEQ ID NO: 364333 - DNA, 18 bp, Homo sapiens
gcccacggctaagaggct

SEQ ID NO: 364334 - DNA, 15 bp, Homo sapiens
gcccactgtcctggg

SEQ ID NO: 364335 - DNA, 21 bp, Homo sapiens
gcccactgtcctgggcgccct

SEQ ID NO: 364336 - DNA, 23 bp, Homo sapiens
gcccactgtcctgggcgccctgg

SEQ ID NO: 364337 - DNA, 21 bp, Homo sapiens
gcccacttagccgtccatggc

SEQ ID NO: 364338 - DNA, 23 bp, Homo sapiens
gcccacttcagggttctcctctc

SEQ ID NO: 364339 - DNA, 18 bp, Homo sapiens
gcccagaacgggcctccc

SEQ ID NO: 364340 - DNA, 20 bp, Homo sapiens
gcccagaacgggcctccccg

SEQ ID NO: 364341 - DNA, 11 bp, Homo sapiens
gcccagaactg

SEQ ID NO: 364342 - DNA, 15 bp, Homo sapiens
gcccagaactgcccc

SEQ ID NO: 364343 - DNA, 20 bp, Homo sapiens
gcccagaactgcccccactg

SEQ ID NO: 364344 - DNA, 17 bp, Homo sapiens
gcccagacaccacagac

SEQ ID NO: 364345 - DNA, 16 bp, Homo sapiens
gcccagacccccagtg

SEQ ID NO: 364346 - DNA, 23 bp, Homo sapiens
gcccagacctcccctcttcctgg

SEQ ID NO: 364347 - DNA, 21 bp, Homo sapiens
gcccagagagaccctgccaac

SEQ ID NO: 364348 - DNA, 21 bp, Homo sapiens
gcccagagagaggcgtcctgg

SEQ ID NO: 364349 - DNA, 22 bp, Homo sapiens
gcccagagatgggactgggagg

SEQ ID NO: 364350 - DNA, 13 bp, Homo sapiens
gcccagagctggg

SEQ ID NO: 364351 - DNA, 16 bp, Homo sapiens
gcccagagctgggtga

SEQ ID NO: 364352 - DNA, 14 bp, Homo sapiens
gcccagaggcacag

SEQ ID NO: 364353 - DNA, 13 bp, Homo sapiens
gcccagagtagcc

SEQ ID NO: 364354 - DNA, 12 bp, Homo sapiens
gcccagcagagc

SEQ ID NO: 364355 - DNA, 13 bp, Homo sapiens
gcccagcagagcc

SEQ ID NO: 364356 - DNA, 21 bp, Homo sapiens
gcccagcagagccgttcctgg

SEQ ID NO: 364357 - DNA, 20 bp, Homo sapiens
gcccagcagcggcccagatt

SEQ ID NO: 364358 - DNA, 21 bp, Homo sapiens
gcccagcagcttggctgagcc

SEQ ID NO: 364359 - DNA, 21 bp, Homo sapiens
gcccagccaaaccctgtctga

SEQ ID NO: 364360 - DNA, 23 bp, Homo sapiens
gcccagccacggacgctggctcc

SEQ ID NO: 364361 - DNA, 11 bp, Homo sapiens
gcccagccagc

SEQ ID NO: 364362 - DNA, 13 bp, Homo sapiens
gcccagccagcag

SEQ ID NO: 364363 - DNA, 15 bp, Homo sapiens
gcccagccagcaggt

SEQ ID NO: 364364 - DNA, 12 bp, Homo sapiens
gcccagcccagc

SEQ ID NO: 364365 - DNA, 18 bp, Homo sapiens
gcccagcccggaccttgg

SEQ ID NO: 364366 - DNA, 16 bp, Homo sapiens
gcccagcccggcaggg

SEQ ID NO: 364367 - DNA, 13 bp, Homo sapiens
gcccagcccggct

SEQ ID NO: 364368 - DNA, 16 bp, Homo sapiens
gcccagcccggctgac

SEQ ID NO: 364369 - DNA, 15 bp, Homo sapiens
gcccagccctcccag

SEQ ID NO: 364370 - DNA, 12 bp, Homo sapiens
gcccagcctctc

SEQ ID NO: 364371 - DNA, 12 bp, Homo sapiens
gcccagcctgga

SEQ ID NO: 364372 - DNA, 16 bp, Homo sapiens
gcccagcctggagccg

SEQ ID NO: 364373 - DNA, 12 bp, Homo sapiens
gcccagcctggc

SEQ ID NO: 364374 - DNA, 20 bp, Homo sapiens
gcccagcctgtcctggtaca

SEQ ID NO: 364375 - DNA, 17 bp, Homo sapiens
gcccagctacattcctc

SEQ ID NO: 364376 - DNA, 15 bp, Homo sapiens
gcccagctcagaggg

SEQ ID NO: 364377 - DNA, 18 bp, Homo sapiens
gcccagctccactcaggg

SEQ ID NO: 364378 - DNA, 10 bp, Homo sapiens
gcccagctct

SEQ ID NO: 364379 - DNA, 12 bp, Homo sapiens
gcccagctgagt

SEQ ID NO: 364380 - DNA, 15 bp, Homo sapiens
gcccagctgctctgc

SEQ ID NO: 364381 - DNA, 16 bp, Homo sapiens
gcccagctgctctgcc

SEQ ID NO: 364382 - DNA, 18 bp, Homo sapiens
gcccagctgctctgccca

SEQ ID NO: 364383 - DNA, 20 bp, Homo sapiens
gcccagctgctctgcccaga

SEQ ID NO: 364384 - DNA, 22 bp, Homo sapiens
gcccagctgctctgcccagagc

SEQ ID NO: 364385 - DNA, 14 bp, Homo sapiens
gcccagctgggctc

SEQ ID NO: 364386 - DNA, 16 bp, Homo sapiens
gcccagctgggctctg

SEQ ID NO: 364387 - DNA, 23 bp, Homo sapiens
gcccagctgggctctgccaccct

SEQ ID NO: 364388 - DNA, 15 bp, Homo sapiens
gcccagctgtagcca

SEQ ID NO: 364389 - DNA, 17 bp, Homo sapiens
gcccagctgtagccatg

SEQ ID NO: 364390 - DNA, 18 bp, Homo sapiens
gcccagctgtagccatgg

SEQ ID NO: 364391 - DNA, 20 bp, Homo sapiens
gcccagctgtagccatggct

SEQ ID NO: 364392 - DNA, 21 bp, Homo sapiens
gcccagctgtagccatggctc

SEQ ID NO: 364393 - DNA, 23 bp, Homo sapiens
gcccagctgtagccatggctcag

SEQ ID NO: 364394 - DNA, 21 bp, Homo sapiens
gcccaggagagcccccaccag

SEQ ID NO: 364395 - DNA, 10 bp, Homo sapiens
gcccaggagg

SEQ ID NO: 364396 - DNA, 15 bp, Homo sapiens
gcccaggagtctgag

SEQ ID NO: 364397 - DNA, 23 bp, Homo sapiens
gcccaggattgtacgtgggagag

SEQ ID NO: 364398 - DNA, 19 bp, Homo sapiens
gcccaggcagcacctggag

SEQ ID NO: 364399 - DNA, 14 bp, Homo sapiens
gcccaggccctaga

SEQ ID NO: 364400 - DNA, 15 bp, Homo sapiens
gcccaggccggccag

SEQ ID NO: 364401 - DNA, 17 bp, Homo sapiens
gcccaggccggccagcc

SEQ ID NO: 364402 - DNA, 19 bp, Homo sapiens
gcccaggccggccagcctc

SEQ ID NO: 364403 - DNA, 21 bp, Homo sapiens
gcccaggccgttccccttggc

SEQ ID NO: 364404 - DNA, 23 bp, Homo sapiens
gcccaggccgttccccttggctt

SEQ ID NO: 364405 - DNA, 10 bp, Homo sapiens
gcccaggcct

SEQ ID NO: 364406 - DNA, 12 bp, Homo sapiens
gcccaggcctgg

SEQ ID NO: 364407 - DNA, 19 bp, Homo sapiens
gcccaggctcccctgcccg

SEQ ID NO: 364408 - DNA, 16 bp, Homo sapiens
gcccaggctctgctga

SEQ ID NO: 364409 - DNA, 17 bp, Homo sapiens
gcccaggctctgctgac

SEQ ID NO: 364410 - DNA, 19 bp, Homo sapiens
gcccaggctggagggcagt

SEQ ID NO: 364411 - DNA, 14 bp, Homo sapiens
gcccaggggtcagc

SEQ ID NO: 364412 - DNA, 14 bp, Homo sapiens
gcccagggtgcagt

SEQ ID NO: 364413 - DNA, 16 bp, Homo sapiens
gcccagggttccccca

SEQ ID NO: 364414 - DNA, 23 bp, Homo sapiens
gcccagggttcccccagccctgt

SEQ ID NO: 364415 - DNA, 21 bp, Homo sapiens
gcccaggtaccacccttcaga

SEQ ID NO: 364416 - DNA, 16 bp, Homo sapiens
gcccaggtcccagtgc

SEQ ID NO: 364417 - DNA, 16 bp, Homo sapiens
gcccagtcattgggtt

SEQ ID NO: 364418 - DNA, 15 bp, Homo sapiens
gcccagtccctggag

SEQ ID NO: 364419 - DNA, 22 bp, Homo sapiens
gcccagtggaacagtcaccctt

SEQ ID NO: 364420 - DNA, 14 bp, Homo sapiens
gcccagttaatctt

SEQ ID NO: 364421 - DNA, 22 bp, Homo sapiens
gcccataatagttagccctcag

SEQ ID NO: 364422 - DNA, 15 bp, Homo sapiens
gcccccgccctctgc

SEQ ID NO: 364423 - DNA, 18 bp, Homo sapiens
gcccccgcgatgccctgg

SEQ ID NO: 364424 - DNA, 16 bp, Homo sapiens
gcccccgcgggttcta

SEQ ID NO: 364425 - DNA, 17 bp, Homo sapiens
gcccccggaggcgccca

SEQ ID NO: 364426 - DNA, 18 bp, Homo sapiens
gcccccggaggcgcccac

SEQ ID NO: 364427 - DNA, 19 bp, Homo sapiens
gcccccggaggcgcccacc

SEQ ID NO: 364428 - DNA, 22 bp, Homo sapiens
gcccccggaggcgcccacctgc

SEQ ID NO: 364429 - DNA, 16 bp, Homo sapiens
gcccccgtcccacctc

SEQ ID NO: 364430 - DNA, 17 bp, Homo sapiens
gcccccgttccagctga

SEQ ID NO: 364431 - DNA, 11 bp, Homo sapiens
gccccctcagg

SEQ ID NO: 364432 - DNA, 15 bp, Homo sapiens
gccccctccacacca

SEQ ID NO: 364433 - DNA, 15 bp, Homo sapiens
gccccctcccccgca

SEQ ID NO: 364434 - DNA, 21 bp, Homo sapiens
gccccctcccccgcagacaga

SEQ ID NO: 364435 - DNA, 15 bp, Homo sapiens
gccccctgcacccac

SEQ ID NO: 364436 - DNA, 17 bp, Homo sapiens
gccccctgcacccaccc

SEQ ID NO: 364437 - DNA, 19 bp, Homo sapiens
gccccctgcacccacccct

SEQ ID NO: 364438 - DNA, 11 bp, Homo sapiens
gccccctgcca

SEQ ID NO: 364439 - DNA, 16 bp, Homo sapiens
gccccctggcccctcc

SEQ ID NO: 364440 - DNA, 20 bp, Homo sapiens
gccccctggcccctcccaca

SEQ ID NO: 364441 - DNA, 21 bp, Homo sapiens
gccccctgtccttcccacggc

SEQ ID NO: 364442 - DNA, 16 bp, Homo sapiens
gccccctgtgcccacc

SEQ ID NO: 364443 - DNA, 18 bp, Homo sapiens
gccccctgtgcccaccca

SEQ ID NO: 364444 - DNA, 22 bp, Homo sapiens
gccccctgtgcccacccagggc

SEQ ID NO: 364445 - DNA, 17 bp, Homo sapiens
gcccccttctcccacac

SEQ ID NO: 364446 - DNA, 19 bp, Homo sapiens
gcccccttctcccacactg

SEQ ID NO: 364447 - DNA, 20 bp, Homo sapiens
gccccgcaaaacccactgac

SEQ ID NO: 364448 - DNA, 14 bp, Homo sapiens
gccccgccccacat

SEQ ID NO: 364449 - DNA, 15 bp, Homo sapiens
gccccgccccacatt

SEQ ID NO: 364450 - DNA, 15 bp, Homo sapiens
gccccgccccagagc

SEQ ID NO: 364451 - DNA, 13 bp, Homo sapiens
gccccgcccccac

SEQ ID NO: 364452 - DNA, 14 bp, Homo sapiens
gccccgcccccacc

SEQ ID NO: 364453 - DNA, 13 bp, Homo sapiens
gccccgccctcag

SEQ ID NO: 364454 - DNA, 20 bp, Homo sapiens
gccccgcgcgtgcccccagc

SEQ ID NO: 364455 - DNA, 13 bp, Homo sapiens
gccccgctcaggt

SEQ ID NO: 364456 - DNA, 21 bp, Homo sapiens
gccccgctcaggtagccacca

SEQ ID NO: 364457 - DNA, 13 bp, Homo sapiens
gccccgctgggat

SEQ ID NO: 364458 - DNA, 23 bp, Homo sapiens
gccccgctgggatttcttcgctg

SEQ ID NO: 364459 - DNA, 14 bp, Homo sapiens
gccccggagcacca

SEQ ID NO: 364460 - DNA, 13 bp, Homo sapiens
gccccggccactc

SEQ ID NO: 364461 - DNA, 15 bp, Homo sapiens
gccccggccactccc

SEQ ID NO: 364462 - DNA, 19 bp, Homo sapiens
gccccggccactccctgcc

SEQ ID NO: 364463 - DNA, 20 bp, Homo sapiens
gccccggccactccctgcca

SEQ ID NO: 364464 - DNA, 17 bp, Homo sapiens
gccccgggctctggcca

SEQ ID NO: 364465 - DNA, 18 bp, Homo sapiens
gccccgggctctggccac

SEQ ID NO: 364466 - DNA, 21 bp, Homo sapiens
gccccggggactcgcagcacc

SEQ ID NO: 364467 - DNA, 13 bp, Homo sapiens
gccccggggctgg

SEQ ID NO: 364468 - DNA, 16 bp, Homo sapiens
gccccggggctggcaa

SEQ ID NO: 364469 - DNA, 17 bp, Homo sapiens
gccccggggctggcaag

SEQ ID NO: 364470 - DNA, 18 bp, Homo sapiens
gccccgtcaccatctcag

SEQ ID NO: 364471 - DNA, 20 bp, Homo sapiens
gccccgtcccctgggccacc

SEQ ID NO: 364472 - DNA, 21 bp, Homo sapiens
gccccgtcccctgggccaccc

SEQ ID NO: 364473 - DNA, 15 bp, Homo sapiens
gccccgtgcagactg

SEQ ID NO: 364474 - DNA, 20 bp, Homo sapiens
gccccgtgcagactggaggg

SEQ ID NO: 364475 - DNA, 21 bp, Homo sapiens
gccccgtgtccccccaggtgc

SEQ ID NO: 364476 - DNA, 18 bp, Homo sapiens
gccccgtgtctggatgca

SEQ ID NO: 364477 - DNA, 18 bp, Homo sapiens
gccccgttccctgtcaga

SEQ ID NO: 364478 - DNA, 16 bp, Homo sapiens
gcccctaccccacacc

SEQ ID NO: 364479 - DNA, 17 bp, Homo sapiens
gcccctagaatcagcct

SEQ ID NO: 364480 - DNA, 20 bp, Homo sapiens
gcccctagaatcagcctagg

SEQ ID NO: 364481 - DNA, 20 bp, Homo sapiens
gcccctatcctgcaccctct

SEQ ID NO: 364482 - DNA, 18 bp, Homo sapiens
gcccctcaccctgcctta

SEQ ID NO: 364483 - DNA, 22 bp, Homo sapiens
gcccctcacctcaggaccccag

SEQ ID NO: 364484 - DNA, 17 bp, Homo sapiens
gcccctcacctgggcct

SEQ ID NO: 364485 - DNA, 16 bp, Homo sapiens
gcccctcagcccttgc

SEQ ID NO: 364486 - DNA, 18 bp, Homo sapiens
gcccctcagcccttgccc

SEQ ID NO: 364487 - DNA, 20 bp, Homo sapiens
gcccctcatttatcactctg

SEQ ID NO: 364488 - DNA, 20 bp, Homo sapiens
gcccctccagaccctgcctg

SEQ ID NO: 364489 - DNA, 20 bp, Homo sapiens
gcccctccaggaacattccc

SEQ ID NO: 364490 - DNA, 14 bp, Homo sapiens
gcccctcccaagcg

SEQ ID NO: 364491 - DNA, 18 bp, Homo sapiens
gcccctcccacatccccc

SEQ ID NO: 364492 - DNA, 13 bp, Homo sapiens
gcccctcccacca

SEQ ID NO: 364493 - DNA, 14 bp, Homo sapiens
gcccctcccaccac

SEQ ID NO: 364494 - DNA, 16 bp, Homo sapiens
gcccctcccaccacag

SEQ ID NO: 364495 - DNA, 17 bp, Homo sapiens
gcccctccccacccctg

SEQ ID NO: 364496 - DNA, 20 bp, Homo sapiens
gcccctccccacccctgcct

SEQ ID NO: 364497 - DNA, 12 bp, Homo sapiens
gcccctccccag

SEQ ID NO: 364498 - DNA, 13 bp, Homo sapiens
gcccctccccagc

SEQ ID NO: 364499 - DNA, 17 bp, Homo sapiens
gcccctccccatggtgc

SEQ ID NO: 364500 - DNA, 21 bp, Homo sapiens
gcccctcccccaacccccacc

SEQ ID NO: 364501 - DNA, 17 bp, Homo sapiens
gcccctccctacctcaa

SEQ ID NO: 364502 - DNA, 18 bp, Homo sapiens
gcccctccctacctcaac

SEQ ID NO: 364503 - DNA, 21 bp, Homo sapiens
gcccctccctacctcaacctg

SEQ ID NO: 364504 - DNA, 21 bp, Homo sapiens
gcccctccctctgccccaagc

SEQ ID NO: 364505 - DNA, 16 bp, Homo sapiens
gcccctccgtccccag

SEQ ID NO: 364506 - DNA, 23 bp, Homo sapiens
gcccctcctctcctcgtccggcc

SEQ ID NO: 364507 - DNA, 16 bp, Homo sapiens
gcccctcctctgagca

SEQ ID NO: 364508 - DNA, 15 bp, Homo sapiens
gcccctcctctgtgc

SEQ ID NO: 364509 - DNA, 22 bp, Homo sapiens
gcccctcctctgtgctccctcg

SEQ ID NO: 364510 - DNA, 17 bp, Homo sapiens
gcccctccttctcccct

SEQ ID NO: 364511 - DNA, 15 bp, Homo sapiens
gcccctcgctgctgc

SEQ ID NO: 364512 - DNA, 15 bp, Homo sapiens
gcccctcggctaccc

SEQ ID NO: 364513 - DNA, 17 bp, Homo sapiens
gcccctcggctaccccc

SEQ ID NO: 364514 - DNA, 21 bp, Homo sapiens
gcccctctcccgccagactgt

SEQ ID NO: 364515 - DNA, 11 bp, Homo sapiens
gcccctctgcc

SEQ ID NO: 364516 - DNA, 16 bp, Homo sapiens
gcccctctgcccagct

SEQ ID NO: 364517 - DNA, 14 bp, Homo sapiens
gcccctctgttctg

SEQ ID NO: 364518 - DNA, 20 bp, Homo sapiens
gcccctctgttctggtggcc

SEQ ID NO: 364519 - DNA, 19 bp, Homo sapiens
gcccctgaggactggagac

SEQ ID NO: 364520 - DNA, 18 bp, Homo sapiens
gcccctgcaggggagggt

SEQ ID NO: 364521 - DNA, 23 bp, Homo sapiens
gcccctgccacctcctgcctcag

SEQ ID NO: 364522 - DNA, 18 bp, Homo sapiens
gcccctgccccggaggaa

SEQ ID NO: 364523 - DNA, 19 bp, Homo sapiens
gcccctgcccctgcccctg

SEQ ID NO: 364524 - DNA, 15 bp, Homo sapiens
gcccctgctgcctcc

SEQ ID NO: 364525 - DNA, 17 bp, Homo sapiens
gcccctgctgcctcccc

SEQ ID NO: 364526 - DNA, 18 bp, Homo sapiens
gcccctggagctcctgct

SEQ ID NO: 364527 - DNA, 13 bp, Homo sapiens
gcccctggcacgt

SEQ ID NO: 364528 - DNA, 22 bp, Homo sapiens
gcccctggcacgtcctccaccg

SEQ ID NO: 364529 - DNA, 23 bp, Homo sapiens
gcccctggcacgtcctccaccgg

SEQ ID NO: 364530 - DNA, 19 bp, Homo sapiens
gcccctggcccagcggccc

SEQ ID NO: 364531 - DNA, 23 bp, Homo sapiens
gcccctggcccagcggcccctcc

SEQ ID NO: 364532 - DNA, 21 bp, Homo sapiens
gcccctgtctaacctacgacc

SEQ ID NO: 364533 - DNA, 18 bp, Homo sapiens
gcccctgtgtcggggggc

SEQ ID NO: 364534 - DNA, 17 bp, Homo sapiens
gcccctgtgttgggggg

SEQ ID NO: 364535 - DNA, 22 bp, Homo sapiens
gcccctgtgttggggggcaagg

SEQ ID NO: 364536 - DNA, 21 bp, Homo sapiens
gccccttcacttctgaccaca

SEQ ID NO: 364537 - DNA, 10 bp, Homo sapiens
gccccttcca

SEQ ID NO: 364538 - DNA, 15 bp, Homo sapiens
gccccttcccatctc

SEQ ID NO: 364539 - DNA, 14 bp, Homo sapiens
gccccttccccaag

SEQ ID NO: 364540 - DNA, 22 bp, Homo sapiens
gccccttctacactctcctggg

SEQ ID NO: 364541 - DNA, 23 bp, Homo sapiens
gccccttctacactctcctgggc

SEQ ID NO: 364542 - DNA, 22 bp, Homo sapiens
gccccttcttgggccccagacc

SEQ ID NO: 364543 - DNA, 14 bp, Homo sapiens
gccccttgacccca

SEQ ID NO: 364544 - DNA, 14 bp, Homo sapiens
gccccttgcttctc

SEQ ID NO: 364545 - DNA, 14 bp, Homo sapiens
gccccttggccctc

SEQ ID NO: 364546 - DNA, 21 bp, Homo sapiens
gccccttgggcatccacccag

SEQ ID NO: 364547 - DNA, 23 bp, Homo sapiens
gccccttgggcatccacccagtg

SEQ ID NO: 364548 - DNA, 16 bp, Homo sapiens
gcccctttttactccc

SEQ ID NO: 364549 - DNA, 21 bp, Homo sapiens
gcccgaatttctcactccctt

SEQ ID NO: 364550 - DNA, 14 bp, Homo sapiens
gcccgaccccatct

SEQ ID NO: 364551 - DNA, 13 bp, Homo sapiens
gcccgacttgctg

SEQ ID NO: 364552 - DNA, 18 bp, Homo sapiens
gccctgccaagcctggag

SEQ ID NO: 364553 - DNA, 22 bp, Homo sapiens
gccctgccaagcctggagcccc

SEQ ID NO: 364554 - DNA, 15 bp, Homo sapiens
gccctgccacctgtc

SEQ ID NO: 364555 - DNA, 12 bp, Homo sapiens
gccctgccaggc

SEQ ID NO: 364556 - DNA, 12 bp, Homo sapiens
gccctgccatta

SEQ ID NO: 364557 - DNA, 19 bp, Homo sapiens
gccctgccccacacaggcc

SEQ ID NO: 364558 - DNA, 21 bp, Homo sapiens
gccctgcccccatctccccag

SEQ ID NO: 364559 - DNA, 15 bp, Homo sapiens
gccctgccctcactc

SEQ ID NO: 364560 - DNA, 17 bp, Homo sapiens
gccctgccctcactcca

SEQ ID NO: 364561 - DNA, 18 bp, Homo sapiens
gccctgccctcactccac

SEQ ID NO: 364562 - DNA, 21 bp, Homo sapiens
gccctgccctcactccactcc

SEQ ID NO: 364563 - DNA, 14 bp, Homo sapiens
gccctgccctcccc

SEQ ID NO: 364564 - DNA, 17 bp, Homo sapiens
gccctgccctcccccac

SEQ ID NO: 364565 - DNA, 15 bp, Homo sapiens
gccctgccctgagga

SEQ ID NO: 364566 - DNA, 20 bp, Homo sapiens
gccctgccctgaggaaggag

SEQ ID NO: 364567 - DNA, 20 bp, Homo sapiens
gccctgcccttcagcatcct

SEQ ID NO: 364568 - DNA, 22 bp, Homo sapiens
gccctgcctccaccgagccagc

SEQ ID NO: 364569 - DNA, 16 bp, Homo sapiens
gccctgcctccctttc

SEQ ID NO: 364570 - DNA, 15 bp, Homo sapiens
gccctgcctgagggc

SEQ ID NO: 364571 - DNA, 23 bp, Homo sapiens
gccctgcctgagggcccctctgc

SEQ ID NO: 364572 - DNA, 12 bp, Homo sapiens
gccctgcctgcc

SEQ ID NO: 364573 - DNA, 13 bp, Homo sapiens
gccctgcctgccc

SEQ ID NO: 364574 - DNA, 19 bp, Homo sapiens
gccctgccttgtccctctc

SEQ ID NO: 364575 - DNA, 18 bp, Homo sapiens
gccctgcgttggagccac

SEQ ID NO: 364576 - DNA, 13 bp, Homo sapiens
gccctgctcaggc

SEQ ID NO: 364577 - DNA, 21 bp, Homo sapiens
gccctgctgccgcctcccagc

SEQ ID NO: 364578 - DNA, 23 bp, Homo sapiens
gccctgctgccgcctcccagcct

SEQ ID NO: 364579 - DNA, 23 bp, Homo sapiens
gccctgctgtcagaccttcttcc

SEQ ID NO: 364580 - DNA, 18 bp, Homo sapiens
gccctgctttgggctgcc

SEQ ID NO: 364581 - DNA, 19 bp, Homo sapiens
gccctgctttgggctgccc

SEQ ID NO: 364582 - DNA, 23 bp, Homo sapiens
gccctgctttgggctgccctggt

SEQ ID NO: 364583 - DNA, 20 bp, Homo sapiens
gccctggaagccggcggccc

SEQ ID NO: 364584 - DNA, 13 bp, Homo sapiens
gccctggctccca

SEQ ID NO: 364585 - DNA, 19 bp, Homo sapiens
gccctggctcccaagggag

SEQ ID NO: 364586 - DNA, 20 bp, Homo sapiens
gccctggctcccacaggccc

SEQ ID NO: 364587 - DNA, 15 bp, Homo sapiens
gccctggctgggttc

SEQ ID NO: 364588 - DNA, 19 bp, Homo sapiens
gccctgggcacccacctcc

SEQ ID NO: 364589 - DNA, 15 bp, Homo sapiens
gccctgggctctggg

SEQ ID NO: 364590 - DNA, 17 bp, Homo sapiens
gccctgggctctgggtt

SEQ ID NO: 364591 - DNA, 18 bp, Homo sapiens
gccctgggctggactgga

SEQ ID NO: 364592 - DNA, 16 bp, Homo sapiens
gccctggggaagaggc

SEQ ID NO: 364593 - DNA, 19 bp, Homo sapiens
gccctggggaagaggcctt

SEQ ID NO: 364594 - DNA, 21 bp, Homo sapiens
gccctggggaagaggccttgg

SEQ ID NO: 364595 - DNA, 23 bp, Homo sapiens
gccctggggaagaggccttgggg

SEQ ID NO: 364596 - DNA, 16 bp, Homo sapiens
gccctggggtccccac

SEQ ID NO: 364597 - DNA, 17 bp, Homo sapiens
gccctggggtccccact

SEQ ID NO: 364598 - DNA, 22 bp, Homo sapiens
gccctggggtccccactccctg

SEQ ID NO: 364599 - DNA, 18 bp, Homo sapiens
gccctggggtctctgagc

SEQ ID NO: 364600 - DNA, 22 bp, Homo sapiens
gccctggggtttccacacaggc

SEQ ID NO: 364601 - DNA, 14 bp, Homo sapiens
gccctggtccaggg

SEQ ID NO: 364602 - DNA, 17 bp, Homo sapiens
gccctggtccagggaag

SEQ ID NO: 364603 - DNA, 23 bp, Homo sapiens
gccctggtccagggaagctggcc

SEQ ID NO: 364604 - DNA, 23 bp, Homo sapiens
gccctggtggagaggcctccctg

SEQ ID NO: 364605 - DNA, 21 bp, Homo sapiens
gccctggttcccccaggaccc

SEQ ID NO: 364606 - DNA, 19 bp, Homo sapiens
gccctggttctccatcccc

SEQ ID NO: 364607 - DNA, 21 bp, Homo sapiens
gccctggttctccatccccat

SEQ ID NO: 364608 - DNA, 16 bp, Homo sapiens
gccctggtttcactgg

SEQ ID NO: 364609 - DNA, 22 bp, Homo sapiens
gccctggtttcactggcccaag

SEQ ID NO: 364610 - DNA, 22 bp, Homo sapiens
gccctgtatcaacccagaaaca

SEQ ID NO: 364611 - DNA, 18 bp, Homo sapiens
gccctgtcagagccgcca

SEQ ID NO: 364612 - DNA, 14 bp, Homo sapiens
gccctgtcagtgca

SEQ ID NO: 364613 - DNA, 15 bp, Homo sapiens
gccctgtcagtgcag

SEQ ID NO: 364614 - DNA, 16 bp, Homo sapiens
gccctgtcgagacact

SEQ ID NO: 364615 - DNA, 23 bp, Homo sapiens
gccctgtgggagtccactttcct

SEQ ID NO: 364616 - DNA, 15 bp, Homo sapiens
gccctgttgtggggg

SEQ ID NO: 364617 - DNA, 17 bp, Homo sapiens
gcccttaaaataatgat

SEQ ID NO: 364618 - DNA, 16 bp, Homo sapiens
gcccttagccttgctg

SEQ ID NO: 364619 - DNA, 15 bp, Homo sapiens
gcccttcactgccat

SEQ ID NO: 364620 - DNA, 17 bp, Homo sapiens
gcccttcactgccatga

SEQ ID NO: 364621 - DNA, 14 bp, Homo sapiens
gcccttcagtccct

SEQ ID NO: 364622 - DNA, 12 bp, Homo sapiens
gcccttccagtg

SEQ ID NO: 364623 - DNA, 14 bp, Homo sapiens
gcccttcccaggcc

SEQ ID NO: 364624 - DNA, 17 bp, Homo sapiens
gcccttcccaggccagc

SEQ ID NO: 364625 - DNA, 18 bp, Homo sapiens
gcccttcccaggccagcg

SEQ ID NO: 364626 - DNA, 13 bp, Homo sapiens
gcccttccctgct

SEQ ID NO: 364627 - DNA, 21 bp, Homo sapiens
gcccttcctcctgaagcctct

SEQ ID NO: 364628 - DNA, 23 bp, Homo sapiens
gcccttcctcctgaagcctctgc

SEQ ID NO: 364629 - DNA, 21 bp, Homo sapiens
gcccttcctctccactgcctt

SEQ ID NO: 364630 - DNA, 19 bp, Homo sapiens
gcccttcctggactggccc

SEQ ID NO: 364631 - DNA, 20 bp, Homo sapiens
gcccttgcaatcttctactt

SEQ ID NO: 364632 - DNA, 14 bp, Homo sapiens
gcccttgcacaggc

SEQ ID NO: 364633 - DNA, 16 bp, Homo sapiens
gcccttgcacaggcca

SEQ ID NO: 364634 - DNA, 21 bp, Homo sapiens
gcccttgcagttcagcaccac

SEQ ID NO: 364635 - DNA, 21 bp, Homo sapiens
gcccttgcccaactcccagcc

SEQ ID NO: 364636 - DNA, 13 bp, Homo sapiens
gcccttgccccca

SEQ ID NO: 364637 - DNA, 20 bp, Homo sapiens
gcccttgcccccatccctcg

SEQ ID NO: 364638 - DNA, 18 bp, Homo sapiens
gcccttgggacagccaga

SEQ ID NO: 364639 - DNA, 23 bp, Homo sapiens
gcccttgggacagccagagctgg

SEQ ID NO: 364640 - DNA, 19 bp, Homo sapiens
gcccttggggcctggcttg

SEQ ID NO: 364641 - DNA, 13 bp, Homo sapiens
gcccttgtcctgc

SEQ ID NO: 364642 - DNA, 14 bp, Homo sapiens
gcccttgtcctgcc

SEQ ID NO: 364643 - DNA, 19 bp, Homo sapiens
gcccttgtcctgccagctg

SEQ ID NO: 364644 - DNA, 21 bp, Homo sapiens
gcccttgtcctgccagctgcc

SEQ ID NO: 364645 - DNA, 12 bp, Homo sapiens
gccctttccagg

SEQ ID NO: 364646 - DNA, 13 bp, Homo sapiens
gccctttccccac

SEQ ID NO: 364647 - DNA, 16 bp, Homo sapiens
gccctttctgtaccat

SEQ ID NO: 364648 - DNA, 22 bp, Homo sapiens
gccctttctgtaccatttattt

SEQ ID NO: 364649 - DNA, 13 bp, Homo sapiens
gccctttgcctgt

SEQ ID NO: 364650 - DNA, 24 bp, Homo sapiens
gccctttggagaacgccagtctcc

SEQ ID NO: 364651 - DNA, 20 bp, Homo sapiens
gcccttttacagctcttggc

SEQ ID NO: 364652 - DNA, 18 bp, Homo sapiens
gcccttttagtggtggtg

SEQ ID NO: 364653 - DNA, 16 bp, Homo sapiens
gcccttttctggctcc

SEQ ID NO: 364654 - DNA, 18 bp, Homo sapiens
gcccttttctggctcctg

SEQ ID NO: 364655 - DNA, 19 bp, Homo sapiens
gccgaaccccccactccct

SEQ ID NO: 364656 - DNA, 15 bp, Homo sapiens
gccgaatgccctcag

SEQ ID NO: 364657 - DNA, 16 bp, Homo sapiens
gccgagaccgcagagg

SEQ ID NO: 364658 - DNA, 18 bp, Homo sapiens
gccgagaccgcagaggga

SEQ ID NO: 364659 - DNA, 19 bp, Homo sapiens
gccgagccgggcctggggc

SEQ ID NO: 364660 - DNA, 20 bp, Homo sapiens
gccgagctctcctgggccag

SEQ ID NO: 364661 - DNA, 13 bp, Homo sapiens
gccgagggaaatg

SEQ ID NO: 364662 - DNA, 20 bp, Homo sapiens
gccgagggtcctggctcctg

SEQ ID NO: 364663 - DNA, 12 bp, Homo sapiens
gccgagtccagg

SEQ ID NO: 364664 - DNA, 21 bp, Homo sapiens
gccgagtccaggagccccagc

SEQ ID NO: 364665 - DNA, 14 bp, Homo sapiens
gccgagtgccccag

SEQ ID NO: 364666 - DNA, 18 bp, Homo sapiens
gccgatgggagtctccct

SEQ ID NO: 364667 - DNA, 22 bp, Homo sapiens
gccgcaaatccataccccctgc

SEQ ID NO: 364668 - DNA, 20 bp, Homo sapiens
gccgcacctaaagcagccag

SEQ ID NO: 364669 - DNA, 23 bp, Homo sapiens
gccgcagggcgctccggcagagg

SEQ ID NO: 364670 - DNA, 20 bp, Homo sapiens
gccgcatggcccctccagga

SEQ ID NO: 364671 - DNA, 21 bp, Homo sapiens
gccgccactaggtgtccccaa

SEQ ID NO: 364672 - DNA, 21 bp, Homo sapiens
gccgccattgccaccaggaga

SEQ ID NO: 364673 - DNA, 19 bp, Homo sapiens
gccgccccgccccagagct

SEQ ID NO: 364674 - DNA, 22 bp, Homo sapiens
gccgccccgccccagagctccg

SEQ ID NO: 364675 - DNA, 24 bp, Homo sapiens
gccgccccgtgtccccccaggtgc

SEQ ID NO: 364676 - DNA, 18 bp, Homo sapiens
gccgccgtctctgtcccg

SEQ ID NO: 364677 - DNA, 14 bp, Homo sapiens
gccgcctagtgcag

SEQ ID NO: 364678 - DNA, 18 bp, Homo sapiens
gccgcctagtgcagagag

SEQ ID NO: 364679 - DNA, 12 bp, Homo sapiens
gccgcctcccag

SEQ ID NO: 364680 - DNA, 17 bp, Homo sapiens
gccgcctcccagcctgg

SEQ ID NO: 364681 - DNA, 22 bp, Homo sapiens
gcctctgtcctggctgtgcaca

SEQ ID NO: 364682 - DNA, 13 bp, Homo sapiens
gcctcttaaaaat

SEQ ID NO: 364683 - DNA, 19 bp, Homo sapiens
gcctcttaaagctgcctgt

SEQ ID NO: 364684 - DNA, 14 bp, Homo sapiens
gcctcttagtgatt

SEQ ID NO: 364685 - DNA, 16 bp, Homo sapiens
gcctcttagtgattgt

SEQ ID NO: 364686 - DNA, 20 bp, Homo sapiens
gcctcttagtgattgtgtct

SEQ ID NO: 364687 - DNA, 15 bp, Homo sapiens
gcctcttgctggtgc

SEQ ID NO: 364688 - DNA, 16 bp, Homo sapiens
gcctcttgtacagtta

SEQ ID NO: 364689 - DNA, 16 bp, Homo sapiens
gcctcttgtgctcacg

SEQ ID NO: 364690 - DNA, 17 bp, Homo sapiens
gcctcttgtgctcacgc

SEQ ID NO: 364691 - DNA, 22 bp, Homo sapiens
gcctcttgtgctcacgctcccc

SEQ ID NO: 364692 - DNA, 18 bp, Homo sapiens
gcctcttttccctctcta

SEQ ID NO: 364693 - DNA, 18 bp, Homo sapiens
gcctcttttctctgtgct

SEQ ID NO: 364694 - DNA, 13 bp, Homo sapiens
gcctgaaacagcc

SEQ ID NO: 364695 - DNA, 16 bp, Homo sapiens
gcctgaaagaggctga

SEQ ID NO: 364696 - DNA, 13 bp, Homo sapiens
gcctgaaagcaac

SEQ ID NO: 364697 - DNA, 20 bp, Homo sapiens
gcctgacaaccactggtctg

SEQ ID NO: 364698 - DNA, 21 bp, Homo sapiens
gcctgaccatcccatgagcag

SEQ ID NO: 364699 - DNA, 15 bp, Homo sapiens
gcctgaccccttgct

SEQ ID NO: 364700 - DNA, 16 bp, Homo sapiens
gcctgacctggcacag

SEQ ID NO: 364701 - DNA, 13 bp, Homo sapiens
gcctgagaagagt

SEQ ID NO: 364702 - DNA, 17 bp, Homo sapiens
gcctgagagcagaatga

SEQ ID NO: 364703 - DNA, 22 bp, Homo sapiens
gcctgagatgtaggctccacct

SEQ ID NO: 364704 - DNA, 22 bp, Homo sapiens
gcctgagccacagtggggccca

SEQ ID NO: 364705 - DNA, 15 bp, Homo sapiens
gcctgagctccaccc

SEQ ID NO: 364706 - DNA, 23 bp, Homo sapiens
gcctgagctccaccctcccctct

SEQ ID NO: 364707 - DNA, 16 bp, Homo sapiens
gcctgagctggggcca

SEQ ID NO: 364708 - DNA, 17 bp, Homo sapiens
gcctgaggatgagctgg

SEQ ID NO: 364709 - DNA, 20 bp, Homo sapiens
gcctgaggatgagctggaag

SEQ ID NO: 364710 - DNA, 17 bp, Homo sapiens
gcctgaggcaggagaat

SEQ ID NO: 364711 - DNA, 13 bp, Homo sapiens
gcctgagggaagc

SEQ ID NO: 364712 - DNA, 15 bp, Homo sapiens
gcctgagggcccctc

SEQ ID NO: 364713 - DNA, 20 bp, Homo sapiens
gcctgagggcccctctgccc

SEQ ID NO: 364714 - DNA, 21 bp, Homo sapiens
gcctgagggcccctctgccca

SEQ ID NO: 364715 - DNA, 23 bp, Homo sapiens
gcctgagggcgaggggagggtgg

SEQ ID NO: 364716 - DNA, 17 bp, Homo sapiens
gcctgagggtggagact

SEQ ID NO: 364717 - DNA, 19 bp, Homo sapiens
gcctgagtcagggcccaga

SEQ ID NO: 364718 - DNA, 13 bp, Homo sapiens
gcctgagtctcct

SEQ ID NO: 364719 - DNA, 13 bp, Homo sapiens
gcctgagtggtga

SEQ ID NO: 364720 - DNA, 23 bp, Homo sapiens
gcctgagtggtgaggggccactg

SEQ ID NO: 364721 - DNA, 19 bp, Homo sapiens
gcctgatggccaagggggt

SEQ ID NO: 364722 - DNA, 20 bp, Homo sapiens
gcctgattggggcctcaccc

SEQ ID NO: 364723 - DNA, 22 bp, Homo sapiens
gcctgattggggcctcacccag

SEQ ID NO: 364724 - DNA, 21 bp, Homo sapiens
gcctgcaaactcactgctcaa

SEQ ID NO: 364725 - DNA, 18 bp, Homo sapiens
gcctgcacacacctgcct

SEQ ID NO: 364726 - DNA, 15 bp, Homo sapiens
gcctgcaccaggaga

SEQ ID NO: 364727 - DNA, 13 bp, Homo sapiens
gcctgcagcatct

SEQ ID NO: 364728 - DNA, 12 bp, Homo sapiens
gcctgcaggccc

SEQ ID NO: 364729 - DNA, 21 bp, Homo sapiens
gcctgcagggtggtgctggga

SEQ ID NO: 364730 - DNA, 23 bp, Homo sapiens
gcctgcagggtggtgctgggact

SEQ ID NO: 364731 - DNA, 20 bp, Homo sapiens
gcctgccaatgccacagcca

SEQ ID NO: 364732 - DNA, 20 bp, Homo sapiens
gcctgccactctctgggact

SEQ ID NO: 364733 - DNA, 21 bp, Homo sapiens
gcctgccactctctgggactc

SEQ ID NO: 364734 - DNA, 17 bp, Homo sapiens
gcctgcccaatgctttg

SEQ ID NO: 364735 - DNA, 12 bp, Homo sapiens
gcctgcccccct

SEQ ID NO: 364736 - DNA, 15 bp, Homo sapiens
gcctgccccccttcc

SEQ ID NO: 364737 - DNA, 16 bp, Homo sapiens
gcctgccccccttccc

SEQ ID NO: 364738 - DNA, 17 bp, Homo sapiens
gcctgcccgcacagcag

SEQ ID NO: 364739 - DNA, 21 bp, Homo sapiens
gcctgcccgcacagcagcctg

SEQ ID NO: 364740 - DNA, 22 bp, Homo sapiens
gcctgccctccccagagcactg

SEQ ID NO: 364741 - DNA, 17 bp, Homo sapiens
gcctgccgcccaaagag

SEQ ID NO: 364742 - DNA, 18 bp, Homo sapiens
gcctgccggccgcccaga

SEQ ID NO: 364743 - DNA, 16 bp, Homo sapiens
gcctgccgtgcatggc

SEQ ID NO: 364744 - DNA, 22 bp, Homo sapiens
gcctgccgtgcatggctcctgt

SEQ ID NO: 364745 - DNA, 17 bp, Homo sapiens
gcctgcctagcactcac

SEQ ID NO: 364746 - DNA, 21 bp, Homo sapiens
gcctgcctagcactcacatgc

SEQ ID NO: 364747 - DNA, 18 bp, Homo sapiens
gcctgcctcatgctctct

SEQ ID NO: 364748 - DNA, 20 bp, Homo sapiens
gcctgcctccggccctgccc

SEQ ID NO: 364749 - DNA, 22 bp, Homo sapiens
gcctgcctccggccctgcccca

SEQ ID NO: 364750 - DNA, 13 bp, Homo sapiens
gcctgcctgtctg

SEQ ID NO: 364751 - DNA, 17 bp, Homo sapiens
gcctgcctgttcccatt

SEQ ID NO: 364752 - DNA, 13 bp, Homo sapiens
gcctgcgcctgca

SEQ ID NO: 364753 - DNA, 14 bp, Homo sapiens
gcctgcgctcctct

SEQ ID NO: 364754 - DNA, 18 bp, Homo sapiens
gcctgcgctcctctgcag

SEQ ID NO: 364755 - DNA, 19 bp, Homo sapiens
gcctgcgctcctctgcagc

SEQ ID NO: 364756 - DNA, 17 bp, Homo sapiens
gcctgcggctgctggca

SEQ ID NO: 364757 - DNA, 22 bp, Homo sapiens
gcctgcggctgctggcacagac

SEQ ID NO: 364758 - DNA, 18 bp, Homo sapiens
gcctgcgtggcctggggc

SEQ ID NO: 364759 - DNA, 23 bp, Homo sapiens
gcctgcgtggcctggggctgccg

SEQ ID NO: 364760 - DNA, 17 bp, Homo sapiens
gcctgctaaggctcctc

SEQ ID NO: 364761 - DNA, 13 bp, Homo sapiens
gcctgctcccagc

SEQ ID NO: 364762 - DNA, 17 bp, Homo sapiens
gcctgctcccagcagcc

SEQ ID NO: 364763 - DNA, 21 bp, Homo sapiens
gcctgctctccttgccctggg

SEQ ID NO: 364764 - DNA, 22 bp, Homo sapiens
gcctgctctccttgccctgggc

SEQ ID NO: 364765 - DNA, 14 bp, Homo sapiens
gcctgctctgcagc

SEQ ID NO: 364766 - DNA, 16 bp, Homo sapiens
gcctgctctgcagccc

SEQ ID NO: 364767 - DNA, 13 bp, Homo sapiens
gcctgctgagagc

SEQ ID NO: 364768 - DNA, 15 bp, Homo sapiens
gcctgctgagagccc

SEQ ID NO: 364769 - DNA, 11 bp, Homo sapiens
gcctgctgcat

SEQ ID NO: 364770 - DNA, 17 bp, Homo sapiens
gcctgctgcgtcagacc

SEQ ID NO: 364771 - DNA, 20 bp, Homo sapiens
gcctgctgggaaccccgcag

SEQ ID NO: 364772 - DNA, 18 bp, Homo sapiens
gcctgcttcacacccctc

SEQ ID NO: 364773 - DNA, 20 bp, Homo sapiens
gcctgcttcacacccctcag

SEQ ID NO: 364774 - DNA, 16 bp, Homo sapiens
gcctgcttttccagga

SEQ ID NO: 364775 - DNA, 17 bp, Homo sapiens
gcctgcttttccaggat

SEQ ID NO: 364776 - DNA, 18 bp, Homo sapiens
gcctggacctgcctcctg

SEQ ID NO: 364777 - DNA, 18 bp, Homo sapiens
gcctggactttcctgcaa

SEQ ID NO: 364778 - DNA, 12 bp, Homo sapiens
gcctggagaaag

SEQ ID NO: 364779 - DNA, 13 bp, Homo sapiens
gcctggagaaagg

SEQ ID NO: 364780 - DNA, 14 bp, Homo sapiens
gcctggagaaagga

SEQ ID NO: 364781 - DNA, 14 bp, Homo sapiens
gcctggagcccctg

SEQ ID NO: 364782 - DNA, 16 bp, Homo sapiens
gcctggagcccctgtg

SEQ ID NO: 364783 - DNA, 17 bp, Homo sapiens
gcctggagcccctgtgt

SEQ ID NO: 364784 - DNA, 18 bp, Homo sapiens
gcctggagcccctgtgtt

SEQ ID NO: 364785 - DNA, 14 bp, Homo sapiens
gcctggagctcctg

SEQ ID NO: 364786 - DNA, 22 bp, Homo sapiens
gcctggaggccgggtgctcagg

SEQ ID NO: 364787 - DNA, 21 bp, Homo sapiens
gcctggatgggggtgcaggca

SEQ ID NO: 364788 - DNA, 15 bp, Homo sapiens
gcctggcaaggcctc

SEQ ID NO: 364789 - DNA, 19 bp, Homo sapiens
gcctggcacagggcagtgg

SEQ ID NO: 364790 - DNA, 13 bp, Homo sapiens
gcctggcagaact

SEQ ID NO: 364791 - DNA, 19 bp, Homo sapiens
gcctggcagaactgagctc

SEQ ID NO: 364792 - DNA, 22 bp, Homo sapiens
gcctggcagccgtgccttcagc

SEQ ID NO: 364793 - DNA, 19 bp, Homo sapiens
gcctggccacctctctcct

SEQ ID NO: 364794 - DNA, 15 bp, Homo sapiens
gcctggccacgcagc

SEQ ID NO: 364795 - DNA, 17 bp, Homo sapiens
gcctggccacgcagcca

SEQ ID NO: 364796 - DNA, 20 bp, Homo sapiens
gcctggccacgcagccagga

SEQ ID NO: 364797 - DNA, 15 bp, Homo sapiens
gcctggccaggagct

SEQ ID NO: 364798 - DNA, 17 bp, Homo sapiens
gcctggccaggcagatc

SEQ ID NO: 364799 - DNA, 14 bp, Homo sapiens
gcctggcccagcca

SEQ ID NO: 364800 - DNA, 19 bp, Homo sapiens
gcctggcccagccagcagg

SEQ ID NO: 364801 - DNA, 17 bp, Homo sapiens
gcctggcccccctccag

SEQ ID NO: 364802 - DNA, 19 bp, Homo sapiens
gcctggcccccctccaggc

SEQ ID NO: 364803 - DNA, 19 bp, Homo sapiens
gcctggccctgccctgagg

SEQ ID NO: 364804 - DNA, 17 bp, Homo sapiens
gcctggcctcccctgcg

SEQ ID NO: 364805 - DNA, 13 bp, Homo sapiens
gcctggcctgagc

SEQ ID NO: 364806 - DNA, 14 bp, Homo sapiens
gcctggcctgagct

SEQ ID NO: 364807 - DNA, 15 bp, Homo sapiens
gcctggcctgagctg

SEQ ID NO: 364808 - DNA, 20 bp, Homo sapiens
gcctggcctgagctggggcc

SEQ ID NO: 364809 - DNA, 14 bp, Homo sapiens
gcctggcctggccc

SEQ ID NO: 364810 - DNA, 16 bp, Homo sapiens
gcctggcctggccctg

SEQ ID NO: 364811 - DNA, 19 bp, Homo sapiens
gcctggcctggccctgccc

SEQ ID NO: 364812 - DNA, 13 bp, Homo sapiens
gcctggcctggtc

SEQ ID NO: 364813 - DNA, 15 bp, Homo sapiens
gcctggcgggcagcc

SEQ ID NO: 364814 - DNA, 17 bp, Homo sapiens
gcctggcgggcagcccc

SEQ ID NO: 364815 - DNA, 23 bp, Homo sapiens
gcctggcgggcagcccctgctgg

SEQ ID NO: 364816 - DNA, 16 bp, Homo sapiens
gcctggctcccaggac

SEQ ID NO: 364817 - DNA, 12 bp, Homo sapiens
gcctggctcccc

SEQ ID NO: 364818 - DNA, 22 bp, Homo sapiens
gcctggctccccacgagtcacc

SEQ ID NO: 364819 - DNA, 17 bp, Homo sapiens
gcctggctccgctgtgt

SEQ ID NO: 364820 - DNA, 12 bp, Homo sapiens
gcctggctgtgg

SEQ ID NO: 364821 - DNA, 13 bp, Homo sapiens
gcctggctgtgga

SEQ ID NO: 364822 - DNA, 18 bp, Homo sapiens
gcctggctgtggaggcct

SEQ ID NO: 364823 - DNA, 19 bp, Homo sapiens
gcctggctgtggaggcctg

SEQ ID NO: 364824 - DNA, 20 bp, Homo sapiens
gcctggctgtggaggcctga

SEQ ID NO: 364825 - DNA, 20 bp, Homo sapiens
gcctggcttctttctctcag

SEQ ID NO: 364826 - DNA, 14 bp, Homo sapiens
gcctggcttgctcc

SEQ ID NO: 364827 - DNA, 17 bp, Homo sapiens
gcctgggacccagctac

SEQ ID NO: 364828 - DNA, 15 bp, Homo sapiens
gcctgggactcccag

SEQ ID NO: 364829 - DNA, 15 bp, Homo sapiens
gcctgggagggtggt

SEQ ID NO: 364830 - DNA, 15 bp, Homo sapiens
gcctgggcaacagag

SEQ ID NO: 364831 - DNA, 18 bp, Homo sapiens
gcctgggcagccaggctg

SEQ ID NO: 364832 - DNA, 14 bp, Homo sapiens
gcctgggcagtgcc

SEQ ID NO: 364833 - DNA, 13 bp, Homo sapiens
gcctgggccactg

SEQ ID NO: 364834 - DNA, 12 bp, Homo sapiens
gcctgggcctgc

SEQ ID NO: 364835 - DNA, 17 bp, Homo sapiens
gcctgggcctgcttttc

SEQ ID NO: 364836 - DNA, 22 bp, Homo sapiens
gcctgggcctgcttttccagga

SEQ ID NO: 364837 - DNA, 16 bp, Homo sapiens
gcctgggcctgtgcag

SEQ ID NO: 364838 - DNA, 19 bp, Homo sapiens
gcctgggcctgtgcagcag

SEQ ID NO: 364839 - DNA, 21 bp, Homo sapiens
gcctgggcctgtgcagcagcc

SEQ ID NO: 364840 - DNA, 21 bp, Homo sapiens
gcctggggatgtaaccaagct

SEQ ID NO: 364841 - DNA, 13 bp, Homo sapiens
gcctggggcctgg

SEQ ID NO: 364842 - DNA, 15 bp, Homo sapiens
gcctggggctccggt

SEQ ID NO: 364843 - DNA, 15 bp, Homo sapiens
gcctgggggcagtga

SEQ ID NO: 364844 - DNA, 21 bp, Homo sapiens
gcctgggggcagtgactggca

SEQ ID NO: 364845 - DNA, 23 bp, Homo sapiens
gcctgggggcagtgactggcagg

SEQ ID NO: 364846 - DNA, 20 bp, Homo sapiens
gcctgggtctccctggtggg

SEQ ID NO: 364847 - DNA, 14 bp, Homo sapiens
gcctgggtgacaga

SEQ ID NO: 364848 - DNA, 12 bp, Homo sapiens
gcctgggtgctg

SEQ ID NO: 364849 - DNA, 20 bp, Homo sapiens
gcctgggtggggcagggcct

SEQ ID NO: 364850 - DNA, 22 bp, Homo sapiens
gcctgggtggggcagggcctgg

SEQ ID NO: 364851 - DNA, 15 bp, Homo sapiens
gcctggtagagacta

SEQ ID NO: 364852 - DNA, 22 bp, Homo sapiens
gcctggtccatgatggagtcag

SEQ ID NO: 364853 - DNA, 12 bp, Homo sapiens
gcctggtctgga

SEQ ID NO: 364854 - DNA, 14 bp, Homo sapiens
gcctggtctggagc

SEQ ID NO: 364855 - DNA, 15 bp, Homo sapiens
gcctggtgacaggca

SEQ ID NO: 364856 - DNA, 16 bp, Homo sapiens
gcctggtgacaggcag

SEQ ID NO: 364857 - DNA, 19 bp, Homo sapiens
gcctggtgacaggcagaca

SEQ ID NO: 364858 - DNA, 13 bp, Homo sapiens
gcctggtgctgct

SEQ ID NO: 364859 - DNA, 16 bp, Homo sapiens
gcctgtaatcccagct

SEQ ID NO: 364860 - DNA, 12 bp, Homo sapiens
gcctgtaatctt

SEQ ID NO: 364861 - DNA, 20 bp, Homo sapiens
gcctgtaatctttttctcca

SEQ ID NO: 364862 - DNA, 19 bp, Homo sapiens
gcctgtacaagctgatgtt

SEQ ID NO: 364863 - DNA, 19 bp, Homo sapiens
gcctgtagtcccagctaca

SEQ ID NO: 364864 - DNA, 23 bp, Homo sapiens
gcctgtagttaggaaataaaacc

SEQ ID NO: 364865 - DNA, 20 bp, Homo sapiens
gcctgtcacgctctggtgca

SEQ ID NO: 364866 - DNA, 22 bp, Homo sapiens
gcctgtcagccaacattgcctt

SEQ ID NO: 364867 - DNA, 23 bp, Homo sapiens
gcctgtcagccaacattgccttg

SEQ ID NO: 364868 - DNA, 17 bp, Homo sapiens
gcctgtccccgccttcc

SEQ ID NO: 364869 - DNA, 22 bp, Homo sapiens
gcctgtccccgccttccctcac

SEQ ID NO: 364870 - DNA, 21 bp, Homo sapiens
gcctgtccctggccatctctg

SEQ ID NO: 364871 - DNA, 11 bp, Homo sapiens
gcctgtcctca

SEQ ID NO: 364872 - DNA, 14 bp, Homo sapiens
gcctgtcgtgccag

SEQ ID NO: 364873 - DNA, 16 bp, Homo sapiens
gcctgtcgtgccagtc

SEQ ID NO: 364874 - DNA, 17 bp, Homo sapiens
gcctgtctcatccccag

SEQ ID NO: 364875 - DNA, 18 bp, Homo sapiens
gcctgtctcatccccagg

SEQ ID NO: 364876 - DNA, 19 bp, Homo sapiens
gcctgtctcatccccaggg

SEQ ID NO: 364877 - DNA, 14 bp, Homo sapiens
gcctgtctctttcc

SEQ ID NO: 364878 - DNA, 17 bp, Homo sapiens
gcctgtcttcagatcct

SEQ ID NO: 364879 - DNA, 23 bp, Homo sapiens
gcctgtcttcagatcctgctgcc

SEQ ID NO: 364880 - DNA, 20 bp, Homo sapiens
gcctgtgcagcagcccagct

SEQ ID NO: 364881 - DNA, 19 bp, Homo sapiens
gcctgtgccacccaccagg

SEQ ID NO: 364882 - DNA, 18 bp, Homo sapiens
gcctgtgcgttcccttca

SEQ ID NO: 364883 - DNA, 19 bp, Homo sapiens
gcctgtgctgaggactccc

SEQ ID NO: 364884 - DNA, 21 bp, Homo sapiens
gcctgtgctgcatgcgacagc

SEQ ID NO: 364885 - DNA, 21 bp, Homo sapiens
gcctgtgctgggccagtggct

SEQ ID NO: 364886 - DNA, 12 bp, Homo sapiens
gcctgtggcaga

SEQ ID NO: 364887 - DNA, 17 bp, Homo sapiens
gcctgtggccttgcccg

SEQ ID NO: 364888 - DNA, 14 bp, Homo sapiens
gcctgtgggagaag

SEQ ID NO: 364889 - DNA, 22 bp, Homo sapiens
gcctgtgggagaagggacagcg

SEQ ID NO: 364890 - DNA, 18 bp, Homo sapiens
gcctgtggtgaagtgtgg

SEQ ID NO: 364891 - DNA, 20 bp, Homo sapiens
gcctgtggtgaagtgtggct

SEQ ID NO: 364892 - DNA, 21 bp, Homo sapiens
gcctgtggtgaagtgtggctg

SEQ ID NO: 364893 - DNA, 12 bp, Homo sapiens
gcctgtgtccag

SEQ ID NO: 364894 - DNA, 14 bp, Homo sapiens
gcctgtgtccagca

SEQ ID NO: 364895 - DNA, 17 bp, Homo sapiens
gcctgtgtccagcagct

SEQ ID NO: 364896 - DNA, 18 bp, Homo sapiens
gcctgtgtccagcagctg

SEQ ID NO: 364897 - DNA, 15 bp, Homo sapiens
gcctgtgtgctccgg

SEQ ID NO: 364898 - DNA, 20 bp, Homo sapiens
gcctgtgtgtaagctgactg

SEQ ID NO: 364899 - DNA, 16 bp, Homo sapiens
gcctgttaagtctgag

SEQ ID NO: 364900 - DNA, 22 bp, Homo sapiens
gcctgttcccctcactggatga

SEQ ID NO: 364901 - DNA, 15 bp, Homo sapiens
gcctgttctgtagga

SEQ ID NO: 364902 - DNA, 22 bp, Homo sapiens
gcctgttctgtaggagagactg

SEQ ID NO: 364903 - DNA, 23 bp, Homo sapiens
gcctgttctgtaggagagactgg

SEQ ID NO: 364904 - DNA, 16 bp, Homo sapiens
gcctgtttctgcagcc

SEQ ID NO: 364905 - DNA, 18 bp, Homo sapiens
gcctgtttctgcagccct

SEQ ID NO: 364906 - DNA, 15 bp, Homo sapiens
gcctgtttgggatgt

SEQ ID NO: 364907 - DNA, 13 bp, Homo sapiens
gccttaaaacttt

SEQ ID NO: 364908 - DNA, 16 bp, Homo sapiens
gccttaaaactttaat

SEQ ID NO: 364909 - DNA, 14 bp, Homo sapiens
gccttaaccttctg

SEQ ID NO: 364910 - DNA, 17 bp, Homo sapiens
gccttaagaaagctata

SEQ ID NO: 364911 - DNA, 23 bp, Homo sapiens
gccttaagaaagctatatatgaa

SEQ ID NO: 364912 - DNA, 22 bp, Homo sapiens
gccttaagccataggcccagga

SEQ ID NO: 364913 - DNA, 16 bp, Homo sapiens
gccttaagtcttactg

SEQ ID NO: 364914 - DNA, 17 bp, Homo sapiens
gccttaatggatgctca

SEQ ID NO: 364915 - DNA, 17 bp, Homo sapiens
gccttagaacctttctt

SEQ ID NO: 364916 - DNA, 15 bp, Homo sapiens
gccttagaggagccc

SEQ ID NO: 364917 - DNA, 12 bp, Homo sapiens
gccttagctgcc

SEQ ID NO: 364918 - DNA, 15 bp, Homo sapiens
gccttagctgccagt

SEQ ID NO: 364919 - DNA, 20 bp, Homo sapiens
gccttatcaagtgtcttcca

SEQ ID NO: 364920 - DNA, 13 bp, Homo sapiens
gccttatgagaac

SEQ ID NO: 364921 - DNA, 20 bp, Homo sapiens
gccttcagtatcaaggctgc

SEQ ID NO: 364922 - DNA, 19 bp, Homo sapiens
gccttcattaaatgtttgt

SEQ ID NO: 364923 - DNA, 19 bp, Homo sapiens
gccttccacgctgtctcca

SEQ ID NO: 364924 - DNA, 14 bp, Homo sapiens
gccttccataatta

SEQ ID NO: 364925 - DNA, 13 bp, Homo sapiens
gccttcccctccc

SEQ ID NO: 364926 - DNA, 21 bp, Homo sapiens
gccttccccttttgcctggct

SEQ ID NO: 364927 - DNA, 22 bp, Homo sapiens
gccttccccttttgcctggctg

SEQ ID NO: 364928 - DNA, 24 bp, Homo sapiens
gccttccccttttgcctggctgtg

SEQ ID NO: 364929 - DNA, 13 bp, Homo sapiens
gccttccctcact

SEQ ID NO: 364930 - DNA, 15 bp, Homo sapiens
gccttccctcactct

SEQ ID NO: 364931 - DNA, 18 bp, Homo sapiens
gccttccctcactcttcc

SEQ ID NO: 364932 - DNA, 22 bp, Homo sapiens
gccttccctcactcttcctcat

SEQ ID NO: 364933 - DNA, 16 bp, Homo sapiens
gccttccctccccaca

SEQ ID NO: 364934 - DNA, 17 bp, Homo sapiens
gccttccgctcccacca

SEQ ID NO: 364935 - DNA, 22 bp, Homo sapiens
gccttccgtgggtcatcccagc

SEQ ID NO: 364936 - DNA, 16 bp, Homo sapiens
gccttcctcatcccct

SEQ ID NO: 364937 - DNA, 17 bp, Homo sapiens
gccttcctcatcccctc

SEQ ID NO: 364938 - DNA, 14 bp, Homo sapiens
gccttcctcctcca

SEQ ID NO: 364939 - DNA, 17 bp, Homo sapiens
gccttcctcctccacag

SEQ ID NO: 364940 - DNA, 17 bp, Homo sapiens
gccttcctctgcagctg

SEQ ID NO: 364941 - DNA, 22 bp, Homo sapiens
gctaagataattaaatgaaata

SEQ ID NO: 364942 - DNA, 23 bp, Homo sapiens
gctaagataattaaatgaaatac

SEQ ID NO: 364943 - DNA, 22 bp, Homo sapiens
gctaagatgagatttgccagca

SEQ ID NO: 364944 - DNA, 21 bp, Homo sapiens
gctaaggcctcttgctggtgc

SEQ ID NO: 364945 - DNA, 19 bp, Homo sapiens
gctaaggctcctccttgcc

SEQ ID NO: 364946 - DNA, 21 bp, Homo sapiens
gctaagtccagctctcccctg

SEQ ID NO: 364947 - DNA, 13 bp, Homo sapiens
gctaagtgaaaag

SEQ ID NO: 364948 - DNA, 14 bp, Homo sapiens
gctaataaaatatc

SEQ ID NO: 364949 - DNA, 17 bp, Homo sapiens
gctaataaaatatcatt

SEQ ID NO: 364950 - DNA, 18 bp, Homo sapiens
gctaataaaatatcattc

SEQ ID NO: 364951 - DNA, 20 bp, Homo sapiens
gctaataaaatatcattcag

SEQ ID NO: 364952 - DNA, 14 bp, Homo sapiens
gctaataaactgtt

SEQ ID NO: 364953 - DNA, 18 bp, Homo sapiens
gctaataaactgtttttt

SEQ ID NO: 364954 - DNA, 15 bp, Homo sapiens
gctaataaatgacca

SEQ ID NO: 364955 - DNA, 22 bp, Homo sapiens
gctaatcagcattctcactcct

SEQ ID NO: 364956 - DNA, 17 bp, Homo sapiens
gctaatctgtagggctg

SEQ ID NO: 364957 - DNA, 19 bp, Homo sapiens
gctaatctgtagggctgga

SEQ ID NO: 364958 - DNA, 16 bp, Homo sapiens
gctaatgaattttaaa

SEQ ID NO: 364959 - DNA, 20 bp, Homo sapiens
gctaatgtaatcatttatct

SEQ ID NO: 364960 - DNA, 18 bp, Homo sapiens
gctaatgtaggactgtat

SEQ ID NO: 364961 - DNA, 21 bp, Homo sapiens
gctaattacacacgtgtgatg

SEQ ID NO: 364962 - DNA, 20 bp, Homo sapiens
gctaattcatacctccctcc

SEQ ID NO: 364963 - DNA, 18 bp, Homo sapiens
gctaattctgggaaggga

SEQ ID NO: 364964 - DNA, 15 bp, Homo sapiens
gctaatttttttgta

SEQ ID NO: 364965 - DNA, 12 bp, Homo sapiens
gctacacacaca

SEQ ID NO: 364966 - DNA, 20 bp, Homo sapiens
gctacacagcagctgttcaa

SEQ ID NO: 364967 - DNA, 17 bp, Homo sapiens
gctacactcgccttctg

SEQ ID NO: 364968 - DNA, 16 bp, Homo sapiens
gctacacttacaagta

SEQ ID NO: 364969 - DNA, 20 bp, Homo sapiens
gctacaggaagcaccccatg

SEQ ID NO: 364970 - DNA, 21 bp, Homo sapiens
gctacaggaagcaccccatgc

SEQ ID NO: 364971 - DNA, 18 bp, Homo sapiens
gctacagtagctgtgggg

SEQ ID NO: 364972 - DNA, 18 bp, Homo sapiens
gctacattcctcagctgc

SEQ ID NO: 364973 - DNA, 19 bp, Homo sapiens
gctacattcctcagctgcc

SEQ ID NO: 364974 - DNA, 20 bp, Homo sapiens
gctacattcctcagctgcca

SEQ ID NO: 364975 - DNA, 14 bp, Homo sapiens
gctacattgtaatc

SEQ ID NO: 364976 - DNA, 14 bp, Homo sapiens
gctacccagaacct

SEQ ID NO: 364977 - DNA, 15 bp, Homo sapiens
gctaccccccgtctc

SEQ ID NO: 364978 - DNA, 19 bp, Homo sapiens
gctaccccccgtctcctgc

SEQ ID NO: 364979 - DNA, 16 bp, Homo sapiens
gctacccttgccaagg

SEQ ID NO: 364980 - DNA, 17 bp, Homo sapiens
gctaccgccctgggctg

SEQ ID NO: 364981 - DNA, 21 bp, Homo sapiens
gctaccgccctgggctggact

SEQ ID NO: 364982 - DNA, 23 bp, Homo sapiens
gctaccgccctgggctggactgg

SEQ ID NO: 364983 - DNA, 13 bp, Homo sapiens
gctacctcaaggg

SEQ ID NO: 364984 - DNA, 20 bp, Homo sapiens
gctacctctaacaccacact

SEQ ID NO: 364985 - DNA, 14 bp, Homo sapiens
gctacctctgatca

SEQ ID NO: 364986 - DNA, 18 bp, Homo sapiens
gctacctgatcccactcc

SEQ ID NO: 364987 - DNA, 20 bp, Homo sapiens
gctactacccgagcccagct

SEQ ID NO: 364988 - DNA, 22 bp, Homo sapiens
gctactccactgacctggaaga

SEQ ID NO: 364989 - DNA, 17 bp, Homo sapiens
gctactctgtccaggcc

SEQ ID NO: 364990 - DNA, 19 bp, Homo sapiens
gctactctgtccaggccac

SEQ ID NO: 364991 - DNA, 17 bp, Homo sapiens
gctactgatttttgtga

SEQ ID NO: 364992 - DNA, 13 bp, Homo sapiens
gctactggcagct

SEQ ID NO: 364993 - DNA, 20 bp, Homo sapiens
gctactggcagctcctctcc

SEQ ID NO: 364994 - DNA, 17 bp, Homo sapiens
gctacttaattcctttc

SEQ ID NO: 364995 - DNA, 23 bp, Homo sapiens
gctacttaattcctttctcatcc

SEQ ID NO: 364996 - DNA, 22 bp, Homo sapiens
gctacttgagagtgggggagaa

SEQ ID NO: 364997 - DNA, 17 bp, Homo sapiens
gctacttttacttgttc

SEQ ID NO: 364998 - DNA, 18 bp, Homo sapiens
gctacttttacttgttca

SEQ ID NO: 364999 - DNA, 23 bp, Homo sapiens
gctacttttacttgttcatttct

SEQ ID NO: 365000 - DNA, 18 bp, Homo sapiens
gctagaaatatgatttta

SEQ ID NO: 365001 - DNA, 21 bp, Homo sapiens
gctagaataggagaaaatgaa

SEQ ID NO: 365002 - DNA, 15 bp, Homo sapiens
gctagaatggtggga

SEQ ID NO: 365003 - DNA, 19 bp, Homo sapiens
gctagacaaaggcccagaa

SEQ ID NO: 365004 - DNA, 20 bp, Homo sapiens
gctagacaaggttgctgttg

SEQ ID NO: 365005 - DNA, 15 bp, Homo sapiens
gctagacacccattt

SEQ ID NO: 365006 - DNA, 22 bp, Homo sapiens
gctagactaggagaccagaagt

SEQ ID NO: 365007 - DNA, 21 bp, Homo sapiens
gctagagaggggcctctggct

SEQ ID NO: 365008 - DNA, 17 bp, Homo sapiens
gctagagcattctgggg

SEQ ID NO: 365009 - DNA, 19 bp, Homo sapiens
gctagagcattctggggtg

SEQ ID NO: 365010 - DNA, 22 bp, Homo sapiens
gctagagcttcaagtctgtgcc

SEQ ID NO: 365011 - DNA, 21 bp, Homo sapiens
gctagaggccagccccaccca

SEQ ID NO: 365012 - DNA, 23 bp, Homo sapiens
gctagatgagaattcagctgccc

SEQ ID NO: 365013 - DNA, 19 bp, Homo sapiens
gctagatgggcatggggtg

SEQ ID NO: 365014 - DNA, 13 bp, Homo sapiens
gctagccccaggg

SEQ ID NO: 365015 - DNA, 14 bp, Homo sapiens
gctagccccagggt

SEQ ID NO: 365016 - DNA, 13 bp, Homo sapiens
gctaggaaaggca

SEQ ID NO: 365017 - DNA, 17 bp, Homo sapiens
gctaggaaaggcagaaa

SEQ ID NO: 365018 - DNA, 15 bp, Homo sapiens
gctaggactgaggag

SEQ ID NO: 365019 - DNA, 18 bp, Homo sapiens
gctaggactgaggagtgg

SEQ ID NO: 365020 - DNA, 19 bp, Homo sapiens
gctaggagagactgaaagc

SEQ ID NO: 365021 - DNA, 16 bp, Homo sapiens
gctaggctgagatgca

SEQ ID NO: 365022 - DNA, 15 bp, Homo sapiens
gctagggtgcctgct

SEQ ID NO: 365023 - DNA, 18 bp, Homo sapiens
gctagggtgcctgctctc

SEQ ID NO: 365024 - DNA, 14 bp, Homo sapiens
gctagggtggccct

SEQ ID NO: 365025 - DNA, 15 bp, Homo sapiens
gctagggtggccctt

SEQ ID NO: 365026 - DNA, 20 bp, Homo sapiens
gctagggttccactggagaa

SEQ ID NO: 365027 - DNA, 19 bp, Homo sapiens
gctaggtgggccagcccct

SEQ ID NO: 365028 - DNA, 20 bp, Homo sapiens
gctaggtgggccagcccctc

SEQ ID NO: 365029 - DNA, 22 bp, Homo sapiens
gctaggttaataggaggacaga

SEQ ID NO: 365030 - DNA, 13 bp, Homo sapiens
gctagtgagctgg

SEQ ID NO: 365031 - DNA, 15 bp, Homo sapiens
gctagtgagctgggc

SEQ ID NO: 365032 - DNA, 18 bp, Homo sapiens
gctagtgatacactgtat

SEQ ID NO: 365033 - DNA, 23 bp, Homo sapiens
gctagtgggccctctctctgggc

SEQ ID NO: 365034 - DNA, 18 bp, Homo sapiens
gctagtgtgagtggcagc

SEQ ID NO: 365035 - DNA, 20 bp, Homo sapiens
gctagtgtgagtggcagcca

SEQ ID NO: 365036 - DNA, 23 bp, Homo sapiens
gctagtgtgagtggcagccatgc

SEQ ID NO: 365037 - DNA, 17 bp, Homo sapiens
gctagtttaaaattatt

SEQ ID NO: 365038 - DNA, 21 bp, Homo sapiens
gctagtttaaaattattaaaa

SEQ ID NO: 365039 - DNA, 16 bp, Homo sapiens
gctataaatagtgaaa

SEQ ID NO: 365040 - DNA, 22 bp, Homo sapiens
gctataatgtttccctcaagaa

SEQ ID NO: 365041 - DNA, 18 bp, Homo sapiens
gctatagctacaggaagc

SEQ ID NO: 365042 - DNA, 15 bp, Homo sapiens
gctatccagccgcaa

SEQ ID NO: 365043 - DNA, 17 bp, Homo sapiens
gctatcccttctcagaa

SEQ ID NO: 365044 - DNA, 21 bp, Homo sapiens
gctatctgcatttataaatgt

SEQ ID NO: 365045 - DNA, 21 bp, Homo sapiens
gctatgaagactacttttaga

SEQ ID NO: 365046 - DNA, 22 bp, Homo sapiens
gctatgcacaccaaattgctga

SEQ ID NO: 365047 - DNA, 18 bp, Homo sapiens
gctatggatggggcccag

SEQ ID NO: 365048 - DNA, 23 bp, Homo sapiens
gctatggatggggcccaggggct

SEQ ID NO: 365049 - DNA, 22 bp, Homo sapiens
gctatggattttctaaggaaga

SEQ ID NO: 365050 - DNA, 13 bp, Homo sapiens
gctatgtctgtga

SEQ ID NO: 365051 - DNA, 14 bp, Homo sapiens
gctatgtctgtgat

SEQ ID NO: 365052 - DNA, 15 bp, Homo sapiens
gctatgtctgtgatg

SEQ ID NO: 365053 - DNA, 12 bp, Homo sapiens
gctattacaaat

SEQ ID NO: 365054 - DNA, 12 bp, Homo sapiens
gctattcccagg

SEQ ID NO: 365055 - DNA, 13 bp, Homo sapiens
gctattcccaggc

SEQ ID NO: 365056 - DNA, 14 bp, Homo sapiens
gctattcccaggca

SEQ ID NO: 365057 - DNA, 17 bp, Homo sapiens
gctattcccaggcaggg

SEQ ID NO: 365058 - DNA, 16 bp, Homo sapiens
gctattctttgaccaa

SEQ ID NO: 365059 - DNA, 21 bp, Homo sapiens
gctattctttgaccaaactgt

SEQ ID NO: 365060 - DNA, 22 bp, Homo sapiens
gctattgaagatacacaagagg

SEQ ID NO: 365061 - DNA, 18 bp, Homo sapiens
gctatttccattccagaa

SEQ ID NO: 365062 - DNA, 16 bp, Homo sapiens
gctatttcccaagctg

SEQ ID NO: 365063 - DNA, 18 bp, Homo sapiens
gctatttctatgtatgtg

SEQ ID NO: 365064 - DNA, 13 bp, Homo sapiens
gctatttctctcc

SEQ ID NO: 365065 - DNA, 21 bp, Homo sapiens
gctatttgctttagagacagg

SEQ ID NO: 365066 - DNA, 23 bp, Homo sapiens
gctatttgctttagagacaggga

SEQ ID NO: 365067 - DNA, 14 bp, Homo sapiens
gctatttgttcaga

SEQ ID NO: 365068 - DNA, 15 bp, Homo sapiens
gctcaaaaaatgagc

SEQ ID NO: 365069 - DNA, 14 bp, Homo sapiens
gctcaaaaggaaac

SEQ ID NO: 365070 - DNA, 19 bp, Homo sapiens
gctcaaaaggaaaccaagt

SEQ ID NO: 365071 - DNA, 22 bp, Homo sapiens
gctcaaaatgatatgtttgagt

SEQ ID NO: 365072 - DNA, 18 bp, Homo sapiens
gctcaaagatgtactgag

SEQ ID NO: 365073 - DNA, 17 bp, Homo sapiens
gctcaaatctattcaga

SEQ ID NO: 365074 - DNA, 18 bp, Homo sapiens
gctcaaatctattcagac

SEQ ID NO: 365075 - DNA, 22 bp, Homo sapiens
gctcaaatctattcagacaagc

SEQ ID NO: 365076 - DNA, 15 bp, Homo sapiens
gctcaacccccctcc

SEQ ID NO: 365077 - DNA, 18 bp, Homo sapiens
gctcaacccccctcccag

SEQ ID NO: 365078 - DNA, 14 bp, Homo sapiens
gctcaacctctcag

SEQ ID NO: 365079 - DNA, 19 bp, Homo sapiens
gctcaactctacccctgct

SEQ ID NO: 365080 - DNA, 20 bp, Homo sapiens
gctcaactctacccctgctc

SEQ ID NO: 365081 - DNA, 24 bp, Homo sapiens
gctcaagcacttttcctgtctcag

SEQ ID NO: 365082 - DNA, 12 bp, Homo sapiens
gctcaagttcat

SEQ ID NO: 365083 - DNA, 14 bp, Homo sapiens
gctcacaactgttt

SEQ ID NO: 365084 - DNA, 21 bp, Homo sapiens
gctcacacggggtattttagg

SEQ ID NO: 365085 - DNA, 22 bp, Homo sapiens
gctcacagaacccttggagcca

SEQ ID NO: 365086 - DNA, 17 bp, Homo sapiens
gctcacagactggagac

SEQ ID NO: 365087 - DNA, 11 bp, Homo sapiens
gctcacagcca

SEQ ID NO: 365088 - DNA, 13 bp, Homo sapiens
gctcacagccacc

SEQ ID NO: 365089 - DNA, 21 bp, Homo sapiens
gctcacagccaccacctggat

SEQ ID NO: 365090 - DNA, 20 bp, Homo sapiens
gctcacagtacaatgtttca

SEQ ID NO: 365091 - DNA, 18 bp, Homo sapiens
gctcacattccctctcat

SEQ ID NO: 365092 - DNA, 18 bp, Homo sapiens
gctcacccattgtctcat

SEQ ID NO: 365093 - DNA, 11 bp, Homo sapiens
gctcacccctg

SEQ ID NO: 365094 - DNA, 15 bp, Homo sapiens
gctcacccctgggca

SEQ ID NO: 365095 - DNA, 16 bp, Homo sapiens
gctcacccctgggcag

SEQ ID NO: 365096 - DNA, 17 bp, Homo sapiens
gctcacccctgggcagg

SEQ ID NO: 365097 - DNA, 18 bp, Homo sapiens
gctcacccctgggcaggc

SEQ ID NO: 365098 - DNA, 19 bp, Homo sapiens
gctcacccctgggcaggcg

SEQ ID NO: 365099 - DNA, 16 bp, Homo sapiens
gctcacgactcttcct

SEQ ID NO: 365100 - DNA, 19 bp, Homo sapiens
gctcacgactcttcctgca

SEQ ID NO: 365101 - DNA, 15 bp, Homo sapiens
gctcacgcctgtaat

SEQ ID NO: 365102 - DNA, 21 bp, Homo sapiens
gctcacgcctgtaatcccagc

SEQ ID NO: 365103 - DNA, 22 bp, Homo sapiens
gctcacgctcccccgcagtccc

SEQ ID NO: 365104 - DNA, 13 bp, Homo sapiens
gctcacgtgtgtg

SEQ ID NO: 365105 - DNA, 20 bp, Homo sapiens
gctcactacaacctccacct

SEQ ID NO: 365106 - DNA, 20 bp, Homo sapiens
gctcactccctaaagccctc

SEQ ID NO: 365107 - DNA, 17 bp, Homo sapiens
gctcactgcagcctcga

SEQ ID NO: 365108 - DNA, 14 bp, Homo sapiens
gctcactgcttctg

SEQ ID NO: 365109 - DNA, 20 bp, Homo sapiens
gctcagaacaccccgctctg

SEQ ID NO: 365110 - DNA, 22 bp, Homo sapiens
gctcagaagagaatcaaggccg

SEQ ID NO: 365111 - DNA, 17 bp, Homo sapiens
gctcagaatagatctga

SEQ ID NO: 365112 - DNA, 20 bp, Homo sapiens
gctcagacgagacaccctaa

SEQ ID NO: 365113 - DNA, 22 bp, Homo sapiens
gctcagacgagacaccctaact

SEQ ID NO: 365114 - DNA, 14 bp, Homo sapiens
gctcagcacagcct

SEQ ID NO: 365115 - DNA, 19 bp, Homo sapiens
gctcagcagttcacttcct

SEQ ID NO: 365116 - DNA, 17 bp, Homo sapiens
gctcagcccacccccct

SEQ ID NO: 365117 - DNA, 16 bp, Homo sapiens
gctcagccccagccca

SEQ ID NO: 365118 - DNA, 18 bp, Homo sapiens
gctcagccccagcccagc

SEQ ID NO: 365119 - DNA, 17 bp, Homo sapiens
gctcagccctccctgcc

SEQ ID NO: 365120 - DNA, 21 bp, Homo sapiens
gctcagccctccctgcccctc

SEQ ID NO: 365121 - DNA, 20 bp, Homo sapiens
gctcagctactgatttttgt

SEQ ID NO: 365122 - DNA, 20 bp, Homo sapiens
gctcagctctggctcacaga

SEQ ID NO: 365123 - DNA, 12 bp, Homo sapiens
gctcaggaccca

SEQ ID NO: 365124 - DNA, 15 bp, Homo sapiens
gctcaggacccaggc

SEQ ID NO: 365125 - DNA, 17 bp, Homo sapiens
gctcaggagaaggcctg

SEQ ID NO: 365126 - DNA, 14 bp, Homo sapiens
gctcaggatctctt

SEQ ID NO: 365127 - DNA, 12 bp, Homo sapiens
gctcaggcaagc

SEQ ID NO: 365128 - DNA, 14 bp, Homo sapiens
gctcaggcaagccc

SEQ ID NO: 365129 - DNA, 17 bp, Homo sapiens
gctcaggcaagcccctc

SEQ ID NO: 365130 - DNA, 19 bp, Homo sapiens
gctcaggcaagcccctcag

SEQ ID NO: 365131 - DNA, 17 bp, Homo sapiens
gctcaggcctcacctgg

SEQ ID NO: 365132 - DNA, 14 bp, Homo sapiens
gctcaggcgcagcc

SEQ ID NO: 365133 - DNA, 15 bp, Homo sapiens
gctcaggcgcagccc

SEQ ID NO: 365134 - DNA, 21 bp, Homo sapiens
gctcagggatcttctccctcc

SEQ ID NO: 365135 - DNA, 14 bp, Homo sapiens
gctcagggctggag

SEQ ID NO: 365136 - DNA, 16 bp, Homo sapiens
gctcaggggcagctca

SEQ ID NO: 365137 - DNA, 20 bp, Homo sapiens
gctcaggggcgtgtggctca

SEQ ID NO: 365138 - DNA, 18 bp, Homo sapiens
gctcaggtagccaccacc

SEQ ID NO: 365139 - DNA, 16 bp, Homo sapiens
gctcagtgccacctat

SEQ ID NO: 365140 - DNA, 17 bp, Homo sapiens
gctcagtgccacctatg

SEQ ID NO: 365141 - DNA, 13 bp, Homo sapiens
gctcagtgcctcc

SEQ ID NO: 365142 - DNA, 17 bp, Homo sapiens
gctcagtgcctcctggc

SEQ ID NO: 365143 - DNA, 14 bp, Homo sapiens
gctcagttgtactt

SEQ ID NO: 365144 - DNA, 13 bp, Homo sapiens
gctcagtttggct

SEQ ID NO: 365145 - DNA, 22 bp, Homo sapiens
gctcatattcctgcagcctgga

SEQ ID NO: 365146 - DNA, 19 bp, Homo sapiens
gctcatgcctgtaaccctg

SEQ ID NO: 365147 - DNA, 20 bp, Homo sapiens
gctcatggcgtaatgggcct

SEQ ID NO: 365148 - DNA, 19 bp, Homo sapiens
gctcattcatattcctgcc

SEQ ID NO: 365149 - DNA, 20 bp, Homo sapiens
gctcattcatattcctgcct

SEQ ID NO: 365150 - DNA, 22 bp, Homo sapiens
gctcattcatattcctgccttt

SEQ ID NO: 365151 - DNA, 19 bp, Homo sapiens
gctccaccaagaaagcagg

SEQ ID NO: 365152 - DNA, 15 bp, Homo sapiens
gctccaccacatcct

SEQ ID NO: 365153 - DNA, 16 bp, Homo sapiens
gctccaccccactcac

SEQ ID NO: 365154 - DNA, 19 bp, Homo sapiens
gctccaccccactcacaga

SEQ ID NO: 365155 - DNA, 14 bp, Homo sapiens
gctccaccctcccc

SEQ ID NO: 365156 - DNA, 19 bp, Homo sapiens
gctccaccctcccctcttc

SEQ ID NO: 365157 - DNA, 20 bp, Homo sapiens
gctccaccctcccctcttct

SEQ ID NO: 365158 - DNA, 13 bp, Homo sapiens
gctccacccttgg

SEQ ID NO: 365159 - DNA, 15 bp, Homo sapiens
gctccacgccctggg

SEQ ID NO: 365160 - DNA, 21 bp, Homo sapiens
gctccacgggggcctagtggc

SEQ ID NO: 365161 - DNA, 13 bp, Homo sapiens
gctccactcaggg

SEQ ID NO: 365162 - DNA, 18 bp, Homo sapiens
gctccactcagggctggc

SEQ ID NO: 365163 - DNA, 22 bp, Homo sapiens
gctccactcagggctggcccgg

SEQ ID NO: 365164 - DNA, 13 bp, Homo sapiens
gctccactctgaa

SEQ ID NO: 365165 - DNA, 20 bp, Homo sapiens
gctccagaattaaggtttgt

SEQ ID NO: 365166 - DNA, 18 bp, Homo sapiens
gctccagcagtgctgggc

SEQ ID NO: 365167 - DNA, 22 bp, Homo sapiens
gctccagcagtgctgggcccag

SEQ ID NO: 365168 - DNA, 20 bp, Homo sapiens
gctccagcatccagcctgtg

SEQ ID NO: 365169 - DNA, 14 bp, Homo sapiens
gctccagccaaccc

SEQ ID NO: 365170 - DNA, 17 bp, Homo sapiens
gctccagccaacccctg

SEQ ID NO: 365171 - DNA, 22 bp, Homo sapiens
gctccagccaacccctgtggag

SEQ ID NO: 365172 - DNA, 20 bp, Homo sapiens
gctccagcgtggcctccgtg

SEQ ID NO: 365173 - DNA, 21 bp, Homo sapiens
gctccagcgtggcctccgtga

SEQ ID NO: 365174 - DNA, 18 bp, Homo sapiens
gctccaggctccaggctg

SEQ ID NO: 365175 - DNA, 23 bp, Homo sapiens
gctccaggggcccttgggacagc

SEQ ID NO: 365176 - DNA, 17 bp, Homo sapiens
gctccagggtcttgggc

SEQ ID NO: 365177 - DNA, 18 bp, Homo sapiens
gctccagggtcttgggct

SEQ ID NO: 365178 - DNA, 19 bp, Homo sapiens
gctccagggtcttgggcta

SEQ ID NO: 365179 - DNA, 14 bp, Homo sapiens
gctccagtcctgct

SEQ ID NO: 365180 - DNA, 17 bp, Homo sapiens
gctccagtcctgctctc

SEQ ID NO: 365181 - DNA, 18 bp, Homo sapiens
gctccagtcctgctctct

SEQ ID NO: 365182 - DNA, 18 bp, Homo sapiens
gctccagtctgctgccct

SEQ ID NO: 365183 - DNA, 14 bp, Homo sapiens
gctccatctccact

SEQ ID NO: 365184 - DNA, 20 bp, Homo sapiens
gctccatgactggctgtctg

SEQ ID NO: 365185 - DNA, 20 bp, Homo sapiens
gctccatgcagatctagcca

SEQ ID NO: 365186 - DNA, 23 bp, Homo sapiens
gctccatgcagatctagccaggc

SEQ ID NO: 365187 - DNA, 23 bp, Homo sapiens
gctccatgctcctcactgcccgc

SEQ ID NO: 365188 - DNA, 16 bp, Homo sapiens
gctccatgggcacctc

SEQ ID NO: 365189 - DNA, 15 bp, Homo sapiens
gctccattcccatca

SEQ ID NO: 365190 - DNA, 23 bp, Homo sapiens
gctccatttataaccccagcctg

SEQ ID NO: 365191 - DNA, 22 bp, Homo sapiens
gctcccacaggcccttcctctc

SEQ ID NO: 365192 - DNA, 12 bp, Homo sapiens
gctcccagaccc

SEQ ID NO: 365193 - DNA, 17 bp, Homo sapiens
gctcccagacccagggc

SEQ ID NO: 365194 - DNA, 12 bp, Homo sapiens
gctcccagcagc

SEQ ID NO: 365195 - DNA, 12 bp, Homo sapiens
gctcccagcctg

SEQ ID NO: 365196 - DNA, 14 bp, Homo sapiens
gctcccagcctgct

SEQ ID NO: 365197 - DNA, 15 bp, Homo sapiens
gctcccagcctgctg

SEQ ID NO: 365198 - DNA, 13 bp, Homo sapiens
gctcccaggacac

SEQ ID NO: 365199 - DNA, 13 bp, Homo sapiens
gctcccaggacgc

SEQ ID NO: 365200 - DNA, 17 bp, Homo sapiens
gctgagcctgaggcctt

SEQ ID NO: 365201 - DNA, 21 bp, Homo sapiens
gctgagcgggtctagtggaaa

SEQ ID NO: 365202 - DNA, 16 bp, Homo sapiens
gctgagctctgacctg

SEQ ID NO: 365203 - DNA, 16 bp, Homo sapiens
gctgagcttagccttg

SEQ ID NO: 365204 - DNA, 19 bp, Homo sapiens
gctgagcttgagctcccct

SEQ ID NO: 365205 - DNA, 16 bp, Homo sapiens
gctgaggacggggcag

SEQ ID NO: 365206 - DNA, 21 bp, Homo sapiens
gctgaggacggggcagagctg

SEQ ID NO: 365207 - DNA, 13 bp, Homo sapiens
gctgaggactccc

SEQ ID NO: 365208 - DNA, 22 bp, Homo sapiens
gctgaggccccagggctgtggg

SEQ ID NO: 365209 - DNA, 21 bp, Homo sapiens
gctgaggcctggactttcctg

SEQ ID NO: 365210 - DNA, 15 bp, Homo sapiens
gctgaggcgggagaa

SEQ ID NO: 365211 - DNA, 16 bp, Homo sapiens
gctgaggcgggagaat

SEQ ID NO: 365212 - DNA, 23 bp, Homo sapiens
gctgaggctctgacccagtgaga

SEQ ID NO: 365213 - DNA, 15 bp, Homo sapiens
gctgagggaccttgg

SEQ ID NO: 365214 - DNA, 23 bp, Homo sapiens
gctgaggggcaacgaagaaaaaa

SEQ ID NO: 365215 - DNA, 15 bp, Homo sapiens
gctgagtcggctggg

SEQ ID NO: 365216 - DNA, 16 bp, Homo sapiens
gctgagtcggctgggc

SEQ ID NO: 365217 - DNA, 19 bp, Homo sapiens
gctgagtcggctgggcagg

SEQ ID NO: 365218 - DNA, 19 bp, Homo sapiens
gctgagtggaatgcaggga

SEQ ID NO: 365219 - DNA, 20 bp, Homo sapiens
gctgagtggaatgcagggaa

SEQ ID NO: 365220 - DNA, 19 bp, Homo sapiens
gctgatgctgaaataaact

SEQ ID NO: 365221 - DNA, 19 bp, Homo sapiens
gctgatggcttgacatgtg

SEQ ID NO: 365222 - DNA, 14 bp, Homo sapiens
gctgattactgtca

SEQ ID NO: 365223 - DNA, 20 bp, Homo sapiens
gctgattactgtcaataaac

SEQ ID NO: 365224 - DNA, 22 bp, Homo sapiens
gctgattactgtcaataaacag

SEQ ID NO: 365225 - DNA, 20 bp, Homo sapiens
gctgatttccaggcccctga

SEQ ID NO: 365226 - DNA, 20 bp, Homo sapiens
gctgcacaccagttactgtt

SEQ ID NO: 365227 - DNA, 11 bp, Homo sapiens
gctgcacagcc

SEQ ID NO: 365228 - DNA, 14 bp, Homo sapiens
gctgcacagcccaa

SEQ ID NO: 365229 - DNA, 18 bp, Homo sapiens
gctgcacattcctggccc

SEQ ID NO: 365230 - DNA, 12 bp, Homo sapiens
gctgcaccaacc

SEQ ID NO: 365231 - DNA, 13 bp, Homo sapiens
gctgcaccagagt

SEQ ID NO: 365232 - DNA, 19 bp, Homo sapiens
gctgcacctcctaccctcc

SEQ ID NO: 365233 - DNA, 13 bp, Homo sapiens
gctgcacctgagg

SEQ ID NO: 365234 - DNA, 15 bp, Homo sapiens
gctgcactgcagtga

SEQ ID NO: 365235 - DNA, 18 bp, Homo sapiens
gctgcagaggcacctcaa

SEQ ID NO: 365236 - DNA, 12 bp, Homo sapiens
gctgcagcaggc

SEQ ID NO: 365237 - DNA, 14 bp, Homo sapiens
gctgcagcaggcag

SEQ ID NO: 365238 - DNA, 21 bp, Homo sapiens
gctgcagcaggcagaggagag

SEQ ID NO: 365239 - DNA, 18 bp, Homo sapiens
gctgcagcgcctcctgga

SEQ ID NO: 365240 - DNA, 22 bp, Homo sapiens
gctgcagcttgggagagcccct

SEQ ID NO: 365241 - DNA, 16 bp, Homo sapiens
gctgcatccgtgagca

SEQ ID NO: 365242 - DNA, 12 bp, Homo sapiens
gctgcatcctca

SEQ ID NO: 365243 - DNA, 14 bp, Homo sapiens
gctgcatcctcagc

SEQ ID NO: 365244 - DNA, 16 bp, Homo sapiens
gctgcatcctcagccc

SEQ ID NO: 365245 - DNA, 20 bp, Homo sapiens
gctgcatggacgcctggctc

SEQ ID NO: 365246 - DNA, 14 bp, Homo sapiens
gctgcatttcaagt

SEQ ID NO: 365247 - DNA, 17 bp, Homo sapiens
gctgccaaattttggcc

SEQ ID NO: 365248 - DNA, 15 bp, Homo sapiens
gctgccaaggccaga

SEQ ID NO: 365249 - DNA, 16 bp, Homo sapiens
gctgccaaggccagag

SEQ ID NO: 365250 - DNA, 15 bp, Homo sapiens
gctgccacacttcag

SEQ ID NO: 365251 - DNA, 21 bp, Homo sapiens
gctgccacacttcaggctctt

SEQ ID NO: 365252 - DNA, 20 bp, Homo sapiens
gctgccaccaaatctgtcta

SEQ ID NO: 365253 - DNA, 19 bp, Homo sapiens
gctgccaccacgtctgcca

SEQ ID NO: 365254 - DNA, 22 bp, Homo sapiens
gctgccaccacgtctgccaggc

SEQ ID NO: 365255 - DNA, 14 bp, Homo sapiens
gctgccagcacaga

SEQ ID NO: 365256 - DNA, 14 bp, Homo sapiens
gctgccatgccact

SEQ ID NO: 365257 - DNA, 17 bp, Homo sapiens
gctgccatgccactgcc

SEQ ID NO: 365258 - DNA, 20 bp, Homo sapiens
gctgccatgccactgccagg

SEQ ID NO: 365259 - DNA, 21 bp, Homo sapiens
gctgccatgccactgccaggc

SEQ ID NO: 365260 - DNA, 22 bp, Homo sapiens
gctgccatgccactgccaggca

SEQ ID NO: 365261 - DNA, 23 bp, Homo sapiens
gctgccatgccactgccaggcac

SEQ ID NO: 365262 - DNA, 15 bp, Homo sapiens
gctgcccacaccacc

SEQ ID NO: 365263 - DNA, 20 bp, Homo sapiens
gctgcccacgctcctgccct

SEQ ID NO: 365264 - DNA, 17 bp, Homo sapiens
gctgcccacggccaccc

SEQ ID NO: 365265 - DNA, 12 bp, Homo sapiens
gctgcccagccc

SEQ ID NO: 365266 - DNA, 14 bp, Homo sapiens
gctgcccagccctc

SEQ ID NO: 365267 - DNA, 13 bp, Homo sapiens
gctgcccaggctc

SEQ ID NO: 365268 - DNA, 15 bp, Homo sapiens
gctgcccaggctctg

SEQ ID NO: 365269 - DNA, 20 bp, Homo sapiens
gctgcccaggctctgctgac

SEQ ID NO: 365270 - DNA, 16 bp, Homo sapiens
gctgccccaacctgct

SEQ ID NO: 365271 - DNA, 17 bp, Homo sapiens
gctgccccaacctgctg

SEQ ID NO: 365272 - DNA, 20 bp, Homo sapiens
gctgccccaacctgctgaag

SEQ ID NO: 365273 - DNA, 15 bp, Homo sapiens
gctgccccagctgac

SEQ ID NO: 365274 - DNA, 21 bp, Homo sapiens
gctgcccccagaccccatcca

SEQ ID NO: 365275 - DNA, 13 bp, Homo sapiens
gctgcccctgtag

SEQ ID NO: 365276 - DNA, 15 bp, Homo sapiens
gctgcccctgtctgg

SEQ ID NO: 365277 - DNA, 16 bp, Homo sapiens
gctgccctaggctccg

SEQ ID NO: 365278 - DNA, 21 bp, Homo sapiens
gctgccctccatcccgacatg

SEQ ID NO: 365279 - DNA, 12 bp, Homo sapiens
gctgccctggtg

SEQ ID NO: 365280 - DNA, 13 bp, Homo sapiens
gctgccctggtgc

SEQ ID NO: 365281 - DNA, 15 bp, Homo sapiens
gctgccctggtgctg

SEQ ID NO: 365282 - DNA, 20 bp, Homo sapiens
gctgccctggtgctgccaca

SEQ ID NO: 365283 - DNA, 22 bp, Homo sapiens
gctgccctggtgctgccacact

SEQ ID NO: 365284 - DNA, 15 bp, Homo sapiens
gctgccgcctcccag

SEQ ID NO: 365285 - DNA, 15 bp, Homo sapiens
gctgcctaagaggca

SEQ ID NO: 365286 - DNA, 13 bp, Homo sapiens
gctgcctccccaa

SEQ ID NO: 365287 - DNA, 17 bp, Homo sapiens
gctgcctccccaaccct

SEQ ID NO: 365288 - DNA, 21 bp, Homo sapiens
gctgcctccccaaccctgccc

SEQ ID NO: 365289 - DNA, 14 bp, Homo sapiens
gctgcctccctggg

SEQ ID NO: 365290 - DNA, 18 bp, Homo sapiens
gctgcctctgaaaatatt

SEQ ID NO: 365291 - DNA, 22 bp, Homo sapiens
gctgcctctgacagcagcctgt

SEQ ID NO: 365292 - DNA, 15 bp, Homo sapiens
gctgcctctgggtga

SEQ ID NO: 365293 - DNA, 16 bp, Homo sapiens
gctgcctctgggtgag

SEQ ID NO: 365294 - DNA, 14 bp, Homo sapiens
gctgcctgaaaacc

SEQ ID NO: 365295 - DNA, 21 bp, Homo sapiens
gctgcctgaaacagccatgtc

SEQ ID NO: 365296 - DNA, 22 bp, Homo sapiens
gctgcctgacactgagccccac

SEQ ID NO: 365297 - DNA, 23 bp, Homo sapiens
gctgcctgacactgagccccacc

SEQ ID NO: 365298 - DNA, 22 bp, Homo sapiens
gctgcctgcccgcacagcagcc

SEQ ID NO: 365299 - DNA, 23 bp, Homo sapiens
gctgcctgcccgcacagcagcct

SEQ ID NO: 365300 - DNA, 17 bp, Homo sapiens
gctgcctgcctccggcc

SEQ ID NO: 365301 - DNA, 15 bp, Homo sapiens
gctgcctgcctgtct

SEQ ID NO: 365302 - DNA, 21 bp, Homo sapiens
gctgcctgctctgcagcccac

SEQ ID NO: 365303 - DNA, 19 bp, Homo sapiens
gctgcctggcccccagctg

SEQ ID NO: 365304 - DNA, 22 bp, Homo sapiens
gctgcctggcccccagctgtgg

SEQ ID NO: 365305 - DNA, 15 bp, Homo sapiens
gctgcctggcgggca

SEQ ID NO: 365306 - DNA, 19 bp, Homo sapiens
gctgcctggcgggcagccc

SEQ ID NO: 365307 - DNA, 20 bp, Homo sapiens
gctgcctggcgggcagcccc

SEQ ID NO: 365308 - DNA, 21 bp, Homo sapiens
gctgcctggcgggcagcccct

SEQ ID NO: 365309 - DNA, 15 bp, Homo sapiens
gctgcctgtagttag

SEQ ID NO: 365310 - DNA, 16 bp, Homo sapiens
gctgcctgtagttagg

SEQ ID NO: 365311 - DNA, 20 bp, Homo sapiens
gctgcctgtagttaggaaat

SEQ ID NO: 365312 - DNA, 22 bp, Homo sapiens
gctgccttaatgacattcccct

SEQ ID NO: 365313 - DNA, 20 bp, Homo sapiens
gctgccttagaacctttctt

SEQ ID NO: 365314 - DNA, 12 bp, Homo sapiens
gctgccttcagg

SEQ ID NO: 365315 - DNA, 20 bp, Homo sapiens
gctgcctttagtcgctgagg

SEQ ID NO: 365316 - DNA, 19 bp, Homo sapiens
gctgcgcccttaccttccc

SEQ ID NO: 365317 - DNA, 12 bp, Homo sapiens
gctgcgcctgcc

SEQ ID NO: 365318 - DNA, 14 bp, Homo sapiens
gctgcgcctgcccg

SEQ ID NO: 365319 - DNA, 15 bp, Homo sapiens
gctgcgggtctgaag

SEQ ID NO: 365320 - DNA, 17 bp, Homo sapiens
gctgcgggtctgaagga

SEQ ID NO: 365321 - DNA, 21 bp, Homo sapiens
gctgcgtcagaccagtactgg

SEQ ID NO: 365322 - DNA, 18 bp, Homo sapiens
gctgctaatcttcagggc

SEQ ID NO: 365323 - DNA, 23 bp, Homo sapiens
gctgctacttaattcctttctca

SEQ ID NO: 365324 - DNA, 14 bp, Homo sapiens
gctgctatgaaaat

SEQ ID NO: 365325 - DNA, 17 bp, Homo sapiens
gctgctcatgggaagaa

SEQ ID NO: 365326 - DNA, 23 bp, Homo sapiens
gctgctccatggatgcatgccct

SEQ ID NO: 365327 - DNA, 15 bp, Homo sapiens
gctgctcccagccac

SEQ ID NO: 365328 - DNA, 19 bp, Homo sapiens
gctgctcccagcctcttgc

SEQ ID NO: 365329 - DNA, 21 bp, Homo sapiens
gctgctccccacccctaccga

SEQ ID NO: 365330 - DNA, 16 bp, Homo sapiens
gctgggccccatgctc

SEQ ID NO: 365331 - DNA, 17 bp, Homo sapiens
gctgggccccccagctc

SEQ ID NO: 365332 - DNA, 18 bp, Homo sapiens
gctgggccccccagctca

SEQ ID NO: 365333 - DNA, 20 bp, Homo sapiens
gctgggccccccagctcagg

SEQ ID NO: 365334 - DNA, 15 bp, Homo sapiens
gctgggccctctgtc

SEQ ID NO: 365335 - DNA, 12 bp, Homo sapiens
gctgggcctcat

SEQ ID NO: 365336 - DNA, 14 bp, Homo sapiens
gctgggctctgcca

SEQ ID NO: 365337 - DNA, 19 bp, Homo sapiens
gctgggctctgtcttcctg

SEQ ID NO: 365338 - DNA, 13 bp, Homo sapiens
gctgggctgagcc

SEQ ID NO: 365339 - DNA, 20 bp, Homo sapiens
gctgggctgagcccctaccc

SEQ ID NO: 365340 - DNA, 22 bp, Homo sapiens
gctgggctgagcccctacccca

SEQ ID NO: 365341 - DNA, 15 bp, Homo sapiens
gctgggcttacaggc

SEQ ID NO: 365342 - DNA, 13 bp, Homo sapiens
gctggggacagct

SEQ ID NO: 365343 - DNA, 21 bp, Homo sapiens
gctggggacagctttcctggg

SEQ ID NO: 365344 - DNA, 16 bp, Homo sapiens
gctggggagcagctga

SEQ ID NO: 365345 - DNA, 17 bp, Homo sapiens
gctggggagcagctgag

SEQ ID NO: 365346 - DNA, 15 bp, Homo sapiens
gctggggccggagcc

SEQ ID NO: 365347 - DNA, 12 bp, Homo sapiens
gctggggcctgg

SEQ ID NO: 365348 - DNA, 14 bp, Homo sapiens
gctggggcctggcc

SEQ ID NO: 365349 - DNA, 16 bp, Homo sapiens
gctggggcctggccta

SEQ ID NO: 365350 - DNA, 20 bp, Homo sapiens
gctggggcttttgtgccagg

SEQ ID NO: 365351 - DNA, 13 bp, Homo sapiens
gctgggggcagga

SEQ ID NO: 365352 - DNA, 16 bp, Homo sapiens
gctggggggctgtcct

SEQ ID NO: 365353 - DNA, 18 bp, Homo sapiens
gctggggggctgtcctga

SEQ ID NO: 365354 - DNA, 18 bp, Homo sapiens
gctgggggtgaggggcca

SEQ ID NO: 365355 - DNA, 21 bp, Homo sapiens
gctgggggtgaggggccaggc

SEQ ID NO: 365356 - DNA, 22 bp, Homo sapiens
gctggggtacacagtgagagta

SEQ ID NO: 365357 - DNA, 18 bp, Homo sapiens
gctggggtgagagaggaa

SEQ ID NO: 365358 - DNA, 15 bp, Homo sapiens
gctgggtaccaggcc

SEQ ID NO: 365359 - DNA, 17 bp, Homo sapiens
gctgggtaccaggccac

SEQ ID NO: 365360 - DNA, 15 bp, Homo sapiens
gctgggtcgcccctc

SEQ ID NO: 365361 - DNA, 16 bp, Homo sapiens
gctgggtcgcccctcc

SEQ ID NO: 365362 - DNA, 14 bp, Homo sapiens
gctgggtggcctgt

SEQ ID NO: 365363 - DNA, 20 bp, Homo sapiens
gctgggtgggcccagaactg

SEQ ID NO: 365364 - DNA, 13 bp, Homo sapiens
gctgggtggtcag

SEQ ID NO: 365365 - DNA, 16 bp, Homo sapiens
gctgggtggtcagcag

SEQ ID NO: 365366 - DNA, 21 bp, Homo sapiens
gctgggtttccacacagcctg

SEQ ID NO: 365367 - DNA, 17 bp, Homo sapiens
gctgggtttgggcagtg

SEQ ID NO: 365368 - DNA, 22 bp, Homo sapiens
gctgggttttcaggggctttgg

SEQ ID NO: 365369 - DNA, 14 bp, Homo sapiens
gctggtaaactatt

SEQ ID NO: 365370 - DNA, 15 bp, Homo sapiens
gctggtaagggccaa

SEQ ID NO: 365371 - DNA, 23 bp, Homo sapiens
gctggtaatttgtatctgaagga

SEQ ID NO: 365372 - DNA, 17 bp, Homo sapiens
gctggtagagatggagg

SEQ ID NO: 365373 - DNA, 16 bp, Homo sapiens
gctggtattctctcta

SEQ ID NO: 365374 - DNA, 20 bp, Homo sapiens
gctggtattctctctatgca

SEQ ID NO: 365375 - DNA, 23 bp, Homo sapiens
gctggtcacccccacccccgggt

SEQ ID NO: 365376 - DNA, 13 bp, Homo sapiens
gctggtcactgcc

SEQ ID NO: 365377 - DNA, 20 bp, Homo sapiens
gctggtctattttgattttg

SEQ ID NO: 365378 - DNA, 16 bp, Homo sapiens
gctggtgacagccttg

SEQ ID NO: 365379 - DNA, 17 bp, Homo sapiens
gctggtgacagccttgg

SEQ ID NO: 365380 - DNA, 22 bp, Homo sapiens
gctggtgcattacagagaggag

SEQ ID NO: 365381 - DNA, 15 bp, Homo sapiens
gctggtgccagcctt

SEQ ID NO: 365382 - DNA, 16 bp, Homo sapiens
gctggtgccccacagc

SEQ ID NO: 365383 - DNA, 17 bp, Homo sapiens
gctggtggatggtgact

SEQ ID NO: 365384 - DNA, 21 bp, Homo sapiens
gctggtgggcaccaagagcca

SEQ ID NO: 365385 - DNA, 15 bp, Homo sapiens
gctggtgtcactctg

SEQ ID NO: 365386 - DNA, 16 bp, Homo sapiens
gctggtgtccccttcc

SEQ ID NO: 365387 - DNA, 18 bp, Homo sapiens
gctggtgtccccttcccc

SEQ ID NO: 365388 - DNA, 21 bp, Homo sapiens
gctggtgtccccttcccctgc

SEQ ID NO: 365389 - DNA, 18 bp, Homo sapiens
gctggttgttgccaggtt

SEQ ID NO: 365390 - DNA, 21 bp, Homo sapiens
gctggttgttgccaggttgca

SEQ ID NO: 365391 - DNA, 22 bp, Homo sapiens
gctggttgttgccaggttgcag

SEQ ID NO: 365392 - DNA, 23 bp, Homo sapiens
gctggttttcctaaatgcagtga

SEQ ID NO: 365393 - DNA, 21 bp, Homo sapiens
gctgtaaaaacacaaatgtgt

SEQ ID NO: 365394 - DNA, 16 bp, Homo sapiens
gctgtaaataaaaata

SEQ ID NO: 365395 - DNA, 22 bp, Homo sapiens
gctgtaaatcctagacttgaaa

SEQ ID NO: 365396 - DNA, 17 bp, Homo sapiens
gctgtaactgctgagcc

SEQ ID NO: 365397 - DNA, 18 bp, Homo sapiens
gctgtaactgctgagcca

SEQ ID NO: 365398 - DNA, 24 bp, Homo sapiens
gctgtaagaagagactgggaagat

SEQ ID NO: 365399 - DNA, 13 bp, Homo sapiens
gctgtaagcattc

SEQ ID NO: 365400 - DNA, 12 bp, Homo sapiens
gctgtaatttaa

SEQ ID NO: 365401 - DNA, 14 bp, Homo sapiens
gctgtacacaccct

SEQ ID NO: 365402 - DNA, 14 bp, Homo sapiens
gctgtacccttcca

SEQ ID NO: 365403 - DNA, 17 bp, Homo sapiens
gctgtactagtgccatt

SEQ ID NO: 365404 - DNA, 15 bp, Homo sapiens
gctgtactcagagca

SEQ ID NO: 365405 - DNA, 20 bp, Homo sapiens
gctgtagccatggctcaggc

SEQ ID NO: 365406 - DNA, 22 bp, Homo sapiens
gctgtataactgtgcagagact

SEQ ID NO: 365407 - DNA, 15 bp, Homo sapiens
gctgtatacaaacag

SEQ ID NO: 365408 - DNA, 18 bp, Homo sapiens
gctgtatacaaacaggtg

SEQ ID NO: 365409 - DNA, 13 bp, Homo sapiens
gctgtatggtata

SEQ ID NO: 365410 - DNA, 19 bp, Homo sapiens
gctgtatttttagagatta

SEQ ID NO: 365411 - DNA, 17 bp, Homo sapiens
gctgtcaattacaggaa

SEQ ID NO: 365412 - DNA, 19 bp, Homo sapiens
gctgtcaattacaggaagt

SEQ ID NO: 365413 - DNA, 22 bp, Homo sapiens
gctgtcaattacaggaagtact

SEQ ID NO: 365414 - DNA, 19 bp, Homo sapiens
gctgtcacccagcaaggca

SEQ ID NO: 365415 - DNA, 14 bp, Homo sapiens
gctgtcccaggggt

SEQ ID NO: 365416 - DNA, 12 bp, Homo sapiens
gctgtcccctct

SEQ ID NO: 365417 - DNA, 20 bp, Homo sapiens
gctgtccctcctgaggtctg

SEQ ID NO: 365418 - DNA, 23 bp, Homo sapiens
gctgtcctctcagaactcctgtg

SEQ ID NO: 365419 - DNA, 21 bp, Homo sapiens
gctgtcctgagccccctgcac

SEQ ID NO: 365420 - DNA, 13 bp, Homo sapiens
gctgtcctgcagt

SEQ ID NO: 365421 - DNA, 16 bp, Homo sapiens
gctgtcctgcagtaga

SEQ ID NO: 365422 - DNA, 17 bp, Homo sapiens
gctgtcgtccccctcca

SEQ ID NO: 365423 - DNA, 21 bp, Homo sapiens
gctgtcgtccccctccagtgc

SEQ ID NO: 365424 - DNA, 14 bp, Homo sapiens
gctgtctccagacc

SEQ ID NO: 365425 - DNA, 15 bp, Homo sapiens
gctgtctccagaccc

SEQ ID NO: 365426 - DNA, 17 bp, Homo sapiens
gctgtctccatgtttga

SEQ ID NO: 365427 - DNA, 13 bp, Homo sapiens
gctgtctgcctgt

SEQ ID NO: 365428 - DNA, 20 bp, Homo sapiens
gctgtgaaacagtgtggatg

SEQ ID NO: 365429 - DNA, 18 bp, Homo sapiens
gctgtgaacatggactct

SEQ ID NO: 365430 - DNA, 18 bp, Homo sapiens
gctgtgacaataagtttg

SEQ ID NO: 365431 - DNA, 15 bp, Homo sapiens
gctgtgactgagggc

SEQ ID NO: 365432 - DNA, 14 bp, Homo sapiens
gctgtgagcagcct

SEQ ID NO: 365433 - DNA, 15 bp, Homo sapiens
gctgtgagcagcctc

SEQ ID NO: 365434 - DNA, 17 bp, Homo sapiens
gctgtgagcagcctcca

SEQ ID NO: 365435 - DNA, 11 bp, Homo sapiens
gctgtgaggaa

SEQ ID NO: 365436 - DNA, 21 bp, Homo sapiens
gctgtgaggaatgctctgtgc

SEQ ID NO: 365437 - DNA, 13 bp, Homo sapiens
gctgtgaggctgt

SEQ ID NO: 365438 - DNA, 15 bp, Homo sapiens
gctgtgatgcatgag

SEQ ID NO: 365439 - DNA, 20 bp, Homo sapiens
gctgtgatgcatgagctccc

SEQ ID NO: 365440 - DNA, 21 bp, Homo sapiens
gctgtgatgcatgagctccct

SEQ ID NO: 365441 - DNA, 19 bp, Homo sapiens
gctgtgccaaagcaggtca

SEQ ID NO: 365442 - DNA, 14 bp, Homo sapiens
gctgtgccaccacc

SEQ ID NO: 365443 - DNA, 15 bp, Homo sapiens
gctgtgccaccaccc

SEQ ID NO: 365444 - DNA, 15 bp, Homo sapiens
gctgtgcctctgcct

SEQ ID NO: 365445 - DNA, 16 bp, Homo sapiens
gctgtgcctctgcctg

SEQ ID NO: 365446 - DNA, 12 bp, Homo sapiens
gctgtgcctgcg

SEQ ID NO: 365447 - DNA, 16 bp, Homo sapiens
gctgtgcctgctagag

SEQ ID NO: 365448 - DNA, 14 bp, Homo sapiens
gctgtgctatgaat

SEQ ID NO: 365449 - DNA, 16 bp, Homo sapiens
gctgtgctatgaattt

SEQ ID NO: 365450 - DNA, 21 bp, Homo sapiens
gctgtgctccagcagtgctgg

SEQ ID NO: 365451 - DNA, 11 bp, Homo sapiens
gctgtgctgca

SEQ ID NO: 365452 - DNA, 22 bp, Homo sapiens
gctgtggaaaggattctaaaca

SEQ ID NO: 365453 - DNA, 22 bp, Homo sapiens
gctgtggagcaaaaggcagctc

SEQ ID NO: 365454 - DNA, 23 bp, Homo sapiens
gctgtggcaggccagctgtggtt

SEQ ID NO: 365455 - DNA, 18 bp, Homo sapiens
gctgtggcatcaggaaag

SEQ ID NO: 365456 - DNA, 20 bp, Homo sapiens
gctgtggccgtctcctccct

SEQ ID NO: 365457 - DNA, 18 bp, Homo sapiens
gctgtgggcctcaaggac

SEQ ID NO: 365458 - DNA, 15 bp, Homo sapiens
gctgtgggtcagtgt

SEQ ID NO: 365459 - DNA, 13 bp, Homo sapiens
gctgtggttttct

SEQ ID NO: 365460 - DNA, 15 bp, Homo sapiens
gcttttattgtataa

SEQ ID NO: 365461 - DNA, 22 bp, Homo sapiens
gcttttcactgctggctgcctt

SEQ ID NO: 365462 - DNA, 23 bp, Homo sapiens
gcttttcactgctggctgcctta

SEQ ID NO: 365463 - DNA, 16 bp, Homo sapiens
gcttttcatggaagtg

SEQ ID NO: 365464 - DNA, 22 bp, Homo sapiens
gcttttcatgtagaactcagca

SEQ ID NO: 365465 - DNA, 17 bp, Homo sapiens
gcttttcccacctcttt

SEQ ID NO: 365466 - DNA, 15 bp, Homo sapiens
gcttttcctcccttg

SEQ ID NO: 365467 - DNA, 15 bp, Homo sapiens
gcttttctcatggta

SEQ ID NO: 365468 - DNA, 13 bp, Homo sapiens
gcttttcttgcca

SEQ ID NO: 365469 - DNA, 15 bp, Homo sapiens
gcttttgctggtcac

SEQ ID NO: 365470 - DNA, 19 bp, Homo sapiens
gcttttgctggtcactgcc

SEQ ID NO: 365471 - DNA, 21 bp, Homo sapiens
gcttttgtctaattaaaacac

SEQ ID NO: 365472 - DNA, 15 bp, Homo sapiens
gcttttgttctagac

SEQ ID NO: 365473 - DNA, 15 bp, Homo sapiens
gcttttgttgtgact

SEQ ID NO: 365474 - DNA, 20 bp, Homo sapiens
gcttttgttgtgacttttta

SEQ ID NO: 365475 - DNA, 19 bp, Homo sapiens
gcttttgttttcctgctgg

SEQ ID NO: 365476 - DNA, 17 bp, Homo sapiens
gctttttaaattttcca

SEQ ID NO: 365477 - DNA, 18 bp, Homo sapiens
gctttttaccgttcactt

SEQ ID NO: 365478 - DNA, 21 bp, Homo sapiens
gctttttaccgttcacttccc

SEQ ID NO: 365479 - DNA, 22 bp, Homo sapiens
gctttttcccagccctttccag

SEQ ID NO: 365480 - DNA, 15 bp, Homo sapiens
gctttttggcacagt

SEQ ID NO: 365481 - DNA, 16 bp, Homo sapiens
gcttttttttttccag

SEQ ID NO: 365482 - DNA, 17 bp, Homo sapiens
gcttttttttttccagc

SEQ ID NO: 365483 - DNA, 17 bp, Homo sapiens
ggaaaaaaaaatcagct

SEQ ID NO: 365484 - DNA, 14 bp, Homo sapiens
ggaaaaaaactttt

SEQ ID NO: 365485 - DNA, 14 bp, Homo sapiens
ggaaaaaaaggtta

SEQ ID NO: 365486 - DNA, 14 bp, Homo sapiens
ggaaaaaatatttt

SEQ ID NO: 365487 - DNA, 19 bp, Homo sapiens
ggaaaaacagaacatttct

SEQ ID NO: 365488 - DNA, 13 bp, Homo sapiens
ggaaaaaggcttc

SEQ ID NO: 365489 - DNA, 19 bp, Homo sapiens
ggaaaaagtgggtttttta

SEQ ID NO: 365490 - DNA, 20 bp, Homo sapiens
ggaaaacaaatcactgtatt

SEQ ID NO: 365491 - DNA, 15 bp, Homo sapiens
ggaaaacaatttgca

SEQ ID NO: 365492 - DNA, 18 bp, Homo sapiens
ggaaaacaatttgcataa

SEQ ID NO: 365493 - DNA, 16 bp, Homo sapiens
ggaaaacataaaaatc

SEQ ID NO: 365494 - DNA, 19 bp, Homo sapiens
ggaaaacataatatcttga

SEQ ID NO: 365495 - DNA, 15 bp, Homo sapiens
ggaaaacgatttaat

SEQ ID NO: 365496 - DNA, 19 bp, Homo sapiens
ggaaaactcaccatttcat

SEQ ID NO: 365497 - DNA, 18 bp, Homo sapiens
ggaaaagaaatcaatttt

SEQ ID NO: 365498 - DNA, 21 bp, Homo sapiens
ggaaaagagtatcaaaggcag

SEQ ID NO: 365499 - DNA, 17 bp, Homo sapiens
ggaaaagggagaaaaag

SEQ ID NO: 365500 - DNA, 15 bp, Homo sapiens
ggaaaagtacattta

SEQ ID NO: 365501 - DNA, 15 bp, Homo sapiens
ggaaaatatcacttt

SEQ ID NO: 365502 - DNA, 12 bp, Homo sapiens
ggaaacagaact

SEQ ID NO: 365503 - DNA, 13 bp, Homo sapiens
ggaaacagaactc

SEQ ID NO: 365504 - DNA, 23 bp, Homo sapiens
ggaaacagaactcgatgcactga

SEQ ID NO: 365505 - DNA, 17 bp, Homo sapiens
ggaaaccaagtggtcag

SEQ ID NO: 365506 - DNA, 15 bp, Homo sapiens
ggaaaccatgcacta

SEQ ID NO: 365507 - DNA, 12 bp, Homo sapiens
ggaaacctgccc

SEQ ID NO: 365508 - DNA, 18 bp, Homo sapiens
ggaaacctgccctgcctg

SEQ ID NO: 365509 - DNA, 22 bp, Homo sapiens
ggaaacctgccctgcctgaggg

SEQ ID NO: 365510 - DNA, 15 bp, Homo sapiens
ggaaacgtgccctct

SEQ ID NO: 365511 - DNA, 17 bp, Homo sapiens
ggaaactgaggcccaga

SEQ ID NO: 365512 - DNA, 22 bp, Homo sapiens
ggaaagaaagcacctgttttta

SEQ ID NO: 365513 - DNA, 15 bp, Homo sapiens
ggaaagacaggaaga

SEQ ID NO: 365514 - DNA, 17 bp, Homo sapiens
ggaaagacaggaagacc

SEQ ID NO: 365515 - DNA, 19 bp, Homo sapiens
ggaaagaggagaaggagag

SEQ ID NO: 365516 - DNA, 15 bp, Homo sapiens
ggaaagattgtgtct

SEQ ID NO: 365517 - DNA, 16 bp, Homo sapiens
ggaaagattgtgtctg

SEQ ID NO: 365518 - DNA, 20 bp, Homo sapiens
ggaaagcaccgcagcatgtg

SEQ ID NO: 365519 - DNA, 19 bp, Homo sapiens
ggaaagccagtgactccag

SEQ ID NO: 365520 - DNA, 21 bp, Homo sapiens
ggaaagccagtgactccagga

SEQ ID NO: 365521 - DNA, 15 bp, Homo sapiens
ggaaaggcagtatgg

SEQ ID NO: 365522 - DNA, 16 bp, Homo sapiens
ggaaaggtgctcaaag

SEQ ID NO: 365523 - DNA, 13 bp, Homo sapiens
ggaaagtgaattt

SEQ ID NO: 365524 - DNA, 16 bp, Homo sapiens
ggaaataaaacctttc

SEQ ID NO: 365525 - DNA, 14 bp, Homo sapiens
ggaaatatatatgt

SEQ ID NO: 365526 - DNA, 12 bp, Homo sapiens
ggaaatatcata

SEQ ID NO: 365527 - DNA, 17 bp, Homo sapiens
ggaaatccagccccata

SEQ ID NO: 365528 - DNA, 13 bp, Homo sapiens
ggaaatcctgtta

SEQ ID NO: 365529 - DNA, 18 bp, Homo sapiens
ggaaatctcaccccatcc

SEQ ID NO: 365530 - DNA, 17 bp, Homo sapiens
ggaaatgtcaacaagta

SEQ ID NO: 365531 - DNA, 22 bp, Homo sapiens
ggaaattcaaccccagaaattg

SEQ ID NO: 365532 - DNA, 18 bp, Homo sapiens
ggaaattcttgcactgta

SEQ ID NO: 365533 - DNA, 23 bp, Homo sapiens
ggaacaaggcaaggctgtcaatt

SEQ ID NO: 365534 - DNA, 16 bp, Homo sapiens
ggaacaatcacaaaag

SEQ ID NO: 365535 - DNA, 17 bp, Homo sapiens
ggaacacccagccccag

SEQ ID NO: 365536 - DNA, 21 bp, Homo sapiens
ggaacaccccataactacaga

SEQ ID NO: 365537 - DNA, 14 bp, Homo sapiens
ggaacactggcctg

SEQ ID NO: 365538 - DNA, 16 bp, Homo sapiens
ggaacagacctcggct

SEQ ID NO: 365539 - DNA, 20 bp, Homo sapiens
ggaacagagtatatatgtac

SEQ ID NO: 365540 - DNA, 21 bp, Homo sapiens
ggaacagatgctaataaactg

SEQ ID NO: 365541 - DNA, 19 bp, Homo sapiens
ggaacagctatgggagccc

SEQ ID NO: 365542 - DNA, 16 bp, Homo sapiens
ggaacaggaggaactg

SEQ ID NO: 365543 - DNA, 16 bp, Homo sapiens
ggaacagtggctgggt

SEQ ID NO: 365544 - DNA, 17 bp, Homo sapiens
ggaacagtggctgggtg

SEQ ID NO: 365545 - DNA, 23 bp, Homo sapiens
ggaacagtgtttcccataatttt

SEQ ID NO: 365546 - DNA, 17 bp, Homo sapiens
ggaacatatgcacaggg

SEQ ID NO: 365547 - DNA, 12 bp, Homo sapiens
ggaaccagagcc

SEQ ID NO: 365548 - DNA, 19 bp, Homo sapiens
ggaaccagagccatggact

SEQ ID NO: 365549 - DNA, 19 bp, Homo sapiens
ggaaccagggaggagagga

SEQ ID NO: 365550 - DNA, 20 bp, Homo sapiens
ggaacccggtcccaggccgc

SEQ ID NO: 365551 - DNA, 21 bp, Homo sapiens
ggaacccggtcccaggccgca

SEQ ID NO: 365552 - DNA, 18 bp, Homo sapiens
ggaacctagtactctctg

SEQ ID NO: 365553 - DNA, 22 bp, Homo sapiens
ggaacctagtactctctgctct

SEQ ID NO: 365554 - DNA, 23 bp, Homo sapiens
ggaacctagtactctctgctcta

SEQ ID NO: 365555 - DNA, 21 bp, Homo sapiens
ggaacctccctgggcctgtct

SEQ ID NO: 365556 - DNA, 14 bp, Homo sapiens
ggaacctggctgcg

SEQ ID NO: 365557 - DNA, 13 bp, Homo sapiens
ggaacgagcactg

SEQ ID NO: 365558 - DNA, 16 bp, Homo sapiens
ggaacgagcactggcc

SEQ ID NO: 365559 - DNA, 17 bp, Homo sapiens
ggaacgcagcctccagt

SEQ ID NO: 365560 - DNA, 22 bp, Homo sapiens
ggaacggtgaaggtgacagcag

SEQ ID NO: 365561 - DNA, 15 bp, Homo sapiens
ggaacgttggacttt

SEQ ID NO: 365562 - DNA, 22 bp, Homo sapiens
ggaactaaagggtgtgggtcag

SEQ ID NO: 365563 - DNA, 18 bp, Homo sapiens
ggaactagactgcctggg

SEQ ID NO: 365564 - DNA, 15 bp, Homo sapiens
ggaactcccaagaac

SEQ ID NO: 365565 - DNA, 19 bp, Homo sapiens
ggaactctgtgcaggtgct

SEQ ID NO: 365566 - DNA, 16 bp, Homo sapiens
ggaactgcatgctgct

SEQ ID NO: 365567 - DNA, 12 bp, Homo sapiens
ggaactgctgcc

SEQ ID NO: 365568 - DNA, 15 bp, Homo sapiens
ggaactgcttgccca

SEQ ID NO: 365569 - DNA, 15 bp, Homo sapiens
ggaactgggaagatg

SEQ ID NO: 365570 - DNA, 22 bp, Homo sapiens
ggaactgggaagatgctggccc

SEQ ID NO: 365571 - DNA, 20 bp, Homo sapiens
ggaactgggccttgtgtgct

SEQ ID NO: 365572 - DNA, 14 bp, Homo sapiens
ggaactggtccagg

SEQ ID NO: 365573 - DNA, 17 bp, Homo sapiens
ggaagacaaaatgtttt

SEQ ID NO: 365574 - DNA, 16 bp, Homo sapiens
ggaagaccaaggcctc

SEQ ID NO: 365575 - DNA, 13 bp, Homo sapiens
ggaagactggaga

SEQ ID NO: 365576 - DNA, 19 bp, Homo sapiens
ggaagactggagactgtcc

SEQ ID NO: 365577 - DNA, 17 bp, Homo sapiens
ggaagacttggcccagg

SEQ ID NO: 365578 - DNA, 19 bp, Homo sapiens
ggaagacttggcccaggaa

SEQ ID NO: 365579 - DNA, 22 bp, Homo sapiens
ggaagagaggagttcaatgatc

SEQ ID NO: 365580 - DNA, 23 bp, Homo sapiens
ggaagagaggagttcaatgatct

SEQ ID NO: 365581 - DNA, 12 bp, Homo sapiens
ggaagagaggca

SEQ ID NO: 365582 - DNA, 14 bp, Homo sapiens
ggaagagaggcacc

SEQ ID NO: 365583 - DNA, 17 bp, Homo sapiens
ggaagagaggcacctgc

SEQ ID NO: 365584 - DNA, 15 bp, Homo sapiens
ggaagagatgctcta

SEQ ID NO: 365585 - DNA, 12 bp, Homo sapiens
ggaagagcagcc

SEQ ID NO: 365586 - DNA, 13 bp, Homo sapiens
ggaagagcagcct

SEQ ID NO: 365587 - DNA, 14 bp, Homo sapiens
ggaagagcagcctg

SEQ ID NO: 365588 - DNA, 22 bp, Homo sapiens
ggaagagggagggtcagtgcca

SEQ ID NO: 365589 - DNA, 21 bp, Homo sapiens
ggaagagggcagtacctggga

SEQ ID NO: 365590 - DNA, 16 bp, Homo sapiens
ggaagaggttctcagc

SEQ ID NO: 365591 - DNA, 17 bp, Homo sapiens
ggaagatcttgagagct

SEQ ID NO: 365592 - DNA, 21 bp, Homo sapiens
ggaagatcttgagagctgctg

SEQ ID NO: 365593 - DNA, 16 bp, Homo sapiens
ggaagatgctggcccc

SEQ ID NO: 365594 - DNA, 21 bp, Homo sapiens
ggaagatggttttattctttg

SEQ ID NO: 365595 - DNA, 23 bp, Homo sapiens
ggaagcaagacgtcctggaatga

SEQ ID NO: 365596 - DNA, 17 bp, Homo sapiens
ggaagcaaggccagccc

SEQ ID NO: 365597 - DNA, 21 bp, Homo sapiens
ggaagcacaagaagtgggagt

SEQ ID NO: 365598 - DNA, 14 bp, Homo sapiens
ggaagcacagcagg

SEQ ID NO: 365599 - DNA, 12 bp, Homo sapiens
ggaagcacaggc

SEQ ID NO: 365600 - DNA, 13 bp, Homo sapiens
ggaagcacaggcc

SEQ ID NO: 365601 - DNA, 15 bp, Homo sapiens
ggaagcaccccatgc

SEQ ID NO: 365602 - DNA, 13 bp, Homo sapiens
ggaagcagggaga

SEQ ID NO: 365603 - DNA, 20 bp, Homo sapiens
ggaagcaggttgcttcaaga

SEQ ID NO: 365604 - DNA, 11 bp, Homo sapiens
ggaagcagtgc

SEQ ID NO: 365605 - DNA, 12 bp, Homo sapiens
ggaagcagtgcc

SEQ ID NO: 365606 - DNA, 23 bp, Homo sapiens
ggaagcagttaagccccctcctc

SEQ ID NO: 365607 - DNA, 20 bp, Homo sapiens
ggaagccacgtgctggagag

SEQ ID NO: 365608 - DNA, 23 bp, Homo sapiens
ggaagccacgtgctggagagtag

SEQ ID NO: 365609 - DNA, 16 bp, Homo sapiens
ggaagcccaaggcagt

SEQ ID NO: 365610 - DNA, 22 bp, Homo sapiens
ggaagcccacccgccccagaga

SEQ ID NO: 365611 - DNA, 20 bp, Homo sapiens
ggaagccggagggtgtttat

SEQ ID NO: 365612 - DNA, 18 bp, Homo sapiens
ggaagccgtctgactcca

SEQ ID NO: 365613 - DNA, 17 bp, Homo sapiens
ggaagcctcctgctgag

SEQ ID NO: 365614 - DNA, 11 bp, Homo sapiens
ggaagcctgct

SEQ ID NO: 365615 - DNA, 13 bp, Homo sapiens
ggaagcctgtcct

SEQ ID NO: 365616 - DNA, 13 bp, Homo sapiens
ggaagctcctggt

SEQ ID NO: 365617 - DNA, 18 bp, Homo sapiens
ggaagctgattcccagag

SEQ ID NO: 365618 - DNA, 20 bp, Homo sapiens
ggaagctggcaggagacact

SEQ ID NO: 365619 - DNA, 22 bp, Homo sapiens
ggaagctggcaggagacactgg

SEQ ID NO: 365620 - DNA, 17 bp, Homo sapiens
ggaagctgtactcagag

SEQ ID NO: 365621 - DNA, 23 bp, Homo sapiens
ggaagctgtactcagagcagagc

SEQ ID NO: 365622 - DNA, 15 bp, Homo sapiens
ggaagcttggggaac

SEQ ID NO: 365623 - DNA, 22 bp, Homo sapiens
ggaagctttctctgcttcagct

SEQ ID NO: 365624 - DNA, 12 bp, Homo sapiens
ggaaggaccaac

SEQ ID NO: 365625 - DNA, 12 bp, Homo sapiens
ggaaggagagaa

SEQ ID NO: 365626 - DNA, 18 bp, Homo sapiens
ggaaggagggagctgctc

SEQ ID NO: 365627 - DNA, 20 bp, Homo sapiens
ggaaggaggggaagctgcag

SEQ ID NO: 365628 - DNA, 14 bp, Homo sapiens
ggaaggcagggcag

SEQ ID NO: 365629 - DNA, 17 bp, Homo sapiens
ggaaggcagggcagagg

SEQ ID NO: 365630 - DNA, 19 bp, Homo sapiens
ggaaggcatgcctggacaa

SEQ ID NO: 365631 - DNA, 18 bp, Homo sapiens
ggaaggccacctgcaggt

SEQ ID NO: 365632 - DNA, 15 bp, Homo sapiens
ggaaggcctgaggga

SEQ ID NO: 365633 - DNA, 21 bp, Homo sapiens
ggaaggcctgagggaagccca

SEQ ID NO: 365634 - DNA, 22 bp, Homo sapiens
ggaaggcctgagggaagcccac

SEQ ID NO: 365635 - DNA, 13 bp, Homo sapiens
ggaaggccttgct

SEQ ID NO: 365636 - DNA, 23 bp, Homo sapiens
ggaagggactggtccaggcatgg

SEQ ID NO: 365637 - DNA, 15 bp, Homo sapiens
ggaagggcaggaagg

SEQ ID NO: 365638 - DNA, 17 bp, Homo sapiens
ggaagggcatccttctg

SEQ ID NO: 365639 - DNA, 12 bp, Homo sapiens
ggaaggtatcac

SEQ ID NO: 365640 - DNA, 14 bp, Homo sapiens
ggaaggtgatgggg

SEQ ID NO: 365641 - DNA, 20 bp, Homo sapiens
ggaagtagatgtgaaaaagc

SEQ ID NO: 365642 - DNA, 15 bp, Homo sapiens
ggaagtcaggagcca

SEQ ID NO: 365643 - DNA, 17 bp, Homo sapiens
ggaagtgacttgaatgt

SEQ ID NO: 365644 - DNA, 23 bp, Homo sapiens
ggaagtgacttgaatgtacaaag

SEQ ID NO: 365645 - DNA, 23 bp, Homo sapiens
ggaagtggattctggatggccgg

SEQ ID NO: 365646 - DNA, 17 bp, Homo sapiens
ggaagtggcctgagaag

SEQ ID NO: 365647 - DNA, 17 bp, Homo sapiens
ggaagtgggagaagtgg

SEQ ID NO: 365648 - DNA, 17 bp, Homo sapiens
ggaagtgtaacagctga

SEQ ID NO: 365649 - DNA, 17 bp, Homo sapiens
ggaagtttgtgttctgt

SEQ ID NO: 365650 - DNA, 14 bp, Homo sapiens
ggaataacactgca

SEQ ID NO: 365651 - DNA, 13 bp, Homo sapiens
ggaataataccta

SEQ ID NO: 365652 - DNA, 21 bp, Homo sapiens
ggaataattatttatttaata

SEQ ID NO: 365653 - DNA, 17 bp, Homo sapiens
ggaatagcatgtcacta

SEQ ID NO: 365654 - DNA, 16 bp, Homo sapiens
ggaatagccagagagg

SEQ ID NO: 365655 - DNA, 17 bp, Homo sapiens
ggaataggtaggagacc

SEQ ID NO: 365656 - DNA, 22 bp, Homo sapiens
ggaatattcccctatctctaga

SEQ ID NO: 365657 - DNA, 18 bp, Homo sapiens
ggaatccagaaggaagct

SEQ ID NO: 365658 - DNA, 19 bp, Homo sapiens
ggaatccagtgcttccaca

SEQ ID NO: 365659 - DNA, 21 bp, Homo sapiens
ggaatcccacttatcaaatca

SEQ ID NO: 365660 - DNA, 14 bp, Homo sapiens
ggaatcccagctcc

SEQ ID NO: 365661 - DNA, 19 bp, Homo sapiens
ggaatcgaggaaccagagc

SEQ ID NO: 365662 - DNA, 21 bp, Homo sapiens
ggaatcgaggaaccagagcca

SEQ ID NO: 365663 - DNA, 20 bp, Homo sapiens
ggaatctgccttccagccca

SEQ ID NO: 365664 - DNA, 13 bp, Homo sapiens
ggaatgaagcatg

SEQ ID NO: 365665 - DNA, 19 bp, Homo sapiens
ggaatgaatgtcagtgtga

SEQ ID NO: 365666 - DNA, 18 bp, Homo sapiens
ggaatgcagggaagaggg

SEQ ID NO: 365667 - DNA, 20 bp, Homo sapiens
ggaatgcagggaagagggca

SEQ ID NO: 365668 - DNA, 15 bp, Homo sapiens
ggaatgcctgtgcca

SEQ ID NO: 365669 - DNA, 14 bp, Homo sapiens
ggaatgcggcaaga

SEQ ID NO: 365670 - DNA, 16 bp, Homo sapiens
ggaatgcggcaagaag

SEQ ID NO: 365671 - DNA, 11 bp, Homo sapiens
ggaatgctcaa

SEQ ID NO: 365672 - DNA, 15 bp, Homo sapiens
ggaatgcttggaata

SEQ ID NO: 365673 - DNA, 21 bp, Homo sapiens
ggaatggaaggctttgccatg

SEQ ID NO: 365674 - DNA, 12 bp, Homo sapiens
ggaatggggacc

SEQ ID NO: 365675 - DNA, 15 bp, Homo sapiens
ggaatgggggcagaa

SEQ ID NO: 365676 - DNA, 17 bp, Homo sapiens
ggaatgtgcccctggcc

SEQ ID NO: 365677 - DNA, 17 bp, Homo sapiens
ggaatgttccctgcacc

SEQ ID NO: 365678 - DNA, 19 bp, Homo sapiens
ggaatgttccctgcaccct

SEQ ID NO: 365679 - DNA, 21 bp, Homo sapiens
ggaatgttccctgcaccctgg

SEQ ID NO: 365680 - DNA, 13 bp, Homo sapiens
ggaattaaaacaa

SEQ ID NO: 365681 - DNA, 16 bp, Homo sapiens
ggaattaacctggtgc

SEQ ID NO: 365682 - DNA, 22 bp, Homo sapiens
ggaattaagttatctttaaaat

SEQ ID NO: 365683 - DNA, 22 bp, Homo sapiens
ggaattacctgataagggagag

SEQ ID NO: 365684 - DNA, 15 bp, Homo sapiens
ggaattcagcaccct

SEQ ID NO: 365685 - DNA, 21 bp, Homo sapiens
ggaattcagcaccctgggtgc

SEQ ID NO: 365686 - DNA, 22 bp, Homo sapiens
ggaattcagcaccctgggtgcc

SEQ ID NO: 365687 - DNA, 22 bp, Homo sapiens
ggaattccttggagccactggg

SEQ ID NO: 365688 - DNA, 19 bp, Homo sapiens
ggaattgacttcagcaggg

SEQ ID NO: 365689 - DNA, 16 bp, Homo sapiens
ggaatttgtaacctca

SEQ ID NO: 365690 - DNA, 18 bp, Homo sapiens
ggaattttataagctgaa

SEQ ID NO: 365691 - DNA, 19 bp, Homo sapiens
ggaattttcattggatgca

SEQ ID NO: 365692 - DNA, 23 bp, Homo sapiens
ggacaaagaaatagcaagagatg

SEQ ID NO: 365693 - DNA, 14 bp, Homo sapiens
ggacaacctgcccc

SEQ ID NO: 365694 - DNA, 13 bp, Homo sapiens
ggacaagaagctg

SEQ ID NO: 365695 - DNA, 16 bp, Homo sapiens
ggacaagaagctgcta

SEQ ID NO: 365696 - DNA, 13 bp, Homo sapiens
ggacaagagcagg

SEQ ID NO: 365697 - DNA, 21 bp, Homo sapiens
ggacaagccaacttgtaaata

SEQ ID NO: 365698 - DNA, 14 bp, Homo sapiens
ggacaagggattct

SEQ ID NO: 365699 - DNA, 19 bp, Homo sapiens
ggacaagggattctgggaa

SEQ ID NO: 365700 - DNA, 22 bp, Homo sapiens
ggacacaccccacaccccagcc

SEQ ID NO: 365701 - DNA, 21 bp, Homo sapiens
ggacacactgtaaacccctgg

SEQ ID NO: 365702 - DNA, 11 bp, Homo sapiens
ggacacagacc

SEQ ID NO: 365703 - DNA, 19 bp, Homo sapiens
ggacacagaccggccgcat

SEQ ID NO: 365704 - DNA, 20 bp, Homo sapiens
ggacacagaccggccgcatg

SEQ ID NO: 365705 - DNA, 12 bp, Homo sapiens
ggacacatgtcc

SEQ ID NO: 365706 - DNA, 23 bp, Homo sapiens
ggacaccatcccctcctagcaca

SEQ ID NO: 365707 - DNA, 21 bp, Homo sapiens
ggacaccccccgccccccacc

SEQ ID NO: 365708 - DNA, 15 bp, Homo sapiens
ggacacccctgctct

SEQ ID NO: 365709 - DNA, 17 bp, Homo sapiens
ggacacccctgctctac

SEQ ID NO: 365710 - DNA, 10 bp, Homo sapiens
ggacacctgc

SEQ ID NO: 365711 - DNA, 12 bp, Homo sapiens
ggacacctgccc

SEQ ID NO: 365712 - DNA, 16 bp, Homo sapiens
ggacacctgccctgcc

SEQ ID NO: 365713 - DNA, 21 bp, Homo sapiens
ggacacggcctctggggagac

SEQ ID NO: 365714 - DNA, 21 bp, Homo sapiens
ggacacgggcagcctggctcc

SEQ ID NO: 365715 - DNA, 15 bp, Homo sapiens
ggacactacaaacat

SEQ ID NO: 365716 - DNA, 22 bp, Homo sapiens
ggacactgatgggtcctgctgc

SEQ ID NO: 365717 - DNA, 24 bp, Homo sapiens
ggacactgatgggtcctgctgctc

SEQ ID NO: 365718 - DNA, 20 bp, Homo sapiens
ggacagaaccaacgggtctg

SEQ ID NO: 365719 - DNA, 16 bp, Homo sapiens
ggacagaagcttgtgg

SEQ ID NO: 365720 - DNA, 22 bp, Homo sapiens
ggagcccctgtgtgggagggcg

SEQ ID NO: 365721 - DNA, 16 bp, Homo sapiens
ggagcccgcaccccca

SEQ ID NO: 365722 - DNA, 18 bp, Homo sapiens
ggagcccgcacccccacc

SEQ ID NO: 365723 - DNA, 21 bp, Homo sapiens
ggagcccgcacccccaccctt

SEQ ID NO: 365724 - DNA, 13 bp, Homo sapiens
ggagccctcatct

SEQ ID NO: 365725 - DNA, 20 bp, Homo sapiens
ggagcctccactgcctctgg

SEQ ID NO: 365726 - DNA, 16 bp, Homo sapiens
ggagcctgaggcagga

SEQ ID NO: 365727 - DNA, 20 bp, Homo sapiens
ggagcctgagtcagggccca

SEQ ID NO: 365728 - DNA, 23 bp, Homo sapiens
ggagcctgagtcagggcccagag

SEQ ID NO: 365729 - DNA, 22 bp, Homo sapiens
ggagcctgcaaactcactgctc

SEQ ID NO: 365730 - DNA, 16 bp, Homo sapiens
ggagcctgcagggtgg

SEQ ID NO: 365731 - DNA, 21 bp, Homo sapiens
ggagcctgcagggtggtgctg

SEQ ID NO: 365732 - DNA, 14 bp, Homo sapiens
ggagcctgcggctg

SEQ ID NO: 365733 - DNA, 19 bp, Homo sapiens
ggagcctgcgtggcctggg

SEQ ID NO: 365734 - DNA, 23 bp, Homo sapiens
ggagcctgcgtggcctggggctg

SEQ ID NO: 365735 - DNA, 11 bp, Homo sapiens
ggagcctggag

SEQ ID NO: 365736 - DNA, 12 bp, Homo sapiens
ggagcctggagc

SEQ ID NO: 365737 - DNA, 20 bp, Homo sapiens
ggagcctgtgttagtgtctg

SEQ ID NO: 365738 - DNA, 23 bp, Homo sapiens
ggagcgaactggcgcctccgagg

SEQ ID NO: 365739 - DNA, 13 bp, Homo sapiens
ggagcggctgagg

SEQ ID NO: 365740 - DNA, 14 bp, Homo sapiens
ggagcggctgagga

SEQ ID NO: 365741 - DNA, 13 bp, Homo sapiens
ggagcgggacctg

SEQ ID NO: 365742 - DNA, 16 bp, Homo sapiens
ggagcgggcagggccg

SEQ ID NO: 365743 - DNA, 17 bp, Homo sapiens
ggagcgtttgctgtgcc

SEQ ID NO: 365744 - DNA, 18 bp, Homo sapiens
ggagcgtttgctgtgcca

SEQ ID NO: 365745 - DNA, 20 bp, Homo sapiens
ggagcgtttgctgtgccagg

SEQ ID NO: 365746 - DNA, 22 bp, Homo sapiens
ggagcgtttgctgtgccaggag

SEQ ID NO: 365747 - DNA, 16 bp, Homo sapiens
ggagctaacactggcc

SEQ ID NO: 365748 - DNA, 22 bp, Homo sapiens
ggagctatcaggaacagctatg

SEQ ID NO: 365749 - DNA, 15 bp, Homo sapiens
ggagctcaggtgggg

SEQ ID NO: 365750 - DNA, 11 bp, Homo sapiens
ggagctcctgg

SEQ ID NO: 365751 - DNA, 11 bp, Homo sapiens
ggagctgagat

SEQ ID NO: 365752 - DNA, 21 bp, Homo sapiens
ggagctgagtcacctcctcca

SEQ ID NO: 365753 - DNA, 21 bp, Homo sapiens
ggagctgcagcgcctcctgga

SEQ ID NO: 365754 - DNA, 23 bp, Homo sapiens
ggagctgcagcgcctcctggaca

SEQ ID NO: 365755 - DNA, 23 bp, Homo sapiens
ggagctgctggcttgcagtgcgc

SEQ ID NO: 365756 - DNA, 17 bp, Homo sapiens
ggagctggcgtctgtct

SEQ ID NO: 365757 - DNA, 14 bp, Homo sapiens
ggagctggctggca

SEQ ID NO: 365758 - DNA, 16 bp, Homo sapiens
ggagctggctggcagg

SEQ ID NO: 365759 - DNA, 19 bp, Homo sapiens
ggagctgggaaggtcccga

SEQ ID NO: 365760 - DNA, 23 bp, Homo sapiens
ggagctgtataactgtgcagaga

SEQ ID NO: 365761 - DNA, 15 bp, Homo sapiens
ggagcttacctccca

SEQ ID NO: 365762 - DNA, 21 bp, Homo sapiens
ggagcttagccaatgtgggag

SEQ ID NO: 365763 - DNA, 14 bp, Homo sapiens
ggagcttccagatg

SEQ ID NO: 365764 - DNA, 15 bp, Homo sapiens
ggagcttccagatgg

SEQ ID NO: 365765 - DNA, 20 bp, Homo sapiens
ggaggaaaaccaagccgtgg

SEQ ID NO: 365766 - DNA, 23 bp, Homo sapiens
ggaggaactggtccaggccaggc

SEQ ID NO: 365767 - DNA, 18 bp, Homo sapiens
ggaggaacttgctgctgt

SEQ ID NO: 365768 - DNA, 18 bp, Homo sapiens
ggaggaagggactggtcc

SEQ ID NO: 365769 - DNA, 18 bp, Homo sapiens
ggaggaaggtgctgagct

SEQ ID NO: 365770 - DNA, 21 bp, Homo sapiens
ggaggaatcgaggaaccagag

SEQ ID NO: 365771 - DNA, 23 bp, Homo sapiens
ggaggaatcgaggaaccagagcc

SEQ ID NO: 365772 - DNA, 12 bp, Homo sapiens
ggaggaatgaca

SEQ ID NO: 365773 - DNA, 23 bp, Homo sapiens
ggaggacaaaggtgattttcctg

SEQ ID NO: 365774 - DNA, 14 bp, Homo sapiens
ggaggacagggagg

SEQ ID NO: 365775 - DNA, 20 bp, Homo sapiens
ggaggacccgggaccacagc

SEQ ID NO: 365776 - DNA, 15 bp, Homo sapiens
ggaggagactcaggc

SEQ ID NO: 365777 - DNA, 13 bp, Homo sapiens
ggaggagagggca

SEQ ID NO: 365778 - DNA, 14 bp, Homo sapiens
ggaggagagggcag

SEQ ID NO: 365779 - DNA, 15 bp, Homo sapiens
ggaggagcaccccca

SEQ ID NO: 365780 - DNA, 18 bp, Homo sapiens
ggaggagcacccccagcc

SEQ ID NO: 365781 - DNA, 15 bp, Homo sapiens
ggaggaggagatggc

SEQ ID NO: 365782 - DNA, 14 bp, Homo sapiens
ggaggaggaggcaa

SEQ ID NO: 365783 - DNA, 17 bp, Homo sapiens
ggaggatcacttgagcc

SEQ ID NO: 365784 - DNA, 17 bp, Homo sapiens
ggaggcacacagctgca

SEQ ID NO: 365785 - DNA, 12 bp, Homo sapiens
ggaggcaccagc

SEQ ID NO: 365786 - DNA, 17 bp, Homo sapiens
ggaggcaccagctctgt

SEQ ID NO: 365787 - DNA, 20 bp, Homo sapiens
ggaggcaccagctctgtggc

SEQ ID NO: 365788 - DNA, 23 bp, Homo sapiens
ggaggcagccccctccacaccag

SEQ ID NO: 365789 - DNA, 22 bp, Homo sapiens
ggaggcaggtcccgagccccct

SEQ ID NO: 365790 - DNA, 12 bp, Homo sapiens
ggaggccaagcc

SEQ ID NO: 365791 - DNA, 13 bp, Homo sapiens
ggaggccaaggca

SEQ ID NO: 365792 - DNA, 15 bp, Homo sapiens
ggaggccaaggcagg

SEQ ID NO: 365793 - DNA, 22 bp, Homo sapiens
ggaggccaccaagctgctctcc

SEQ ID NO: 365794 - DNA, 13 bp, Homo sapiens
ggaggccacccca

SEQ ID NO: 365795 - DNA, 16 bp, Homo sapiens
ggaggccatgggggcc

SEQ ID NO: 365796 - DNA, 18 bp, Homo sapiens
ggaggcccctggcccagc

SEQ ID NO: 365797 - DNA, 22 bp, Homo sapiens
ggaggcccttttctggctcctg

SEQ ID NO: 365798 - DNA, 16 bp, Homo sapiens
ggaggccgaggcacga

SEQ ID NO: 365799 - DNA, 14 bp, Homo sapiens
ggaggccgaggcag

SEQ ID NO: 365800 - DNA, 18 bp, Homo sapiens
ggaggccgggtgctcagg

SEQ ID NO: 365801 - DNA, 19 bp, Homo sapiens
ggaggcctgatgctgcccc

SEQ ID NO: 365802 - DNA, 14 bp, Homo sapiens
ggaggcctggtctg

SEQ ID NO: 365803 - DNA, 14 bp, Homo sapiens
ggaggcgcccacct

SEQ ID NO: 365804 - DNA, 16 bp, Homo sapiens
ggaggcgcccacctgc

SEQ ID NO: 365805 - DNA, 23 bp, Homo sapiens
ggaggcgcccacctgcccagtta

SEQ ID NO: 365806 - DNA, 13 bp, Homo sapiens
ggaggcggcagct

SEQ ID NO: 365807 - DNA, 23 bp, Homo sapiens
ggaggcggcagctcttctgggca

SEQ ID NO: 365808 - DNA, 18 bp, Homo sapiens
ggaggcgtgcccccctcc

SEQ ID NO: 365809 - DNA, 21 bp, Homo sapiens
ggaggctgagacgcaaggatc

SEQ ID NO: 365810 - DNA, 20 bp, Homo sapiens
ggaggctgagatgggaggat

SEQ ID NO: 365811 - DNA, 12 bp, Homo sapiens
ggaggctggagg

SEQ ID NO: 365812 - DNA, 13 bp, Homo sapiens
ggaggctggcagg

SEQ ID NO: 365813 - DNA, 17 bp, Homo sapiens
ggaggcttgtcagagct

SEQ ID NO: 365814 - DNA, 17 bp, Homo sapiens
ggagggaaacccgggga

SEQ ID NO: 365815 - DNA, 17 bp, Homo sapiens
ggagggaattgaggtct

SEQ ID NO: 365816 - DNA, 17 bp, Homo sapiens
ggagggagctgctcaga

SEQ ID NO: 365817 - DNA, 20 bp, Homo sapiens
ggagggatagaggggggctg

SEQ ID NO: 365818 - DNA, 20 bp, Homo sapiens
ggagggattggccgcttggc

SEQ ID NO: 365819 - DNA, 12 bp, Homo sapiens
ggagggcagagc

SEQ ID NO: 365820 - DNA, 22 bp, Homo sapiens
ggagggcagagccatgggcctg

SEQ ID NO: 365821 - DNA, 22 bp, Homo sapiens
ggagggcatcagctttccctgg

SEQ ID NO: 365822 - DNA, 14 bp, Homo sapiens
ggagggcccctgcg

SEQ ID NO: 365823 - DNA, 16 bp, Homo sapiens
ggagggccctacctga

SEQ ID NO: 365824 - DNA, 17 bp, Homo sapiens
ggagggcctcagagaca

SEQ ID NO: 365825 - DNA, 18 bp, Homo sapiens
ggagggcctcagagacag

SEQ ID NO: 365826 - DNA, 22 bp, Homo sapiens
ggagggcgaggcgggggagcct

SEQ ID NO: 365827 - DNA, 13 bp, Homo sapiens
ggaggggaagctg

SEQ ID NO: 365828 - DNA, 14 bp, Homo sapiens
ggaggggaagctgc

SEQ ID NO: 365829 - DNA, 22 bp, Homo sapiens
ggaggggacttgtaggaatctg

SEQ ID NO: 365830 - DNA, 18 bp, Homo sapiens
ggaggggaggcagatgga

SEQ ID NO: 365831 - DNA, 12 bp, Homo sapiens
ggaggggaggtg

SEQ ID NO: 365832 - DNA, 14 bp, Homo sapiens
ggaggggcctggcc

SEQ ID NO: 365833 - DNA, 20 bp, Homo sapiens
ggaggggcttggagcagaga

SEQ ID NO: 365834 - DNA, 15 bp, Homo sapiens
ggagggggagggggt

SEQ ID NO: 365835 - DNA, 16 bp, Homo sapiens
ggagggggcgctcagg

SEQ ID NO: 365836 - DNA, 14 bp, Homo sapiens
ggagggtcagtgcc

SEQ ID NO: 365837 - DNA, 21 bp, Homo sapiens
ggagggtgacgggggtgaact

SEQ ID NO: 365838 - DNA, 14 bp, Homo sapiens
ggagggtggttcct

SEQ ID NO: 365839 - DNA, 19 bp, Homo sapiens
ggagggttggggaggggcg

SEQ ID NO: 365840 - DNA, 13 bp, Homo sapiens
ggaggtagagagg

SEQ ID NO: 365841 - DNA, 15 bp, Homo sapiens
ggaggtcaggccctg

SEQ ID NO: 365842 - DNA, 16 bp, Homo sapiens
ggaggtcaggccctgg

SEQ ID NO: 365843 - DNA, 13 bp, Homo sapiens
ggaggtcccagga

SEQ ID NO: 365844 - DNA, 17 bp, Homo sapiens
ggaggtcccaggaagtc

SEQ ID NO: 365845 - DNA, 21 bp, Homo sapiens
ggaggtgagatcacagcctcc

SEQ ID NO: 365846 - DNA, 18 bp, Homo sapiens
ggaggtggctatggccac

SEQ ID NO: 365847 - DNA, 21 bp, Homo sapiens
ggaggtgggcatgccaccctc

SEQ ID NO: 365848 - DNA, 16 bp, Homo sapiens
ggaggttctctcggag

SEQ ID NO: 365849 - DNA, 14 bp, Homo sapiens
ggaggttgagtgag

SEQ ID NO: 365850 - DNA, 19 bp, Homo sapiens
ggaggttgagtgagccggg

SEQ ID NO: 365851 - DNA, 19 bp, Homo sapiens
ggaggttgatcagatctga

SEQ ID NO: 365852 - DNA, 14 bp, Homo sapiens
ggaggttggtgact

SEQ ID NO: 365853 - DNA, 12 bp, Homo sapiens
ggaggtttgttt

SEQ ID NO: 365854 - DNA, 17 bp, Homo sapiens
ggagtcaagtgtgcctg

SEQ ID NO: 365855 - DNA, 18 bp, Homo sapiens
ggagtcagagccctggct

SEQ ID NO: 365856 - DNA, 18 bp, Homo sapiens
ggagtcagatgagcaagg

SEQ ID NO: 365857 - DNA, 18 bp, Homo sapiens
ggagtcaggcttctcttg

SEQ ID NO: 365858 - DNA, 19 bp, Homo sapiens
ggagtcagggagccctggg

SEQ ID NO: 365859 - DNA, 23 bp, Homo sapiens
ggagtcagtaggtccaagggcca

SEQ ID NO: 365860 - DNA, 18 bp, Homo sapiens
ggagtccactttcctctc

SEQ ID NO: 365861 - DNA, 22 bp, Homo sapiens
ggagtccactttcctctctctc

SEQ ID NO: 365862 - DNA, 14 bp, Homo sapiens
ggagtccagacctg

SEQ ID NO: 365863 - DNA, 15 bp, Homo sapiens
ggagtccagacctgg

SEQ ID NO: 365864 - DNA, 21 bp, Homo sapiens
ggagtccagacctgggccctg

SEQ ID NO: 365865 - DNA, 23 bp, Homo sapiens
ggagtccagacctgggccctggt

SEQ ID NO: 365866 - DNA, 16 bp, Homo sapiens
ggagtcctgttctcag

SEQ ID NO: 365867 - DNA, 17 bp, Homo sapiens
ggagtcctgttctcaga

SEQ ID NO: 365868 - DNA, 18 bp, Homo sapiens
ggagtcctgttctcagag

SEQ ID NO: 365869 - DNA, 21 bp, Homo sapiens
ggagtcctgttctcagagctc

SEQ ID NO: 365870 - DNA, 14 bp, Homo sapiens
ggagtctccctccg

SEQ ID NO: 365871 - DNA, 15 bp, Homo sapiens
ggagtctctgccacc

SEQ ID NO: 365872 - DNA, 16 bp, Homo sapiens
ggagtctctgccaccc

SEQ ID NO: 365873 - DNA, 17 bp, Homo sapiens
ggagtctctgccaccca

SEQ ID NO: 365874 - DNA, 19 bp, Homo sapiens
ggagtctctgccacccact

SEQ ID NO: 365875 - DNA, 20 bp, Homo sapiens
ggagtctctgccacccactc

SEQ ID NO: 365876 - DNA, 19 bp, Homo sapiens
ggagtctgaaggagaggag

SEQ ID NO: 365877 - DNA, 18 bp, Homo sapiens
ggagtctgattgcaggaa

SEQ ID NO: 365878 - DNA, 18 bp, Homo sapiens
ggagtgaggcttccaggc

SEQ ID NO: 365879 - DNA, 20 bp, Homo sapiens
ggagtgaggcttccaggctc

SEQ ID NO: 365880 - DNA, 19 bp, Homo sapiens
ggagtgcagaacacctggc

SEQ ID NO: 365881 - DNA, 15 bp, Homo sapiens
ggagtgcagggagga

SEQ ID NO: 365882 - DNA, 17 bp, Homo sapiens
ggagtgcatggccacag

SEQ ID NO: 365883 - DNA, 18 bp, Homo sapiens
ggagtgcatggccacagc

SEQ ID NO: 365884 - DNA, 21 bp, Homo sapiens
ggagtgcatggccacagccac

SEQ ID NO: 365885 - DNA, 21 bp, Homo sapiens
ggagtgcgctcttggtccctg

SEQ ID NO: 365886 - DNA, 23 bp, Homo sapiens
ggagtgcgctcttggtccctggt

SEQ ID NO: 365887 - DNA, 12 bp, Homo sapiens
ggagtgctggct

SEQ ID NO: 365888 - DNA, 22 bp, Homo sapiens
ggagtgctggctccacgccctg

SEQ ID NO: 365889 - DNA, 23 bp, Homo sapiens
ggagtgctggctccacgccctgg

SEQ ID NO: 365890 - DNA, 17 bp, Homo sapiens
ggagtggaggggtcagc

SEQ ID NO: 365891 - DNA, 18 bp, Homo sapiens
ggagtgggacagagtctg

SEQ ID NO: 365892 - DNA, 14 bp, Homo sapiens
ggagtgggagagga

SEQ ID NO: 365893 - DNA, 15 bp, Homo sapiens
ggagtgggcacctca

SEQ ID NO: 365894 - DNA, 16 bp, Homo sapiens
ggagtgggcacctcag

SEQ ID NO: 365895 - DNA, 17 bp, Homo sapiens
ggagtgggcacctcaga

SEQ ID NO: 365896 - DNA, 18 bp, Homo sapiens
ggagtgggcacctcagaa

SEQ ID NO: 365897 - DNA, 18 bp, Homo sapiens
ggagtgggctctgagcag

SEQ ID NO: 365898 - DNA, 18 bp, Homo sapiens
ggagtggtaacaagagga

SEQ ID NO: 365899 - DNA, 21 bp, Homo sapiens
ggagtgtaattacctgtcatc

SEQ ID NO: 365900 - DNA, 21 bp, Homo sapiens
ggagtgtgctcaggccgggct

SEQ ID NO: 365901 - DNA, 19 bp, Homo sapiens
ggagtgtgtgggggtctgg

SEQ ID NO: 365902 - DNA, 21 bp, Homo sapiens
ggagtgtgtgggggtctggga

SEQ ID NO: 365903 - DNA, 19 bp, Homo sapiens
ggagtgttctgtgggcttg

SEQ ID NO: 365904 - DNA, 16 bp, Homo sapiens
ggagttcaatgatcta

SEQ ID NO: 365905 - DNA, 13 bp, Homo sapiens
ggagttgagtcac

SEQ ID NO: 365906 - DNA, 19 bp, Homo sapiens
ggagttggcattgcattta

SEQ ID NO: 365907 - DNA, 18 bp, Homo sapiens
ggagtttgagacaagccc

SEQ ID NO: 365908 - DNA, 14 bp, Homo sapiens
ggataaaaaagaaa

SEQ ID NO: 365909 - DNA, 14 bp, Homo sapiens
ggataaaatgaggt

SEQ ID NO: 365910 - DNA, 17 bp, Homo sapiens
ggataacagaggcagga

SEQ ID NO: 365911 - DNA, 20 bp, Homo sapiens
ggataaggagactgaggctt

SEQ ID NO: 365912 - DNA, 14 bp, Homo sapiens
ggataatgtcatta

SEQ ID NO: 365913 - DNA, 20 bp, Homo sapiens
ggataatgtcattaatatat

SEQ ID NO: 365914 - DNA, 21 bp, Homo sapiens
ggatacttagtggtatgtctc

SEQ ID NO: 365915 - DNA, 12 bp, Homo sapiens
ggatagaggggt

SEQ ID NO: 365916 - DNA, 13 bp, Homo sapiens
ggatagcctttgt

SEQ ID NO: 365917 - DNA, 17 bp, Homo sapiens
ggataggaactgggcct

SEQ ID NO: 365918 - DNA, 18 bp, Homo sapiens
ggatagttgctccgcctc

SEQ ID NO: 365919 - DNA, 17 bp, Homo sapiens
ggatatctgttagatgc

SEQ ID NO: 365920 - DNA, 16 bp, Homo sapiens
ggatatttttaattta

SEQ ID NO: 365921 - DNA, 17 bp, Homo sapiens
ggatcacttgagcccag

SEQ ID NO: 365922 - DNA, 21 bp, Homo sapiens
ggatcagagtctggcctgcca

SEQ ID NO: 365923 - DNA, 13 bp, Homo sapiens
ggatccagagaga

SEQ ID NO: 365924 - DNA, 17 bp, Homo sapiens
ggatcccgtgctggaag

SEQ ID NO: 365925 - DNA, 24 bp, Homo sapiens
ggatccgcggggaccctgccgagg

SEQ ID NO: 365926 - DNA, 15 bp, Homo sapiens
ggatccgctgccacc

SEQ ID NO: 365927 - DNA, 12 bp, Homo sapiens
ggatcctcctgg

SEQ ID NO: 365928 - DNA, 12 bp, Homo sapiens
ggatcctgcagg

SEQ ID NO: 365929 - DNA, 17 bp, Homo sapiens
ggatcctggagcccctg

SEQ ID NO: 365930 - DNA, 18 bp, Homo sapiens
ggatctaccagcataaat

SEQ ID NO: 365931 - DNA, 15 bp, Homo sapiens
ggatctagccatggc

SEQ ID NO: 365932 - DNA, 23 bp, Homo sapiens
ggatctagccatggctggcagag

SEQ ID NO: 365933 - DNA, 13 bp, Homo sapiens
ggatctccaggcc

SEQ ID NO: 365934 - DNA, 17 bp, Homo sapiens
ggatctccaggcccagc

SEQ ID NO: 365935 - DNA, 18 bp, Homo sapiens
ggatctccaggcccagcc

SEQ ID NO: 365936 - DNA, 16 bp, Homo sapiens
ggatctctcaggagca

SEQ ID NO: 365937 - DNA, 22 bp, Homo sapiens
ggatctctcaggagcacaggca

SEQ ID NO: 365938 - DNA, 13 bp, Homo sapiens
ggatcttctccct

SEQ ID NO: 365939 - DNA, 18 bp, Homo sapiens
ggatgaaataactccttc

SEQ ID NO: 365940 - DNA, 23 bp, Homo sapiens
ggatgaatgtatgtgcactgtca

SEQ ID NO: 365941 - DNA, 21 bp, Homo sapiens
ggatgaattccaaattctgct

SEQ ID NO: 365942 - DNA, 17 bp, Homo sapiens
ggatgacaaagaaaatg

SEQ ID NO: 365943 - DNA, 21 bp, Homo sapiens
ggatgaggccgctagaggcct

SEQ ID NO: 365944 - DNA, 16 bp, Homo sapiens
ggatgatccagggatt

SEQ ID NO: 365945 - DNA, 15 bp, Homo sapiens
ggatgattgtacaga

SEQ ID NO: 365946 - DNA, 16 bp, Homo sapiens
ggatgcacagatgcca

SEQ ID NO: 365947 - DNA, 18 bp, Homo sapiens
ggatgcacagatgccatg

SEQ ID NO: 365948 - DNA, 20 bp, Homo sapiens
ggatgccaacaccttcttgg

SEQ ID NO: 365949 - DNA, 23 bp, Homo sapiens
ggatgccaacaccttcttggctt

SEQ ID NO: 365950 - DNA, 18 bp, Homo sapiens
ggatgccataccttgaga

SEQ ID NO: 365951 - DNA, 18 bp, Homo sapiens
ggatgccatctgtgggca

SEQ ID NO: 365952 - DNA, 19 bp, Homo sapiens
ggatgccatctgtgggcac

SEQ ID NO: 365953 - DNA, 23 bp, Homo sapiens
ggatgctcattcatattcctgcc

SEQ ID NO: 365954 - DNA, 17 bp, Homo sapiens
ggatgctgtgcctccca

SEQ ID NO: 365955 - DNA, 21 bp, Homo sapiens
ggatgcttgcctagggcctgg

SEQ ID NO: 365956 - DNA, 12 bp, Homo sapiens
ggatggaaggag

SEQ ID NO: 365957 - DNA, 15 bp, Homo sapiens
ggatggccgggctgc

SEQ ID NO: 365958 - DNA, 17 bp, Homo sapiens
ggatggccgggctgctg

SEQ ID NO: 365959 - DNA, 14 bp, Homo sapiens
ggatgggaacactg

SEQ ID NO: 365960 - DNA, 16 bp, Homo sapiens
ggatgggcagctgggg

SEQ ID NO: 365961 - DNA, 23 bp, Homo sapiens
ggatgggcattgggctgacacct

SEQ ID NO: 365962 - DNA, 15 bp, Homo sapiens
ggatgggccacccac

SEQ ID NO: 365963 - DNA, 22 bp, Homo sapiens
ggatgggccacccaccagggct

SEQ ID NO: 365964 - DNA, 19 bp, Homo sapiens
ggatggggagaatggtcaa

SEQ ID NO: 365965 - DNA, 15 bp, Homo sapiens
ggatggggccacagc

SEQ ID NO: 365966 - DNA, 13 bp, Homo sapiens
ggatggtgacttt

SEQ ID NO: 365967 - DNA, 15 bp, Homo sapiens
ggatggtgacttttg

SEQ ID NO: 365968 - DNA, 21 bp, Homo sapiens
ggatggtgacttttgaagaac

SEQ ID NO: 365969 - DNA, 23 bp, Homo sapiens
ggatggtgacttttgaagaacaa

SEQ ID NO: 365970 - DNA, 21 bp, Homo sapiens
ggatgtacttaagagtggcat

SEQ ID NO: 365971 - DNA, 22 bp, Homo sapiens
ggatgtacttaagagtggcata

SEQ ID NO: 365972 - DNA, 16 bp, Homo sapiens
ggatgtcccctgtccc

SEQ ID NO: 365973 - DNA, 21 bp, Homo sapiens
ggatgtcccctgtcccaccaa

SEQ ID NO: 365974 - DNA, 14 bp, Homo sapiens
ggatgtcttccttg

SEQ ID NO: 365975 - DNA, 18 bp, Homo sapiens
ggatgtcttgagatgtat

SEQ ID NO: 365976 - DNA, 13 bp, Homo sapiens
ggatgtttcttct

SEQ ID NO: 365977 - DNA, 13 bp, Homo sapiens
ggattaaatggca

SEQ ID NO: 365978 - DNA, 19 bp, Homo sapiens
ggattaagatacactcctg

SEQ ID NO: 365979 - DNA, 16 bp, Homo sapiens
ggcatctgacacaaaa

SEQ ID NO: 365980 - DNA, 16 bp, Homo sapiens
ggcatctttgccttgg

SEQ ID NO: 365981 - DNA, 21 bp, Homo sapiens
ggcatctttgccttgggctgc

SEQ ID NO: 365982 - DNA, 23 bp, Homo sapiens
ggcatctttgccttgggctgctc

SEQ ID NO: 365983 - DNA, 14 bp, Homo sapiens
ggcatgacaaggtg

SEQ ID NO: 365984 - DNA, 22 bp, Homo sapiens
ggcatgacaaggtgtgcagtgg

SEQ ID NO: 365985 - DNA, 21 bp, Homo sapiens
ggcatgacactctagtgactt

SEQ ID NO: 365986 - DNA, 13 bp, Homo sapiens
ggcatgaccctgg

SEQ ID NO: 365987 - DNA, 21 bp, Homo sapiens
ggcatgaccctggagcccggc

SEQ ID NO: 365988 - DNA, 13 bp, Homo sapiens
ggcatgagctctt

SEQ ID NO: 365989 - DNA, 16 bp, Homo sapiens
ggcatgagggctgaga

SEQ ID NO: 365990 - DNA, 16 bp, Homo sapiens
ggcatgccaccctcac

SEQ ID NO: 365991 - DNA, 24 bp, Homo sapiens
ggcatgccaccctcacacacacag

SEQ ID NO: 365992 - DNA, 18 bp, Homo sapiens
ggcatgctcccagcattt

SEQ ID NO: 365993 - DNA, 21 bp, Homo sapiens
ggcatgctcccagcatttgtc

SEQ ID NO: 365994 - DNA, 18 bp, Homo sapiens
ggcatggaagagggaggg

SEQ ID NO: 365995 - DNA, 17 bp, Homo sapiens
ggcatggccaggtggcc

SEQ ID NO: 365996 - DNA, 18 bp, Homo sapiens
ggcatggccaggtggcca

SEQ ID NO: 365997 - DNA, 18 bp, Homo sapiens
ggcatggcccagcctgga

SEQ ID NO: 365998 - DNA, 19 bp, Homo sapiens
ggcatggcccagcctggag

SEQ ID NO: 365999 - DNA, 16 bp, Homo sapiens
ggcatggctccagtct

SEQ ID NO: 366000 - DNA, 23 bp, Homo sapiens
ggcatggctttatttgttttttt

SEQ ID NO: 366001 - DNA, 21 bp, Homo sapiens
ggcatgggaaagccacctctc

SEQ ID NO: 366002 - DNA, 15 bp, Homo sapiens
ggcatgggggaggct

SEQ ID NO: 366003 - DNA, 16 bp, Homo sapiens
ggcatgggggaggctc

SEQ ID NO: 366004 - DNA, 20 bp, Homo sapiens
ggcatgggggaggctctgaa

SEQ ID NO: 366005 - DNA, 18 bp, Homo sapiens
ggcatggggtgggcctct

SEQ ID NO: 366006 - DNA, 20 bp, Homo sapiens
ggcatggttccttccctggg

SEQ ID NO: 366007 - DNA, 23 bp, Homo sapiens
ggcatggttccttccctgggaag

SEQ ID NO: 366008 - DNA, 17 bp, Homo sapiens
ggcatgtattggcctgg

SEQ ID NO: 366009 - DNA, 19 bp, Homo sapiens
ggcatgtattggcctggag

SEQ ID NO: 366010 - DNA, 23 bp, Homo sapiens
ggcatgtgaaaagtaaaacagat

SEQ ID NO: 366011 - DNA, 18 bp, Homo sapiens
ggcatgtgatattttcac

SEQ ID NO: 366012 - DNA, 15 bp, Homo sapiens
ggcatgtgtgcctgt

SEQ ID NO: 366013 - DNA, 22 bp, Homo sapiens
ggcattagtttcaggcaaggca

SEQ ID NO: 366014 - DNA, 14 bp, Homo sapiens
ggcattcacacaca

SEQ ID NO: 366015 - DNA, 15 bp, Homo sapiens
ggcattcacacacag

SEQ ID NO: 366016 - DNA, 16 bp, Homo sapiens
ggcattcacacacagc

SEQ ID NO: 366017 - DNA, 17 bp, Homo sapiens
ggcattcacacacagcc

SEQ ID NO: 366018 - DNA, 13 bp, Homo sapiens
ggcattcccagag

SEQ ID NO: 366019 - DNA, 22 bp, Homo sapiens
ggcattcccagaggtggggaag

SEQ ID NO: 366020 - DNA, 17 bp, Homo sapiens
ggcattctacacctgga

SEQ ID NO: 366021 - DNA, 14 bp, Homo sapiens
ggcattgggctgac

SEQ ID NO: 366022 - DNA, 17 bp, Homo sapiens
ggcattgggctgacacc

SEQ ID NO: 366023 - DNA, 14 bp, Homo sapiens
ggcatttgctgaat

SEQ ID NO: 366024 - DNA, 22 bp, Homo sapiens
ggcatttgtaaatattaaacca

SEQ ID NO: 366025 - DNA, 19 bp, Homo sapiens
ggccaaacatcagacctgt

SEQ ID NO: 366026 - DNA, 18 bp, Homo sapiens
ggccaacgtggacctgcc

SEQ ID NO: 366027 - DNA, 22 bp, Homo sapiens
ggccaagccagggttccagaca

SEQ ID NO: 366028 - DNA, 11 bp, Homo sapiens
ggccaaggact

SEQ ID NO: 366029 - DNA, 13 bp, Homo sapiens
ggccaaggactgc

SEQ ID NO: 366030 - DNA, 15 bp, Homo sapiens
ggccaaggcaggtag

SEQ ID NO: 366031 - DNA, 12 bp, Homo sapiens
ggccaaggcctc

SEQ ID NO: 366032 - DNA, 14 bp, Homo sapiens
ggccaagtcccacc

SEQ ID NO: 366033 - DNA, 20 bp, Homo sapiens
ggccacaacctgaaagacaa

SEQ ID NO: 366034 - DNA, 16 bp, Homo sapiens
ggccacacccaggaag

SEQ ID NO: 366035 - DNA, 23 bp, Homo sapiens
ggccacacgctgcccaggctctg

SEQ ID NO: 366036 - DNA, 21 bp, Homo sapiens
ggccacactattaccatgaga

SEQ ID NO: 366037 - DNA, 22 bp, Homo sapiens
ggccacactattaccatgagaa

SEQ ID NO: 366038 - DNA, 13 bp, Homo sapiens
ggccacagccaga

SEQ ID NO: 366039 - DNA, 12 bp, Homo sapiens
ggccacaggcca

SEQ ID NO: 366040 - DNA, 16 bp, Homo sapiens
ggccacatgagtccca

SEQ ID NO: 366041 - DNA, 20 bp, Homo sapiens
ggccacatgagtcccagtgg

SEQ ID NO: 366042 - DNA, 18 bp, Homo sapiens
ggccaccagctccactgg

SEQ ID NO: 366043 - DNA, 21 bp, Homo sapiens
ggccaccagctccactggcct

SEQ ID NO: 366044 - DNA, 13 bp, Homo sapiens
ggccaccagctgc

SEQ ID NO: 366045 - DNA, 17 bp, Homo sapiens
ggccaccagctgctgga

SEQ ID NO: 366046 - DNA, 21 bp, Homo sapiens
ggccaccatctgtaccctgct

SEQ ID NO: 366047 - DNA, 14 bp, Homo sapiens
ggccacccaccagg

SEQ ID NO: 366048 - DNA, 18 bp, Homo sapiens
ggccacccaccagggctc

SEQ ID NO: 366049 - DNA, 20 bp, Homo sapiens
ggccacccaccagggctcag

SEQ ID NO: 366050 - DNA, 15 bp, Homo sapiens
ggccacccacccttc

SEQ ID NO: 366051 - DNA, 16 bp, Homo sapiens
ggccaccccaaacccc

SEQ ID NO: 366052 - DNA, 23 bp, Homo sapiens
ggccaccccaaaccccagcccca

SEQ ID NO: 366053 - DNA, 15 bp, Homo sapiens
ggccaccccgtgcca

SEQ ID NO: 366054 - DNA, 21 bp, Homo sapiens
ggccacccgttctgctggcct

SEQ ID NO: 366055 - DNA, 12 bp, Homo sapiens
ggccaccctcct

SEQ ID NO: 366056 - DNA, 19 bp, Homo sapiens
ggccaccctccttcccgcc

SEQ ID NO: 366057 - DNA, 12 bp, Homo sapiens
ggccacccttca

SEQ ID NO: 366058 - DNA, 23 bp, Homo sapiens
ggccacccttcacgctggcttcc

SEQ ID NO: 366059 - DNA, 17 bp, Homo sapiens
ggccaccggggcaagag

SEQ ID NO: 366060 - DNA, 20 bp, Homo sapiens
ggccacctccaaggactcta

SEQ ID NO: 366061 - DNA, 14 bp, Homo sapiens
ggccacgcagccag

SEQ ID NO: 366062 - DNA, 16 bp, Homo sapiens
ggccacgcagccagga

SEQ ID NO: 366063 - DNA, 16 bp, Homo sapiens
ggccacgccccagccc

SEQ ID NO: 366064 - DNA, 11 bp, Homo sapiens
ggccacgctcc

SEQ ID NO: 366065 - DNA, 13 bp, Homo sapiens
ggccacgctcctc

SEQ ID NO: 366066 - DNA, 15 bp, Homo sapiens
ggccacgctcctctg

SEQ ID NO: 366067 - DNA, 16 bp, Homo sapiens
ggccacgctcctctgt

SEQ ID NO: 366068 - DNA, 15 bp, Homo sapiens
ggccacggcctggga

SEQ ID NO: 366069 - DNA, 23 bp, Homo sapiens
ggccacgtgggcaaacaggcagt

SEQ ID NO: 366070 - DNA, 15 bp, Homo sapiens
ggccactccctgcca

SEQ ID NO: 366071 - DNA, 16 bp, Homo sapiens
ggccactccctgccaa

SEQ ID NO: 366072 - DNA, 17 bp, Homo sapiens
ggccactccctgccaac

SEQ ID NO: 366073 - DNA, 21 bp, Homo sapiens
ggccactccctgccaactcca

SEQ ID NO: 366074 - DNA, 16 bp, Homo sapiens
ggccactctcagagac

SEQ ID NO: 366075 - DNA, 20 bp, Homo sapiens
ggccactgcaaaccctgctg

SEQ ID NO: 366076 - DNA, 17 bp, Homo sapiens
ggccactgcagtcaccc

SEQ ID NO: 366077 - DNA, 24 bp, Homo sapiens
ggccactgcagtcacccctgtctg

SEQ ID NO: 366078 - DNA, 14 bp, Homo sapiens
ggccactgccctct

SEQ ID NO: 366079 - DNA, 17 bp, Homo sapiens
ggccactgccctctcca

SEQ ID NO: 366080 - DNA, 20 bp, Homo sapiens
ggccactgggccccattctc

SEQ ID NO: 366081 - DNA, 15 bp, Homo sapiens
ggccactgtggccag

SEQ ID NO: 366082 - DNA, 18 bp, Homo sapiens
ggccactgtggccagagc

SEQ ID NO: 366083 - DNA, 14 bp, Homo sapiens
ggccacttgctcag

SEQ ID NO: 366084 - DNA, 15 bp, Homo sapiens
ggccacttttgacta

SEQ ID NO: 366085 - DNA, 16 bp, Homo sapiens
ggccagaaggagggca

SEQ ID NO: 366086 - DNA, 14 bp, Homo sapiens
ggccagaccagagc

SEQ ID NO: 366087 - DNA, 18 bp, Homo sapiens
ggccagaccagagctctg

SEQ ID NO: 366088 - DNA, 23 bp, Homo sapiens
ggccagaccagagctctggagcc

SEQ ID NO: 366089 - DNA, 16 bp, Homo sapiens
ggccagactggctgca

SEQ ID NO: 366090 - DNA, 18 bp, Homo sapiens
ggccagagagcctggtgc

SEQ ID NO: 366091 - DNA, 15 bp, Homo sapiens
ggccagagagggccc

SEQ ID NO: 366092 - DNA, 17 bp, Homo sapiens
ggccagagagggcccag

SEQ ID NO: 366093 - DNA, 22 bp, Homo sapiens
ggccagagcacctcaggaccct

SEQ ID NO: 366094 - DNA, 12 bp, Homo sapiens
ggccagagcctg

SEQ ID NO: 366095 - DNA, 19 bp, Homo sapiens
ggccagagcctggtagaga

SEQ ID NO: 366096 - DNA, 11 bp, Homo sapiens
ggccagagctc

SEQ ID NO: 366097 - DNA, 13 bp, Homo sapiens
ggccagagctccc

SEQ ID NO: 366098 - DNA, 15 bp, Homo sapiens
ggccagagctcccag

SEQ ID NO: 366099 - DNA, 16 bp, Homo sapiens
ggccagagctcccagg

SEQ ID NO: 366100 - DNA, 20 bp, Homo sapiens
ggccagagctcccaggacgc

SEQ ID NO: 366101 - DNA, 15 bp, Homo sapiens
ggccagagctggaag

SEQ ID NO: 366102 - DNA, 19 bp, Homo sapiens
ggccagaggcagaaccctg

SEQ ID NO: 366103 - DNA, 15 bp, Homo sapiens
ggccagaggcagcta

SEQ ID NO: 366104 - DNA, 15 bp, Homo sapiens
ggccagcaaggcagg

SEQ ID NO: 366105 - DNA, 17 bp, Homo sapiens
ggccagcaaggcaggtt

SEQ ID NO: 366106 - DNA, 12 bp, Homo sapiens
ggccagcagctt

SEQ ID NO: 366107 - DNA, 13 bp, Homo sapiens
ggccagcagcttg

SEQ ID NO: 366108 - DNA, 14 bp, Homo sapiens
ggccagccccaccc

SEQ ID NO: 366109 - DNA, 21 bp, Homo sapiens
ggccagccccacccaggaggg

SEQ ID NO: 366110 - DNA, 21 bp, Homo sapiens
ggccagcccctcccaccacag

SEQ ID NO: 366111 - DNA, 23 bp, Homo sapiens
ggccagcccctcccaccacagca

SEQ ID NO: 366112 - DNA, 12 bp, Homo sapiens
ggccagccctcc

SEQ ID NO: 366113 - DNA, 14 bp, Homo sapiens
ggccagcctcaccc

SEQ ID NO: 366114 - DNA, 15 bp, Homo sapiens
ggccagcctcaccct

SEQ ID NO: 366115 - DNA, 20 bp, Homo sapiens
ggccagcgagtggtcaagga

SEQ ID NO: 366116 - DNA, 19 bp, Homo sapiens
ggccagcgtgaaggacctg

SEQ ID NO: 366117 - DNA, 20 bp, Homo sapiens
ggccagcgtgaaggacctgg

SEQ ID NO: 366118 - DNA, 13 bp, Homo sapiens
ggccagctgcccc

SEQ ID NO: 366119 - DNA, 14 bp, Homo sapiens
ggccagctgcccct

SEQ ID NO: 366120 - DNA, 18 bp, Homo sapiens
ggccagctgtggttttct

SEQ ID NO: 366121 - DNA, 16 bp, Homo sapiens
ggccaggatggagggg

SEQ ID NO: 366122 - DNA, 22 bp, Homo sapiens
ggccaggatggcgtgtcccctg

SEQ ID NO: 366123 - DNA, 12 bp, Homo sapiens
ggccaggccatg

SEQ ID NO: 366124 - DNA, 12 bp, Homo sapiens
ggccaggccctc

SEQ ID NO: 366125 - DNA, 21 bp, Homo sapiens
ggccaggccctcctgctggct

SEQ ID NO: 366126 - DNA, 22 bp, Homo sapiens
ggccaggccctcctgctggctg

SEQ ID NO: 366127 - DNA, 23 bp, Homo sapiens
ggccaggccctcctgctggctga

SEQ ID NO: 366128 - DNA, 13 bp, Homo sapiens
ggccagggctctg

SEQ ID NO: 366129 - DNA, 22 bp, Homo sapiens
ggccagggtagacttggagctg

SEQ ID NO: 366130 - DNA, 18 bp, Homo sapiens
ggccagggtctcactgag

SEQ ID NO: 366131 - DNA, 19 bp, Homo sapiens
ggccagggtctcgtcagga

SEQ ID NO: 366132 - DNA, 17 bp, Homo sapiens
ggccagtagagagtgcc

SEQ ID NO: 366133 - DNA, 19 bp, Homo sapiens
ggccagtagagagtgccct

SEQ ID NO: 366134 - DNA, 16 bp, Homo sapiens
ggccagtcctgcctgg

SEQ ID NO: 366135 - DNA, 17 bp, Homo sapiens
ggccagtctgggctgcc

SEQ ID NO: 366136 - DNA, 13 bp, Homo sapiens
ggccatactgcct

SEQ ID NO: 366137 - DNA, 14 bp, Homo sapiens
ggccatactgcctt

SEQ ID NO: 366138 - DNA, 14 bp, Homo sapiens
ggccatcggtcctg

SEQ ID NO: 366139 - DNA, 22 bp, Homo sapiens
ggccatcggtcctgtctcccct

SEQ ID NO: 366140 - DNA, 17 bp, Homo sapiens
ggccatgaactttgtcc

SEQ ID NO: 366141 - DNA, 21 bp, Homo sapiens
ggccatgagctccagaccccc

SEQ ID NO: 366142 - DNA, 21 bp, Homo sapiens
ggccatgaggcctcagtggac

SEQ ID NO: 366143 - DNA, 21 bp, Homo sapiens
ggccatgattcgcccaaagcc

SEQ ID NO: 366144 - DNA, 13 bp, Homo sapiens
ggccatgcctgcc

SEQ ID NO: 366145 - DNA, 11 bp, Homo sapiens
ggccatgctca

SEQ ID NO: 366146 - DNA, 16 bp, Homo sapiens
ggccatgctcaacccc

SEQ ID NO: 366147 - DNA, 20 bp, Homo sapiens
ggccatggaagctggcagga

SEQ ID NO: 366148 - DNA, 19 bp, Homo sapiens
ggccatggccaaggggcca

SEQ ID NO: 366149 - DNA, 20 bp, Homo sapiens
ggccatgggggcccctcggc

SEQ ID NO: 366150 - DNA, 15 bp, Homo sapiens
ggccatgtgagccac

SEQ ID NO: 366151 - DNA, 16 bp, Homo sapiens
ggcccaagcatgcccc

SEQ ID NO: 366152 - DNA, 19 bp, Homo sapiens
ggcccaaggtcccctccac

SEQ ID NO: 366153 - DNA, 22 bp, Homo sapiens
ggcccaccagggactgcagctg

SEQ ID NO: 366154 - DNA, 23 bp, Homo sapiens
ggcccacccctcttcccccttcc

SEQ ID NO: 366155 - DNA, 21 bp, Homo sapiens
ggcccacctaccttcaaagct

SEQ ID NO: 366156 - DNA, 16 bp, Homo sapiens
ggcccacctcctccag

SEQ ID NO: 366157 - DNA, 22 bp, Homo sapiens
ggcccacgccctccctctccca

SEQ ID NO: 366158 - DNA, 16 bp, Homo sapiens
ggcccagaactgcccc

SEQ ID NO: 366159 - DNA, 17 bp, Homo sapiens
ggcccagaactgccccc

SEQ ID NO: 366160 - DNA, 19 bp, Homo sapiens
ggcccagaactgcccccac

SEQ ID NO: 366161 - DNA, 15 bp, Homo sapiens
ggcccagagagctga

SEQ ID NO: 366162 - DNA, 22 bp, Homo sapiens
ggcccagagctggaacactctc

SEQ ID NO: 366163 - DNA, 14 bp, Homo sapiens
ggcccagaggcaca

SEQ ID NO: 366164 - DNA, 17 bp, Homo sapiens
ggcccagaggcacagcc

SEQ ID NO: 366165 - DNA, 13 bp, Homo sapiens
ggcccagaggctg

SEQ ID NO: 366166 - DNA, 20 bp, Homo sapiens
ggcccagaggggcggggcca

SEQ ID NO: 366167 - DNA, 23 bp, Homo sapiens
ggcccagcagagccgttcctggg

SEQ ID NO: 366168 - DNA, 17 bp, Homo sapiens
ggcccagcagcggccca

SEQ ID NO: 366169 - DNA, 19 bp, Homo sapiens
ggcccagcagcggcccaga

SEQ ID NO: 366170 - DNA, 20 bp, Homo sapiens
ggcccagcagcttggctgag

SEQ ID NO: 366171 - DNA, 13 bp, Homo sapiens
ggcccagccagca

SEQ ID NO: 366172 - DNA, 15 bp, Homo sapiens
ggcccagccagcagg

SEQ ID NO: 366173 - DNA, 17 bp, Homo sapiens
ggcccagccatgggccc

SEQ ID NO: 366174 - DNA, 21 bp, Homo sapiens
ggcccagccatgggccctctg

SEQ ID NO: 366175 - DNA, 19 bp, Homo sapiens
ggcccagccggggtggggt

SEQ ID NO: 366176 - DNA, 23 bp, Homo sapiens
ggcccagcctggccccaaatgtt

SEQ ID NO: 366177 - DNA, 14 bp, Homo sapiens
ggcccagctgggct

SEQ ID NO: 366178 - DNA, 18 bp, Homo sapiens
ggcccagctgtagccatg

SEQ ID NO: 366179 - DNA, 19 bp, Homo sapiens
ggcccagctgtagccatgg

SEQ ID NO: 366180 - DNA, 22 bp, Homo sapiens
ggcccagctgtagccatggctc

SEQ ID NO: 366181 - DNA, 21 bp, Homo sapiens
ggcccaggatatttctgagag

SEQ ID NO: 366182 - DNA, 11 bp, Homo sapiens
ggcccaggcct

SEQ ID NO: 366183 - DNA, 15 bp, Homo sapiens
ggcccaggcctggag

SEQ ID NO: 366184 - DNA, 17 bp, Homo sapiens
ggcccaggcctggagcg

SEQ ID NO: 366185 - DNA, 17 bp, Homo sapiens
ggcccaggctcccctgc

SEQ ID NO: 366186 - DNA, 18 bp, Homo sapiens
ggcccaggctcccctgcc

SEQ ID NO: 366187 - DNA, 15 bp, Homo sapiens
ggcccaggggctttg

SEQ ID NO: 366188 - DNA, 19 bp, Homo sapiens
ggcccagtgtcaagttgtg

SEQ ID NO: 366189 - DNA, 23 bp, Homo sapiens
ggcccagtgtcaagttgtgcttg

SEQ ID NO: 366190 - DNA, 20 bp, Homo sapiens
ggcccatcactcggctgtgg

SEQ ID NO: 366191 - DNA, 23 bp, Homo sapiens
ggcccatcactcggctgtggaga

SEQ ID NO: 366192 - DNA, 13 bp, Homo sapiens
ggcccatctcagc

SEQ ID NO: 366193 - DNA, 16 bp, Homo sapiens
ggcccatctcagcctc

SEQ ID NO: 366194 - DNA, 18 bp, Homo sapiens
ggcccatctcagcctcct

SEQ ID NO: 366195 - DNA, 20 bp, Homo sapiens
ggcccatctcaggtgccact

SEQ ID NO: 366196 - DNA, 13 bp, Homo sapiens
ggcccatggcccc

SEQ ID NO: 366197 - DNA, 15 bp, Homo sapiens
ggcccatggccccag

SEQ ID NO: 366198 - DNA, 16 bp, Homo sapiens
ggcccatgggcagaag

SEQ ID NO: 366199 - DNA, 13 bp, Homo sapiens
ggccccaaagccc

SEQ ID NO: 366200 - DNA, 15 bp, Homo sapiens
ggccccaaagcccag

SEQ ID NO: 366201 - DNA, 17 bp, Homo sapiens
ggccccaaagcccagcc

SEQ ID NO: 366202 - DNA, 18 bp, Homo sapiens
ggccccaaatgttctttc

SEQ ID NO: 366203 - DNA, 13 bp, Homo sapiens
ggccccacatggg

SEQ ID NO: 366204 - DNA, 18 bp, Homo sapiens
ggccccagagactcagag

SEQ ID NO: 366205 - DNA, 23 bp, Homo sapiens
ggccccagagactcagagggagg

SEQ ID NO: 366206 - DNA, 23 bp, Homo sapiens
ggccccagatctgcctgggcctg

SEQ ID NO: 366207 - DNA, 13 bp, Homo sapiens
ggccccagctggc

SEQ ID NO: 366208 - DNA, 13 bp, Homo sapiens
ggccccaggccct

SEQ ID NO: 366209 - DNA, 19 bp, Homo sapiens
ggccccaggctcccctggt

SEQ ID NO: 366210 - DNA, 15 bp, Homo sapiens
ggccccagggaacta

SEQ ID NO: 366211 - DNA, 18 bp, Homo sapiens
ggccccagggctaccctc

SEQ ID NO: 366212 - DNA, 17 bp, Homo sapiens
ggccccaggtgccacca

SEQ ID NO: 366213 - DNA, 22 bp, Homo sapiens
ggccccaggtgccaccaataaa

SEQ ID NO: 366214 - DNA, 16 bp, Homo sapiens
ggccccatccagcatg

SEQ ID NO: 366215 - DNA, 16 bp, Homo sapiens
ggccccatgctctgcc

SEQ ID NO: 366216 - DNA, 23 bp, Homo sapiens
ggccccattcagaactctcagac

SEQ ID NO: 366217 - DNA, 22 bp, Homo sapiens
ggccccattctccctccatggc

SEQ ID NO: 366218 - DNA, 20 bp, Homo sapiens
ggcccccaaacatagcccct

SEQ ID NO: 366219 - DNA, 22 bp, Homo sapiens
ggcccccattatcctaggggtg

SEQ ID NO: 366220 - DNA, 15 bp, Homo sapiens
ggccccccagctcag

SEQ ID NO: 366221 - DNA, 21 bp, Homo sapiens
ggccccccagctcaggggcag

SEQ ID NO: 366222 - DNA, 15 bp, Homo sapiens
ggcccccgagctggg

SEQ ID NO: 366223 - DNA, 14 bp, Homo sapiens
ggcccccgccctct

SEQ ID NO: 366224 - DNA, 15 bp, Homo sapiens
ggcccccgccctctg

SEQ ID NO: 366225 - DNA, 16 bp, Homo sapiens
ggcccccgccctctgc

SEQ ID NO: 366226 - DNA, 20 bp, Homo sapiens
ggcccccggaggcgcccacc

SEQ ID NO: 366227 - DNA, 22 bp, Homo sapiens
ggcccccggaggcgcccacctg

SEQ ID NO: 366228 - DNA, 16 bp, Homo sapiens
ggccccgccctcaggc

SEQ ID NO: 366229 - DNA, 19 bp, Homo sapiens
ggccccgcgcgtgccccca

SEQ ID NO: 366230 - DNA, 21 bp, Homo sapiens
ggccccgggctctggccaccc

SEQ ID NO: 366231 - DNA, 15 bp, Homo sapiens
ggccccggggctggc

SEQ ID NO: 366232 - DNA, 16 bp, Homo sapiens
ggccccggggctggca

SEQ ID NO: 366233 - DNA, 17 bp, Homo sapiens
ggcccctaccagccacg

SEQ ID NO: 366234 - DNA, 19 bp, Homo sapiens
ggcccctcaccctgcctta

SEQ ID NO: 366235 - DNA, 14 bp, Homo sapiens
ggcccctccagacc

SEQ ID NO: 366236 - DNA, 19 bp, Homo sapiens
ggcccctccagaccctgcc

SEQ ID NO: 366237 - DNA, 16 bp, Homo sapiens
ggcccctccctacctc

SEQ ID NO: 366238 - DNA, 18 bp, Homo sapiens
ggcgtgcccccctcctcc

SEQ ID NO: 366239 - DNA, 16 bp, Homo sapiens
ggcgtgggacgtggtc

SEQ ID NO: 366240 - DNA, 22 bp, Homo sapiens
ggcgtgggatccagagagaagc

SEQ ID NO: 366241 - DNA, 14 bp, Homo sapiens
ggcgtgtcccctgc

SEQ ID NO: 366242 - DNA, 15 bp, Homo sapiens
ggcgttagtgggcag

SEQ ID NO: 366243 - DNA, 13 bp, Homo sapiens
ggcgttcctgcca

SEQ ID NO: 366244 - DNA, 22 bp, Homo sapiens
ggcgttcctgccaggctctccc

SEQ ID NO: 366245 - DNA, 23 bp, Homo sapiens
ggcgttcctgccaggctctccct

SEQ ID NO: 366246 - DNA, 16 bp, Homo sapiens
ggcgttggatttaaaa

SEQ ID NO: 366247 - DNA, 18 bp, Homo sapiens
ggctaacatttaggagaa

SEQ ID NO: 366248 - DNA, 21 bp, Homo sapiens
ggctaagatactgctgatgct

SEQ ID NO: 366249 - DNA, 18 bp, Homo sapiens
ggctaagtccagctctcc

SEQ ID NO: 366250 - DNA, 20 bp, Homo sapiens
ggctacatcccagcctgtgg

SEQ ID NO: 366251 - DNA, 20 bp, Homo sapiens
ggctacattgtaatctgctt

SEQ ID NO: 366252 - DNA, 12 bp, Homo sapiens
ggctaccctccc

SEQ ID NO: 366253 - DNA, 19 bp, Homo sapiens
ggctactctcctcggcccc

SEQ ID NO: 366254 - DNA, 15 bp, Homo sapiens
ggctactgcagcttt

SEQ ID NO: 366255 - DNA, 15 bp, Homo sapiens
ggctactggcagctc

SEQ ID NO: 366256 - DNA, 16 bp, Homo sapiens
ggctactggcagctcc

SEQ ID NO: 366257 - DNA, 13 bp, Homo sapiens
ggctagaaaaaac

SEQ ID NO: 366258 - DNA, 20 bp, Homo sapiens
ggctagaggccagccccacc

SEQ ID NO: 366259 - DNA, 17 bp, Homo sapiens
ggctaggccggccagct

SEQ ID NO: 366260 - DNA, 16 bp, Homo sapiens
ggctaggtagtgggga

SEQ ID NO: 366261 - DNA, 20 bp, Homo sapiens
ggctatagctacaggaagca

SEQ ID NO: 366262 - DNA, 18 bp, Homo sapiens
ggctatcccttctcagaa

SEQ ID NO: 366263 - DNA, 19 bp, Homo sapiens
ggctatggatggggcccag

SEQ ID NO: 366264 - DNA, 22 bp, Homo sapiens
ggctatggattttctaaggaag

SEQ ID NO: 366265 - DNA, 18 bp, Homo sapiens
ggctatggcaagggggtg

SEQ ID NO: 366266 - DNA, 15 bp, Homo sapiens
ggctatttgttcaga

SEQ ID NO: 366267 - DNA, 21 bp, Homo sapiens
ggctcaaggcaccgcagcctg

SEQ ID NO: 366268 - DNA, 14 bp, Homo sapiens
ggctcacagccacc

SEQ ID NO: 366269 - DNA, 13 bp, Homo sapiens
ggctcacgcctgt

SEQ ID NO: 366270 - DNA, 18 bp, Homo sapiens
ggctcacgcctgtaatcc

SEQ ID NO: 366271 - DNA, 14 bp, Homo sapiens
ggctcactctttcc

SEQ ID NO: 366272 - DNA, 13 bp, Homo sapiens
ggctcagctctgg

SEQ ID NO: 366273 - DNA, 16 bp, Homo sapiens
ggctcagggctggagt

SEQ ID NO: 366274 - DNA, 14 bp, Homo sapiens
ggctcagtgccacc

SEQ ID NO: 366275 - DNA, 17 bp, Homo sapiens
ggctcagtgccacctat

SEQ ID NO: 366276 - DNA, 20 bp, Homo sapiens
ggctcatattcctgcagcct

SEQ ID NO: 366277 - DNA, 16 bp, Homo sapiens
ggctcatcagaactga

SEQ ID NO: 366278 - DNA, 22 bp, Homo sapiens
ggctcatggcgtaatgggcctg

SEQ ID NO: 366279 - DNA, 23 bp, Homo sapiens
ggctcatggcgtaatgggcctgc

SEQ ID NO: 366280 - DNA, 15 bp, Homo sapiens
ggctccagcatccag

SEQ ID NO: 366281 - DNA, 19 bp, Homo sapiens
ggctccagcatccagcctg

SEQ ID NO: 366282 - DNA, 20 bp, Homo sapiens
ggctccagcatccagcctgt

SEQ ID NO: 366283 - DNA, 12 bp, Homo sapiens
ggctccaggctc

SEQ ID NO: 366284 - DNA, 19 bp, Homo sapiens
ggctccaggctccaggctg

SEQ ID NO: 366285 - DNA, 22 bp, Homo sapiens
ggctccagtctgctgccctcca

SEQ ID NO: 366286 - DNA, 16 bp, Homo sapiens
ggctcccaagggaggc

SEQ ID NO: 366287 - DNA, 18 bp, Homo sapiens
ggctcccagacccagggc

SEQ ID NO: 366288 - DNA, 20 bp, Homo sapiens
ggctcccagacccagggcag

SEQ ID NO: 366289 - DNA, 17 bp, Homo sapiens
ggctccccctgccagca

SEQ ID NO: 366290 - DNA, 19 bp, Homo sapiens
ggctccccctgccagcaac

SEQ ID NO: 366291 - DNA, 17 bp, Homo sapiens
ggctccccgcctccact

SEQ ID NO: 366292 - DNA, 13 bp, Homo sapiens
ggctcccctggtc

SEQ ID NO: 366293 - DNA, 17 bp, Homo sapiens
ggctcccctggtctcct

SEQ ID NO: 366294 - DNA, 19 bp, Homo sapiens
ggctcccgctttggggagc

SEQ ID NO: 366295 - DNA, 16 bp, Homo sapiens
ggctccctcctggagc

SEQ ID NO: 366296 - DNA, 21 bp, Homo sapiens
ggctcccttcatctccaggga

SEQ ID NO: 366297 - DNA, 18 bp, Homo sapiens
ggctccgaaaaactttgt

SEQ ID NO: 366298 - DNA, 17 bp, Homo sapiens
ggctccgagggcggcca

SEQ ID NO: 366299 - DNA, 18 bp, Homo sapiens
ggctccgagggcggccag

SEQ ID NO: 366300 - DNA, 19 bp, Homo sapiens
ggctccgagggcggccagg

SEQ ID NO: 366301 - DNA, 22 bp, Homo sapiens
ggctccgagggcggccagggac

SEQ ID NO: 366302 - DNA, 15 bp, Homo sapiens
ggctccgctgtgtgg

SEQ ID NO: 366303 - DNA, 24 bp, Homo sapiens
ggctccgtcagtatcaggcctgcc

SEQ ID NO: 366304 - DNA, 21 bp, Homo sapiens
ggctcctacaggcgctccagg

SEQ ID NO: 366305 - DNA, 13 bp, Homo sapiens
ggctcctcaccac

SEQ ID NO: 366306 - DNA, 13 bp, Homo sapiens
ggctcctccccga

SEQ ID NO: 366307 - DNA, 16 bp, Homo sapiens
ggctcctccttgccca

SEQ ID NO: 366308 - DNA, 12 bp, Homo sapiens
ggctcctgaggg

SEQ ID NO: 366309 - DNA, 13 bp, Homo sapiens
ggctcctggctgc

SEQ ID NO: 366310 - DNA, 17 bp, Homo sapiens
ggctcctggctgccagg

SEQ ID NO: 366311 - DNA, 20 bp, Homo sapiens
ggctcctggctgccaggcgt

SEQ ID NO: 366312 - DNA, 11 bp, Homo sapiens
ggctcctttcc

SEQ ID NO: 366313 - DNA, 12 bp, Homo sapiens
ggctcctttccc

SEQ ID NO: 366314 - DNA, 14 bp, Homo sapiens
ggctcctttcccac

SEQ ID NO: 366315 - DNA, 12 bp, Homo sapiens
ggctcctttctc

SEQ ID NO: 366316 - DNA, 13 bp, Homo sapiens
ggctcctttctcc

SEQ ID NO: 366317 - DNA, 19 bp, Homo sapiens
ggctcctttctccagccag

SEQ ID NO: 366318 - DNA, 20 bp, Homo sapiens
ggctcctttctccagccagc

SEQ ID NO: 366319 - DNA, 21 bp, Homo sapiens
ggctcgagcagtcctgcctca

SEQ ID NO: 366320 - DNA, 16 bp, Homo sapiens
ggctcgagtgcccctg

SEQ ID NO: 366321 - DNA, 20 bp, Homo sapiens
ggctcgccccacccagggct

SEQ ID NO: 366322 - DNA, 17 bp, Homo sapiens
ggctcggacccacccca

SEQ ID NO: 366323 - DNA, 13 bp, Homo sapiens
ggctctaatttcc

SEQ ID NO: 366324 - DNA, 18 bp, Homo sapiens
ggctctacaactgagtcc

SEQ ID NO: 366325 - DNA, 19 bp, Homo sapiens
ggctctacaactgagtcct

SEQ ID NO: 366326 - DNA, 23 bp, Homo sapiens
ggctctgaaagctgcttctgggg

SEQ ID NO: 366327 - DNA, 19 bp, Homo sapiens
ggctctgccaccctacctg

SEQ ID NO: 366328 - DNA, 21 bp, Homo sapiens
ggctctgccctccctccttcc

SEQ ID NO: 366329 - DNA, 15 bp, Homo sapiens
ggctctggccaccct

SEQ ID NO: 366330 - DNA, 23 bp, Homo sapiens
ggctctgggatagctgacccagc

SEQ ID NO: 366331 - DNA, 17 bp, Homo sapiens
ggctctgggctcagggc

SEQ ID NO: 366332 - DNA, 19 bp, Homo sapiens
ggctctgggctcagggctg

SEQ ID NO: 366333 - DNA, 19 bp, Homo sapiens
ggctctgggttcgggaaga

SEQ ID NO: 366334 - DNA, 15 bp, Homo sapiens
ggctctgtcaccgcc

SEQ ID NO: 366335 - DNA, 20 bp, Homo sapiens
ggctctgtcaccgccatgca

SEQ ID NO: 366336 - DNA, 14 bp, Homo sapiens
ggctctgtcttcct

SEQ ID NO: 366337 - DNA, 18 bp, Homo sapiens
ggctctgtggcttgctag

SEQ ID NO: 366338 - DNA, 20 bp, Homo sapiens
ggctcttagcagcttccaga

SEQ ID NO: 366339 - DNA, 23 bp, Homo sapiens
ggctcttctcctttcacaacctt

SEQ ID NO: 366340 - DNA, 15 bp, Homo sapiens
ggctctttcagagag

SEQ ID NO: 366341 - DNA, 15 bp, Homo sapiens
ggctctttccttgct

SEQ ID NO: 366342 - DNA, 16 bp, Homo sapiens
ggctctttccttgctc

SEQ ID NO: 366343 - DNA, 13 bp, Homo sapiens
ggctgaaaagtgc

SEQ ID NO: 366344 - DNA, 14 bp, Homo sapiens
ggctgaaaatcact

SEQ ID NO: 366345 - DNA, 23 bp, Homo sapiens
ggctgacacctaccatgctgctt

SEQ ID NO: 366346 - DNA, 24 bp, Homo sapiens
ggctgactagaagggccagtcctg

SEQ ID NO: 366347 - DNA, 17 bp, Homo sapiens
ggctgactggggctggg

SEQ ID NO: 366348 - DNA, 14 bp, Homo sapiens
ggctgactgggggc

SEQ ID NO: 366349 - DNA, 20 bp, Homo sapiens
ggctgagactgcagaggagc

SEQ ID NO: 366350 - DNA, 21 bp, Homo sapiens
ggctgagactggatactgccc

SEQ ID NO: 366351 - DNA, 16 bp, Homo sapiens
ggctgagagccccagc

SEQ ID NO: 366352 - DNA, 18 bp, Homo sapiens
ggctgagagggctgtggc

SEQ ID NO: 366353 - DNA, 21 bp, Homo sapiens
ggctgagagggctgtggctgg

SEQ ID NO: 366354 - DNA, 11 bp, Homo sapiens
ggctgagcccc

SEQ ID NO: 366355 - DNA, 19 bp, Homo sapiens
ggctgagccccctctcctg

SEQ ID NO: 366356 - DNA, 23 bp, Homo sapiens
ggctgagccccctctcctgaagc

SEQ ID NO: 366357 - DNA, 12 bp, Homo sapiens
ggctgagcccct

SEQ ID NO: 366358 - DNA, 13 bp, Homo sapiens
ggctgagcccctc

SEQ ID NO: 366359 - DNA, 14 bp, Homo sapiens
ggctgagcccctcc

SEQ ID NO: 366360 - DNA, 15 bp, Homo sapiens
ggctgagcccctcct

SEQ ID NO: 366361 - DNA, 18 bp, Homo sapiens
ggctgagcctactgtctc

SEQ ID NO: 366362 - DNA, 22 bp, Homo sapiens
ggctgagcctactgtctccttc

SEQ ID NO: 366363 - DNA, 23 bp, Homo sapiens
ggctgagcctactgtctccttcc

SEQ ID NO: 366364 - DNA, 23 bp, Homo sapiens
ggctgagcctgaggccttccaga

SEQ ID NO: 366365 - DNA, 15 bp, Homo sapiens
ggctgagctgagctt

SEQ ID NO: 366366 - DNA, 15 bp, Homo sapiens
ggctgagtgcagagg

SEQ ID NO: 366367 - DNA, 20 bp, Homo sapiens
ggctgagtggaatgcaggga

SEQ ID NO: 366368 - DNA, 23 bp, Homo sapiens
gggagcacttgcgtcctgcagag

SEQ ID NO: 366369 - DNA, 13 bp, Homo sapiens
gggagcagagaca

SEQ ID NO: 366370 - DNA, 11 bp, Homo sapiens
gggagcagtgt

SEQ ID NO: 366371 - DNA, 19 bp, Homo sapiens
gggagcagtgtcttccata

SEQ ID NO: 366372 - DNA, 22 bp, Homo sapiens
gggagccaatactgagtgcctg

SEQ ID NO: 366373 - DNA, 12 bp, Homo sapiens
gggagcccccgc

SEQ ID NO: 366374 - DNA, 20 bp, Homo sapiens
gggagcccctcctctgagca

SEQ ID NO: 366375 - DNA, 16 bp, Homo sapiens
gggagccgggccgcag

SEQ ID NO: 366376 - DNA, 17 bp, Homo sapiens
gggagcctgaggcagga

SEQ ID NO: 366377 - DNA, 20 bp, Homo sapiens
gggagcctgaggcaggagaa

SEQ ID NO: 366378 - DNA, 24 bp, Homo sapiens
gggagcctgcgtggcctggggctg

SEQ ID NO: 366379 - DNA, 12 bp, Homo sapiens
gggagcctggag

SEQ ID NO: 366380 - DNA, 17 bp, Homo sapiens
gggagcctggagcccct

SEQ ID NO: 366381 - DNA, 13 bp, Homo sapiens
gggagctggtgac

SEQ ID NO: 366382 - DNA, 18 bp, Homo sapiens
gggaggaacgtggttcag

SEQ ID NO: 366383 - DNA, 20 bp, Homo sapiens
gggaggaatcttttactgtg

SEQ ID NO: 366384 - DNA, 17 bp, Homo sapiens
gggaggagactcaggcc

SEQ ID NO: 366385 - DNA, 21 bp, Homo sapiens
gggaggagcacccccagcctc

SEQ ID NO: 366386 - DNA, 13 bp, Homo sapiens
gggaggagccttg

SEQ ID NO: 366387 - DNA, 17 bp, Homo sapiens
gggaggagccttggagt

SEQ ID NO: 366388 - DNA, 17 bp, Homo sapiens
gggaggaggatccgggc

SEQ ID NO: 366389 - DNA, 14 bp, Homo sapiens
gggaggcaccagct

SEQ ID NO: 366390 - DNA, 16 bp, Homo sapiens
gggaggcaccagctct

SEQ ID NO: 366391 - DNA, 13 bp, Homo sapiens
gggaggcagccgg

SEQ ID NO: 366392 - DNA, 16 bp, Homo sapiens
gggaggccaaggcagg

SEQ ID NO: 366393 - DNA, 17 bp, Homo sapiens
gggaggccaaggcaggc

SEQ ID NO: 366394 - DNA, 14 bp, Homo sapiens
gggaggcgcgagcc

SEQ ID NO: 366395 - DNA, 13 bp, Homo sapiens
gggaggctcccag

SEQ ID NO: 366396 - DNA, 14 bp, Homo sapiens
gggaggctcccaga

SEQ ID NO: 366397 - DNA, 13 bp, Homo sapiens
gggaggctctgaa

SEQ ID NO: 366398 - DNA, 16 bp, Homo sapiens
gggagggcgaggcggg

SEQ ID NO: 366399 - DNA, 14 bp, Homo sapiens
gggaggggaaccag

SEQ ID NO: 366400 - DNA, 19 bp, Homo sapiens
gggaggggcctggcctggg

SEQ ID NO: 366401 - DNA, 21 bp, Homo sapiens
gggagggggttacaaactgca

SEQ ID NO: 366402 - DNA, 18 bp, Homo sapiens
gggaggggtcagctctgg

SEQ ID NO: 366403 - DNA, 17 bp, Homo sapiens
gggagggttggggaggg

SEQ ID NO: 366404 - DNA, 17 bp, Homo sapiens
gggaggtcaggccctgg

SEQ ID NO: 366405 - DNA, 22 bp, Homo sapiens
gggaggtcaggccctggaactc

SEQ ID NO: 366406 - DNA, 22 bp, Homo sapiens
gggaggtggccgtcgagttgac

SEQ ID NO: 366407 - DNA, 20 bp, Homo sapiens
gggaggtgtttaaagagagg

SEQ ID NO: 366408 - DNA, 20 bp, Homo sapiens
gggagtacaaagacagggaa

SEQ ID NO: 366409 - DNA, 23 bp, Homo sapiens
gggagtacctgctgccccagctg

SEQ ID NO: 366410 - DNA, 10 bp, Homo sapiens
gggagtagga

SEQ ID NO: 366411 - DNA, 16 bp, Homo sapiens
gggagtcaagtgtgcc

SEQ ID NO: 366412 - DNA, 20 bp, Homo sapiens
gggagtccactttcctctct

SEQ ID NO: 366413 - DNA, 16 bp, Homo sapiens
gggagtgaacatttct

SEQ ID NO: 366414 - DNA, 19 bp, Homo sapiens
gggagtgagacagaagtaa

SEQ ID NO: 366415 - DNA, 12 bp, Homo sapiens
gggagtgggaga

SEQ ID NO: 366416 - DNA, 18 bp, Homo sapiens
gggagtgggcacctcaga

SEQ ID NO: 366417 - DNA, 19 bp, Homo sapiens
gggagtgggcacctcagaa

SEQ ID NO: 366418 - DNA, 14 bp, Homo sapiens
gggagtgtctgcag

SEQ ID NO: 366419 - DNA, 18 bp, Homo sapiens
gggagtgttctgtgggct

SEQ ID NO: 366420 - DNA, 15 bp, Homo sapiens
gggatataggagagg

SEQ ID NO: 366421 - DNA, 16 bp, Homo sapiens
gggatataggagagga

SEQ ID NO: 366422 - DNA, 13 bp, Homo sapiens
gggatccagagag

SEQ ID NO: 366423 - DNA, 13 bp, Homo sapiens
gggatcctggagc

SEQ ID NO: 366424 - DNA, 17 bp, Homo sapiens
gggatcctggagcccct

SEQ ID NO: 366425 - DNA, 21 bp, Homo sapiens
gggatcgcaccttttatacca

SEQ ID NO: 366426 - DNA, 15 bp, Homo sapiens
gggatctggggaagg

SEQ ID NO: 366427 - DNA, 16 bp, Homo sapiens
gggatctgtttgaaca

SEQ ID NO: 366428 - DNA, 16 bp, Homo sapiens
gggatcttctccctcc

SEQ ID NO: 366429 - DNA, 19 bp, Homo sapiens
gggatgaattgcctgtcct

SEQ ID NO: 366430 - DNA, 12 bp, Homo sapiens
gggatgcttcat

SEQ ID NO: 366431 - DNA, 18 bp, Homo sapiens
gggatggagaatgccagc

SEQ ID NO: 366432 - DNA, 17 bp, Homo sapiens
gggatgggcacaggctg

SEQ ID NO: 366433 - DNA, 12 bp, Homo sapiens
gggatgtagaac

SEQ ID NO: 366434 - DNA, 23 bp, Homo sapiens
gggatgtatccatgggggcaggg

SEQ ID NO: 366435 - DNA, 22 bp, Homo sapiens
gggatgttcagcactgtccctt

SEQ ID NO: 366436 - DNA, 16 bp, Homo sapiens
gggattaacctctgca

SEQ ID NO: 366437 - DNA, 16 bp, Homo sapiens
gggattcaaatgcatg

SEQ ID NO: 366438 - DNA, 15 bp, Homo sapiens
gggattcaggctgct

SEQ ID NO: 366439 - DNA, 16 bp, Homo sapiens
gggattcaggctgctt

SEQ ID NO: 366440 - DNA, 21 bp, Homo sapiens
gggattctactttaagcacta

SEQ ID NO: 366441 - DNA, 22 bp, Homo sapiens
gggattctctattggaggtgag

SEQ ID NO: 366442 - DNA, 16 bp, Homo sapiens
gggattgggggctggt

SEQ ID NO: 366443 - DNA, 15 bp, Homo sapiens
gggatttctcccagc

SEQ ID NO: 366444 - DNA, 17 bp, Homo sapiens
gggatttctcccagctc

SEQ ID NO: 366445 - DNA, 18 bp, Homo sapiens
gggatttcttcgctgctc

SEQ ID NO: 366446 - DNA, 14 bp, Homo sapiens
gggcaaacaggcag

SEQ ID NO: 366447 - DNA, 18 bp, Homo sapiens
gggcaaagccacaaggct

SEQ ID NO: 366448 - DNA, 20 bp, Homo sapiens
gggcaaagccacaaggctgg

SEQ ID NO: 366449 - DNA, 18 bp, Homo sapiens
gggcaaccctggtgacca

SEQ ID NO: 366450 - DNA, 13 bp, Homo sapiens
gggcaagaccttt

SEQ ID NO: 366451 - DNA, 12 bp, Homo sapiens
gggcaagaggga

SEQ ID NO: 366452 - DNA, 21 bp, Homo sapiens
gggcaaggtgggggagcctgg

SEQ ID NO: 366453 - DNA, 15 bp, Homo sapiens
gggcacaccactgcc

SEQ ID NO: 366454 - DNA, 17 bp, Homo sapiens
gggcacaccactgccct

SEQ ID NO: 366455 - DNA, 20 bp, Homo sapiens
gggcacaccactgccctgcc

SEQ ID NO: 366456 - DNA, 22 bp, Homo sapiens
gggcacacttccccttgggatg

SEQ ID NO: 366457 - DNA, 23 bp, Homo sapiens
gggcacacttccccttgggatgg

SEQ ID NO: 366458 - DNA, 14 bp, Homo sapiens
gggcacagcctagg

SEQ ID NO: 366459 - DNA, 13 bp, Homo sapiens
gggcacaggctgc

SEQ ID NO: 366460 - DNA, 17 bp, Homo sapiens
gggcaccaagcccacag

SEQ ID NO: 366461 - DNA, 19 bp, Homo sapiens
gggcacctcatggactcca

SEQ ID NO: 366462 - DNA, 18 bp, Homo sapiens
gggcacctggggagtggg

SEQ ID NO: 366463 - DNA, 17 bp, Homo sapiens
gggcacgctgtgggcag

SEQ ID NO: 366464 - DNA, 18 bp, Homo sapiens
gggcacgctgtgggcagg

SEQ ID NO: 366465 - DNA, 13 bp, Homo sapiens
gggcacgggagag

SEQ ID NO: 366466 - DNA, 17 bp, Homo sapiens
gggcactggaaaacata

SEQ ID NO: 366467 - DNA, 17 bp, Homo sapiens
gggcactggctgctctg

SEQ ID NO: 366468 - DNA, 20 bp, Homo sapiens
gggcactggctgctctgtct

SEQ ID NO: 366469 - DNA, 18 bp, Homo sapiens
gggcacttttgaactcac

SEQ ID NO: 366470 - DNA, 23 bp, Homo sapiens
gggcacttttgaactcacgagcc

SEQ ID NO: 366471 - DNA, 24 bp, Homo sapiens
gggcacttttgaactcacgagcct

SEQ ID NO: 366472 - DNA, 12 bp, Homo sapiens
gggcagagcagc

SEQ ID NO: 366473 - DNA, 15 bp, Homo sapiens
gggcagagctgagtc

SEQ ID NO: 366474 - DNA, 16 bp, Homo sapiens
gggcagagctgagtcg

SEQ ID NO: 366475 - DNA, 20 bp, Homo sapiens
gggcagagctgagtcggctg

SEQ ID NO: 366476 - DNA, 21 bp, Homo sapiens
gggcagagctgagtcggctgg

SEQ ID NO: 366477 - DNA, 12 bp, Homo sapiens
gggcagagggaa

SEQ ID NO: 366478 - DNA, 23 bp, Homo sapiens
gggcagaggggagaggaagcaca

SEQ ID NO: 366479 - DNA, 13 bp, Homo sapiens
gggcagaggggca

SEQ ID NO: 366480 - DNA, 18 bp, Homo sapiens
gggcagaggggcagccgc

SEQ ID NO: 366481 - DNA, 21 bp, Homo sapiens
gggcagcactgggaagctgga

SEQ ID NO: 366482 - DNA, 13 bp, Homo sapiens
gggcagcaggagc

SEQ ID NO: 366483 - DNA, 13 bp, Homo sapiens
gggcagccaggct

SEQ ID NO: 366484 - DNA, 12 bp, Homo sapiens
gggcagcccaga

SEQ ID NO: 366485 - DNA, 14 bp, Homo sapiens
gggcagcccagaga

SEQ ID NO: 366486 - DNA, 14 bp, Homo sapiens
gggcagcccctccc

SEQ ID NO: 366487 - DNA, 20 bp, Homo sapiens
gggcagcccctgctggacca

SEQ ID NO: 366488 - DNA, 22 bp, Homo sapiens
gggcagccgctaggagagactg

SEQ ID NO: 366489 - DNA, 18 bp, Homo sapiens
gggcagcctggctcccag

SEQ ID NO: 366490 - DNA, 19 bp, Homo sapiens
gggcagctgttagagtcca

SEQ ID NO: 366491 - DNA, 21 bp, Homo sapiens
gggcaggaaggagagcctgct

SEQ ID NO: 366492 - DNA, 18 bp, Homo sapiens
gggcaggaatcaaggagc

SEQ ID NO: 366493 - DNA, 22 bp, Homo sapiens
gggcaggccagcttcgtgctgg

SEQ ID NO: 366494 - DNA, 21 bp, Homo sapiens
gggcaggcctgggacccagct

SEQ ID NO: 366495 - DNA, 20 bp, Homo sapiens
gggcagggaaggggaggcag

SEQ ID NO: 366496 - DNA, 14 bp, Homo sapiens
gggcagggagtgat

SEQ ID NO: 366497 - DNA, 16 bp, Homo sapiens
gggcagggagtgatga

SEQ ID NO: 366498 - DNA, 12 bp, Homo sapiens
gggcagggcagc

SEQ ID NO: 366499 - DNA, 19 bp, Homo sapiens
ggggcacaccactgccctg

SEQ ID NO: 366500 - DNA, 21 bp, Homo sapiens
ggggcacaccactgccctgcc

SEQ ID NO: 366501 - DNA, 21 bp, Homo sapiens
ggggcacactacagagcagct

SEQ ID NO: 366502 - DNA, 14 bp, Homo sapiens
ggggcacccagccc

SEQ ID NO: 366503 - DNA, 16 bp, Homo sapiens
ggggcagaaggaggaa

SEQ ID NO: 366504 - DNA, 13 bp, Homo sapiens
ggggcagagctga

SEQ ID NO: 366505 - DNA, 20 bp, Homo sapiens
ggggcagaggggcagccgct

SEQ ID NO: 366506 - DNA, 23 bp, Homo sapiens
ggggcaggaagtccctgagaagc

SEQ ID NO: 366507 - DNA, 22 bp, Homo sapiens
ggggcaggaatcaaggagcctc

SEQ ID NO: 366508 - DNA, 13 bp, Homo sapiens
ggggcaggcctgg

SEQ ID NO: 366509 - DNA, 16 bp, Homo sapiens
ggggcaggcctgggac

SEQ ID NO: 366510 - DNA, 16 bp, Homo sapiens
ggggcagggcagggcg

SEQ ID NO: 366511 - DNA, 17 bp, Homo sapiens
ggggcatggacagggcc

SEQ ID NO: 366512 - DNA, 18 bp, Homo sapiens
ggggcatggacagggcca

SEQ ID NO: 366513 - DNA, 15 bp, Homo sapiens
ggggcatgggggagg

SEQ ID NO: 366514 - DNA, 18 bp, Homo sapiens
ggggcatggttccttccc

SEQ ID NO: 366515 - DNA, 17 bp, Homo sapiens
ggggccagactggctgc

SEQ ID NO: 366516 - DNA, 20 bp, Homo sapiens
ggggccatgagctccagacc

SEQ ID NO: 366517 - DNA, 14 bp, Homo sapiens
ggggccatggaagc

SEQ ID NO: 366518 - DNA, 17 bp, Homo sapiens
ggggccatggaagctgg

SEQ ID NO: 366519 - DNA, 22 bp, Homo sapiens
ggggcccacagacagatcccat

SEQ ID NO: 366520 - DNA, 16 bp, Homo sapiens
ggggcccatggcccca

SEQ ID NO: 366521 - DNA, 18 bp, Homo sapiens
ggggcccatggccccagc

SEQ ID NO: 366522 - DNA, 12 bp, Homo sapiens
ggggccccaaag

SEQ ID NO: 366523 - DNA, 18 bp, Homo sapiens
ggggccccaaagcccagc

SEQ ID NO: 366524 - DNA, 19 bp, Homo sapiens
ggggccccaaagcccagcc

SEQ ID NO: 366525 - DNA, 21 bp, Homo sapiens
ggggccccaaagcccagcccg

SEQ ID NO: 366526 - DNA, 14 bp, Homo sapiens
ggggccccagatct

SEQ ID NO: 366527 - DNA, 16 bp, Homo sapiens
ggggccccggggctgg

SEQ ID NO: 366528 - DNA, 15 bp, Homo sapiens
ggggcccctcctctg

SEQ ID NO: 366529 - DNA, 21 bp, Homo sapiens
ggggcccgcctggcagaactg

SEQ ID NO: 366530 - DNA, 23 bp, Homo sapiens
ggggcccgcctggcagaactgag

SEQ ID NO: 366531 - DNA, 14 bp, Homo sapiens
ggggcccttccaga

SEQ ID NO: 366532 - DNA, 22 bp, Homo sapiens
ggggcccttgggacagccagag

SEQ ID NO: 366533 - DNA, 20 bp, Homo sapiens
ggggcccttggggcctggct

SEQ ID NO: 366534 - DNA, 21 bp, Homo sapiens
ggggcccttggggcctggctt

SEQ ID NO: 366535 - DNA, 13 bp, Homo sapiens
ggggccgggctgg

SEQ ID NO: 366536 - DNA, 22 bp, Homo sapiens
ggggcctagtggcttcagcccc

SEQ ID NO: 366537 - DNA, 14 bp, Homo sapiens
ggggcctcacccag

SEQ ID NO: 366538 - DNA, 21 bp, Homo sapiens
ggggcctctgcctccaggagg

SEQ ID NO: 366539 - DNA, 13 bp, Homo sapiens
ggggcctctggct

SEQ ID NO: 366540 - DNA, 18 bp, Homo sapiens
ggggcctgcaggccccag

SEQ ID NO: 366541 - DNA, 14 bp, Homo sapiens
ggggcctggacctg

SEQ ID NO: 366542 - DNA, 16 bp, Homo sapiens
ggggcctggacctgcc

SEQ ID NO: 366543 - DNA, 13 bp, Homo sapiens
ggggcctggcagg

SEQ ID NO: 366544 - DNA, 14 bp, Homo sapiens
ggggcctggcttgc

SEQ ID NO: 366545 - DNA, 21 bp, Homo sapiens
ggggcctggcttgctccaggg

SEQ ID NO: 366546 - DNA, 12 bp, Homo sapiens
ggggcgctcagg

SEQ ID NO: 366547 - DNA, 21 bp, Homo sapiens
ggggcgctcaggacccaggcc

SEQ ID NO: 366548 - DNA, 14 bp, Homo sapiens
ggggcggggcagga

SEQ ID NO: 366549 - DNA, 13 bp, Homo sapiens
ggggcggggccag

SEQ ID NO: 366550 - DNA, 15 bp, Homo sapiens
ggggcgtgtccctcc

SEQ ID NO: 366551 - DNA, 21 bp, Homo sapiens
ggggctaaaggggagaaactg

SEQ ID NO: 366552 - DNA, 15 bp, Homo sapiens
ggggctaactggccc

SEQ ID NO: 366553 - DNA, 23 bp, Homo sapiens
ggggctcgagtgcccctgcaggg

SEQ ID NO: 366554 - DNA, 18 bp, Homo sapiens
ggggctctccaaaggggc

SEQ ID NO: 366555 - DNA, 14 bp, Homo sapiens
ggggctctgcttcc

SEQ ID NO: 366556 - DNA, 20 bp, Homo sapiens
ggggctctgcttcctcagcc

SEQ ID NO: 366557 - DNA, 16 bp, Homo sapiens
ggggctgagtctggct

SEQ ID NO: 366558 - DNA, 18 bp, Homo sapiens
ggggctgagtgcagaggc

SEQ ID NO: 366559 - DNA, 15 bp, Homo sapiens
ggggctgcacctcct

SEQ ID NO: 366560 - DNA, 23 bp, Homo sapiens
ggggctgcacctcctaccctccc

SEQ ID NO: 366561 - DNA, 11 bp, Homo sapiens
ggggctgctgg

SEQ ID NO: 366562 - DNA, 21 bp, Homo sapiens
ggggctggccctgccctcccc

SEQ ID NO: 366563 - DNA, 16 bp, Homo sapiens
ggggctggccttcctg

SEQ ID NO: 366564 - DNA, 11 bp, Homo sapiens
ggggctgggcc

SEQ ID NO: 366565 - DNA, 22 bp, Homo sapiens
ggggcttcaaccttgagacagc

SEQ ID NO: 366566 - DNA, 18 bp, Homo sapiens
ggggcttccatggtggtt

SEQ ID NO: 366567 - DNA, 14 bp, Homo sapiens
ggggcttccctctg

SEQ ID NO: 366568 - DNA, 13 bp, Homo sapiens
ggggcttggaagg

SEQ ID NO: 366569 - DNA, 14 bp, Homo sapiens
ggggcttggagcag

SEQ ID NO: 366570 - DNA, 11 bp, Homo sapiens
ggggcttggcg

SEQ ID NO: 366571 - DNA, 23 bp, Homo sapiens
ggggcttggggtagagaggacag

SEQ ID NO: 366572 - DNA, 22 bp, Homo sapiens
gggggacaggaacacccagccc

SEQ ID NO: 366573 - DNA, 11 bp, Homo sapiens
gggggagctga

SEQ ID NO: 366574 - DNA, 15 bp, Homo sapiens
gggggaggagcaccc

SEQ ID NO: 366575 - DNA, 13 bp, Homo sapiens
gggggaggctctg

SEQ ID NO: 366576 - DNA, 18 bp, Homo sapiens
gggggattcaaatgcatg

SEQ ID NO: 366577 - DNA, 22 bp, Homo sapiens
gggggcaagagctcaggagaag

SEQ ID NO: 366578 - DNA, 14 bp, Homo sapiens
gggggcaaggtggg

SEQ ID NO: 366579 - DNA, 17 bp, Homo sapiens
gggggccacctccccag

SEQ ID NO: 366580 - DNA, 14 bp, Homo sapiens
gggggccaggtgca

SEQ ID NO: 366581 - DNA, 18 bp, Homo sapiens
gggggccctggggtcccc

SEQ ID NO: 366582 - DNA, 17 bp, Homo sapiens
gggggcctagtggcttc

SEQ ID NO: 366583 - DNA, 14 bp, Homo sapiens
gggggcctgcaggc

SEQ ID NO: 366584 - DNA, 22 bp, Homo sapiens
gggggctatagctacaggaagc

SEQ ID NO: 366585 - DNA, 13 bp, Homo sapiens
gggggctggtgcc

SEQ ID NO: 366586 - DNA, 21 bp, Homo sapiens
gggggctggtgccagccttcc

SEQ ID NO: 366587 - DNA, 21 bp, Homo sapiens
gggggcttggggtagagagga

SEQ ID NO: 366588 - DNA, 14 bp, Homo sapiens
gggggtagagctga

SEQ ID NO: 366589 - DNA, 15 bp, Homo sapiens
gggggtagagctgat

SEQ ID NO: 366590 - DNA, 13 bp, Homo sapiens
gggggtcccagga

SEQ ID NO: 366591 - DNA, 19 bp, Homo sapiens
gggggtcggaagcctgtcc

SEQ ID NO: 366592 - DNA, 15 bp, Homo sapiens
ggggtaaatatatgt

SEQ ID NO: 366593 - DNA, 23 bp, Homo sapiens
ggggtaaatatatgttttgagaa

SEQ ID NO: 366594 - DNA, 13 bp, Homo sapiens
ggggtagagagga

SEQ ID NO: 366595 - DNA, 16 bp, Homo sapiens
ggggtagagaggacag

SEQ ID NO: 366596 - DNA, 20 bp, Homo sapiens
ggggtcaggaacagtggctg

SEQ ID NO: 366597 - DNA, 15 bp, Homo sapiens
ggggtcaggctccat

SEQ ID NO: 366598 - DNA, 22 bp, Homo sapiens
ggggtcagggaccaaggacccc

SEQ ID NO: 366599 - DNA, 21 bp, Homo sapiens
ggggtcccaggatcccctgct

SEQ ID NO: 366600 - DNA, 18 bp, Homo sapiens
ggggtccccactccctgt

SEQ ID NO: 366601 - DNA, 20 bp, Homo sapiens
ggggtcgggggaggagcacc

SEQ ID NO: 366602 - DNA, 22 bp, Homo sapiens
ggggtcgggggaggagcacccc

SEQ ID NO: 366603 - DNA, 13 bp, Homo sapiens
ggggtctatacat

SEQ ID NO: 366604 - DNA, 17 bp, Homo sapiens
ggggtctatacattcct

SEQ ID NO: 366605 - DNA, 19 bp, Homo sapiens
ggggtctccctgagcctgc

SEQ ID NO: 366606 - DNA, 20 bp, Homo sapiens
ggggtctccctgagcctgcc

SEQ ID NO: 366607 - DNA, 14 bp, Homo sapiens
ggggtctgggaggc

SEQ ID NO: 366608 - DNA, 17 bp, Homo sapiens
ggggtctgggaggcagg

SEQ ID NO: 366609 - DNA, 18 bp, Homo sapiens
ggggtctgtatatacatt

SEQ ID NO: 366610 - DNA, 13 bp, Homo sapiens
ggggtctgtgctg

SEQ ID NO: 366611 - DNA, 14 bp, Homo sapiens
ggggtctgtgctgt

SEQ ID NO: 366612 - DNA, 20 bp, Homo sapiens
ggggtctgtgctgtgcctgc

SEQ ID NO: 366613 - DNA, 13 bp, Homo sapiens
ggggtgaagctgg

SEQ ID NO: 366614 - DNA, 21 bp, Homo sapiens
ggggtgagacagtgggggtgc

SEQ ID NO: 366615 - DNA, 18 bp, Homo sapiens
ggggtgccaaaatgccta

SEQ ID NO: 366616 - DNA, 21 bp, Homo sapiens
ggggtgccctccactgccctc

SEQ ID NO: 366617 - DNA, 14 bp, Homo sapiens
ggggtgcttgctgt

SEQ ID NO: 366618 - DNA, 14 bp, Homo sapiens
ggggtgggagccaa

SEQ ID NO: 366619 - DNA, 14 bp, Homo sapiens
ggggtgggggcctg

SEQ ID NO: 366620 - DNA, 12 bp, Homo sapiens
ggggtggggtgc

SEQ ID NO: 366621 - DNA, 18 bp, Homo sapiens
ggggtggttggaggcctg

SEQ ID NO: 366622 - DNA, 21 bp, Homo sapiens
ggggtgtgttccaactgcccc

SEQ ID NO: 366623 - DNA, 15 bp, Homo sapiens
ggggtgttccaaaga

SEQ ID NO: 366624 - DNA, 13 bp, Homo sapiens
ggggttacaaact

SEQ ID NO: 366625 - DNA, 17 bp, Homo sapiens
ggggttacaaactgcaa

SEQ ID NO: 366626 - DNA, 19 bp, Homo sapiens
ggggttggctgttccagac

SEQ ID NO: 366627 - DNA, 18 bp, Homo sapiens
ggggtttccacacaggcc

SEQ ID NO: 366628 - DNA, 21 bp, Homo sapiens
ggggtttccacacaggcccat

SEQ ID NO: 366629 - DNA, 20 bp, Homo sapiens
ggggtttgcttttgttttgt

SEQ ID NO: 366630 - DNA, 23 bp, Homo sapiens
ggtcctgtctcccctctgctggc

SEQ ID NO: 366631 - DNA, 12 bp, Homo sapiens
ggtcctttcctt

SEQ ID NO: 366632 - DNA, 21 bp, Homo sapiens
ggtcgcccctcctcgggcgcc

SEQ ID NO: 366633 - DNA, 15 bp, Homo sapiens
ggtcggccctgccca

SEQ ID NO: 366634 - DNA, 14 bp, Homo sapiens
ggtcgggctcagct

SEQ ID NO: 366635 - DNA, 15 bp, Homo sapiens
ggtcgggggaggagc

SEQ ID NO: 366636 - DNA, 21 bp, Homo sapiens
ggtcgggggaggagcaccccc

SEQ ID NO: 366637 - DNA, 23 bp, Homo sapiens
ggtcgggggaggagcacccccag

SEQ ID NO: 366638 - DNA, 14 bp, Homo sapiens
ggtcgtttttttca

SEQ ID NO: 366639 - DNA, 12 bp, Homo sapiens
ggtctatttctc

SEQ ID NO: 366640 - DNA, 18 bp, Homo sapiens
ggtctatttctcccttca

SEQ ID NO: 366641 - DNA, 23 bp, Homo sapiens
ggtctcaaactcctgggctcagg

SEQ ID NO: 366642 - DNA, 12 bp, Homo sapiens
ggtctccacccc

SEQ ID NO: 366643 - DNA, 13 bp, Homo sapiens
ggtctccacccct

SEQ ID NO: 366644 - DNA, 18 bp, Homo sapiens
ggtctccacccctcaagc

SEQ ID NO: 366645 - DNA, 21 bp, Homo sapiens
ggtctccatatcagctctctg

SEQ ID NO: 366646 - DNA, 18 bp, Homo sapiens
ggtctccatttttcccag

SEQ ID NO: 366647 - DNA, 18 bp, Homo sapiens
ggtctccctgagcctgcc

SEQ ID NO: 366648 - DNA, 23 bp, Homo sapiens
ggtctccctggtggggtgtgcat

SEQ ID NO: 366649 - DNA, 14 bp, Homo sapiens
ggtctcctcagggt

SEQ ID NO: 366650 - DNA, 18 bp, Homo sapiens
ggtctcctcagggtgggg

SEQ ID NO: 366651 - DNA, 20 bp, Homo sapiens
ggtctcctctgattatcagg

SEQ ID NO: 366652 - DNA, 19 bp, Homo sapiens
ggtctcctctttgttttgt

SEQ ID NO: 366653 - DNA, 19 bp, Homo sapiens
ggtctcgctttgttgccca

SEQ ID NO: 366654 - DNA, 21 bp, Homo sapiens
ggtctcgctttgttgcccagg

SEQ ID NO: 366655 - DNA, 19 bp, Homo sapiens
ggtctctgagcagtgggga

SEQ ID NO: 366656 - DNA, 13 bp, Homo sapiens
ggtctgaaaggaa

SEQ ID NO: 366657 - DNA, 12 bp, Homo sapiens
ggtctgaaatgg

SEQ ID NO: 366658 - DNA, 21 bp, Homo sapiens
ggtctgaaggaatagccagag

SEQ ID NO: 366659 - DNA, 12 bp, Homo sapiens
ggtctgaatgtt

SEQ ID NO: 366660 - DNA, 14 bp, Homo sapiens
ggtctgaatgttct

SEQ ID NO: 366661 - DNA, 21 bp, Homo sapiens
ggtctgagatcggcccagctc

SEQ ID NO: 366662 - DNA, 19 bp, Homo sapiens
ggtctgcattttctcaggc

SEQ ID NO: 366663 - DNA, 11 bp, Homo sapiens
ggtctgcctcc

SEQ ID NO: 366664 - DNA, 20 bp, Homo sapiens
ggtctgctctttctctgcca

SEQ ID NO: 366665 - DNA, 13 bp, Homo sapiens
ggtctggagcccc

SEQ ID NO: 366666 - DNA, 15 bp, Homo sapiens
ggtctggagccccta

SEQ ID NO: 366667 - DNA, 15 bp, Homo sapiens
ggtctggcctagtgg

SEQ ID NO: 366668 - DNA, 20 bp, Homo sapiens
ggtctgggagaggcagagtg

SEQ ID NO: 366669 - DNA, 14 bp, Homo sapiens
ggtctgggaggcag

SEQ ID NO: 366670 - DNA, 15 bp, Homo sapiens
ggtctgtgctgtgcc

SEQ ID NO: 366671 - DNA, 18 bp, Homo sapiens
ggtctgtgtctcttttct

SEQ ID NO: 366672 - DNA, 22 bp, Homo sapiens
ggtcttccctacctcaggcagg

SEQ ID NO: 366673 - DNA, 22 bp, Homo sapiens
ggtcttcttacatgcatttgag

SEQ ID NO: 366674 - DNA, 14 bp, Homo sapiens
ggtcttggagagga

SEQ ID NO: 366675 - DNA, 18 bp, Homo sapiens
ggtcttgggctactggca

SEQ ID NO: 366676 - DNA, 21 bp, Homo sapiens
ggtcttgggctactggcagct

SEQ ID NO: 366677 - DNA, 21 bp, Homo sapiens
ggtcttgggggtcagggggga

SEQ ID NO: 366678 - DNA, 20 bp, Homo sapiens
ggtctttgaaatatgcatgt

SEQ ID NO: 366679 - DNA, 21 bp, Homo sapiens
ggtcttttgacatgtggaaag

SEQ ID NO: 366680 - DNA, 22 bp, Homo sapiens
ggtgaaaagtatggcagtggga

SEQ ID NO: 366681 - DNA, 12 bp, Homo sapiens
ggtgaaacacac

SEQ ID NO: 366682 - DNA, 14 bp, Homo sapiens
ggtgaaacacacac

SEQ ID NO: 366683 - DNA, 21 bp, Homo sapiens
ggtgaaacacacacacattct

SEQ ID NO: 366684 - DNA, 13 bp, Homo sapiens
ggtgaaagggagc

SEQ ID NO: 366685 - DNA, 12 bp, Homo sapiens
ggtgaaattatg

SEQ ID NO: 366686 - DNA, 16 bp, Homo sapiens
ggtgaacttggttccc

SEQ ID NO: 366687 - DNA, 16 bp, Homo sapiens
ggtgaagctggggaca

SEQ ID NO: 366688 - DNA, 19 bp, Homo sapiens
ggtgaagctggggacagct

SEQ ID NO: 366689 - DNA, 13 bp, Homo sapiens
ggtgaagtgtggc

SEQ ID NO: 366690 - DNA, 23 bp, Homo sapiens
ggtgacagagcgagactctgtct

SEQ ID NO: 366691 - DNA, 23 bp, Homo sapiens
ggtgacagagcgagattccgtct

SEQ ID NO: 366692 - DNA, 17 bp, Homo sapiens
ggtgacagcagtcggtt

SEQ ID NO: 366693 - DNA, 12 bp, Homo sapiens
ggtgacaggcag

SEQ ID NO: 366694 - DNA, 14 bp, Homo sapiens
ggtgacatcccagg

SEQ ID NO: 366695 - DNA, 15 bp, Homo sapiens
ggtgaccgcccagct

SEQ ID NO: 366696 - DNA, 18 bp, Homo sapiens
ggtgagaatcctgcctct

SEQ ID NO: 366697 - DNA, 16 bp, Homo sapiens
ggtgagaattaaaata

SEQ ID NO: 366698 - DNA, 13 bp, Homo sapiens
ggtgagactctga

SEQ ID NO: 366699 - DNA, 20 bp, Homo sapiens
ggtgagactctgaggtgtca

SEQ ID NO: 366700 - DNA, 16 bp, Homo sapiens
ggtgagagaggaaaga

SEQ ID NO: 366701 - DNA, 21 bp, Homo sapiens
ggtgagatacccagagagaaa

SEQ ID NO: 366702 - DNA, 11 bp, Homo sapiens
ggtgagctggg

SEQ ID NO: 366703 - DNA, 17 bp, Homo sapiens
ggtgaggaagctccagt

SEQ ID NO: 366704 - DNA, 18 bp, Homo sapiens
ggtgaggaccactcctgt

SEQ ID NO: 366705 - DNA, 15 bp, Homo sapiens
ggtgaggaggaggca

SEQ ID NO: 366706 - DNA, 15 bp, Homo sapiens
ggtgaggcaataaaa

SEQ ID NO: 366707 - DNA, 20 bp, Homo sapiens
ggtgagggctgagagggctg

SEQ ID NO: 366708 - DNA, 15 bp, Homo sapiens
ggtgaggggccactg

SEQ ID NO: 366709 - DNA, 19 bp, Homo sapiens
ggtgaggggccactgggcc

SEQ ID NO: 366710 - DNA, 21 bp, Homo sapiens
ggtgaggggccaggccatggc

SEQ ID NO: 366711 - DNA, 23 bp, Homo sapiens
ggtgaggtgggggtctggcctag

SEQ ID NO: 366712 - DNA, 14 bp, Homo sapiens
ggtgagtggctgac

SEQ ID NO: 366713 - DNA, 16 bp, Homo sapiens
ggtgagtgtgagggca

SEQ ID NO: 366714 - DNA, 19 bp, Homo sapiens
ggtgagtgtgagggcagca

SEQ ID NO: 366715 - DNA, 20 bp, Homo sapiens
ggtgatatccattctttctg

SEQ ID NO: 366716 - DNA, 14 bp, Homo sapiens
ggtgatcctctatt

SEQ ID NO: 366717 - DNA, 18 bp, Homo sapiens
ggtgatcctctattttgt

SEQ ID NO: 366718 - DNA, 16 bp, Homo sapiens
ggtgatgtcctgtaaa

SEQ ID NO: 366719 - DNA, 20 bp, Homo sapiens
ggtgatgtttccagctgcca

SEQ ID NO: 366720 - DNA, 21 bp, Homo sapiens
ggtgatgtttccagctgccaa

SEQ ID NO: 366721 - DNA, 15 bp, Homo sapiens
ggtgcaagagggagc

SEQ ID NO: 366722 - DNA, 22 bp, Homo sapiens
ggtgcaaggccatctgcttacc

SEQ ID NO: 366723 - DNA, 19 bp, Homo sapiens
ggtgcagccttcccctccc

SEQ ID NO: 366724 - DNA, 22 bp, Homo sapiens
ggtgcatacacccccacctcct

SEQ ID NO: 366725 - DNA, 19 bp, Homo sapiens
ggtgcattacagagaggag

SEQ ID NO: 366726 - DNA, 12 bp, Homo sapiens
ggtgccaccaat

SEQ ID NO: 366727 - DNA, 14 bp, Homo sapiens
ggtgccaccaataa

SEQ ID NO: 366728 - DNA, 16 bp, Homo sapiens
ggtgccaccaataaaa

SEQ ID NO: 366729 - DNA, 18 bp, Homo sapiens
ggtgccaccaataaaaat

SEQ ID NO: 366730 - DNA, 16 bp, Homo sapiens
ggtgccactccctgag

SEQ ID NO: 366731 - DNA, 17 bp, Homo sapiens
ggtgccactccctgagc

SEQ ID NO: 366732 - DNA, 18 bp, Homo sapiens
ggtgccactccctgagct

SEQ ID NO: 366733 - DNA, 21 bp, Homo sapiens
ggtgccccacagctacctgag

SEQ ID NO: 366734 - DNA, 12 bp, Homo sapiens
ggtgccctgtgg

SEQ ID NO: 366735 - DNA, 14 bp, Homo sapiens
ggtgccgtgagcag

SEQ ID NO: 366736 - DNA, 17 bp, Homo sapiens
ggtgccgtgagcaggct

SEQ ID NO: 366737 - DNA, 14 bp, Homo sapiens
ggtgcctgagcccg

SEQ ID NO: 366738 - DNA, 16 bp, Homo sapiens
ggtgcctgctctcctt

SEQ ID NO: 366739 - DNA, 20 bp, Homo sapiens
ggtgcctggtgcgctgtgct

SEQ ID NO: 366740 - DNA, 21 bp, Homo sapiens
ggtgcctggtgcgctgtgctc

SEQ ID NO: 366741 - DNA, 14 bp, Homo sapiens
ggtgcgctgtgctc

SEQ ID NO: 366742 - DNA, 23 bp, Homo sapiens
ggtgcgctgtgctccagcagtgc

SEQ ID NO: 366743 - DNA, 18 bp, Homo sapiens
ggtgcggaccggagcggc

SEQ ID NO: 366744 - DNA, 20 bp, Homo sapiens
ggtgcggaccggagcggctg

SEQ ID NO: 366745 - DNA, 24 bp, Homo sapiens
ggtgcggaccggagcggctgagga

SEQ ID NO: 366746 - DNA, 16 bp, Homo sapiens
ggtgcggtaggtgctg

SEQ ID NO: 366747 - DNA, 20 bp, Homo sapiens
ggtgcggtaggtgctggcct

SEQ ID NO: 366748 - DNA, 21 bp, Homo sapiens
ggtgcggtaggtgctggcctc

SEQ ID NO: 366749 - DNA, 20 bp, Homo sapiens
ggtgcgtgaccggcccgcca

SEQ ID NO: 366750 - DNA, 16 bp, Homo sapiens
ggtgctagggtgcctg

SEQ ID NO: 366751 - DNA, 18 bp, Homo sapiens
ggtgctagggtgcctgct

SEQ ID NO: 366752 - DNA, 20 bp, Homo sapiens
ggtgctagggtgcctgctct

SEQ ID NO: 366753 - DNA, 15 bp, Homo sapiens
ggtgctcaaagatgt

SEQ ID NO: 366754 - DNA, 23 bp, Homo sapiens
ggtgctcaaagatgtactgagag

SEQ ID NO: 366755 - DNA, 15 bp, Homo sapiens
ggtgctcagggctga

SEQ ID NO: 366756 - DNA, 15 bp, Homo sapiens
ggtgctccctcctca

SEQ ID NO: 366757 - DNA, 10 bp, Homo sapiens
ggtgctctgg

SEQ ID NO: 366758 - DNA, 19 bp, Homo sapiens
ggtgctctggcggcttcct

SEQ ID NO: 366759 - DNA, 19 bp, Homo sapiens
ggtgctctggctggagagg

SEQ ID NO: 366760 - DNA, 20 bp, Homo sapiens
gtaatctgtaaatgaacaca

SEQ ID NO: 366761 - DNA, 23 bp, Homo sapiens
gtaatgaggtggtactatgatta

SEQ ID NO: 366762 - DNA, 21 bp, Homo sapiens
gtaatgcagacatttacatgt

SEQ ID NO: 366763 - DNA, 16 bp, Homo sapiens
gtaatgtaacttaatt

SEQ ID NO: 366764 - DNA, 17 bp, Homo sapiens
gtaatgtagttctttgt

SEQ ID NO: 366765 - DNA, 17 bp, Homo sapiens
gtaatgtatcttattta

SEQ ID NO: 366766 - DNA, 19 bp, Homo sapiens
gtaatgtatcttatttata

SEQ ID NO: 366767 - DNA, 17 bp, Homo sapiens
gtaatgttactgatcat

SEQ ID NO: 366768 - DNA, 21 bp, Homo sapiens
gtaatgttactgatcatgcat

SEQ ID NO: 366769 - DNA, 22 bp, Homo sapiens
gtaatgttactgatcatgcatt

SEQ ID NO: 366770 - DNA, 23 bp, Homo sapiens
gtaatgttactgatcatgcattg

SEQ ID NO: 366771 - DNA, 20 bp, Homo sapiens
gtaattatcgggaacagtgt

SEQ ID NO: 366772 - DNA, 21 bp, Homo sapiens
gtaattatcgggaacagtgtt

SEQ ID NO: 366773 - DNA, 18 bp, Homo sapiens
gtaattctaaatgaatgt

SEQ ID NO: 366774 - DNA, 16 bp, Homo sapiens
gtaattgaataaagtt

SEQ ID NO: 366775 - DNA, 22 bp, Homo sapiens
gtaattgtaaactagtactatt

SEQ ID NO: 366776 - DNA, 15 bp, Homo sapiens
gtaattgtctcaaag

SEQ ID NO: 366777 - DNA, 15 bp, Homo sapiens
gtaatttgtatctga

SEQ ID NO: 366778 - DNA, 22 bp, Homo sapiens
gtaatttgttatatcagcagac

SEQ ID NO: 366779 - DNA, 13 bp, Homo sapiens
gtaattttctgat

SEQ ID NO: 366780 - DNA, 17 bp, Homo sapiens
gtaattttgcacagaca

SEQ ID NO: 366781 - DNA, 20 bp, Homo sapiens
gtacaaaatccagctatgaa

SEQ ID NO: 366782 - DNA, 14 bp, Homo sapiens
gtacaaacccagat

SEQ ID NO: 366783 - DNA, 14 bp, Homo sapiens
gtacaaagacaggg

SEQ ID NO: 366784 - DNA, 15 bp, Homo sapiens
gtacaaagacaggga

SEQ ID NO: 366785 - DNA, 19 bp, Homo sapiens
gtacaaagacagggaatag

SEQ ID NO: 366786 - DNA, 20 bp, Homo sapiens
gtacaagtgctcagttccaa

SEQ ID NO: 366787 - DNA, 23 bp, Homo sapiens
gtacaagtgctcagttccaatgt

SEQ ID NO: 366788 - DNA, 22 bp, Homo sapiens
gtacaataagtgtttttgtatt

SEQ ID NO: 366789 - DNA, 14 bp, Homo sapiens
gtacaatgtttcag

SEQ ID NO: 366790 - DNA, 15 bp, Homo sapiens
gtacaattactaaat

SEQ ID NO: 366791 - DNA, 18 bp, Homo sapiens
gtacaattctttgttgct

SEQ ID NO: 366792 - DNA, 18 bp, Homo sapiens
gtacaattttcatcccac

SEQ ID NO: 366793 - DNA, 17 bp, Homo sapiens
gtacacaccctccagca

SEQ ID NO: 366794 - DNA, 16 bp, Homo sapiens
gtacacagtttaaaca

SEQ ID NO: 366795 - DNA, 17 bp, Homo sapiens
gtacaccatagtttaca

SEQ ID NO: 366796 - DNA, 17 bp, Homo sapiens
gtacacttggtgtactg

SEQ ID NO: 366797 - DNA, 18 bp, Homo sapiens
gtacacttggtgtactgg

SEQ ID NO: 366798 - DNA, 17 bp, Homo sapiens
gtacagattgctgcttc

SEQ ID NO: 366799 - DNA, 19 bp, Homo sapiens
gtacagattgctgcttctg

SEQ ID NO: 366800 - DNA, 20 bp, Homo sapiens
gtacagcagggtcttgctgt

SEQ ID NO: 366801 - DNA, 24 bp, Homo sapiens
gtacaggcaaaacacgcaagggca

SEQ ID NO: 366802 - DNA, 13 bp, Homo sapiens
gtacagtatgtgt

SEQ ID NO: 366803 - DNA, 17 bp, Homo sapiens
gtacagtatgtgtctag

SEQ ID NO: 366804 - DNA, 16 bp, Homo sapiens
gtacagtatttacctt

SEQ ID NO: 366805 - DNA, 14 bp, Homo sapiens
gtacagtctgtcat

SEQ ID NO: 366806 - DNA, 14 bp, Homo sapiens
gtacagttcagttc

SEQ ID NO: 366807 - DNA, 15 bp, Homo sapiens
gtacagttcataaat

SEQ ID NO: 366808 - DNA, 17 bp, Homo sapiens
gtacagttcataaattt

SEQ ID NO: 366809 - DNA, 16 bp, Homo sapiens
gtacagttcttcggga

SEQ ID NO: 366810 - DNA, 15 bp, Homo sapiens
gtacagttgactggc

SEQ ID NO: 366811 - DNA, 23 bp, Homo sapiens
gtacataaattgcataaagcata

SEQ ID NO: 366812 - DNA, 19 bp, Homo sapiens
gtacatatggtagacaatt

SEQ ID NO: 366813 - DNA, 14 bp, Homo sapiens
gtacatcacccagt

SEQ ID NO: 366814 - DNA, 15 bp, Homo sapiens
gtacatcatgttatt

SEQ ID NO: 366815 - DNA, 16 bp, Homo sapiens
gtacatggaagaagta

SEQ ID NO: 366816 - DNA, 18 bp, Homo sapiens
gtaccaaagttttatcaa

SEQ ID NO: 366817 - DNA, 15 bp, Homo sapiens
gtaccaactgagcca

SEQ ID NO: 366818 - DNA, 15 bp, Homo sapiens
gtaccaatcatttta

SEQ ID NO: 366819 - DNA, 17 bp, Homo sapiens
gtaccactgctaataaa

SEQ ID NO: 366820 - DNA, 18 bp, Homo sapiens
gtaccactgctaataaat

SEQ ID NO: 366821 - DNA, 21 bp, Homo sapiens
gtaccactgctaataaatgac

SEQ ID NO: 366822 - DNA, 17 bp, Homo sapiens
gtaccagccctggggct

SEQ ID NO: 366823 - DNA, 17 bp, Homo sapiens
gtaccaggccacccact

SEQ ID NO: 366824 - DNA, 17 bp, Homo sapiens
gtaccatcaataaagta

SEQ ID NO: 366825 - DNA, 15 bp, Homo sapiens
gtaccatcccactga

SEQ ID NO: 366826 - DNA, 17 bp, Homo sapiens
gtaccatcccactgata

SEQ ID NO: 366827 - DNA, 21 bp, Homo sapiens
gtaccatgctggcggcgcaga

SEQ ID NO: 366828 - DNA, 16 bp, Homo sapiens
gtaccatgttaaagag

SEQ ID NO: 366829 - DNA, 15 bp, Homo sapiens
gtacccaaggtcaca

SEQ ID NO: 366830 - DNA, 14 bp, Homo sapiens
gtacccacctgagc

SEQ ID NO: 366831 - DNA, 16 bp, Homo sapiens
gtacccacctgagctt

SEQ ID NO: 366832 - DNA, 15 bp, Homo sapiens
gtacccagccacctt

SEQ ID NO: 366833 - DNA, 12 bp, Homo sapiens
gtacccagctcc

SEQ ID NO: 366834 - DNA, 13 bp, Homo sapiens
gtacccagctcct

SEQ ID NO: 366835 - DNA, 18 bp, Homo sapiens
gtaccctatagagagggg

SEQ ID NO: 366836 - DNA, 17 bp, Homo sapiens
gtacctctctctgctcc

SEQ ID NO: 366837 - DNA, 20 bp, Homo sapiens
gtacctgcccccactcagca

SEQ ID NO: 366838 - DNA, 21 bp, Homo sapiens
gtacctgcccccactcagcat

SEQ ID NO: 366839 - DNA, 19 bp, Homo sapiens
gtacctgctgccccagctg

SEQ ID NO: 366840 - DNA, 21 bp, Homo sapiens
gtacctgtaggaaacagaaaa

SEQ ID NO: 366841 - DNA, 14 bp, Homo sapiens
gtacctttctgaca

SEQ ID NO: 366842 - DNA, 16 bp, Homo sapiens
gtacctttcttcactg

SEQ ID NO: 366843 - DNA, 13 bp, Homo sapiens
gtacctttgtcac

SEQ ID NO: 366844 - DNA, 16 bp, Homo sapiens
gtacgtgggagaggca

SEQ ID NO: 366845 - DNA, 21 bp, Homo sapiens
gtacgttattgttgacttatt

SEQ ID NO: 366846 - DNA, 16 bp, Homo sapiens
gtactaagccaggagg

SEQ ID NO: 366847 - DNA, 20 bp, Homo sapiens
gtactactagatgtctttag

SEQ ID NO: 366848 - DNA, 22 bp, Homo sapiens
gtactatgtattaccagccccc

SEQ ID NO: 366849 - DNA, 14 bp, Homo sapiens
gtactatttaactg

SEQ ID NO: 366850 - DNA, 21 bp, Homo sapiens
gtactatttagatataacact

SEQ ID NO: 366851 - DNA, 15 bp, Homo sapiens
gtactcagagcagag

SEQ ID NO: 366852 - DNA, 14 bp, Homo sapiens
gtactcattaaaaa

SEQ ID NO: 366853 - DNA, 16 bp, Homo sapiens
gtactccagcctgggt

SEQ ID NO: 366854 - DNA, 14 bp, Homo sapiens
gtactcctcagacg

SEQ ID NO: 366855 - DNA, 15 bp, Homo sapiens
gtactcctgcaaaat

SEQ ID NO: 366856 - DNA, 17 bp, Homo sapiens
gtactctacgccaaagt

SEQ ID NO: 366857 - DNA, 15 bp, Homo sapiens
gtactctcctagaga

SEQ ID NO: 366858 - DNA, 23 bp, Homo sapiens
gtactctcctagagacagaagca

SEQ ID NO: 366859 - DNA, 19 bp, Homo sapiens
gtactctctgctctagcca

SEQ ID NO: 366860 - DNA, 21 bp, Homo sapiens
gtactctctgctctagccagg

SEQ ID NO: 366861 - DNA, 18 bp, Homo sapiens
gtactcttgatgtgaaga

SEQ ID NO: 366862 - DNA, 14 bp, Homo sapiens
gtactgagaggagg

SEQ ID NO: 366863 - DNA, 23 bp, Homo sapiens
gtactgagaggaggggtaaatat

SEQ ID NO: 366864 - DNA, 14 bp, Homo sapiens
gtactgataaaata

SEQ ID NO: 366865 - DNA, 17 bp, Homo sapiens
gtactgctagtacctgt

SEQ ID NO: 366866 - DNA, 14 bp, Homo sapiens
gtactggatttaac

SEQ ID NO: 366867 - DNA, 20 bp, Homo sapiens
gtactgggttaatggctagt

SEQ ID NO: 366868 - DNA, 11 bp, Homo sapiens
gtactgtgctg

SEQ ID NO: 366869 - DNA, 17 bp, Homo sapiens
gtacttaaatgaaagca

SEQ ID NO: 366870 - DNA, 14 bp, Homo sapiens
gtacttaactattc

SEQ ID NO: 366871 - DNA, 14 bp, Homo sapiens
gtacttaactgtgt

SEQ ID NO: 366872 - DNA, 14 bp, Homo sapiens
gtacttcctcctga

SEQ ID NO: 366873 - DNA, 18 bp, Homo sapiens
gtacttcctcctgatggc

SEQ ID NO: 366874 - DNA, 24 bp, Homo sapiens
gtacttgaccgtttttatattact

SEQ ID NO: 366875 - DNA, 19 bp, Homo sapiens
gtacttgctcaataaaggt

SEQ ID NO: 366876 - DNA, 20 bp, Homo sapiens
gtacttgctcaataaaggtc

SEQ ID NO: 366877 - DNA, 18 bp, Homo sapiens
gtacttggtaagagggag

SEQ ID NO: 366878 - DNA, 13 bp, Homo sapiens
gtactttattctt

SEQ ID NO: 366879 - DNA, 14 bp, Homo sapiens
gtactttattcttg

SEQ ID NO: 366880 - DNA, 18 bp, Homo sapiens
gtactttattcttgctgg

SEQ ID NO: 366881 - DNA, 22 bp, Homo sapiens
gtactttgtttttccatgtgtt

SEQ ID NO: 366882 - DNA, 18 bp, Homo sapiens
gtagaaacacagttttga

SEQ ID NO: 366883 - DNA, 12 bp, Homo sapiens
gtagaaatatta

SEQ ID NO: 366884 - DNA, 14 bp, Homo sapiens
gtagaaatgatgat

SEQ ID NO: 366885 - DNA, 15 bp, Homo sapiens
gtagaactcagcagt

SEQ ID NO: 366886 - DNA, 11 bp, Homo sapiens
gtagaagccag

SEQ ID NO: 366887 - DNA, 17 bp, Homo sapiens
gtagaatgctgtagaat

SEQ ID NO: 366888 - DNA, 14 bp, Homo sapiens
gtagacccctggct

SEQ ID NO: 366889 - DNA, 16 bp, Homo sapiens
gtagacctagggagga

SEQ ID NO: 366890 - DNA, 20 bp, Homo sapiens
gtatccaattatgtgacaac

SEQ ID NO: 366891 - DNA, 12 bp, Homo sapiens
gtatccagaggt

SEQ ID NO: 366892 - DNA, 16 bp, Homo sapiens
gtatccatgcatgtgc

SEQ ID NO: 366893 - DNA, 12 bp, Homo sapiens
gtatcccacctc

SEQ ID NO: 366894 - DNA, 17 bp, Homo sapiens
gtatcccacctccagcc

SEQ ID NO: 366895 - DNA, 18 bp, Homo sapiens
gtatcccttctcacagca

SEQ ID NO: 366896 - DNA, 19 bp, Homo sapiens
gtatcccttctcacagcac

SEQ ID NO: 366897 - DNA, 20 bp, Homo sapiens
gtatcctgataaacattaaa

SEQ ID NO: 366898 - DNA, 17 bp, Homo sapiens
gtatcggagacagtgat

SEQ ID NO: 366899 - DNA, 15 bp, Homo sapiens
gtatctagtgcagct

SEQ ID NO: 366900 - DNA, 17 bp, Homo sapiens
gtatctagtgcagctga

SEQ ID NO: 366901 - DNA, 18 bp, Homo sapiens
gtatctagtgcagctgat

SEQ ID NO: 366902 - DNA, 20 bp, Homo sapiens
gtatctctgaagcatgtttc

SEQ ID NO: 366903 - DNA, 11 bp, Homo sapiens
gtatctgaagg

SEQ ID NO: 366904 - DNA, 23 bp, Homo sapiens
gtatctgatatctgtttgcttct

SEQ ID NO: 366905 - DNA, 15 bp, Homo sapiens
gtatctgcatgtaaa

SEQ ID NO: 366906 - DNA, 15 bp, Homo sapiens
gtatctggctgggtt

SEQ ID NO: 366907 - DNA, 13 bp, Homo sapiens
gtatcttaaatct

SEQ ID NO: 366908 - DNA, 13 bp, Homo sapiens
gtatcttatttat

SEQ ID NO: 366909 - DNA, 15 bp, Homo sapiens
gtatcttatttatat

SEQ ID NO: 366910 - DNA, 19 bp, Homo sapiens
gtatctttaaagacttgat

SEQ ID NO: 366911 - DNA, 23 bp, Homo sapiens
gtatgaaagatggctgtgcctct

SEQ ID NO: 366912 - DNA, 20 bp, Homo sapiens
gtatgaacttgaggacacat

SEQ ID NO: 366913 - DNA, 14 bp, Homo sapiens
gtatgaagacactg

SEQ ID NO: 366914 - DNA, 13 bp, Homo sapiens
gtatgaaggcttt

SEQ ID NO: 366915 - DNA, 17 bp, Homo sapiens
gtatgaatgatatcttt

SEQ ID NO: 366916 - DNA, 15 bp, Homo sapiens
gtatgaatgcagtgg

SEQ ID NO: 366917 - DNA, 14 bp, Homo sapiens
gtatgactaaagag

SEQ ID NO: 366918 - DNA, 20 bp, Homo sapiens
gtatgagaaatacagtgctt

SEQ ID NO: 366919 - DNA, 17 bp, Homo sapiens
gtatgatgtgttgtgat

SEQ ID NO: 366920 - DNA, 19 bp, Homo sapiens
gtatgattttgatgcacaa

SEQ ID NO: 366921 - DNA, 18 bp, Homo sapiens
gtatggagagaaaacaga

SEQ ID NO: 366922 - DNA, 21 bp, Homo sapiens
gtatggatatgtgtaaatgtt

SEQ ID NO: 366923 - DNA, 22 bp, Homo sapiens
gtatggcactggcattgtccct

SEQ ID NO: 366924 - DNA, 14 bp, Homo sapiens
gtatgggaagccat

SEQ ID NO: 366925 - DNA, 23 bp, Homo sapiens
gtatgggaagccatattcacacc

SEQ ID NO: 366926 - DNA, 22 bp, Homo sapiens
gtatgggacctgctaagtgtgg

SEQ ID NO: 366927 - DNA, 16 bp, Homo sapiens
gtatggttttgtggat

SEQ ID NO: 366928 - DNA, 11 bp, Homo sapiens
gtatgtaaaaa

SEQ ID NO: 366929 - DNA, 20 bp, Homo sapiens
gtatgtacagttcataaatt

SEQ ID NO: 366930 - DNA, 12 bp, Homo sapiens
gtatgtatgtgt

SEQ ID NO: 366931 - DNA, 13 bp, Homo sapiens
gtatgtatgtgta

SEQ ID NO: 366932 - DNA, 18 bp, Homo sapiens
gtatgtgaattgaagtca

SEQ ID NO: 366933 - DNA, 17 bp, Homo sapiens
gtatgtgatatctgaac

SEQ ID NO: 366934 - DNA, 15 bp, Homo sapiens
gtatgtgccaatttt

SEQ ID NO: 366935 - DNA, 16 bp, Homo sapiens
gtatgtgtaatgattt

SEQ ID NO: 366936 - DNA, 11 bp, Homo sapiens
gtatgtgtcta

SEQ ID NO: 366937 - DNA, 20 bp, Homo sapiens
gtatgtgtctagcaaagcca

SEQ ID NO: 366938 - DNA, 14 bp, Homo sapiens
gtatgttttagcat

SEQ ID NO: 366939 - DNA, 17 bp, Homo sapiens
gtattaaactctccttt

SEQ ID NO: 366940 - DNA, 14 bp, Homo sapiens
gtattaaacttgaa

SEQ ID NO: 366941 - DNA, 17 bp, Homo sapiens
gtattaacctacctgtg

SEQ ID NO: 366942 - DNA, 18 bp, Homo sapiens
gtattaacctacctgtga

SEQ ID NO: 366943 - DNA, 14 bp, Homo sapiens
gtattaccagcccc

SEQ ID NO: 366944 - DNA, 23 bp, Homo sapiens
gtattagcacctctttttgaaca

SEQ ID NO: 366945 - DNA, 22 bp, Homo sapiens
gtattaggggtaatatattgct

SEQ ID NO: 366946 - DNA, 14 bp, Homo sapiens
gtattagtggaaag

SEQ ID NO: 366947 - DNA, 18 bp, Homo sapiens
gtattagtggaaagtgat

SEQ ID NO: 366948 - DNA, 23 bp, Homo sapiens
gtattagtggaaagtgatttgta

SEQ ID NO: 366949 - DNA, 14 bp, Homo sapiens
gtattatgcaaagt

SEQ ID NO: 366950 - DNA, 15 bp, Homo sapiens
gtattattctgcagc

SEQ ID NO: 366951 - DNA, 14 bp, Homo sapiens
gtattatttggagt

SEQ ID NO: 366952 - DNA, 20 bp, Homo sapiens
gtattcaaatgttagagttt

SEQ ID NO: 366953 - DNA, 18 bp, Homo sapiens
gtattcaagcaaacatca

SEQ ID NO: 366954 - DNA, 16 bp, Homo sapiens
gtattcagagccaccc

SEQ ID NO: 366955 - DNA, 13 bp, Homo sapiens
gtattcaggaccc

SEQ ID NO: 366956 - DNA, 14 bp, Homo sapiens
gtattccaccttaa

SEQ ID NO: 366957 - DNA, 19 bp, Homo sapiens
gtattccaccttaaattaa

SEQ ID NO: 366958 - DNA, 23 bp, Homo sapiens
gtattccatttttactaaagcag

SEQ ID NO: 366959 - DNA, 15 bp, Homo sapiens
gtattcctgcctttg

SEQ ID NO: 366960 - DNA, 17 bp, Homo sapiens
gtattccttggcccagc

SEQ ID NO: 366961 - DNA, 12 bp, Homo sapiens
gtattctcagag

SEQ ID NO: 366962 - DNA, 14 bp, Homo sapiens
gtattctcagagca

SEQ ID NO: 366963 - DNA, 21 bp, Homo sapiens
gtattctcagagcatgtgtca

SEQ ID NO: 366964 - DNA, 18 bp, Homo sapiens
gtattctctgtccagggc

SEQ ID NO: 366965 - DNA, 19 bp, Homo sapiens
gtattctgtggattctata

SEQ ID NO: 366966 - DNA, 15 bp, Homo sapiens
gtattgaaaacttca

SEQ ID NO: 366967 - DNA, 16 bp, Homo sapiens
gtattgaaaacttcaa

SEQ ID NO: 366968 - DNA, 17 bp, Homo sapiens
gtattgaaaacttcaaa

SEQ ID NO: 366969 - DNA, 19 bp, Homo sapiens
gtattgaaaacttcaaagc

SEQ ID NO: 366970 - DNA, 23 bp, Homo sapiens
gtattgacttctttttggcatta

SEQ ID NO: 366971 - DNA, 18 bp, Homo sapiens
gtattgagacactgtcaa

SEQ ID NO: 366972 - DNA, 19 bp, Homo sapiens
gtattgagacactgtcaag

SEQ ID NO: 366973 - DNA, 22 bp, Homo sapiens
gtattgagacactgtcaagatt

SEQ ID NO: 366974 - DNA, 21 bp, Homo sapiens
gtattgtccatatcagacctc

SEQ ID NO: 366975 - DNA, 15 bp, Homo sapiens
gtattgtgaaatttg

SEQ ID NO: 366976 - DNA, 11 bp, Homo sapiens
gtattgttccc

SEQ ID NO: 366977 - DNA, 17 bp, Homo sapiens
gtattgttcttgtaaaa

SEQ ID NO: 366978 - DNA, 16 bp, Homo sapiens
gtatttaccttccttt

SEQ ID NO: 366979 - DNA, 22 bp, Homo sapiens
gtatttattttcctccccagca

SEQ ID NO: 366980 - DNA, 23 bp, Homo sapiens
gtatttcattgctgtgtcacact

SEQ ID NO: 366981 - DNA, 16 bp, Homo sapiens
gtatttccagtgcaat

SEQ ID NO: 366982 - DNA, 12 bp, Homo sapiens
gtatttctatat

SEQ ID NO: 366983 - DNA, 20 bp, Homo sapiens
gtatttctgtagaatgctgt

SEQ ID NO: 366984 - DNA, 21 bp, Homo sapiens
gtatttctgtagaatgctgta

SEQ ID NO: 366985 - DNA, 15 bp, Homo sapiens
gtatttctgtggaaa

SEQ ID NO: 366986 - DNA, 13 bp, Homo sapiens
gtatttcttattt

SEQ ID NO: 366987 - DNA, 10 bp, Homo sapiens
gtatttcttt

SEQ ID NO: 366988 - DNA, 13 bp, Homo sapiens
gtatttcttttat

SEQ ID NO: 366989 - DNA, 19 bp, Homo sapiens
gtatttcttttatatataa

SEQ ID NO: 366990 - DNA, 20 bp, Homo sapiens
gtatttcttttatatataaa

SEQ ID NO: 366991 - DNA, 16 bp, Homo sapiens
gtattttcaataaaga

SEQ ID NO: 366992 - DNA, 15 bp, Homo sapiens
gtattttcgtgcatt

SEQ ID NO: 366993 - DNA, 20 bp, Homo sapiens
gtattttcttcccatttgta

SEQ ID NO: 366994 - DNA, 16 bp, Homo sapiens
gtattttgaataccat

SEQ ID NO: 366995 - DNA, 14 bp, Homo sapiens
gtatttttagagat

SEQ ID NO: 366996 - DNA, 22 bp, Homo sapiens
gtatttttagagattaatttgt

SEQ ID NO: 366997 - DNA, 22 bp, Homo sapiens
gtatttttagtagagacagtgt

SEQ ID NO: 366998 - DNA, 16 bp, Homo sapiens
gtatttttattttcct

SEQ ID NO: 366999 - DNA, 17 bp, Homo sapiens
gtatttttcagagattt

SEQ ID NO: 367000 - DNA, 20 bp, Homo sapiens
gtatttttcaggtaggccct

SEQ ID NO: 367001 - DNA, 14 bp, Homo sapiens
gtatttttgaataa

SEQ ID NO: 367002 - DNA, 16 bp, Homo sapiens
gtattttttttttcca

SEQ ID NO: 367003 - DNA, 20 bp, Homo sapiens
gtcaaaaagtttggttctgt

SEQ ID NO: 367004 - DNA, 16 bp, Homo sapiens
gtcaaactgtagaaat

SEQ ID NO: 367005 - DNA, 19 bp, Homo sapiens
gtcaaagtggtgagaggca

SEQ ID NO: 367006 - DNA, 15 bp, Homo sapiens
gtcaaataaagcaaa

SEQ ID NO: 367007 - DNA, 19 bp, Homo sapiens
gtcaaatgtcattatgtag

SEQ ID NO: 367008 - DNA, 17 bp, Homo sapiens
gtcaacactcttcttga

SEQ ID NO: 367009 - DNA, 12 bp, Homo sapiens
gtcaacagtgaa

SEQ ID NO: 367010 - DNA, 14 bp, Homo sapiens
gtcaactccaaggc

SEQ ID NO: 367011 - DNA, 15 bp, Homo sapiens
gtcaactccaaggca

SEQ ID NO: 367012 - DNA, 22 bp, Homo sapiens
gtcaactccaaggcaaatgtcc

SEQ ID NO: 367013 - DNA, 22 bp, Homo sapiens
gtcaactccaggacttgcttcc

SEQ ID NO: 367014 - DNA, 15 bp, Homo sapiens
gtcaactgctgtttt

SEQ ID NO: 367015 - DNA, 20 bp, Homo sapiens
gtcaacttgagcatgttact

SEQ ID NO: 367016 - DNA, 13 bp, Homo sapiens
gtcaactttatgc

SEQ ID NO: 367017 - DNA, 14 bp, Homo sapiens
gtcaagctgcttgg

SEQ ID NO: 367018 - DNA, 12 bp, Homo sapiens
gtcaaggcctgt

SEQ ID NO: 367019 - DNA, 14 bp, Homo sapiens
gtcaagtaagaaga

SEQ ID NO: 367020 - DNA, 15 bp, Homo sapiens
gtcaagtaagaagac

SEQ ID NO: 367021 - DNA, 17 bp, Homo sapiens
gtccccactcaccccct

SEQ ID NO: 367022 - DNA, 17 bp, Homo sapiens
gtccccagccctgtcct

SEQ ID NO: 367023 - DNA, 19 bp, Homo sapiens
gtccccagccctgtcctgg

SEQ ID NO: 367024 - DNA, 20 bp, Homo sapiens
gtccccagcccttctgcctt

SEQ ID NO: 367025 - DNA, 22 bp, Homo sapiens
gtccccagggcccctccctctg

SEQ ID NO: 367026 - DNA, 12 bp, Homo sapiens
gtccccatcccc

SEQ ID NO: 367027 - DNA, 13 bp, Homo sapiens
gtccccatcccca

SEQ ID NO: 367028 - DNA, 17 bp, Homo sapiens
gtccccatccccaccag

SEQ ID NO: 367029 - DNA, 21 bp, Homo sapiens
gtccccatccccaccagctcg

SEQ ID NO: 367030 - DNA, 23 bp, Homo sapiens
gtccccattctataaattcaaca

SEQ ID NO: 367031 - DNA, 13 bp, Homo sapiens
gtcccccacgtgg

SEQ ID NO: 367032 - DNA, 22 bp, Homo sapiens
gtcccccatccccatcctccag

SEQ ID NO: 367033 - DNA, 19 bp, Homo sapiens
gtcccccatgccaccaccc

SEQ ID NO: 367034 - DNA, 17 bp, Homo sapiens
gtccccctacccaccga

SEQ ID NO: 367035 - DNA, 18 bp, Homo sapiens
gtccccctatccttggca

SEQ ID NO: 367036 - DNA, 20 bp, Homo sapiens
gtccccctcccctcccagtc

SEQ ID NO: 367037 - DNA, 22 bp, Homo sapiens
gtccccctggggcttctcctga

SEQ ID NO: 367038 - DNA, 19 bp, Homo sapiens
gtccccggacgctggctcg

SEQ ID NO: 367039 - DNA, 16 bp, Homo sapiens
gtccccgggaaaggcc

SEQ ID NO: 367040 - DNA, 22 bp, Homo sapiens
gtccccgtgccccgcctccccg

SEQ ID NO: 367041 - DNA, 19 bp, Homo sapiens
gtccccgtgtgccccaaga

SEQ ID NO: 367042 - DNA, 15 bp, Homo sapiens
gtcccctcacctcca

SEQ ID NO: 367043 - DNA, 17 bp, Homo sapiens
gtcccctcacctccacc

SEQ ID NO: 367044 - DNA, 13 bp, Homo sapiens
gtcccctccatct

SEQ ID NO: 367045 - DNA, 14 bp, Homo sapiens
gtcccctccatctg

SEQ ID NO: 367046 - DNA, 16 bp, Homo sapiens
gtcccctccccggccc

SEQ ID NO: 367047 - DNA, 21 bp, Homo sapiens
gtcccctctgtcatcactccc

SEQ ID NO: 367048 - DNA, 17 bp, Homo sapiens
gtcccctgacctgtcca

SEQ ID NO: 367049 - DNA, 11 bp, Homo sapiens
gtcccctgagg

SEQ ID NO: 367050 - DNA, 16 bp, Homo sapiens
gtcccctgggccaccc

SEQ ID NO: 367051 - DNA, 19 bp, Homo sapiens
gtcccctgtcccaccaact

SEQ ID NO: 367052 - DNA, 15 bp, Homo sapiens
gtccccttcccctgc

SEQ ID NO: 367053 - DNA, 18 bp, Homo sapiens
gtccccttcccctgctga

SEQ ID NO: 367054 - DNA, 20 bp, Homo sapiens
gtcccgaatggagtccagac

SEQ ID NO: 367055 - DNA, 23 bp, Homo sapiens
gtcccgaatggagtccagacctg

SEQ ID NO: 367056 - DNA, 14 bp, Homo sapiens
gtcccgagccccct

SEQ ID NO: 367057 - DNA, 15 bp, Homo sapiens
gtcccgagccccctg

SEQ ID NO: 367058 - DNA, 20 bp, Homo sapiens
gtcccgagccccctgtcctt

SEQ ID NO: 367059 - DNA, 23 bp, Homo sapiens
gtcccgaggaagggccagagcct

SEQ ID NO: 367060 - DNA, 19 bp, Homo sapiens
gtcccgccttcctcctcca

SEQ ID NO: 367061 - DNA, 21 bp, Homo sapiens
gtcccgccttcctcctccaca

SEQ ID NO: 367062 - DNA, 12 bp, Homo sapiens
gtcccgctgctg

SEQ ID NO: 367063 - DNA, 17 bp, Homo sapiens
gtcccgctgctgtgctc

SEQ ID NO: 367064 - DNA, 23 bp, Homo sapiens
gtcccgcttattctcctccctgt

SEQ ID NO: 367065 - DNA, 21 bp, Homo sapiens
gtcccggccccgcgcgtgccc

SEQ ID NO: 367066 - DNA, 15 bp, Homo sapiens
gtcccggggctccac

SEQ ID NO: 367067 - DNA, 18 bp, Homo sapiens
gtcccgggttagcctggt

SEQ ID NO: 367068 - DNA, 22 bp, Homo sapiens
gtcccggttcagacccctgcct

SEQ ID NO: 367069 - DNA, 23 bp, Homo sapiens
gtcccggttcagacccctgcctg

SEQ ID NO: 367070 - DNA, 17 bp, Homo sapiens
gtcccgttctccattct

SEQ ID NO: 367071 - DNA, 15 bp, Homo sapiens
gtccctaaagaaaaa

SEQ ID NO: 367072 - DNA, 21 bp, Homo sapiens
gtccctaattctcttcgctgt

SEQ ID NO: 367073 - DNA, 16 bp, Homo sapiens
gtccctacttaggaaa

SEQ ID NO: 367074 - DNA, 16 bp, Homo sapiens
gtccctaggtgggtca

SEQ ID NO: 367075 - DNA, 15 bp, Homo sapiens
gtccctatgcatatc

SEQ ID NO: 367076 - DNA, 19 bp, Homo sapiens
gtccctccacgttcacccc

SEQ ID NO: 367077 - DNA, 19 bp, Homo sapiens
gtccctccctcctggctca

SEQ ID NO: 367078 - DNA, 19 bp, Homo sapiens
gtccctcctgttgccacac

SEQ ID NO: 367079 - DNA, 21 bp, Homo sapiens
gtccctctcactccccagccc

SEQ ID NO: 367080 - DNA, 14 bp, Homo sapiens
gtccctctcaggca

SEQ ID NO: 367081 - DNA, 20 bp, Homo sapiens
gtccctctcctatgtggcag

SEQ ID NO: 367082 - DNA, 23 bp, Homo sapiens
gtccctctcctatgtggcagctg

SEQ ID NO: 367083 - DNA, 13 bp, Homo sapiens
gtccctgaagtct

SEQ ID NO: 367084 - DNA, 18 bp, Homo sapiens
gtccctgacttcccagct

SEQ ID NO: 367085 - DNA, 18 bp, Homo sapiens
gtccctgccacactcagt

SEQ ID NO: 367086 - DNA, 19 bp, Homo sapiens
gtccctgccccgcccccca

SEQ ID NO: 367087 - DNA, 12 bp, Homo sapiens
gtccctggtccc

SEQ ID NO: 367088 - DNA, 15 bp, Homo sapiens
gtccctggtccctcg

SEQ ID NO: 367089 - DNA, 11 bp, Homo sapiens
gtccctgtggt

SEQ ID NO: 367090 - DNA, 18 bp, Homo sapiens
gtccctgtggtaccctgg

SEQ ID NO: 367091 - DNA, 19 bp, Homo sapiens
gtccctgtggtaccctggc

SEQ ID NO: 367092 - DNA, 23 bp, Homo sapiens
gtccctgtggtaccctggcagag

SEQ ID NO: 367093 - DNA, 18 bp, Homo sapiens
gtcccttacgtgagtcct

SEQ ID NO: 367094 - DNA, 19 bp, Homo sapiens
gtcccttacgtgagtcctg

SEQ ID NO: 367095 - DNA, 16 bp, Homo sapiens
gtcccttccaggccat

SEQ ID NO: 367096 - DNA, 14 bp, Homo sapiens
gtcccttcccctcc

SEQ ID NO: 367097 - DNA, 17 bp, Homo sapiens
gtcccttcccctccctg

SEQ ID NO: 367098 - DNA, 18 bp, Homo sapiens
gtcccttcccctccctgg

SEQ ID NO: 367099 - DNA, 10 bp, Homo sapiens
gtccctttcc

SEQ ID NO: 367100 - DNA, 17 bp, Homo sapiens
gtccctttccctacctt

SEQ ID NO: 367101 - DNA, 17 bp, Homo sapiens
gtccctttcttggccag

SEQ ID NO: 367102 - DNA, 13 bp, Homo sapiens
gtcccttttcctt

SEQ ID NO: 367103 - DNA, 16 bp, Homo sapiens
gtccgagctctgtcct

SEQ ID NO: 367104 - DNA, 15 bp, Homo sapiens
gtccgatctttgact

SEQ ID NO: 367105 - DNA, 13 bp, Homo sapiens
gtccgcaccagct

SEQ ID NO: 367106 - DNA, 16 bp, Homo sapiens
gtccgcaccagctgct

SEQ ID NO: 367107 - DNA, 18 bp, Homo sapiens
gtccgcaccagctgctct

SEQ ID NO: 367108 - DNA, 19 bp, Homo sapiens
gtccgcaccagctgctctg

SEQ ID NO: 367109 - DNA, 20 bp, Homo sapiens
gtccgcaccagctgctctgc

SEQ ID NO: 367110 - DNA, 22 bp, Homo sapiens
gtccgcaccagctgctctgccc

SEQ ID NO: 367111 - DNA, 22 bp, Homo sapiens
gtccgcctctgcccgcagagcc

SEQ ID NO: 367112 - DNA, 19 bp, Homo sapiens
gtccgccttaatctggaag

SEQ ID NO: 367113 - DNA, 23 bp, Homo sapiens
gtccgcgcgccagcacagaaaca

SEQ ID NO: 367114 - DNA, 16 bp, Homo sapiens
gtccgctctctcatgt

SEQ ID NO: 367115 - DNA, 19 bp, Homo sapiens
gtccggacccacctcaccc

SEQ ID NO: 367116 - DNA, 14 bp, Homo sapiens
gtccggcctgcagc

SEQ ID NO: 367117 - DNA, 16 bp, Homo sapiens
gtccggcctgcagccc

SEQ ID NO: 367118 - DNA, 21 bp, Homo sapiens
gtccgtccgcccgcccacccc

SEQ ID NO: 367119 - DNA, 18 bp, Homo sapiens
gtcctaaagggacaataa

SEQ ID NO: 367120 - DNA, 21 bp, Homo sapiens
gtcctagtgtctattccctgg

SEQ ID NO: 367121 - DNA, 14 bp, Homo sapiens
gtcctcaaagaagt

SEQ ID NO: 367122 - DNA, 18 bp, Homo sapiens
gtcctcaagcttctcaga

SEQ ID NO: 367123 - DNA, 21 bp, Homo sapiens
gtcctcacaagcctcttctga

SEQ ID NO: 367124 - DNA, 21 bp, Homo sapiens
gtcctcacagcctaggaccag

SEQ ID NO: 367125 - DNA, 14 bp, Homo sapiens
gtcctcactcccag

SEQ ID NO: 367126 - DNA, 18 bp, Homo sapiens
gtcctcactcccagtcca

SEQ ID NO: 367127 - DNA, 18 bp, Homo sapiens
gtcctcagagggtcccta

SEQ ID NO: 367128 - DNA, 17 bp, Homo sapiens
gtcctcaggtgaataac

SEQ ID NO: 367129 - DNA, 15 bp, Homo sapiens
gtcctccaccacaag

SEQ ID NO: 367130 - DNA, 21 bp, Homo sapiens
gtcctccaccacaagagctcc

SEQ ID NO: 367131 - DNA, 13 bp, Homo sapiens
gtcctccagaagc

SEQ ID NO: 367132 - DNA, 14 bp, Homo sapiens
gtcctccagaagcc

SEQ ID NO: 367133 - DNA, 21 bp, Homo sapiens
gtcctccagaagcctctggct

SEQ ID NO: 367134 - DNA, 12 bp, Homo sapiens
gtcctcccgggc

SEQ ID NO: 367135 - DNA, 16 bp, Homo sapiens
gtcctcggtcttaccc

SEQ ID NO: 367136 - DNA, 19 bp, Homo sapiens
gtcctctcagaactcctgt

SEQ ID NO: 367137 - DNA, 20 bp, Homo sapiens
gtcctctcagaactcctgtg

SEQ ID NO: 367138 - DNA, 19 bp, Homo sapiens
gtcctctcccaagtccaca

SEQ ID NO: 367139 - DNA, 21 bp, Homo sapiens
gtcctcttaggtcccgggagg

SEQ ID NO: 367140 - DNA, 21 bp, Homo sapiens
gtcctctttactcccttcctg

SEQ ID NO: 367141 - DNA, 18 bp, Homo sapiens
gtcctctttcagaaaaca

SEQ ID NO: 367142 - DNA, 14 bp, Homo sapiens
gtcctgacgccctg

SEQ ID NO: 367143 - DNA, 16 bp, Homo sapiens
gtcctgacgccctgcg

SEQ ID NO: 367144 - DNA, 16 bp, Homo sapiens
gtcctgacggcgcccc

SEQ ID NO: 367145 - DNA, 21 bp, Homo sapiens
gtcctgacggcgcccccagtg

SEQ ID NO: 367146 - DNA, 21 bp, Homo sapiens
gtcctgagccccctgcaccca

SEQ ID NO: 367147 - DNA, 11 bp, Homo sapiens
gtcctgaggaa

SEQ ID NO: 367148 - DNA, 18 bp, Homo sapiens
gtcctgcaatctccaggg

SEQ ID NO: 367149 - DNA, 20 bp, Homo sapiens
gtcctgcaatctccagggct

SEQ ID NO: 367150 - DNA, 14 bp, Homo sapiens
gtcctgcagagctg

SEQ ID NO: 367151 - DNA, 15 bp, Homo sapiens
gtcctgcagagctgg

SEQ ID NO: 367152 - DNA, 16 bp, Homo sapiens
gtcctgcagagctggg

SEQ ID NO: 367153 - DNA, 17 bp, Homo sapiens
gtcctgcagagctgggg

SEQ ID NO: 367154 - DNA, 13 bp, Homo sapiens
gtcctgcagagga

SEQ ID NO: 367155 - DNA, 14 bp, Homo sapiens
gtcctgcagtgtga

SEQ ID NO: 367156 - DNA, 23 bp, Homo sapiens
gtcctgccaagtggtttctatga

SEQ ID NO: 367157 - DNA, 14 bp, Homo sapiens
gtcctgccacctgg

SEQ ID NO: 367158 - DNA, 18 bp, Homo sapiens
gtcctgccacctggggca

SEQ ID NO: 367159 - DNA, 11 bp, Homo sapiens
gtcctgccagc

SEQ ID NO: 367160 - DNA, 17 bp, Homo sapiens
gtcctgccagctgcctt

SEQ ID NO: 367161 - DNA, 21 bp, Homo sapiens
gtcctgccagctgccttcctc

SEQ ID NO: 367162 - DNA, 22 bp, Homo sapiens
gtcctgccagctgccttcctca

SEQ ID NO: 367163 - DNA, 17 bp, Homo sapiens
gtcctgcctcagcctcc

SEQ ID NO: 367164 - DNA, 14 bp, Homo sapiens
gtcctgcctggcca

SEQ ID NO: 367165 - DNA, 23 bp, Homo sapiens
gtcctgctctctacccagcccat

SEQ ID NO: 367166 - DNA, 11 bp, Homo sapiens
gtcctgctgct

SEQ ID NO: 367167 - DNA, 19 bp, Homo sapiens
gtcctggaatgaagcatgt

SEQ ID NO: 367168 - DNA, 15 bp, Homo sapiens
gtcctggcagggcag

SEQ ID NO: 367169 - DNA, 20 bp, Homo sapiens
gtcctggcagggcaggcaga

SEQ ID NO: 367170 - DNA, 16 bp, Homo sapiens
gtcctggcatgggaat

SEQ ID NO: 367171 - DNA, 15 bp, Homo sapiens
gtcctggctacatcc

SEQ ID NO: 367172 - DNA, 11 bp, Homo sapiens
gtcctggctcc

SEQ ID NO: 367173 - DNA, 14 bp, Homo sapiens
gtcctggctcctga

SEQ ID NO: 367174 - DNA, 17 bp, Homo sapiens
gtcctggctcctgaggg

SEQ ID NO: 367175 - DNA, 15 bp, Homo sapiens
gtcctggctgtgcac

SEQ ID NO: 367176 - DNA, 16 bp, Homo sapiens
gtcctggctgtgcaca

SEQ ID NO: 367177 - DNA, 14 bp, Homo sapiens
gtcctgggcgccct

SEQ ID NO: 367178 - DNA, 16 bp, Homo sapiens
gtcctgggcgccctgg

SEQ ID NO: 367179 - DNA, 17 bp, Homo sapiens
gtcctgggcgccctgga

SEQ ID NO: 367180 - DNA, 15 bp, Homo sapiens
gtcctggggaggctg

SEQ ID NO: 367181 - DNA, 22 bp, Homo sapiens
gtcctggggaggctgagactgc

SEQ ID NO: 367182 - DNA, 23 bp, Homo sapiens
gtcctggggaggctgagactgca

SEQ ID NO: 367183 - DNA, 18 bp, Homo sapiens
gtcctggtacagcagggt

SEQ ID NO: 367184 - DNA, 19 bp, Homo sapiens
gtcctggtggggctgagcc

SEQ ID NO: 367185 - DNA, 17 bp, Homo sapiens
gtcctggttcagtggga

SEQ ID NO: 367186 - DNA, 21 bp, Homo sapiens
gtcctgtaaacactcagctgt

SEQ ID NO: 367187 - DNA, 15 bp, Homo sapiens
gtcctgtacattgtg

SEQ ID NO: 367188 - DNA, 13 bp, Homo sapiens
gtcctgtcccaga

SEQ ID NO: 367189 - DNA, 15 bp, Homo sapiens
gtcctgtcccagagg

SEQ ID NO: 367190 - DNA, 16 bp, Homo sapiens
gtcctgtctcccctct

SEQ ID NO: 367191 - DNA, 18 bp, Homo sapiens
gtcctgtctcccctctgc

SEQ ID NO: 367192 - DNA, 18 bp, Homo sapiens
gtcctgtgctttctgcat

SEQ ID NO: 367193 - DNA, 23 bp, Homo sapiens
gtcctgtgctttctgcatgctta

SEQ ID NO: 367194 - DNA, 23 bp, Homo sapiens
gtcctgtggggagcccatcctct

SEQ ID NO: 367195 - DNA, 21 bp, Homo sapiens
gtcctgttaaccctccacctc

SEQ ID NO: 367196 - DNA, 23 bp, Homo sapiens
gtcctgttctcagagctccacag

SEQ ID NO: 367197 - DNA, 17 bp, Homo sapiens
gtccttagactccttct

SEQ ID NO: 367198 - DNA, 23 bp, Homo sapiens
gtccttagactccttctccccaa

SEQ ID NO: 367199 - DNA, 18 bp, Homo sapiens
gtccttagcaaggggctc

SEQ ID NO: 367200 - DNA, 22 bp, Homo sapiens
gtccttcaaaatccttccaaag

SEQ ID NO: 367201 - DNA, 13 bp, Homo sapiens
gtccttcagagct

SEQ ID NO: 367202 - DNA, 12 bp, Homo sapiens
gtccttccctct

SEQ ID NO: 367203 - DNA, 21 bp, Homo sapiens
gtccttccctctccccaagac

SEQ ID NO: 367204 - DNA, 22 bp, Homo sapiens
gtccttggtggccgggggtggg

SEQ ID NO: 367205 - DNA, 23 bp, Homo sapiens
gtccttggtggccgggggtgggg

SEQ ID NO: 367206 - DNA, 14 bp, Homo sapiens
gtcctttaggcagc

SEQ ID NO: 367207 - DNA, 15 bp, Homo sapiens
gtcctttaggcagcc

SEQ ID NO: 367208 - DNA, 17 bp, Homo sapiens
gtcctttaggcagcctg

SEQ ID NO: 367209 - DNA, 18 bp, Homo sapiens
gtcctttaggcagcctgc

SEQ ID NO: 367210 - DNA, 21 bp, Homo sapiens
gtcctttaggcagcctgccgc

SEQ ID NO: 367211 - DNA, 22 bp, Homo sapiens
gtcctttccagtggcctggctc

SEQ ID NO: 367212 - DNA, 14 bp, Homo sapiens
gtcctttccctgga

SEQ ID NO: 367213 - DNA, 18 bp, Homo sapiens
gtcctttccctggagtca

SEQ ID NO: 367214 - DNA, 22 bp, Homo sapiens
gtcctttccctggagtcagttt

SEQ ID NO: 367215 - DNA, 16 bp, Homo sapiens
gtcctttgagaaagaa

SEQ ID NO: 367216 - DNA, 18 bp, Homo sapiens
gtcctttgagaaagaaat

SEQ ID NO: 367217 - DNA, 18 bp, Homo sapiens
gtcgagtgatatggcttg

SEQ ID NO: 367218 - DNA, 13 bp, Homo sapiens
gtcgatgctcaat

SEQ ID NO: 367219 - DNA, 23 bp, Homo sapiens
gtcgattaacctgcatgcagcaa

SEQ ID NO: 367220 - DNA, 22 bp, Homo sapiens
gtcgcaaaggtgaacactcatg

SEQ ID NO: 367221 - DNA, 19 bp, Homo sapiens
gtcgcagaccagagctgtc

SEQ ID NO: 367222 - DNA, 21 bp, Homo sapiens
gtcgcaggatccgctgccacc

SEQ ID NO: 367223 - DNA, 22 bp, Homo sapiens
gtcgcaggatccgctgccacca

SEQ ID NO: 367224 - DNA, 20 bp, Homo sapiens
gtcgcccaggctggagtgca

SEQ ID NO: 367225 - DNA, 16 bp, Homo sapiens
gtcgcccctcctcggg

SEQ ID NO: 367226 - DNA, 18 bp, Homo sapiens
gtcgccgtccctctgcct

SEQ ID NO: 367227 - DNA, 12 bp, Homo sapiens
gtcgcctctgca

SEQ ID NO: 367228 - DNA, 22 bp, Homo sapiens
gtcgcctgcggactccatggcc

SEQ ID NO: 367229 - DNA, 19 bp, Homo sapiens
gtcggagaggctgtctggg

SEQ ID NO: 367230 - DNA, 20 bp, Homo sapiens
gtcggagaggctgtctgggg

SEQ ID NO: 367231 - DNA, 14 bp, Homo sapiens
gtcggaggcttggg

SEQ ID NO: 367232 - DNA, 16 bp, Homo sapiens
gtcggaggcttgggac

SEQ ID NO: 367233 - DNA, 12 bp, Homo sapiens
gtcggctgggca

SEQ ID NO: 367234 - DNA, 16 bp, Homo sapiens
gtcggctgggcagggc

SEQ ID NO: 367235 - DNA, 17 bp, Homo sapiens
gtcggctgggcagggcc

SEQ ID NO: 367236 - DNA, 17 bp, Homo sapiens
gtcgggaaattctgctg

SEQ ID NO: 367237 - DNA, 22 bp, Homo sapiens
gtcgggaaattctgctgcttga

SEQ ID NO: 367238 - DNA, 21 bp, Homo sapiens
gtcgggctcagctctggctca

SEQ ID NO: 367239 - DNA, 21 bp, Homo sapiens
gtcgggggaggagcaccccca

SEQ ID NO: 367240 - DNA, 22 bp, Homo sapiens
gtcgggggaggagcacccccag

SEQ ID NO: 367241 - DNA, 14 bp, Homo sapiens
gtcgggggctgagg

SEQ ID NO: 367242 - DNA, 19 bp, Homo sapiens
gtcggggggcgagggaggg

SEQ ID NO: 367243 - DNA, 20 bp, Homo sapiens
gtcgtccccctccagtgctt

SEQ ID NO: 367244 - DNA, 17 bp, Homo sapiens
gtcgtggagatgtcttc

SEQ ID NO: 367245 - DNA, 22 bp, Homo sapiens
gtcgtggcagataatcagcctc

SEQ ID NO: 367246 - DNA, 22 bp, Homo sapiens
gtcgtttcattcattttgtgta

SEQ ID NO: 367247 - DNA, 17 bp, Homo sapiens
gtctaaaagattcttta

SEQ ID NO: 367248 - DNA, 11 bp, Homo sapiens
gtctaaagttt

SEQ ID NO: 367249 - DNA, 17 bp, Homo sapiens
gtctaaagtttacagta

SEQ ID NO: 367250 - DNA, 13 bp, Homo sapiens
gtctaaatatttc

SEQ ID NO: 367251 - DNA, 13 bp, Homo sapiens
gtctaaatttgaa

SEQ ID NO: 367252 - DNA, 13 bp, Homo sapiens
gtctaaccccagg

SEQ ID NO: 367253 - DNA, 18 bp, Homo sapiens
gtctaacttttgtgtgaa

SEQ ID NO: 367254 - DNA, 23 bp, Homo sapiens
gtctaagatagtaacaatgaaga

SEQ ID NO: 367255 - DNA, 15 bp, Homo sapiens
gtctacaaaagcaaa

SEQ ID NO: 367256 - DNA, 15 bp, Homo sapiens
gtctacaaatataag

SEQ ID NO: 367257 - DNA, 20 bp, Homo sapiens
gtctacaaatataagatttt

SEQ ID NO: 367258 - DNA, 15 bp, Homo sapiens
gtctacaggcctttc

SEQ ID NO: 367259 - DNA, 19 bp, Homo sapiens
gtctacaggcctttcagga

SEQ ID NO: 367260 - DNA, 21 bp, Homo sapiens
gtctaccaccgaatccctagt

SEQ ID NO: 367261 - DNA, 13 bp, Homo sapiens
gtctaccatctcc

SEQ ID NO: 367262 - DNA, 14 bp, Homo sapiens
gtctaccatctccc

SEQ ID NO: 367263 - DNA, 22 bp, Homo sapiens
gtctactgtggtgatctgtaga

SEQ ID NO: 367264 - DNA, 20 bp, Homo sapiens
gtctagaatcctgctttaca

SEQ ID NO: 367265 - DNA, 22 bp, Homo sapiens
gtctagaggcaacagtgttctg

SEQ ID NO: 367266 - DNA, 14 bp, Homo sapiens
gtctagataacatt

SEQ ID NO: 367267 - DNA, 15 bp, Homo sapiens
gtctaggataatttt

SEQ ID NO: 367268 - DNA, 22 bp, Homo sapiens
gtctatgacatgaacaatgtgt

SEQ ID NO: 367269 - DNA, 15 bp, Homo sapiens
gtctattctgagcct

SEQ ID NO: 367270 - DNA, 20 bp, Homo sapiens
gtctcaagcactaaaaagtg

SEQ ID NO: 367271 - DNA, 23 bp, Homo sapiens
gtctcacagtgttgcccaggctg

SEQ ID NO: 367272 - DNA, 17 bp, Homo sapiens
gtctcaccagctcagcc

SEQ ID NO: 367273 - DNA, 14 bp, Homo sapiens
gtctcactcctgag

SEQ ID NO: 367274 - DNA, 22 bp, Homo sapiens
gtctcacttgtgcagtgttgac

SEQ ID NO: 367275 - DNA, 23 bp, Homo sapiens
gtctcagcaaattcttgaataaa

SEQ ID NO: 367276 - DNA, 16 bp, Homo sapiens
gtctcaggtccctgca

SEQ ID NO: 367277 - DNA, 16 bp, Homo sapiens
gtctcataattgtcaa

SEQ ID NO: 367278 - DNA, 15 bp, Homo sapiens
gtctcatattttcag

SEQ ID NO: 367279 - DNA, 18 bp, Homo sapiens
gtgacacttcagagagct

SEQ ID NO: 367280 - DNA, 21 bp, Homo sapiens
gtgacacttcagagagctggt

SEQ ID NO: 367281 - DNA, 15 bp, Homo sapiens
gtgacagacaggctc

SEQ ID NO: 367282 - DNA, 17 bp, Homo sapiens
gtgacagagttcactat

SEQ ID NO: 367283 - DNA, 18 bp, Homo sapiens
gtgacagagttcactata

SEQ ID NO: 367284 - DNA, 13 bp, Homo sapiens
gtgacagccttgg

SEQ ID NO: 367285 - DNA, 13 bp, Homo sapiens
gtgacatgcggct

SEQ ID NO: 367286 - DNA, 21 bp, Homo sapiens
gtgacatgcgggctgggcagc

SEQ ID NO: 367287 - DNA, 18 bp, Homo sapiens
gtgaccaattgccctgcc

SEQ ID NO: 367288 - DNA, 13 bp, Homo sapiens
gtgaccaccttct

SEQ ID NO: 367289 - DNA, 15 bp, Homo sapiens
gtgaccaccttctgt

SEQ ID NO: 367290 - DNA, 16 bp, Homo sapiens
gtgaccaccttctgtc

SEQ ID NO: 367291 - DNA, 22 bp, Homo sapiens
gtgaccaccttctgtccccagc

SEQ ID NO: 367292 - DNA, 12 bp, Homo sapiens
gtgaccaggtcc

SEQ ID NO: 367293 - DNA, 15 bp, Homo sapiens
gtgaccatttataat

SEQ ID NO: 367294 - DNA, 17 bp, Homo sapiens
gtgacccaccagtgcct

SEQ ID NO: 367295 - DNA, 19 bp, Homo sapiens
gtgaccgcccagctctccc

SEQ ID NO: 367296 - DNA, 14 bp, Homo sapiens
gtgaccggcccgcc

SEQ ID NO: 367297 - DNA, 16 bp, Homo sapiens
gtgaccggcccgccac

SEQ ID NO: 367298 - DNA, 19 bp, Homo sapiens
gtgaccggcccgccacctt

SEQ ID NO: 367299 - DNA, 23 bp, Homo sapiens
gtgacctgtggggatttctccca

SEQ ID NO: 367300 - DNA, 17 bp, Homo sapiens
gtgacgcctgccctccc

SEQ ID NO: 367301 - DNA, 21 bp, Homo sapiens
gtgacggtcctttaggcagcc

SEQ ID NO: 367302 - DNA, 24 bp, Homo sapiens
gtgacggtcctttaggcagcctgc

SEQ ID NO: 367303 - DNA, 17 bp, Homo sapiens
gtgacgtgagtggggag

SEQ ID NO: 367304 - DNA, 13 bp, Homo sapiens
gtgactagtgctg

SEQ ID NO: 367305 - DNA, 15 bp, Homo sapiens
gtgactagtgctgaa

SEQ ID NO: 367306 - DNA, 21 bp, Homo sapiens
gtgactgaaggggcacaccac

SEQ ID NO: 367307 - DNA, 22 bp, Homo sapiens
gtgactgaatttgggcctcttg

SEQ ID NO: 367308 - DNA, 12 bp, Homo sapiens
gtgactggcacc

SEQ ID NO: 367309 - DNA, 12 bp, Homo sapiens
gtgactggcagg

SEQ ID NO: 367310 - DNA, 13 bp, Homo sapiens
gtgactggcaggt

SEQ ID NO: 367311 - DNA, 15 bp, Homo sapiens
gtgactggcaggtgc

SEQ ID NO: 367312 - DNA, 21 bp, Homo sapiens
gtgactggcaggtgcagatgg

SEQ ID NO: 367313 - DNA, 24 bp, Homo sapiens
gtgactggcaggtgcagatgggct

SEQ ID NO: 367314 - DNA, 21 bp, Homo sapiens
gtgactgtcaagtacaagcaa

SEQ ID NO: 367315 - DNA, 16 bp, Homo sapiens
gtgactgtttggctta

SEQ ID NO: 367316 - DNA, 14 bp, Homo sapiens
gtgacttgaatgta

SEQ ID NO: 367317 - DNA, 14 bp, Homo sapiens
gtgacttttgaaga

SEQ ID NO: 367318 - DNA, 15 bp, Homo sapiens
gtgactttttagcca

SEQ ID NO: 367319 - DNA, 20 bp, Homo sapiens
gtgactttttagccagtgac

SEQ ID NO: 367320 - DNA, 14 bp, Homo sapiens
gtgagaacttttca

SEQ ID NO: 367321 - DNA, 20 bp, Homo sapiens
gtgagaataattgtgtacaa

SEQ ID NO: 367322 - DNA, 14 bp, Homo sapiens
gtgagaatcctgcc

SEQ ID NO: 367323 - DNA, 18 bp, Homo sapiens
gtgagaatcctgcctctc

SEQ ID NO: 367324 - DNA, 19 bp, Homo sapiens
gtgagaatcctgcctctcc

SEQ ID NO: 367325 - DNA, 22 bp, Homo sapiens
gtgagaatcgacctcactgtca

SEQ ID NO: 367326 - DNA, 16 bp, Homo sapiens
gtgagaattaaaataa

SEQ ID NO: 367327 - DNA, 21 bp, Homo sapiens
gtgagacagtgggggtgcctg

SEQ ID NO: 367328 - DNA, 22 bp, Homo sapiens
gtgagacagtgggggtgcctgg

SEQ ID NO: 367329 - DNA, 20 bp, Homo sapiens
gtgagaccacctctcaatat

SEQ ID NO: 367330 - DNA, 15 bp, Homo sapiens
gtgagacccccacac

SEQ ID NO: 367331 - DNA, 16 bp, Homo sapiens
gtgagacgaggcaggg

SEQ ID NO: 367332 - DNA, 18 bp, Homo sapiens
gtgagacgaggcaggggc

SEQ ID NO: 367333 - DNA, 16 bp, Homo sapiens
gtgagagaatttatca

SEQ ID NO: 367334 - DNA, 22 bp, Homo sapiens
gtgagagaccctcgcaaaatga

SEQ ID NO: 367335 - DNA, 18 bp, Homo sapiens
gtgagagcacaaagataa

SEQ ID NO: 367336 - DNA, 18 bp, Homo sapiens
gtgagagcgaggctgagc

SEQ ID NO: 367337 - DNA, 15 bp, Homo sapiens
gtgagataacttcct

SEQ ID NO: 367338 - DNA, 16 bp, Homo sapiens
gtgagatacccagaga

SEQ ID NO: 367339 - DNA, 21 bp, Homo sapiens
gtgagatccttcacaggcagt

SEQ ID NO: 367340 - DNA, 19 bp, Homo sapiens
gtgagcagaagtggagctg

SEQ ID NO: 367341 - DNA, 21 bp, Homo sapiens
gtgagcagcctccactgtgtc

SEQ ID NO: 367342 - DNA, 18 bp, Homo sapiens
gtgagcaggaaggcctgg

SEQ ID NO: 367343 - DNA, 19 bp, Homo sapiens
gtgagcaggaaggcctggg

SEQ ID NO: 367344 - DNA, 19 bp, Homo sapiens
gtgagcaggctttgggaac

SEQ ID NO: 367345 - DNA, 21 bp, Homo sapiens
gtgagcagggccctcagagga

SEQ ID NO: 367346 - DNA, 15 bp, Homo sapiens
gtgagccaccgctgc

SEQ ID NO: 367347 - DNA, 24 bp, Homo sapiens
gtgagccaccgctgccagcacaga

SEQ ID NO: 367348 - DNA, 16 bp, Homo sapiens
gtgagcccctccccag

SEQ ID NO: 367349 - DNA, 16 bp, Homo sapiens
gtgagccttgctgcca

SEQ ID NO: 367350 - DNA, 16 bp, Homo sapiens
gtgagcggagatcgca

SEQ ID NO: 367351 - DNA, 16 bp, Homo sapiens
gtgagcgggtggggtg

SEQ ID NO: 367352 - DNA, 20 bp, Homo sapiens
gtgagctcaaactggccttg

SEQ ID NO: 367353 - DNA, 16 bp, Homo sapiens
gtgagctgggaagctg

SEQ ID NO: 367354 - DNA, 14 bp, Homo sapiens
gtgagctgtgatca

SEQ ID NO: 367355 - DNA, 16 bp, Homo sapiens
gtgaggaagctccagt

SEQ ID NO: 367356 - DNA, 20 bp, Homo sapiens
gtgaggaatgctctgtgcca

SEQ ID NO: 367357 - DNA, 23 bp, Homo sapiens
gtgaggacaaggtacaggcaagg

SEQ ID NO: 367358 - DNA, 11 bp, Homo sapiens
gtgaggagctg

SEQ ID NO: 367359 - DNA, 18 bp, Homo sapiens
gtgaggagctgctggctt

SEQ ID NO: 367360 - DNA, 15 bp, Homo sapiens
gtgaggaggaggcag

SEQ ID NO: 367361 - DNA, 16 bp, Homo sapiens
gtgaggaggaggcaga

SEQ ID NO: 367362 - DNA, 12 bp, Homo sapiens
gtgaggagggtg

SEQ ID NO: 367363 - DNA, 17 bp, Homo sapiens
gtgaggatgaaaaaata

SEQ ID NO: 367364 - DNA, 14 bp, Homo sapiens
gtgaggcccagcct

SEQ ID NO: 367365 - DNA, 16 bp, Homo sapiens
gtgaggcccagcctgt

SEQ ID NO: 367366 - DNA, 15 bp, Homo sapiens
gtgaggcccagggag

SEQ ID NO: 367367 - DNA, 20 bp, Homo sapiens
gtgaggcccccggaggcgcc

SEQ ID NO: 367368 - DNA, 12 bp, Homo sapiens
gtgaggcctggg

SEQ ID NO: 367369 - DNA, 19 bp, Homo sapiens
gtgaggcggcagctggggc

SEQ ID NO: 367370 - DNA, 21 bp, Homo sapiens
gtgaggcgtgggatccagaga

SEQ ID NO: 367371 - DNA, 18 bp, Homo sapiens
gtgaggcttccaggctct

SEQ ID NO: 367372 - DNA, 15 bp, Homo sapiens
gtgagggaggcctga

SEQ ID NO: 367373 - DNA, 12 bp, Homo sapiens
gtgagggagtgc

SEQ ID NO: 367374 - DNA, 23 bp, Homo sapiens
gtgagggatgccataccttgaga

SEQ ID NO: 367375 - DNA, 12 bp, Homo sapiens
gtgagggcagca

SEQ ID NO: 367376 - DNA, 15 bp, Homo sapiens
gtgagggcagcactg

SEQ ID NO: 367377 - DNA, 17 bp, Homo sapiens
gtgaggggccactgggc

SEQ ID NO: 367378 - DNA, 16 bp, Homo sapiens
gtgagggggagctgaa

SEQ ID NO: 367379 - DNA, 16 bp, Homo sapiens
gtgaggttgggcagct

SEQ ID NO: 367380 - DNA, 16 bp, Homo sapiens
gtgagtaagagctggt

SEQ ID NO: 367381 - DNA, 17 bp, Homo sapiens
gtgagtcctggcatggg

SEQ ID NO: 367382 - DNA, 18 bp, Homo sapiens
gtgagtctgtcctttccc

SEQ ID NO: 367383 - DNA, 15 bp, Homo sapiens
gtgagtggcagccat

SEQ ID NO: 367384 - DNA, 16 bp, Homo sapiens
gtgagtggcatgtggg

SEQ ID NO: 367385 - DNA, 22 bp, Homo sapiens
gtgagtgtgtccaagtgtgtgt

SEQ ID NO: 367386 - DNA, 15 bp, Homo sapiens
gtgagttctcactat

SEQ ID NO: 367387 - DNA, 15 bp, Homo sapiens
gtgagttctgttgtg

SEQ ID NO: 367388 - DNA, 11 bp, Homo sapiens
gtgataagtgg

SEQ ID NO: 367389 - DNA, 17 bp, Homo sapiens
gtgatacactgtatcta

SEQ ID NO: 367390 - DNA, 18 bp, Homo sapiens
gtgataggcaaggatgaa

SEQ ID NO: 367391 - DNA, 16 bp, Homo sapiens
gtgataggcccaaggt

SEQ ID NO: 367392 - DNA, 13 bp, Homo sapiens
gtgatatggagcc

SEQ ID NO: 367393 - DNA, 22 bp, Homo sapiens
gtgatatggtactaaggagaat

SEQ ID NO: 367394 - DNA, 20 bp, Homo sapiens
gtgatatgtgtaatatcatt

SEQ ID NO: 367395 - DNA, 18 bp, Homo sapiens
gtgatcaataaaatgtga

SEQ ID NO: 367396 - DNA, 17 bp, Homo sapiens
gtgatcaattaaatgta

SEQ ID NO: 367397 - DNA, 14 bp, Homo sapiens
gtgatcactttctg

SEQ ID NO: 367398 - DNA, 13 bp, Homo sapiens
gtgatccacctgc

SEQ ID NO: 367399 - DNA, 20 bp, Homo sapiens
gtgatccatccatctccagg

SEQ ID NO: 367400 - DNA, 22 bp, Homo sapiens
gtgatccgcctacctcagcctc

SEQ ID NO: 367401 - DNA, 21 bp, Homo sapiens
gtgatcctctattttgtgatg

SEQ ID NO: 367402 - DNA, 15 bp, Homo sapiens
gtgatcgcacaagga

SEQ ID NO: 367403 - DNA, 13 bp, Homo sapiens
gtgatgaaattat

SEQ ID NO: 367404 - DNA, 17 bp, Homo sapiens
gtgatgaaattataagt

SEQ ID NO: 367405 - DNA, 13 bp, Homo sapiens
gtgatgatagcac

SEQ ID NO: 367406 - DNA, 15 bp, Homo sapiens
gtgatgatgctgtga

SEQ ID NO: 367407 - DNA, 19 bp, Homo sapiens
gtgatggcattactctgca

SEQ ID NO: 367408 - DNA, 21 bp, Homo sapiens
gtgatgggccaccggggcaag

SEQ ID NO: 367409 - DNA, 22 bp, Homo sapiens
gtgatgggggcatgggtggagg

SEQ ID NO: 367410 - DNA, 19 bp, Homo sapiens
gtgccggcggcagccccac

SEQ ID NO: 367411 - DNA, 20 bp, Homo sapiens
gtgccgtgagcaggctttgg

SEQ ID NO: 367412 - DNA, 15 bp, Homo sapiens
gtgcctaaaattgta

SEQ ID NO: 367413 - DNA, 13 bp, Homo sapiens
gtgcctaataaag

SEQ ID NO: 367414 - DNA, 15 bp, Homo sapiens
gtgcctcaagagaag

SEQ ID NO: 367415 - DNA, 16 bp, Homo sapiens
gtgcctcagcgctgcc

SEQ ID NO: 367416 - DNA, 18 bp, Homo sapiens
gtgcctcagcgctgccca

SEQ ID NO: 367417 - DNA, 23 bp, Homo sapiens
gtgcctcccaagctcagagcagc

SEQ ID NO: 367418 - DNA, 20 bp, Homo sapiens
gtgcctcccacacttgctgg

SEQ ID NO: 367419 - DNA, 12 bp, Homo sapiens
gtgcctcccccc

SEQ ID NO: 367420 - DNA, 18 bp, Homo sapiens
gtgcctccccccagaccc

SEQ ID NO: 367421 - DNA, 12 bp, Homo sapiens
gtgcctcccccg

SEQ ID NO: 367422 - DNA, 15 bp, Homo sapiens
gtgcctcctctgggg

SEQ ID NO: 367423 - DNA, 13 bp, Homo sapiens
gtgcctccttcca

SEQ ID NO: 367424 - DNA, 14 bp, Homo sapiens
gtgcctcgaggcac

SEQ ID NO: 367425 - DNA, 15 bp, Homo sapiens
gtgcctcgaggcacc

SEQ ID NO: 367426 - DNA, 16 bp, Homo sapiens
gtgcctcgaggcaccg

SEQ ID NO: 367427 - DNA, 13 bp, Homo sapiens
gtgcctctgcctg

SEQ ID NO: 367428 - DNA, 21 bp, Homo sapiens
gtgcctctggaggcctctggg

SEQ ID NO: 367429 - DNA, 21 bp, Homo sapiens
gtgcctcttgggagacgtcca

SEQ ID NO: 367430 - DNA, 19 bp, Homo sapiens
gtgcctgagagcagaatga

SEQ ID NO: 367431 - DNA, 21 bp, Homo sapiens
gtgcctgagcccgaatttctc

SEQ ID NO: 367432 - DNA, 15 bp, Homo sapiens
gtgcctgccactctc

SEQ ID NO: 367433 - DNA, 21 bp, Homo sapiens
gtgcctgccactctctgggac

SEQ ID NO: 367434 - DNA, 19 bp, Homo sapiens
gtgcctgctagagcaaccc

SEQ ID NO: 367435 - DNA, 22 bp, Homo sapiens
gtgcctgctagagcaacccctg

SEQ ID NO: 367436 - DNA, 20 bp, Homo sapiens
gtgcctgctatccagccgca

SEQ ID NO: 367437 - DNA, 21 bp, Homo sapiens
gtgcctgctctccttgccctg

SEQ ID NO: 367438 - DNA, 22 bp, Homo sapiens
gtgcctgctctccttgccctgg

SEQ ID NO: 367439 - DNA, 23 bp, Homo sapiens
gtgcctgctctccttgccctggg

SEQ ID NO: 367440 - DNA, 12 bp, Homo sapiens
gtgcctggagct

SEQ ID NO: 367441 - DNA, 23 bp, Homo sapiens
gtgcctggatgggggtgcaggca

SEQ ID NO: 367442 - DNA, 15 bp, Homo sapiens
gtgcctgggaatgta

SEQ ID NO: 367443 - DNA, 19 bp, Homo sapiens
gtgcctgggatcagtgggg

SEQ ID NO: 367444 - DNA, 20 bp, Homo sapiens
gtgcctggtgcgctgtgctc

SEQ ID NO: 367445 - DNA, 19 bp, Homo sapiens
gtgcctgtcacgctctggt

SEQ ID NO: 367446 - DNA, 20 bp, Homo sapiens
gtgcctgtgaccggggtcct

SEQ ID NO: 367447 - DNA, 15 bp, Homo sapiens
gtgccttcagctcta

SEQ ID NO: 367448 - DNA, 22 bp, Homo sapiens
gtgccttccataattatgacag

SEQ ID NO: 367449 - DNA, 20 bp, Homo sapiens
gtgccttccgtgggtcatcc

SEQ ID NO: 367450 - DNA, 21 bp, Homo sapiens
gtgccttggggaatttcctct

SEQ ID NO: 367451 - DNA, 21 bp, Homo sapiens
gtgcctttgagtttcctcagg

SEQ ID NO: 367452 - DNA, 22 bp, Homo sapiens
gtgcgcagccgcgctctgcccc

SEQ ID NO: 367453 - DNA, 19 bp, Homo sapiens
gtgcgctcttggtccctgg

SEQ ID NO: 367454 - DNA, 16 bp, Homo sapiens
gtgcggtaggtgctgg

SEQ ID NO: 367455 - DNA, 15 bp, Homo sapiens
gtgcgtgaaacacac

SEQ ID NO: 367456 - DNA, 21 bp, Homo sapiens
gtgcgtgaaacacaccaggct

SEQ ID NO: 367457 - DNA, 16 bp, Homo sapiens
gtgcgtggctgtggca

SEQ ID NO: 367458 - DNA, 12 bp, Homo sapiens
gtgcgtgggtga

SEQ ID NO: 367459 - DNA, 16 bp, Homo sapiens
gtgcgtgtctctgcca

SEQ ID NO: 367460 - DNA, 21 bp, Homo sapiens
gtgcgtgtggccctgtgggag

SEQ ID NO: 367461 - DNA, 13 bp, Homo sapiens
gtgcgtgtgtgca

SEQ ID NO: 367462 - DNA, 16 bp, Homo sapiens
gtgctacagagaaaat

SEQ ID NO: 367463 - DNA, 22 bp, Homo sapiens
gtgctagggtgcctgctctcct

SEQ ID NO: 367464 - DNA, 14 bp, Homo sapiens
gtgctagtgagctg

SEQ ID NO: 367465 - DNA, 13 bp, Homo sapiens
gtgctatgaattt

SEQ ID NO: 367466 - DNA, 13 bp, Homo sapiens
gtgctcaaagatg

SEQ ID NO: 367467 - DNA, 17 bp, Homo sapiens
gtgctcacccattgtct

SEQ ID NO: 367468 - DNA, 18 bp, Homo sapiens
gtgctccagcagtgctgg

SEQ ID NO: 367469 - DNA, 23 bp, Homo sapiens
gtgctccagcagtgctgggccca

SEQ ID NO: 367470 - DNA, 20 bp, Homo sapiens
gtgctccctcggtcacctgt

SEQ ID NO: 367471 - DNA, 16 bp, Homo sapiens
gtgctccttttctctt

SEQ ID NO: 367472 - DNA, 22 bp, Homo sapiens
gtgctcggacacagttttgtct

SEQ ID NO: 367473 - DNA, 19 bp, Homo sapiens
gtgctctggcggcttcctg

SEQ ID NO: 367474 - DNA, 16 bp, Homo sapiens
gtgctctttgtggcag

SEQ ID NO: 367475 - DNA, 22 bp, Homo sapiens
gtgctgaacaaaaaataaaaat

SEQ ID NO: 367476 - DNA, 14 bp, Homo sapiens
gtgctgaagcttat

SEQ ID NO: 367477 - DNA, 13 bp, Homo sapiens
gtgctgaccccag

SEQ ID NO: 367478 - DNA, 18 bp, Homo sapiens
gtgctgaccccaggaagt

SEQ ID NO: 367479 - DNA, 14 bp, Homo sapiens
gtgctgagaagctt

SEQ ID NO: 367480 - DNA, 22 bp, Homo sapiens
gtgctgatcgtgctaaattttc

SEQ ID NO: 367481 - DNA, 17 bp, Homo sapiens
gtgctgcagacaaaaag

SEQ ID NO: 367482 - DNA, 12 bp, Homo sapiens
gtgctgccatgc

SEQ ID NO: 367483 - DNA, 14 bp, Homo sapiens
gtgctgctgctgct

SEQ ID NO: 367484 - DNA, 20 bp, Homo sapiens
gtgctggaatggggacctgg

SEQ ID NO: 367485 - DNA, 13 bp, Homo sapiens
gtgctggaggcag

SEQ ID NO: 367486 - DNA, 21 bp, Homo sapiens
gtgctggaggcagactcgagg

SEQ ID NO: 367487 - DNA, 23 bp, Homo sapiens
gtgctggaggcagactcgagggc

SEQ ID NO: 367488 - DNA, 15 bp, Homo sapiens
gtgctggctgcccag

SEQ ID NO: 367489 - DNA, 18 bp, Homo sapiens
gtgctgggactgagccag

SEQ ID NO: 367490 - DNA, 22 bp, Homo sapiens
gtgctgggactgagccagtccc

SEQ ID NO: 367491 - DNA, 16 bp, Homo sapiens
gtgctgggcccagccg

SEQ ID NO: 367492 - DNA, 21 bp, Homo sapiens
gtgctggtctattttgatttt

SEQ ID NO: 367493 - DNA, 15 bp, Homo sapiens
gtgctgtgaccattt

SEQ ID NO: 367494 - DNA, 15 bp, Homo sapiens
gtgctgtggttcctg

SEQ ID NO: 367495 - DNA, 14 bp, Homo sapiens
gtgctgttgattct

SEQ ID NO: 367496 - DNA, 20 bp, Homo sapiens
gtgctgttgtcattgcttta

SEQ ID NO: 367497 - DNA, 17 bp, Homo sapiens
gtgcttaagcagaagca

SEQ ID NO: 367498 - DNA, 16 bp, Homo sapiens
gtgcttaatgtgaact

SEQ ID NO: 367499 - DNA, 15 bp, Homo sapiens
gtgcttcaattaata

SEQ ID NO: 367500 - DNA, 13 bp, Homo sapiens
gtgcttcttgtaa

SEQ ID NO: 367501 - DNA, 13 bp, Homo sapiens
gtgcttggctgcc

SEQ ID NO: 367502 - DNA, 15 bp, Homo sapiens
gtgcttggctgcccc

SEQ ID NO: 367503 - DNA, 19 bp, Homo sapiens
gtgcttggggctatttgtg

SEQ ID NO: 367504 - DNA, 20 bp, Homo sapiens
gtgcttgttccctctccctg

SEQ ID NO: 367505 - DNA, 19 bp, Homo sapiens
gtgcttgtttacagcacta

SEQ ID NO: 367506 - DNA, 15 bp, Homo sapiens
gtgctttatgctgaa

SEQ ID NO: 367507 - DNA, 17 bp, Homo sapiens
gtgctttatgctgaaac

SEQ ID NO: 367508 - DNA, 12 bp, Homo sapiens
gtgctttctcaa

SEQ ID NO: 367509 - DNA, 12 bp, Homo sapiens
gtgctttctgca

SEQ ID NO: 367510 - DNA, 13 bp, Homo sapiens
gtgctttctgcat

SEQ ID NO: 367511 - DNA, 15 bp, Homo sapiens
gtgctttgtagctta

SEQ ID NO: 367512 - DNA, 16 bp, Homo sapiens
gtgcttttgcaaaaga

SEQ ID NO: 367513 - DNA, 15 bp, Homo sapiens
gtggaaaaaagagaa

SEQ ID NO: 367514 - DNA, 19 bp, Homo sapiens
gtggaaaaaagagaaaaac

SEQ ID NO: 367515 - DNA, 19 bp, Homo sapiens
gtggaaaacaatttgcata

SEQ ID NO: 367516 - DNA, 22 bp, Homo sapiens
gtggaaaacaatttgcataata

SEQ ID NO: 367517 - DNA, 16 bp, Homo sapiens
gtggaaaggattctaa

SEQ ID NO: 367518 - DNA, 19 bp, Homo sapiens
gtggaaagtgaatttgaat

SEQ ID NO: 367519 - DNA, 19 bp, Homo sapiens
gtggaacaggaggaactgg

SEQ ID NO: 367520 - DNA, 20 bp, Homo sapiens
gtggaacaggaggaactggt

SEQ ID NO: 367521 - DNA, 15 bp, Homo sapiens
gtggaagagcagcct

SEQ ID NO: 367522 - DNA, 12 bp, Homo sapiens
gtggaaggagcc

SEQ ID NO: 367523 - DNA, 22 bp, Homo sapiens
gtggacagagggagaagggaga

SEQ ID NO: 367524 - DNA, 21 bp, Homo sapiens
gtggacagggcccccggccac

SEQ ID NO: 367525 - DNA, 13 bp, Homo sapiens
gtggacccagctg

SEQ ID NO: 367526 - DNA, 19 bp, Homo sapiens
gtggacctctactttccag

SEQ ID NO: 367527 - DNA, 14 bp, Homo sapiens
gtggacctgaagga

SEQ ID NO: 367528 - DNA, 14 bp, Homo sapiens
gtggacctgcctac

SEQ ID NO: 367529 - DNA, 16 bp, Homo sapiens
gtggactctgtgctca

SEQ ID NO: 367530 - DNA, 18 bp, Homo sapiens
gtggactctgtgctcacc

SEQ ID NO: 367531 - DNA, 20 bp, Homo sapiens
gtggactttatttaatttca

SEQ ID NO: 367532 - DNA, 21 bp, Homo sapiens
gtggactttatttaatttcat

SEQ ID NO: 367533 - DNA, 17 bp, Homo sapiens
gtggactttccaccccc

SEQ ID NO: 367534 - DNA, 20 bp, Homo sapiens
gtggactttccaccccctcc

SEQ ID NO: 367535 - DNA, 16 bp, Homo sapiens
gtggagaacaaagacc

SEQ ID NO: 367536 - DNA, 14 bp, Homo sapiens
gtggagagctggtg

SEQ ID NO: 367537 - DNA, 17 bp, Homo sapiens
gtggagagctggtgccc

SEQ ID NO: 367538 - DNA, 11 bp, Homo sapiens
gtggagaggag

SEQ ID NO: 367539 - DNA, 14 bp, Homo sapiens
gtggagaggagaga

SEQ ID NO: 367540 - DNA, 22 bp, Homo sapiens
gtgggcctggcctgagctgggg

SEQ ID NO: 367541 - DNA, 16 bp, Homo sapiens
gtgggccttttgctca

SEQ ID NO: 367542 - DNA, 20 bp, Homo sapiens
gtgggcggatcacaaggtca

SEQ ID NO: 367543 - DNA, 14 bp, Homo sapiens
gtgggctccagagt

SEQ ID NO: 367544 - DNA, 14 bp, Homo sapiens
gtgggctctgagca

SEQ ID NO: 367545 - DNA, 15 bp, Homo sapiens
gtgggctctggctcc

SEQ ID NO: 367546 - DNA, 15 bp, Homo sapiens
gtgggctgggccctc

SEQ ID NO: 367547 - DNA, 22 bp, Homo sapiens
gtgggctggtattctctctatg

SEQ ID NO: 367548 - DNA, 12 bp, Homo sapiens
gtgggctggtgc

SEQ ID NO: 367549 - DNA, 13 bp, Homo sapiens
gtgggctgtgagt

SEQ ID NO: 367550 - DNA, 11 bp, Homo sapiens
gtgggctgtgg

SEQ ID NO: 367551 - DNA, 15 bp, Homo sapiens
gtgggcttggccttg

SEQ ID NO: 367552 - DNA, 14 bp, Homo sapiens
gtggggaagagagc

SEQ ID NO: 367553 - DNA, 14 bp, Homo sapiens
gtggggacagggct

SEQ ID NO: 367554 - DNA, 22 bp, Homo sapiens
gtggggagcacttgcgtcctgc

SEQ ID NO: 367555 - DNA, 18 bp, Homo sapiens
gtggggagggacaaggga

SEQ ID NO: 367556 - DNA, 22 bp, Homo sapiens
gtggggagggacaagggattct

SEQ ID NO: 367557 - DNA, 17 bp, Homo sapiens
gtggggatttctcccag

SEQ ID NO: 367558 - DNA, 14 bp, Homo sapiens
gtggggcagcacag

SEQ ID NO: 367559 - DNA, 23 bp, Homo sapiens
gtggggcagcacagagagggggc

SEQ ID NO: 367560 - DNA, 12 bp, Homo sapiens
gtggggccacac

SEQ ID NO: 367561 - DNA, 17 bp, Homo sapiens
gtggggcccatggcccc

SEQ ID NO: 367562 - DNA, 20 bp, Homo sapiens
gtggggcccatggccccagc

SEQ ID NO: 367563 - DNA, 19 bp, Homo sapiens
gtggggccccaaagcccag

SEQ ID NO: 367564 - DNA, 20 bp, Homo sapiens
gtggggccccaaagcccagc

SEQ ID NO: 367565 - DNA, 13 bp, Homo sapiens
gtggggcgggagg

SEQ ID NO: 367566 - DNA, 24 bp, Homo sapiens
gtggggcttagaatggggcttcca

SEQ ID NO: 367567 - DNA, 12 bp, Homo sapiens
gtggggcttggc

SEQ ID NO: 367568 - DNA, 14 bp, Homo sapiens
gtgggggagaatgg

SEQ ID NO: 367569 - DNA, 19 bp, Homo sapiens
gtgggggagaatggctctg

SEQ ID NO: 367570 - DNA, 11 bp, Homo sapiens
gtgggggagcc

SEQ ID NO: 367571 - DNA, 12 bp, Homo sapiens
gtgggggagcct

SEQ ID NO: 367572 - DNA, 18 bp, Homo sapiens
gtgggggatgctgaggag

SEQ ID NO: 367573 - DNA, 14 bp, Homo sapiens
gtgggggcctgctg

SEQ ID NO: 367574 - DNA, 14 bp, Homo sapiens
gtgggggtctggga

SEQ ID NO: 367575 - DNA, 21 bp, Homo sapiens
gtgggggtgtcacagaggcag

SEQ ID NO: 367576 - DNA, 22 bp, Homo sapiens
gtgggggtgtcacagaggcagt

SEQ ID NO: 367577 - DNA, 13 bp, Homo sapiens
gtggggtctcagt

SEQ ID NO: 367578 - DNA, 14 bp, Homo sapiens
gtggggtgaagctg

SEQ ID NO: 367579 - DNA, 12 bp, Homo sapiens
gtggggtggggt

SEQ ID NO: 367580 - DNA, 18 bp, Homo sapiens
gtgggtacccaggctggt

SEQ ID NO: 367581 - DNA, 19 bp, Homo sapiens
gtgggtacccaggctggtt

SEQ ID NO: 367582 - DNA, 15 bp, Homo sapiens
gtgggtatcccacct

SEQ ID NO: 367583 - DNA, 16 bp, Homo sapiens
gtgggtcaactccaag

SEQ ID NO: 367584 - DNA, 19 bp, Homo sapiens
gtgggtcatcccagcacct

SEQ ID NO: 367585 - DNA, 19 bp, Homo sapiens
gtgggtccaggaaggcagc

SEQ ID NO: 367586 - DNA, 20 bp, Homo sapiens
gtgggtccaggaaggcagct

SEQ ID NO: 367587 - DNA, 23 bp, Homo sapiens
gtgggtccaggaaggcagctgct

SEQ ID NO: 367588 - DNA, 12 bp, Homo sapiens
gtgggtgagcca

SEQ ID NO: 367589 - DNA, 13 bp, Homo sapiens
gtgggtgagccag

SEQ ID NO: 367590 - DNA, 16 bp, Homo sapiens
gtgggtggagtcaggc

SEQ ID NO: 367591 - DNA, 17 bp, Homo sapiens
gtgggtggcacctcctg

SEQ ID NO: 367592 - DNA, 18 bp, Homo sapiens
gtgggtggcacctcctga

SEQ ID NO: 367593 - DNA, 21 bp, Homo sapiens
gtgggtggggctgtacacacc

SEQ ID NO: 367594 - DNA, 16 bp, Homo sapiens
gtgggtttagcaggct

SEQ ID NO: 367595 - DNA, 15 bp, Homo sapiens
gtgggtttctctgtg

SEQ ID NO: 367596 - DNA, 19 bp, Homo sapiens
gtgggtttctctgtgctct

SEQ ID NO: 367597 - DNA, 18 bp, Homo sapiens
gtgggttttttagttgaa

SEQ ID NO: 367598 - DNA, 16 bp, Homo sapiens
gtggtaacaagaggag

SEQ ID NO: 367599 - DNA, 22 bp, Homo sapiens
gtggtaacaagaggagcaggaa

SEQ ID NO: 367600 - DNA, 16 bp, Homo sapiens
gtggtaactgccagcc

SEQ ID NO: 367601 - DNA, 15 bp, Homo sapiens
gtggtaagtggagga

SEQ ID NO: 367602 - DNA, 15 bp, Homo sapiens
gtggtaccctggcag

SEQ ID NO: 367603 - DNA, 14 bp, Homo sapiens
gtggtagctctgag

SEQ ID NO: 367604 - DNA, 19 bp, Homo sapiens
gtggtagctctgagccctc

SEQ ID NO: 367605 - DNA, 22 bp, Homo sapiens
gtggtatcctacatacttcttt

SEQ ID NO: 367606 - DNA, 13 bp, Homo sapiens
gtggtatgtctct

SEQ ID NO: 367607 - DNA, 14 bp, Homo sapiens
gtggtatgtctctt

SEQ ID NO: 367608 - DNA, 22 bp, Homo sapiens
gtggtcagcagaaacccccagg

SEQ ID NO: 367609 - DNA, 21 bp, Homo sapiens
gtggtcatgaattcatactct

SEQ ID NO: 367610 - DNA, 19 bp, Homo sapiens
gtggtccacattctgctgc

SEQ ID NO: 367611 - DNA, 19 bp, Homo sapiens
gtggtccagaagaaattat

SEQ ID NO: 367612 - DNA, 17 bp, Homo sapiens
gtggtccctccactagg

SEQ ID NO: 367613 - DNA, 21 bp, Homo sapiens
gtggtctgagccaaagagaat

SEQ ID NO: 367614 - DNA, 15 bp, Homo sapiens
gtggtcttggagagg

SEQ ID NO: 367615 - DNA, 20 bp, Homo sapiens
gtggtcttggagaggaggtg

SEQ ID NO: 367616 - DNA, 16 bp, Homo sapiens
gtggtgaagtgtggct

SEQ ID NO: 367617 - DNA, 17 bp, Homo sapiens
gtggtgaagtgtggctg

SEQ ID NO: 367618 - DNA, 18 bp, Homo sapiens
gtggtgaagtgtggctgg

SEQ ID NO: 367619 - DNA, 22 bp, Homo sapiens
gtggtgaagtgtggctggtgtc

SEQ ID NO: 367620 - DNA, 14 bp, Homo sapiens
gtggtgacaggccc

SEQ ID NO: 367621 - DNA, 15 bp, Homo sapiens
gtggtgatgcctaaa

SEQ ID NO: 367622 - DNA, 23 bp, Homo sapiens
gtggtggaggaaacttccaactt

SEQ ID NO: 367623 - DNA, 15 bp, Homo sapiens
gtggtgtccttcttc

SEQ ID NO: 367624 - DNA, 15 bp, Homo sapiens
gtggtgtgaggcccc

SEQ ID NO: 367625 - DNA, 19 bp, Homo sapiens
gtggtgtgaggcccccgga

SEQ ID NO: 367626 - DNA, 14 bp, Homo sapiens
gtggttatgtccca

SEQ ID NO: 367627 - DNA, 22 bp, Homo sapiens
gtggttattagcaaggctgggt

SEQ ID NO: 367628 - DNA, 16 bp, Homo sapiens
gtggttcactttggtc

SEQ ID NO: 367629 - DNA, 21 bp, Homo sapiens
gtggttcagagactggcagcc

SEQ ID NO: 367630 - DNA, 13 bp, Homo sapiens
gtggttctatttt

SEQ ID NO: 367631 - DNA, 16 bp, Homo sapiens
gtggttctattttact

SEQ ID NO: 367632 - DNA, 22 bp, Homo sapiens
gtggttggaggcctggtctgga

SEQ ID NO: 367633 - DNA, 13 bp, Homo sapiens
gtggtttctatac

SEQ ID NO: 367634 - DNA, 14 bp, Homo sapiens
gtggtttgccatgt

SEQ ID NO: 367635 - DNA, 18 bp, Homo sapiens
gtggtttgccatgtcgct

SEQ ID NO: 367636 - DNA, 18 bp, Homo sapiens
gtggttttcccctccctg

SEQ ID NO: 367637 - DNA, 21 bp, Homo sapiens
gtggttttcccctccctgggt

SEQ ID NO: 367638 - DNA, 24 bp, Homo sapiens
gtggttttcccctccctgggttca

SEQ ID NO: 367639 - DNA, 16 bp, Homo sapiens
gtggtttttgagccat

SEQ ID NO: 367640 - DNA, 13 bp, Homo sapiens
gtgtaaattatgt

SEQ ID NO: 367641 - DNA, 15 bp, Homo sapiens
gtgtaacagctgagg

SEQ ID NO: 367642 - DNA, 19 bp, Homo sapiens
gtgtaactgcccaaagcag

SEQ ID NO: 367643 - DNA, 16 bp, Homo sapiens
gtgtaatatcatttca

SEQ ID NO: 367644 - DNA, 12 bp, Homo sapiens
gtgtaatattac

SEQ ID NO: 367645 - DNA, 21 bp, Homo sapiens
gtgtaattttaatggctgcaa

SEQ ID NO: 367646 - DNA, 19 bp, Homo sapiens
gtgtacaaagtagagaagt

SEQ ID NO: 367647 - DNA, 12 bp, Homo sapiens
gtgtacagaaga

SEQ ID NO: 367648 - DNA, 18 bp, Homo sapiens
gtgtacagtatgtgtcta

SEQ ID NO: 367649 - DNA, 20 bp, Homo sapiens
gtgtacgtggagagggatga

SEQ ID NO: 367650 - DNA, 14 bp, Homo sapiens
gtgtactgctttca

SEQ ID NO: 367651 - DNA, 20 bp, Homo sapiens
gtgtactgggttaatggcta

SEQ ID NO: 367652 - DNA, 15 bp, Homo sapiens
gtgtacttaactatt

SEQ ID NO: 367653 - DNA, 18 bp, Homo sapiens
gtgtagatgtagcattgt

SEQ ID NO: 367654 - DNA, 15 bp, Homo sapiens
gtgtagccccaagaa

SEQ ID NO: 367655 - DNA, 22 bp, Homo sapiens
gtgtagcgtcctgaggaataaa

SEQ ID NO: 367656 - DNA, 14 bp, Homo sapiens
gtgtagctgtcctc

SEQ ID NO: 367657 - DNA, 18 bp, Homo sapiens
gtgtagggagatggagaa

SEQ ID NO: 367658 - DNA, 19 bp, Homo sapiens
gtgtagtggaagagcagcc

SEQ ID NO: 367659 - DNA, 21 bp, Homo sapiens
gtgtagtggaagagcagcctg

SEQ ID NO: 367660 - DNA, 14 bp, Homo sapiens
gtgtataaaaataa

SEQ ID NO: 367661 - DNA, 17 bp, Homo sapiens
gtgtatatcatgaagcc

SEQ ID NO: 367662 - DNA, 21 bp, Homo sapiens
gtgtatatcatgaagccttgc

SEQ ID NO: 367663 - DNA, 14 bp, Homo sapiens
gtgtatatccttcc

SEQ ID NO: 367664 - DNA, 23 bp, Homo sapiens
gtgtatcaccctcagctggcgga

SEQ ID NO: 367665 - DNA, 14 bp, Homo sapiens
gtgtatcctggggc

SEQ ID NO: 367666 - DNA, 15 bp, Homo sapiens
gtgtatgactaaaga

SEQ ID NO: 367667 - DNA, 17 bp, Homo sapiens
gtgtatgtacatatata

SEQ ID NO: 367668 - DNA, 19 bp, Homo sapiens
gtgtatgtgtttataattg

SEQ ID NO: 367669 - DNA, 14 bp, Homo sapiens
gtgtattcaggacc

SEQ ID NO: 367670 - DNA, 12 bp, Homo sapiens
gtgtattctgtg

SEQ ID NO: 367671 - DNA, 17 bp, Homo sapiens
gttattttcagtatttt

SEQ ID NO: 367672 - DNA, 16 bp, Homo sapiens
gttatttttatatcag

SEQ ID NO: 367673 - DNA, 23 bp, Homo sapiens
gttatttttatatcagcctgagt

SEQ ID NO: 367674 - DNA, 13 bp, Homo sapiens
gttcaaaatgtct

SEQ ID NO: 367675 - DNA, 17 bp, Homo sapiens
gttcaaactactgtaca

SEQ ID NO: 367676 - DNA, 18 bp, Homo sapiens
gttcaaactactgtacat

SEQ ID NO: 367677 - DNA, 12 bp, Homo sapiens
gttcaaagaacc

SEQ ID NO: 367678 - DNA, 22 bp, Homo sapiens
gttcaaagaacccccctcccca

SEQ ID NO: 367679 - DNA, 11 bp, Homo sapiens
gttcaaagtac

SEQ ID NO: 367680 - DNA, 20 bp, Homo sapiens
gttcaataaacttaacttta

SEQ ID NO: 367681 - DNA, 17 bp, Homo sapiens
gttcaatgatctaggtt

SEQ ID NO: 367682 - DNA, 20 bp, Homo sapiens
gttcaatgatctaggtttaa

SEQ ID NO: 367683 - DNA, 18 bp, Homo sapiens
gttcaattgtgtctgtgg

SEQ ID NO: 367684 - DNA, 16 bp, Homo sapiens
gttcacaccctgcaag

SEQ ID NO: 367685 - DNA, 19 bp, Homo sapiens
gttcacaccctgcaaggcc

SEQ ID NO: 367686 - DNA, 19 bp, Homo sapiens
gttcacgccattctcctgc

SEQ ID NO: 367687 - DNA, 20 bp, Homo sapiens
gttcacgccattctcctgcc

SEQ ID NO: 367688 - DNA, 18 bp, Homo sapiens
gttcacgtcactgccaga

SEQ ID NO: 367689 - DNA, 15 bp, Homo sapiens
gttcactaaagcagt

SEQ ID NO: 367690 - DNA, 24 bp, Homo sapiens
gttcactctacttagcatgtccct

SEQ ID NO: 367691 - DNA, 13 bp, Homo sapiens
gttcacttcccct

SEQ ID NO: 367692 - DNA, 13 bp, Homo sapiens
gttcacttcctag

SEQ ID NO: 367693 - DNA, 17 bp, Homo sapiens
gttcagacccctgcctg

SEQ ID NO: 367694 - DNA, 17 bp, Homo sapiens
gttcagagttccacagt

SEQ ID NO: 367695 - DNA, 17 bp, Homo sapiens
gttcagatgtgcatttc

SEQ ID NO: 367696 - DNA, 15 bp, Homo sapiens
gttcagcactgtccc

SEQ ID NO: 367697 - DNA, 17 bp, Homo sapiens
gttcagggaactgcttg

SEQ ID NO: 367698 - DNA, 17 bp, Homo sapiens
gttcagggaggggctga

SEQ ID NO: 367699 - DNA, 16 bp, Homo sapiens
gttcaggtcagggcta

SEQ ID NO: 367700 - DNA, 16 bp, Homo sapiens
gttcatagtttctgta

SEQ ID NO: 367701 - DNA, 17 bp, Homo sapiens
gttcatagtttctgtaa

SEQ ID NO: 367702 - DNA, 12 bp, Homo sapiens
gttcatcagtgt

SEQ ID NO: 367703 - DNA, 14 bp, Homo sapiens
gttcatcagtgtta

SEQ ID NO: 367704 - DNA, 18 bp, Homo sapiens
gttcatccaatcctcact

SEQ ID NO: 367705 - DNA, 18 bp, Homo sapiens
gttcatcctattgttgat

SEQ ID NO: 367706 - DNA, 14 bp, Homo sapiens
gttcatctctgctg

SEQ ID NO: 367707 - DNA, 14 bp, Homo sapiens
gttcatctgaggag

SEQ ID NO: 367708 - DNA, 18 bp, Homo sapiens
gttcatcttgaattgtaa

SEQ ID NO: 367709 - DNA, 16 bp, Homo sapiens
gttcatgccaccatgg

SEQ ID NO: 367710 - DNA, 19 bp, Homo sapiens
gttcatgggcacctcatgg

SEQ ID NO: 367711 - DNA, 15 bp, Homo sapiens
gttcatgtttgtaaa

SEQ ID NO: 367712 - DNA, 16 bp, Homo sapiens
gttcatgttttgctaa

SEQ ID NO: 367713 - DNA, 18 bp, Homo sapiens
gttcattaaacgtcattc

SEQ ID NO: 367714 - DNA, 20 bp, Homo sapiens
gttcattaaacgtcattcag

SEQ ID NO: 367715 - DNA, 15 bp, Homo sapiens
gttcattattggaat

SEQ ID NO: 367716 - DNA, 18 bp, Homo sapiens
gttcattattttgtggtt

SEQ ID NO: 367717 - DNA, 19 bp, Homo sapiens
gttcattgtaatgttactg

SEQ ID NO: 367718 - DNA, 23 bp, Homo sapiens
gttcattgtaatgttactgatca

SEQ ID NO: 367719 - DNA, 13 bp, Homo sapiens
gttcatttctgtc

SEQ ID NO: 367720 - DNA, 13 bp, Homo sapiens
gttcattttagtg

SEQ ID NO: 367721 - DNA, 19 bp, Homo sapiens
gttccaagacattgtcaat

SEQ ID NO: 367722 - DNA, 14 bp, Homo sapiens
gttccaagtgtgtg

SEQ ID NO: 367723 - DNA, 17 bp, Homo sapiens
gttccaagtgtgtgtgc

SEQ ID NO: 367724 - DNA, 20 bp, Homo sapiens
gttccacgtccccctggggc

SEQ ID NO: 367725 - DNA, 20 bp, Homo sapiens
gttccacttaacacatgaat

SEQ ID NO: 367726 - DNA, 24 bp, Homo sapiens
gttccagaacagccctcggcctcc

SEQ ID NO: 367727 - DNA, 10 bp, Homo sapiens
gttccagaca

SEQ ID NO: 367728 - DNA, 15 bp, Homo sapiens
gttccagacagagtg

SEQ ID NO: 367729 - DNA, 14 bp, Homo sapiens
gttccagctctttg

SEQ ID NO: 367730 - DNA, 16 bp, Homo sapiens
gttccagctgttgtga

SEQ ID NO: 367731 - DNA, 16 bp, Homo sapiens
gttccaggctgtgtgt

SEQ ID NO: 367732 - DNA, 13 bp, Homo sapiens
gttccatccacca

SEQ ID NO: 367733 - DNA, 16 bp, Homo sapiens
gttccatccaccacct

SEQ ID NO: 367734 - DNA, 17 bp, Homo sapiens
gttccatgcctgagggt

SEQ ID NO: 367735 - DNA, 16 bp, Homo sapiens
gttcccaataaaagtg

SEQ ID NO: 367736 - DNA, 22 bp, Homo sapiens
gttcccagtgacacttcagaga

SEQ ID NO: 367737 - DNA, 13 bp, Homo sapiens
gttcccccagccc

SEQ ID NO: 367738 - DNA, 20 bp, Homo sapiens
gttcccccaggaccctgagg

SEQ ID NO: 367739 - DNA, 19 bp, Homo sapiens
gttcccccagtacctccaa

SEQ ID NO: 367740 - DNA, 17 bp, Homo sapiens
gttcccctcacccaaaa

SEQ ID NO: 367741 - DNA, 20 bp, Homo sapiens
gttcccggagcacagccctg

SEQ ID NO: 367742 - DNA, 20 bp, Homo sapiens
gttccctacttcctgtgact

SEQ ID NO: 367743 - DNA, 18 bp, Homo sapiens
gttccctcagtgtgaagc

SEQ ID NO: 367744 - DNA, 15 bp, Homo sapiens
gttccctctttcctg

SEQ ID NO: 367745 - DNA, 20 bp, Homo sapiens
gttccctctttcctgtgcca

SEQ ID NO: 367746 - DNA, 12 bp, Homo sapiens
gttccctgcacc

SEQ ID NO: 367747 - DNA, 14 bp, Homo sapiens
gttccctgcaccct

SEQ ID NO: 367748 - DNA, 15 bp, Homo sapiens
gttcccttggcctca

SEQ ID NO: 367749 - DNA, 16 bp, Homo sapiens
gttcccttggcctcag

SEQ ID NO: 367750 - DNA, 19 bp, Homo sapiens
gttcccttggcctcagaat

SEQ ID NO: 367751 - DNA, 19 bp, Homo sapiens
gttccctttccttccatcc

SEQ ID NO: 367752 - DNA, 18 bp, Homo sapiens
gttccctttgctccaccc

SEQ ID NO: 367753 - DNA, 23 bp, Homo sapiens
gttccgttcatctgaggagtcca

SEQ ID NO: 367754 - DNA, 13 bp, Homo sapiens
gttcctcaccaat

SEQ ID NO: 367755 - DNA, 15 bp, Homo sapiens
gttcctcaccaataa

SEQ ID NO: 367756 - DNA, 17 bp, Homo sapiens
gttcctcaccaataact

SEQ ID NO: 367757 - DNA, 18 bp, Homo sapiens
gttcctcaccaataactt

SEQ ID NO: 367758 - DNA, 17 bp, Homo sapiens
gttcctcatccatgcag

SEQ ID NO: 367759 - DNA, 12 bp, Homo sapiens
gttcctcatggc

SEQ ID NO: 367760 - DNA, 11 bp, Homo sapiens
gttcctccagc

SEQ ID NO: 367761 - DNA, 14 bp, Homo sapiens
gttcctctttgcat

SEQ ID NO: 367762 - DNA, 23 bp, Homo sapiens
gttcctgatagctacccacagag

SEQ ID NO: 367763 - DNA, 17 bp, Homo sapiens
gttcctgcagcagagcc

SEQ ID NO: 367764 - DNA, 18 bp, Homo sapiens
gttcctgcagcagagcct

SEQ ID NO: 367765 - DNA, 9 bp, Homo sapiens
gttcctgcc

SEQ ID NO: 367766 - DNA, 20 bp, Homo sapiens
gttcctgcccccgccctgct

SEQ ID NO: 367767 - DNA, 22 bp, Homo sapiens
gttcctgcccccgccctgctgt

SEQ ID NO: 367768 - DNA, 18 bp, Homo sapiens
gttcctgccttctcttct

SEQ ID NO: 367769 - DNA, 23 bp, Homo sapiens
gttcctgctccatgactggctgt

SEQ ID NO: 367770 - DNA, 21 bp, Homo sapiens
gttcctgctttctctttcagt

SEQ ID NO: 367771 - DNA, 21 bp, Homo sapiens
gttcctggcaatagtgtgttc

SEQ ID NO: 367772 - DNA, 15 bp, Homo sapiens
gttcctggcctcagc

SEQ ID NO: 367773 - DNA, 22 bp, Homo sapiens
gttcctggccttctgaactcca

SEQ ID NO: 367774 - DNA, 16 bp, Homo sapiens
gttcctggctcagcct

SEQ ID NO: 367775 - DNA, 22 bp, Homo sapiens
gttcctgttctcagcatccact

SEQ ID NO: 367776 - DNA, 14 bp, Homo sapiens
gttccttccctggg

SEQ ID NO: 367777 - DNA, 19 bp, Homo sapiens
gttccttgctagccctggg

SEQ ID NO: 367778 - DNA, 19 bp, Homo sapiens
gttcctttgttaaatttag

SEQ ID NO: 367779 - DNA, 16 bp, Homo sapiens
gttcgatttaagccat

SEQ ID NO: 367780 - DNA, 19 bp, Homo sapiens
gttcgccgtctggcgagcc

SEQ ID NO: 367781 - DNA, 23 bp, Homo sapiens
gttcgttcttgttctgttttgtt

SEQ ID NO: 367782 - DNA, 17 bp, Homo sapiens
gttctaaagatggaaaa

SEQ ID NO: 367783 - DNA, 14 bp, Homo sapiens
gttctaatgctgca

SEQ ID NO: 367784 - DNA, 20 bp, Homo sapiens
gttctacaatctatttattg

SEQ ID NO: 367785 - DNA, 16 bp, Homo sapiens
gttctacactcatctt

SEQ ID NO: 367786 - DNA, 18 bp, Homo sapiens
gttctacttgatatttcc

SEQ ID NO: 367787 - DNA, 21 bp, Homo sapiens
gttctagaaggggcgaggctt

SEQ ID NO: 367788 - DNA, 23 bp, Homo sapiens
gttctagtctcctttgcactgag

SEQ ID NO: 367789 - DNA, 17 bp, Homo sapiens
gttctatttatttattg

SEQ ID NO: 367790 - DNA, 17 bp, Homo sapiens
gttctatttctatctgc

SEQ ID NO: 367791 - DNA, 16 bp, Homo sapiens
gttctcaatgcttttc

SEQ ID NO: 367792 - DNA, 16 bp, Homo sapiens
gttctcactatgtttc

SEQ ID NO: 367793 - DNA, 12 bp, Homo sapiens
gttctcactgtt

SEQ ID NO: 367794 - DNA, 16 bp, Homo sapiens
gttctcactgttccct

SEQ ID NO: 367795 - DNA, 12 bp, Homo sapiens
gttctcagagcc

SEQ ID NO: 367796 - DNA, 13 bp, Homo sapiens
gttctcagagctc

SEQ ID NO: 367797 - DNA, 14 bp, Homo sapiens
gttctcagagctcc

SEQ ID NO: 367798 - DNA, 20 bp, Homo sapiens
gttctcagagctccacagaa

SEQ ID NO: 367799 - DNA, 10 bp, Homo sapiens
gttctcagca

SEQ ID NO: 367800 - DNA, 16 bp, Homo sapiens
gttctcagcaagtgta

SEQ ID NO: 367801 - DNA, 17 bp, Homo sapiens
gttctcagcaagtgtac

SEQ ID NO: 367802 - DNA, 19 bp, Homo sapiens
gttggagccactctgttcc

SEQ ID NO: 367803 - DNA, 12 bp, Homo sapiens
gttggagcctgc

SEQ ID NO: 367804 - DNA, 19 bp, Homo sapiens
gttggagcctgcagggtgg

SEQ ID NO: 367805 - DNA, 20 bp, Homo sapiens
gttggaggcctcaccctgct

SEQ ID NO: 367806 - DNA, 15 bp, Homo sapiens
gttggatgggagtgg

SEQ ID NO: 367807 - DNA, 18 bp, Homo sapiens
gttggatgggagtgggca

SEQ ID NO: 367808 - DNA, 15 bp, Homo sapiens
gttggcaccccagct

SEQ ID NO: 367809 - DNA, 13 bp, Homo sapiens
gttggcagagaag

SEQ ID NO: 367810 - DNA, 20 bp, Homo sapiens
gttggcagagaaggcctctt

SEQ ID NO: 367811 - DNA, 14 bp, Homo sapiens
gttggccaggctgg

SEQ ID NO: 367812 - DNA, 14 bp, Homo sapiens
gttggctgctgcca

SEQ ID NO: 367813 - DNA, 14 bp, Homo sapiens
gttggctggatgaa

SEQ ID NO: 367814 - DNA, 12 bp, Homo sapiens
gttggctggggg

SEQ ID NO: 367815 - DNA, 12 bp, Homo sapiens
gttggctgggta

SEQ ID NO: 367816 - DNA, 13 bp, Homo sapiens
gttggctgttcca

SEQ ID NO: 367817 - DNA, 15 bp, Homo sapiens
gttgggagcactgga

SEQ ID NO: 367818 - DNA, 16 bp, Homo sapiens
gttgggagcactggag

SEQ ID NO: 367819 - DNA, 16 bp, Homo sapiens
gttgggagcctgaaat

SEQ ID NO: 367820 - DNA, 13 bp, Homo sapiens
gttgggagctgat

SEQ ID NO: 367821 - DNA, 14 bp, Homo sapiens
gttggggaaggcaa

SEQ ID NO: 367822 - DNA, 23 bp, Homo sapiens
gttggggtggtttttgagccatg

SEQ ID NO: 367823 - DNA, 19 bp, Homo sapiens
gttgggtctgaaaggaaaa

SEQ ID NO: 367824 - DNA, 13 bp, Homo sapiens
gttggtagtttct

SEQ ID NO: 367825 - DNA, 13 bp, Homo sapiens
gttggtgccactt

SEQ ID NO: 367826 - DNA, 12 bp, Homo sapiens
gttggtggcagt

SEQ ID NO: 367827 - DNA, 19 bp, Homo sapiens
gttggtggcagtgacttct

SEQ ID NO: 367828 - DNA, 15 bp, Homo sapiens
gttggttctgcacta

SEQ ID NO: 367829 - DNA, 15 bp, Homo sapiens
gttgtaccactgcta

SEQ ID NO: 367830 - DNA, 16 bp, Homo sapiens
gttgtagatacaatca

SEQ ID NO: 367831 - DNA, 18 bp, Homo sapiens
gttgtagatacaatcagc

SEQ ID NO: 367832 - DNA, 21 bp, Homo sapiens
gttgtagatacaatcagctgc

SEQ ID NO: 367833 - DNA, 19 bp, Homo sapiens
gttgtattcctgcctttga

SEQ ID NO: 367834 - DNA, 21 bp, Homo sapiens
gttgtatttctatatttattt

SEQ ID NO: 367835 - DNA, 15 bp, Homo sapiens
gttgtcaatattaaa

SEQ ID NO: 367836 - DNA, 16 bp, Homo sapiens
gttgtcaatattaaat

SEQ ID NO: 367837 - DNA, 17 bp, Homo sapiens
gttgtcaatattaaata

SEQ ID NO: 367838 - DNA, 23 bp, Homo sapiens
gttgtcaatattaaatacagaca

SEQ ID NO: 367839 - DNA, 12 bp, Homo sapiens
gttgtccaggaa

SEQ ID NO: 367840 - DNA, 19 bp, Homo sapiens
gttgtctgaagtcactgca

SEQ ID NO: 367841 - DNA, 20 bp, Homo sapiens
gttgtgattccccggagctg

SEQ ID NO: 367842 - DNA, 23 bp, Homo sapiens
gttgtgcctttcacagcttcttt

SEQ ID NO: 367843 - DNA, 21 bp, Homo sapiens
gttgtggcccccgccccctcc

SEQ ID NO: 367844 - DNA, 15 bp, Homo sapiens
gttgtgtaagagaat

SEQ ID NO: 367845 - DNA, 16 bp, Homo sapiens
gttgtgtacgtggaga

SEQ ID NO: 367846 - DNA, 19 bp, Homo sapiens
gttgttaatactgtattgc

SEQ ID NO: 367847 - DNA, 18 bp, Homo sapiens
gttgttaatgaaaatgtc

SEQ ID NO: 367848 - DNA, 15 bp, Homo sapiens
gttgttagtgatttg

SEQ ID NO: 367849 - DNA, 19 bp, Homo sapiens
gttgttatcatttaagatt

SEQ ID NO: 367850 - DNA, 22 bp, Homo sapiens
gttgttgccaactaagccctcg

SEQ ID NO: 367851 - DNA, 14 bp, Homo sapiens
gttgttgccaggtt

SEQ ID NO: 367852 - DNA, 18 bp, Homo sapiens
gttgttgccaggttgcag

SEQ ID NO: 367853 - DNA, 12 bp, Homo sapiens
gttgttgttgtt

SEQ ID NO: 367854 - DNA, 13 bp, Homo sapiens
gttgtttctctga

SEQ ID NO: 367855 - DNA, 13 bp, Homo sapiens
gttgtttgaaaat

SEQ ID NO: 367856 - DNA, 15 bp, Homo sapiens
gttgtttgatgtgta

SEQ ID NO: 367857 - DNA, 14 bp, Homo sapiens
gttgtttgctgttt

SEQ ID NO: 367858 - DNA, 14 bp, Homo sapiens
gttgttttttcata

SEQ ID NO: 367859 - DNA, 18 bp, Homo sapiens
gttgttttttcatagtgc

SEQ ID NO: 367860 - DNA, 16 bp, Homo sapiens
gtttaaaaagtttcac

SEQ ID NO: 367861 - DNA, 16 bp, Homo sapiens
gtttaaagagaggtta

SEQ ID NO: 367862 - DNA, 15 bp, Homo sapiens
gtttaaataaagacc

SEQ ID NO: 367863 - DNA, 14 bp, Homo sapiens
gtttaaataaagta

SEQ ID NO: 367864 - DNA, 20 bp, Homo sapiens
gtttaaataccagtacttga

SEQ ID NO: 367865 - DNA, 16 bp, Homo sapiens
gtttaacaaatctaat

SEQ ID NO: 367866 - DNA, 15 bp, Homo sapiens
gtttaatattgagaa

SEQ ID NO: 367867 - DNA, 18 bp, Homo sapiens
gtttacaacaaacactgt

SEQ ID NO: 367868 - DNA, 19 bp, Homo sapiens
gtttacaagtgtatatcag

SEQ ID NO: 367869 - DNA, 13 bp, Homo sapiens
gtttacagaaaaa

SEQ ID NO: 367870 - DNA, 18 bp, Homo sapiens
gtttacagaaaaatcttg

SEQ ID NO: 367871 - DNA, 13 bp, Homo sapiens
gtttacagtaaat

SEQ ID NO: 367872 - DNA, 15 bp, Homo sapiens
gtttacagtaaataa

SEQ ID NO: 367873 - DNA, 15 bp, Homo sapiens
gtttaccctccctgt

SEQ ID NO: 367874 - DNA, 12 bp, Homo sapiens
gtttactctgtg

SEQ ID NO: 367875 - DNA, 14 bp, Homo sapiens
gtttactgctgtca

SEQ ID NO: 367876 - DNA, 21 bp, Homo sapiens
gtttagaatcaagtctgtgaa

SEQ ID NO: 367877 - DNA, 20 bp, Homo sapiens
gtttagcaggctgcagcagg

SEQ ID NO: 367878 - DNA, 16 bp, Homo sapiens
gtttagggattgggtc

SEQ ID NO: 367879 - DNA, 18 bp, Homo sapiens
gtttagtagctgataaag

SEQ ID NO: 367880 - DNA, 18 bp, Homo sapiens
gtttatacagttttaaag

SEQ ID NO: 367881 - DNA, 20 bp, Homo sapiens
gtttatacagttttaaagaa

SEQ ID NO: 367882 - DNA, 20 bp, Homo sapiens
gtttatagcaaacttggaat

SEQ ID NO: 367883 - DNA, 19 bp, Homo sapiens
gtttatatatatgctactt

SEQ ID NO: 367884 - DNA, 14 bp, Homo sapiens
gtttatatgtcttg

SEQ ID NO: 367885 - DNA, 19 bp, Homo sapiens
gtttatgagaactggttct

SEQ ID NO: 367886 - DNA, 21 bp, Homo sapiens
gtttatgataataaaggcacc

SEQ ID NO: 367887 - DNA, 15 bp, Homo sapiens
gtttatgcagtgctg

SEQ ID NO: 367888 - DNA, 17 bp, Homo sapiens
gtttatgcagtgctgct

SEQ ID NO: 367889 - DNA, 13 bp, Homo sapiens
gtttatggcctca

SEQ ID NO: 367890 - DNA, 13 bp, Homo sapiens
gtttatgtctaaa

SEQ ID NO: 367891 - DNA, 18 bp, Homo sapiens
gtttatttttatatagct

SEQ ID NO: 367892 - DNA, 14 bp, Homo sapiens
gtttatttttcata

SEQ ID NO: 367893 - DNA, 22 bp, Homo sapiens
gtttcaatttactttttaaaca

SEQ ID NO: 367894 - DNA, 15 bp, Homo sapiens
gtttcacatatttgt

SEQ ID NO: 367895 - DNA, 17 bp, Homo sapiens
gtttcactattcctatg

SEQ ID NO: 367896 - DNA, 15 bp, Homo sapiens
gtttcactgttcatg

SEQ ID NO: 367897 - DNA, 17 bp, Homo sapiens
gtttcagatatatatca

SEQ ID NO: 367898 - DNA, 13 bp, Homo sapiens
gtttcaggacagc

SEQ ID NO: 367899 - DNA, 17 bp, Homo sapiens
gtttcaggtggaacagg

SEQ ID NO: 367900 - DNA, 18 bp, Homo sapiens
gtttcagtaataaaacat

SEQ ID NO: 367901 - DNA, 18 bp, Homo sapiens
gtttcagtaatagctgaa

SEQ ID NO: 367902 - DNA, 12 bp, Homo sapiens
gtttcagtttga

SEQ ID NO: 367903 - DNA, 17 bp, Homo sapiens
gtttcatattctcagat

SEQ ID NO: 367904 - DNA, 19 bp, Homo sapiens
gtttcatgttttgtgacta

SEQ ID NO: 367905 - DNA, 16 bp, Homo sapiens
gtttccaagcctgggc

SEQ ID NO: 367906 - DNA, 14 bp, Homo sapiens
gtttccacatgctc

SEQ ID NO: 367907 - DNA, 17 bp, Homo sapiens
gtttccagaaattcttc

SEQ ID NO: 367908 - DNA, 19 bp, Homo sapiens
gtttccagctaagcctgat

SEQ ID NO: 367909 - DNA, 22 bp, Homo sapiens
gtttccagctaagcctgatgat

SEQ ID NO: 367910 - DNA, 14 bp, Homo sapiens
gtttccagctgcca

SEQ ID NO: 367911 - DNA, 19 bp, Homo sapiens
gtttccaggcatgaccctg

SEQ ID NO: 367912 - DNA, 22 bp, Homo sapiens
gtttccaggcatgaccctggag

SEQ ID NO: 367913 - DNA, 17 bp, Homo sapiens
gtttccatcatttctgt

SEQ ID NO: 367914 - DNA, 13 bp, Homo sapiens
gtttcccataatt

SEQ ID NO: 367915 - DNA, 20 bp, Homo sapiens
gtttcccataattttcttca

SEQ ID NO: 367916 - DNA, 15 bp, Homo sapiens
gtttccctgctggcc

SEQ ID NO: 367917 - DNA, 18 bp, Homo sapiens
gtttcctcaggctgctgg

SEQ ID NO: 367918 - DNA, 19 bp, Homo sapiens
gtttcctcaggctgctgga

SEQ ID NO: 367919 - DNA, 21 bp, Homo sapiens
gtttcctgtgcccatcatctc

SEQ ID NO: 367920 - DNA, 16 bp, Homo sapiens
gtttcggggtgaagca

SEQ ID NO: 367921 - DNA, 18 bp, Homo sapiens
gtttctaatttgctgctg

SEQ ID NO: 367922 - DNA, 14 bp, Homo sapiens
gtttctacattctc

SEQ ID NO: 367923 - DNA, 16 bp, Homo sapiens
gtttctagaggcctca

SEQ ID NO: 367924 - DNA, 18 bp, Homo sapiens
gtttctagaggcctcagt

SEQ ID NO: 367925 - DNA, 22 bp, Homo sapiens
gtttctatactgtttgtaatat

SEQ ID NO: 367926 - DNA, 22 bp, Homo sapiens
gtttctatggattcacttctat

SEQ ID NO: 367927 - DNA, 22 bp, Homo sapiens
gtttctcaagcgctatccacag

SEQ ID NO: 367928 - DNA, 18 bp, Homo sapiens
gtttctcagactggtctc

SEQ ID NO: 367929 - DNA, 12 bp, Homo sapiens
gtttctctgctg

SEQ ID NO: 367930 - DNA, 13 bp, Homo sapiens
gtttctctgctgt

SEQ ID NO: 367931 - DNA, 14 bp, Homo sapiens
gtttctctgtgctc

SEQ ID NO: 367932 - DNA, 16 bp, Homo sapiens
gtttctgaaaattcca

SEQ ID NO: 367933 - DNA, 20 bp, Homo sapiens
gtttctgaaagaatcatttg

SEQ ID NO: 367934 - DNA, 16 bp, Homo sapiens
taccccctaagagcca

SEQ ID NO: 367935 - DNA, 19 bp, Homo sapiens
tacccccttgtctgctgct

SEQ ID NO: 367936 - DNA, 20 bp, Homo sapiens
tacccctgctcccattcctc

SEQ ID NO: 367937 - DNA, 18 bp, Homo sapiens
taccccttacttagcatg

SEQ ID NO: 367938 - DNA, 16 bp, Homo sapiens
tacccgagcccagcta

SEQ ID NO: 367939 - DNA, 19 bp, Homo sapiens
tacccgagcccagctacat

SEQ ID NO: 367940 - DNA, 21 bp, Homo sapiens
tacccgagcccagctacattc

SEQ ID NO: 367941 - DNA, 15 bp, Homo sapiens
taccctactggctgt

SEQ ID NO: 367942 - DNA, 21 bp, Homo sapiens
taccctaggtctccacccctc

SEQ ID NO: 367943 - DNA, 21 bp, Homo sapiens
taccctcaggcataggcctgg

SEQ ID NO: 367944 - DNA, 14 bp, Homo sapiens
taccctcccaccag

SEQ ID NO: 367945 - DNA, 11 bp, Homo sapiens
taccctccccc

SEQ ID NO: 367946 - DNA, 15 bp, Homo sapiens
taccctccctgtccc

SEQ ID NO: 367947 - DNA, 17 bp, Homo sapiens
taccctccctgtcccct

SEQ ID NO: 367948 - DNA, 18 bp, Homo sapiens
taccctcctttttttccc

SEQ ID NO: 367949 - DNA, 16 bp, Homo sapiens
taccctctaaaaaaga

SEQ ID NO: 367950 - DNA, 19 bp, Homo sapiens
taccctcttctcagctcca

SEQ ID NO: 367951 - DNA, 18 bp, Homo sapiens
taccctggcagagaagag

SEQ ID NO: 367952 - DNA, 14 bp, Homo sapiens
tacccttccacctc

SEQ ID NO: 367953 - DNA, 20 bp, Homo sapiens
tacccttccacctcctagag

SEQ ID NO: 367954 - DNA, 18 bp, Homo sapiens
tacccttctgtgcccagc

SEQ ID NO: 367955 - DNA, 19 bp, Homo sapiens
tacccttctgtgcccagct

SEQ ID NO: 367956 - DNA, 21 bp, Homo sapiens
tacccttctgtgcccagctca

SEQ ID NO: 367957 - DNA, 23 bp, Homo sapiens
tacccttgagacctggaaccaga

SEQ ID NO: 367958 - DNA, 14 bp, Homo sapiens
tacccttgccaagg

SEQ ID NO: 367959 - DNA, 21 bp, Homo sapiens
tacccttgtgagagcccattc

SEQ ID NO: 367960 - DNA, 17 bp, Homo sapiens
taccctttatagaacat

SEQ ID NO: 367961 - DNA, 13 bp, Homo sapiens
taccgagtatctg

SEQ ID NO: 367962 - DNA, 13 bp, Homo sapiens
taccgatggtccc

SEQ ID NO: 367963 - DNA, 17 bp, Homo sapiens
taccgccctgggctgga

SEQ ID NO: 367964 - DNA, 18 bp, Homo sapiens
taccgggttctcctgatt

SEQ ID NO: 367965 - DNA, 14 bp, Homo sapiens
taccgtagcctccg

SEQ ID NO: 367966 - DNA, 18 bp, Homo sapiens
taccgtttggtgtctgat

SEQ ID NO: 367967 - DNA, 22 bp, Homo sapiens
tacctaaacagatataaatggc

SEQ ID NO: 367968 - DNA, 15 bp, Homo sapiens
tacctaacattattt

SEQ ID NO: 367969 - DNA, 15 bp, Homo sapiens
tacctacaaaatgag

SEQ ID NO: 367970 - DNA, 16 bp, Homo sapiens
tacctaccacagtgtc

SEQ ID NO: 367971 - DNA, 20 bp, Homo sapiens
tacctaccccagttcatctc

SEQ ID NO: 367972 - DNA, 15 bp, Homo sapiens
tacctactgagtagg

SEQ ID NO: 367973 - DNA, 13 bp, Homo sapiens
tacctagatttac

SEQ ID NO: 367974 - DNA, 13 bp, Homo sapiens
tacctataaatgg

SEQ ID NO: 367975 - DNA, 16 bp, Homo sapiens
tacctataaatggact

SEQ ID NO: 367976 - DNA, 17 bp, Homo sapiens
tacctataaatggactt

SEQ ID NO: 367977 - DNA, 20 bp, Homo sapiens
tacctcactggtgcatttaa

SEQ ID NO: 367978 - DNA, 13 bp, Homo sapiens
tacctcccacctt

SEQ ID NO: 367979 - DNA, 16 bp, Homo sapiens
tacctcccacctttgg

SEQ ID NO: 367980 - DNA, 11 bp, Homo sapiens
tacctcctcct

SEQ ID NO: 367981 - DNA, 19 bp, Homo sapiens
tacctctaacaccacactg

SEQ ID NO: 367982 - DNA, 22 bp, Homo sapiens
tacctctaacaccacactgacc

SEQ ID NO: 367983 - DNA, 20 bp, Homo sapiens
tacctctctctatatataca

SEQ ID NO: 367984 - DNA, 17 bp, Homo sapiens
tacctctcttatagaat

SEQ ID NO: 367985 - DNA, 18 bp, Homo sapiens
tacctctgcataaatatt

SEQ ID NO: 367986 - DNA, 12 bp, Homo sapiens
tacctctggctc

SEQ ID NO: 367987 - DNA, 21 bp, Homo sapiens
tacctgaacacttattgcttt

SEQ ID NO: 367988 - DNA, 13 bp, Homo sapiens
tacctgaagtctt

SEQ ID NO: 367989 - DNA, 16 bp, Homo sapiens
tacctgaagtctttgt

SEQ ID NO: 367990 - DNA, 22 bp, Homo sapiens
tacctggcttagcgttctgttt

SEQ ID NO: 367991 - DNA, 17 bp, Homo sapiens
tacctgggaaatttgcc

SEQ ID NO: 367992 - DNA, 19 bp, Homo sapiens
tacctgtacactgacttga

SEQ ID NO: 367993 - DNA, 13 bp, Homo sapiens
tacctgtaggaaa

SEQ ID NO: 367994 - DNA, 14 bp, Homo sapiens
tacctgtaggaaac

SEQ ID NO: 367995 - DNA, 18 bp, Homo sapiens
tacctgtaggaaacagaa

SEQ ID NO: 367996 - DNA, 22 bp, Homo sapiens
tacctgtgaatcatatgttgta

SEQ ID NO: 367997 - DNA, 21 bp, Homo sapiens
tacctgtgagcatccttccca

SEQ ID NO: 367998 - DNA, 21 bp, Homo sapiens
taccttaattctttgtttcct

SEQ ID NO: 367999 - DNA, 15 bp, Homo sapiens
taccttcaaagctga

SEQ ID NO: 368000 - DNA, 14 bp, Homo sapiens
taccttcatttcag

SEQ ID NO: 368001 - DNA, 18 bp, Homo sapiens
taccttgagaccctcttc

SEQ ID NO: 368002 - DNA, 21 bp, Homo sapiens
taccttgagaccctcttctct

SEQ ID NO: 368003 - DNA, 23 bp, Homo sapiens
taccttgagaccctcttctctgg

SEQ ID NO: 368004 - DNA, 11 bp, Homo sapiens
tacctttaaat

SEQ ID NO: 368005 - DNA, 22 bp, Homo sapiens
tacctttaaatatcattctttg

SEQ ID NO: 368006 - DNA, 14 bp, Homo sapiens
tacctttatggttt

SEQ ID NO: 368007 - DNA, 20 bp, Homo sapiens
tacctttctgagtctcttgg

SEQ ID NO: 368008 - DNA, 22 bp, Homo sapiens
taccttttgataaaatgttcct

SEQ ID NO: 368009 - DNA, 23 bp, Homo sapiens
taccttttgataaaatgttcctt

SEQ ID NO: 368010 - DNA, 18 bp, Homo sapiens
tacctttttttctctcct

SEQ ID NO: 368011 - DNA, 18 bp, Homo sapiens
tacgaaaagaggggaaga

SEQ ID NO: 368012 - DNA, 21 bp, Homo sapiens
tacgaaaagaggggaagagac

SEQ ID NO: 368013 - DNA, 21 bp, Homo sapiens
tacgaccccagagtgactgac

SEQ ID NO: 368014 - DNA, 15 bp, Homo sapiens
tacgactttattttc

SEQ ID NO: 368015 - DNA, 22 bp, Homo sapiens
tacggcaggtggcctaaggctg

SEQ ID NO: 368016 - DNA, 23 bp, Homo sapiens
tacggcaggtggcctaaggctgc

SEQ ID NO: 368017 - DNA, 18 bp, Homo sapiens
tacgggagggtaaggctg

SEQ ID NO: 368018 - DNA, 22 bp, Homo sapiens
tacggtgatattgtgcatgcaa

SEQ ID NO: 368019 - DNA, 24 bp, Homo sapiens
tacggttccctgcctaggagctgg

SEQ ID NO: 368020 - DNA, 16 bp, Homo sapiens
tacgtcccgctgctgt

SEQ ID NO: 368021 - DNA, 14 bp, Homo sapiens
tactaaatatgaaa

SEQ ID NO: 368022 - DNA, 15 bp, Homo sapiens
tactaaccaccattt

SEQ ID NO: 368023 - DNA, 16 bp, Homo sapiens
tactaaccatttctta

SEQ ID NO: 368024 - DNA, 18 bp, Homo sapiens
tactaacctggagacagt

SEQ ID NO: 368025 - DNA, 15 bp, Homo sapiens
tactaagaaaagata

SEQ ID NO: 368026 - DNA, 22 bp, Homo sapiens
tactaagaataaataaagaaga

SEQ ID NO: 368027 - DNA, 23 bp, Homo sapiens
tactaagacatagtctctaccta

SEQ ID NO: 368028 - DNA, 19 bp, Homo sapiens
tactaaggagaattaaact

SEQ ID NO: 368029 - DNA, 17 bp, Homo sapiens
tactaatagagtactta

SEQ ID NO: 368030 - DNA, 19 bp, Homo sapiens
tactaatagagtacttaat

SEQ ID NO: 368031 - DNA, 23 bp, Homo sapiens
tactaatagagtacttaatatac

SEQ ID NO: 368032 - DNA, 13 bp, Homo sapiens
tactaatgatgtt

SEQ ID NO: 368033 - DNA, 15 bp, Homo sapiens
tactaatgatgtttt

SEQ ID NO: 368034 - DNA, 16 bp, Homo sapiens
tactaattttctagat

SEQ ID NO: 368035 - DNA, 20 bp, Homo sapiens
tactaatttttagatattca

SEQ ID NO: 368036 - DNA, 22 bp, Homo sapiens
tactaatttttagatattcatt

SEQ ID NO: 368037 - DNA, 14 bp, Homo sapiens
tactacatttgcat

SEQ ID NO: 368038 - DNA, 14 bp, Homo sapiens
tactactattctgt

SEQ ID NO: 368039 - DNA, 12 bp, Homo sapiens
tactactgcaag

SEQ ID NO: 368040 - DNA, 19 bp, Homo sapiens
tactactgtagaactgcaa

SEQ ID NO: 368041 - DNA, 16 bp, Homo sapiens
tactactttaaatcct

SEQ ID NO: 368042 - DNA, 23 bp, Homo sapiens
tactagaaagctctgcatgtgtg

SEQ ID NO: 368043 - DNA, 16 bp, Homo sapiens
tactagaagctgatct

SEQ ID NO: 368044 - DNA, 19 bp, Homo sapiens
tactagagtctgaacagct

SEQ ID NO: 368045 - DNA, 18 bp, Homo sapiens
tactaggcagttagagat

SEQ ID NO: 368046 - DNA, 16 bp, Homo sapiens
tactataaatatattg

SEQ ID NO: 368047 - DNA, 18 bp, Homo sapiens
tactatagatataactgt

SEQ ID NO: 368048 - DNA, 20 bp, Homo sapiens
tactatatctgttttactgc

SEQ ID NO: 368049 - DNA, 21 bp, Homo sapiens
tactatatgtatatctttgca

SEQ ID NO: 368050 - DNA, 16 bp, Homo sapiens
tactatggctgtattt

SEQ ID NO: 368051 - DNA, 14 bp, Homo sapiens
tactatgtgctggg

SEQ ID NO: 368052 - DNA, 13 bp, Homo sapiens
tactattattgtt

SEQ ID NO: 368053 - DNA, 18 bp, Homo sapiens
tactattcccactttcat

SEQ ID NO: 368054 - DNA, 14 bp, Homo sapiens
tactatttaactga

SEQ ID NO: 368055 - DNA, 22 bp, Homo sapiens
tactatttttattttaaaataa

SEQ ID NO: 368056 - DNA, 15 bp, Homo sapiens
tactcaccaaaatat

SEQ ID NO: 368057 - DNA, 14 bp, Homo sapiens
tactcacctcctcc

SEQ ID NO: 368058 - DNA, 13 bp, Homo sapiens
tactcagagcaga

SEQ ID NO: 368059 - DNA, 14 bp, Homo sapiens
tactcagagcagag

SEQ ID NO: 368060 - DNA, 15 bp, Homo sapiens
tactcagagcagagc

SEQ ID NO: 368061 - DNA, 17 bp, Homo sapiens
tactccactgacctgga

SEQ ID NO: 368062 - DNA, 16 bp, Homo sapiens
tactcccattaggtag

SEQ ID NO: 368063 - DNA, 10 bp, Homo sapiens
tactcccctt

SEQ ID NO: 368064 - DNA, 21 bp, Homo sapiens
tagataacattcatgagattg

SEQ ID NO: 368065 - DNA, 17 bp, Homo sapiens
tagataactgctctttt

SEQ ID NO: 368066 - DNA, 12 bp, Homo sapiens
tagatacaatca

SEQ ID NO: 368067 - DNA, 21 bp, Homo sapiens
tagatacaatcagctgctttg

SEQ ID NO: 368068 - DNA, 22 bp, Homo sapiens
tagatacaatcagctgctttgt

SEQ ID NO: 368069 - DNA, 20 bp, Homo sapiens
tagatacagatccgcatgtg

SEQ ID NO: 368070 - DNA, 16 bp, Homo sapiens
tagatacttaaaggaa

SEQ ID NO: 368071 - DNA, 16 bp, Homo sapiens
tagatatgagaaatat

SEQ ID NO: 368072 - DNA, 13 bp, Homo sapiens
tagatattgtttt

SEQ ID NO: 368073 - DNA, 22 bp, Homo sapiens
tagatcaacaataaaaaaaaac

SEQ ID NO: 368074 - DNA, 17 bp, Homo sapiens
tagatcgcttgagccca

SEQ ID NO: 368075 - DNA, 18 bp, Homo sapiens
tagatcgcttgagcccag

SEQ ID NO: 368076 - DNA, 22 bp, Homo sapiens
tagatctcctatttttcagaat

SEQ ID NO: 368077 - DNA, 12 bp, Homo sapiens
tagatctcctgt

SEQ ID NO: 368078 - DNA, 18 bp, Homo sapiens
tagatctgagccctccct

SEQ ID NO: 368079 - DNA, 13 bp, Homo sapiens
tagatcttctgaa

SEQ ID NO: 368080 - DNA, 16 bp, Homo sapiens
tagatcttctgaaatg

SEQ ID NO: 368081 - DNA, 16 bp, Homo sapiens
tagatgaactttttaa

SEQ ID NO: 368082 - DNA, 22 bp, Homo sapiens
tagatgagaattcagctgcccc

SEQ ID NO: 368083 - DNA, 17 bp, Homo sapiens
tagatgagggtgactgt

SEQ ID NO: 368084 - DNA, 22 bp, Homo sapiens
tagatgagtgggaggcgtgccc

SEQ ID NO: 368085 - DNA, 21 bp, Homo sapiens
tagatgatttctagcaggcag

SEQ ID NO: 368086 - DNA, 18 bp, Homo sapiens
tagatggagcaagtgagc

SEQ ID NO: 368087 - DNA, 13 bp, Homo sapiens
tagatggatgaat

SEQ ID NO: 368088 - DNA, 14 bp, Homo sapiens
tagatggtgaaatt

SEQ ID NO: 368089 - DNA, 15 bp, Homo sapiens
tagatggtgctgaga

SEQ ID NO: 368090 - DNA, 15 bp, Homo sapiens
tagatgtagcattgt

SEQ ID NO: 368091 - DNA, 21 bp, Homo sapiens
tagatgtattttcaataaaga

SEQ ID NO: 368092 - DNA, 18 bp, Homo sapiens
tagatgtccctttcttgg

SEQ ID NO: 368093 - DNA, 22 bp, Homo sapiens
tagatgtccctttcttggccag

SEQ ID NO: 368094 - DNA, 22 bp, Homo sapiens
tagatgtgcatttttgtgaaat

SEQ ID NO: 368095 - DNA, 22 bp, Homo sapiens
tagattagtagtaaatgcttga

SEQ ID NO: 368096 - DNA, 18 bp, Homo sapiens
tagattatattgagacaa

SEQ ID NO: 368097 - DNA, 16 bp, Homo sapiens
tagattcacctgtaaa

SEQ ID NO: 368098 - DNA, 17 bp, Homo sapiens
tagattcacctgtaaaa

SEQ ID NO: 368099 - DNA, 21 bp, Homo sapiens
tagattcacctgtaaaacttt

SEQ ID NO: 368100 - DNA, 16 bp, Homo sapiens
tagattcctacttaaa

SEQ ID NO: 368101 - DNA, 19 bp, Homo sapiens
tagattctccaaatgattt

SEQ ID NO: 368102 - DNA, 13 bp, Homo sapiens
tagatttctagaa

SEQ ID NO: 368103 - DNA, 13 bp, Homo sapiens
tagatttctttga

SEQ ID NO: 368104 - DNA, 13 bp, Homo sapiens
tagatttggaata

SEQ ID NO: 368105 - DNA, 13 bp, Homo sapiens
tagatttgttttg

SEQ ID NO: 368106 - DNA, 17 bp, Homo sapiens
tagatttttagattcct

SEQ ID NO: 368107 - DNA, 22 bp, Homo sapiens
tagcaaaacgcatggagtgtgt

SEQ ID NO: 368108 - DNA, 21 bp, Homo sapiens
tagcaaaattcttaagtatgt

SEQ ID NO: 368109 - DNA, 17 bp, Homo sapiens
tagcaacctatttgact

SEQ ID NO: 368110 - DNA, 16 bp, Homo sapiens
tagcaagaagattcta

SEQ ID NO: 368111 - DNA, 17 bp, Homo sapiens
tagcaagaagattctaa

SEQ ID NO: 368112 - DNA, 22 bp, Homo sapiens
tagcaagttgactaaacagcaa

SEQ ID NO: 368113 - DNA, 13 bp, Homo sapiens
tagcaatatttat

SEQ ID NO: 368114 - DNA, 15 bp, Homo sapiens
tagcactcacatgct

SEQ ID NO: 368115 - DNA, 17 bp, Homo sapiens
tagcactcacatgctgg

SEQ ID NO: 368116 - DNA, 20 bp, Homo sapiens
tagcactgggaactctggct

SEQ ID NO: 368117 - DNA, 14 bp, Homo sapiens
tagcagattttaat

SEQ ID NO: 368118 - DNA, 12 bp, Homo sapiens
tagcagctcagg

SEQ ID NO: 368119 - DNA, 13 bp, Homo sapiens
tagcagctcaggc

SEQ ID NO: 368120 - DNA, 15 bp, Homo sapiens
tagcagcttccagat

SEQ ID NO: 368121 - DNA, 15 bp, Homo sapiens
tagcaggcccagctg

SEQ ID NO: 368122 - DNA, 15 bp, Homo sapiens
tagcagggctgggct

SEQ ID NO: 368123 - DNA, 15 bp, Homo sapiens
tagcaggtttcacta

SEQ ID NO: 368124 - DNA, 13 bp, Homo sapiens
tagcagtcatcat

SEQ ID NO: 368125 - DNA, 16 bp, Homo sapiens
tagcagttctgcaaat

SEQ ID NO: 368126 - DNA, 15 bp, Homo sapiens
tagcagtttcactgc

SEQ ID NO: 368127 - DNA, 22 bp, Homo sapiens
tagcatactgatgagacaacac

SEQ ID NO: 368128 - DNA, 15 bp, Homo sapiens
tagcatcctgattat

SEQ ID NO: 368129 - DNA, 20 bp, Homo sapiens
tagcatcctgattattgaat

SEQ ID NO: 368130 - DNA, 22 bp, Homo sapiens
tagcatgaaaggtaatctgaaa

SEQ ID NO: 368131 - DNA, 16 bp, Homo sapiens
tagcatgacaagcccc

SEQ ID NO: 368132 - DNA, 19 bp, Homo sapiens
tagcatgaccttttggcct

SEQ ID NO: 368133 - DNA, 20 bp, Homo sapiens
tagcatgaccttttggcctt

SEQ ID NO: 368134 - DNA, 21 bp, Homo sapiens
tagcatgtaatattaaattcc

SEQ ID NO: 368135 - DNA, 22 bp, Homo sapiens
tagcatgtaatattaaattcct

SEQ ID NO: 368136 - DNA, 12 bp, Homo sapiens
tagcatgtaatg

SEQ ID NO: 368137 - DNA, 12 bp, Homo sapiens
tagcatgttcta

SEQ ID NO: 368138 - DNA, 14 bp, Homo sapiens
tagcattaaaaata

SEQ ID NO: 368139 - DNA, 15 bp, Homo sapiens
tagcattaaaaataa

SEQ ID NO: 368140 - DNA, 21 bp, Homo sapiens
tagcattaaaaataaaagttg

SEQ ID NO: 368141 - DNA, 12 bp, Homo sapiens
tagcattaacta

SEQ ID NO: 368142 - DNA, 15 bp, Homo sapiens
tagcattgttccaca

SEQ ID NO: 368143 - DNA, 16 bp, Homo sapiens
tagcattgttccacac

SEQ ID NO: 368144 - DNA, 16 bp, Homo sapiens
tagcattttcttgaac

SEQ ID NO: 368145 - DNA, 21 bp, Homo sapiens
tagccaaaagaatggctgact

SEQ ID NO: 368146 - DNA, 14 bp, Homo sapiens
tagccaatgtggga

SEQ ID NO: 368147 - DNA, 17 bp, Homo sapiens
tagccaccaccggggca

SEQ ID NO: 368148 - DNA, 12 bp, Homo sapiens
tagccactggca

SEQ ID NO: 368149 - DNA, 19 bp, Homo sapiens
tagccagagaggagcacct

SEQ ID NO: 368150 - DNA, 18 bp, Homo sapiens
tagccaggaagccccgct

SEQ ID NO: 368151 - DNA, 16 bp, Homo sapiens
tagccaggagtctgtg

SEQ ID NO: 368152 - DNA, 21 bp, Homo sapiens
tagccaggagtctgtgctctt

SEQ ID NO: 368153 - DNA, 17 bp, Homo sapiens
tagccagtcattgtaac

SEQ ID NO: 368154 - DNA, 23 bp, Homo sapiens
tagccagtgactttttctgagct

SEQ ID NO: 368155 - DNA, 15 bp, Homo sapiens
tagccatggctcagg

SEQ ID NO: 368156 - DNA, 23 bp, Homo sapiens
tagccatggctcaggcaagcccc

SEQ ID NO: 368157 - DNA, 15 bp, Homo sapiens
tagccatttgaagaa

SEQ ID NO: 368158 - DNA, 21 bp, Homo sapiens
tagcccacaataatgaataat

SEQ ID NO: 368159 - DNA, 23 bp, Homo sapiens
tagcccacacttgagaggatgaa

SEQ ID NO: 368160 - DNA, 15 bp, Homo sapiens
tagcccaccctgctg

SEQ ID NO: 368161 - DNA, 14 bp, Homo sapiens
tagcccaggtcact

SEQ ID NO: 368162 - DNA, 12 bp, Homo sapiens
tagcccagtccc

SEQ ID NO: 368163 - DNA, 19 bp, Homo sapiens
tagcccagtccctggagct

SEQ ID NO: 368164 - DNA, 18 bp, Homo sapiens
tagccccaagaaggctgg

SEQ ID NO: 368165 - DNA, 19 bp, Homo sapiens
tagccccaagaaggctggg

SEQ ID NO: 368166 - DNA, 13 bp, Homo sapiens
tagccccataatt

SEQ ID NO: 368167 - DNA, 13 bp, Homo sapiens
tagccctccccct

SEQ ID NO: 368168 - DNA, 15 bp, Homo sapiens
tagccctccccctca

SEQ ID NO: 368169 - DNA, 18 bp, Homo sapiens
tagccctctttctctctg

SEQ ID NO: 368170 - DNA, 24 bp, Homo sapiens
tagccctctttctctctgtgtggc

SEQ ID NO: 368171 - DNA, 23 bp, Homo sapiens
tagccgcgtgacggacatccagg

SEQ ID NO: 368172 - DNA, 16 bp, Homo sapiens
tagccgtccatggcac

SEQ ID NO: 368173 - DNA, 23 bp, Homo sapiens
tagcctcacggggttggctgttc

SEQ ID NO: 368174 - DNA, 19 bp, Homo sapiens
tagcctcgaatatcttaat

SEQ ID NO: 368175 - DNA, 17 bp, Homo sapiens
tagcctgcgtcatggct

SEQ ID NO: 368176 - DNA, 14 bp, Homo sapiens
tagcctgggccaga

SEQ ID NO: 368177 - DNA, 21 bp, Homo sapiens
tagccttagtgtcacctttct

SEQ ID NO: 368178 - DNA, 20 bp, Homo sapiens
tagccttgctgtagagactt

SEQ ID NO: 368179 - DNA, 17 bp, Homo sapiens
tagccttgtgccctgcc

SEQ ID NO: 368180 - DNA, 18 bp, Homo sapiens
tagccttgtgccctgccc

SEQ ID NO: 368181 - DNA, 19 bp, Homo sapiens
tagccttgtgccctgcccc

SEQ ID NO: 368182 - DNA, 13 bp, Homo sapiens
tagcctttgtagg

SEQ ID NO: 368183 - DNA, 14 bp, Homo sapiens
tagcgagctgctct

SEQ ID NO: 368184 - DNA, 19 bp, Homo sapiens
tagcgtcctgaggaataaa

SEQ ID NO: 368185 - DNA, 13 bp, Homo sapiens
tagcgttctggac

SEQ ID NO: 368186 - DNA, 22 bp, Homo sapiens
tagcgttctggactctgcccca

SEQ ID NO: 368187 - DNA, 19 bp, Homo sapiens
tagctacaatcctaccttt

SEQ ID NO: 368188 - DNA, 20 bp, Homo sapiens
tagctacaggaagcacccca

SEQ ID NO: 368189 - DNA, 23 bp, Homo sapiens
tagctacaggaagcaccccatgc

SEQ ID NO: 368190 - DNA, 13 bp, Homo sapiens
tagctacccacag

SEQ ID NO: 368191 - DNA, 15 bp, Homo sapiens
tagctacggttccct

SEQ ID NO: 368192 - DNA, 19 bp, Homo sapiens
tagctagaaatatgatttt

SEQ ID NO: 368193 - DNA, 17 bp, Homo sapiens
tagctagaatatcctat

SEQ ID NO: 368194 - DNA, 15 bp, Homo sapiens
tatactgtcttgtct

SEQ ID NO: 368195 - DNA, 16 bp, Homo sapiens
tatactgtttgtaata

SEQ ID NO: 368196 - DNA, 15 bp, Homo sapiens
tatacttaaacagct

SEQ ID NO: 368197 - DNA, 17 bp, Homo sapiens
tatacttaaacagcttt

SEQ ID NO: 368198 - DNA, 22 bp, Homo sapiens
tatacttgtggttttcaaattg

SEQ ID NO: 368199 - DNA, 23 bp, Homo sapiens
tatagaaatgtattttgaaaaca

SEQ ID NO: 368200 - DNA, 22 bp, Homo sapiens
tatagaataaagcctctgtgct

SEQ ID NO: 368201 - DNA, 22 bp, Homo sapiens
tatagaatacttttttctagtt

SEQ ID NO: 368202 - DNA, 18 bp, Homo sapiens
tatagaccccaagcattc

SEQ ID NO: 368203 - DNA, 11 bp, Homo sapiens
tatagactcta

SEQ ID NO: 368204 - DNA, 16 bp, Homo sapiens
tatagagacttctaaa

SEQ ID NO: 368205 - DNA, 15 bp, Homo sapiens
tatagagatatgcag

SEQ ID NO: 368206 - DNA, 17 bp, Homo sapiens
tatagagatatgcagaa

SEQ ID NO: 368207 - DNA, 16 bp, Homo sapiens
tatagatataactgta

SEQ ID NO: 368208 - DNA, 19 bp, Homo sapiens
tatagcaacctatttgact

SEQ ID NO: 368209 - DNA, 13 bp, Homo sapiens
tatagcatgtaat

SEQ ID NO: 368210 - DNA, 17 bp, Homo sapiens
tatagccatttgcccca

SEQ ID NO: 368211 - DNA, 18 bp, Homo sapiens
tatagccatttgccccaa

SEQ ID NO: 368212 - DNA, 21 bp, Homo sapiens
tatagctagctatttctatgt

SEQ ID NO: 368213 - DNA, 19 bp, Homo sapiens
tataggaacatatgaaaat

SEQ ID NO: 368214 - DNA, 17 bp, Homo sapiens
tataggagacttgtagt

SEQ ID NO: 368215 - DNA, 13 bp, Homo sapiens
tatagggtttgtt

SEQ ID NO: 368216 - DNA, 14 bp, Homo sapiens
tataggtcactcct

SEQ ID NO: 368217 - DNA, 15 bp, Homo sapiens
tataggttgtgcaaa

SEQ ID NO: 368218 - DNA, 16 bp, Homo sapiens
tatagtacctttgctc

SEQ ID NO: 368219 - DNA, 18 bp, Homo sapiens
tatagtatatctggacaa

SEQ ID NO: 368220 - DNA, 18 bp, Homo sapiens
tatagtattagtggaaag

SEQ ID NO: 368221 - DNA, 18 bp, Homo sapiens
tatagtcctagctgacgc

SEQ ID NO: 368222 - DNA, 21 bp, Homo sapiens
tatagttgtctttctttgctg

SEQ ID NO: 368223 - DNA, 22 bp, Homo sapiens
tatagttgtctttctttgctgc

SEQ ID NO: 368224 - DNA, 13 bp, Homo sapiens
tatagtttcagat

SEQ ID NO: 368225 - DNA, 17 bp, Homo sapiens
tatagttttacactcta

SEQ ID NO: 368226 - DNA, 23 bp, Homo sapiens
tatataaaaagaaaagataaaga

SEQ ID NO: 368227 - DNA, 13 bp, Homo sapiens
tatataaaacaaa

SEQ ID NO: 368228 - DNA, 12 bp, Homo sapiens
tatataaaataa

SEQ ID NO: 368229 - DNA, 20 bp, Homo sapiens
tatataaaataaatatacta

SEQ ID NO: 368230 - DNA, 22 bp, Homo sapiens
tatataaaataaatatactaat

SEQ ID NO: 368231 - DNA, 21 bp, Homo sapiens
tatataaagtactactgtaga

SEQ ID NO: 368232 - DNA, 12 bp, Homo sapiens
tatataaagtta

SEQ ID NO: 368233 - DNA, 17 bp, Homo sapiens
tatataagctgtttagt

SEQ ID NO: 368234 - DNA, 12 bp, Homo sapiens
tatataagcttt

SEQ ID NO: 368235 - DNA, 17 bp, Homo sapiens
tatataagttaaagaga

SEQ ID NO: 368236 - DNA, 21 bp, Homo sapiens
tatataagttaaagagacaaa

SEQ ID NO: 368237 - DNA, 15 bp, Homo sapiens
tatataatacttaaa

SEQ ID NO: 368238 - DNA, 14 bp, Homo sapiens
tatataatggttta

SEQ ID NO: 368239 - DNA, 15 bp, Homo sapiens
tatataatggtttac

SEQ ID NO: 368240 - DNA, 16 bp, Homo sapiens
tatatacatgtatagt

SEQ ID NO: 368241 - DNA, 22 bp, Homo sapiens
tatatacctggcttttacttta

SEQ ID NO: 368242 - DNA, 21 bp, Homo sapiens
tatatacttgtggttttcaaa

SEQ ID NO: 368243 - DNA, 21 bp, Homo sapiens
tatatagagacttctaaatca

SEQ ID NO: 368244 - DNA, 19 bp, Homo sapiens
tatatagagatgtttttaa

SEQ ID NO: 368245 - DNA, 18 bp, Homo sapiens
tatatagtacctttgctc

SEQ ID NO: 368246 - DNA, 13 bp, Homo sapiens
tatatataaaata

SEQ ID NO: 368247 - DNA, 13 bp, Homo sapiens
tatatatagaatc

SEQ ID NO: 368248 - DNA, 22 bp, Homo sapiens
tatatatcatattggtattcac

SEQ ID NO: 368249 - DNA, 16 bp, Homo sapiens
tatatatgaagtaagt

SEQ ID NO: 368250 - DNA, 22 bp, Homo sapiens
tatatatgtacagttatacata

SEQ ID NO: 368251 - DNA, 17 bp, Homo sapiens
tatatatgtataatttc

SEQ ID NO: 368252 - DNA, 16 bp, Homo sapiens
tatatatgtatataaa

SEQ ID NO: 368253 - DNA, 21 bp, Homo sapiens
tatatattctggctgataaaa

SEQ ID NO: 368254 - DNA, 20 bp, Homo sapiens
tatatattcttataaaaatg

SEQ ID NO: 368255 - DNA, 14 bp, Homo sapiens
tatatatttataac

SEQ ID NO: 368256 - DNA, 15 bp, Homo sapiens
tatatatttataact

SEQ ID NO: 368257 - DNA, 13 bp, Homo sapiens
tatatatttgaaa

SEQ ID NO: 368258 - DNA, 13 bp, Homo sapiens
tatatcagaaaag

SEQ ID NO: 368259 - DNA, 18 bp, Homo sapiens
tatatcagcagacactcc

SEQ ID NO: 368260 - DNA, 11 bp, Homo sapiens
tatatcagcct

SEQ ID NO: 368261 - DNA, 15 bp, Homo sapiens
tatatcagcctgagt

SEQ ID NO: 368262 - DNA, 23 bp, Homo sapiens
tatatcagcctgagtctcctgtg

SEQ ID NO: 368263 - DNA, 16 bp, Homo sapiens
tatatcatgaagcctt

SEQ ID NO: 368264 - DNA, 17 bp, Homo sapiens
tatatccatgtactgta

SEQ ID NO: 368265 - DNA, 14 bp, Homo sapiens
tatatcccagaaat

SEQ ID NO: 368266 - DNA, 20 bp, Homo sapiens
tatatcctttctaacaaaaa

SEQ ID NO: 368267 - DNA, 17 bp, Homo sapiens
tatatctgcttcagtgg

SEQ ID NO: 368268 - DNA, 20 bp, Homo sapiens
tatatctgggctggccagtt

SEQ ID NO: 368269 - DNA, 12 bp, Homo sapiens
tatatctgtaaa

SEQ ID NO: 368270 - DNA, 13 bp, Homo sapiens
tatatctgtaaat

SEQ ID NO: 368271 - DNA, 14 bp, Homo sapiens
tatatctgtaaatt

SEQ ID NO: 368272 - DNA, 13 bp, Homo sapiens
tatatctttgcac

SEQ ID NO: 368273 - DNA, 14 bp, Homo sapiens
tatatgaaaactaa

SEQ ID NO: 368274 - DNA, 16 bp, Homo sapiens
tatatgatatataaac

SEQ ID NO: 368275 - DNA, 15 bp, Homo sapiens
tatatgcaggctgtc

SEQ ID NO: 368276 - DNA, 21 bp, Homo sapiens
tatatgcataaacaacagtac

SEQ ID NO: 368277 - DNA, 16 bp, Homo sapiens
tatatgccatgatgga

SEQ ID NO: 368278 - DNA, 21 bp, Homo sapiens
tatatggaggattctttcccc

SEQ ID NO: 368279 - DNA, 23 bp, Homo sapiens
tatatggaggattctttccccag

SEQ ID NO: 368280 - DNA, 16 bp, Homo sapiens
tatatggcaagaaagc

SEQ ID NO: 368281 - DNA, 14 bp, Homo sapiens
tatatgtacagtta

SEQ ID NO: 368282 - DNA, 15 bp, Homo sapiens
tatatgtatataaaa

SEQ ID NO: 368283 - DNA, 20 bp, Homo sapiens
tatatgtatatctttgcact

SEQ ID NO: 368284 - DNA, 16 bp, Homo sapiens
tatatgtatgtaaaaa

SEQ ID NO: 368285 - DNA, 11 bp, Homo sapiens
tatatgtcttg

SEQ ID NO: 368286 - DNA, 16 bp, Homo sapiens
tatatgtgtgtttaaa

SEQ ID NO: 368287 - DNA, 16 bp, Homo sapiens
tatatgtttggctgaa

SEQ ID NO: 368288 - DNA, 13 bp, Homo sapiens
tatatgttttgag

SEQ ID NO: 368289 - DNA, 14 bp, Homo sapiens
tatatgttttgaga

SEQ ID NO: 368290 - DNA, 15 bp, Homo sapiens
tatatgttttgagaa

SEQ ID NO: 368291 - DNA, 16 bp, Homo sapiens
tatatgttttgagaaa

SEQ ID NO: 368292 - DNA, 18 bp, Homo sapiens
tatatgttttgagaaaaa

SEQ ID NO: 368293 - DNA, 15 bp, Homo sapiens
tatattaaggcagta

SEQ ID NO: 368294 - DNA, 14 bp, Homo sapiens
tatattataagatt

SEQ ID NO: 368295 - DNA, 13 bp, Homo sapiens
tatattataagtt

SEQ ID NO: 368296 - DNA, 13 bp, Homo sapiens
tatattatatata

SEQ ID NO: 368297 - DNA, 23 bp, Homo sapiens
tatattcagagatgtaccatgtt

SEQ ID NO: 368298 - DNA, 14 bp, Homo sapiens
tatattcatcaaat

SEQ ID NO: 368299 - DNA, 19 bp, Homo sapiens
tatattgagacaaaaatta

SEQ ID NO: 368300 - DNA, 17 bp, Homo sapiens
tatattgtttttatata

SEQ ID NO: 368301 - DNA, 14 bp, Homo sapiens
tatatttaacttct

SEQ ID NO: 368302 - DNA, 15 bp, Homo sapiens
tatatttaatgataa

SEQ ID NO: 368303 - DNA, 16 bp, Homo sapiens
tatatttataactcat

SEQ ID NO: 368304 - DNA, 24 bp, Homo sapiens
tatatttataactcatcataaaat

SEQ ID NO: 368305 - DNA, 16 bp, Homo sapiens
tatatttcactatttt

SEQ ID NO: 368306 - DNA, 13 bp, Homo sapiens
tatatttcatatt

SEQ ID NO: 368307 - DNA, 20 bp, Homo sapiens
tatatttccctaaaatacat

SEQ ID NO: 368308 - DNA, 14 bp, Homo sapiens
tatatttctttgtt

SEQ ID NO: 368309 - DNA, 20 bp, Homo sapiens
tatatttgaaactgctaatt

SEQ ID NO: 368310 - DNA, 12 bp, Homo sapiens
tatatttgaaag

SEQ ID NO: 368311 - DNA, 16 bp, Homo sapiens
tatatttgaaagaagt

SEQ ID NO: 368312 - DNA, 13 bp, Homo sapiens
tatatttgtctca

SEQ ID NO: 368313 - DNA, 15 bp, Homo sapiens
tatattttatactgc

SEQ ID NO: 368314 - DNA, 14 bp, Homo sapiens
tatatttttaagac

SEQ ID NO: 368315 - DNA, 18 bp, Homo sapiens
tatatttttatatttagt

SEQ ID NO: 368316 - DNA, 23 bp, Homo sapiens
tatatttttccctgtttgcctat

SEQ ID NO: 368317 - DNA, 16 bp, Homo sapiens
tatatttttgtttgtt

SEQ ID NO: 368318 - DNA, 19 bp, Homo sapiens
tatattttttaatttgatg

SEQ ID NO: 368319 - DNA, 14 bp, Homo sapiens
tatattttttacaa

SEQ ID NO: 368320 - DNA, 15 bp, Homo sapiens
tatattttttacaaa

SEQ ID NO: 368321 - DNA, 16 bp, Homo sapiens
tatcaaactcgtctga

SEQ ID NO: 368322 - DNA, 22 bp, Homo sapiens
tatcaaactcgtctgatgtttt

SEQ ID NO: 368323 - DNA, 21 bp, Homo sapiens
tatcaaacttcagctgtactt

SEQ ID NO: 368324 - DNA, 23 bp, Homo sapiens
tatcaaaggcagaaaggagatca

SEQ ID NO: 368325 - DNA, 19 bp, Homo sapiens
tatggttcccaataaaagt

SEQ ID NO: 368326 - DNA, 10 bp, Homo sapiens
tatgtaaaaa

SEQ ID NO: 368327 - DNA, 20 bp, Homo sapiens
tatgtaaagtatgtaaacag

SEQ ID NO: 368328 - DNA, 16 bp, Homo sapiens
tatgtaaattattgta

SEQ ID NO: 368329 - DNA, 18 bp, Homo sapiens
tatgtaaattattgtaaa

SEQ ID NO: 368330 - DNA, 15 bp, Homo sapiens
tatgtaagagcacct

SEQ ID NO: 368331 - DNA, 20 bp, Homo sapiens
tatgtaatgcttatgtgttg

SEQ ID NO: 368332 - DNA, 18 bp, Homo sapiens
tatgtacagttatacata

SEQ ID NO: 368333 - DNA, 20 bp, Homo sapiens
tatgtactcctctttacact

SEQ ID NO: 368334 - DNA, 21 bp, Homo sapiens
tatgtactctacgccaaagtg

SEQ ID NO: 368335 - DNA, 12 bp, Homo sapiens
tatgtagatgtg

SEQ ID NO: 368336 - DNA, 16 bp, Homo sapiens
tatgtagatgtgcatt

SEQ ID NO: 368337 - DNA, 14 bp, Homo sapiens
tatgtagattgcct

SEQ ID NO: 368338 - DNA, 23 bp, Homo sapiens
tatgtatctaaatgaaaagagaa

SEQ ID NO: 368339 - DNA, 16 bp, Homo sapiens
tatgtatgtaaaaatg

SEQ ID NO: 368340 - DNA, 17 bp, Homo sapiens
tatgtatgtttacatat

SEQ ID NO: 368341 - DNA, 18 bp, Homo sapiens
tatgtattaccagccccc

SEQ ID NO: 368342 - DNA, 13 bp, Homo sapiens
tatgtattataca

SEQ ID NO: 368343 - DNA, 20 bp, Homo sapiens
tatgtattgtaaacatgtgt

SEQ ID NO: 368344 - DNA, 22 bp, Homo sapiens
tatgtattgtaaacatgtgttt

SEQ ID NO: 368345 - DNA, 15 bp, Homo sapiens
tatgtatttcattgc

SEQ ID NO: 368346 - DNA, 20 bp, Homo sapiens
tatgtcaaatggatgtaata

SEQ ID NO: 368347 - DNA, 18 bp, Homo sapiens
tatgtcagcagctctgag

SEQ ID NO: 368348 - DNA, 22 bp, Homo sapiens
tatgtcagcagctctgagacag

SEQ ID NO: 368349 - DNA, 20 bp, Homo sapiens
tatgtcagtccaataaatta

SEQ ID NO: 368350 - DNA, 22 bp, Homo sapiens
tatgtccagatgtgcaggctcc

SEQ ID NO: 368351 - DNA, 14 bp, Homo sapiens
tatgtcccagcccc

SEQ ID NO: 368352 - DNA, 13 bp, Homo sapiens
tatgtcctaagga

SEQ ID NO: 368353 - DNA, 12 bp, Homo sapiens
tatgtctaaaga

SEQ ID NO: 368354 - DNA, 15 bp, Homo sapiens
tatgtctatatttaa

SEQ ID NO: 368355 - DNA, 18 bp, Homo sapiens
tatgtcttactactttaa

SEQ ID NO: 368356 - DNA, 22 bp, Homo sapiens
tatgtcttgcaaagcctttaaa

SEQ ID NO: 368357 - DNA, 22 bp, Homo sapiens
tatgtgaaagtgtaaaatagaa

SEQ ID NO: 368358 - DNA, 12 bp, Homo sapiens
tatgtgaatgat

SEQ ID NO: 368359 - DNA, 21 bp, Homo sapiens
tatgtgaattgaagtcatcat

SEQ ID NO: 368360 - DNA, 15 bp, Homo sapiens
tatgtgacaaccttt

SEQ ID NO: 368361 - DNA, 20 bp, Homo sapiens
tatgtgacaacctttgtgta

SEQ ID NO: 368362 - DNA, 21 bp, Homo sapiens
tatgtgacaacctttgtgtaa

SEQ ID NO: 368363 - DNA, 14 bp, Homo sapiens
tatgtgagcatgaa

SEQ ID NO: 368364 - DNA, 22 bp, Homo sapiens
tatgtgagcatgaaactatgca

SEQ ID NO: 368365 - DNA, 16 bp, Homo sapiens
tatgtgagtgaaagta

SEQ ID NO: 368366 - DNA, 20 bp, Homo sapiens
tatgtgagtgaaagtacttc

SEQ ID NO: 368367 - DNA, 23 bp, Homo sapiens
tatgtgagtgtgtgtttgtgctg

SEQ ID NO: 368368 - DNA, 17 bp, Homo sapiens
tatgtggatacagtcat

SEQ ID NO: 368369 - DNA, 17 bp, Homo sapiens
tatgtggcagctgggga

SEQ ID NO: 368370 - DNA, 17 bp, Homo sapiens
tatgtggtggtttctat

SEQ ID NO: 368371 - DNA, 18 bp, Homo sapiens
tatgtgtatgtgccattt

SEQ ID NO: 368372 - DNA, 16 bp, Homo sapiens
tatgtgtcatgatttc

SEQ ID NO: 368373 - DNA, 22 bp, Homo sapiens
tatgttaagcagctaaattttc

SEQ ID NO: 368374 - DNA, 20 bp, Homo sapiens
tatgttacttaaacatcatt

SEQ ID NO: 368375 - DNA, 15 bp, Homo sapiens
tatgttatgaacatg

SEQ ID NO: 368376 - DNA, 17 bp, Homo sapiens
tatgttgctcagtctcc

SEQ ID NO: 368377 - DNA, 20 bp, Homo sapiens
tatgttgctcagtctccctt

SEQ ID NO: 368378 - DNA, 15 bp, Homo sapiens
tatgttgtgaagatg

SEQ ID NO: 368379 - DNA, 14 bp, Homo sapiens
tatgtttacatatc

SEQ ID NO: 368380 - DNA, 15 bp, Homo sapiens
tatgtttccatagct

SEQ ID NO: 368381 - DNA, 19 bp, Homo sapiens
tatgtttgcacacttgtgt

SEQ ID NO: 368382 - DNA, 23 bp, Homo sapiens
tatgtttgctcagaacacattct

SEQ ID NO: 368383 - DNA, 16 bp, Homo sapiens
tatgtttggctgaaat

SEQ ID NO: 368384 - DNA, 15 bp, Homo sapiens
tatgttttgagaaaa

SEQ ID NO: 368385 - DNA, 11 bp, Homo sapiens
tatgttttgga

SEQ ID NO: 368386 - DNA, 12 bp, Homo sapiens
tattaaaaatat

SEQ ID NO: 368387 - DNA, 22 bp, Homo sapiens
tattaaaatgattgtaaaatag

SEQ ID NO: 368388 - DNA, 17 bp, Homo sapiens
tattaaaccataagatg

SEQ ID NO: 368389 - DNA, 15 bp, Homo sapiens
tattaaactctcctt

SEQ ID NO: 368390 - DNA, 15 bp, Homo sapiens
tattaaacttcagca

SEQ ID NO: 368391 - DNA, 20 bp, Homo sapiens
tattaaagcgcaaatgaatt

SEQ ID NO: 368392 - DNA, 12 bp, Homo sapiens
tattaaatacag

SEQ ID NO: 368393 - DNA, 18 bp, Homo sapiens
tattaaatacagacacta

SEQ ID NO: 368394 - DNA, 21 bp, Homo sapiens
tattaaatacagacactaagt

SEQ ID NO: 368395 - DNA, 15 bp, Homo sapiens
tattaaattcctcct

SEQ ID NO: 368396 - DNA, 18 bp, Homo sapiens
tattaactctgcatagac

SEQ ID NO: 368397 - DNA, 19 bp, Homo sapiens
tattaagaatagtctctgg

SEQ ID NO: 368398 - DNA, 13 bp, Homo sapiens
tattaagatggat

SEQ ID NO: 368399 - DNA, 15 bp, Homo sapiens
tattaagatggattc

SEQ ID NO: 368400 - DNA, 21 bp, Homo sapiens
tattaagatggattctcagat

SEQ ID NO: 368401 - DNA, 19 bp, Homo sapiens
tattaagcagtaaaaactg

SEQ ID NO: 368402 - DNA, 21 bp, Homo sapiens
tattaagtctgggatgtagaa

SEQ ID NO: 368403 - DNA, 21 bp, Homo sapiens
tattaataaaactttatgtac

SEQ ID NO: 368404 - DNA, 21 bp, Homo sapiens
tattaatccacaaatatgcta

SEQ ID NO: 368405 - DNA, 13 bp, Homo sapiens
tattaatgaactg

SEQ ID NO: 368406 - DNA, 15 bp, Homo sapiens
tattaatgaactgtg

SEQ ID NO: 368407 - DNA, 18 bp, Homo sapiens
tattaatgaactgtgaca

SEQ ID NO: 368408 - DNA, 19 bp, Homo sapiens
tattaatgaactgtgacag

SEQ ID NO: 368409 - DNA, 13 bp, Homo sapiens
tattaatgctaag

SEQ ID NO: 368410 - DNA, 22 bp, Homo sapiens
tattaatttagcctttaataat

SEQ ID NO: 368411 - DNA, 11 bp, Homo sapiens
tattaatttat

SEQ ID NO: 368412 - DNA, 15 bp, Homo sapiens
tattaatttcattgt

SEQ ID NO: 368413 - DNA, 11 bp, Homo sapiens
tattacaaata

SEQ ID NO: 368414 - DNA, 19 bp, Homo sapiens
tattacactgtatttgtat

SEQ ID NO: 368415 - DNA, 15 bp, Homo sapiens
tattacatctaatgc

SEQ ID NO: 368416 - DNA, 22 bp, Homo sapiens
tattacatctttattaacctca

SEQ ID NO: 368417 - DNA, 16 bp, Homo sapiens
tattacattagttaag

SEQ ID NO: 368418 - DNA, 20 bp, Homo sapiens
tattaccagcaagaataaaa

SEQ ID NO: 368419 - DNA, 21 bp, Homo sapiens
tattaccagcaagaataaaaa

SEQ ID NO: 368420 - DNA, 14 bp, Homo sapiens
tattacccctcatt

SEQ ID NO: 368421 - DNA, 14 bp, Homo sapiens
tattacctctgata

SEQ ID NO: 368422 - DNA, 18 bp, Homo sapiens
tattactgatgtgtgcaa

SEQ ID NO: 368423 - DNA, 16 bp, Homo sapiens
tattactgttgcattt

SEQ ID NO: 368424 - DNA, 19 bp, Homo sapiens
tattactgttgcatttact

SEQ ID NO: 368425 - DNA, 21 bp, Homo sapiens
tattacttgtttgtaagattt

SEQ ID NO: 368426 - DNA, 14 bp, Homo sapiens
tattactttaacat

SEQ ID NO: 368427 - DNA, 15 bp, Homo sapiens
tattactttaacatg

SEQ ID NO: 368428 - DNA, 17 bp, Homo sapiens
tattacttttgtaaata

SEQ ID NO: 368429 - DNA, 18 bp, Homo sapiens
tattacttttgtaaatat

SEQ ID NO: 368430 - DNA, 23 bp, Homo sapiens
tattacttttgtaaatattcttg

SEQ ID NO: 368431 - DNA, 16 bp, Homo sapiens
tattagactttagaaa

SEQ ID NO: 368432 - DNA, 24 bp, Homo sapiens
tattagagtgcccttaaaataatg

SEQ ID NO: 368433 - DNA, 21 bp, Homo sapiens
tattagccaggtaatgtgaat

SEQ ID NO: 368434 - DNA, 17 bp, Homo sapiens
tattaggggtaatatat

SEQ ID NO: 368435 - DNA, 18 bp, Homo sapiens
tattaggggtaatatatt

SEQ ID NO: 368436 - DNA, 19 bp, Homo sapiens
tattagtggaaagtgattt

SEQ ID NO: 368437 - DNA, 20 bp, Homo sapiens
tattagtggaaagtgatttg

SEQ ID NO: 368438 - DNA, 19 bp, Homo sapiens
tattataaatccaaagtaa

SEQ ID NO: 368439 - DNA, 13 bp, Homo sapiens
tattataagcatt

SEQ ID NO: 368440 - DNA, 17 bp, Homo sapiens
tattataagcattgaaa

SEQ ID NO: 368441 - DNA, 20 bp, Homo sapiens
tattataagcattgaaatta

SEQ ID NO: 368442 - DNA, 12 bp, Homo sapiens
tattataagttg

SEQ ID NO: 368443 - DNA, 21 bp, Homo sapiens
tattataataatgttctctgg

SEQ ID NO: 368444 - DNA, 19 bp, Homo sapiens
tattataatttttttcaat

SEQ ID NO: 368445 - DNA, 15 bp, Homo sapiens
tattatactaagaaa

SEQ ID NO: 368446 - DNA, 19 bp, Homo sapiens
tattatactaagaaaagat

SEQ ID NO: 368447 - DNA, 15 bp, Homo sapiens
tattatcaacaatag

SEQ ID NO: 368448 - DNA, 13 bp, Homo sapiens
tattatcatttct

SEQ ID NO: 368449 - DNA, 12 bp, Homo sapiens
tattatgctacc

SEQ ID NO: 368450 - DNA, 15 bp, Homo sapiens
tattatggaattact

SEQ ID NO: 368451 - DNA, 16 bp, Homo sapiens
tattatgggtatgtgt

SEQ ID NO: 368452 - DNA, 18 bp, Homo sapiens
tattattggcttgcactt

SEQ ID NO: 368453 - DNA, 16 bp, Homo sapiens
tattattttcacctgt

SEQ ID NO: 368454 - DNA, 14 bp, Homo sapiens
tattcaaacacaca

SEQ ID NO: 368455 - DNA, 19 bp, Homo sapiens
tcaagcgctatccacagaa

SEQ ID NO: 368456 - DNA, 20 bp, Homo sapiens
tcaagctaataaaatatcat

SEQ ID NO: 368457 - DNA, 12 bp, Homo sapiens
tcaagctgtccc

SEQ ID NO: 368458 - DNA, 13 bp, Homo sapiens
tcaagctgtcccc

SEQ ID NO: 368459 - DNA, 21 bp, Homo sapiens
tcaagctgtcccctctgtcat

SEQ ID NO: 368460 - DNA, 16 bp, Homo sapiens
tcaaggagaatatgat

SEQ ID NO: 368461 - DNA, 21 bp, Homo sapiens
tcaaggcaactagtggagaga

SEQ ID NO: 368462 - DNA, 19 bp, Homo sapiens
tcaaggccgtgtccccttg

SEQ ID NO: 368463 - DNA, 15 bp, Homo sapiens
tcaaggctgcagtga

SEQ ID NO: 368464 - DNA, 17 bp, Homo sapiens
tcaaggctgcctggaga

SEQ ID NO: 368465 - DNA, 16 bp, Homo sapiens
tcaagggttgcttctg

SEQ ID NO: 368466 - DNA, 13 bp, Homo sapiens
tcaaggtgctcaa

SEQ ID NO: 368467 - DNA, 18 bp, Homo sapiens
tcaagtaagaagacatga

SEQ ID NO: 368468 - DNA, 16 bp, Homo sapiens
tcaagtaattgtgaaa

SEQ ID NO: 368469 - DNA, 18 bp, Homo sapiens
tcaagtcaatcatttctc

SEQ ID NO: 368470 - DNA, 15 bp, Homo sapiens
tcaagtcatgatgga

SEQ ID NO: 368471 - DNA, 21 bp, Homo sapiens
tcaagtctgtgcctggagctc

SEQ ID NO: 368472 - DNA, 12 bp, Homo sapiens
tcaagtgcctta

SEQ ID NO: 368473 - DNA, 15 bp, Homo sapiens
tcaagtgtgcctgct

SEQ ID NO: 368474 - DNA, 13 bp, Homo sapiens
tcaagttattgta

SEQ ID NO: 368475 - DNA, 17 bp, Homo sapiens
tcaagttattgtacagc

SEQ ID NO: 368476 - DNA, 20 bp, Homo sapiens
tcaagttcatagtttctgta

SEQ ID NO: 368477 - DNA, 21 bp, Homo sapiens
tcaagttcatagtttctgtaa

SEQ ID NO: 368478 - DNA, 21 bp, Homo sapiens
tcaagttccgtctcctctcca

SEQ ID NO: 368479 - DNA, 14 bp, Homo sapiens
tcaagttgtgcttg

SEQ ID NO: 368480 - DNA, 21 bp, Homo sapiens
tcaagttttgggggtgggctg

SEQ ID NO: 368481 - DNA, 16 bp, Homo sapiens
tcaagtttttctctca

SEQ ID NO: 368482 - DNA, 17 bp, Homo sapiens
tcaataaaatgcactga

SEQ ID NO: 368483 - DNA, 19 bp, Homo sapiens
tcaataaaatgtgattttt

SEQ ID NO: 368484 - DNA, 22 bp, Homo sapiens
tcaataaaatgtgatttttctg

SEQ ID NO: 368485 - DNA, 12 bp, Homo sapiens
tcaataaacagc

SEQ ID NO: 368486 - DNA, 21 bp, Homo sapiens
tcaataaacagcttcatgcct

SEQ ID NO: 368487 - DNA, 14 bp, Homo sapiens
tcaataaagcacta

SEQ ID NO: 368488 - DNA, 13 bp, Homo sapiens
tcaataaaggtca

SEQ ID NO: 368489 - DNA, 20 bp, Homo sapiens
tcaataaaggtcatattgga

SEQ ID NO: 368490 - DNA, 19 bp, Homo sapiens
tcaataattgtggagagga

SEQ ID NO: 368491 - DNA, 22 bp, Homo sapiens
tcaataccccaagtccacctgc

SEQ ID NO: 368492 - DNA, 22 bp, Homo sapiens
tcaatacttttgtgtattctgt

SEQ ID NO: 368493 - DNA, 23 bp, Homo sapiens
tcaatacttttgtgtattctgtg

SEQ ID NO: 368494 - DNA, 15 bp, Homo sapiens
tcaatattaaataca

SEQ ID NO: 368495 - DNA, 22 bp, Homo sapiens
tcaatattaaatacagacacta

SEQ ID NO: 368496 - DNA, 17 bp, Homo sapiens
tcaatattcctgaatga

SEQ ID NO: 368497 - DNA, 20 bp, Homo sapiens
tcaatatttattattttcac

SEQ ID NO: 368498 - DNA, 14 bp, Homo sapiens
tcaatcaaacaggg

SEQ ID NO: 368499 - DNA, 16 bp, Homo sapiens
tcaatccacagtattg

SEQ ID NO: 368500 - DNA, 21 bp, Homo sapiens
tcaatccacagtattgttctt

SEQ ID NO: 368501 - DNA, 16 bp, Homo sapiens
tcaatcccaattctgt

SEQ ID NO: 368502 - DNA, 20 bp, Homo sapiens
tcaatgaaaccttcctcttg

SEQ ID NO: 368503 - DNA, 12 bp, Homo sapiens
tcaatgaaatat

SEQ ID NO: 368504 - DNA, 21 bp, Homo sapiens
tcaatgaaatatttgcttatt

SEQ ID NO: 368505 - DNA, 14 bp, Homo sapiens
tcaatgacctgtat

SEQ ID NO: 368506 - DNA, 16 bp, Homo sapiens
tcaatgctacaaaatg

SEQ ID NO: 368507 - DNA, 17 bp, Homo sapiens
tcaatgctatggactgc

SEQ ID NO: 368508 - DNA, 18 bp, Homo sapiens
tcaatgctatggactgca

SEQ ID NO: 368509 - DNA, 16 bp, Homo sapiens
tcaatgctctaacaaa

SEQ ID NO: 368510 - DNA, 18 bp, Homo sapiens
tcaatggaagaaaccctt

SEQ ID NO: 368511 - DNA, 17 bp, Homo sapiens
tcaatgggcaatgacag

SEQ ID NO: 368512 - DNA, 20 bp, Homo sapiens
tcaatggttgggacaatggc

SEQ ID NO: 368513 - DNA, 12 bp, Homo sapiens
tcaatgtgaaaa

SEQ ID NO: 368514 - DNA, 16 bp, Homo sapiens
tcaatgtgattctaat

SEQ ID NO: 368515 - DNA, 11 bp, Homo sapiens
tcaatgttcat

SEQ ID NO: 368516 - DNA, 16 bp, Homo sapiens
tcaatgttcattgtaa

SEQ ID NO: 368517 - DNA, 23 bp, Homo sapiens
tcaatgttttcttttctgtggtt

SEQ ID NO: 368518 - DNA, 12 bp, Homo sapiens
tcaattaaatgt

SEQ ID NO: 368519 - DNA, 13 bp, Homo sapiens
tcaattaaatgta

SEQ ID NO: 368520 - DNA, 23 bp, Homo sapiens
tcaattacaggaagtactggaga

SEQ ID NO: 368521 - DNA, 14 bp, Homo sapiens
tcaattccacctgc

SEQ ID NO: 368522 - DNA, 14 bp, Homo sapiens
tcaattcctctggg

SEQ ID NO: 368523 - DNA, 15 bp, Homo sapiens
tcaattcctctggga

SEQ ID NO: 368524 - DNA, 16 bp, Homo sapiens
tcaattgcagatgcca

SEQ ID NO: 368525 - DNA, 17 bp, Homo sapiens
tcaattggacaattatt

SEQ ID NO: 368526 - DNA, 16 bp, Homo sapiens
tcaattgtgtctgtgg

SEQ ID NO: 368527 - DNA, 12 bp, Homo sapiens
tcaatttctcac

SEQ ID NO: 368528 - DNA, 16 bp, Homo sapiens
tcaatttgaaatcacc

SEQ ID NO: 368529 - DNA, 15 bp, Homo sapiens
tcaattttgtattta

SEQ ID NO: 368530 - DNA, 17 bp, Homo sapiens
tcaattttgtatttaat

SEQ ID NO: 368531 - DNA, 21 bp, Homo sapiens
tcaattttttaaaccactaat

SEQ ID NO: 368532 - DNA, 18 bp, Homo sapiens
tcacaaaaaaagtaattg

SEQ ID NO: 368533 - DNA, 19 bp, Homo sapiens
tcacaaaagctgtgtctct

SEQ ID NO: 368534 - DNA, 17 bp, Homo sapiens
tcacaaagctgtgaaat

SEQ ID NO: 368535 - DNA, 21 bp, Homo sapiens
tcacaaatagtgttgatcaga

SEQ ID NO: 368536 - DNA, 22 bp, Homo sapiens
tcacaaatatagttgaacaaga

SEQ ID NO: 368537 - DNA, 20 bp, Homo sapiens
tcacaaatcctaaaagaagc

SEQ ID NO: 368538 - DNA, 19 bp, Homo sapiens
tcacaaccaccgttacaag

SEQ ID NO: 368539 - DNA, 12 bp, Homo sapiens
tcacaacctctc

SEQ ID NO: 368540 - DNA, 11 bp, Homo sapiens
tcacaactcct

SEQ ID NO: 368541 - DNA, 20 bp, Homo sapiens
tcacaactccttccatcctt

SEQ ID NO: 368542 - DNA, 22 bp, Homo sapiens
tcacaactccttccatccttga

SEQ ID NO: 368543 - DNA, 12 bp, Homo sapiens
tcacaactgttt

SEQ ID NO: 368544 - DNA, 13 bp, Homo sapiens
tcacaactgtttt

SEQ ID NO: 368545 - DNA, 12 bp, Homo sapiens
tcacaagctgcc

SEQ ID NO: 368546 - DNA, 14 bp, Homo sapiens
tcacaagctgcctc

SEQ ID NO: 368547 - DNA, 22 bp, Homo sapiens
tcacaagggcaaactttttcct

SEQ ID NO: 368548 - DNA, 15 bp, Homo sapiens
tcacaagtaggagac

SEQ ID NO: 368549 - DNA, 17 bp, Homo sapiens
tcacaagtaggagacac

SEQ ID NO: 368550 - DNA, 22 bp, Homo sapiens
tcacaagttaagattcttggta

SEQ ID NO: 368551 - DNA, 20 bp, Homo sapiens
tcacaatacagataacatta

SEQ ID NO: 368552 - DNA, 13 bp, Homo sapiens
tcacaatataaag

SEQ ID NO: 368553 - DNA, 14 bp, Homo sapiens
tcacacaaagcaga

SEQ ID NO: 368554 - DNA, 14 bp, Homo sapiens
tcacacacacacac

SEQ ID NO: 368555 - DNA, 15 bp, Homo sapiens
tcacacacacacaca

SEQ ID NO: 368556 - DNA, 14 bp, Homo sapiens
tcacacacacagct

SEQ ID NO: 368557 - DNA, 18 bp, Homo sapiens
tcacacacacagctgggc

SEQ ID NO: 368558 - DNA, 14 bp, Homo sapiens
tcacacacagcctg

SEQ ID NO: 368559 - DNA, 21 bp, Homo sapiens
tcacacagcacctcctctctg

SEQ ID NO: 368560 - DNA, 13 bp, Homo sapiens
tcacacagctggg

SEQ ID NO: 368561 - DNA, 22 bp, Homo sapiens
tcacacagctggggctgtagca

SEQ ID NO: 368562 - DNA, 23 bp, Homo sapiens
tcacacagggctctttgatggac

SEQ ID NO: 368563 - DNA, 14 bp, Homo sapiens
tcacacatccagac

SEQ ID NO: 368564 - DNA, 21 bp, Homo sapiens
tcacacattatagaaattact

SEQ ID NO: 368565 - DNA, 13 bp, Homo sapiens
tcacaccctgcaa

SEQ ID NO: 368566 - DNA, 12 bp, Homo sapiens
tcacacctctgg

SEQ ID NO: 368567 - DNA, 13 bp, Homo sapiens
tcacacctctggg

SEQ ID NO: 368568 - DNA, 17 bp, Homo sapiens
tcacacggggtatttta

SEQ ID NO: 368569 - DNA, 12 bp, Homo sapiens
tcacactgctgg

SEQ ID NO: 368570 - DNA, 11 bp, Homo sapiens
tcacactgtgc

SEQ ID NO: 368571 - DNA, 20 bp, Homo sapiens
tcacactgtggaacactaaa

SEQ ID NO: 368572 - DNA, 11 bp, Homo sapiens
tcacactttgc

SEQ ID NO: 368573 - DNA, 16 bp, Homo sapiens
tcacagaaatcagagg

SEQ ID NO: 368574 - DNA, 21 bp, Homo sapiens
tcacagaaatcagaggagaga

SEQ ID NO: 368575 - DNA, 21 bp, Homo sapiens
tcacagaacccttggagccaa

SEQ ID NO: 368576 - DNA, 15 bp, Homo sapiens
tcacagagacacagg

SEQ ID NO: 368577 - DNA, 20 bp, Homo sapiens
tcacagaggcagtggcagca

SEQ ID NO: 368578 - DNA, 21 bp, Homo sapiens
tcacagatgggtattaaactt

SEQ ID NO: 368579 - DNA, 18 bp, Homo sapiens
tcacagatgtgcccagag

SEQ ID NO: 368580 - DNA, 19 bp, Homo sapiens
tcacagatgtgcccagagt

SEQ ID NO: 368581 - DNA, 20 bp, Homo sapiens
tcacagatgtgcccagagta

SEQ ID NO: 368582 - DNA, 23 bp, Homo sapiens
tcacagatgtgcccagagtagcc

SEQ ID NO: 368583 - DNA, 19 bp, Homo sapiens
tcacagcacatgctggcca

SEQ ID NO: 368584 - DNA, 15 bp, Homo sapiens
tcacagcagtacttg

SEQ ID NO: 368585 - DNA, 17 bp, Homo sapiens
tcacagccaccacctgg

SEQ ID NO: 368586 - DNA, 17 bp, Homo sapiens
tcagaatgctctacttc

SEQ ID NO: 368587 - DNA, 21 bp, Homo sapiens
tcagaattgatcattttcccc

SEQ ID NO: 368588 - DNA, 23 bp, Homo sapiens
tcagaatttctttgtcattcaag

SEQ ID NO: 368589 - DNA, 11 bp, Homo sapiens
tcagacaagca

SEQ ID NO: 368590 - DNA, 19 bp, Homo sapiens
tcagacacaattagagaag

SEQ ID NO: 368591 - DNA, 23 bp, Homo sapiens
tcagacacacggggcacccagcc

SEQ ID NO: 368592 - DNA, 14 bp, Homo sapiens
tcagacactttgga

SEQ ID NO: 368593 - DNA, 20 bp, Homo sapiens
tcagaccaactctctcctgt

SEQ ID NO: 368594 - DNA, 15 bp, Homo sapiens
tcagacccctgcctg

SEQ ID NO: 368595 - DNA, 16 bp, Homo sapiens
tcagacctctgatccc

SEQ ID NO: 368596 - DNA, 12 bp, Homo sapiens
tcagacctgggt

SEQ ID NO: 368597 - DNA, 13 bp, Homo sapiens
tcagacctgtctt

SEQ ID NO: 368598 - DNA, 17 bp, Homo sapiens
tcagacctgtcttccaa

SEQ ID NO: 368599 - DNA, 20 bp, Homo sapiens
tcagacctgtcttccaagga

SEQ ID NO: 368600 - DNA, 18 bp, Homo sapiens
tcagacgagacaccctaa

SEQ ID NO: 368601 - DNA, 14 bp, Homo sapiens
tcagactagtgaca

SEQ ID NO: 368602 - DNA, 20 bp, Homo sapiens
tcagactctaaacacacaag

SEQ ID NO: 368603 - DNA, 16 bp, Homo sapiens
tcagactgctttgaga

SEQ ID NO: 368604 - DNA, 16 bp, Homo sapiens
tcagactttaaagaat

SEQ ID NO: 368605 - DNA, 13 bp, Homo sapiens
tcagactttgctt

SEQ ID NO: 368606 - DNA, 16 bp, Homo sapiens
tcagagaaaacacttt

SEQ ID NO: 368607 - DNA, 14 bp, Homo sapiens
tcagagaaggccag

SEQ ID NO: 368608 - DNA, 11 bp, Homo sapiens
tcagagaagtc

SEQ ID NO: 368609 - DNA, 22 bp, Homo sapiens
tcagagaagtcagttggagaaa

SEQ ID NO: 368610 - DNA, 20 bp, Homo sapiens
tcagagacaggaagtcttca

SEQ ID NO: 368611 - DNA, 17 bp, Homo sapiens
tcagagactggcagcca

SEQ ID NO: 368612 - DNA, 21 bp, Homo sapiens
tcagagactggcagccaggga

SEQ ID NO: 368613 - DNA, 23 bp, Homo sapiens
tcagagagcaagaaaaaagtaca

SEQ ID NO: 368614 - DNA, 13 bp, Homo sapiens
tcagagagctggt

SEQ ID NO: 368615 - DNA, 15 bp, Homo sapiens
tcagagagtgtacat

SEQ ID NO: 368616 - DNA, 23 bp, Homo sapiens
tcagagatggtaatctacagctc

SEQ ID NO: 368617 - DNA, 14 bp, Homo sapiens
tcagagatgtacca

SEQ ID NO: 368618 - DNA, 17 bp, Homo sapiens
tcagagatttatataaa

SEQ ID NO: 368619 - DNA, 18 bp, Homo sapiens
tcagagatttatataaat

SEQ ID NO: 368620 - DNA, 12 bp, Homo sapiens
tcagagccaagt

SEQ ID NO: 368621 - DNA, 14 bp, Homo sapiens
tcagagcccacatg

SEQ ID NO: 368622 - DNA, 18 bp, Homo sapiens
tcagagccctggctgggt

SEQ ID NO: 368623 - DNA, 19 bp, Homo sapiens
tcagagccctggctgggtt

SEQ ID NO: 368624 - DNA, 17 bp, Homo sapiens
tcagagctcttcaagct

SEQ ID NO: 368625 - DNA, 21 bp, Homo sapiens
tcagagctcttcaagctgtcc

SEQ ID NO: 368626 - DNA, 20 bp, Homo sapiens
tcagaggaaaaacagaggat

SEQ ID NO: 368627 - DNA, 21 bp, Homo sapiens
tcagagggaaactcagatgtc

SEQ ID NO: 368628 - DNA, 15 bp, Homo sapiens
tcagagggtccctag

SEQ ID NO: 368629 - DNA, 18 bp, Homo sapiens
tcagaggtagggctgcca

SEQ ID NO: 368630 - DNA, 18 bp, Homo sapiens
tcagagtaagctgctttt

SEQ ID NO: 368631 - DNA, 13 bp, Homo sapiens
tcagagtccaggc

SEQ ID NO: 368632 - DNA, 15 bp, Homo sapiens
tcagagtcttgtccc

SEQ ID NO: 368633 - DNA, 17 bp, Homo sapiens
tcagagttgctttaaag

SEQ ID NO: 368634 - DNA, 12 bp, Homo sapiens
tcagatccctcg

SEQ ID NO: 368635 - DNA, 17 bp, Homo sapiens
tcagatcctgctgccgc

SEQ ID NO: 368636 - DNA, 20 bp, Homo sapiens
tcagatctgaacacagttta

SEQ ID NO: 368637 - DNA, 22 bp, Homo sapiens
tcagatctggtctagttaacct

SEQ ID NO: 368638 - DNA, 18 bp, Homo sapiens
tcagatcttacaagttta

SEQ ID NO: 368639 - DNA, 15 bp, Homo sapiens
tcagatgaaaataaa

SEQ ID NO: 368640 - DNA, 15 bp, Homo sapiens
tcagatgactagaaa

SEQ ID NO: 368641 - DNA, 17 bp, Homo sapiens
tcagatgagcaaggaca

SEQ ID NO: 368642 - DNA, 19 bp, Homo sapiens
tcagatggaaatattttga

SEQ ID NO: 368643 - DNA, 15 bp, Homo sapiens
tcagatgtcttctgc

SEQ ID NO: 368644 - DNA, 16 bp, Homo sapiens
tcagatgtcttctgcc

SEQ ID NO: 368645 - DNA, 19 bp, Homo sapiens
tcagatgtcttctgcctgt

SEQ ID NO: 368646 - DNA, 12 bp, Homo sapiens
tcagatgtgcat

SEQ ID NO: 368647 - DNA, 24 bp, Homo sapiens
tcagatgtgttgacgtaagctcta

SEQ ID NO: 368648 - DNA, 19 bp, Homo sapiens
tcagattaggacacagtgt

SEQ ID NO: 368649 - DNA, 24 bp, Homo sapiens
tcagattgtaaaggtaggtgcatg

SEQ ID NO: 368650 - DNA, 14 bp, Homo sapiens
tcagatttaccata

SEQ ID NO: 368651 - DNA, 21 bp, Homo sapiens
tcagatttaccataatgttcc

SEQ ID NO: 368652 - DNA, 12 bp, Homo sapiens
tcagatttgaac

SEQ ID NO: 368653 - DNA, 14 bp, Homo sapiens
tcagcaaattcttg

SEQ ID NO: 368654 - DNA, 15 bp, Homo sapiens
tcagcaaattcttga

SEQ ID NO: 368655 - DNA, 20 bp, Homo sapiens
tcagcaaccctacagtatat

SEQ ID NO: 368656 - DNA, 20 bp, Homo sapiens
tcagcaaggggctctgccct

SEQ ID NO: 368657 - DNA, 13 bp, Homo sapiens
tcagcaagtgtac

SEQ ID NO: 368658 - DNA, 15 bp, Homo sapiens
tcagcaagtgtacag

SEQ ID NO: 368659 - DNA, 14 bp, Homo sapiens
tcagcacatgcact

SEQ ID NO: 368660 - DNA, 12 bp, Homo sapiens
tcagcaccaccc

SEQ ID NO: 368661 - DNA, 13 bp, Homo sapiens
tcagcaccaccct

SEQ ID NO: 368662 - DNA, 14 bp, Homo sapiens
tcagcaccacccta

SEQ ID NO: 368663 - DNA, 12 bp, Homo sapiens
tcagcaccccca

SEQ ID NO: 368664 - DNA, 14 bp, Homo sapiens
tcagcacccccacc

SEQ ID NO: 368665 - DNA, 18 bp, Homo sapiens
tcagcacccccacccacc

SEQ ID NO: 368666 - DNA, 12 bp, Homo sapiens
tcagcaccctgg

SEQ ID NO: 368667 - DNA, 16 bp, Homo sapiens
tcagcaccctgggtgc

SEQ ID NO: 368668 - DNA, 17 bp, Homo sapiens
tcagcaccctgggtgcc

SEQ ID NO: 368669 - DNA, 19 bp, Homo sapiens
tcagcaccctgggtgccat

SEQ ID NO: 368670 - DNA, 20 bp, Homo sapiens
tcagcactgatttcacaaca

SEQ ID NO: 368671 - DNA, 13 bp, Homo sapiens
tcagcactgtccc

SEQ ID NO: 368672 - DNA, 14 bp, Homo sapiens
tcagcactgtccct

SEQ ID NO: 368673 - DNA, 23 bp, Homo sapiens
tcagcacttgggggatctgttgt

SEQ ID NO: 368674 - DNA, 13 bp, Homo sapiens
tcagcagaaaccc

SEQ ID NO: 368675 - DNA, 17 bp, Homo sapiens
tcagcagaaacccccag

SEQ ID NO: 368676 - DNA, 21 bp, Homo sapiens
tcagcagaaacccccaggagg

SEQ ID NO: 368677 - DNA, 14 bp, Homo sapiens
tcagcagacactcc

SEQ ID NO: 368678 - DNA, 15 bp, Homo sapiens
tcagcagacactcca

SEQ ID NO: 368679 - DNA, 17 bp, Homo sapiens
tcagcagccccctgccc

SEQ ID NO: 368680 - DNA, 23 bp, Homo sapiens
tcagcaggggggttgggttccag

SEQ ID NO: 368681 - DNA, 18 bp, Homo sapiens
tcagcaggggtgggaggc

SEQ ID NO: 368682 - DNA, 12 bp, Homo sapiens
tcagcagtgatt

SEQ ID NO: 368683 - DNA, 18 bp, Homo sapiens
tcagcagtgattgaagta

SEQ ID NO: 368684 - DNA, 14 bp, Homo sapiens
tcagcagttgacat

SEQ ID NO: 368685 - DNA, 15 bp, Homo sapiens
tcagcagttgacatc

SEQ ID NO: 368686 - DNA, 15 bp, Homo sapiens
tcagcatcaaacatg

SEQ ID NO: 368687 - DNA, 18 bp, Homo sapiens
tcagcatcaaacatgaaa

SEQ ID NO: 368688 - DNA, 20 bp, Homo sapiens
tcagcatcaaacatgaaaac

SEQ ID NO: 368689 - DNA, 18 bp, Homo sapiens
tcagcatgaaaatgtgtg

SEQ ID NO: 368690 - DNA, 23 bp, Homo sapiens
tcagcattctcactcctacctgg

SEQ ID NO: 368691 - DNA, 14 bp, Homo sapiens
tcagccaaatgact

SEQ ID NO: 368692 - DNA, 21 bp, Homo sapiens
tcagccaaatgacttcatttc

SEQ ID NO: 368693 - DNA, 16 bp, Homo sapiens
tcagccaaatgtaatt

SEQ ID NO: 368694 - DNA, 22 bp, Homo sapiens
tcagccaaatgtaattgaataa

SEQ ID NO: 368695 - DNA, 23 bp, Homo sapiens
tcagccaaatgtaattgaataaa

SEQ ID NO: 368696 - DNA, 22 bp, Homo sapiens
tcagccaagaattcttaaatat

SEQ ID NO: 368697 - DNA, 16 bp, Homo sapiens
tcagccaatttgtctc

SEQ ID NO: 368698 - DNA, 17 bp, Homo sapiens
tcagccaatttgtctcc

SEQ ID NO: 368699 - DNA, 14 bp, Homo sapiens
tcagccagctgccc

SEQ ID NO: 368700 - DNA, 17 bp, Homo sapiens
tcagcccacccccctca

SEQ ID NO: 368701 - DNA, 18 bp, Homo sapiens
tcagcccacccccctcat

SEQ ID NO: 368702 - DNA, 16 bp, Homo sapiens
tcagccccagcccagc

SEQ ID NO: 368703 - DNA, 17 bp, Homo sapiens
tcagccccagcccagcc

SEQ ID NO: 368704 - DNA, 17 bp, Homo sapiens
tcagccccagggccctg

SEQ ID NO: 368705 - DNA, 20 bp, Homo sapiens
tcagccccagggccctgctc

SEQ ID NO: 368706 - DNA, 13 bp, Homo sapiens
tcagccccggcca

SEQ ID NO: 368707 - DNA, 14 bp, Homo sapiens
tcagccccggccac

SEQ ID NO: 368708 - DNA, 15 bp, Homo sapiens
tcagccccggccact

SEQ ID NO: 368709 - DNA, 18 bp, Homo sapiens
tcagccccggccactccc

SEQ ID NO: 368710 - DNA, 22 bp, Homo sapiens
tcagccccggccactccctgcc

SEQ ID NO: 368711 - DNA, 23 bp, Homo sapiens
tcagccccggccactccctgcca

SEQ ID NO: 368712 - DNA, 20 bp, Homo sapiens
tcagcccctcttgcccccca

SEQ ID NO: 368713 - DNA, 23 bp, Homo sapiens
tcagccctagaggcgagccaggc

SEQ ID NO: 368714 - DNA, 15 bp, Homo sapiens
tcagccctccctgcc

SEQ ID NO: 368715 - DNA, 17 bp, Homo sapiens
tcagccctccctgcccc

SEQ ID NO: 368716 - DNA, 18 bp, Homo sapiens
tcagccctccctgcccct

SEQ ID NO: 368717 - DNA, 16 bp, Homo sapiens
tcatagttctgttaaa

SEQ ID NO: 368718 - DNA, 14 bp, Homo sapiens
tcatagtttctgta

SEQ ID NO: 368719 - DNA, 12 bp, Homo sapiens
tcatataaagtg

SEQ ID NO: 368720 - DNA, 23 bp, Homo sapiens
tcatatcctccgccctttttgtc

SEQ ID NO: 368721 - DNA, 15 bp, Homo sapiens
tcatatctctccctt

SEQ ID NO: 368722 - DNA, 20 bp, Homo sapiens
tcatatctctcccttcttta

SEQ ID NO: 368723 - DNA, 22 bp, Homo sapiens
tcatatctctcccttctttacc

SEQ ID NO: 368724 - DNA, 17 bp, Homo sapiens
tcatatgagtatcttta

SEQ ID NO: 368725 - DNA, 17 bp, Homo sapiens
tcatatggcccagtgtc

SEQ ID NO: 368726 - DNA, 18 bp, Homo sapiens
tcatatgtatctaaatga

SEQ ID NO: 368727 - DNA, 23 bp, Homo sapiens
tcatatgtatctaaatgaaaaga

SEQ ID NO: 368728 - DNA, 17 bp, Homo sapiens
tcatatgtgaagacaga

SEQ ID NO: 368729 - DNA, 15 bp, Homo sapiens
tcatatgttgctcag

SEQ ID NO: 368730 - DNA, 17 bp, Homo sapiens
tcatattcctgcagcct

SEQ ID NO: 368731 - DNA, 20 bp, Homo sapiens
tcatatttacttcttataca

SEQ ID NO: 368732 - DNA, 22 bp, Homo sapiens
tcatatttacttcttatacatt

SEQ ID NO: 368733 - DNA, 12 bp, Homo sapiens
tcatatttgcaa

SEQ ID NO: 368734 - DNA, 15 bp, Homo sapiens
tcatatttttacaaa

SEQ ID NO: 368735 - DNA, 13 bp, Homo sapiens
tcatcaaaaagag

SEQ ID NO: 368736 - DNA, 22 bp, Homo sapiens
tcatcaaataaaccttgtttct

SEQ ID NO: 368737 - DNA, 23 bp, Homo sapiens
tcatcaacaaaagggagaacatg

SEQ ID NO: 368738 - DNA, 24 bp, Homo sapiens
tcatcaatacttttgtgtattctg

SEQ ID NO: 368739 - DNA, 15 bp, Homo sapiens
tcatcactccctgga

SEQ ID NO: 368740 - DNA, 19 bp, Homo sapiens
tcatcactccctggatgtg

SEQ ID NO: 368741 - DNA, 15 bp, Homo sapiens
tcatcactggatgaa

SEQ ID NO: 368742 - DNA, 15 bp, Homo sapiens
tcatcacttttcagt

SEQ ID NO: 368743 - DNA, 23 bp, Homo sapiens
tcatcaggcttggaatgaattct

SEQ ID NO: 368744 - DNA, 20 bp, Homo sapiens
tcatcagtaagtataacaaa

SEQ ID NO: 368745 - DNA, 15 bp, Homo sapiens
tcatcagtattgtgt

SEQ ID NO: 368746 - DNA, 19 bp, Homo sapiens
tcatcataaaataaagtat

SEQ ID NO: 368747 - DNA, 20 bp, Homo sapiens
tcatcatgggggatttttca

SEQ ID NO: 368748 - DNA, 15 bp, Homo sapiens
tcatccaatcctcac

SEQ ID NO: 368749 - DNA, 19 bp, Homo sapiens
tcatccaatcctcactggg

SEQ ID NO: 368750 - DNA, 20 bp, Homo sapiens
tcatccaatcctcactgggt

SEQ ID NO: 368751 - DNA, 18 bp, Homo sapiens
tcatccacacaacaccag

SEQ ID NO: 368752 - DNA, 15 bp, Homo sapiens
tcatccacagaggcc

SEQ ID NO: 368753 - DNA, 18 bp, Homo sapiens
tcatccacagaggccagg

SEQ ID NO: 368754 - DNA, 21 bp, Homo sapiens
tcatccactaggtgcccagtc

SEQ ID NO: 368755 - DNA, 21 bp, Homo sapiens
tcatccagactcctcatggat

SEQ ID NO: 368756 - DNA, 13 bp, Homo sapiens
tcatccatagaca

SEQ ID NO: 368757 - DNA, 20 bp, Homo sapiens
tcatcccagcacctgccagg

SEQ ID NO: 368758 - DNA, 21 bp, Homo sapiens
tcatccccaggggtcccagcc

SEQ ID NO: 368759 - DNA, 20 bp, Homo sapiens
tcatcccctcgtcctgtccc

SEQ ID NO: 368760 - DNA, 22 bp, Homo sapiens
tcatcctgcttctcttttcctc

SEQ ID NO: 368761 - DNA, 13 bp, Homo sapiens
tcatcctggcctc

SEQ ID NO: 368762 - DNA, 18 bp, Homo sapiens
tcatcctgtgtcccctga

SEQ ID NO: 368763 - DNA, 20 bp, Homo sapiens
tcatcctgtgtcccctgacc

SEQ ID NO: 368764 - DNA, 21 bp, Homo sapiens
tcatcctgttggctgctgcca

SEQ ID NO: 368765 - DNA, 23 bp, Homo sapiens
tcatcctgttggctgctgccacc

SEQ ID NO: 368766 - DNA, 22 bp, Homo sapiens
tcatccttctggaataaggaga

SEQ ID NO: 368767 - DNA, 22 bp, Homo sapiens
tcatctccagggagtcccctcc

SEQ ID NO: 368768 - DNA, 13 bp, Homo sapiens
tcatctctgctga

SEQ ID NO: 368769 - DNA, 12 bp, Homo sapiens
tcatctgaggag

SEQ ID NO: 368770 - DNA, 12 bp, Homo sapiens
tcatctgggctg

SEQ ID NO: 368771 - DNA, 13 bp, Homo sapiens
tcatctgggctgg

SEQ ID NO: 368772 - DNA, 14 bp, Homo sapiens
tcatctgggctggc

SEQ ID NO: 368773 - DNA, 17 bp, Homo sapiens
tcatctgtagatactag

SEQ ID NO: 368774 - DNA, 11 bp, Homo sapiens
tcatctgtcag

SEQ ID NO: 368775 - DNA, 14 bp, Homo sapiens
tcatctgtgtgaaa

SEQ ID NO: 368776 - DNA, 18 bp, Homo sapiens
tcatcttccctttcctcc

SEQ ID NO: 368777 - DNA, 23 bp, Homo sapiens
tcatcttccctttcctcccttct

SEQ ID NO: 368778 - DNA, 22 bp, Homo sapiens
tcatcttggtactactagatgt

SEQ ID NO: 368779 - DNA, 13 bp, Homo sapiens
tcatctttccaaa

SEQ ID NO: 368780 - DNA, 13 bp, Homo sapiens
tcatctttttccc

SEQ ID NO: 368781 - DNA, 14 bp, Homo sapiens
tcatctttttcccc

SEQ ID NO: 368782 - DNA, 21 bp, Homo sapiens
tcatgaaagcacctgccctct

SEQ ID NO: 368783 - DNA, 21 bp, Homo sapiens
tcatgaatcactgcacctctt

SEQ ID NO: 368784 - DNA, 13 bp, Homo sapiens
tcatgaatgtaaa

SEQ ID NO: 368785 - DNA, 14 bp, Homo sapiens
tcatgaatgtaaat

SEQ ID NO: 368786 - DNA, 19 bp, Homo sapiens
tcatgaatgtaaatttgta

SEQ ID NO: 368787 - DNA, 20 bp, Homo sapiens
tcatgaatgtaaatttgtac

SEQ ID NO: 368788 - DNA, 19 bp, Homo sapiens
tcatgaattttacatggta

SEQ ID NO: 368789 - DNA, 24 bp, Homo sapiens
tcatgacaacactacacgcaccca

SEQ ID NO: 368790 - DNA, 18 bp, Homo sapiens
tcatgaccaatcctatgt

SEQ ID NO: 368791 - DNA, 20 bp, Homo sapiens
tcatgaccactgggcctgct

SEQ ID NO: 368792 - DNA, 17 bp, Homo sapiens
tcatgacttttccatgt

SEQ ID NO: 368793 - DNA, 22 bp, Homo sapiens
tcatgagattggtcattaaata

SEQ ID NO: 368794 - DNA, 22 bp, Homo sapiens
tcatgatccacccacctcagcc

SEQ ID NO: 368795 - DNA, 13 bp, Homo sapiens
tcatgatgctcat

SEQ ID NO: 368796 - DNA, 22 bp, Homo sapiens
tcatgatgtctgcaaaggaggg

SEQ ID NO: 368797 - DNA, 15 bp, Homo sapiens
tcatgattagacaat

SEQ ID NO: 368798 - DNA, 16 bp, Homo sapiens
tcatgattagacaatg

SEQ ID NO: 368799 - DNA, 14 bp, Homo sapiens
tcatgattagcaag

SEQ ID NO: 368800 - DNA, 13 bp, Homo sapiens
tcatgcaatgaca

SEQ ID NO: 368801 - DNA, 16 bp, Homo sapiens
tcatgcaatgacatct

SEQ ID NO: 368802 - DNA, 16 bp, Homo sapiens
tcatgcactgcaaata

SEQ ID NO: 368803 - DNA, 22 bp, Homo sapiens
tcatgccaccatggccagccaa

SEQ ID NO: 368804 - DNA, 14 bp, Homo sapiens
tcatgcctggcccc

SEQ ID NO: 368805 - DNA, 19 bp, Homo sapiens
tcatgcctggcccccctcc

SEQ ID NO: 368806 - DNA, 21 bp, Homo sapiens
tcatgcctggcccccctccag

SEQ ID NO: 368807 - DNA, 23 bp, Homo sapiens
tcatgcctggcccccctccaggc

SEQ ID NO: 368808 - DNA, 16 bp, Homo sapiens
tcatgcctttgtaagt

SEQ ID NO: 368809 - DNA, 17 bp, Homo sapiens
tcatgcggcccagccat

SEQ ID NO: 368810 - DNA, 21 bp, Homo sapiens
tcatgcttataagcaacatga

SEQ ID NO: 368811 - DNA, 13 bp, Homo sapiens
tcatggcaggcat

SEQ ID NO: 368812 - DNA, 18 bp, Homo sapiens
tcatggcgtaatgggcct

SEQ ID NO: 368813 - DNA, 21 bp, Homo sapiens
tcatggctaagcttaaaaaaa

SEQ ID NO: 368814 - DNA, 16 bp, Homo sapiens
tcatggctcactgcag

SEQ ID NO: 368815 - DNA, 22 bp, Homo sapiens
tcatgggttatgtgtatgtgcc

SEQ ID NO: 368816 - DNA, 16 bp, Homo sapiens
tcatggtctcagtcat

SEQ ID NO: 368817 - DNA, 13 bp, Homo sapiens
tcatggtctcttc

SEQ ID NO: 368818 - DNA, 15 bp, Homo sapiens
tcatggtgaggctta

SEQ ID NO: 368819 - DNA, 19 bp, Homo sapiens
tcatggtgatcagtgcaat

SEQ ID NO: 368820 - DNA, 15 bp, Homo sapiens
tcatggtgatgcaag

SEQ ID NO: 368821 - DNA, 15 bp, Homo sapiens
tcatgtaaataaata

SEQ ID NO: 368822 - DNA, 17 bp, Homo sapiens
tcatgtaccaagtgctt

SEQ ID NO: 368823 - DNA, 16 bp, Homo sapiens
tcatgtaccatcaata

SEQ ID NO: 368824 - DNA, 17 bp, Homo sapiens
tcatgtcaacttctggc

SEQ ID NO: 368825 - DNA, 18 bp, Homo sapiens
tcatgtcaacttctggct

SEQ ID NO: 368826 - DNA, 13 bp, Homo sapiens
tcatgtcatttct

SEQ ID NO: 368827 - DNA, 15 bp, Homo sapiens
tcatgtgatctatta

SEQ ID NO: 368828 - DNA, 22 bp, Homo sapiens
tcatgtgctctgttttgacata

SEQ ID NO: 368829 - DNA, 16 bp, Homo sapiens
tcatgtgctttgtagc

SEQ ID NO: 368830 - DNA, 20 bp, Homo sapiens
tcatgtgggtgagccagtgg

SEQ ID NO: 368831 - DNA, 14 bp, Homo sapiens
tcatgtgtataaaa

SEQ ID NO: 368832 - DNA, 15 bp, Homo sapiens
tcatgtgtcagctgt

SEQ ID NO: 368833 - DNA, 20 bp, Homo sapiens
tcatgtgtcagctgtagaaa

SEQ ID NO: 368834 - DNA, 15 bp, Homo sapiens
tcatgtgttgcaaat

SEQ ID NO: 368835 - DNA, 18 bp, Homo sapiens
tcatgttaattgatagaa

SEQ ID NO: 368836 - DNA, 12 bp, Homo sapiens
tcatgttatttt

SEQ ID NO: 368837 - DNA, 14 bp, Homo sapiens
tcatgttattttat

SEQ ID NO: 368838 - DNA, 14 bp, Homo sapiens
tcatgtttccctac

SEQ ID NO: 368839 - DNA, 18 bp, Homo sapiens
tcatgttttaaaagtttg

SEQ ID NO: 368840 - DNA, 23 bp, Homo sapiens
tcatgttttaaaagtttgtcctt

SEQ ID NO: 368841 - DNA, 14 bp, Homo sapiens
tcatgttttgctaa

SEQ ID NO: 368842 - DNA, 17 bp, Homo sapiens
tcatgttttgctaatgc

SEQ ID NO: 368843 - DNA, 16 bp, Homo sapiens
tcatgttttgtgacta

SEQ ID NO: 368844 - DNA, 22 bp, Homo sapiens
tcattaaaagttttatgtactt

SEQ ID NO: 368845 - DNA, 20 bp, Homo sapiens
tcattaaaatggaagtggat

SEQ ID NO: 368846 - DNA, 16 bp, Homo sapiens
tcattaaacatgaatt

SEQ ID NO: 368847 - DNA, 12 bp, Homo sapiens
tccactttcctc

SEQ ID NO: 368848 - DNA, 22 bp, Homo sapiens
tccactttgttggcccttccag

SEQ ID NO: 368849 - DNA, 22 bp, Homo sapiens
tccagaaaatagggtggacaga

SEQ ID NO: 368850 - DNA, 19 bp, Homo sapiens
tccagaaagcaggagcagc

SEQ ID NO: 368851 - DNA, 20 bp, Homo sapiens
tccagaaagcaggagcagct

SEQ ID NO: 368852 - DNA, 21 bp, Homo sapiens
tccagaaagcaggagcagctg

SEQ ID NO: 368853 - DNA, 19 bp, Homo sapiens
tccagaaaggatatttaag

SEQ ID NO: 368854 - DNA, 16 bp, Homo sapiens
tccagaaattcttcaa

SEQ ID NO: 368855 - DNA, 20 bp, Homo sapiens
tccagaacaaacctctatat

SEQ ID NO: 368856 - DNA, 15 bp, Homo sapiens
tccagaacagccctc

SEQ ID NO: 368857 - DNA, 22 bp, Homo sapiens
tccagaaccagtgtctgaacca

SEQ ID NO: 368858 - DNA, 21 bp, Homo sapiens
tccagaagaaattatttaata

SEQ ID NO: 368859 - DNA, 16 bp, Homo sapiens
tccagaagaatattca

SEQ ID NO: 368860 - DNA, 19 bp, Homo sapiens
tccagaagaatattcagga

SEQ ID NO: 368861 - DNA, 18 bp, Homo sapiens
tccagaagcctctggcta

SEQ ID NO: 368862 - DNA, 19 bp, Homo sapiens
tccagaagcctctggctag

SEQ ID NO: 368863 - DNA, 13 bp, Homo sapiens
tccagaaggaagc

SEQ ID NO: 368864 - DNA, 14 bp, Homo sapiens
tccagaaggaagct

SEQ ID NO: 368865 - DNA, 19 bp, Homo sapiens
tccagaaggccacaggcca

SEQ ID NO: 368866 - DNA, 23 bp, Homo sapiens
tccagaaggccacaggccactgc

SEQ ID NO: 368867 - DNA, 21 bp, Homo sapiens
tccagaagttttaacttccag

SEQ ID NO: 368868 - DNA, 23 bp, Homo sapiens
tccagaatatctgggattctact

SEQ ID NO: 368869 - DNA, 12 bp, Homo sapiens
tccagaatgtaa

SEQ ID NO: 368870 - DNA, 14 bp, Homo sapiens
tccagaatgtaaga

SEQ ID NO: 368871 - DNA, 17 bp, Homo sapiens
tccagaatgtaagaaaa

SEQ ID NO: 368872 - DNA, 15 bp, Homo sapiens
tccagaatttcccaa

SEQ ID NO: 368873 - DNA, 22 bp, Homo sapiens
tccagacagagtggatctggag

SEQ ID NO: 368874 - DNA, 20 bp, Homo sapiens
tccagaccaaaataatacaa

SEQ ID NO: 368875 - DNA, 13 bp, Homo sapiens
tccagacccccac

SEQ ID NO: 368876 - DNA, 14 bp, Homo sapiens
tccagacccccagc

SEQ ID NO: 368877 - DNA, 18 bp, Homo sapiens
tccagacccctggctttt

SEQ ID NO: 368878 - DNA, 13 bp, Homo sapiens
tccagaccctgcc

SEQ ID NO: 368879 - DNA, 16 bp, Homo sapiens
tccagaccctgcctga

SEQ ID NO: 368880 - DNA, 17 bp, Homo sapiens
tccagaccctgcctgag

SEQ ID NO: 368881 - DNA, 20 bp, Homo sapiens
tccagaccctgcctgagccc

SEQ ID NO: 368882 - DNA, 14 bp, Homo sapiens
tccagacctgggcc

SEQ ID NO: 368883 - DNA, 18 bp, Homo sapiens
tccagacctgggccctgg

SEQ ID NO: 368884 - DNA, 19 bp, Homo sapiens
tccagactcaggttccaga

SEQ ID NO: 368885 - DNA, 22 bp, Homo sapiens
tccagactcgagagggctgagc

SEQ ID NO: 368886 - DNA, 23 bp, Homo sapiens
tccagactcgagagggctgagcc

SEQ ID NO: 368887 - DNA, 12 bp, Homo sapiens
tccagactgtaa

SEQ ID NO: 368888 - DNA, 13 bp, Homo sapiens
tccagactgtaag

SEQ ID NO: 368889 - DNA, 19 bp, Homo sapiens
tccagactgtaagatgttg

SEQ ID NO: 368890 - DNA, 21 bp, Homo sapiens
tccagacttcgctattcccag

SEQ ID NO: 368891 - DNA, 23 bp, Homo sapiens
tccagacttcgctattcccaggc

SEQ ID NO: 368892 - DNA, 18 bp, Homo sapiens
tccagagaccacaccact

SEQ ID NO: 368893 - DNA, 18 bp, Homo sapiens
tccagagagaagcacccc

SEQ ID NO: 368894 - DNA, 15 bp, Homo sapiens
tccagagagtggctc

SEQ ID NO: 368895 - DNA, 22 bp, Homo sapiens
tccagagagtggctcctcccgg

SEQ ID NO: 368896 - DNA, 10 bp, Homo sapiens
tccagagcca

SEQ ID NO: 368897 - DNA, 15 bp, Homo sapiens
tccagagccagcctg

SEQ ID NO: 368898 - DNA, 20 bp, Homo sapiens
tccagagcctaagaaaatca

SEQ ID NO: 368899 - DNA, 13 bp, Homo sapiens
tccagagcttttc

SEQ ID NO: 368900 - DNA, 17 bp, Homo sapiens
tccagagtccggaggca

SEQ ID NO: 368901 - DNA, 19 bp, Homo sapiens
tccagagtccggaggcagc

SEQ ID NO: 368902 - DNA, 16 bp, Homo sapiens
tccagatccagactgt

SEQ ID NO: 368903 - DNA, 14 bp, Homo sapiens
tccagattgtagct

SEQ ID NO: 368904 - DNA, 22 bp, Homo sapiens
tccagattttttacagctgcct

SEQ ID NO: 368905 - DNA, 15 bp, Homo sapiens
tccagcaattgtgtg

SEQ ID NO: 368906 - DNA, 15 bp, Homo sapiens
tccagcacagactgt

SEQ ID NO: 368907 - DNA, 13 bp, Homo sapiens
tccagcagctgcg

SEQ ID NO: 368908 - DNA, 20 bp, Homo sapiens
tccagcagtgctgggcccag

SEQ ID NO: 368909 - DNA, 22 bp, Homo sapiens
tccagcagtgctgggcccagcc

SEQ ID NO: 368910 - DNA, 23 bp, Homo sapiens
tccagcagtgctgggcccagccg

SEQ ID NO: 368911 - DNA, 15 bp, Homo sapiens
tccagcatccagcct

SEQ ID NO: 368912 - DNA, 12 bp, Homo sapiens
tccagcatgtgt

SEQ ID NO: 368913 - DNA, 13 bp, Homo sapiens
tccagcatgtgtg

SEQ ID NO: 368914 - DNA, 14 bp, Homo sapiens
tccagcatgtgtgt

SEQ ID NO: 368915 - DNA, 20 bp, Homo sapiens
tccagcatgtgtgtgtctct

SEQ ID NO: 368916 - DNA, 20 bp, Homo sapiens
tccagccaacccctgtggag

SEQ ID NO: 368917 - DNA, 23 bp, Homo sapiens
tccagccaacccctgtggagccc

SEQ ID NO: 368918 - DNA, 17 bp, Homo sapiens
tccagccacccagccag

SEQ ID NO: 368919 - DNA, 14 bp, Homo sapiens
tccagcccacagtg

SEQ ID NO: 368920 - DNA, 19 bp, Homo sapiens
tccagcccacagtgctcag

SEQ ID NO: 368921 - DNA, 20 bp, Homo sapiens
tccagcccacagtgctcagt

SEQ ID NO: 368922 - DNA, 12 bp, Homo sapiens
tccagcccaccc

SEQ ID NO: 368923 - DNA, 15 bp, Homo sapiens
tccagcccagacatc

SEQ ID NO: 368924 - DNA, 16 bp, Homo sapiens
tccagccccatagaaa

SEQ ID NO: 368925 - DNA, 18 bp, Homo sapiens
tccagccccatagaaaac

SEQ ID NO: 368926 - DNA, 21 bp, Homo sapiens
tccagccgcaaatccataccc

SEQ ID NO: 368927 - DNA, 18 bp, Homo sapiens
tccagccgccattgccac

SEQ ID NO: 368928 - DNA, 20 bp, Homo sapiens
tccagccgccattgccacca

SEQ ID NO: 368929 - DNA, 21 bp, Homo sapiens
tccagccgccattgccaccag

SEQ ID NO: 368930 - DNA, 13 bp, Homo sapiens
tccagcctctccc

SEQ ID NO: 368931 - DNA, 16 bp, Homo sapiens
tccagcctctcccggc

SEQ ID NO: 368932 - DNA, 20 bp, Homo sapiens
tccagcctgagatgtaggct

SEQ ID NO: 368933 - DNA, 23 bp, Homo sapiens
tccagcctgggcagccaggctgc

SEQ ID NO: 368934 - DNA, 22 bp, Homo sapiens
tccagcctgggtgacagagcga

SEQ ID NO: 368935 - DNA, 23 bp, Homo sapiens
tccagcctgggtgacagagcgag

SEQ ID NO: 368936 - DNA, 14 bp, Homo sapiens
tccagcctgtgtgt

SEQ ID NO: 368937 - DNA, 21 bp, Homo sapiens
tccagcgggccctctgccgac

SEQ ID NO: 368938 - DNA, 16 bp, Homo sapiens
tccagcgtcttctaga

SEQ ID NO: 368939 - DNA, 22 bp, Homo sapiens
tccagctaagcctgatgatgga

SEQ ID NO: 368940 - DNA, 18 bp, Homo sapiens
tccagctctaataaaaca

SEQ ID NO: 368941 - DNA, 15 bp, Homo sapiens
tccagctctcccctg

SEQ ID NO: 368942 - DNA, 14 bp, Homo sapiens
tccagctctgcccc

SEQ ID NO: 368943 - DNA, 22 bp, Homo sapiens
tccagctgattttaactttttt

SEQ ID NO: 368944 - DNA, 11 bp, Homo sapiens
tccagcttccc

SEQ ID NO: 368945 - DNA, 19 bp, Homo sapiens
tccagcttctggtactctc

SEQ ID NO: 368946 - DNA, 16 bp, Homo sapiens
tccaggaaggcagctg

SEQ ID NO: 368947 - DNA, 20 bp, Homo sapiens
tccaggaaggcagctgctct

SEQ ID NO: 368948 - DNA, 23 bp, Homo sapiens
tccaggaaggcagctgctcttag

SEQ ID NO: 368949 - DNA, 20 bp, Homo sapiens
tccaggaaggcggggcttca

SEQ ID NO: 368950 - DNA, 13 bp, Homo sapiens
tccaggagcccca

SEQ ID NO: 368951 - DNA, 14 bp, Homo sapiens
tccaggagccccag

SEQ ID NO: 368952 - DNA, 19 bp, Homo sapiens
tccaggagccccagccagc

SEQ ID NO: 368953 - DNA, 21 bp, Homo sapiens
tccaggagccccagccagccc

SEQ ID NO: 368954 - DNA, 23 bp, Homo sapiens
tccaggagccccagccagccctt

SEQ ID NO: 368955 - DNA, 21 bp, Homo sapiens
tccaggagggcatcagctttc

SEQ ID NO: 368956 - DNA, 15 bp, Homo sapiens
tccaggatccagaag

SEQ ID NO: 368957 - DNA, 19 bp, Homo sapiens
tccaggatcctcctggagc

SEQ ID NO: 368958 - DNA, 20 bp, Homo sapiens
tccaggatcctcctggagca

SEQ ID NO: 368959 - DNA, 14 bp, Homo sapiens
tccaggatcctgca

SEQ ID NO: 368960 - DNA, 21 bp, Homo sapiens
tccaggattgtccacaaatgt

SEQ ID NO: 368961 - DNA, 21 bp, Homo sapiens
tccaggcaggacgagactcct

SEQ ID NO: 368962 - DNA, 14 bp, Homo sapiens
tccaggcatgctgg

SEQ ID NO: 368963 - DNA, 17 bp, Homo sapiens
tccaggcatgctggcct

SEQ ID NO: 368964 - DNA, 18 bp, Homo sapiens
tccaggcatgctggcctc

SEQ ID NO: 368965 - DNA, 21 bp, Homo sapiens
tccaggccatcagaggcctag

SEQ ID NO: 368966 - DNA, 14 bp, Homo sapiens
tccaggcccagcct

SEQ ID NO: 368967 - DNA, 17 bp, Homo sapiens
tccaggcccctgaggac

SEQ ID NO: 368968 - DNA, 20 bp, Homo sapiens
tccaggcccctgaggactgg

SEQ ID NO: 368969 - DNA, 16 bp, Homo sapiens
tccaggcctgaggctg

SEQ ID NO: 368970 - DNA, 17 bp, Homo sapiens
tccaggcgtagggccag

SEQ ID NO: 368971 - DNA, 23 bp, Homo sapiens
tccaggcgtagggccagggctct

SEQ ID NO: 368972 - DNA, 19 bp, Homo sapiens
tccaggctagtccggaccc

SEQ ID NO: 368973 - DNA, 15 bp, Homo sapiens
tccaggctccaggct

SEQ ID NO: 368974 - DNA, 14 bp, Homo sapiens
tccaggctcttcct

SEQ ID NO: 368975 - DNA, 23 bp, Homo sapiens
tccaggctgactgggggcctctg

SEQ ID NO: 368976 - DNA, 10 bp, Homo sapiens
tcccaggccg

SEQ ID NO: 368977 - DNA, 17 bp, Homo sapiens
tcccaggccgcatggcc

SEQ ID NO: 368978 - DNA, 18 bp, Homo sapiens
tcccaggcgccccttccc

SEQ ID NO: 368979 - DNA, 15 bp, Homo sapiens
tcccaggcttcaccc

SEQ ID NO: 368980 - DNA, 18 bp, Homo sapiens
tcccaggcttcaccctga

SEQ ID NO: 368981 - DNA, 22 bp, Homo sapiens
tcccaggcttcaccctgaatgg

SEQ ID NO: 368982 - DNA, 14 bp, Homo sapiens
tcccagggaaggac

SEQ ID NO: 368983 - DNA, 11 bp, Homo sapiens
tcccagggccc

SEQ ID NO: 368984 - DNA, 22 bp, Homo sapiens
tcccaggggtctccctgagcct

SEQ ID NO: 368985 - DNA, 20 bp, Homo sapiens
tcccaggtataaaacctaaa

SEQ ID NO: 368986 - DNA, 21 bp, Homo sapiens
tcccaggtggattttgtggag

SEQ ID NO: 368987 - DNA, 20 bp, Homo sapiens
tcccagtccaaatgtcctcc

SEQ ID NO: 368988 - DNA, 15 bp, Homo sapiens
tcccagtcctccaga

SEQ ID NO: 368989 - DNA, 16 bp, Homo sapiens
tcccagtcctccagac

SEQ ID NO: 368990 - DNA, 15 bp, Homo sapiens
tcccagtgaattctt

SEQ ID NO: 368991 - DNA, 20 bp, Homo sapiens
tcccagtgacacttcagaga

SEQ ID NO: 368992 - DNA, 13 bp, Homo sapiens
tcccagttcatgt

SEQ ID NO: 368993 - DNA, 17 bp, Homo sapiens
tcccagttcatgttgct

SEQ ID NO: 368994 - DNA, 17 bp, Homo sapiens
tcccatagccaggaaac

SEQ ID NO: 368995 - DNA, 16 bp, Homo sapiens
tcccatcaccccttcc

SEQ ID NO: 368996 - DNA, 12 bp, Homo sapiens
tcccatcactgc

SEQ ID NO: 368997 - DNA, 18 bp, Homo sapiens
tcccatccatcagctccc

SEQ ID NO: 368998 - DNA, 17 bp, Homo sapiens
tcccatcgctggaaaac

SEQ ID NO: 368999 - DNA, 15 bp, Homo sapiens
tcccatctccttccc

SEQ ID NO: 369000 - DNA, 17 bp, Homo sapiens
tcccatctccttccccc

SEQ ID NO: 369001 - DNA, 20 bp, Homo sapiens
tcccatctccttcccccagc

SEQ ID NO: 369002 - DNA, 14 bp, Homo sapiens
tcccatgactgcac

SEQ ID NO: 369003 - DNA, 21 bp, Homo sapiens
tcccatgactgcacccagctc

SEQ ID NO: 369004 - DNA, 23 bp, Homo sapiens
tcccatgactgcacccagctcca

SEQ ID NO: 369005 - DNA, 19 bp, Homo sapiens
tcccatgatccctgtgttg

SEQ ID NO: 369006 - DNA, 19 bp, Homo sapiens
tcccatgcacaactctcca

SEQ ID NO: 369007 - DNA, 21 bp, Homo sapiens
tcccatgcacaactctccaaa

SEQ ID NO: 369008 - DNA, 21 bp, Homo sapiens
tcccatgcacacaaacacctc

SEQ ID NO: 369009 - DNA, 12 bp, Homo sapiens
tcccatgcctgt

SEQ ID NO: 369010 - DNA, 16 bp, Homo sapiens
tcccatgcctgtctct

SEQ ID NO: 369011 - DNA, 19 bp, Homo sapiens
tcccatggatgtttcttct

SEQ ID NO: 369012 - DNA, 14 bp, Homo sapiens
tcccatggcccagc

SEQ ID NO: 369013 - DNA, 20 bp, Homo sapiens
tcccatggcccagcagcttg

SEQ ID NO: 369014 - DNA, 18 bp, Homo sapiens
tcccatgggggctccaga

SEQ ID NO: 369015 - DNA, 17 bp, Homo sapiens
tcccatggtccctagca

SEQ ID NO: 369016 - DNA, 17 bp, Homo sapiens
tcccatgttgcatgcct

SEQ ID NO: 369017 - DNA, 17 bp, Homo sapiens
tcccattctagatcctg

SEQ ID NO: 369018 - DNA, 21 bp, Homo sapiens
tcccattctagatcctgcacc

SEQ ID NO: 369019 - DNA, 21 bp, Homo sapiens
tcccatttattattttaatat

SEQ ID NO: 369020 - DNA, 12 bp, Homo sapiens
tcccatttgtaa

SEQ ID NO: 369021 - DNA, 17 bp, Homo sapiens
tcccatttgtaatgtat

SEQ ID NO: 369022 - DNA, 16 bp, Homo sapiens
tccccaaccctgcccc

SEQ ID NO: 369023 - DNA, 17 bp, Homo sapiens
tccccaaccctgcccct

SEQ ID NO: 369024 - DNA, 19 bp, Homo sapiens
tccccaaccctgcccctgc

SEQ ID NO: 369025 - DNA, 14 bp, Homo sapiens
tccccaacccttcc

SEQ ID NO: 369026 - DNA, 16 bp, Homo sapiens
tccccaacccttccac

SEQ ID NO: 369027 - DNA, 15 bp, Homo sapiens
tccccaacgtcccct

SEQ ID NO: 369028 - DNA, 19 bp, Homo sapiens
tccccaacgtcccctccgc

SEQ ID NO: 369029 - DNA, 13 bp, Homo sapiens
tccccaactccat

SEQ ID NO: 369030 - DNA, 20 bp, Homo sapiens
tccccaactccttcctcttt

SEQ ID NO: 369031 - DNA, 22 bp, Homo sapiens
tccccaactccttcctctttgc

SEQ ID NO: 369032 - DNA, 17 bp, Homo sapiens
tccccaagaaagcctca

SEQ ID NO: 369033 - DNA, 12 bp, Homo sapiens
tccccaagctgg

SEQ ID NO: 369034 - DNA, 14 bp, Homo sapiens
tccccaagctggcc

SEQ ID NO: 369035 - DNA, 13 bp, Homo sapiens
tccccaaggaaga

SEQ ID NO: 369036 - DNA, 15 bp, Homo sapiens
tccccaatccaaccc

SEQ ID NO: 369037 - DNA, 22 bp, Homo sapiens
tccccaatccaacccatgcatg

SEQ ID NO: 369038 - DNA, 18 bp, Homo sapiens
tccccacagtcctcacag

SEQ ID NO: 369039 - DNA, 13 bp, Homo sapiens
tccccaccagctc

SEQ ID NO: 369040 - DNA, 20 bp, Homo sapiens
tccccaccagtctcacccac

SEQ ID NO: 369041 - DNA, 13 bp, Homo sapiens
tccccaccagtga

SEQ ID NO: 369042 - DNA, 13 bp, Homo sapiens
tccccacccctgc

SEQ ID NO: 369043 - DNA, 20 bp, Homo sapiens
tccccacccctgcctttgtt

SEQ ID NO: 369044 - DNA, 12 bp, Homo sapiens
tccccacctgcg

SEQ ID NO: 369045 - DNA, 16 bp, Homo sapiens
tccccaccttccaagg

SEQ ID NO: 369046 - DNA, 19 bp, Homo sapiens
tccccaccttcccccaact

SEQ ID NO: 369047 - DNA, 21 bp, Homo sapiens
tccccacgagtcacctgcaag

SEQ ID NO: 369048 - DNA, 12 bp, Homo sapiens
tccccactcccg

SEQ ID NO: 369049 - DNA, 19 bp, Homo sapiens
tccccactccctgtccatc

SEQ ID NO: 369050 - DNA, 16 bp, Homo sapiens
tccccactctgctccc

SEQ ID NO: 369051 - DNA, 16 bp, Homo sapiens
tccccagacctgagct

SEQ ID NO: 369052 - DNA, 20 bp, Homo sapiens
tccccagccccctggcccct

SEQ ID NO: 369053 - DNA, 22 bp, Homo sapiens
tccccagccccctggcccctcc

SEQ ID NO: 369054 - DNA, 14 bp, Homo sapiens
tccccagccctgtc

SEQ ID NO: 369055 - DNA, 14 bp, Homo sapiens
tccccagcccttct

SEQ ID NO: 369056 - DNA, 17 bp, Homo sapiens
tccccagcccttctgcc

SEQ ID NO: 369057 - DNA, 19 bp, Homo sapiens
tccccagcccttctgcctt

SEQ ID NO: 369058 - DNA, 15 bp, Homo sapiens
tccccagccctttgc

SEQ ID NO: 369059 - DNA, 11 bp, Homo sapiens
tccccagggcc

SEQ ID NO: 369060 - DNA, 11 bp, Homo sapiens
tccccagtgcc

SEQ ID NO: 369061 - DNA, 16 bp, Homo sapiens
tccccagtgtttttgc

SEQ ID NO: 369062 - DNA, 21 bp, Homo sapiens
tccccagttggggctgcgacc

SEQ ID NO: 369063 - DNA, 16 bp, Homo sapiens
tccccatatataaatt

SEQ ID NO: 369064 - DNA, 22 bp, Homo sapiens
tccccatatataaattattact

SEQ ID NO: 369065 - DNA, 15 bp, Homo sapiens
tccccatatccaagt

SEQ ID NO: 369066 - DNA, 14 bp, Homo sapiens
tccccatccccacc

SEQ ID NO: 369067 - DNA, 17 bp, Homo sapiens
tccccatccccaccagc

SEQ ID NO: 369068 - DNA, 16 bp, Homo sapiens
tccccatcctccagct

SEQ ID NO: 369069 - DNA, 17 bp, Homo sapiens
tccccatcctccagctt

SEQ ID NO: 369070 - DNA, 17 bp, Homo sapiens
tccccattctataaatt

SEQ ID NO: 369071 - DNA, 15 bp, Homo sapiens
tccccatttcctctt

SEQ ID NO: 369072 - DNA, 16 bp, Homo sapiens
tccccatttcctcttc

SEQ ID NO: 369073 - DNA, 23 bp, Homo sapiens
tccccatttcctcttccttctct

SEQ ID NO: 369074 - DNA, 17 bp, Homo sapiens
tcccccaacccccaccc

SEQ ID NO: 369075 - DNA, 13 bp, Homo sapiens
tcccccaccctcc

SEQ ID NO: 369076 - DNA, 17 bp, Homo sapiens
tcccccaccctccatgc

SEQ ID NO: 369077 - DNA, 16 bp, Homo sapiens
tcccccacctcttttc

SEQ ID NO: 369078 - DNA, 15 bp, Homo sapiens
tcccccacctgacaa

SEQ ID NO: 369079 - DNA, 22 bp, Homo sapiens
tcccccacctgacaatggcagc

SEQ ID NO: 369080 - DNA, 23 bp, Homo sapiens
tcccccacctgacaatggcagct

SEQ ID NO: 369081 - DNA, 20 bp, Homo sapiens
tcccccacggccgtccctga

SEQ ID NO: 369082 - DNA, 22 bp, Homo sapiens
tcccccactcctcttatttgct

SEQ ID NO: 369083 - DNA, 13 bp, Homo sapiens
tcccccagccagg

SEQ ID NO: 369084 - DNA, 13 bp, Homo sapiens
tcccccagcccaa

SEQ ID NO: 369085 - DNA, 19 bp, Homo sapiens
tcccccagcccaataaagg

SEQ ID NO: 369086 - DNA, 21 bp, Homo sapiens
tcccccagcccaataaaggtc

SEQ ID NO: 369087 - DNA, 17 bp, Homo sapiens
tcccccagccctgtgga

SEQ ID NO: 369088 - DNA, 12 bp, Homo sapiens
tcccccagcctc

SEQ ID NO: 369089 - DNA, 16 bp, Homo sapiens
tcccccaggaccctga

SEQ ID NO: 369090 - DNA, 21 bp, Homo sapiens
tcccccaggctgcgcctgccc

SEQ ID NO: 369091 - DNA, 19 bp, Homo sapiens
tcccccatcctccccttcc

SEQ ID NO: 369092 - DNA, 21 bp, Homo sapiens
tcccccatcctccccttccct

SEQ ID NO: 369093 - DNA, 12 bp, Homo sapiens
tcccccatgcca

SEQ ID NO: 369094 - DNA, 15 bp, Homo sapiens
tcccccatgccacca

SEQ ID NO: 369095 - DNA, 16 bp, Homo sapiens
tcccccatgccaccac

SEQ ID NO: 369096 - DNA, 12 bp, Homo sapiens
tccccccactct

SEQ ID NO: 369097 - DNA, 18 bp, Homo sapiens
tcccccgacactgctgca

SEQ ID NO: 369098 - DNA, 20 bp, Homo sapiens
tcccccgcagtccccagccc

SEQ ID NO: 369099 - DNA, 21 bp, Homo sapiens
tcccccgcagtccccagccct

SEQ ID NO: 369100 - DNA, 14 bp, Homo sapiens
tcccccgccacctg

SEQ ID NO: 369101 - DNA, 20 bp, Homo sapiens
tcccccgccacctgtgtgtt

SEQ ID NO: 369102 - DNA, 12 bp, Homo sapiens
tccccctaccca

SEQ ID NO: 369103 - DNA, 15 bp, Homo sapiens
tccccctatccttgg

SEQ ID NO: 369104 - DNA, 17 bp, Homo sapiens
tccccctcaacctcacc

SEQ ID NO: 369105 - DNA, 13 bp, Homo sapiens
tccccctccttgc

SEQ ID NO: 369106 - DNA, 14 bp, Homo sapiens
tccccctccttgcc

SEQ ID NO: 369107 - DNA, 13 bp, Homo sapiens
tcccttcctccgc

SEQ ID NO: 369108 - DNA, 13 bp, Homo sapiens
tcccttcctggcc

SEQ ID NO: 369109 - DNA, 15 bp, Homo sapiens
tcccttcctggcctc

SEQ ID NO: 369110 - DNA, 19 bp, Homo sapiens
tcccttctcagaaaacttc

SEQ ID NO: 369111 - DNA, 23 bp, Homo sapiens
tcccttctctgtagggaactctg

SEQ ID NO: 369112 - DNA, 20 bp, Homo sapiens
tcccttctttgcttcttttt

SEQ ID NO: 369113 - DNA, 22 bp, Homo sapiens
tcccttctttgcttctttttct

SEQ ID NO: 369114 - DNA, 23 bp, Homo sapiens
tcccttgaactgttctggcctca

SEQ ID NO: 369115 - DNA, 18 bp, Homo sapiens
tcccttgacctttccagc

SEQ ID NO: 369116 - DNA, 17 bp, Homo sapiens
tcccttgctcagtgcct

SEQ ID NO: 369117 - DNA, 14 bp, Homo sapiens
tcccttggccacgg

SEQ ID NO: 369118 - DNA, 15 bp, Homo sapiens
tcccttggccacggc

SEQ ID NO: 369119 - DNA, 17 bp, Homo sapiens
tcccttggccacggcct

SEQ ID NO: 369120 - DNA, 22 bp, Homo sapiens
tcccttggccacggcctgggag

SEQ ID NO: 369121 - DNA, 16 bp, Homo sapiens
tcccttggcctcagaa

SEQ ID NO: 369122 - DNA, 18 bp, Homo sapiens
tcccttgggctggaagaa

SEQ ID NO: 369123 - DNA, 17 bp, Homo sapiens
tcccttgggttctgata

SEQ ID NO: 369124 - DNA, 16 bp, Homo sapiens
tcccttgtgcgtgggt

SEQ ID NO: 369125 - DNA, 15 bp, Homo sapiens
tcccttgtttttgat

SEQ ID NO: 369126 - DNA, 16 bp, Homo sapiens
tcccttgtttttgatg

SEQ ID NO: 369127 - DNA, 20 bp, Homo sapiens
tccctttccctgcatccctt

SEQ ID NO: 369128 - DNA, 19 bp, Homo sapiens
tccctttcctcccttctga

SEQ ID NO: 369129 - DNA, 14 bp, Homo sapiens
tccctttccttcca

SEQ ID NO: 369130 - DNA, 17 bp, Homo sapiens
tccctttccttccatcc

SEQ ID NO: 369131 - DNA, 18 bp, Homo sapiens
tccctttccttccatccc

SEQ ID NO: 369132 - DNA, 19 bp, Homo sapiens
tccctttccttccatccct

SEQ ID NO: 369133 - DNA, 16 bp, Homo sapiens
tccctttcttggccag

SEQ ID NO: 369134 - DNA, 17 bp, Homo sapiens
tccctttcttggccagt

SEQ ID NO: 369135 - DNA, 15 bp, Homo sapiens
tccctttgacttcag

SEQ ID NO: 369136 - DNA, 17 bp, Homo sapiens
tccctttgacttcagct

SEQ ID NO: 369137 - DNA, 23 bp, Homo sapiens
tccctttgacttcagctgcctga

SEQ ID NO: 369138 - DNA, 13 bp, Homo sapiens
tccctttgctcca

SEQ ID NO: 369139 - DNA, 15 bp, Homo sapiens
tccctttgctccacc

SEQ ID NO: 369140 - DNA, 22 bp, Homo sapiens
tccctttgctccaccccactca

SEQ ID NO: 369141 - DNA, 14 bp, Homo sapiens
tccctttgttgctg

SEQ ID NO: 369142 - DNA, 15 bp, Homo sapiens
tccctttgttgctgt

SEQ ID NO: 369143 - DNA, 17 bp, Homo sapiens
tcccttttttcttcccc

SEQ ID NO: 369144 - DNA, 14 bp, Homo sapiens
tccgaaaaaaaaat

SEQ ID NO: 369145 - DNA, 20 bp, Homo sapiens
tccgacaaccgatgctccag

SEQ ID NO: 369146 - DNA, 12 bp, Homo sapiens
tccgagaactaa

SEQ ID NO: 369147 - DNA, 16 bp, Homo sapiens
tccgagctctgtcctc

SEQ ID NO: 369148 - DNA, 14 bp, Homo sapiens
tccgaggctccccg

SEQ ID NO: 369149 - DNA, 21 bp, Homo sapiens
tccgaggctccccgcctccac

SEQ ID NO: 369150 - DNA, 17 bp, Homo sapiens
tccgagggcggccaggg

SEQ ID NO: 369151 - DNA, 22 bp, Homo sapiens
tccgcaggtcaccttagttcac

SEQ ID NO: 369152 - DNA, 13 bp, Homo sapiens
tccgcccaaatca

SEQ ID NO: 369153 - DNA, 12 bp, Homo sapiens
tccgcccgccca

SEQ ID NO: 369154 - DNA, 16 bp, Homo sapiens
tccgcccgcccacccc

SEQ ID NO: 369155 - DNA, 14 bp, Homo sapiens
tccgccctgggctc

SEQ ID NO: 369156 - DNA, 20 bp, Homo sapiens
tccgcctggcacccactccg

SEQ ID NO: 369157 - DNA, 17 bp, Homo sapiens
tccgctctctcatgtgg

SEQ ID NO: 369158 - DNA, 14 bp, Homo sapiens
tccgctctgaggca

SEQ ID NO: 369159 - DNA, 13 bp, Homo sapiens
tccgctgccacca

SEQ ID NO: 369160 - DNA, 23 bp, Homo sapiens
tccgctgccaccacgtctgccag

SEQ ID NO: 369161 - DNA, 23 bp, Homo sapiens
tccgctgtcacccagcaaggcac

SEQ ID NO: 369162 - DNA, 14 bp, Homo sapiens
tccggaatgaccag

SEQ ID NO: 369163 - DNA, 22 bp, Homo sapiens
tccggagatgaatatgagctca

SEQ ID NO: 369164 - DNA, 15 bp, Homo sapiens
tccggagatgtagca

SEQ ID NO: 369165 - DNA, 15 bp, Homo sapiens
tccggaggcagcaga

SEQ ID NO: 369166 - DNA, 18 bp, Homo sapiens
tccggattccggccctgg

SEQ ID NO: 369167 - DNA, 13 bp, Homo sapiens
tccggcagaggca

SEQ ID NO: 369168 - DNA, 16 bp, Homo sapiens
tccggcagaggcaggg

SEQ ID NO: 369169 - DNA, 17 bp, Homo sapiens
tccggcagaggcagggc

SEQ ID NO: 369170 - DNA, 18 bp, Homo sapiens
tccggcagaggcagggcc

SEQ ID NO: 369171 - DNA, 19 bp, Homo sapiens
tccggcagaggcagggccc

SEQ ID NO: 369172 - DNA, 14 bp, Homo sapiens
tccggcccccagag

SEQ ID NO: 369173 - DNA, 23 bp, Homo sapiens
tccggccctgccccacacaggcc

SEQ ID NO: 369174 - DNA, 15 bp, Homo sapiens
tccggccctggctgg

SEQ ID NO: 369175 - DNA, 14 bp, Homo sapiens
tccggcctcccctc

SEQ ID NO: 369176 - DNA, 13 bp, Homo sapiens
tccggcctgcagc

SEQ ID NO: 369177 - DNA, 20 bp, Homo sapiens
tccggcttggctagtcacat

SEQ ID NO: 369178 - DNA, 23 bp, Homo sapiens
tccgggaccattgacctcagctg

SEQ ID NO: 369179 - DNA, 19 bp, Homo sapiens
tccgggcaggggagccagg

SEQ ID NO: 369180 - DNA, 18 bp, Homo sapiens
tccgggctttcccccagg

SEQ ID NO: 369181 - DNA, 16 bp, Homo sapiens
tccgggtgccattccc

SEQ ID NO: 369182 - DNA, 14 bp, Homo sapiens
tccgtccacccagg

SEQ ID NO: 369183 - DNA, 16 bp, Homo sapiens
tccgtccacccaggct

SEQ ID NO: 369184 - DNA, 18 bp, Homo sapiens
tccgtccacccaggctgc

SEQ ID NO: 369185 - DNA, 21 bp, Homo sapiens
tccgtccccagggtgcaggcg

SEQ ID NO: 369186 - DNA, 13 bp, Homo sapiens
tccgtccgcccgc

SEQ ID NO: 369187 - DNA, 15 bp, Homo sapiens
tccgtccgcccgccc

SEQ ID NO: 369188 - DNA, 18 bp, Homo sapiens
tccgtccgcccgcccacc

SEQ ID NO: 369189 - DNA, 15 bp, Homo sapiens
tccgtcctggcaggg

SEQ ID NO: 369190 - DNA, 18 bp, Homo sapiens
tccgtcctggcagggcag

SEQ ID NO: 369191 - DNA, 13 bp, Homo sapiens
tccgtctcctctc

SEQ ID NO: 369192 - DNA, 21 bp, Homo sapiens
tccgtctcctctccagcccta

SEQ ID NO: 369193 - DNA, 14 bp, Homo sapiens
tccgtgagacacaa

SEQ ID NO: 369194 - DNA, 16 bp, Homo sapiens
tccgtgagacacaaga

SEQ ID NO: 369195 - DNA, 15 bp, Homo sapiens
tccgtgagcagtgtg

SEQ ID NO: 369196 - DNA, 23 bp, Homo sapiens
tccgtgagcagtgtgtctcctgc

SEQ ID NO: 369197 - DNA, 21 bp, Homo sapiens
tccgtggccccgccctcaggc

SEQ ID NO: 369198 - DNA, 16 bp, Homo sapiens
tccgtgtggagcacgt

SEQ ID NO: 369199 - DNA, 21 bp, Homo sapiens
tccgtgtggagcacgtggaga

SEQ ID NO: 369200 - DNA, 22 bp, Homo sapiens
tccgttaacctttttgtaaata

SEQ ID NO: 369201 - DNA, 21 bp, Homo sapiens
tccgttaggaataacactgca

SEQ ID NO: 369202 - DNA, 22 bp, Homo sapiens
tccgttcatctgaggagtccaa

SEQ ID NO: 369203 - DNA, 23 bp, Homo sapiens
tcctaaactgagacaatgccttg

SEQ ID NO: 369204 - DNA, 13 bp, Homo sapiens
tcctaaagtgaag

SEQ ID NO: 369205 - DNA, 15 bp, Homo sapiens
tcctaaatatccaaa

SEQ ID NO: 369206 - DNA, 19 bp, Homo sapiens
tcctaaatgcagtgaattg

SEQ ID NO: 369207 - DNA, 19 bp, Homo sapiens
tcctaagcagtgcttgtaa

SEQ ID NO: 369208 - DNA, 15 bp, Homo sapiens
tcctaagctgttgga

SEQ ID NO: 369209 - DNA, 17 bp, Homo sapiens
tcctaaggacacactaa

SEQ ID NO: 369210 - DNA, 17 bp, Homo sapiens
tcctacaaccaggtctt

SEQ ID NO: 369211 - DNA, 18 bp, Homo sapiens
tcctacaagagcagcctg

SEQ ID NO: 369212 - DNA, 20 bp, Homo sapiens
tcctacaagagcagcctgtg

SEQ ID NO: 369213 - DNA, 17 bp, Homo sapiens
tcctacacccttggact

SEQ ID NO: 369214 - DNA, 18 bp, Homo sapiens
tcctacaggcgctccagg

SEQ ID NO: 369215 - DNA, 14 bp, Homo sapiens
tcctaccaatgcat

SEQ ID NO: 369216 - DNA, 16 bp, Homo sapiens
tcctaccaatgcatgc

SEQ ID NO: 369217 - DNA, 17 bp, Homo sapiens
tcctaccaatgcatgca

SEQ ID NO: 369218 - DNA, 15 bp, Homo sapiens
tcctaccattatggc

SEQ ID NO: 369219 - DNA, 14 bp, Homo sapiens
tcctaccccacctc

SEQ ID NO: 369220 - DNA, 15 bp, Homo sapiens
tcctacccctgtcct

SEQ ID NO: 369221 - DNA, 16 bp, Homo sapiens
tcctacccctgtcctg

SEQ ID NO: 369222 - DNA, 19 bp, Homo sapiens
tcctactctgggaagaatg

SEQ ID NO: 369223 - DNA, 20 bp, Homo sapiens
tcctactctgggaagaatgt

SEQ ID NO: 369224 - DNA, 14 bp, Homo sapiens
tcctacttaaacaa

SEQ ID NO: 369225 - DNA, 15 bp, Homo sapiens
tcctagacttgaaag

SEQ ID NO: 369226 - DNA, 19 bp, Homo sapiens
tcctagacttgaaagtttt

SEQ ID NO: 369227 - DNA, 20 bp, Homo sapiens
tcctagacttgaaagttttc

SEQ ID NO: 369228 - DNA, 18 bp, Homo sapiens
tcctagagacagaagcag

SEQ ID NO: 369229 - DNA, 21 bp, Homo sapiens
tcctagaggtgggcagctggg

SEQ ID NO: 369230 - DNA, 22 bp, Homo sapiens
tcctagaggtgggcagctgggc

SEQ ID NO: 369231 - DNA, 23 bp, Homo sapiens
tcctagaggtgggcagctgggcc

SEQ ID NO: 369232 - DNA, 22 bp, Homo sapiens
tcctagatggcagtcactgaat

SEQ ID NO: 369233 - DNA, 20 bp, Homo sapiens
tcctagcacaaggagtgccc

SEQ ID NO: 369234 - DNA, 15 bp, Homo sapiens
tcctagctgacgcca

SEQ ID NO: 369235 - DNA, 12 bp, Homo sapiens
tcctagctgtgt

SEQ ID NO: 369236 - DNA, 19 bp, Homo sapiens
tcctagcttatctccctgc

SEQ ID NO: 369237 - DNA, 14 bp, Homo sapiens
tcctggaaccaatc

SEQ ID NO: 369238 - DNA, 16 bp, Homo sapiens
tcctggaatgaagcat

SEQ ID NO: 369239 - DNA, 20 bp, Homo sapiens
tcctggaatgaagcatgtag

SEQ ID NO: 369240 - DNA, 15 bp, Homo sapiens
tcctggacctgagtc

SEQ ID NO: 369241 - DNA, 16 bp, Homo sapiens
tcctggactggccctt

SEQ ID NO: 369242 - DNA, 18 bp, Homo sapiens
tcctggagagtctcactc

SEQ ID NO: 369243 - DNA, 14 bp, Homo sapiens
tcctggagcatccc

SEQ ID NO: 369244 - DNA, 18 bp, Homo sapiens
tcctggagcatcccaggc

SEQ ID NO: 369245 - DNA, 18 bp, Homo sapiens
tcctggagcctttgaata

SEQ ID NO: 369246 - DNA, 17 bp, Homo sapiens
tcctggataaaaaagaa

SEQ ID NO: 369247 - DNA, 21 bp, Homo sapiens
tcctggataaaaaagaaaaca

SEQ ID NO: 369248 - DNA, 14 bp, Homo sapiens
tcctggattttctt

SEQ ID NO: 369249 - DNA, 21 bp, Homo sapiens
tcctggattttctttctatgt

SEQ ID NO: 369250 - DNA, 23 bp, Homo sapiens
tcctggcaaacaccattattcca

SEQ ID NO: 369251 - DNA, 14 bp, Homo sapiens
tcctggcagggcag

SEQ ID NO: 369252 - DNA, 20 bp, Homo sapiens
tcctggccccgggctctggc

SEQ ID NO: 369253 - DNA, 16 bp, Homo sapiens
tcctggccctctgtgt

SEQ ID NO: 369254 - DNA, 20 bp, Homo sapiens
tcctggcctcactggctggg

SEQ ID NO: 369255 - DNA, 13 bp, Homo sapiens
tcctggcctcctt

SEQ ID NO: 369256 - DNA, 17 bp, Homo sapiens
tcctggctacatcccag

SEQ ID NO: 369257 - DNA, 20 bp, Homo sapiens
tcctggctacatcccagcct

SEQ ID NO: 369258 - DNA, 21 bp, Homo sapiens
tcctggctacatcccagcctg

SEQ ID NO: 369259 - DNA, 12 bp, Homo sapiens
tcctggctcaca

SEQ ID NO: 369260 - DNA, 15 bp, Homo sapiens
tcctggctcacagcc

SEQ ID NO: 369261 - DNA, 16 bp, Homo sapiens
tcctggctcacagcca

SEQ ID NO: 369262 - DNA, 18 bp, Homo sapiens
tcctggctcacagccacc

SEQ ID NO: 369263 - DNA, 13 bp, Homo sapiens
tcctggctcagcc

SEQ ID NO: 369264 - DNA, 16 bp, Homo sapiens
tcctggctcagcctca

SEQ ID NO: 369265 - DNA, 14 bp, Homo sapiens
tcctggctgccagg

SEQ ID NO: 369266 - DNA, 14 bp, Homo sapiens
tcctggctgtaaat

SEQ ID NO: 369267 - DNA, 21 bp, Homo sapiens
tcctgggaaggagggagctgc

SEQ ID NO: 369268 - DNA, 21 bp, Homo sapiens
tcctgggcaacagagtgagac

SEQ ID NO: 369269 - DNA, 14 bp, Homo sapiens
tcctgggcagccca

SEQ ID NO: 369270 - DNA, 15 bp, Homo sapiens
tcctgggcagcccag

SEQ ID NO: 369271 - DNA, 15 bp, Homo sapiens
tcctgggcatcccca

SEQ ID NO: 369272 - DNA, 17 bp, Homo sapiens
tcctgggcatccccagc

SEQ ID NO: 369273 - DNA, 22 bp, Homo sapiens
tcctgggcatgtttgtctgtgt

SEQ ID NO: 369274 - DNA, 14 bp, Homo sapiens
tcctgggccagggt

SEQ ID NO: 369275 - DNA, 15 bp, Homo sapiens
tcctgggccagggtc

SEQ ID NO: 369276 - DNA, 16 bp, Homo sapiens
tcctgggccagggtct

SEQ ID NO: 369277 - DNA, 14 bp, Homo sapiens
tcctgggcccaggc

SEQ ID NO: 369278 - DNA, 23 bp, Homo sapiens
tcctgggcccctccctacctcaa

SEQ ID NO: 369279 - DNA, 10 bp, Homo sapiens
tcctgggcct

SEQ ID NO: 369280 - DNA, 16 bp, Homo sapiens
tcctgggcctgtcccc

SEQ ID NO: 369281 - DNA, 17 bp, Homo sapiens
tcctgggccttctcagc

SEQ ID NO: 369282 - DNA, 19 bp, Homo sapiens
tcctgggccttctcagctc

SEQ ID NO: 369283 - DNA, 16 bp, Homo sapiens
tcctgggctcaagcaa

SEQ ID NO: 369284 - DNA, 19 bp, Homo sapiens
tcctggggaggctgagact

SEQ ID NO: 369285 - DNA, 20 bp, Homo sapiens
tcctggggaggctgagactg

SEQ ID NO: 369286 - DNA, 15 bp, Homo sapiens
tcctggggccccgct

SEQ ID NO: 369287 - DNA, 18 bp, Homo sapiens
tcctggggccccgctggg

SEQ ID NO: 369288 - DNA, 16 bp, Homo sapiens
tcctggggctcccttc

SEQ ID NO: 369289 - DNA, 21 bp, Homo sapiens
tcctggggctgggtgtgtttc

SEQ ID NO: 369290 - DNA, 21 bp, Homo sapiens
tcctgggggttctttcttcct

SEQ ID NO: 369291 - DNA, 23 bp, Homo sapiens
tcctgggggttctttcttcctct

SEQ ID NO: 369292 - DNA, 22 bp, Homo sapiens
tcctggggtgccctccactgcc

SEQ ID NO: 369293 - DNA, 19 bp, Homo sapiens
tcctggggtggttggaggc

SEQ ID NO: 369294 - DNA, 22 bp, Homo sapiens
tcctggtatgggtttctcccag

SEQ ID NO: 369295 - DNA, 14 bp, Homo sapiens
tcctggtctgaaaa

SEQ ID NO: 369296 - DNA, 17 bp, Homo sapiens
tcctggtcttgagatgt

SEQ ID NO: 369297 - DNA, 16 bp, Homo sapiens
tcctggtgaggcccag

SEQ ID NO: 369298 - DNA, 16 bp, Homo sapiens
tcctggtggggctgag

SEQ ID NO: 369299 - DNA, 21 bp, Homo sapiens
tcctggtggggctgagcctga

SEQ ID NO: 369300 - DNA, 22 bp, Homo sapiens
tcctggtggggctgagcctgag

SEQ ID NO: 369301 - DNA, 13 bp, Homo sapiens
tcctggtgtctag

SEQ ID NO: 369302 - DNA, 15 bp, Homo sapiens
tcctggtgtggaaga

SEQ ID NO: 369303 - DNA, 17 bp, Homo sapiens
tcctggttcagtgggaa

SEQ ID NO: 369304 - DNA, 23 bp, Homo sapiens
tcctggttccttcctatgcccag

SEQ ID NO: 369305 - DNA, 17 bp, Homo sapiens
tcctgtaaaatactatt

SEQ ID NO: 369306 - DNA, 16 bp, Homo sapiens
tcctgtaaaatccatt

SEQ ID NO: 369307 - DNA, 10 bp, Homo sapiens
tcctgtaaac

SEQ ID NO: 369308 - DNA, 14 bp, Homo sapiens
tcctgtacattgtg

SEQ ID NO: 369309 - DNA, 20 bp, Homo sapiens
tcctgtagacctagggagga

SEQ ID NO: 369310 - DNA, 23 bp, Homo sapiens
tcctgtagacctagggaggacct

SEQ ID NO: 369311 - DNA, 16 bp, Homo sapiens
tcctgtagccactggc

SEQ ID NO: 369312 - DNA, 23 bp, Homo sapiens
tcctgtagtgcccctcccatggc

SEQ ID NO: 369313 - DNA, 12 bp, Homo sapiens
tcctgtcaatgt

SEQ ID NO: 369314 - DNA, 21 bp, Homo sapiens
tcctgtccactctcggggccc

SEQ ID NO: 369315 - DNA, 22 bp, Homo sapiens
tcctgtccactctcggggccct

SEQ ID NO: 369316 - DNA, 14 bp, Homo sapiens
tcctgtccagagag

SEQ ID NO: 369317 - DNA, 13 bp, Homo sapiens
tcctgtcccagag

SEQ ID NO: 369318 - DNA, 19 bp, Homo sapiens
tcctgtcccctccttccag

SEQ ID NO: 369319 - DNA, 22 bp, Homo sapiens
tcctgtcccgccttcctcctcc

SEQ ID NO: 369320 - DNA, 13 bp, Homo sapiens
tcctgtccgccct

SEQ ID NO: 369321 - DNA, 19 bp, Homo sapiens
tcctgtccgccctcttccc

SEQ ID NO: 369322 - DNA, 14 bp, Homo sapiens
tcctgtcctgctca

SEQ ID NO: 369323 - DNA, 16 bp, Homo sapiens
tcctgtcctgctcacg

SEQ ID NO: 369324 - DNA, 12 bp, Homo sapiens
tcctgtctcccc

SEQ ID NO: 369325 - DNA, 12 bp, Homo sapiens
tcctgtctcctc

SEQ ID NO: 369326 - DNA, 19 bp, Homo sapiens
tcctgtctcctctgtcagt

SEQ ID NO: 369327 - DNA, 20 bp, Homo sapiens
tcctgtctcctctgtcagtt

SEQ ID NO: 369328 - DNA, 12 bp, Homo sapiens
tcctgtctggcc

SEQ ID NO: 369329 - DNA, 13 bp, Homo sapiens
tcctgtctggccc

SEQ ID NO: 369330 - DNA, 23 bp, Homo sapiens
tcctgtctggctcggacccaccc

SEQ ID NO: 369331 - DNA, 22 bp, Homo sapiens
tcctgtgccaacctgatgcccc

SEQ ID NO: 369332 - DNA, 13 bp, Homo sapiens
tcctgtgccagga

SEQ ID NO: 369333 - DNA, 23 bp, Homo sapiens
tcctgtgcccacccgtcttcaat

SEQ ID NO: 369334 - DNA, 17 bp, Homo sapiens
tcctgtgcccatcatct

SEQ ID NO: 369335 - DNA, 22 bp, Homo sapiens
tcctgtgcccatcatctctgcc

SEQ ID NO: 369336 - DNA, 23 bp, Homo sapiens
tcctgtgcccatcatctctgcct

SEQ ID NO: 369337 - DNA, 12 bp, Homo sapiens
tcctgtgctaca

SEQ ID NO: 369338 - DNA, 13 bp, Homo sapiens
tcctgtggccagg

SEQ ID NO: 369339 - DNA, 22 bp, Homo sapiens
tcctgtgtaatcatttcttggg

SEQ ID NO: 369340 - DNA, 16 bp, Homo sapiens
tcctgtgtcatctgtc

SEQ ID NO: 369341 - DNA, 15 bp, Homo sapiens
tcctgtgtggagagg

SEQ ID NO: 369342 - DNA, 22 bp, Homo sapiens
tcctgtgtggagagggaatgtg

SEQ ID NO: 369343 - DNA, 18 bp, Homo sapiens
tcctgttacttacctaaa

SEQ ID NO: 369344 - DNA, 19 bp, Homo sapiens
tcctgttcccatgagatga

SEQ ID NO: 369345 - DNA, 13 bp, Homo sapiens
tcctgttcctgcc

SEQ ID NO: 369346 - DNA, 14 bp, Homo sapiens
tcctgttcctgcct

SEQ ID NO: 369347 - DNA, 16 bp, Homo sapiens
tcctgttcctgccttc

SEQ ID NO: 369348 - DNA, 20 bp, Homo sapiens
tcctgttccttgctagccct

SEQ ID NO: 369349 - DNA, 23 bp, Homo sapiens
tcctgttccttgctagccctggg

SEQ ID NO: 369350 - DNA, 15 bp, Homo sapiens
tcctgttctcagagc

SEQ ID NO: 369351 - DNA, 13 bp, Homo sapiens
tcctgttgccaca

SEQ ID NO: 369352 - DNA, 18 bp, Homo sapiens
tcctgttggctgctgcca

SEQ ID NO: 369353 - DNA, 19 bp, Homo sapiens
tcctgttgttgttaatgaa

SEQ ID NO: 369354 - DNA, 21 bp, Homo sapiens
tcctgttgttgttaatgaaaa

SEQ ID NO: 369355 - DNA, 17 bp, Homo sapiens
tcctgtttaactcccta

SEQ ID NO: 369356 - DNA, 15 bp, Homo sapiens
tccttaaacagggca

SEQ ID NO: 369357 - DNA, 15 bp, Homo sapiens
tccttaaactgtgtg

SEQ ID NO: 369358 - DNA, 16 bp, Homo sapiens
tccttaaactgtgtgg

SEQ ID NO: 369359 - DNA, 17 bp, Homo sapiens
tccttactctgagccca

SEQ ID NO: 369360 - DNA, 18 bp, Homo sapiens
tccttactctgagcccag

SEQ ID NO: 369361 - DNA, 19 bp, Homo sapiens
tccttactctgagcccagg

SEQ ID NO: 369362 - DNA, 20 bp, Homo sapiens
tccttactctgagcccaggc

SEQ ID NO: 369363 - DNA, 17 bp, Homo sapiens
tccttagacccgccagg

SEQ ID NO: 369364 - DNA, 21 bp, Homo sapiens
tccttagactccttctcccca

SEQ ID NO: 369365 - DNA, 16 bp, Homo sapiens
tccttagcaacagccg

SEQ ID NO: 369366 - DNA, 14 bp, Homo sapiens
tccttagcagctca

SEQ ID NO: 369367 - DNA, 20 bp, Homo sapiens
tctaggagggagccttgtga

SEQ ID NO: 369368 - DNA, 22 bp, Homo sapiens
tctaggcgaggcgaagctgagc

SEQ ID NO: 369369 - DNA, 20 bp, Homo sapiens
tctagggaaggccacctgca

SEQ ID NO: 369370 - DNA, 23 bp, Homo sapiens
tctagggaaggccacctgcaggt

SEQ ID NO: 369371 - DNA, 19 bp, Homo sapiens
tctaggggtcaggctccat

SEQ ID NO: 369372 - DNA, 17 bp, Homo sapiens
tctagggtgggccccag

SEQ ID NO: 369373 - DNA, 21 bp, Homo sapiens
tctagggttgctggagcctga

SEQ ID NO: 369374 - DNA, 17 bp, Homo sapiens
tctaggtagtgccctat

SEQ ID NO: 369375 - DNA, 16 bp, Homo sapiens
tctaggtcaaggcctg

SEQ ID NO: 369376 - DNA, 20 bp, Homo sapiens
tctaggtcaaggcctgtccc

SEQ ID NO: 369377 - DNA, 20 bp, Homo sapiens
tctaggtcagtacccacctg

SEQ ID NO: 369378 - DNA, 21 bp, Homo sapiens
tctaggtcagtacccacctga

SEQ ID NO: 369379 - DNA, 18 bp, Homo sapiens
tctaggtctcctcagggt

SEQ ID NO: 369380 - DNA, 11 bp, Homo sapiens
tctaggtcttg

SEQ ID NO: 369381 - DNA, 21 bp, Homo sapiens
tctaggtcttggttagagaag

SEQ ID NO: 369382 - DNA, 17 bp, Homo sapiens
tctaggtggagttgaaa

SEQ ID NO: 369383 - DNA, 23 bp, Homo sapiens
tctaggttctaaaaattgtgatc

SEQ ID NO: 369384 - DNA, 19 bp, Homo sapiens
tctaggtttaactcagatc

SEQ ID NO: 369385 - DNA, 20 bp, Homo sapiens
tctaggtttaactcagatca

SEQ ID NO: 369386 - DNA, 22 bp, Homo sapiens
tctagtacttgggagacctgta

SEQ ID NO: 369387 - DNA, 15 bp, Homo sapiens
tctagtcaactgctg

SEQ ID NO: 369388 - DNA, 17 bp, Homo sapiens
tctagtcaactgctgtt

SEQ ID NO: 369389 - DNA, 21 bp, Homo sapiens
tctagtcaactgctgttttat

SEQ ID NO: 369390 - DNA, 22 bp, Homo sapiens
tctagtcaactgctgttttatg

SEQ ID NO: 369391 - DNA, 20 bp, Homo sapiens
tctagtctcctttgcactga

SEQ ID NO: 369392 - DNA, 22 bp, Homo sapiens
tctagtctcctttgcactgagg

SEQ ID NO: 369393 - DNA, 15 bp, Homo sapiens
tctagtgacttcctg

SEQ ID NO: 369394 - DNA, 22 bp, Homo sapiens
tctagtgcagctgattttaaca

SEQ ID NO: 369395 - DNA, 23 bp, Homo sapiens
tctagtgcagctgattttaacaa

SEQ ID NO: 369396 - DNA, 18 bp, Homo sapiens
tctagttagcaggaaata

SEQ ID NO: 369397 - DNA, 12 bp, Homo sapiens
tctagttctaga

SEQ ID NO: 369398 - DNA, 13 bp, Homo sapiens
tctagttctagat

SEQ ID NO: 369399 - DNA, 14 bp, Homo sapiens
tctagttctagatg

SEQ ID NO: 369400 - DNA, 13 bp, Homo sapiens
tctagttgctctt

SEQ ID NO: 369401 - DNA, 14 bp, Homo sapiens
tctagtttacagaa

SEQ ID NO: 369402 - DNA, 15 bp, Homo sapiens
tctagtttgcatact

SEQ ID NO: 369403 - DNA, 13 bp, Homo sapiens
tctagttttgtca

SEQ ID NO: 369404 - DNA, 12 bp, Homo sapiens
tctatactgttt

SEQ ID NO: 369405 - DNA, 16 bp, Homo sapiens
tctatactgtttgtaa

SEQ ID NO: 369406 - DNA, 21 bp, Homo sapiens
tctataggaacatatgaaaat

SEQ ID NO: 369407 - DNA, 13 bp, Homo sapiens
tctatatttcata

SEQ ID NO: 369408 - DNA, 16 bp, Homo sapiens
tctatatttcatattg

SEQ ID NO: 369409 - DNA, 22 bp, Homo sapiens
tctatcaagtcaatcatttctc

SEQ ID NO: 369410 - DNA, 11 bp, Homo sapiens
tctatcacctg

SEQ ID NO: 369411 - DNA, 14 bp, Homo sapiens
tctatcacctgtca

SEQ ID NO: 369412 - DNA, 15 bp, Homo sapiens
tctatcacctgtcat

SEQ ID NO: 369413 - DNA, 17 bp, Homo sapiens
tctatcacctgtcatca

SEQ ID NO: 369414 - DNA, 18 bp, Homo sapiens
tctatcacctgtcatcat

SEQ ID NO: 369415 - DNA, 14 bp, Homo sapiens
tctatcagagaaaa

SEQ ID NO: 369416 - DNA, 14 bp, Homo sapiens
tctatccccaagct

SEQ ID NO: 369417 - DNA, 15 bp, Homo sapiens
tctatccccaagctg

SEQ ID NO: 369418 - DNA, 16 bp, Homo sapiens
tctatcctacaacaag

SEQ ID NO: 369419 - DNA, 19 bp, Homo sapiens
tctatcctgttaacactgt

SEQ ID NO: 369420 - DNA, 20 bp, Homo sapiens
tctatcgagtttgcaatgtc

SEQ ID NO: 369421 - DNA, 14 bp, Homo sapiens
tctatctaaatgat

SEQ ID NO: 369422 - DNA, 21 bp, Homo sapiens
tctatctgcaatgtttttgtg

SEQ ID NO: 369423 - DNA, 16 bp, Homo sapiens
tctatctgggcctggg

SEQ ID NO: 369424 - DNA, 19 bp, Homo sapiens
tctatcttgcatctacctg

SEQ ID NO: 369425 - DNA, 16 bp, Homo sapiens
tctatgacaataaatt

SEQ ID NO: 369426 - DNA, 15 bp, Homo sapiens
tctatgatcagaact

SEQ ID NO: 369427 - DNA, 23 bp, Homo sapiens
tctatgcaaagtctctcatttct

SEQ ID NO: 369428 - DNA, 18 bp, Homo sapiens
tctatggattcacttcta

SEQ ID NO: 369429 - DNA, 19 bp, Homo sapiens
tctatggggagaggaactc

SEQ ID NO: 369430 - DNA, 12 bp, Homo sapiens
tctatgtaaatt

SEQ ID NO: 369431 - DNA, 20 bp, Homo sapiens
tctatgtaaattattgtaaa

SEQ ID NO: 369432 - DNA, 17 bp, Homo sapiens
tctatgtagaactgttc

SEQ ID NO: 369433 - DNA, 20 bp, Homo sapiens
tctatgtccaacagagtgga

SEQ ID NO: 369434 - DNA, 19 bp, Homo sapiens
tctattaatcacctctctg

SEQ ID NO: 369435 - DNA, 16 bp, Homo sapiens
tctattactctgacat

SEQ ID NO: 369436 - DNA, 18 bp, Homo sapiens
tctattactctgacataa

SEQ ID NO: 369437 - DNA, 14 bp, Homo sapiens
tctattagacttta

SEQ ID NO: 369438 - DNA, 13 bp, Homo sapiens
tctattccctgga

SEQ ID NO: 369439 - DNA, 18 bp, Homo sapiens
tctattccctggaattca

SEQ ID NO: 369440 - DNA, 17 bp, Homo sapiens
tctattccttctggcct

SEQ ID NO: 369441 - DNA, 17 bp, Homo sapiens
tctattctcaaagtttc

SEQ ID NO: 369442 - DNA, 17 bp, Homo sapiens
tctattctctgcaattt

SEQ ID NO: 369443 - DNA, 20 bp, Homo sapiens
tctattgatgtacagtctgt

SEQ ID NO: 369444 - DNA, 15 bp, Homo sapiens
tctattgggttcatt

SEQ ID NO: 369445 - DNA, 18 bp, Homo sapiens
tctattgggttcattatt

SEQ ID NO: 369446 - DNA, 16 bp, Homo sapiens
tctatttatctgtctg

SEQ ID NO: 369447 - DNA, 19 bp, Homo sapiens
tctatttatctgtctgagc

SEQ ID NO: 369448 - DNA, 20 bp, Homo sapiens
tctatttcggaaatacacta

SEQ ID NO: 369449 - DNA, 17 bp, Homo sapiens
tctattttgtgatgatg

SEQ ID NO: 369450 - DNA, 15 bp, Homo sapiens
tctatttttgttaat

SEQ ID NO: 369451 - DNA, 14 bp, Homo sapiens
tctattttttacta

SEQ ID NO: 369452 - DNA, 19 bp, Homo sapiens
tctatttttttaactgaaa

SEQ ID NO: 369453 - DNA, 14 bp, Homo sapiens
tctcaaaagcattt

SEQ ID NO: 369454 - DNA, 16 bp, Homo sapiens
tctcaaaagtctattt

SEQ ID NO: 369455 - DNA, 17 bp, Homo sapiens
tctcaaaagtctatttt

SEQ ID NO: 369456 - DNA, 18 bp, Homo sapiens
tctcaaaatgtgccgtct

SEQ ID NO: 369457 - DNA, 17 bp, Homo sapiens
tctcaaagcatcaaata

SEQ ID NO: 369458 - DNA, 19 bp, Homo sapiens
tctcaaagcatcaaataat

SEQ ID NO: 369459 - DNA, 22 bp, Homo sapiens
tctcaaagtttttacagtgtat

SEQ ID NO: 369460 - DNA, 21 bp, Homo sapiens
tctcaacaaagcacagtgtta

SEQ ID NO: 369461 - DNA, 18 bp, Homo sapiens
tctcaagagggcactggt

SEQ ID NO: 369462 - DNA, 22 bp, Homo sapiens
tctcaagattatattataataa

SEQ ID NO: 369463 - DNA, 19 bp, Homo sapiens
tctcaagcactaaaaagtg

SEQ ID NO: 369464 - DNA, 14 bp, Homo sapiens
tctcaagtatataa

SEQ ID NO: 369465 - DNA, 22 bp, Homo sapiens
tctcaatatataataaatggga

SEQ ID NO: 369466 - DNA, 18 bp, Homo sapiens
tctcaatattcaataaag

SEQ ID NO: 369467 - DNA, 20 bp, Homo sapiens
tctcaatattcaataaagct

SEQ ID NO: 369468 - DNA, 21 bp, Homo sapiens
tctcaatgttccattcagtct

SEQ ID NO: 369469 - DNA, 12 bp, Homo sapiens
tctcaattttgt

SEQ ID NO: 369470 - DNA, 13 bp, Homo sapiens
tctcaattttgta

SEQ ID NO: 369471 - DNA, 15 bp, Homo sapiens
tctcaattttgtatt

SEQ ID NO: 369472 - DNA, 15 bp, Homo sapiens
tctcacaaataagta

SEQ ID NO: 369473 - DNA, 11 bp, Homo sapiens
tctcacagcac

SEQ ID NO: 369474 - DNA, 23 bp, Homo sapiens
tctcacagcacatgctggccagc

SEQ ID NO: 369475 - DNA, 21 bp, Homo sapiens
tctcacatgtggcaaaatatg

SEQ ID NO: 369476 - DNA, 15 bp, Homo sapiens
tctcaccatttggat

SEQ ID NO: 369477 - DNA, 16 bp, Homo sapiens
tctcaccatttggatc

SEQ ID NO: 369478 - DNA, 18 bp, Homo sapiens
tctcaccatttggatcct

SEQ ID NO: 369479 - DNA, 17 bp, Homo sapiens
tctcaccccatcccaca

SEQ ID NO: 369480 - DNA, 21 bp, Homo sapiens
tctcaccccatcccacaccct

SEQ ID NO: 369481 - DNA, 18 bp, Homo sapiens
tctcacctagaccttgcc

SEQ ID NO: 369482 - DNA, 18 bp, Homo sapiens
tctcacctctaggcctca

SEQ ID NO: 369483 - DNA, 19 bp, Homo sapiens
tctcacctctaggcctcag

SEQ ID NO: 369484 - DNA, 13 bp, Homo sapiens
tctcactaaactt

SEQ ID NO: 369485 - DNA, 15 bp, Homo sapiens
tctcactatgtttct

SEQ ID NO: 369486 - DNA, 13 bp, Homo sapiens
tctcactccccag

SEQ ID NO: 369487 - DNA, 13 bp, Homo sapiens
tctcactcccctc

SEQ ID NO: 369488 - DNA, 13 bp, Homo sapiens
tctcactcctacc

SEQ ID NO: 369489 - DNA, 16 bp, Homo sapiens
tctcactcctacctgg

SEQ ID NO: 369490 - DNA, 13 bp, Homo sapiens
tctcactcctgag

SEQ ID NO: 369491 - DNA, 15 bp, Homo sapiens
tctcactctgctttg

SEQ ID NO: 369492 - DNA, 21 bp, Homo sapiens
tctcactgagaagattgtgaa

SEQ ID NO: 369493 - DNA, 15 bp, Homo sapiens
tctcactgctttgca

SEQ ID NO: 369494 - DNA, 13 bp, Homo sapiens
tctcactgtgtcc

SEQ ID NO: 369495 - DNA, 14 bp, Homo sapiens
tctcactgtgtccc

SEQ ID NO: 369496 - DNA, 17 bp, Homo sapiens
tctcactgttccctctg

SEQ ID NO: 369497 - DNA, 12 bp, Homo sapiens
tctctctgttcc

SEQ ID NO: 369498 - DNA, 16 bp, Homo sapiens
tctctctgttccaagt

SEQ ID NO: 369499 - DNA, 12 bp, Homo sapiens
tctctcttcaat

SEQ ID NO: 369500 - DNA, 10 bp, Homo sapiens
tctctcttcc

SEQ ID NO: 369501 - DNA, 15 bp, Homo sapiens
tctctgaacttcagc

SEQ ID NO: 369502 - DNA, 16 bp, Homo sapiens
tctctgaacttcagct

SEQ ID NO: 369503 - DNA, 16 bp, Homo sapiens
tctctgaagcatgttt

SEQ ID NO: 369504 - DNA, 22 bp, Homo sapiens
tctctgaagcatgtttcatgtt

SEQ ID NO: 369505 - DNA, 16 bp, Homo sapiens
tctctgagagagatga

SEQ ID NO: 369506 - DNA, 15 bp, Homo sapiens
tctctgagcagtggg

SEQ ID NO: 369507 - DNA, 19 bp, Homo sapiens
tctctgagcagtggggagc

SEQ ID NO: 369508 - DNA, 21 bp, Homo sapiens
tctctgagccccctgtgccca

SEQ ID NO: 369509 - DNA, 14 bp, Homo sapiens
tctctgagctttgt

SEQ ID NO: 369510 - DNA, 22 bp, Homo sapiens
tctctgatcttgtgctcagcat

SEQ ID NO: 369511 - DNA, 14 bp, Homo sapiens
tctctgattaaatt

SEQ ID NO: 369512 - DNA, 16 bp, Homo sapiens
tctctgatttgcaaat

SEQ ID NO: 369513 - DNA, 14 bp, Homo sapiens
tctctgcaatttgt

SEQ ID NO: 369514 - DNA, 22 bp, Homo sapiens
tctctgcaatttgtttaaagaa

SEQ ID NO: 369515 - DNA, 16 bp, Homo sapiens
tctctgccacccactc

SEQ ID NO: 369516 - DNA, 12 bp, Homo sapiens
tctctgccagct

SEQ ID NO: 369517 - DNA, 15 bp, Homo sapiens
tctctgccggctctt

SEQ ID NO: 369518 - DNA, 15 bp, Homo sapiens
tctctgctccaccac

SEQ ID NO: 369519 - DNA, 11 bp, Homo sapiens
tctctgctcct

SEQ ID NO: 369520 - DNA, 13 bp, Homo sapiens
tctctgctctagc

SEQ ID NO: 369521 - DNA, 18 bp, Homo sapiens
tctctgctctagccagga

SEQ ID NO: 369522 - DNA, 20 bp, Homo sapiens
tctctgctctagccaggagt

SEQ ID NO: 369523 - DNA, 14 bp, Homo sapiens
tctctgctgaacat

SEQ ID NO: 369524 - DNA, 19 bp, Homo sapiens
tctctgctgcttctgggcc

SEQ ID NO: 369525 - DNA, 20 bp, Homo sapiens
tctctgctgcttctgggcct

SEQ ID NO: 369526 - DNA, 22 bp, Homo sapiens
tctctgcttactaatgtgcccc

SEQ ID NO: 369527 - DNA, 11 bp, Homo sapiens
tctctgcttcc

SEQ ID NO: 369528 - DNA, 22 bp, Homo sapiens
tctctgcttccatggcttcctg

SEQ ID NO: 369529 - DNA, 19 bp, Homo sapiens
tctctgcttgagtcaggtt

SEQ ID NO: 369530 - DNA, 17 bp, Homo sapiens
tctctggactttctcca

SEQ ID NO: 369531 - DNA, 15 bp, Homo sapiens
tctctggccactctg

SEQ ID NO: 369532 - DNA, 17 bp, Homo sapiens
tctctggccactctgct

SEQ ID NO: 369533 - DNA, 17 bp, Homo sapiens
tctctggccttttccta

SEQ ID NO: 369534 - DNA, 19 bp, Homo sapiens
tctctgggactctcctcct

SEQ ID NO: 369535 - DNA, 21 bp, Homo sapiens
tctctgggactctcctcctcc

SEQ ID NO: 369536 - DNA, 16 bp, Homo sapiens
tctctgggctgagcct

SEQ ID NO: 369537 - DNA, 23 bp, Homo sapiens
tctctgggctgagcctactgtct

SEQ ID NO: 369538 - DNA, 15 bp, Homo sapiens
tctctgtccagggct

SEQ ID NO: 369539 - DNA, 15 bp, Homo sapiens
tctctgtctaccatc

SEQ ID NO: 369540 - DNA, 16 bp, Homo sapiens
tctctgtgaacgattt

SEQ ID NO: 369541 - DNA, 15 bp, Homo sapiens
tctctgtgaatacaa

SEQ ID NO: 369542 - DNA, 19 bp, Homo sapiens
tctctgtgaatacaattaa

SEQ ID NO: 369543 - DNA, 20 bp, Homo sapiens
tctctgtgaatacaattaaa

SEQ ID NO: 369544 - DNA, 20 bp, Homo sapiens
tctctgtgactcgcttagct

SEQ ID NO: 369545 - DNA, 14 bp, Homo sapiens
tctctgtgctctga

SEQ ID NO: 369546 - DNA, 20 bp, Homo sapiens
tctctgtgtggcaaacattt

SEQ ID NO: 369547 - DNA, 19 bp, Homo sapiens
tctctgttcagatgtgcat

SEQ ID NO: 369548 - DNA, 14 bp, Homo sapiens
tctctgttccaagt

SEQ ID NO: 369549 - DNA, 22 bp, Homo sapiens
tctcttaaatgaagtgcccact

SEQ ID NO: 369550 - DNA, 18 bp, Homo sapiens
tctcttaatttaatcttt

SEQ ID NO: 369551 - DNA, 21 bp, Homo sapiens
tctcttaccgcgagactgaga

SEQ ID NO: 369552 - DNA, 15 bp, Homo sapiens
tctcttatagaatat

SEQ ID NO: 369553 - DNA, 17 bp, Homo sapiens
tctcttatagaatattt

SEQ ID NO: 369554 - DNA, 14 bp, Homo sapiens
tctcttcaatctct

SEQ ID NO: 369555 - DNA, 13 bp, Homo sapiens
tctcttcaggttc

SEQ ID NO: 369556 - DNA, 14 bp, Homo sapiens
tctcttcaggttct

SEQ ID NO: 369557 - DNA, 16 bp, Homo sapiens
tctcttcaggttctta

SEQ ID NO: 369558 - DNA, 15 bp, Homo sapiens
tctcttcattcccac

SEQ ID NO: 369559 - DNA, 22 bp, Homo sapiens
tctcttcattcccactgcactt

SEQ ID NO: 369560 - DNA, 14 bp, Homo sapiens
tctcttccagccca

SEQ ID NO: 369561 - DNA, 20 bp, Homo sapiens
tctcttccctaatcctccaa

SEQ ID NO: 369562 - DNA, 13 bp, Homo sapiens
tctcttccgggag

SEQ ID NO: 369563 - DNA, 15 bp, Homo sapiens
tctcttcgctgtgat

SEQ ID NO: 369564 - DNA, 17 bp, Homo sapiens
tctcttctatcctgcaa

SEQ ID NO: 369565 - DNA, 13 bp, Homo sapiens
tctcttctccact

SEQ ID NO: 369566 - DNA, 20 bp, Homo sapiens
tctcttctgtccatcagtgc

SEQ ID NO: 369567 - DNA, 17 bp, Homo sapiens
tctcttcttactgtatt

SEQ ID NO: 369568 - DNA, 16 bp, Homo sapiens
tctcttgattgatttt

SEQ ID NO: 369569 - DNA, 22 bp, Homo sapiens
tctcttgccgaggagccaggca

SEQ ID NO: 369570 - DNA, 16 bp, Homo sapiens
tctcttggactccctc

SEQ ID NO: 369571 - DNA, 17 bp, Homo sapiens
tctcttggactccctcc

SEQ ID NO: 369572 - DNA, 13 bp, Homo sapiens
tctcttgtagaag

SEQ ID NO: 369573 - DNA, 20 bp, Homo sapiens
tctctttaatcttcagtttt

SEQ ID NO: 369574 - DNA, 15 bp, Homo sapiens
tctctttacattttg

SEQ ID NO: 369575 - DNA, 15 bp, Homo sapiens
tctctttctttccaa

SEQ ID NO: 369576 - DNA, 22 bp, Homo sapiens
tctctttgtaaggacttgtgcc

SEQ ID NO: 369577 - DNA, 16 bp, Homo sapiens
tctctttgtggggctt

SEQ ID NO: 369578 - DNA, 16 bp, Homo sapiens
tctcttttctctttct

SEQ ID NO: 369579 - DNA, 14 bp, Homo sapiens
tctctttttccaga

SEQ ID NO: 369580 - DNA, 16 bp, Homo sapiens
tctctttttcttgtaa

SEQ ID NO: 369581 - DNA, 19 bp, Homo sapiens
tctctttttggaggtgctt

SEQ ID NO: 369582 - DNA, 16 bp, Homo sapiens
tctgaaaaacattcca

SEQ ID NO: 369583 - DNA, 22 bp, Homo sapiens
tctgaaaatgttgttatgctat

SEQ ID NO: 369584 - DNA, 18 bp, Homo sapiens
tctgaaactatagaataa

SEQ ID NO: 369585 - DNA, 19 bp, Homo sapiens
tctgaaactatagaataaa

SEQ ID NO: 369586 - DNA, 21 bp, Homo sapiens
tctgaacacatactagaaagc

SEQ ID NO: 369587 - DNA, 22 bp, Homo sapiens
tctgaacccttgtgcttggtgg

SEQ ID NO: 369588 - DNA, 17 bp, Homo sapiens
tctgaactccatacagc

SEQ ID NO: 369589 - DNA, 20 bp, Homo sapiens
tctgaactccatacagcctc

SEQ ID NO: 369590 - DNA, 21 bp, Homo sapiens
tctgaactcgcttctctgtga

SEQ ID NO: 369591 - DNA, 13 bp, Homo sapiens
tctgaactctcaa

SEQ ID NO: 369592 - DNA, 14 bp, Homo sapiens
tctgaacttcagct

SEQ ID NO: 369593 - DNA, 13 bp, Homo sapiens
tctgaagaagcaa

SEQ ID NO: 369594 - DNA, 12 bp, Homo sapiens
tctgaagagctg

SEQ ID NO: 369595 - DNA, 13 bp, Homo sapiens
tctgaagcatgtt

SEQ ID NO: 369596 - DNA, 14 bp, Homo sapiens
tctgaagcatgttt

SEQ ID NO: 369597 - DNA, 20 bp, Homo sapiens
tctgaagcatgtttcatgtt

SEQ ID NO: 369598 - DNA, 23 bp, Homo sapiens
tctgaaggaatagccagagagga

SEQ ID NO: 369599 - DNA, 12 bp, Homo sapiens
tctgaaggagat

SEQ ID NO: 369600 - DNA, 19 bp, Homo sapiens
tctgaaggagattttcctt

SEQ ID NO: 369601 - DNA, 17 bp, Homo sapiens
tctgaaggcaaatataa

SEQ ID NO: 369602 - DNA, 20 bp, Homo sapiens
tctgaaggccttgttaaaat

SEQ ID NO: 369603 - DNA, 20 bp, Homo sapiens
tctgaaggtaatactataaa

SEQ ID NO: 369604 - DNA, 16 bp, Homo sapiens
tctgaaggtgcccagg

SEQ ID NO: 369605 - DNA, 19 bp, Homo sapiens
tctgaagtcccttcctgtc

SEQ ID NO: 369606 - DNA, 14 bp, Homo sapiens
tctgaagttggaca

SEQ ID NO: 369607 - DNA, 15 bp, Homo sapiens
tctgaagttggacag

SEQ ID NO: 369608 - DNA, 17 bp, Homo sapiens
tctgaagtttcatttat

SEQ ID NO: 369609 - DNA, 15 bp, Homo sapiens
tctgaataatttctt

SEQ ID NO: 369610 - DNA, 19 bp, Homo sapiens
tctgaatctctcaaaatgt

SEQ ID NO: 369611 - DNA, 13 bp, Homo sapiens
tctgaatgctgct

SEQ ID NO: 369612 - DNA, 18 bp, Homo sapiens
tctgaatgggagccagaa

SEQ ID NO: 369613 - DNA, 16 bp, Homo sapiens
tctgaatgtacacttt

SEQ ID NO: 369614 - DNA, 23 bp, Homo sapiens
tctgaatgttctgacattaacag

SEQ ID NO: 369615 - DNA, 20 bp, Homo sapiens
tctgaattgttgaaactaaa

SEQ ID NO: 369616 - DNA, 21 bp, Homo sapiens
tctgacaaagtcatgaagctc

SEQ ID NO: 369617 - DNA, 14 bp, Homo sapiens
tctgacagcagcct

SEQ ID NO: 369618 - DNA, 17 bp, Homo sapiens
tctgacagcagcctgtg

SEQ ID NO: 369619 - DNA, 19 bp, Homo sapiens
tctgacagcagcctgtgag

SEQ ID NO: 369620 - DNA, 22 bp, Homo sapiens
tctgacataaacccatctgtaa

SEQ ID NO: 369621 - DNA, 17 bp, Homo sapiens
tctgacatcctgacctc

SEQ ID NO: 369622 - DNA, 15 bp, Homo sapiens
tctgacattaacagt

SEQ ID NO: 369623 - DNA, 18 bp, Homo sapiens
tctgacattaacagtttt

SEQ ID NO: 369624 - DNA, 19 bp, Homo sapiens
tctgacattaacagttttc

SEQ ID NO: 369625 - DNA, 12 bp, Homo sapiens
tctgaccacact

SEQ ID NO: 369626 - DNA, 14 bp, Homo sapiens
tctgacccagtgag

SEQ ID NO: 369627 - DNA, 23 bp, Homo sapiens
tctgaccccacttatgctgctgt

SEQ ID NO: 369628 - DNA, 12 bp, Homo sapiens
tctggctgggga

SEQ ID NO: 369629 - DNA, 19 bp, Homo sapiens
tctggctgtggcccctcct

SEQ ID NO: 369630 - DNA, 16 bp, Homo sapiens
tctgggaaaggtgctc

SEQ ID NO: 369631 - DNA, 21 bp, Homo sapiens
tctgggaaaggtgctcaaaga

SEQ ID NO: 369632 - DNA, 23 bp, Homo sapiens
tctgggaaaggtgctcaaagatg

SEQ ID NO: 369633 - DNA, 22 bp, Homo sapiens
tctgggaaatggcttgaagcca

SEQ ID NO: 369634 - DNA, 14 bp, Homo sapiens
tctgggaagaaaat

SEQ ID NO: 369635 - DNA, 19 bp, Homo sapiens
tctgggaagcttgagcctc

SEQ ID NO: 369636 - DNA, 13 bp, Homo sapiens
tctgggacctcag

SEQ ID NO: 369637 - DNA, 22 bp, Homo sapiens
tctgggactctcctcctcccct

SEQ ID NO: 369638 - DNA, 21 bp, Homo sapiens
tctgggacttccttgctctcc

SEQ ID NO: 369639 - DNA, 17 bp, Homo sapiens
tctgggacttgaaatca

SEQ ID NO: 369640 - DNA, 23 bp, Homo sapiens
tctgggatgtagaacttcaagaa

SEQ ID NO: 369641 - DNA, 22 bp, Homo sapiens
tctgggcaaggtgagggatgcc

SEQ ID NO: 369642 - DNA, 18 bp, Homo sapiens
tctgggcagagcctgtcc

SEQ ID NO: 369643 - DNA, 19 bp, Homo sapiens
tctgggcatggtggcacac

SEQ ID NO: 369644 - DNA, 16 bp, Homo sapiens
tctgggccaccagctc

SEQ ID NO: 369645 - DNA, 17 bp, Homo sapiens
tctgggccctgcaggag

SEQ ID NO: 369646 - DNA, 19 bp, Homo sapiens
tctgggccctgcaggaggc

SEQ ID NO: 369647 - DNA, 12 bp, Homo sapiens
tctgggcctctg

SEQ ID NO: 369648 - DNA, 20 bp, Homo sapiens
tctgggcctgatggagagga

SEQ ID NO: 369649 - DNA, 17 bp, Homo sapiens
tctgggctcagggctgg

SEQ ID NO: 369650 - DNA, 21 bp, Homo sapiens
tctgggctcctggaaccaatc

SEQ ID NO: 369651 - DNA, 21 bp, Homo sapiens
tctgggctgagcctactgtct

SEQ ID NO: 369652 - DNA, 22 bp, Homo sapiens
tctgggctgagcctactgtctc

SEQ ID NO: 369653 - DNA, 12 bp, Homo sapiens
tctgggctggca

SEQ ID NO: 369654 - DNA, 13 bp, Homo sapiens
tctgggctggcag

SEQ ID NO: 369655 - DNA, 22 bp, Homo sapiens
tctgggctttgattccatctcc

SEQ ID NO: 369656 - DNA, 13 bp, Homo sapiens
tctggggaaggac

SEQ ID NO: 369657 - DNA, 19 bp, Homo sapiens
tctggggaagggaaccagc

SEQ ID NO: 369658 - DNA, 16 bp, Homo sapiens
tctggggatttctggg

SEQ ID NO: 369659 - DNA, 14 bp, Homo sapiens
tctggggtggggct

SEQ ID NO: 369660 - DNA, 19 bp, Homo sapiens
tctgggtggtaactgccag

SEQ ID NO: 369661 - DNA, 22 bp, Homo sapiens
tctgggtggtaactgccagcct

SEQ ID NO: 369662 - DNA, 16 bp, Homo sapiens
tctgggtttacaacaa

SEQ ID NO: 369663 - DNA, 20 bp, Homo sapiens
tctgggtttacaacaaacac

SEQ ID NO: 369664 - DNA, 21 bp, Homo sapiens
tctggtaaacattcctccagc

SEQ ID NO: 369665 - DNA, 15 bp, Homo sapiens
tctggtaggttctgt

SEQ ID NO: 369666 - DNA, 19 bp, Homo sapiens
tctggtaggttctgtctgt

SEQ ID NO: 369667 - DNA, 22 bp, Homo sapiens
tctggtcagtgaagcccaggag

SEQ ID NO: 369668 - DNA, 18 bp, Homo sapiens
tctggtccacacaccaca

SEQ ID NO: 369669 - DNA, 22 bp, Homo sapiens
tctggtccacacaccacagaag

SEQ ID NO: 369670 - DNA, 16 bp, Homo sapiens
tctggtcccctgtggt

SEQ ID NO: 369671 - DNA, 14 bp, Homo sapiens
tctggtcccttgca

SEQ ID NO: 369672 - DNA, 17 bp, Homo sapiens
tctggtctcctctttgt

SEQ ID NO: 369673 - DNA, 23 bp, Homo sapiens
tctggtgagatacccagagagaa

SEQ ID NO: 369674 - DNA, 22 bp, Homo sapiens
tctggtgcgtgtggccctgtgg

SEQ ID NO: 369675 - DNA, 14 bp, Homo sapiens
tctggtggccccag

SEQ ID NO: 369676 - DNA, 17 bp, Homo sapiens
tctggtgttacacatac

SEQ ID NO: 369677 - DNA, 21 bp, Homo sapiens
tctggtgttctcaatgctttt

SEQ ID NO: 369678 - DNA, 14 bp, Homo sapiens
tctggttgtatttc

SEQ ID NO: 369679 - DNA, 15 bp, Homo sapiens
tctggttttaacaat

SEQ ID NO: 369680 - DNA, 13 bp, Homo sapiens
tctgtaaaaaaga

SEQ ID NO: 369681 - DNA, 16 bp, Homo sapiens
tctgtaaaatggaaaa

SEQ ID NO: 369682 - DNA, 12 bp, Homo sapiens
tctgtaaataac

SEQ ID NO: 369683 - DNA, 19 bp, Homo sapiens
tctgtaaatatcccagaga

SEQ ID NO: 369684 - DNA, 16 bp, Homo sapiens
tctgtaaatgaacaca

SEQ ID NO: 369685 - DNA, 13 bp, Homo sapiens
tctgtaaatttaa

SEQ ID NO: 369686 - DNA, 16 bp, Homo sapiens
tctgtaaccacctctc

SEQ ID NO: 369687 - DNA, 13 bp, Homo sapiens
tctgtaacccttg

SEQ ID NO: 369688 - DNA, 14 bp, Homo sapiens
tctgtaacccttga

SEQ ID NO: 369689 - DNA, 21 bp, Homo sapiens
tctgtaagattttattttcaa

SEQ ID NO: 369690 - DNA, 16 bp, Homo sapiens
tctgtaatatattgcc

SEQ ID NO: 369691 - DNA, 21 bp, Homo sapiens
tctgtacatgtggaaaactca

SEQ ID NO: 369692 - DNA, 19 bp, Homo sapiens
tctgtaccctgcttcccaa

SEQ ID NO: 369693 - DNA, 22 bp, Homo sapiens
tctgtactccttggatttgcat

SEQ ID NO: 369694 - DNA, 19 bp, Homo sapiens
tctgtagacttctggttgt

SEQ ID NO: 369695 - DNA, 16 bp, Homo sapiens
tctgtagagcagggca

SEQ ID NO: 369696 - DNA, 19 bp, Homo sapiens
tctgtagctattctttgac

SEQ ID NO: 369697 - DNA, 23 bp, Homo sapiens
tctgtagctccctcctcccatct

SEQ ID NO: 369698 - DNA, 13 bp, Homo sapiens
tctgtagctcctc

SEQ ID NO: 369699 - DNA, 17 bp, Homo sapiens
tctgtaggagagactgg

SEQ ID NO: 369700 - DNA, 16 bp, Homo sapiens
tctgtagggctggacc

SEQ ID NO: 369701 - DNA, 13 bp, Homo sapiens
tctgtatatacat

SEQ ID NO: 369702 - DNA, 14 bp, Homo sapiens
tctgtatatacatt

SEQ ID NO: 369703 - DNA, 21 bp, Homo sapiens
tctgtatatgttgtaataaaa

SEQ ID NO: 369704 - DNA, 18 bp, Homo sapiens
tctgtatcaagcccctgt

SEQ ID NO: 369705 - DNA, 18 bp, Homo sapiens
tctgtatcggagacagtg

SEQ ID NO: 369706 - DNA, 19 bp, Homo sapiens
tctgtatcggagacagtga

SEQ ID NO: 369707 - DNA, 21 bp, Homo sapiens
tctgtatcggagacagtgatc

SEQ ID NO: 369708 - DNA, 14 bp, Homo sapiens
tctgtattctgcaa

SEQ ID NO: 369709 - DNA, 19 bp, Homo sapiens
tctgtatttttaaattctg

SEQ ID NO: 369710 - DNA, 14 bp, Homo sapiens
tctgtcaatgaaaa

SEQ ID NO: 369711 - DNA, 22 bp, Homo sapiens
tctgtcactgtaggtatagaag

SEQ ID NO: 369712 - DNA, 15 bp, Homo sapiens
tctgtcagcttccca

SEQ ID NO: 369713 - DNA, 17 bp, Homo sapiens
tctgtcagtttgtgaag

SEQ ID NO: 369714 - DNA, 15 bp, Homo sapiens
tctgtcatcactccc

SEQ ID NO: 369715 - DNA, 17 bp, Homo sapiens
tctgtccaaaggaggct

SEQ ID NO: 369716 - DNA, 21 bp, Homo sapiens
tctgtccaattccagagctgt

SEQ ID NO: 369717 - DNA, 19 bp, Homo sapiens
tctgtccagaggctgcaag

SEQ ID NO: 369718 - DNA, 14 bp, Homo sapiens
tctgtccagggctt

SEQ ID NO: 369719 - DNA, 20 bp, Homo sapiens
tctgtccatctgtctgtcct

SEQ ID NO: 369720 - DNA, 12 bp, Homo sapiens
tctgtccccagc

SEQ ID NO: 369721 - DNA, 12 bp, Homo sapiens
tctgtccctgtc

SEQ ID NO: 369722 - DNA, 14 bp, Homo sapiens
tctgtccctgtccc

SEQ ID NO: 369723 - DNA, 21 bp, Homo sapiens
tctgtcccttgtttttgatgt

SEQ ID NO: 369724 - DNA, 14 bp, Homo sapiens
tctgtccttcagat

SEQ ID NO: 369725 - DNA, 17 bp, Homo sapiens
tctgtccttccttccat

SEQ ID NO: 369726 - DNA, 16 bp, Homo sapiens
tctgtcgcccaggctg

SEQ ID NO: 369727 - DNA, 14 bp, Homo sapiens
tctgtctaccatct

SEQ ID NO: 369728 - DNA, 17 bp, Homo sapiens
tctgtctactgtggtga

SEQ ID NO: 369729 - DNA, 17 bp, Homo sapiens
tctgtctcataattgtc

SEQ ID NO: 369730 - DNA, 22 bp, Homo sapiens
tctgtctcccagttatgaatca

SEQ ID NO: 369731 - DNA, 22 bp, Homo sapiens
tctgtctccctataatgctgga

SEQ ID NO: 369732 - DNA, 21 bp, Homo sapiens
tctgtctctctctctttttct

SEQ ID NO: 369733 - DNA, 11 bp, Homo sapiens
tctgtctgagc

SEQ ID NO: 369734 - DNA, 19 bp, Homo sapiens
tctgtctgagccctgccct

SEQ ID NO: 369735 - DNA, 16 bp, Homo sapiens
tctgtctgattctatg

SEQ ID NO: 369736 - DNA, 17 bp, Homo sapiens
tctgtctgattctatgc

SEQ ID NO: 369737 - DNA, 14 bp, Homo sapiens
tctgtctgtaagat

SEQ ID NO: 369738 - DNA, 14 bp, Homo sapiens
tctgtctgtcccaa

SEQ ID NO: 369739 - DNA, 16 bp, Homo sapiens
tctgtctgtcctaccc

SEQ ID NO: 369740 - DNA, 20 bp, Homo sapiens
tctgtctgtcctacccgccc

SEQ ID NO: 369741 - DNA, 18 bp, Homo sapiens
tctgtctgtctgtcccaa

SEQ ID NO: 369742 - DNA, 17 bp, Homo sapiens
tctgtcttcaagggctt

SEQ ID NO: 369743 - DNA, 12 bp, Homo sapiens
tctgtcttcaca

SEQ ID NO: 369744 - DNA, 12 bp, Homo sapiens
tctgtcttcctg

SEQ ID NO: 369745 - DNA, 15 bp, Homo sapiens
tctgtcttcctggtc

SEQ ID NO: 369746 - DNA, 15 bp, Homo sapiens
tctgtcttctctcca

SEQ ID NO: 369747 - DNA, 15 bp, Homo sapiens
tctgtctttttcctt

SEQ ID NO: 369748 - DNA, 17 bp, Homo sapiens
tctgtctttttccttcc

SEQ ID NO: 369749 - DNA, 18 bp, Homo sapiens
tctgtctttttccttcct

SEQ ID NO: 369750 - DNA, 21 bp, Homo sapiens
tctgtgaaagtctcctgtatc

SEQ ID NO: 369751 - DNA, 17 bp, Homo sapiens
tctgtgaaatgctggca

SEQ ID NO: 369752 - DNA, 20 bp, Homo sapiens
tctgtgaagccctttgcctg

SEQ ID NO: 369753 - DNA, 18 bp, Homo sapiens
tctgtgaagcctttatct

SEQ ID NO: 369754 - DNA, 17 bp, Homo sapiens
tctgtgaataaagccac

SEQ ID NO: 369755 - DNA, 12 bp, Homo sapiens
tctgtgaataca

SEQ ID NO: 369756 - DNA, 19 bp, Homo sapiens
tctgtgaatacaattaaag

SEQ ID NO: 369757 - DNA, 22 bp, Homo sapiens
tctgtgaattaaaaaagctcaa

SEQ ID NO: 369758 - DNA, 13 bp, Homo sapiens
tcttgattgattt

SEQ ID NO: 369759 - DNA, 16 bp, Homo sapiens
tcttgcaaagccttta

SEQ ID NO: 369760 - DNA, 19 bp, Homo sapiens
tcttgcaaagcctttaaat

SEQ ID NO: 369761 - DNA, 16 bp, Homo sapiens
tcttgcatctgggcca

SEQ ID NO: 369762 - DNA, 16 bp, Homo sapiens
tcttgcattgaattta

SEQ ID NO: 369763 - DNA, 14 bp, Homo sapiens
tcttgccacacagt

SEQ ID NO: 369764 - DNA, 21 bp, Homo sapiens
tcttgccagcattttcacatt

SEQ ID NO: 369765 - DNA, 11 bp, Homo sapiens
tcttgccagct

SEQ ID NO: 369766 - DNA, 13 bp, Homo sapiens
tcttgccagctca

SEQ ID NO: 369767 - DNA, 14 bp, Homo sapiens
tcttgccagctcag

SEQ ID NO: 369768 - DNA, 21 bp, Homo sapiens
tcttgccccccaccccagcct

SEQ ID NO: 369769 - DNA, 12 bp, Homo sapiens
tcttgccctgag

SEQ ID NO: 369770 - DNA, 14 bp, Homo sapiens
tcttgcctctctca

SEQ ID NO: 369771 - DNA, 14 bp, Homo sapiens
tcttgctaactttg

SEQ ID NO: 369772 - DNA, 19 bp, Homo sapiens
tcttgctaagctccagccc

SEQ ID NO: 369773 - DNA, 17 bp, Homo sapiens
tcttgctatataaataa

SEQ ID NO: 369774 - DNA, 14 bp, Homo sapiens
tcttgctcactccc

SEQ ID NO: 369775 - DNA, 12 bp, Homo sapiens
tcttgctcctgt

SEQ ID NO: 369776 - DNA, 21 bp, Homo sapiens
tcttgctcttagattgggcca

SEQ ID NO: 369777 - DNA, 14 bp, Homo sapiens
tcttgctctttcta

SEQ ID NO: 369778 - DNA, 18 bp, Homo sapiens
tcttgctggattaatgtt

SEQ ID NO: 369779 - DNA, 19 bp, Homo sapiens
tcttgctggattaatgttt

SEQ ID NO: 369780 - DNA, 11 bp, Homo sapiens
tcttgctgtga

SEQ ID NO: 369781 - DNA, 13 bp, Homo sapiens
tcttgctgtggtc

SEQ ID NO: 369782 - DNA, 16 bp, Homo sapiens
tcttgcttgtaaaaat

SEQ ID NO: 369783 - DNA, 13 bp, Homo sapiens
tcttgctttcaca

SEQ ID NO: 369784 - DNA, 14 bp, Homo sapiens
tcttgctttcacaa

SEQ ID NO: 369785 - DNA, 22 bp, Homo sapiens
tcttgctttggtcttcttccaa

SEQ ID NO: 369786 - DNA, 19 bp, Homo sapiens
tcttggactccctccccac

SEQ ID NO: 369787 - DNA, 13 bp, Homo sapiens
tcttggagaggag

SEQ ID NO: 369788 - DNA, 20 bp, Homo sapiens
tcttggctcgtttgggctca

SEQ ID NO: 369789 - DNA, 16 bp, Homo sapiens
tcttggctggcttcct

SEQ ID NO: 369790 - DNA, 19 bp, Homo sapiens
tcttggcttctgggacctg

SEQ ID NO: 369791 - DNA, 20 bp, Homo sapiens
tcttggggctcgccccaccc

SEQ ID NO: 369792 - DNA, 13 bp, Homo sapiens
tcttgggggaggc

SEQ ID NO: 369793 - DNA, 18 bp, Homo sapiens
tcttgggggaggccaccc

SEQ ID NO: 369794 - DNA, 19 bp, Homo sapiens
tcttgggggaggccacccc

SEQ ID NO: 369795 - DNA, 21 bp, Homo sapiens
tcttggggtactcttgatgtg

SEQ ID NO: 369796 - DNA, 14 bp, Homo sapiens
tcttggtccctggt

SEQ ID NO: 369797 - DNA, 12 bp, Homo sapiens
tcttggtctctt

SEQ ID NO: 369798 - DNA, 15 bp, Homo sapiens
tcttgtaaaactgtg

SEQ ID NO: 369799 - DNA, 18 bp, Homo sapiens
tcttgtaaacctggaggg

SEQ ID NO: 369800 - DNA, 22 bp, Homo sapiens
tcttgtacagttaactctccca

SEQ ID NO: 369801 - DNA, 20 bp, Homo sapiens
tcttgtattttcttcccatt

SEQ ID NO: 369802 - DNA, 16 bp, Homo sapiens
tcttgtcacaataaat

SEQ ID NO: 369803 - DNA, 13 bp, Homo sapiens
tcttgtcatgtgt

SEQ ID NO: 369804 - DNA, 15 bp, Homo sapiens
tcttgtcatgtgtat

SEQ ID NO: 369805 - DNA, 14 bp, Homo sapiens
tcttgtgctagaat

SEQ ID NO: 369806 - DNA, 17 bp, Homo sapiens
tcttgtgctagaatact

SEQ ID NO: 369807 - DNA, 19 bp, Homo sapiens
tcttgtgctagaatacttt

SEQ ID NO: 369808 - DNA, 15 bp, Homo sapiens
tcttgtgctcacgct

SEQ ID NO: 369809 - DNA, 23 bp, Homo sapiens
tcttgtgtctccttatggtacac

SEQ ID NO: 369810 - DNA, 14 bp, Homo sapiens
tcttgtgtttgaaa

SEQ ID NO: 369811 - DNA, 22 bp, Homo sapiens
tcttgttcatgttttgctaatg

SEQ ID NO: 369812 - DNA, 16 bp, Homo sapiens
tcttgttgcatctttt

SEQ ID NO: 369813 - DNA, 16 bp, Homo sapiens
tcttgtttaccaaaga

SEQ ID NO: 369814 - DNA, 22 bp, Homo sapiens
tcttgtttggagggatcatttt

SEQ ID NO: 369815 - DNA, 13 bp, Homo sapiens
tctttaaactact

SEQ ID NO: 369816 - DNA, 16 bp, Homo sapiens
tctttaaactactgaa

SEQ ID NO: 369817 - DNA, 13 bp, Homo sapiens
tctttaaataaat

SEQ ID NO: 369818 - DNA, 15 bp, Homo sapiens
tctttaaataaatgt

SEQ ID NO: 369819 - DNA, 15 bp, Homo sapiens
tctttaactcataaa

SEQ ID NO: 369820 - DNA, 23 bp, Homo sapiens
tctttaatcattttgcctctttt

SEQ ID NO: 369821 - DNA, 15 bp, Homo sapiens
tctttaatctgttgt

SEQ ID NO: 369822 - DNA, 17 bp, Homo sapiens
tctttaatgttgtccag

SEQ ID NO: 369823 - DNA, 15 bp, Homo sapiens
tctttaattgtatct

SEQ ID NO: 369824 - DNA, 14 bp, Homo sapiens
tctttacaaaatga

SEQ ID NO: 369825 - DNA, 18 bp, Homo sapiens
tctttaccttcatttcat

SEQ ID NO: 369826 - DNA, 20 bp, Homo sapiens
tctttaccttcatttcatcc

SEQ ID NO: 369827 - DNA, 20 bp, Homo sapiens
tctttactactgcaagttca

SEQ ID NO: 369828 - DNA, 16 bp, Homo sapiens
tctttatacttaaaca

SEQ ID NO: 369829 - DNA, 21 bp, Homo sapiens
tctttatacttaaacagcttt

SEQ ID NO: 369830 - DNA, 15 bp, Homo sapiens
tctttattcttatta

SEQ ID NO: 369831 - DNA, 18 bp, Homo sapiens
tctttattttattattca

SEQ ID NO: 369832 - DNA, 16 bp, Homo sapiens
tctttcagaaaacaga

SEQ ID NO: 369833 - DNA, 20 bp, Homo sapiens
tctttcagaaaacagaaaaa

SEQ ID NO: 369834 - DNA, 19 bp, Homo sapiens
tctttcagccaagaattct

SEQ ID NO: 369835 - DNA, 18 bp, Homo sapiens
tctttcagcctgcttctt

SEQ ID NO: 369836 - DNA, 16 bp, Homo sapiens
tctttcatagttctgt

SEQ ID NO: 369837 - DNA, 20 bp, Homo sapiens
tctttcatagttctgttaaa

SEQ ID NO: 369838 - DNA, 14 bp, Homo sapiens
tctttccactttgt

SEQ ID NO: 369839 - DNA, 18 bp, Homo sapiens
tctttccatctcattaca

SEQ ID NO: 369840 - DNA, 13 bp, Homo sapiens
tctttccatgcag

SEQ ID NO: 369841 - DNA, 12 bp, Homo sapiens
tctttccccaga

SEQ ID NO: 369842 - DNA, 12 bp, Homo sapiens
tctttcccctcc

SEQ ID NO: 369843 - DNA, 13 bp, Homo sapiens
tctttcccctcct

SEQ ID NO: 369844 - DNA, 17 bp, Homo sapiens
tctttcccctcctttgt

SEQ ID NO: 369845 - DNA, 14 bp, Homo sapiens
tctttcctccttcc

SEQ ID NO: 369846 - DNA, 15 bp, Homo sapiens
tctttcctccttcca

SEQ ID NO: 369847 - DNA, 13 bp, Homo sapiens
tctttcctctctg

SEQ ID NO: 369848 - DNA, 13 bp, Homo sapiens
tctttccttgctc

SEQ ID NO: 369849 - DNA, 20 bp, Homo sapiens
tctttcctttcatcctcagc

SEQ ID NO: 369850 - DNA, 19 bp, Homo sapiens
tctttcgttggttgtttct

SEQ ID NO: 369851 - DNA, 20 bp, Homo sapiens
tctttcgttggttgtttctc

SEQ ID NO: 369852 - DNA, 22 bp, Homo sapiens
tctttcgttggttgtttctctg

SEQ ID NO: 369853 - DNA, 23 bp, Homo sapiens
tctttcgttggttgtttctctga

SEQ ID NO: 369854 - DNA, 19 bp, Homo sapiens
tctttctaatgtgtgaatc

SEQ ID NO: 369855 - DNA, 21 bp, Homo sapiens
tctttctacatgactgggcct

SEQ ID NO: 369856 - DNA, 18 bp, Homo sapiens
tctttctccttagtcttc

SEQ ID NO: 369857 - DNA, 12 bp, Homo sapiens
tctttctctcag

SEQ ID NO: 369858 - DNA, 13 bp, Homo sapiens
tctttctctctgt

SEQ ID NO: 369859 - DNA, 15 bp, Homo sapiens
tctttctctgccagt

SEQ ID NO: 369860 - DNA, 20 bp, Homo sapiens
tctttctgataactagatgg

SEQ ID NO: 369861 - DNA, 23 bp, Homo sapiens
tctttctgataactagatggtgc

SEQ ID NO: 369862 - DNA, 23 bp, Homo sapiens
tctttctggcctgccttcgttaa

SEQ ID NO: 369863 - DNA, 17 bp, Homo sapiens
tctttcttcctctgctg

SEQ ID NO: 369864 - DNA, 15 bp, Homo sapiens
tctttcttggtgcat

SEQ ID NO: 369865 - DNA, 17 bp, Homo sapiens
tctttctttacctgaga

SEQ ID NO: 369866 - DNA, 15 bp, Homo sapiens
tctttctttccaaag

SEQ ID NO: 369867 - DNA, 16 bp, Homo sapiens
tctttgaaacaacttt

SEQ ID NO: 369868 - DNA, 22 bp, Homo sapiens
tctttgaaatatgcatgtactt

SEQ ID NO: 369869 - DNA, 18 bp, Homo sapiens
tctttgaacgtacccaag

SEQ ID NO: 369870 - DNA, 22 bp, Homo sapiens
tctttgagaaaggattaagata

SEQ ID NO: 369871 - DNA, 20 bp, Homo sapiens
tctttgagtcaagtcaaata

SEQ ID NO: 369872 - DNA, 20 bp, Homo sapiens
tctttgataaagaaaagaat

SEQ ID NO: 369873 - DNA, 22 bp, Homo sapiens
tctttgataagatgaggaaata

SEQ ID NO: 369874 - DNA, 15 bp, Homo sapiens
tctttgattgtgaaa

SEQ ID NO: 369875 - DNA, 15 bp, Homo sapiens
tctttgatttaactg

SEQ ID NO: 369876 - DNA, 14 bp, Homo sapiens
tctttgccttgggc

SEQ ID NO: 369877 - DNA, 20 bp, Homo sapiens
tctttgctgaagaagaccag

SEQ ID NO: 369878 - DNA, 21 bp, Homo sapiens
tctttgctgaatgtcattatt

SEQ ID NO: 369879 - DNA, 22 bp, Homo sapiens
tctttgctgcagtcatctactt

SEQ ID NO: 369880 - DNA, 18 bp, Homo sapiens
tctttgctgcccctgtct

SEQ ID NO: 369881 - DNA, 12 bp, Homo sapiens
tctttgctgtgc

SEQ ID NO: 369882 - DNA, 15 bp, Homo sapiens
tctttgctgtgccaa

SEQ ID NO: 369883 - DNA, 19 bp, Homo sapiens
tctttgctgtgccaaagca

SEQ ID NO: 369884 - DNA, 12 bp, Homo sapiens
tctttgcttggg

SEQ ID NO: 369885 - DNA, 13 bp, Homo sapiens
tctttggcttcag

SEQ ID NO: 369886 - DNA, 22 bp, Homo sapiens
tctttgggggattcaaatgcat

SEQ ID NO: 369887 - DNA, 18 bp, Homo sapiens
tctttgtaaggacttgtg

SEQ ID NO: 369888 - DNA, 22 bp, Homo sapiens
tctttgtaaggacttgtgcctc

SEQ ID NO: 369889 - DNA, 16 bp, Homo sapiens
tgaagcttattaatgc

SEQ ID NO: 369890 - DNA, 15 bp, Homo sapiens
tgaaggaaaatgata

SEQ ID NO: 369891 - DNA, 19 bp, Homo sapiens
tgaaggaacattccttagt

SEQ ID NO: 369892 - DNA, 17 bp, Homo sapiens
tgaaggaatagccagag

SEQ ID NO: 369893 - DNA, 19 bp, Homo sapiens
tgaaggaattagaaatgaa

SEQ ID NO: 369894 - DNA, 16 bp, Homo sapiens
tgaaggagagcccttc

SEQ ID NO: 369895 - DNA, 18 bp, Homo sapiens
tgaaggagccacgtgaat

SEQ ID NO: 369896 - DNA, 16 bp, Homo sapiens
tgaaggcagtctgaac

SEQ ID NO: 369897 - DNA, 18 bp, Homo sapiens
tgaaggcagtctgaaccc

SEQ ID NO: 369898 - DNA, 19 bp, Homo sapiens
tgaaggcagtctgaaccct

SEQ ID NO: 369899 - DNA, 19 bp, Homo sapiens
tgaaggcccaagagcagag

SEQ ID NO: 369900 - DNA, 23 bp, Homo sapiens
tgaaggcccaagagcagagtctg

SEQ ID NO: 369901 - DNA, 20 bp, Homo sapiens
tgaaggcttttggtctccct

SEQ ID NO: 369902 - DNA, 17 bp, Homo sapiens
tgaagggagagccagct

SEQ ID NO: 369903 - DNA, 22 bp, Homo sapiens
tgaaggggcacaccactgccct

SEQ ID NO: 369904 - DNA, 16 bp, Homo sapiens
tgaagggtcatttctc

SEQ ID NO: 369905 - DNA, 16 bp, Homo sapiens
tgaaggtgcccaggag

SEQ ID NO: 369906 - DNA, 21 bp, Homo sapiens
tgaaggtgtgctacagaaaat

SEQ ID NO: 369907 - DNA, 18 bp, Homo sapiens
tgaaggttggaactgctg

SEQ ID NO: 369908 - DNA, 22 bp, Homo sapiens
tgaaggttggaactgctgccat

SEQ ID NO: 369909 - DNA, 22 bp, Homo sapiens
tgaagtaaccttataggttact

SEQ ID NO: 369910 - DNA, 20 bp, Homo sapiens
tgaagtaatgaatttttatg

SEQ ID NO: 369911 - DNA, 20 bp, Homo sapiens
tgaagtacatattaggaaaa

SEQ ID NO: 369912 - DNA, 19 bp, Homo sapiens
tgaagtactgcacccagca

SEQ ID NO: 369913 - DNA, 13 bp, Homo sapiens
tgaagtactttta

SEQ ID NO: 369914 - DNA, 16 bp, Homo sapiens
tgaagtacttttaacg

SEQ ID NO: 369915 - DNA, 17 bp, Homo sapiens
tgaagtcccaatttaag

SEQ ID NO: 369916 - DNA, 21 bp, Homo sapiens
tgaagtcccttcctgtcctgc

SEQ ID NO: 369917 - DNA, 13 bp, Homo sapiens
tgaagtccttcag

SEQ ID NO: 369918 - DNA, 22 bp, Homo sapiens
tgaagtccttcagtgagcccct

SEQ ID NO: 369919 - DNA, 20 bp, Homo sapiens
tgaagtctctttttcttcct

SEQ ID NO: 369920 - DNA, 23 bp, Homo sapiens
tgaagtctgcttaccaaaacata

SEQ ID NO: 369921 - DNA, 13 bp, Homo sapiens
tgaagtgaataca

SEQ ID NO: 369922 - DNA, 18 bp, Homo sapiens
tgaagttggacagcaaaa

SEQ ID NO: 369923 - DNA, 16 bp, Homo sapiens
tgaagtttacattgta

SEQ ID NO: 369924 - DNA, 13 bp, Homo sapiens
tgaagtttcacat

SEQ ID NO: 369925 - DNA, 18 bp, Homo sapiens
tgaataaaaaacatttgt

SEQ ID NO: 369926 - DNA, 14 bp, Homo sapiens
tgaataaaaaccct

SEQ ID NO: 369927 - DNA, 20 bp, Homo sapiens
tgaataaaaactttgctaaa

SEQ ID NO: 369928 - DNA, 14 bp, Homo sapiens
tgaataaaagtgca

SEQ ID NO: 369929 - DNA, 16 bp, Homo sapiens
tgaataaacacttttt

SEQ ID NO: 369930 - DNA, 17 bp, Homo sapiens
tgaataaacactttttc

SEQ ID NO: 369931 - DNA, 19 bp, Homo sapiens
tgaataaattctataggaa

SEQ ID NO: 369932 - DNA, 12 bp, Homo sapiens
tgaataacaaca

SEQ ID NO: 369933 - DNA, 15 bp, Homo sapiens
tgaataacaacaatt

SEQ ID NO: 369934 - DNA, 13 bp, Homo sapiens
tgaataacttgaa

SEQ ID NO: 369935 - DNA, 13 bp, Homo sapiens
tgaataagttgat

SEQ ID NO: 369936 - DNA, 15 bp, Homo sapiens
tgaatacaattaaag

SEQ ID NO: 369937 - DNA, 17 bp, Homo sapiens
tgaataccattaaaact

SEQ ID NO: 369938 - DNA, 20 bp, Homo sapiens
tgaatacttaatatgtggga

SEQ ID NO: 369939 - DNA, 14 bp, Homo sapiens
tgaatacttgaagt

SEQ ID NO: 369940 - DNA, 16 bp, Homo sapiens
tgaatagatgtgatca

SEQ ID NO: 369941 - DNA, 16 bp, Homo sapiens
tgaatatcatatgtat

SEQ ID NO: 369942 - DNA, 14 bp, Homo sapiens
tgaatatgcaattt

SEQ ID NO: 369943 - DNA, 19 bp, Homo sapiens
tgaatattaagaaacaatt

SEQ ID NO: 369944 - DNA, 17 bp, Homo sapiens
tgaatattgaagtttca

SEQ ID NO: 369945 - DNA, 11 bp, Homo sapiens
tgaatatttat

SEQ ID NO: 369946 - DNA, 18 bp, Homo sapiens
tgaatatttataacagca

SEQ ID NO: 369947 - DNA, 19 bp, Homo sapiens
tgaatatttataacagcat

SEQ ID NO: 369948 - DNA, 24 bp, Homo sapiens
tgaatattttttatttctaagtat

SEQ ID NO: 369949 - DNA, 18 bp, Homo sapiens
tgaatcagtatgaagaca

SEQ ID NO: 369950 - DNA, 22 bp, Homo sapiens
tgaatcctaagggctggtctct

SEQ ID NO: 369951 - DNA, 15 bp, Homo sapiens
tgaatcctggctctg

SEQ ID NO: 369952 - DNA, 18 bp, Homo sapiens
tgaatctctcaaaatgtg

SEQ ID NO: 369953 - DNA, 16 bp, Homo sapiens
tgaatcttatggtgga

SEQ ID NO: 369954 - DNA, 19 bp, Homo sapiens
tgaatctttccaataaacc

SEQ ID NO: 369955 - DNA, 18 bp, Homo sapiens
tgaatgaaaaatttaagc

SEQ ID NO: 369956 - DNA, 19 bp, Homo sapiens
tgaatgaaaaatttaagca

SEQ ID NO: 369957 - DNA, 20 bp, Homo sapiens
tgaatgaaaaatttaagcat

SEQ ID NO: 369958 - DNA, 23 bp, Homo sapiens
tgaatgaaagtcttgtgactagt

SEQ ID NO: 369959 - DNA, 16 bp, Homo sapiens
tgaatgaaatataaac

SEQ ID NO: 369960 - DNA, 17 bp, Homo sapiens
tgaatgacaacagaagc

SEQ ID NO: 369961 - DNA, 17 bp, Homo sapiens
tgaatgaggaacaatca

SEQ ID NO: 369962 - DNA, 22 bp, Homo sapiens
tgaatgagtaaataaactcttc

SEQ ID NO: 369963 - DNA, 22 bp, Homo sapiens
tgaatgagtttccagctaagcc

SEQ ID NO: 369964 - DNA, 15 bp, Homo sapiens
tgaatgatatctttg

SEQ ID NO: 369965 - DNA, 14 bp, Homo sapiens
tgaatgatgtttta

SEQ ID NO: 369966 - DNA, 19 bp, Homo sapiens
tgaatgatgttttagaatg

SEQ ID NO: 369967 - DNA, 14 bp, Homo sapiens
tgaatgcagtataa

SEQ ID NO: 369968 - DNA, 18 bp, Homo sapiens
tgaatgcagtataaaatg

SEQ ID NO: 369969 - DNA, 19 bp, Homo sapiens
tgaatgcagtataaaatgt

SEQ ID NO: 369970 - DNA, 14 bp, Homo sapiens
tgaatgccgtggat

SEQ ID NO: 369971 - DNA, 17 bp, Homo sapiens
tgaatgcgctttattgc

SEQ ID NO: 369972 - DNA, 20 bp, Homo sapiens
tgaatgctgtacctttctga

SEQ ID NO: 369973 - DNA, 22 bp, Homo sapiens
tgaatgctgtacctttctgaca

SEQ ID NO: 369974 - DNA, 13 bp, Homo sapiens
tgaatggattaaa

SEQ ID NO: 369975 - DNA, 16 bp, Homo sapiens
tgaatggattaaatgg

SEQ ID NO: 369976 - DNA, 19 bp, Homo sapiens
tgaatggattaaatggcac

SEQ ID NO: 369977 - DNA, 20 bp, Homo sapiens
tgaatggcggtttttatcca

SEQ ID NO: 369978 - DNA, 18 bp, Homo sapiens
tgaatggtgttgtatgcc

SEQ ID NO: 369979 - DNA, 20 bp, Homo sapiens
tgaatggtgttgtatgcctt

SEQ ID NO: 369980 - DNA, 23 bp, Homo sapiens
tgaatggttccatgcctgagggt

SEQ ID NO: 369981 - DNA, 15 bp, Homo sapiens
tgaatgtaaatttgt

SEQ ID NO: 369982 - DNA, 16 bp, Homo sapiens
tgaatgtaaatttgta

SEQ ID NO: 369983 - DNA, 18 bp, Homo sapiens
tgaatgtaaatttgtact

SEQ ID NO: 369984 - DNA, 19 bp, Homo sapiens
tgaatgtcagtgtgactga

SEQ ID NO: 369985 - DNA, 16 bp, Homo sapiens
tgaatgtctaaaattg

SEQ ID NO: 369986 - DNA, 14 bp, Homo sapiens
tgaatgttatttgt

SEQ ID NO: 369987 - DNA, 14 bp, Homo sapiens
tgaatgttctgaca

SEQ ID NO: 369988 - DNA, 15 bp, Homo sapiens
tgaatgttctgacat

SEQ ID NO: 369989 - DNA, 22 bp, Homo sapiens
tgaatgtttacactctttgtaa

SEQ ID NO: 369990 - DNA, 14 bp, Homo sapiens
tgaattatgataaa

SEQ ID NO: 369991 - DNA, 19 bp, Homo sapiens
tgaattattttgttactgt

SEQ ID NO: 369992 - DNA, 16 bp, Homo sapiens
tgaattcatactctgt

SEQ ID NO: 369993 - DNA, 16 bp, Homo sapiens
tgaattgaatgctcta

SEQ ID NO: 369994 - DNA, 22 bp, Homo sapiens
tgaattgcattttttaaaacaa

SEQ ID NO: 369995 - DNA, 21 bp, Homo sapiens
tgaattgtaaaagcaacatca

SEQ ID NO: 369996 - DNA, 13 bp, Homo sapiens
tgaattgtaagga

SEQ ID NO: 369997 - DNA, 17 bp, Homo sapiens
tgaatttaaataaagtt

SEQ ID NO: 369998 - DNA, 18 bp, Homo sapiens
tgaatttaaataaagtta

SEQ ID NO: 369999 - DNA, 16 bp, Homo sapiens
tgaatttaaatataat

SEQ ID NO: 370000 - DNA, 17 bp, Homo sapiens
tgaatttaagcatgagt

SEQ ID NO: 370001 - DNA, 19 bp, Homo sapiens
tgaatttaagcatgagtgg

SEQ ID NO: 370002 - DNA, 13 bp, Homo sapiens
tgaatttagtcat

SEQ ID NO: 370003 - DNA, 16 bp, Homo sapiens
tgaatttctagacagt

SEQ ID NO: 370004 - DNA, 13 bp, Homo sapiens
tgaatttctttga

SEQ ID NO: 370005 - DNA, 16 bp, Homo sapiens
tgaatttgaatgaaaa

SEQ ID NO: 370006 - DNA, 20 bp, Homo sapiens
tgaattttaaattaaagcaa

SEQ ID NO: 370007 - DNA, 23 bp, Homo sapiens
tgaattttggtgatgtaaaacag

SEQ ID NO: 370008 - DNA, 18 bp, Homo sapiens
tgaattttttcctaccat

SEQ ID NO: 370009 - DNA, 21 bp, Homo sapiens
tgaattttttttaacattcct

SEQ ID NO: 370010 - DNA, 22 bp, Homo sapiens
tgaattttttttaacattcctc

SEQ ID NO: 370011 - DNA, 13 bp, Homo sapiens
tgacaaaattttg

SEQ ID NO: 370012 - DNA, 16 bp, Homo sapiens
tgacaaagaaaatgag

SEQ ID NO: 370013 - DNA, 18 bp, Homo sapiens
tgacaaagtcatgaagct

SEQ ID NO: 370014 - DNA, 14 bp, Homo sapiens
tgacaacagaagct

SEQ ID NO: 370015 - DNA, 22 bp, Homo sapiens
tgacaacagaagcttcagaagt

SEQ ID NO: 370016 - DNA, 16 bp, Homo sapiens
tgacaacctttgtgta

SEQ ID NO: 370017 - DNA, 18 bp, Homo sapiens
tgacaacctttgtgtaat

SEQ ID NO: 370018 - DNA, 20 bp, Homo sapiens
tgacaacctttgtgtaataa

SEQ ID NO: 370019 - DNA, 22 bp, Homo sapiens
tgagcccctaccccacaccagg

SEQ ID NO: 370020 - DNA, 15 bp, Homo sapiens
tgagcccctccccag

SEQ ID NO: 370021 - DNA, 15 bp, Homo sapiens
tgagcccctcctctc

SEQ ID NO: 370022 - DNA, 20 bp, Homo sapiens
tgagcccgaatttctcactc

SEQ ID NO: 370023 - DNA, 18 bp, Homo sapiens
tgagccctccctcttccc

SEQ ID NO: 370024 - DNA, 22 bp, Homo sapiens
tgagccctgccctcactccact

SEQ ID NO: 370025 - DNA, 14 bp, Homo sapiens
tgagcctactgtct

SEQ ID NO: 370026 - DNA, 16 bp, Homo sapiens
tgagcctctccttgcc

SEQ ID NO: 370027 - DNA, 22 bp, Homo sapiens
tgagcctctttaacagctttct

SEQ ID NO: 370028 - DNA, 14 bp, Homo sapiens
tgagcctgccccag

SEQ ID NO: 370029 - DNA, 16 bp, Homo sapiens
tgagcctggtcctggc

SEQ ID NO: 370030 - DNA, 12 bp, Homo sapiens
tgagcctgtctc

SEQ ID NO: 370031 - DNA, 19 bp, Homo sapiens
tgagccttcgtgccccccc

SEQ ID NO: 370032 - DNA, 15 bp, Homo sapiens
tgagccttgctgcca

SEQ ID NO: 370033 - DNA, 17 bp, Homo sapiens
tgagccttgctgccaag

SEQ ID NO: 370034 - DNA, 13 bp, Homo sapiens
tgagccttgtaat

SEQ ID NO: 370035 - DNA, 23 bp, Homo sapiens
tgagcgattattatctaaagtgt

SEQ ID NO: 370036 - DNA, 19 bp, Homo sapiens
tgagcgcagagtaaaataa

SEQ ID NO: 370037 - DNA, 18 bp, Homo sapiens
tgagcgccccgcccccac

SEQ ID NO: 370038 - DNA, 19 bp, Homo sapiens
tgagcgccccgcccccacc

SEQ ID NO: 370039 - DNA, 23 bp, Homo sapiens
tgagcgccccgcccccaccccta

SEQ ID NO: 370040 - DNA, 19 bp, Homo sapiens
tgagcggccgcctgtcctt

SEQ ID NO: 370041 - DNA, 13 bp, Homo sapiens
tgagcgtgattct

SEQ ID NO: 370042 - DNA, 16 bp, Homo sapiens
tgagcgtgtccacaga

SEQ ID NO: 370043 - DNA, 18 bp, Homo sapiens
tgagcgtgtccacagagt

SEQ ID NO: 370044 - DNA, 18 bp, Homo sapiens
tgagctataatgtttccc

SEQ ID NO: 370045 - DNA, 19 bp, Homo sapiens
tgagctatttccattccag

SEQ ID NO: 370046 - DNA, 21 bp, Homo sapiens
tgagctcaaactggccttggt

SEQ ID NO: 370047 - DNA, 17 bp, Homo sapiens
tgagctcaggagagagc

SEQ ID NO: 370048 - DNA, 14 bp, Homo sapiens
tgagctccaccctc

SEQ ID NO: 370049 - DNA, 17 bp, Homo sapiens
tgagctccaccctcccc

SEQ ID NO: 370050 - DNA, 14 bp, Homo sapiens
tgagctccagaccc

SEQ ID NO: 370051 - DNA, 17 bp, Homo sapiens
tgagctccagaccccca

SEQ ID NO: 370052 - DNA, 22 bp, Homo sapiens
tgagctccccaccaccccagct

SEQ ID NO: 370053 - DNA, 22 bp, Homo sapiens
tgagctcccctggagccagcag

SEQ ID NO: 370054 - DNA, 13 bp, Homo sapiens
tgagctcctctgg

SEQ ID NO: 370055 - DNA, 20 bp, Homo sapiens
tgagctctcggaactgcatg

SEQ ID NO: 370056 - DNA, 17 bp, Homo sapiens
tgagctctctaatagaa

SEQ ID NO: 370057 - DNA, 15 bp, Homo sapiens
tgagctgccatccag

SEQ ID NO: 370058 - DNA, 15 bp, Homo sapiens
tgagctggggccaca

SEQ ID NO: 370059 - DNA, 11 bp, Homo sapiens
tgagctgtttt

SEQ ID NO: 370060 - DNA, 21 bp, Homo sapiens
tgagcttagccttgtgccctg

SEQ ID NO: 370061 - DNA, 19 bp, Homo sapiens
tgagcttcggttctccaga

SEQ ID NO: 370062 - DNA, 15 bp, Homo sapiens
tgagcttctctgtga

SEQ ID NO: 370063 - DNA, 16 bp, Homo sapiens
tgagcttgagctcccc

SEQ ID NO: 370064 - DNA, 15 bp, Homo sapiens
tgagcttgattctaa

SEQ ID NO: 370065 - DNA, 15 bp, Homo sapiens
tgagcttggccagaa

SEQ ID NO: 370066 - DNA, 17 bp, Homo sapiens
tgagctttccggggagg

SEQ ID NO: 370067 - DNA, 18 bp, Homo sapiens
tgagctttccggggagga

SEQ ID NO: 370068 - DNA, 19 bp, Homo sapiens
tgagctttctttttaaagc

SEQ ID NO: 370069 - DNA, 15 bp, Homo sapiens
tgagctttggacaca

SEQ ID NO: 370070 - DNA, 22 bp, Homo sapiens
tgaggaagcaaaagcatctatg

SEQ ID NO: 370071 - DNA, 18 bp, Homo sapiens
tgaggaagcctaaataaa

SEQ ID NO: 370072 - DNA, 23 bp, Homo sapiens
tgaggaagctccagtcctgctct

SEQ ID NO: 370073 - DNA, 17 bp, Homo sapiens
tgaggaataattattta

SEQ ID NO: 370074 - DNA, 21 bp, Homo sapiens
tgaggaatgcggttcagggct

SEQ ID NO: 370075 - DNA, 13 bp, Homo sapiens
tgaggacacatgt

SEQ ID NO: 370076 - DNA, 14 bp, Homo sapiens
tgaggacacatgtc

SEQ ID NO: 370077 - DNA, 13 bp, Homo sapiens
tgaggacagacag

SEQ ID NO: 370078 - DNA, 21 bp, Homo sapiens
tgaggacatgtttttgttttc

SEQ ID NO: 370079 - DNA, 23 bp, Homo sapiens
tgaggacttaaaatattcctgca

SEQ ID NO: 370080 - DNA, 12 bp, Homo sapiens
tgaggagctgct

SEQ ID NO: 370081 - DNA, 15 bp, Homo sapiens
tgaggagctgctggc

SEQ ID NO: 370082 - DNA, 15 bp, Homo sapiens
tgaggaggaagcaga

SEQ ID NO: 370083 - DNA, 17 bp, Homo sapiens
tgaggaggaagcagaat

SEQ ID NO: 370084 - DNA, 12 bp, Homo sapiens
tgaggaggaagg

SEQ ID NO: 370085 - DNA, 24 bp, Homo sapiens
tgaggaggcagaaagcagaggctg

SEQ ID NO: 370086 - DNA, 17 bp, Homo sapiens
tgaggagggtggaggaa

SEQ ID NO: 370087 - DNA, 16 bp, Homo sapiens
tgaggatgagctggaa

SEQ ID NO: 370088 - DNA, 16 bp, Homo sapiens
tgaggcaaccccctcg

SEQ ID NO: 370089 - DNA, 21 bp, Homo sapiens
tgaggcaaccccctcggagcc

SEQ ID NO: 370090 - DNA, 22 bp, Homo sapiens
tgaggcaagagaaatgaggaag

SEQ ID NO: 370091 - DNA, 20 bp, Homo sapiens
tgaggcacctgcatatctct

SEQ ID NO: 370092 - DNA, 13 bp, Homo sapiens
tgaggcaggagaa

SEQ ID NO: 370093 - DNA, 21 bp, Homo sapiens
tgaggcaggggagtctgcttg

SEQ ID NO: 370094 - DNA, 19 bp, Homo sapiens
tgaggccattccctgtagg

SEQ ID NO: 370095 - DNA, 16 bp, Homo sapiens
tgaggcccagcagagc

SEQ ID NO: 370096 - DNA, 14 bp, Homo sapiens
tgaggcccagcctg

SEQ ID NO: 370097 - DNA, 16 bp, Homo sapiens
tgaggcccagcctgtc

SEQ ID NO: 370098 - DNA, 20 bp, Homo sapiens
tgaggcccagcctgtcctgg

SEQ ID NO: 370099 - DNA, 15 bp, Homo sapiens
tgaggccccaggccc

SEQ ID NO: 370100 - DNA, 14 bp, Homo sapiens
tgaggcccccggag

SEQ ID NO: 370101 - DNA, 15 bp, Homo sapiens
tgaggcccccggagg

SEQ ID NO: 370102 - DNA, 16 bp, Homo sapiens
tgaggccgcatctttc

SEQ ID NO: 370103 - DNA, 20 bp, Homo sapiens
tgaggccgctagaggcctga

SEQ ID NO: 370104 - DNA, 22 bp, Homo sapiens
tgaggccgctagaggcctgagg

SEQ ID NO: 370105 - DNA, 23 bp, Homo sapiens
tgaggccgctagaggcctgagga

SEQ ID NO: 370106 - DNA, 19 bp, Homo sapiens
tgaggcctcagtggacttt

SEQ ID NO: 370107 - DNA, 22 bp, Homo sapiens
tgaggcctccagcttcaggcag

SEQ ID NO: 370108 - DNA, 11 bp, Homo sapiens
tgaggcctgga

SEQ ID NO: 370109 - DNA, 14 bp, Homo sapiens
tgaggcctggactt

SEQ ID NO: 370110 - DNA, 17 bp, Homo sapiens
tgaggcctggactttcc

SEQ ID NO: 370111 - DNA, 15 bp, Homo sapiens
tgaggcggcagctgg

SEQ ID NO: 370112 - DNA, 19 bp, Homo sapiens
tgaggcgtgggatccagag

SEQ ID NO: 370113 - DNA, 21 bp, Homo sapiens
tgaggctctgacccagtgaga

SEQ ID NO: 370114 - DNA, 12 bp, Homo sapiens
tgaggctgtcct

SEQ ID NO: 370115 - DNA, 14 bp, Homo sapiens
tgaggctgtcctgt

SEQ ID NO: 370116 - DNA, 20 bp, Homo sapiens
tgaggcttaacaatgtcttg

SEQ ID NO: 370117 - DNA, 17 bp, Homo sapiens
tgaggcttagagagagg

SEQ ID NO: 370118 - DNA, 17 bp, Homo sapiens
tgaggcttgggcccagt

SEQ ID NO: 370119 - DNA, 20 bp, Homo sapiens
tgaggcttttcccaccagct

SEQ ID NO: 370120 - DNA, 22 bp, Homo sapiens
tgaggcttttcccaccagctcc

SEQ ID NO: 370121 - DNA, 18 bp, Homo sapiens
tgagggaaacaaaatatt

SEQ ID NO: 370122 - DNA, 17 bp, Homo sapiens
tgagggaacagagaggt

SEQ ID NO: 370123 - DNA, 12 bp, Homo sapiens
tgagggaagccc

SEQ ID NO: 370124 - DNA, 20 bp, Homo sapiens
tgagggaccttggagagctc

SEQ ID NO: 370125 - DNA, 23 bp, Homo sapiens
tgagggacgaggtcaaggagata

SEQ ID NO: 370126 - DNA, 14 bp, Homo sapiens
tgagggagcttagc

SEQ ID NO: 370127 - DNA, 17 bp, Homo sapiens
tgagggagtgcagaaca

SEQ ID NO: 370128 - DNA, 22 bp, Homo sapiens
tgagggagtgcagaacacctgg

SEQ ID NO: 370129 - DNA, 19 bp, Homo sapiens
tgagggcactctctgccag

SEQ ID NO: 370130 - DNA, 22 bp, Homo sapiens
tgagggcactctctgccagctc

SEQ ID NO: 370131 - DNA, 23 bp, Homo sapiens
tgagggcactctctgccagctcc

SEQ ID NO: 370132 - DNA, 15 bp, Homo sapiens
tgagggcagcactgg

SEQ ID NO: 370133 - DNA, 15 bp, Homo sapiens
tgagggcccctctgc

SEQ ID NO: 370134 - DNA, 19 bp, Homo sapiens
tgagggcccctctgcccag

SEQ ID NO: 370135 - DNA, 13 bp, Homo sapiens
tgaggggccactg

SEQ ID NO: 370136 - DNA, 14 bp, Homo sapiens
tgaggggccaggcc

SEQ ID NO: 370137 - DNA, 16 bp, Homo sapiens
tgaggggcccgagcag

SEQ ID NO: 370138 - DNA, 14 bp, Homo sapiens
tgaggggctggcct

SEQ ID NO: 370139 - DNA, 14 bp, Homo sapiens
tgaggggcttccct

SEQ ID NO: 370140 - DNA, 18 bp, Homo sapiens
tgaggggcttccctctgc

SEQ ID NO: 370141 - DNA, 22 bp, Homo sapiens
tgaggggcttccctctgctcca

SEQ ID NO: 370142 - DNA, 18 bp, Homo sapiens
tgagggggagctgaaagg

SEQ ID NO: 370143 - DNA, 14 bp, Homo sapiens
tgagggtggagact

SEQ ID NO: 370144 - DNA, 18 bp, Homo sapiens
tgagggtgtccgctgctg

SEQ ID NO: 370145 - DNA, 22 bp, Homo sapiens
tgaggtagaccaggatttctaa

SEQ ID NO: 370146 - DNA, 15 bp, Homo sapiens
tgaggtcatcccggg

SEQ ID NO: 370147 - DNA, 13 bp, Homo sapiens
tgaggtcatgcat

SEQ ID NO: 370148 - DNA, 15 bp, Homo sapiens
tgaggtctgaaatgg

SEQ ID NO: 370149 - DNA, 22 bp, Homo sapiens
tgattccttgatggagatattt

SEQ ID NO: 370150 - DNA, 15 bp, Homo sapiens
tgattctaaagggga

SEQ ID NO: 370151 - DNA, 16 bp, Homo sapiens
tgattctaaaggggac

SEQ ID NO: 370152 - DNA, 17 bp, Homo sapiens
tgattctaatgtcttca

SEQ ID NO: 370153 - DNA, 15 bp, Homo sapiens
tgattctcatgcact

SEQ ID NO: 370154 - DNA, 22 bp, Homo sapiens
tgattctcatgcactgcaaata

SEQ ID NO: 370155 - DNA, 13 bp, Homo sapiens
tgattctcctctc

SEQ ID NO: 370156 - DNA, 14 bp, Homo sapiens
tgattctcctctcc

SEQ ID NO: 370157 - DNA, 13 bp, Homo sapiens
tgattctcctgcc

SEQ ID NO: 370158 - DNA, 16 bp, Homo sapiens
tgattctctcttctct

SEQ ID NO: 370159 - DNA, 21 bp, Homo sapiens
tgattctgtcccccacgtgga

SEQ ID NO: 370160 - DNA, 13 bp, Homo sapiens
tgattctgtgtgt

SEQ ID NO: 370161 - DNA, 15 bp, Homo sapiens
tgattcttttcccat

SEQ ID NO: 370162 - DNA, 22 bp, Homo sapiens
tgattgaaaatagtaaatgctt

SEQ ID NO: 370163 - DNA, 17 bp, Homo sapiens
tgattgaaccagctcat

SEQ ID NO: 370164 - DNA, 20 bp, Homo sapiens
tgattgaacgttctcaaacc

SEQ ID NO: 370165 - DNA, 22 bp, Homo sapiens
tgattgaatctgattggacatt

SEQ ID NO: 370166 - DNA, 12 bp, Homo sapiens
tgattgacattt

SEQ ID NO: 370167 - DNA, 13 bp, Homo sapiens
tgattgatttgaa

SEQ ID NO: 370168 - DNA, 17 bp, Homo sapiens
tgattgatttgaagtgg

SEQ ID NO: 370169 - DNA, 19 bp, Homo sapiens
tgattggaagagtgacctg

SEQ ID NO: 370170 - DNA, 23 bp, Homo sapiens
tgattggacattttcttcagaga

SEQ ID NO: 370171 - DNA, 17 bp, Homo sapiens
tgattggattattcatt

SEQ ID NO: 370172 - DNA, 18 bp, Homo sapiens
tgattggcagcttcaaaa

SEQ ID NO: 370173 - DNA, 20 bp, Homo sapiens
tgattggcagcttcaaaaca

SEQ ID NO: 370174 - DNA, 17 bp, Homo sapiens
tgattgtaaaatagctt

SEQ ID NO: 370175 - DNA, 16 bp, Homo sapiens
tgattgtaacatattt

SEQ ID NO: 370176 - DNA, 18 bp, Homo sapiens
tgattgttgagacgcctt

SEQ ID NO: 370177 - DNA, 12 bp, Homo sapiens
tgatttaacatt

SEQ ID NO: 370178 - DNA, 16 bp, Homo sapiens
tgatttacatgctgat

SEQ ID NO: 370179 - DNA, 15 bp, Homo sapiens
tgatttaggcttcta

SEQ ID NO: 370180 - DNA, 16 bp, Homo sapiens
tgatttatcacacaaa

SEQ ID NO: 370181 - DNA, 15 bp, Homo sapiens
tgatttatgcattta

SEQ ID NO: 370182 - DNA, 17 bp, Homo sapiens
tgatttcaatgattgtt

SEQ ID NO: 370183 - DNA, 13 bp, Homo sapiens
tgatttcatttca

SEQ ID NO: 370184 - DNA, 17 bp, Homo sapiens
tgatttcatttcaactg

SEQ ID NO: 370185 - DNA, 14 bp, Homo sapiens
tgatttccaggccc

SEQ ID NO: 370186 - DNA, 15 bp, Homo sapiens
tgatttccaggcccc

SEQ ID NO: 370187 - DNA, 20 bp, Homo sapiens
tgatttcccttttttcttcc

SEQ ID NO: 370188 - DNA, 17 bp, Homo sapiens
tgatttctagaaagcct

SEQ ID NO: 370189 - DNA, 13 bp, Homo sapiens
tgatttctattca

SEQ ID NO: 370190 - DNA, 22 bp, Homo sapiens
tgatttgagtttcctttaaata

SEQ ID NO: 370191 - DNA, 21 bp, Homo sapiens
tgatttgcatggattttggat

SEQ ID NO: 370192 - DNA, 19 bp, Homo sapiens
tgatttggaagagaggcac

SEQ ID NO: 370193 - DNA, 13 bp, Homo sapiens
tgatttgggggag

SEQ ID NO: 370194 - DNA, 18 bp, Homo sapiens
tgatttgggggaggcttt

SEQ ID NO: 370195 - DNA, 22 bp, Homo sapiens
tgatttgggggaggctttggga

SEQ ID NO: 370196 - DNA, 12 bp, Homo sapiens
tgattttaacaa

SEQ ID NO: 370197 - DNA, 17 bp, Homo sapiens
tgattttaacaataact

SEQ ID NO: 370198 - DNA, 22 bp, Homo sapiens
tgattttaacaataactactgt

SEQ ID NO: 370199 - DNA, 13 bp, Homo sapiens
tgattttaacttt

SEQ ID NO: 370200 - DNA, 20 bp, Homo sapiens
tgattttatttaaactattc

SEQ ID NO: 370201 - DNA, 14 bp, Homo sapiens
tgattttcaaaatc

SEQ ID NO: 370202 - DNA, 15 bp, Homo sapiens
tgattttcatcaatt

SEQ ID NO: 370203 - DNA, 13 bp, Homo sapiens
tgattttcctgtg

SEQ ID NO: 370204 - DNA, 16 bp, Homo sapiens
tgattttcctgtgtcc

SEQ ID NO: 370205 - DNA, 20 bp, Homo sapiens
tgattttgtttactgaaatt

SEQ ID NO: 370206 - DNA, 16 bp, Homo sapiens
tgatttttaagtacaa

SEQ ID NO: 370207 - DNA, 14 bp, Homo sapiens
tgatttttgtgtat

SEQ ID NO: 370208 - DNA, 16 bp, Homo sapiens
tgatttttttttttca

SEQ ID NO: 370209 - DNA, 13 bp, Homo sapiens
tgcaaaaagtaca

SEQ ID NO: 370210 - DNA, 20 bp, Homo sapiens
tgcaaaaagtacatagtgaa

SEQ ID NO: 370211 - DNA, 20 bp, Homo sapiens
tgcaaaagactaatttaaaa

SEQ ID NO: 370212 - DNA, 23 bp, Homo sapiens
tgcaaaagactaatttaaaaaat

SEQ ID NO: 370213 - DNA, 19 bp, Homo sapiens
tgcaaaaggttaagccata

SEQ ID NO: 370214 - DNA, 13 bp, Homo sapiens
tgcaaaattacct

SEQ ID NO: 370215 - DNA, 21 bp, Homo sapiens
tgcaaaatttccagtaccttt

SEQ ID NO: 370216 - DNA, 17 bp, Homo sapiens
tgcaaagaaaattctca

SEQ ID NO: 370217 - DNA, 12 bp, Homo sapiens
tgcaaaggactg

SEQ ID NO: 370218 - DNA, 22 bp, Homo sapiens
tgcaaagtaccaactgagccaa

SEQ ID NO: 370219 - DNA, 19 bp, Homo sapiens
tgcaaagtataaatttgtg

SEQ ID NO: 370220 - DNA, 21 bp, Homo sapiens
tgcaaagtataaatttgtgta

SEQ ID NO: 370221 - DNA, 21 bp, Homo sapiens
tgcaaagtgttttctcagaac

SEQ ID NO: 370222 - DNA, 23 bp, Homo sapiens
tgcaaagttccctacttcctgtg

SEQ ID NO: 370223 - DNA, 14 bp, Homo sapiens
tgcaaatagaaaac

SEQ ID NO: 370224 - DNA, 17 bp, Homo sapiens
tgcaaatagaaaacagg

SEQ ID NO: 370225 - DNA, 15 bp, Homo sapiens
tgcaaatagtttcaa

SEQ ID NO: 370226 - DNA, 19 bp, Homo sapiens
tgcaaatgcacatttgtca

SEQ ID NO: 370227 - DNA, 14 bp, Homo sapiens
tgcaaattaacagt

SEQ ID NO: 370228 - DNA, 12 bp, Homo sapiens
tgcaaattattc

SEQ ID NO: 370229 - DNA, 17 bp, Homo sapiens
tgcaaattattctagtc

SEQ ID NO: 370230 - DNA, 19 bp, Homo sapiens
tgcaaattattctagtcaa

SEQ ID NO: 370231 - DNA, 21 bp, Homo sapiens
tgcaaatttttttgtattttt

SEQ ID NO: 370232 - DNA, 15 bp, Homo sapiens
tgcaacaataataaa

SEQ ID NO: 370233 - DNA, 17 bp, Homo sapiens
tgcaacaataataaatg

SEQ ID NO: 370234 - DNA, 15 bp, Homo sapiens
tgcaacacacagaca

SEQ ID NO: 370235 - DNA, 13 bp, Homo sapiens
tgcaacagcactg

SEQ ID NO: 370236 - DNA, 17 bp, Homo sapiens
tgcaacagcactggctc

SEQ ID NO: 370237 - DNA, 21 bp, Homo sapiens
tgcaacatggattccaaagca

SEQ ID NO: 370238 - DNA, 23 bp, Homo sapiens
tgcaacatggattccaaagcatt

SEQ ID NO: 370239 - DNA, 23 bp, Homo sapiens
tgcaacatttacagtccttcaaa

SEQ ID NO: 370240 - DNA, 14 bp, Homo sapiens
tgcaaccacacacc

SEQ ID NO: 370241 - DNA, 15 bp, Homo sapiens
tgcaaccactgcaac

SEQ ID NO: 370242 - DNA, 15 bp, Homo sapiens
tgcaacccttacccc

SEQ ID NO: 370243 - DNA, 21 bp, Homo sapiens
tgcaacctctgcctcccaggt

SEQ ID NO: 370244 - DNA, 16 bp, Homo sapiens
tgcaactcaaggactt

SEQ ID NO: 370245 - DNA, 18 bp, Homo sapiens
tgcaactcatgaacaaaa

SEQ ID NO: 370246 - DNA, 19 bp, Homo sapiens
tgcaactcatgaacaaaat

SEQ ID NO: 370247 - DNA, 14 bp, Homo sapiens
tgcaactccatgcc

SEQ ID NO: 370248 - DNA, 15 bp, Homo sapiens
tgcaacttcatgtca

SEQ ID NO: 370249 - DNA, 15 bp, Homo sapiens
tgcaacttctgtccc

SEQ ID NO: 370250 - DNA, 15 bp, Homo sapiens
tgcaagaagaatata

SEQ ID NO: 370251 - DNA, 12 bp, Homo sapiens
tgcaagagaagg

SEQ ID NO: 370252 - DNA, 18 bp, Homo sapiens
tgcaagagaaggagatgt

SEQ ID NO: 370253 - DNA, 19 bp, Homo sapiens
tgcaagagtatactttgta

SEQ ID NO: 370254 - DNA, 15 bp, Homo sapiens
tgcaagcaaagaacc

SEQ ID NO: 370255 - DNA, 13 bp, Homo sapiens
tgcaagccccagg

SEQ ID NO: 370256 - DNA, 16 bp, Homo sapiens
tgcaagccccagggcc

SEQ ID NO: 370257 - DNA, 20 bp, Homo sapiens
tgcaagctgtccagagaaaa

SEQ ID NO: 370258 - DNA, 16 bp, Homo sapiens
tgcaaggaaggaaaca

SEQ ID NO: 370259 - DNA, 12 bp, Homo sapiens
tgcaaggcccac

SEQ ID NO: 370260 - DNA, 13 bp, Homo sapiens
tgcaaggcccaca

SEQ ID NO: 370261 - DNA, 17 bp, Homo sapiens
tgcaaggcccacaggag

SEQ ID NO: 370262 - DNA, 18 bp, Homo sapiens
tgcaagtatgtgagtgtg

SEQ ID NO: 370263 - DNA, 21 bp, Homo sapiens
tgcaagtatgttttagcatgt

SEQ ID NO: 370264 - DNA, 22 bp, Homo sapiens
tgcaagtatgttttagcatgtg

SEQ ID NO: 370265 - DNA, 19 bp, Homo sapiens
tgcaagtgtgtatgtgcgt

SEQ ID NO: 370266 - DNA, 13 bp, Homo sapiens
tgcaagtgtgtgc

SEQ ID NO: 370267 - DNA, 14 bp, Homo sapiens
tgcaagtgtttctg

SEQ ID NO: 370268 - DNA, 15 bp, Homo sapiens
tgcaagtgtttctgt

SEQ ID NO: 370269 - DNA, 19 bp, Homo sapiens
tgcaagttcaagactgaaa

SEQ ID NO: 370270 - DNA, 21 bp, Homo sapiens
tgcaataagaatttagggaga

SEQ ID NO: 370271 - DNA, 21 bp, Homo sapiens
tgcaatatgaggggactgcat

SEQ ID NO: 370272 - DNA, 23 bp, Homo sapiens
tgcaatatgaggggactgcatgc

SEQ ID NO: 370273 - DNA, 14 bp, Homo sapiens
tgcaatattccttt

SEQ ID NO: 370274 - DNA, 21 bp, Homo sapiens
tgcaatgaaaagaaaatgtgc

SEQ ID NO: 370275 - DNA, 13 bp, Homo sapiens
tgcaatgaagaag

SEQ ID NO: 370276 - DNA, 16 bp, Homo sapiens
tgcaatgacatcttca

SEQ ID NO: 370277 - DNA, 22 bp, Homo sapiens
tgcaatgcttttatatggccca

SEQ ID NO: 370278 - DNA, 19 bp, Homo sapiens
tgcaatgtcacaacctctc

SEQ ID NO: 370279 - DNA, 20 bp, Homo sapiens
tgcaatgttattattggctt

SEQ ID NO: 370280 - DNA, 17 bp, Homo sapiens
tgcatgcttagagcatg

SEQ ID NO: 370281 - DNA, 19 bp, Homo sapiens
tgcatggaatttgtaagtt

SEQ ID NO: 370282 - DNA, 20 bp, Homo sapiens
tgcatggacctaacattcga

SEQ ID NO: 370283 - DNA, 17 bp, Homo sapiens
tgcatggacgcctggct

SEQ ID NO: 370284 - DNA, 19 bp, Homo sapiens
tgcatggacgcctggctcc

SEQ ID NO: 370285 - DNA, 15 bp, Homo sapiens
tgcatggagtgtttg

SEQ ID NO: 370286 - DNA, 15 bp, Homo sapiens
tgcatggcagcaggc

SEQ ID NO: 370287 - DNA, 15 bp, Homo sapiens
tgcatggccacagcc

SEQ ID NO: 370288 - DNA, 22 bp, Homo sapiens
tgcatggccacagccacctcca

SEQ ID NO: 370289 - DNA, 12 bp, Homo sapiens
tgcatggcctcc

SEQ ID NO: 370290 - DNA, 13 bp, Homo sapiens
tgcatggcctccc

SEQ ID NO: 370291 - DNA, 19 bp, Homo sapiens
tgcatggcctcccagccac

SEQ ID NO: 370292 - DNA, 15 bp, Homo sapiens
tgcatggctcctgtc

SEQ ID NO: 370293 - DNA, 16 bp, Homo sapiens
tgcatggctcctgtct

SEQ ID NO: 370294 - DNA, 23 bp, Homo sapiens
tgcatggggtggggtagggctga

SEQ ID NO: 370295 - DNA, 18 bp, Homo sapiens
tgcatggtaatttatagt

SEQ ID NO: 370296 - DNA, 15 bp, Homo sapiens
tgcatgtagcatata

SEQ ID NO: 370297 - DNA, 16 bp, Homo sapiens
tgcatgtagcatataa

SEQ ID NO: 370298 - DNA, 18 bp, Homo sapiens
tgcatgtagcatataaat

SEQ ID NO: 370299 - DNA, 23 bp, Homo sapiens
tgcatgtgaagcatgctttgctg

SEQ ID NO: 370300 - DNA, 12 bp, Homo sapiens
tgcatgtgtgcg

SEQ ID NO: 370301 - DNA, 20 bp, Homo sapiens
tgcatgttttatgtgcactc

SEQ ID NO: 370302 - DNA, 15 bp, Homo sapiens
tgcattaaatgcttt

SEQ ID NO: 370303 - DNA, 17 bp, Homo sapiens
tgcattaacttaaaaga

SEQ ID NO: 370304 - DNA, 15 bp, Homo sapiens
tgcattacagagagg

SEQ ID NO: 370305 - DNA, 22 bp, Homo sapiens
tgcattacagagaggagaaaca

SEQ ID NO: 370306 - DNA, 13 bp, Homo sapiens
tgcattcaaaatc

SEQ ID NO: 370307 - DNA, 21 bp, Homo sapiens
tgcattcacaaggtgactggg

SEQ ID NO: 370308 - DNA, 12 bp, Homo sapiens
tgcattggccct

SEQ ID NO: 370309 - DNA, 22 bp, Homo sapiens
tgcattgtaatcatcatagaag

SEQ ID NO: 370310 - DNA, 16 bp, Homo sapiens
tgcattgtgtgagctt

SEQ ID NO: 370311 - DNA, 15 bp, Homo sapiens
tgcatttaaaatgga

SEQ ID NO: 370312 - DNA, 18 bp, Homo sapiens
tgcatttaaactcatttg

SEQ ID NO: 370313 - DNA, 21 bp, Homo sapiens
tgcatttagaactttctgctt

SEQ ID NO: 370314 - DNA, 16 bp, Homo sapiens
tgcatttataaatgtg

SEQ ID NO: 370315 - DNA, 19 bp, Homo sapiens
tgcatttattgcagtttat

SEQ ID NO: 370316 - DNA, 18 bp, Homo sapiens
tgcatttcacctgtgaca

SEQ ID NO: 370317 - DNA, 19 bp, Homo sapiens
tgcatttcacctgtgacaa

SEQ ID NO: 370318 - DNA, 13 bp, Homo sapiens
tgcatttcctgac

SEQ ID NO: 370319 - DNA, 18 bp, Homo sapiens
tgcatttctgaatagaaa

SEQ ID NO: 370320 - DNA, 19 bp, Homo sapiens
tgcatttctttatttctgt

SEQ ID NO: 370321 - DNA, 18 bp, Homo sapiens
tgcattttctcaggcagt

SEQ ID NO: 370322 - DNA, 16 bp, Homo sapiens
tgcattttctgggttc

SEQ ID NO: 370323 - DNA, 23 bp, Homo sapiens
tgcattttctgggttctgggtgg

SEQ ID NO: 370324 - DNA, 13 bp, Homo sapiens
tgcatttttgtat

SEQ ID NO: 370325 - DNA, 19 bp, Homo sapiens
tgcatttttgtgaaatgaa

SEQ ID NO: 370326 - DNA, 19 bp, Homo sapiens
tgcattttttaaaacaaga

SEQ ID NO: 370327 - DNA, 17 bp, Homo sapiens
tgccaaaaactaaaatt

SEQ ID NO: 370328 - DNA, 19 bp, Homo sapiens
tgccaaaaactaaaattca

SEQ ID NO: 370329 - DNA, 15 bp, Homo sapiens
tgccaaacagttgta

SEQ ID NO: 370330 - DNA, 20 bp, Homo sapiens
tgccaaagctagggtggccc

SEQ ID NO: 370331 - DNA, 21 bp, Homo sapiens
tgccaaagctagggtggccct

SEQ ID NO: 370332 - DNA, 19 bp, Homo sapiens
tgccaaagctggctttttg

SEQ ID NO: 370333 - DNA, 14 bp, Homo sapiens
tgccaaagggaaat

SEQ ID NO: 370334 - DNA, 21 bp, Homo sapiens
tgccaaagtgtctacatgtgc

SEQ ID NO: 370335 - DNA, 16 bp, Homo sapiens
tgccaaatatgtcctg

SEQ ID NO: 370336 - DNA, 15 bp, Homo sapiens
tgccaaatcctgggc

SEQ ID NO: 370337 - DNA, 22 bp, Homo sapiens
tgccaaatcctgggcatcccca

SEQ ID NO: 370338 - DNA, 18 bp, Homo sapiens
tgccaacaccacagaaat

SEQ ID NO: 370339 - DNA, 21 bp, Homo sapiens
tgccaacaccacagaaatggg

SEQ ID NO: 370340 - DNA, 23 bp, Homo sapiens
tgccaacaccttcttggcttctg

SEQ ID NO: 370341 - DNA, 15 bp, Homo sapiens
tgccaaccacctctg

SEQ ID NO: 370342 - DNA, 16 bp, Homo sapiens
tgccaaccacctctgg

SEQ ID NO: 370343 - DNA, 17 bp, Homo sapiens
tgccaaccacctctggc

SEQ ID NO: 370344 - DNA, 23 bp, Homo sapiens
tgccaacctgatgccccttcccc

SEQ ID NO: 370345 - DNA, 20 bp, Homo sapiens
tgccaactccatgaccaggc

SEQ ID NO: 370346 - DNA, 22 bp, Homo sapiens
tgccaactccatgaccaggcca

SEQ ID NO: 370347 - DNA, 14 bp, Homo sapiens
tgccaactttccag

SEQ ID NO: 370348 - DNA, 17 bp, Homo sapiens
tgccaactttccagact

SEQ ID NO: 370349 - DNA, 17 bp, Homo sapiens
tgccaagaactctgggc

SEQ ID NO: 370350 - DNA, 17 bp, Homo sapiens
tgccaagaactgaaaac

SEQ ID NO: 370351 - DNA, 18 bp, Homo sapiens
tgccaagaactgaaaaca

SEQ ID NO: 370352 - DNA, 22 bp, Homo sapiens
tgccaagattctactcttgtca

SEQ ID NO: 370353 - DNA, 14 bp, Homo sapiens
tgccaagcctggag

SEQ ID NO: 370354 - DNA, 15 bp, Homo sapiens
tgccaagcctggagc

SEQ ID NO: 370355 - DNA, 18 bp, Homo sapiens
tgccaagcctggagcccc

SEQ ID NO: 370356 - DNA, 16 bp, Homo sapiens
tgccaagctttcttct

SEQ ID NO: 370357 - DNA, 22 bp, Homo sapiens
tgccaaggccagagtggcctgg

SEQ ID NO: 370358 - DNA, 13 bp, Homo sapiens
tgccaaggctctc

SEQ ID NO: 370359 - DNA, 15 bp, Homo sapiens
tgccaagtcctgcct

SEQ ID NO: 370360 - DNA, 17 bp, Homo sapiens
tgccaagtcctgccttt

SEQ ID NO: 370361 - DNA, 17 bp, Homo sapiens
tgccaagtctcaggagg

SEQ ID NO: 370362 - DNA, 20 bp, Homo sapiens
tgccaagtctcaggaggagg

SEQ ID NO: 370363 - DNA, 18 bp, Homo sapiens
tgccaataaaagttttct

SEQ ID NO: 370364 - DNA, 21 bp, Homo sapiens
tgccaatgaggtctgaaatgg

SEQ ID NO: 370365 - DNA, 19 bp, Homo sapiens
tgccaatggtgtagctgtc

SEQ ID NO: 370366 - DNA, 21 bp, Homo sapiens
tgccaatggtgtagctgtcct

SEQ ID NO: 370367 - DNA, 22 bp, Homo sapiens
tgccaatggtgtagctgtcctc

SEQ ID NO: 370368 - DNA, 21 bp, Homo sapiens
tgccaattttgtcacagctct

SEQ ID NO: 370369 - DNA, 17 bp, Homo sapiens
tgccacacagtgggccg

SEQ ID NO: 370370 - DNA, 22 bp, Homo sapiens
tgccacactcagtcccccacca

SEQ ID NO: 370371 - DNA, 21 bp, Homo sapiens
tgccacactttcactggggat

SEQ ID NO: 370372 - DNA, 14 bp, Homo sapiens
tgccacagccaagc

SEQ ID NO: 370373 - DNA, 15 bp, Homo sapiens
tgccacagccaagcc

SEQ ID NO: 370374 - DNA, 17 bp, Homo sapiens
tgccacagccaagccca

SEQ ID NO: 370375 - DNA, 18 bp, Homo sapiens
tgccacagccaagcccac

SEQ ID NO: 370376 - DNA, 22 bp, Homo sapiens
tgccacagccaagcccaccctg

SEQ ID NO: 370377 - DNA, 12 bp, Homo sapiens
tgccacaggaca

SEQ ID NO: 370378 - DNA, 19 bp, Homo sapiens
tgccacattttgctttata

SEQ ID NO: 370379 - DNA, 14 bp, Homo sapiens
tgccaccaataaaa

SEQ ID NO: 370380 - DNA, 17 bp, Homo sapiens
tgccaccaataaaaatc

SEQ ID NO: 370381 - DNA, 19 bp, Homo sapiens
tgccaccaataaaaatcct

SEQ ID NO: 370382 - DNA, 18 bp, Homo sapiens
tgccaccacgtctgccag

SEQ ID NO: 370383 - DNA, 20 bp, Homo sapiens
tgccaccacgtctgccaggc

SEQ ID NO: 370384 - DNA, 22 bp, Homo sapiens
tgccaccacgtctgccaggccc

SEQ ID NO: 370385 - DNA, 17 bp, Homo sapiens
tgccaccaggagaacca

SEQ ID NO: 370386 - DNA, 22 bp, Homo sapiens
tgccaccaggagaaccactaca

SEQ ID NO: 370387 - DNA, 12 bp, Homo sapiens
tgccacccactc

SEQ ID NO: 370388 - DNA, 17 bp, Homo sapiens
tgccacccactcaggat

SEQ ID NO: 370389 - DNA, 20 bp, Homo sapiens
tgccacccactcaggattgg

SEQ ID NO: 370390 - DNA, 14 bp, Homo sapiens
tgccaccctctgca

SEQ ID NO: 370391 - DNA, 17 bp, Homo sapiens
tgccaccgtcacacagt

SEQ ID NO: 370392 - DNA, 15 bp, Homo sapiens
tgccacctatgcctg

SEQ ID NO: 370393 - DNA, 13 bp, Homo sapiens
tgccacctgcagc

SEQ ID NO: 370394 - DNA, 14 bp, Homo sapiens
tgccacctgcagcg

SEQ ID NO: 370395 - DNA, 19 bp, Homo sapiens
tgccacctggggcagtcac

SEQ ID NO: 370396 - DNA, 11 bp, Homo sapiens
tgccacctgtc

SEQ ID NO: 370397 - DNA, 22 bp, Homo sapiens
tgccactaggctgggtgcccac

SEQ ID NO: 370398 - DNA, 13 bp, Homo sapiens
tgccactccctga

SEQ ID NO: 370399 - DNA, 15 bp, Homo sapiens
tgccactccctgagc

SEQ ID NO: 370400 - DNA, 18 bp, Homo sapiens
tgccactctctgggactc

SEQ ID NO: 370401 - DNA, 12 bp, Homo sapiens
tgccactgcaaa

SEQ ID NO: 370402 - DNA, 19 bp, Homo sapiens
tgccactgccaggcacctg

SEQ ID NO: 370403 - DNA, 23 bp, Homo sapiens
tgccactgccaggcacctggcct

SEQ ID NO: 370404 - DNA, 13 bp, Homo sapiens
tgccactgcctct

SEQ ID NO: 370405 - DNA, 20 bp, Homo sapiens
tgccactgcctcttcctccc

SEQ ID NO: 370406 - DNA, 17 bp, Homo sapiens
tgccacttgacattcct

SEQ ID NO: 370407 - DNA, 19 bp, Homo sapiens
tgccacttgacattccttg

SEQ ID NO: 370408 - DNA, 12 bp, Homo sapiens
tgccagaagtgt

SEQ ID NO: 370409 - DNA, 13 bp, Homo sapiens
tgccagaagtgtg

SEQ ID NO: 370410 - DNA, 20 bp, Homo sapiens
tgccgtgggcctgtcgtgcc

SEQ ID NO: 370411 - DNA, 14 bp, Homo sapiens
tgcctaaaatatga

SEQ ID NO: 370412 - DNA, 19 bp, Homo sapiens
tgcctaaaattgtatgaaa

SEQ ID NO: 370413 - DNA, 15 bp, Homo sapiens
tgcctacagataatt

SEQ ID NO: 370414 - DNA, 22 bp, Homo sapiens
tgcctacggagggtgggctctg

SEQ ID NO: 370415 - DNA, 15 bp, Homo sapiens
tgcctactatgtgcg

SEQ ID NO: 370416 - DNA, 17 bp, Homo sapiens
tgcctactatgtgcgag

SEQ ID NO: 370417 - DNA, 15 bp, Homo sapiens
tgcctactctttgtt

SEQ ID NO: 370418 - DNA, 19 bp, Homo sapiens
tgcctagcactcacatgct

SEQ ID NO: 370419 - DNA, 22 bp, Homo sapiens
tgcctaggagctggctggcagg

SEQ ID NO: 370420 - DNA, 23 bp, Homo sapiens
tgcctaggagctggctggcaggt

SEQ ID NO: 370421 - DNA, 14 bp, Homo sapiens
tgcctatccatcct

SEQ ID NO: 370422 - DNA, 21 bp, Homo sapiens
tgcctatttactggaaacctg

SEQ ID NO: 370423 - DNA, 13 bp, Homo sapiens
tgcctcaatgcca

SEQ ID NO: 370424 - DNA, 15 bp, Homo sapiens
tgcctcaatgccagt

SEQ ID NO: 370425 - DNA, 14 bp, Homo sapiens
tgcctcagcctccg

SEQ ID NO: 370426 - DNA, 14 bp, Homo sapiens
tgcctcagccttcc

SEQ ID NO: 370427 - DNA, 16 bp, Homo sapiens
tgcctcagcgctgccc

SEQ ID NO: 370428 - DNA, 14 bp, Homo sapiens
tgcctcatgccaca

SEQ ID NO: 370429 - DNA, 13 bp, Homo sapiens
tgcctccaggagg

SEQ ID NO: 370430 - DNA, 14 bp, Homo sapiens
tgcctccaggaggg

SEQ ID NO: 370431 - DNA, 18 bp, Homo sapiens
tgcctccatggtgcctct

SEQ ID NO: 370432 - DNA, 21 bp, Homo sapiens
tgcctcccaagctcagagcag

SEQ ID NO: 370433 - DNA, 22 bp, Homo sapiens
tgcctcccaaggtcctctcagt

SEQ ID NO: 370434 - DNA, 18 bp, Homo sapiens
tgcctcccacgctgggac

SEQ ID NO: 370435 - DNA, 16 bp, Homo sapiens
tgcctcccaggttcca

SEQ ID NO: 370436 - DNA, 22 bp, Homo sapiens
tgcctccccaaccctgcccctg

SEQ ID NO: 370437 - DNA, 17 bp, Homo sapiens
tgcctccccccagaccc

SEQ ID NO: 370438 - DNA, 22 bp, Homo sapiens
tgcctccccccagaccccgccc

SEQ ID NO: 370439 - DNA, 18 bp, Homo sapiens
tgcctcccccgccacctg

SEQ ID NO: 370440 - DNA, 18 bp, Homo sapiens
tgcctccccggctcgagc

SEQ ID NO: 370441 - DNA, 19 bp, Homo sapiens
tgcctcccctcctctcctg

SEQ ID NO: 370442 - DNA, 19 bp, Homo sapiens
tgcctcccggctttgcagg

SEQ ID NO: 370443 - DNA, 14 bp, Homo sapiens
tgcctccctctctt

SEQ ID NO: 370444 - DNA, 20 bp, Homo sapiens
tgcctccctgaccctgcaga

SEQ ID NO: 370445 - DNA, 22 bp, Homo sapiens
tgcctccctggggaccaggagc

SEQ ID NO: 370446 - DNA, 13 bp, Homo sapiens
tgcctccctgtcc

SEQ ID NO: 370447 - DNA, 15 bp, Homo sapiens
tgcctccctgtccac

SEQ ID NO: 370448 - DNA, 12 bp, Homo sapiens
tgcctcccttcc

SEQ ID NO: 370449 - DNA, 13 bp, Homo sapiens
tgcctcccttccc

SEQ ID NO: 370450 - DNA, 18 bp, Homo sapiens
tgcctcccttcctccgct

SEQ ID NO: 370451 - DNA, 16 bp, Homo sapiens
tgcctccggccctgcc

SEQ ID NO: 370452 - DNA, 18 bp, Homo sapiens
tgcctccggccctgcccc

SEQ ID NO: 370453 - DNA, 19 bp, Homo sapiens
tgcctccggccctgcccca

SEQ ID NO: 370454 - DNA, 13 bp, Homo sapiens
tgcctcctcccat

SEQ ID NO: 370455 - DNA, 15 bp, Homo sapiens
tgcctcctctctccc

SEQ ID NO: 370456 - DNA, 18 bp, Homo sapiens
tgcctcctctctccctgc

SEQ ID NO: 370457 - DNA, 14 bp, Homo sapiens
tgcctcctctgtcc

SEQ ID NO: 370458 - DNA, 15 bp, Homo sapiens
tgcctcctctgtcct

SEQ ID NO: 370459 - DNA, 17 bp, Homo sapiens
tgcctcctctgtcctca

SEQ ID NO: 370460 - DNA, 14 bp, Homo sapiens
tgcctcgaggcacc

SEQ ID NO: 370461 - DNA, 15 bp, Homo sapiens
tgcctcgaggcaccg

SEQ ID NO: 370462 - DNA, 17 bp, Homo sapiens
tgcctctgaactgctgc

SEQ ID NO: 370463 - DNA, 21 bp, Homo sapiens
tgcctctgaactgctgctggt

SEQ ID NO: 370464 - DNA, 21 bp, Homo sapiens
tgcctctgacagcagcctgtg

SEQ ID NO: 370465 - DNA, 23 bp, Homo sapiens
tgcctctgacagcagcctgtgag

SEQ ID NO: 370466 - DNA, 22 bp, Homo sapiens
tgcctctgccttagaggagccc

SEQ ID NO: 370467 - DNA, 13 bp, Homo sapiens
tgcctctgccttg

SEQ ID NO: 370468 - DNA, 17 bp, Homo sapiens
tgcctctggaggcctct

SEQ ID NO: 370469 - DNA, 19 bp, Homo sapiens
tgcctctgggtgagtggct

SEQ ID NO: 370470 - DNA, 22 bp, Homo sapiens
tgcctctgggtgagtggctgac

SEQ ID NO: 370471 - DNA, 17 bp, Homo sapiens
tgcctcttctacctctt

SEQ ID NO: 370472 - DNA, 20 bp, Homo sapiens
tgcctcttctacctcttcca

SEQ ID NO: 370473 - DNA, 15 bp, Homo sapiens
tgcctcttgggagac

SEQ ID NO: 370474 - DNA, 18 bp, Homo sapiens
tgcctctttcctgttgtt

SEQ ID NO: 370475 - DNA, 19 bp, Homo sapiens
tgcctgaaacagccatgtc

SEQ ID NO: 370476 - DNA, 17 bp, Homo sapiens
tgcctgacactgagccc

SEQ ID NO: 370477 - DNA, 22 bp, Homo sapiens
tgcctgacactgagccccacct

SEQ ID NO: 370478 - DNA, 20 bp, Homo sapiens
tgcctgaccatcccatgagc

SEQ ID NO: 370479 - DNA, 21 bp, Homo sapiens
tgcctgaccccttgctccctt

SEQ ID NO: 370480 - DNA, 22 bp, Homo sapiens
tgcctgactaattttgtatttt

SEQ ID NO: 370481 - DNA, 15 bp, Homo sapiens
tgcctgagggcccct

SEQ ID NO: 370482 - DNA, 21 bp, Homo sapiens
tgcctgagggcccctctgccc

SEQ ID NO: 370483 - DNA, 19 bp, Homo sapiens
tgcctgagggcgaggggag

SEQ ID NO: 370484 - DNA, 15 bp, Homo sapiens
tgcctgcaccaggag

SEQ ID NO: 370485 - DNA, 18 bp, Homo sapiens
tgcctgcaccaggagaca

SEQ ID NO: 370486 - DNA, 20 bp, Homo sapiens
tgcctgcaccaggagacaga

SEQ ID NO: 370487 - DNA, 14 bp, Homo sapiens
tgcctgcagagcag

SEQ ID NO: 370488 - DNA, 11 bp, Homo sapiens
tgcctgccact

SEQ ID NO: 370489 - DNA, 13 bp, Homo sapiens
tgcctgccactct

SEQ ID NO: 370490 - DNA, 15 bp, Homo sapiens
tgcctgccactctct

SEQ ID NO: 370491 - DNA, 16 bp, Homo sapiens
tgcctgccactctctg

SEQ ID NO: 370492 - DNA, 14 bp, Homo sapiens
tgcctgcccacccg

SEQ ID NO: 370493 - DNA, 18 bp, Homo sapiens
tgcctgcccgcacagcag

SEQ ID NO: 370494 - DNA, 22 bp, Homo sapiens
tgcctgcccgcacagcagcctg

SEQ ID NO: 370495 - DNA, 20 bp, Homo sapiens
tgcctgcctccggccctgcc

SEQ ID NO: 370496 - DNA, 14 bp, Homo sapiens
tgcctgcctgtctg

SEQ ID NO: 370497 - DNA, 14 bp, Homo sapiens
tgcctgctagagca

SEQ ID NO: 370498 - DNA, 18 bp, Homo sapiens
tgcctgctagagcaaccc

SEQ ID NO: 370499 - DNA, 16 bp, Homo sapiens
tgcctgctatccagcc

SEQ ID NO: 370500 - DNA, 18 bp, Homo sapiens
tgcctgctatccagccgc

SEQ ID NO: 370501 - DNA, 19 bp, Homo sapiens
tgcctgctatccagccgca

SEQ ID NO: 370502 - DNA, 19 bp, Homo sapiens
tgcctgctctccttgccct

SEQ ID NO: 370503 - DNA, 23 bp, Homo sapiens
tgcctgctctccttgccctgggc

SEQ ID NO: 370504 - DNA, 15 bp, Homo sapiens
tgcctggacaaaccc

SEQ ID NO: 370505 - DNA, 11 bp, Homo sapiens
tgcctggagct

SEQ ID NO: 370506 - DNA, 17 bp, Homo sapiens
tgcctggagctcctggg

SEQ ID NO: 370507 - DNA, 16 bp, Homo sapiens
tgcctggatttcttcc

SEQ ID NO: 370508 - DNA, 17 bp, Homo sapiens
tgcctggcccagggagg

SEQ ID NO: 370509 - DNA, 21 bp, Homo sapiens
tgcctggcccccctccaggca

SEQ ID NO: 370510 - DNA, 13 bp, Homo sapiens
tgcctggcctggc

SEQ ID NO: 370511 - DNA, 16 bp, Homo sapiens
tgcctggcctggctcc

SEQ ID NO: 370512 - DNA, 19 bp, Homo sapiens
tgcctggcgggcagcccct

SEQ ID NO: 370513 - DNA, 20 bp, Homo sapiens
tgcctggcgggcagcccctg

SEQ ID NO: 370514 - DNA, 21 bp, Homo sapiens
tgcctggcgggcagcccctgc

SEQ ID NO: 370515 - DNA, 11 bp, Homo sapiens
tgcctggctgt

SEQ ID NO: 370516 - DNA, 12 bp, Homo sapiens
tgcctggctgtg

SEQ ID NO: 370517 - DNA, 13 bp, Homo sapiens
tgcctggctgtgg

SEQ ID NO: 370518 - DNA, 15 bp, Homo sapiens
tgcctggctgtggag

SEQ ID NO: 370519 - DNA, 19 bp, Homo sapiens
tgcctggctgtggaggcct

SEQ ID NO: 370520 - DNA, 16 bp, Homo sapiens
tgcctgggaatgtatt

SEQ ID NO: 370521 - DNA, 19 bp, Homo sapiens
tgcctgggatcagtggggc

SEQ ID NO: 370522 - DNA, 15 bp, Homo sapiens
tgcctgggcctgtgc

SEQ ID NO: 370523 - DNA, 21 bp, Homo sapiens
tgcctgggcctgtgcagcagc

SEQ ID NO: 370524 - DNA, 22 bp, Homo sapiens
tgcctgggcctgtgcagcagcc

SEQ ID NO: 370525 - DNA, 11 bp, Homo sapiens
tgcctggtgcg

SEQ ID NO: 370526 - DNA, 19 bp, Homo sapiens
tgcctggtgcgctgtgctc

SEQ ID NO: 370527 - DNA, 14 bp, Homo sapiens
tgcctgtagagcca

SEQ ID NO: 370528 - DNA, 22 bp, Homo sapiens
tgcctgtagagccagccttggt

SEQ ID NO: 370529 - DNA, 15 bp, Homo sapiens
tgcctgtagttagga

SEQ ID NO: 370530 - DNA, 19 bp, Homo sapiens
tgcctgtagttaggaaata

SEQ ID NO: 370531 - DNA, 20 bp, Homo sapiens
tgcctgtagttaggaaataa

SEQ ID NO: 370532 - DNA, 17 bp, Homo sapiens
tgcctgtatcttttatt

SEQ ID NO: 370533 - DNA, 14 bp, Homo sapiens
tgcctgtatttcca

SEQ ID NO: 370534 - DNA, 14 bp, Homo sapiens
tgcctgtattttcg

SEQ ID NO: 370535 - DNA, 17 bp, Homo sapiens
tgcctgtcacgctctgg

SEQ ID NO: 370536 - DNA, 16 bp, Homo sapiens
tgcctgtcactactgg

SEQ ID NO: 370537 - DNA, 16 bp, Homo sapiens
tgcctgtccagcctgg

SEQ ID NO: 370538 - DNA, 14 bp, Homo sapiens
tgcctgtccctctc

SEQ ID NO: 370539 - DNA, 14 bp, Homo sapiens
tgcctgtctctgtt

SEQ ID NO: 370540 - DNA, 15 bp, Homo sapiens
tgcctgtctctgttc

SEQ ID NO: 370541 - DNA, 19 bp, Homo sapiens
tgctctttgtggcagtggc

SEQ ID NO: 370542 - DNA, 13 bp, Homo sapiens
tgctcttttacta

SEQ ID NO: 370543 - DNA, 14 bp, Homo sapiens
tgctcttttcccag

SEQ ID NO: 370544 - DNA, 22 bp, Homo sapiens
tgctgaaaaccatctggcctgg

SEQ ID NO: 370545 - DNA, 23 bp, Homo sapiens
tgctgaaacacacaggccatttc

SEQ ID NO: 370546 - DNA, 12 bp, Homo sapiens
tgctgaaataaa

SEQ ID NO: 370547 - DNA, 15 bp, Homo sapiens
tgctgaaataaacta

SEQ ID NO: 370548 - DNA, 12 bp, Homo sapiens
tgctgaacattt

SEQ ID NO: 370549 - DNA, 13 bp, Homo sapiens
tgctgaagcttat

SEQ ID NO: 370550 - DNA, 19 bp, Homo sapiens
tgctgaagcttattaatgc

SEQ ID NO: 370551 - DNA, 22 bp, Homo sapiens
tgctgaagcttattaatgctaa

SEQ ID NO: 370552 - DNA, 11 bp, Homo sapiens
tgctgaagtac

SEQ ID NO: 370553 - DNA, 16 bp, Homo sapiens
tgctgaataacaacaa

SEQ ID NO: 370554 - DNA, 18 bp, Homo sapiens
tgctgaataacaacaatt

SEQ ID NO: 370555 - DNA, 21 bp, Homo sapiens
tgctgaatgcattcaggggaa

SEQ ID NO: 370556 - DNA, 16 bp, Homo sapiens
tgctgaatgtcattat

SEQ ID NO: 370557 - DNA, 20 bp, Homo sapiens
tgctgaatgtcattatttga

SEQ ID NO: 370558 - DNA, 23 bp, Homo sapiens
tgctgaatgtcattatttgataa

SEQ ID NO: 370559 - DNA, 18 bp, Homo sapiens
tgctgaattcctttacaa

SEQ ID NO: 370560 - DNA, 14 bp, Homo sapiens
tgctgaccccagga

SEQ ID NO: 370561 - DNA, 23 bp, Homo sapiens
tgctgaccccaggaagtgggaga

SEQ ID NO: 370562 - DNA, 14 bp, Homo sapiens
tgctgactgtactc

SEQ ID NO: 370563 - DNA, 16 bp, Homo sapiens
tgctgactgtactcct

SEQ ID NO: 370564 - DNA, 17 bp, Homo sapiens
tgctgagaagcttttga

SEQ ID NO: 370565 - DNA, 14 bp, Homo sapiens
tgctgagagccccc

SEQ ID NO: 370566 - DNA, 20 bp, Homo sapiens
tgctgagatgtttagtagct

SEQ ID NO: 370567 - DNA, 21 bp, Homo sapiens
tgctgagatgtttagtagctg

SEQ ID NO: 370568 - DNA, 16 bp, Homo sapiens
tgctgagattcttcag

SEQ ID NO: 370569 - DNA, 16 bp, Homo sapiens
tgctgagcttagcctt

SEQ ID NO: 370570 - DNA, 17 bp, Homo sapiens
tgctgaggactccctcc

SEQ ID NO: 370571 - DNA, 16 bp, Homo sapiens
tgctgaggagggggag

SEQ ID NO: 370572 - DNA, 17 bp, Homo sapiens
tgctgaggcctccagct

SEQ ID NO: 370573 - DNA, 22 bp, Homo sapiens
tgctgagggaccttggagagct

SEQ ID NO: 370574 - DNA, 21 bp, Homo sapiens
tgctgagtatgttaagctctt

SEQ ID NO: 370575 - DNA, 19 bp, Homo sapiens
tgctgagtctgtgaataaa

SEQ ID NO: 370576 - DNA, 17 bp, Homo sapiens
tgctgagtggtccacat

SEQ ID NO: 370577 - DNA, 21 bp, Homo sapiens
tgctgatcgccttatttatat

SEQ ID NO: 370578 - DNA, 21 bp, Homo sapiens
tgctgatgaactcttaatcaa

SEQ ID NO: 370579 - DNA, 13 bp, Homo sapiens
tgctgatggcttg

SEQ ID NO: 370580 - DNA, 19 bp, Homo sapiens
tgctgatggcttgacatgt

SEQ ID NO: 370581 - DNA, 18 bp, Homo sapiens
tgctgatgtaggagctgg

SEQ ID NO: 370582 - DNA, 22 bp, Homo sapiens
tgctgcaaagagttatatgact

SEQ ID NO: 370583 - DNA, 20 bp, Homo sapiens
tgctgcagacaaaaagaaca

SEQ ID NO: 370584 - DNA, 22 bp, Homo sapiens
tgctgccaccaaatctgtctag

SEQ ID NO: 370585 - DNA, 13 bp, Homo sapiens
tgctgccatgcca

SEQ ID NO: 370586 - DNA, 21 bp, Homo sapiens
tgctgccatgccactgccagg

SEQ ID NO: 370587 - DNA, 22 bp, Homo sapiens
tgctgccatgccactgccaggc

SEQ ID NO: 370588 - DNA, 14 bp, Homo sapiens
tgctgcccacggcc

SEQ ID NO: 370589 - DNA, 18 bp, Homo sapiens
tgctgcccacggccaccc

SEQ ID NO: 370590 - DNA, 14 bp, Homo sapiens
tgctgccccagctg

SEQ ID NO: 370591 - DNA, 21 bp, Homo sapiens
tgctgccccgttccctgtcag

SEQ ID NO: 370592 - DNA, 22 bp, Homo sapiens
tgctgccccgttccctgtcaga

SEQ ID NO: 370593 - DNA, 20 bp, Homo sapiens
tgctgcccctgtctggaaga

SEQ ID NO: 370594 - DNA, 20 bp, Homo sapiens
tgctgccgcctcccagcctg

SEQ ID NO: 370595 - DNA, 13 bp, Homo sapiens
tgctgcctaggct

SEQ ID NO: 370596 - DNA, 15 bp, Homo sapiens
tgctgcctctgaaaa

SEQ ID NO: 370597 - DNA, 11 bp, Homo sapiens
tgctgcctgcc

SEQ ID NO: 370598 - DNA, 14 bp, Homo sapiens
tgctgccttcaggg

SEQ ID NO: 370599 - DNA, 15 bp, Homo sapiens
tgctgccttcaggga

SEQ ID NO: 370600 - DNA, 22 bp, Homo sapiens
tgctgccttcagggagacaggc

SEQ ID NO: 370601 - DNA, 17 bp, Homo sapiens
tgctgctaatcttcagg

SEQ ID NO: 370602 - DNA, 21 bp, Homo sapiens
tgctgctaatcttcagggcac

SEQ ID NO: 370603 - DNA, 21 bp, Homo sapiens
tgctgctatgaaaatgagcat

SEQ ID NO: 370604 - DNA, 13 bp, Homo sapiens
tgctgctcctctt

SEQ ID NO: 370605 - DNA, 20 bp, Homo sapiens
tgctgctgtaactgctgagc

SEQ ID NO: 370606 - DNA, 16 bp, Homo sapiens
tgctgctgtgcctgcg

SEQ ID NO: 370607 - DNA, 17 bp, Homo sapiens
tgctgcttccctctgcc

SEQ ID NO: 370608 - DNA, 21 bp, Homo sapiens
tgctgcttccctctgcctgtc

SEQ ID NO: 370609 - DNA, 17 bp, Homo sapiens
tgctgcttcctaactta

SEQ ID NO: 370610 - DNA, 16 bp, Homo sapiens
tgctgcttctcttggg

SEQ ID NO: 370611 - DNA, 22 bp, Homo sapiens
tgctgcttgaaacttcagccct

SEQ ID NO: 370612 - DNA, 14 bp, Homo sapiens
tgctgctttccttc

SEQ ID NO: 370613 - DNA, 15 bp, Homo sapiens
tgctgctttgcttct

SEQ ID NO: 370614 - DNA, 13 bp, Homo sapiens
tgctgcttttgat

SEQ ID NO: 370615 - DNA, 21 bp, Homo sapiens
tgctggaaaatctgtaaaaaa

SEQ ID NO: 370616 - DNA, 16 bp, Homo sapiens
tgctggaaaccacact

SEQ ID NO: 370617 - DNA, 16 bp, Homo sapiens
tgctggacaggtctgg

SEQ ID NO: 370618 - DNA, 12 bp, Homo sapiens
tgctggagaggt

SEQ ID NO: 370619 - DNA, 11 bp, Homo sapiens
tgctggagagt

SEQ ID NO: 370620 - DNA, 12 bp, Homo sapiens
tgctggagcctg

SEQ ID NO: 370621 - DNA, 17 bp, Homo sapiens
tgctggagtcctgttct

SEQ ID NO: 370622 - DNA, 18 bp, Homo sapiens
tgctggagtcctgttctc

SEQ ID NO: 370623 - DNA, 17 bp, Homo sapiens
tgctggatattttcaaa

SEQ ID NO: 370624 - DNA, 13 bp, Homo sapiens
tgctggcacagac

SEQ ID NO: 370625 - DNA, 15 bp, Homo sapiens
tgctggccagcctgg

SEQ ID NO: 370626 - DNA, 16 bp, Homo sapiens
tgctggccagcctggg

SEQ ID NO: 370627 - DNA, 21 bp, Homo sapiens
tgctggccagcctggggcctg

SEQ ID NO: 370628 - DNA, 23 bp, Homo sapiens
tgctggccagcctggggcctggc

SEQ ID NO: 370629 - DNA, 11 bp, Homo sapiens
tgctggcccca

SEQ ID NO: 370630 - DNA, 22 bp, Homo sapiens
tgctggcccctcacctgggcac

SEQ ID NO: 370631 - DNA, 21 bp, Homo sapiens
tgctggcctcccaataaagct

SEQ ID NO: 370632 - DNA, 20 bp, Homo sapiens
tgctggcggcgcagagggaa

SEQ ID NO: 370633 - DNA, 17 bp, Homo sapiens
tgctggctccacgccct

SEQ ID NO: 370634 - DNA, 13 bp, Homo sapiens
tgctggctgccca

SEQ ID NO: 370635 - DNA, 15 bp, Homo sapiens
tgctggctgccttag

SEQ ID NO: 370636 - DNA, 17 bp, Homo sapiens
tgctggcttccgctgtc

SEQ ID NO: 370637 - DNA, 19 bp, Homo sapiens
tgctggcttccgctgtcac

SEQ ID NO: 370638 - DNA, 22 bp, Homo sapiens
tgctggcttccgctgtcaccca

SEQ ID NO: 370639 - DNA, 22 bp, Homo sapiens
tgctgggacagctaggctgaga

SEQ ID NO: 370640 - DNA, 14 bp, Homo sapiens
tgctgggagcagaa

SEQ ID NO: 370641 - DNA, 22 bp, Homo sapiens
tgctgggcatactttctctcta

SEQ ID NO: 370642 - DNA, 22 bp, Homo sapiens
tgctgggcctcattctagcacc

SEQ ID NO: 370643 - DNA, 19 bp, Homo sapiens
tgctggggcatgtgtgcct

SEQ ID NO: 370644 - DNA, 22 bp, Homo sapiens
tgctggggcatgtgtgcctgtg

SEQ ID NO: 370645 - DNA, 20 bp, Homo sapiens
tgctggggctcacggggcct

SEQ ID NO: 370646 - DNA, 18 bp, Homo sapiens
tgctggggtacacagtga

SEQ ID NO: 370647 - DNA, 16 bp, Homo sapiens
tgctgggtaaactgtg

SEQ ID NO: 370648 - DNA, 18 bp, Homo sapiens
tgctgggtgcctcccaca

SEQ ID NO: 370649 - DNA, 22 bp, Homo sapiens
tgctggtcaagccccctttgat

SEQ ID NO: 370650 - DNA, 18 bp, Homo sapiens
tgctggtcacccccaccc

SEQ ID NO: 370651 - DNA, 16 bp, Homo sapiens
tgctggtcactgccat

SEQ ID NO: 370652 - DNA, 16 bp, Homo sapiens
tgctggttgctgggcc

SEQ ID NO: 370653 - DNA, 20 bp, Homo sapiens
tgctgtaaataaaaatagct

SEQ ID NO: 370654 - DNA, 21 bp, Homo sapiens
tgctgtaactcagacattcca

SEQ ID NO: 370655 - DNA, 18 bp, Homo sapiens
tgctgtaactgctgagcc

SEQ ID NO: 370656 - DNA, 20 bp, Homo sapiens
tgctgtaactgctgagccac

SEQ ID NO: 370657 - DNA, 23 bp, Homo sapiens
tgctgtaactgctgagccactcg

SEQ ID NO: 370658 - DNA, 15 bp, Homo sapiens
tgctgtaagacggcc

SEQ ID NO: 370659 - DNA, 19 bp, Homo sapiens
tgctgtacccttccacctc

SEQ ID NO: 370660 - DNA, 21 bp, Homo sapiens
tgctgtacccttccacctcct

SEQ ID NO: 370661 - DNA, 19 bp, Homo sapiens
tgctgtatacaaacaggtg

SEQ ID NO: 370662 - DNA, 23 bp, Homo sapiens
tgctgtcagaccttcttccacag

SEQ ID NO: 370663 - DNA, 20 bp, Homo sapiens
tgctgtcagccctgctgtca

SEQ ID NO: 370664 - DNA, 15 bp, Homo sapiens
tgctgtcatgtgaat

SEQ ID NO: 370665 - DNA, 20 bp, Homo sapiens
tgctgtcattgtccatgcct

SEQ ID NO: 370666 - DNA, 16 bp, Homo sapiens
tgctgtccctcctgag

SEQ ID NO: 370667 - DNA, 19 bp, Homo sapiens
tgctgtcccttacgtgagt

SEQ ID NO: 370668 - DNA, 17 bp, Homo sapiens
tgctgtcccttttcctt

SEQ ID NO: 370669 - DNA, 23 bp, Homo sapiens
tgctgtcgggcaagatagctcct

SEQ ID NO: 370670 - DNA, 20 bp, Homo sapiens
tggacaggtctgggagaggc

SEQ ID NO: 370671 - DNA, 22 bp, Homo sapiens
tggacaggtctgggagaggcag

SEQ ID NO: 370672 - DNA, 23 bp, Homo sapiens
tggacagtatcactgtctttcct

SEQ ID NO: 370673 - DNA, 15 bp, Homo sapiens
tggacattcagaaca

SEQ ID NO: 370674 - DNA, 22 bp, Homo sapiens
tggaccaaaaaaataaagcatt

SEQ ID NO: 370675 - DNA, 16 bp, Homo sapiens
tggaccaccagcccca

SEQ ID NO: 370676 - DNA, 17 bp, Homo sapiens
tggaccaccagccccag

SEQ ID NO: 370677 - DNA, 12 bp, Homo sapiens
tggaccagcctc

SEQ ID NO: 370678 - DNA, 20 bp, Homo sapiens
tggacccagcaggggcagaa

SEQ ID NO: 370679 - DNA, 13 bp, Homo sapiens
tggaccccaggcc

SEQ ID NO: 370680 - DNA, 18 bp, Homo sapiens
tggacccctcccttgctc

SEQ ID NO: 370681 - DNA, 17 bp, Homo sapiens
tggaccgggtgggcctg

SEQ ID NO: 370682 - DNA, 19 bp, Homo sapiens
tggaccgggtgggcctggc

SEQ ID NO: 370683 - DNA, 13 bp, Homo sapiens
tggacctaacatt

SEQ ID NO: 370684 - DNA, 19 bp, Homo sapiens
tggacctatgtcctaagga

SEQ ID NO: 370685 - DNA, 18 bp, Homo sapiens
tggacctctcttgtgagc

SEQ ID NO: 370686 - DNA, 18 bp, Homo sapiens
tggacctgcctcctgcct

SEQ ID NO: 370687 - DNA, 18 bp, Homo sapiens
tggacgcctggctccagg

SEQ ID NO: 370688 - DNA, 13 bp, Homo sapiens
tggactaagaaga

SEQ ID NO: 370689 - DNA, 19 bp, Homo sapiens
tggactatagcagggctgg

SEQ ID NO: 370690 - DNA, 21 bp, Homo sapiens
tggactccaggatcctcctgg

SEQ ID NO: 370691 - DNA, 15 bp, Homo sapiens
tggactccctcccca

SEQ ID NO: 370692 - DNA, 19 bp, Homo sapiens
tggactccctccccacccc

SEQ ID NO: 370693 - DNA, 14 bp, Homo sapiens
tggactcctctgtc

SEQ ID NO: 370694 - DNA, 17 bp, Homo sapiens
tggactctacactgtga

SEQ ID NO: 370695 - DNA, 12 bp, Homo sapiens
tggactctcagg

SEQ ID NO: 370696 - DNA, 14 bp, Homo sapiens
tggactctcaggga

SEQ ID NO: 370697 - DNA, 14 bp, Homo sapiens
tggactctgcccca

SEQ ID NO: 370698 - DNA, 17 bp, Homo sapiens
tggactctgccccaatc

SEQ ID NO: 370699 - DNA, 16 bp, Homo sapiens
tggactctgtgctcac

SEQ ID NO: 370700 - DNA, 19 bp, Homo sapiens
tggactctgtggggccaca

SEQ ID NO: 370701 - DNA, 12 bp, Homo sapiens
tggactcttgct

SEQ ID NO: 370702 - DNA, 14 bp, Homo sapiens
tggactcttgctct

SEQ ID NO: 370703 - DNA, 17 bp, Homo sapiens
tggactgaagcctgcag

SEQ ID NO: 370704 - DNA, 19 bp, Homo sapiens
tggactgaagcctgcagga

SEQ ID NO: 370705 - DNA, 13 bp, Homo sapiens
tggactgacattt

SEQ ID NO: 370706 - DNA, 21 bp, Homo sapiens
tggactggcccttgcccaact

SEQ ID NO: 370707 - DNA, 13 bp, Homo sapiens
tggactggctaga

SEQ ID NO: 370708 - DNA, 19 bp, Homo sapiens
tggactggctagagtcctc

SEQ ID NO: 370709 - DNA, 17 bp, Homo sapiens
tggactgggaagcatta

SEQ ID NO: 370710 - DNA, 15 bp, Homo sapiens
tggactgtcctaggt

SEQ ID NO: 370711 - DNA, 12 bp, Homo sapiens
tggactgtgtcc

SEQ ID NO: 370712 - DNA, 18 bp, Homo sapiens
tggactgttcacggcaga

SEQ ID NO: 370713 - DNA, 19 bp, Homo sapiens
tggacttgtatgctgccca

SEQ ID NO: 370714 - DNA, 21 bp, Homo sapiens
tggactttatttaatttcata

SEQ ID NO: 370715 - DNA, 16 bp, Homo sapiens
tggactttccaccccc

SEQ ID NO: 370716 - DNA, 19 bp, Homo sapiens
tggactttccaccccctcc

SEQ ID NO: 370717 - DNA, 11 bp, Homo sapiens
tggactttgtt

SEQ ID NO: 370718 - DNA, 15 bp, Homo sapiens
tggactttgttacac

SEQ ID NO: 370719 - DNA, 22 bp, Homo sapiens
tggactttgttacactgttatt

SEQ ID NO: 370720 - DNA, 22 bp, Homo sapiens
tggacttttcgttaacattgac

SEQ ID NO: 370721 - DNA, 15 bp, Homo sapiens
tggagaaaggatggc

SEQ ID NO: 370722 - DNA, 11 bp, Homo sapiens
tggagaaatta

SEQ ID NO: 370723 - DNA, 15 bp, Homo sapiens
tggagaaattattta

SEQ ID NO: 370724 - DNA, 18 bp, Homo sapiens
tggagaacgccagtctcc

SEQ ID NO: 370725 - DNA, 13 bp, Homo sapiens
tggagaaggaaaa

SEQ ID NO: 370726 - DNA, 19 bp, Homo sapiens
tggagaaggaaaaggctgg

SEQ ID NO: 370727 - DNA, 18 bp, Homo sapiens
tggagacaatgcagatgc

SEQ ID NO: 370728 - DNA, 15 bp, Homo sapiens
tggagacaattacaa

SEQ ID NO: 370729 - DNA, 17 bp, Homo sapiens
tggagaccaggactctg

SEQ ID NO: 370730 - DNA, 23 bp, Homo sapiens
tggagaccgcttcacccctgcac

SEQ ID NO: 370731 - DNA, 18 bp, Homo sapiens
tggagactaagccctgtc

SEQ ID NO: 370732 - DNA, 22 bp, Homo sapiens
tggagagaccagcctttcttcc

SEQ ID NO: 370733 - DNA, 20 bp, Homo sapiens
tggagagcagctggctctcc

SEQ ID NO: 370734 - DNA, 21 bp, Homo sapiens
tggagagcccggcgcccctgc

SEQ ID NO: 370735 - DNA, 14 bp, Homo sapiens
tggagagctggtgc

SEQ ID NO: 370736 - DNA, 16 bp, Homo sapiens
tggagagctggtgccc

SEQ ID NO: 370737 - DNA, 19 bp, Homo sapiens
tggagagctggtgcccgga

SEQ ID NO: 370738 - DNA, 12 bp, Homo sapiens
tggagaggagaa

SEQ ID NO: 370739 - DNA, 21 bp, Homo sapiens
tggagaggaggtgtggagtgg

SEQ ID NO: 370740 - DNA, 15 bp, Homo sapiens
tggagaggcctccct

SEQ ID NO: 370741 - DNA, 15 bp, Homo sapiens
tggagagggaatgtg

SEQ ID NO: 370742 - DNA, 16 bp, Homo sapiens
tggagagggaatgtga

SEQ ID NO: 370743 - DNA, 17 bp, Homo sapiens
tggagagggaatgtgaa

SEQ ID NO: 370744 - DNA, 18 bp, Homo sapiens
tggagagggaatgtgaaa

SEQ ID NO: 370745 - DNA, 13 bp, Homo sapiens
tggagagtagaca

SEQ ID NO: 370746 - DNA, 15 bp, Homo sapiens
tggagatctttgctt

SEQ ID NO: 370747 - DNA, 18 bp, Homo sapiens
tggagatgacagaaatat

SEQ ID NO: 370748 - DNA, 16 bp, Homo sapiens
tggagatgggatgctt

SEQ ID NO: 370749 - DNA, 22 bp, Homo sapiens
tggagatgtcttcgtacagttc

SEQ ID NO: 370750 - DNA, 22 bp, Homo sapiens
tggagatttgaaggtctgcaag

SEQ ID NO: 370751 - DNA, 18 bp, Homo sapiens
tggagcaaaacaaagctg

SEQ ID NO: 370752 - DNA, 23 bp, Homo sapiens
tggagcaaaaggcagctcacccc

SEQ ID NO: 370753 - DNA, 21 bp, Homo sapiens
tggagcagagacggcagcccc

SEQ ID NO: 370754 - DNA, 22 bp, Homo sapiens
tggagcaggcggtggggagaga

SEQ ID NO: 370755 - DNA, 18 bp, Homo sapiens
tggagcatgggcctggcc

SEQ ID NO: 370756 - DNA, 21 bp, Homo sapiens
tggagcatttggaaggaaagg

SEQ ID NO: 370757 - DNA, 23 bp, Homo sapiens
tggagccaatggtgagggctgag

SEQ ID NO: 370758 - DNA, 11 bp, Homo sapiens
tggagccacag

SEQ ID NO: 370759 - DNA, 16 bp, Homo sapiens
tggagccacaggcaga

SEQ ID NO: 370760 - DNA, 22 bp, Homo sapiens
tggagccacctgtcccacctca

SEQ ID NO: 370761 - DNA, 16 bp, Homo sapiens
tggagccactcctgtc

SEQ ID NO: 370762 - DNA, 17 bp, Homo sapiens
tggagccactcctgtcc

SEQ ID NO: 370763 - DNA, 15 bp, Homo sapiens
tggagccactctgtt

SEQ ID NO: 370764 - DNA, 21 bp, Homo sapiens
tggagcccataggccaccccc

SEQ ID NO: 370765 - DNA, 18 bp, Homo sapiens
tggagcccggcagtgcac

SEQ ID NO: 370766 - DNA, 16 bp, Homo sapiens
tggagcgtttgctgtg

SEQ ID NO: 370767 - DNA, 17 bp, Homo sapiens
tggagcgtttgctgtgc

SEQ ID NO: 370768 - DNA, 22 bp, Homo sapiens
tggagcgtttgctgtgccagga

SEQ ID NO: 370769 - DNA, 18 bp, Homo sapiens
tggagctcacccaaggtc

SEQ ID NO: 370770 - DNA, 16 bp, Homo sapiens
tggagctcctgctggg

SEQ ID NO: 370771 - DNA, 20 bp, Homo sapiens
tggagctcctgggaaggcta

SEQ ID NO: 370772 - DNA, 18 bp, Homo sapiens
tggagctgagatgagccc

SEQ ID NO: 370773 - DNA, 20 bp, Homo sapiens
tggagctgagatgagcccca

SEQ ID NO: 370774 - DNA, 15 bp, Homo sapiens
tggagctgcttccag

SEQ ID NO: 370775 - DNA, 16 bp, Homo sapiens
tggagctgtcctccag

SEQ ID NO: 370776 - DNA, 18 bp, Homo sapiens
tggagcttgtacatattg

SEQ ID NO: 370777 - DNA, 23 bp, Homo sapiens
tggaggaaaaccaagccgtggct

SEQ ID NO: 370778 - DNA, 19 bp, Homo sapiens
tggaggaacaactctccag

SEQ ID NO: 370779 - DNA, 14 bp, Homo sapiens
tggaggaaggtgct

SEQ ID NO: 370780 - DNA, 18 bp, Homo sapiens
tggaggaattgggacctg

SEQ ID NO: 370781 - DNA, 21 bp, Homo sapiens
tggaggaattgggacctggtt

SEQ ID NO: 370782 - DNA, 16 bp, Homo sapiens
tggaggaggaggcaat

SEQ ID NO: 370783 - DNA, 16 bp, Homo sapiens
tggaggattctttccc

SEQ ID NO: 370784 - DNA, 18 bp, Homo sapiens
tggaggcacacagctgca

SEQ ID NO: 370785 - DNA, 13 bp, Homo sapiens
tggaggccaagcc

SEQ ID NO: 370786 - DNA, 14 bp, Homo sapiens
tggaggccaagcct

SEQ ID NO: 370787 - DNA, 15 bp, Homo sapiens
tggaggcccttttct

SEQ ID NO: 370788 - DNA, 21 bp, Homo sapiens
tggaggcccttttctggctcc

SEQ ID NO: 370789 - DNA, 23 bp, Homo sapiens
tggaggcccttttctggctcctg

SEQ ID NO: 370790 - DNA, 21 bp, Homo sapiens
tggaggccgggtgctcagggc

SEQ ID NO: 370791 - DNA, 17 bp, Homo sapiens
tggaggcctcaccctgc

SEQ ID NO: 370792 - DNA, 14 bp, Homo sapiens
tggaggcctctggg

SEQ ID NO: 370793 - DNA, 15 bp, Homo sapiens
tggaggcctctgggc

SEQ ID NO: 370794 - DNA, 18 bp, Homo sapiens
tggaggcctgatgctgcc

SEQ ID NO: 370795 - DNA, 18 bp, Homo sapiens
tggagggatcattttctg

SEQ ID NO: 370796 - DNA, 20 bp, Homo sapiens
tggagggcaaggggtttcca

SEQ ID NO: 370797 - DNA, 20 bp, Homo sapiens
tggaggtatcctgtgtgtct

SEQ ID NO: 370798 - DNA, 17 bp, Homo sapiens
tggaggtggggttggga

SEQ ID NO: 370799 - DNA, 17 bp, Homo sapiens
tggaggttctcagagcc

SEQ ID NO: 370800 - DNA, 15 bp, Homo sapiens
tggccgcctggcagg

SEQ ID NO: 370801 - DNA, 18 bp, Homo sapiens
tggccgcctggcaggtgg

SEQ ID NO: 370802 - DNA, 19 bp, Homo sapiens
tggccgcctggcaggtgga

SEQ ID NO: 370803 - DNA, 14 bp, Homo sapiens
tggccgctgggaga

SEQ ID NO: 370804 - DNA, 20 bp, Homo sapiens
tggccgcttccctacccaca

SEQ ID NO: 370805 - DNA, 22 bp, Homo sapiens
tggccgcttccctacccacagg

SEQ ID NO: 370806 - DNA, 13 bp, Homo sapiens
tggccggctggcc

SEQ ID NO: 370807 - DNA, 14 bp, Homo sapiens
tggccgggcatggt

SEQ ID NO: 370808 - DNA, 15 bp, Homo sapiens
tggccgggctgctgc

SEQ ID NO: 370809 - DNA, 16 bp, Homo sapiens
tggccgggctgctgct

SEQ ID NO: 370810 - DNA, 15 bp, Homo sapiens
tggccgggggtgggg

SEQ ID NO: 370811 - DNA, 22 bp, Homo sapiens
tggccgggttggaggcctcacc

SEQ ID NO: 370812 - DNA, 17 bp, Homo sapiens
tggcctagcccaccctg

SEQ ID NO: 370813 - DNA, 22 bp, Homo sapiens
tggcctagcccaccctgctgcc

SEQ ID NO: 370814 - DNA, 23 bp, Homo sapiens
tggcctagcccaccctgctgcct

SEQ ID NO: 370815 - DNA, 16 bp, Homo sapiens
tggcctagtcagatgg

SEQ ID NO: 370816 - DNA, 20 bp, Homo sapiens
tggcctagtggggaggggcc

SEQ ID NO: 370817 - DNA, 15 bp, Homo sapiens
tggcctatttaagcc

SEQ ID NO: 370818 - DNA, 23 bp, Homo sapiens
tggcctattttggacgtgtgagg

SEQ ID NO: 370819 - DNA, 16 bp, Homo sapiens
tggcctcaaccctccc

SEQ ID NO: 370820 - DNA, 18 bp, Homo sapiens
tggcctcaaccctccctc

SEQ ID NO: 370821 - DNA, 13 bp, Homo sapiens
tggcctcagctgc

SEQ ID NO: 370822 - DNA, 14 bp, Homo sapiens
tggcctcagctgcc

SEQ ID NO: 370823 - DNA, 16 bp, Homo sapiens
tggcctcagctgcctc

SEQ ID NO: 370824 - DNA, 13 bp, Homo sapiens
tggcctcccagcc

SEQ ID NO: 370825 - DNA, 16 bp, Homo sapiens
tggcctcccagccacc

SEQ ID NO: 370826 - DNA, 14 bp, Homo sapiens
tggcctcccctgcg

SEQ ID NO: 370827 - DNA, 15 bp, Homo sapiens
tggcctccggcctcc

SEQ ID NO: 370828 - DNA, 17 bp, Homo sapiens
tggcctccttttgctgt

SEQ ID NO: 370829 - DNA, 22 bp, Homo sapiens
tggcctcttgagcagtggctgg

SEQ ID NO: 370830 - DNA, 17 bp, Homo sapiens
tggcctgacctggcaca

SEQ ID NO: 370831 - DNA, 11 bp, Homo sapiens
tggcctgagct

SEQ ID NO: 370832 - DNA, 22 bp, Homo sapiens
tggcctgctaaggctcctcctt

SEQ ID NO: 370833 - DNA, 22 bp, Homo sapiens
tggcctggaggtggggttggga

SEQ ID NO: 370834 - DNA, 18 bp, Homo sapiens
tggcctggccaggagctc

SEQ ID NO: 370835 - DNA, 21 bp, Homo sapiens
tggcctggccaggagctcttc

SEQ ID NO: 370836 - DNA, 13 bp, Homo sapiens
tggcctggccctg

SEQ ID NO: 370837 - DNA, 14 bp, Homo sapiens
tggcctggccctgc

SEQ ID NO: 370838 - DNA, 15 bp, Homo sapiens
tggcctggccctgcc

SEQ ID NO: 370839 - DNA, 18 bp, Homo sapiens
tggcctggccctgccctg

SEQ ID NO: 370840 - DNA, 13 bp, Homo sapiens
tggcctggcctgg

SEQ ID NO: 370841 - DNA, 15 bp, Homo sapiens
tggcctggcctggcc

SEQ ID NO: 370842 - DNA, 17 bp, Homo sapiens
tggcctggcctggccct

SEQ ID NO: 370843 - DNA, 11 bp, Homo sapiens
tggcctggctc

SEQ ID NO: 370844 - DNA, 18 bp, Homo sapiens
tggcctggctccgctgtg

SEQ ID NO: 370845 - DNA, 20 bp, Homo sapiens
tggcctggggctgccgtgca

SEQ ID NO: 370846 - DNA, 21 bp, Homo sapiens
tggcctgggtggggcagggcc

SEQ ID NO: 370847 - DNA, 14 bp, Homo sapiens
tggcctggtccagg

SEQ ID NO: 370848 - DNA, 14 bp, Homo sapiens
tggcctgtctcatc

SEQ ID NO: 370849 - DNA, 20 bp, Homo sapiens
tggcctgtctcatccccagg

SEQ ID NO: 370850 - DNA, 24 bp, Homo sapiens
tggcctgtctcatccccaggggtc

SEQ ID NO: 370851 - DNA, 16 bp, Homo sapiens
tggcctgtgctgggcc

SEQ ID NO: 370852 - DNA, 17 bp, Homo sapiens
tggcctgtgctgggcca

SEQ ID NO: 370853 - DNA, 20 bp, Homo sapiens
tggcctgtgctgggccagtg

SEQ ID NO: 370854 - DNA, 17 bp, Homo sapiens
tggcctgtgtccagcag

SEQ ID NO: 370855 - DNA, 22 bp, Homo sapiens
tggcctgtgtccagcagctgcg

SEQ ID NO: 370856 - DNA, 18 bp, Homo sapiens
tggcctgttctgtaggag

SEQ ID NO: 370857 - DNA, 21 bp, Homo sapiens
tggccttccccttttgcctgg

SEQ ID NO: 370858 - DNA, 22 bp, Homo sapiens
tggccttccccttttgcctggc

SEQ ID NO: 370859 - DNA, 13 bp, Homo sapiens
tggccttgcccgc

SEQ ID NO: 370860 - DNA, 15 bp, Homo sapiens
tggccttggggccag

SEQ ID NO: 370861 - DNA, 21 bp, Homo sapiens
tggcctttgcttatgaatatt

SEQ ID NO: 370862 - DNA, 11 bp, Homo sapiens
tggcctttgta

SEQ ID NO: 370863 - DNA, 20 bp, Homo sapiens
tggcctttgtaagacacaca

SEQ ID NO: 370864 - DNA, 16 bp, Homo sapiens
tggccttttcctattt

SEQ ID NO: 370865 - DNA, 18 bp, Homo sapiens
tggcgatatgagagggat

SEQ ID NO: 370866 - DNA, 19 bp, Homo sapiens
tggcgcacccggcagcccc

SEQ ID NO: 370867 - DNA, 13 bp, Homo sapiens
tggcgcagtgcct

SEQ ID NO: 370868 - DNA, 18 bp, Homo sapiens
tggcgcgggaggcaccag

SEQ ID NO: 370869 - DNA, 20 bp, Homo sapiens
tggcgcgggaggcaccagct

SEQ ID NO: 370870 - DNA, 13 bp, Homo sapiens
tggcgctaggcat

SEQ ID NO: 370871 - DNA, 14 bp, Homo sapiens
tggcggaacctggc

SEQ ID NO: 370872 - DNA, 17 bp, Homo sapiens
tggcggaacctggctgc

SEQ ID NO: 370873 - DNA, 16 bp, Homo sapiens
tggcggaggccatggg

SEQ ID NO: 370874 - DNA, 17 bp, Homo sapiens
tggcgggccaaggactg

SEQ ID NO: 370875 - DNA, 14 bp, Homo sapiens
tggcgggcgcctgt

SEQ ID NO: 370876 - DNA, 23 bp, Homo sapiens
tggcgtctgcctaggagctggct

SEQ ID NO: 370877 - DNA, 20 bp, Homo sapiens
tggcgtctgtcttcaagggc

SEQ ID NO: 370878 - DNA, 16 bp, Homo sapiens
tggcgtgtgtccctgt

SEQ ID NO: 370879 - DNA, 17 bp, Homo sapiens
tggctaagcttaaaaaa

SEQ ID NO: 370880 - DNA, 20 bp, Homo sapiens
tggctaagcttaaaaaaaac

SEQ ID NO: 370881 - DNA, 23 bp, Homo sapiens
tggctaaggcatcattttcacct

SEQ ID NO: 370882 - DNA, 16 bp, Homo sapiens
tggctaattcaattta

SEQ ID NO: 370883 - DNA, 15 bp, Homo sapiens
tggctagagtcctca

SEQ ID NO: 370884 - DNA, 18 bp, Homo sapiens
tggctagagtcctcactc

SEQ ID NO: 370885 - DNA, 21 bp, Homo sapiens
tggctagagtcctcactccca

SEQ ID NO: 370886 - DNA, 21 bp, Homo sapiens
tggctagggttccactggaga

SEQ ID NO: 370887 - DNA, 22 bp, Homo sapiens
tggctagtcacatatcaagtcc

SEQ ID NO: 370888 - DNA, 18 bp, Homo sapiens
tggctataacatgtcttt

SEQ ID NO: 370889 - DNA, 15 bp, Homo sapiens
tggctatattaatct

SEQ ID NO: 370890 - DNA, 14 bp, Homo sapiens
tggctcacagactg

SEQ ID NO: 370891 - DNA, 17 bp, Homo sapiens
tggctcacagactggag

SEQ ID NO: 370892 - DNA, 18 bp, Homo sapiens
tggctcacagactggaga

SEQ ID NO: 370893 - DNA, 16 bp, Homo sapiens
tggctcacagccacca

SEQ ID NO: 370894 - DNA, 17 bp, Homo sapiens
tggctcacagccaccac

SEQ ID NO: 370895 - DNA, 20 bp, Homo sapiens
tggctcacagccaccacctg

SEQ ID NO: 370896 - DNA, 22 bp, Homo sapiens
tggctcacagccaccacctgga

SEQ ID NO: 370897 - DNA, 18 bp, Homo sapiens
tggctcacgcctgtaatc

SEQ ID NO: 370898 - DNA, 16 bp, Homo sapiens
tggctcaggcaagccc

SEQ ID NO: 370899 - DNA, 18 bp, Homo sapiens
tggctcagggatcttctc

SEQ ID NO: 370900 - DNA, 20 bp, Homo sapiens
tggctcagggatcttctccc

SEQ ID NO: 370901 - DNA, 20 bp, Homo sapiens
tggctcagggcccacctcct

SEQ ID NO: 370902 - DNA, 15 bp, Homo sapiens
tggctccacgccctg

SEQ ID NO: 370903 - DNA, 16 bp, Homo sapiens
tggctcccaagggagg

SEQ ID NO: 370904 - DNA, 22 bp, Homo sapiens
tggctcccaagggaggcccatg

SEQ ID NO: 370905 - DNA, 20 bp, Homo sapiens
tggctcccacaggcccttcc

SEQ ID NO: 370906 - DNA, 15 bp, Homo sapiens
tggctcccagggcca

SEQ ID NO: 370907 - DNA, 20 bp, Homo sapiens
tggctcccatgaccatactg

SEQ ID NO: 370908 - DNA, 13 bp, Homo sapiens
tggctcccctcta

SEQ ID NO: 370909 - DNA, 21 bp, Homo sapiens
tggctcccctctatttagcat

SEQ ID NO: 370910 - DNA, 20 bp, Homo sapiens
tggctcccgctttggggagc

SEQ ID NO: 370911 - DNA, 14 bp, Homo sapiens
tggctcctcaaaca

SEQ ID NO: 370912 - DNA, 20 bp, Homo sapiens
tggctcctgaggggcatctg

SEQ ID NO: 370913 - DNA, 23 bp, Homo sapiens
tggctcctgaggggcatctgccc

SEQ ID NO: 370914 - DNA, 17 bp, Homo sapiens
tggctcctttcccacag

SEQ ID NO: 370915 - DNA, 16 bp, Homo sapiens
tggctcggacccaccc

SEQ ID NO: 370916 - DNA, 18 bp, Homo sapiens
tggctcggacccacccca

SEQ ID NO: 370917 - DNA, 17 bp, Homo sapiens
tggctcgtgggctctgg

SEQ ID NO: 370918 - DNA, 20 bp, Homo sapiens
tggctcgtgggctctggctc

SEQ ID NO: 370919 - DNA, 16 bp, Homo sapiens
tggctctccaccttgt

SEQ ID NO: 370920 - DNA, 13 bp, Homo sapiens
tggctctgaagaa

SEQ ID NO: 370921 - DNA, 17 bp, Homo sapiens
tggctctggaatgacat

SEQ ID NO: 370922 - DNA, 22 bp, Homo sapiens
tggctcttttacccaataagat

SEQ ID NO: 370923 - DNA, 12 bp, Homo sapiens
tggctgaaaatc

SEQ ID NO: 370924 - DNA, 18 bp, Homo sapiens
tggctgaaaatcactata

SEQ ID NO: 370925 - DNA, 15 bp, Homo sapiens
tggctgaaaatggtg

SEQ ID NO: 370926 - DNA, 14 bp, Homo sapiens
tggctgaaattatg

SEQ ID NO: 370927 - DNA, 13 bp, Homo sapiens
tggctgaagacat

SEQ ID NO: 370928 - DNA, 15 bp, Homo sapiens
tggctgactgggaac

SEQ ID NO: 370929 - DNA, 22 bp, Homo sapiens
tggctgagtggaatgcagggaa

SEQ ID NO: 370930 - DNA, 16 bp, Homo sapiens
tgggccccagggaact

SEQ ID NO: 370931 - DNA, 16 bp, Homo sapiens
tgggccccatgctctg

SEQ ID NO: 370932 - DNA, 20 bp, Homo sapiens
tgggccccatgctctgcccc

SEQ ID NO: 370933 - DNA, 16 bp, Homo sapiens
tgggccccattcagaa

SEQ ID NO: 370934 - DNA, 19 bp, Homo sapiens
tgggccccccagctcaggg

SEQ ID NO: 370935 - DNA, 18 bp, Homo sapiens
tgggccccctctcttacc

SEQ ID NO: 370936 - DNA, 18 bp, Homo sapiens
tgggcccgggcaggccag

SEQ ID NO: 370937 - DNA, 19 bp, Homo sapiens
tgggcccgggcaggccagc

SEQ ID NO: 370938 - DNA, 18 bp, Homo sapiens
tgggccctaggcatactc

SEQ ID NO: 370939 - DNA, 13 bp, Homo sapiens
tgggccctctgag

SEQ ID NO: 370940 - DNA, 17 bp, Homo sapiens
tgggccctctgtccaca

SEQ ID NO: 370941 - DNA, 18 bp, Homo sapiens
tgggccctgcaggaggcc

SEQ ID NO: 370942 - DNA, 20 bp, Homo sapiens
tgggccctgcaggaggcctg

SEQ ID NO: 370943 - DNA, 14 bp, Homo sapiens
tgggccggccccag

SEQ ID NO: 370944 - DNA, 16 bp, Homo sapiens
tgggccggccccaggc

SEQ ID NO: 370945 - DNA, 17 bp, Homo sapiens
tgggccggccccaggct

SEQ ID NO: 370946 - DNA, 19 bp, Homo sapiens
tgggccggccccaggctcc

SEQ ID NO: 370947 - DNA, 21 bp, Homo sapiens
tgggcctcccgtccgtccgcc

SEQ ID NO: 370948 - DNA, 22 bp, Homo sapiens
tgggcctcccttgggctggaag

SEQ ID NO: 370949 - DNA, 20 bp, Homo sapiens
tgggcctctgcttctctcac

SEQ ID NO: 370950 - DNA, 16 bp, Homo sapiens
tgggcctctggtttgg

SEQ ID NO: 370951 - DNA, 19 bp, Homo sapiens
tgggcctgatggagaggag

SEQ ID NO: 370952 - DNA, 21 bp, Homo sapiens
tgggcctgatggagaggagaa

SEQ ID NO: 370953 - DNA, 12 bp, Homo sapiens
tgggcctgccca

SEQ ID NO: 370954 - DNA, 16 bp, Homo sapiens
tgggcctgcccaatgc

SEQ ID NO: 370955 - DNA, 18 bp, Homo sapiens
tgggcctgcttttccagg

SEQ ID NO: 370956 - DNA, 19 bp, Homo sapiens
tgggcctgcttttccagga

SEQ ID NO: 370957 - DNA, 20 bp, Homo sapiens
tgggcctgcttttccaggat

SEQ ID NO: 370958 - DNA, 21 bp, Homo sapiens
tgggcctgcttttccaggatc

SEQ ID NO: 370959 - DNA, 13 bp, Homo sapiens
tgggcctggcctg

SEQ ID NO: 370960 - DNA, 14 bp, Homo sapiens
tgggcctggcctga

SEQ ID NO: 370961 - DNA, 15 bp, Homo sapiens
tgggcctggcctgag

SEQ ID NO: 370962 - DNA, 12 bp, Homo sapiens
tgggcctgggcc

SEQ ID NO: 370963 - DNA, 16 bp, Homo sapiens
tgggcctgggctaggg

SEQ ID NO: 370964 - DNA, 18 bp, Homo sapiens
tgggcctgggctagggga

SEQ ID NO: 370965 - DNA, 14 bp, Homo sapiens
tgggcctgtctcag

SEQ ID NO: 370966 - DNA, 12 bp, Homo sapiens
tgggcctgtgca

SEQ ID NO: 370967 - DNA, 16 bp, Homo sapiens
tgggcctgtgcagcag

SEQ ID NO: 370968 - DNA, 15 bp, Homo sapiens
tgggccttctcagct

SEQ ID NO: 370969 - DNA, 17 bp, Homo sapiens
tgggccttctcagctct

SEQ ID NO: 370970 - DNA, 14 bp, Homo sapiens
tgggccttgctttg

SEQ ID NO: 370971 - DNA, 13 bp, Homo sapiens
tgggcctttcctg

SEQ ID NO: 370972 - DNA, 15 bp, Homo sapiens
tgggcctttcctgtg

SEQ ID NO: 370973 - DNA, 23 bp, Homo sapiens
tgggcgaatctacagaacaaaga

SEQ ID NO: 370974 - DNA, 13 bp, Homo sapiens
tgggcgagtcccg

SEQ ID NO: 370975 - DNA, 15 bp, Homo sapiens
tgggcgccctggaag

SEQ ID NO: 370976 - DNA, 20 bp, Homo sapiens
tgggcgccctggaagccggc

SEQ ID NO: 370977 - DNA, 16 bp, Homo sapiens
tgggcgctgcttccag

SEQ ID NO: 370978 - DNA, 21 bp, Homo sapiens
tgggcggctgagagccccagc

SEQ ID NO: 370979 - DNA, 13 bp, Homo sapiens
tgggcgtgacttc

SEQ ID NO: 370980 - DNA, 12 bp, Homo sapiens
tgggctaacatt

SEQ ID NO: 370981 - DNA, 17 bp, Homo sapiens
tgggctaattaaataaa

SEQ ID NO: 370982 - DNA, 14 bp, Homo sapiens
tgggctactggcag

SEQ ID NO: 370983 - DNA, 16 bp, Homo sapiens
tgggctactggcagct

SEQ ID NO: 370984 - DNA, 17 bp, Homo sapiens
tgggctactggcagctc

SEQ ID NO: 370985 - DNA, 19 bp, Homo sapiens
tgggctactggcagctcct

SEQ ID NO: 370986 - DNA, 19 bp, Homo sapiens
tgggctaggtagtggggac

SEQ ID NO: 370987 - DNA, 11 bp, Homo sapiens
tgggctccaga

SEQ ID NO: 370988 - DNA, 15 bp, Homo sapiens
tgggctccagagtag

SEQ ID NO: 370989 - DNA, 19 bp, Homo sapiens
tgggctcctggaaccaatc

SEQ ID NO: 370990 - DNA, 13 bp, Homo sapiens
tgggctcctggct

SEQ ID NO: 370991 - DNA, 11 bp, Homo sapiens
tgggctctgcg

SEQ ID NO: 370992 - DNA, 14 bp, Homo sapiens
tgggctgagcccct

SEQ ID NO: 370993 - DNA, 17 bp, Homo sapiens
tgggctgagcccctacc

SEQ ID NO: 370994 - DNA, 17 bp, Homo sapiens
tgggctgaggaggcagt

SEQ ID NO: 370995 - DNA, 16 bp, Homo sapiens
tgggctgccatgtgaa

SEQ ID NO: 370996 - DNA, 14 bp, Homo sapiens
tgggctgccctggt

SEQ ID NO: 370997 - DNA, 16 bp, Homo sapiens
tgggctgccctggtgc

SEQ ID NO: 370998 - DNA, 16 bp, Homo sapiens
tgggctgctcctcatg

SEQ ID NO: 370999 - DNA, 13 bp, Homo sapiens
tgggctggcagag

SEQ ID NO: 371000 - DNA, 12 bp, Homo sapiens
tgggctgggaga

SEQ ID NO: 371001 - DNA, 23 bp, Homo sapiens
tgggctgggagaaggtgcttggg

SEQ ID NO: 371002 - DNA, 18 bp, Homo sapiens
tgggctggtgccccacag

SEQ ID NO: 371003 - DNA, 20 bp, Homo sapiens
tgggctggtgccccacagct

SEQ ID NO: 371004 - DNA, 20 bp, Homo sapiens
tgggctgtgttgactgctgc

SEQ ID NO: 371005 - DNA, 19 bp, Homo sapiens
tgggctgttggctgggggc

SEQ ID NO: 371006 - DNA, 20 bp, Homo sapiens
tgggctgttggctgggggca

SEQ ID NO: 371007 - DNA, 23 bp, Homo sapiens
tgggcttctgcggtgaggcaggg

SEQ ID NO: 371008 - DNA, 22 bp, Homo sapiens
tgggcttggacttcctggggcc

SEQ ID NO: 371009 - DNA, 14 bp, Homo sapiens
tgggcttggccttg

SEQ ID NO: 371010 - DNA, 15 bp, Homo sapiens
tgggcttggccttgt

SEQ ID NO: 371011 - DNA, 14 bp, Homo sapiens
tgggcttgttttct

SEQ ID NO: 371012 - DNA, 23 bp, Homo sapiens
tgggctttaacaaaacaagaaag

SEQ ID NO: 371013 - DNA, 18 bp, Homo sapiens
tgggctttctccggggtc

SEQ ID NO: 371014 - DNA, 12 bp, Homo sapiens
tgggctttctgg

SEQ ID NO: 371015 - DNA, 14 bp, Homo sapiens
tgggctttgcaggc

SEQ ID NO: 371016 - DNA, 19 bp, Homo sapiens
tggggaacaagggtggcat

SEQ ID NO: 371017 - DNA, 17 bp, Homo sapiens
tggggaagagagcctgc

SEQ ID NO: 371018 - DNA, 18 bp, Homo sapiens
tggggaagagagcctgcc

SEQ ID NO: 371019 - DNA, 16 bp, Homo sapiens
tggggaagaggccttg

SEQ ID NO: 371020 - DNA, 21 bp, Homo sapiens
tggggaagcaagacgtcctgg

SEQ ID NO: 371021 - DNA, 22 bp, Homo sapiens
tggggaagcaagacgtcctgga

SEQ ID NO: 371022 - DNA, 14 bp, Homo sapiens
tggggaaggcaaga

SEQ ID NO: 371023 - DNA, 15 bp, Homo sapiens
tggggacagttggca

SEQ ID NO: 371024 - DNA, 17 bp, Homo sapiens
tggggacagttggcaga

SEQ ID NO: 371025 - DNA, 18 bp, Homo sapiens
tggggacagttggcagag

SEQ ID NO: 371026 - DNA, 14 bp, Homo sapiens
tggggaccaggagc

SEQ ID NO: 371027 - DNA, 21 bp, Homo sapiens
tggggacgccaaggaggtggg

SEQ ID NO: 371028 - DNA, 20 bp, Homo sapiens
tggggacgtcctgccacctg

SEQ ID NO: 371029 - DNA, 19 bp, Homo sapiens
tggggactctgcttggctg

SEQ ID NO: 371030 - DNA, 23 bp, Homo sapiens
tggggagacataaccactgcttc

SEQ ID NO: 371031 - DNA, 20 bp, Homo sapiens
tggggagaggaactccttgg

SEQ ID NO: 371032 - DNA, 15 bp, Homo sapiens
tggggagcagctgag

SEQ ID NO: 371033 - DNA, 22 bp, Homo sapiens
tggggagccaacagaagcttcc

SEQ ID NO: 371034 - DNA, 22 bp, Homo sapiens
tggggagcccaggcctggcctc

SEQ ID NO: 371035 - DNA, 23 bp, Homo sapiens
tggggagggacaagggattctgg

SEQ ID NO: 371036 - DNA, 20 bp, Homo sapiens
tggggaggggcctggcctgg

SEQ ID NO: 371037 - DNA, 22 bp, Homo sapiens
tggggaggggcctggcctgggt

SEQ ID NO: 371038 - DNA, 19 bp, Homo sapiens
tggggaggggcggcaggag

SEQ ID NO: 371039 - DNA, 17 bp, Homo sapiens
tggggagggtgggcgtg

SEQ ID NO: 371040 - DNA, 19 bp, Homo sapiens
tggggagtgagcttggtgc

SEQ ID NO: 371041 - DNA, 14 bp, Homo sapiens
tggggatggagaat

SEQ ID NO: 371042 - DNA, 19 bp, Homo sapiens
tggggatgtaaccaagctg

SEQ ID NO: 371043 - DNA, 21 bp, Homo sapiens
tggggatgtaaccaagctgta

SEQ ID NO: 371044 - DNA, 19 bp, Homo sapiens
tggggatgtttgtgctgca

SEQ ID NO: 371045 - DNA, 22 bp, Homo sapiens
tggggcaagcctgagtggtgag

SEQ ID NO: 371046 - DNA, 16 bp, Homo sapiens
tggggcagcacagaga

SEQ ID NO: 371047 - DNA, 14 bp, Homo sapiens
tggggcagggcctg

SEQ ID NO: 371048 - DNA, 17 bp, Homo sapiens
tggggcagtagaaggtc

SEQ ID NO: 371049 - DNA, 18 bp, Homo sapiens
tggggcatagaactccgg

SEQ ID NO: 371050 - DNA, 21 bp, Homo sapiens
tggggcatggttccttccctg

SEQ ID NO: 371051 - DNA, 18 bp, Homo sapiens
tggggccagactggctgc

SEQ ID NO: 371052 - DNA, 23 bp, Homo sapiens
tggggccagactggctgcacagc

SEQ ID NO: 371053 - DNA, 15 bp, Homo sapiens
tggggccaggtcacc

SEQ ID NO: 371054 - DNA, 18 bp, Homo sapiens
tggggcccaagcatgccc

SEQ ID NO: 371055 - DNA, 16 bp, Homo sapiens
tggggcccatggcccc

SEQ ID NO: 371056 - DNA, 16 bp, Homo sapiens
tggggccccaaagccc

SEQ ID NO: 371057 - DNA, 20 bp, Homo sapiens
tggggccccaaagcccagcc

SEQ ID NO: 371058 - DNA, 21 bp, Homo sapiens
tggggcccctttttactcccc

SEQ ID NO: 371059 - DNA, 16 bp, Homo sapiens
tggggcctagactctg

SEQ ID NO: 371060 - DNA, 12 bp, Homo sapiens
tgtaaattattt

SEQ ID NO: 371061 - DNA, 18 bp, Homo sapiens
tgtaaattattttaaatt

SEQ ID NO: 371062 - DNA, 20 bp, Homo sapiens
tgtaaattttataaggctga

SEQ ID NO: 371063 - DNA, 13 bp, Homo sapiens
tgtaaattttgga

SEQ ID NO: 371064 - DNA, 12 bp, Homo sapiens
tgtaacatattt

SEQ ID NO: 371065 - DNA, 14 bp, Homo sapiens
tgtaaccaagctgt

SEQ ID NO: 371066 - DNA, 13 bp, Homo sapiens
tgtaaccagcagt

SEQ ID NO: 371067 - DNA, 15 bp, Homo sapiens
tgtaaccatatgatt

SEQ ID NO: 371068 - DNA, 12 bp, Homo sapiens
tgtaacctcagc

SEQ ID NO: 371069 - DNA, 18 bp, Homo sapiens
tgtaactgcccaaagcag

SEQ ID NO: 371070 - DNA, 13 bp, Homo sapiens
tgtaactgcctac

SEQ ID NO: 371071 - DNA, 19 bp, Homo sapiens
tgtaactgctgagccactc

SEQ ID NO: 371072 - DNA, 16 bp, Homo sapiens
tgtaactgggttcaaa

SEQ ID NO: 371073 - DNA, 14 bp, Homo sapiens
tgtaacttaattat

SEQ ID NO: 371074 - DNA, 17 bp, Homo sapiens
tgtaactttctgaaata

SEQ ID NO: 371075 - DNA, 15 bp, Homo sapiens
tgtaactttgcatgt

SEQ ID NO: 371076 - DNA, 19 bp, Homo sapiens
tgtaagaagagactgggaa

SEQ ID NO: 371077 - DNA, 17 bp, Homo sapiens
tgtaagacacacagcct

SEQ ID NO: 371078 - DNA, 18 bp, Homo sapiens
tgtaagacacacagcctt

SEQ ID NO: 371079 - DNA, 16 bp, Homo sapiens
tgtaagacggccttgg

SEQ ID NO: 371080 - DNA, 13 bp, Homo sapiens
tgtaagagaattc

SEQ ID NO: 371081 - DNA, 19 bp, Homo sapiens
tgtaagagcaccttcctca

SEQ ID NO: 371082 - DNA, 19 bp, Homo sapiens
tgtaagatcgttctctgcc

SEQ ID NO: 371083 - DNA, 20 bp, Homo sapiens
tgtaagatcgttctctgcct

SEQ ID NO: 371084 - DNA, 19 bp, Homo sapiens
tgtaagctctttgaaacaa

SEQ ID NO: 371085 - DNA, 19 bp, Homo sapiens
tgtaagcttagattttctg

SEQ ID NO: 371086 - DNA, 14 bp, Homo sapiens
tgtaaggaaatgtt

SEQ ID NO: 371087 - DNA, 15 bp, Homo sapiens
tgtaaggaatgatta

SEQ ID NO: 371088 - DNA, 15 bp, Homo sapiens
tgtaaggaatgcttg

SEQ ID NO: 371089 - DNA, 16 bp, Homo sapiens
tgtaaggactcagtgt

SEQ ID NO: 371090 - DNA, 17 bp, Homo sapiens
tgtaaggacttgtgcct

SEQ ID NO: 371091 - DNA, 16 bp, Homo sapiens
tgtaagtaaatgtctg

SEQ ID NO: 371092 - DNA, 18 bp, Homo sapiens
tgtaagtgagagagacaa

SEQ ID NO: 371093 - DNA, 17 bp, Homo sapiens
tgtaagtgtgagtaaga

SEQ ID NO: 371094 - DNA, 16 bp, Homo sapiens
tgtaagttatttcttg

SEQ ID NO: 371095 - DNA, 15 bp, Homo sapiens
tgtaagttgtaagga

SEQ ID NO: 371096 - DNA, 20 bp, Homo sapiens
tgtaagtttatgtctaaaga

SEQ ID NO: 371097 - DNA, 20 bp, Homo sapiens
tgtaataaaaatttgtttaa

SEQ ID NO: 371098 - DNA, 21 bp, Homo sapiens
tgtaataaaacttatgctagt

SEQ ID NO: 371099 - DNA, 15 bp, Homo sapiens
tgtaataaagtatat

SEQ ID NO: 371100 - DNA, 16 bp, Homo sapiens
tgtaataaagtatata

SEQ ID NO: 371101 - DNA, 14 bp, Homo sapiens
tgtaataactgtga

SEQ ID NO: 371102 - DNA, 22 bp, Homo sapiens
tgtaataactgtgaagtttaca

SEQ ID NO: 371103 - DNA, 16 bp, Homo sapiens
tgtaatagcctcacct

SEQ ID NO: 371104 - DNA, 13 bp, Homo sapiens
tgtaatatattgc

SEQ ID NO: 371105 - DNA, 21 bp, Homo sapiens
tgtaatatctttaaatgatgt

SEQ ID NO: 371106 - DNA, 19 bp, Homo sapiens
tgtaatattactttaacat

SEQ ID NO: 371107 - DNA, 14 bp, Homo sapiens
tgtaatcaatgttt

SEQ ID NO: 371108 - DNA, 20 bp, Homo sapiens
tgtaatcaatgtttcttcta

SEQ ID NO: 371109 - DNA, 18 bp, Homo sapiens
tgtaatcacaactcagca

SEQ ID NO: 371110 - DNA, 17 bp, Homo sapiens
tgtaatcacactctctt

SEQ ID NO: 371111 - DNA, 20 bp, Homo sapiens
tgtaatcacactctcttctt

SEQ ID NO: 371112 - DNA, 23 bp, Homo sapiens
tgtaatcacactctcttcttact

SEQ ID NO: 371113 - DNA, 21 bp, Homo sapiens
tgtaatcatttcttgggccct

SEQ ID NO: 371114 - DNA, 22 bp, Homo sapiens
tgtaatcctcagctgacacata

SEQ ID NO: 371115 - DNA, 15 bp, Homo sapiens
tgtaatgcttatgtg

SEQ ID NO: 371116 - DNA, 18 bp, Homo sapiens
tgtaatggtctctgaaaa

SEQ ID NO: 371117 - DNA, 17 bp, Homo sapiens
tgtaatgttactgatca

SEQ ID NO: 371118 - DNA, 15 bp, Homo sapiens
tgtaattaatatctt

SEQ ID NO: 371119 - DNA, 16 bp, Homo sapiens
tgtaattaatatcttg

SEQ ID NO: 371120 - DNA, 14 bp, Homo sapiens
tgtaattctaaatg

SEQ ID NO: 371121 - DNA, 15 bp, Homo sapiens
tgtaattctaaatga

SEQ ID NO: 371122 - DNA, 16 bp, Homo sapiens
tgtaattctaaatgaa

SEQ ID NO: 371123 - DNA, 12 bp, Homo sapiens
tgtaattgctgc

SEQ ID NO: 371124 - DNA, 15 bp, Homo sapiens
tgtaattgctgcctt

SEQ ID NO: 371125 - DNA, 16 bp, Homo sapiens
tgtaattgcttacatt

SEQ ID NO: 371126 - DNA, 18 bp, Homo sapiens
tgtaattgcttacatttt

SEQ ID NO: 371127 - DNA, 13 bp, Homo sapiens
tgtaattgtctca

SEQ ID NO: 371128 - DNA, 19 bp, Homo sapiens
tgtaatttcagctagttaa

SEQ ID NO: 371129 - DNA, 15 bp, Homo sapiens
tgtacaaagatactt

SEQ ID NO: 371130 - DNA, 19 bp, Homo sapiens
tgtacaaagtagagaagta

SEQ ID NO: 371131 - DNA, 18 bp, Homo sapiens
tgtacaaggtatgtacag

SEQ ID NO: 371132 - DNA, 23 bp, Homo sapiens
tgtacaagttttgtataaataat

SEQ ID NO: 371133 - DNA, 22 bp, Homo sapiens
tgtacaattttcatcccacaat

SEQ ID NO: 371134 - DNA, 19 bp, Homo sapiens
tgtacaccatagtttacaa

SEQ ID NO: 371135 - DNA, 14 bp, Homo sapiens
tgtacactgaatat

SEQ ID NO: 371136 - DNA, 15 bp, Homo sapiens
tgtacactgaatatt

SEQ ID NO: 371137 - DNA, 16 bp, Homo sapiens
tgtacactgaatattt

SEQ ID NO: 371138 - DNA, 21 bp, Homo sapiens
tgtacactgaatatttatatt

SEQ ID NO: 371139 - DNA, 24 bp, Homo sapiens
tgtacagaaccagcactcccaggg

SEQ ID NO: 371140 - DNA, 14 bp, Homo sapiens
tgtacagacaacaa

SEQ ID NO: 371141 - DNA, 17 bp, Homo sapiens
tgtacagtatgtgtcta

SEQ ID NO: 371142 - DNA, 18 bp, Homo sapiens
tgtacagtatgtgtctag

SEQ ID NO: 371143 - DNA, 16 bp, Homo sapiens
tgtacagtatttacct

SEQ ID NO: 371144 - DNA, 22 bp, Homo sapiens
tgtacagtgtctgtgccatgga

SEQ ID NO: 371145 - DNA, 17 bp, Homo sapiens
tgtacagttatttatgc

SEQ ID NO: 371146 - DNA, 14 bp, Homo sapiens
tgtacagttcagtt

SEQ ID NO: 371147 - DNA, 22 bp, Homo sapiens
tgtacagttgactggctttcct

SEQ ID NO: 371148 - DNA, 22 bp, Homo sapiens
tgtacataatgcttaatttcta

SEQ ID NO: 371149 - DNA, 23 bp, Homo sapiens
tgtacataatgcttaatttctaa

SEQ ID NO: 371150 - DNA, 13 bp, Homo sapiens
tgtacatacattg

SEQ ID NO: 371151 - DNA, 23 bp, Homo sapiens
tgtacatagtggtcatttggtgg

SEQ ID NO: 371152 - DNA, 22 bp, Homo sapiens
tgtacatatggaaatcctgtta

SEQ ID NO: 371153 - DNA, 15 bp, Homo sapiens
tgtacatattactgt

SEQ ID NO: 371154 - DNA, 14 bp, Homo sapiens
tgtacatgcattca

SEQ ID NO: 371155 - DNA, 17 bp, Homo sapiens
tgtacatgtggaaaact

SEQ ID NO: 371156 - DNA, 12 bp, Homo sapiens
tgtacattcctg

SEQ ID NO: 371157 - DNA, 15 bp, Homo sapiens
tgtaccagggctctg

SEQ ID NO: 371158 - DNA, 12 bp, Homo sapiens
tgtacccagcca

SEQ ID NO: 371159 - DNA, 17 bp, Homo sapiens
tgtacccagccaccttc

SEQ ID NO: 371160 - DNA, 20 bp, Homo sapiens
tgtacccttccacctcctag

SEQ ID NO: 371161 - DNA, 18 bp, Homo sapiens
tgtacctgtaggaaacag

SEQ ID NO: 371162 - DNA, 22 bp, Homo sapiens
tgtacctgtaggaaacagaaaa

SEQ ID NO: 371163 - DNA, 19 bp, Homo sapiens
tgtaccttattgatctttg

SEQ ID NO: 371164 - DNA, 22 bp, Homo sapiens
tgtacgtatgaatgatatcttt

SEQ ID NO: 371165 - DNA, 12 bp, Homo sapiens
tgtacgtggaga

SEQ ID NO: 371166 - DNA, 16 bp, Homo sapiens
tgtactaagccaggag

SEQ ID NO: 371167 - DNA, 18 bp, Homo sapiens
tgtactatatgtatatct

SEQ ID NO: 371168 - DNA, 14 bp, Homo sapiens
tgtactatttaact

SEQ ID NO: 371169 - DNA, 15 bp, Homo sapiens
tgtactcagagcaga

SEQ ID NO: 371170 - DNA, 15 bp, Homo sapiens
tgtactccagcctgg

SEQ ID NO: 371171 - DNA, 18 bp, Homo sapiens
tgtactccagcctgggtg

SEQ ID NO: 371172 - DNA, 13 bp, Homo sapiens
tgtactcctccca

SEQ ID NO: 371173 - DNA, 22 bp, Homo sapiens
tgtactgagaggaggggtaaat

SEQ ID NO: 371174 - DNA, 17 bp, Homo sapiens
tgtactgagccttgtaa

SEQ ID NO: 371175 - DNA, 12 bp, Homo sapiens
tgtactgataaa

SEQ ID NO: 371176 - DNA, 18 bp, Homo sapiens
tgtactgatgattgtttg

SEQ ID NO: 371177 - DNA, 19 bp, Homo sapiens
tgtactggagagtggcaaa

SEQ ID NO: 371178 - DNA, 16 bp, Homo sapiens
tgtactgtagtttttc

SEQ ID NO: 371179 - DNA, 11 bp, Homo sapiens
tgtactgtgct

SEQ ID NO: 371180 - DNA, 15 bp, Homo sapiens
tgtactttgcttctt

SEQ ID NO: 371181 - DNA, 12 bp, Homo sapiens
tgtactttgttt

SEQ ID NO: 371182 - DNA, 16 bp, Homo sapiens
tgtactttgtttttcc

SEQ ID NO: 371183 - DNA, 20 bp, Homo sapiens
tgtagaaaggttgattctca

SEQ ID NO: 371184 - DNA, 21 bp, Homo sapiens
tgtagaaaggttgattctcat

SEQ ID NO: 371185 - DNA, 16 bp, Homo sapiens
tgtagaactcagcagt

SEQ ID NO: 371186 - DNA, 17 bp, Homo sapiens
tgtagaactcagcagtt

SEQ ID NO: 371187 - DNA, 19 bp, Homo sapiens
tgtagaactcagcagttga

SEQ ID NO: 371188 - DNA, 18 bp, Homo sapiens
tgtagaactgttcatttc

SEQ ID NO: 371189 - DNA, 22 bp, Homo sapiens
tgtagaactgttcatttccacc

SEQ ID NO: 371190 - DNA, 11 bp, Homo sapiens
tgtagaagaaa

SEQ ID NO: 371191 - DNA, 13 bp, Homo sapiens
tgtccacaaatgt

SEQ ID NO: 371192 - DNA, 17 bp, Homo sapiens
tgtccacaaatgtcctc

SEQ ID NO: 371193 - DNA, 20 bp, Homo sapiens
tgtccacagagtttgtagta

SEQ ID NO: 371194 - DNA, 17 bp, Homo sapiens
tgtccacataggtttag

SEQ ID NO: 371195 - DNA, 22 bp, Homo sapiens
tgtccaccctcatttctgccag

SEQ ID NO: 371196 - DNA, 16 bp, Homo sapiens
tgtccagaagaatatt

SEQ ID NO: 371197 - DNA, 23 bp, Homo sapiens
tgtccagaagcggcctgtgcgtt

SEQ ID NO: 371198 - DNA, 20 bp, Homo sapiens
tgtccagatgtgcaggctcc

SEQ ID NO: 371199 - DNA, 21 bp, Homo sapiens
tgtccaggaaaccctggcttg

SEQ ID NO: 371200 - DNA, 14 bp, Homo sapiens
tgtccaggccactg

SEQ ID NO: 371201 - DNA, 21 bp, Homo sapiens
tgtccaggccactgtggccag

SEQ ID NO: 371202 - DNA, 20 bp, Homo sapiens
tgtccaggtgagtgtgaggg

SEQ ID NO: 371203 - DNA, 16 bp, Homo sapiens
tgtccataagagaaat

SEQ ID NO: 371204 - DNA, 13 bp, Homo sapiens
tgtccatccccag

SEQ ID NO: 371205 - DNA, 14 bp, Homo sapiens
tgtccatccccagt

SEQ ID NO: 371206 - DNA, 14 bp, Homo sapiens
tgtccatctgtctg

SEQ ID NO: 371207 - DNA, 15 bp, Homo sapiens
tgtccatctgtctgt

SEQ ID NO: 371208 - DNA, 18 bp, Homo sapiens
tgtccatctgtctgtcct

SEQ ID NO: 371209 - DNA, 19 bp, Homo sapiens
tgtccatctgtctgtccta

SEQ ID NO: 371210 - DNA, 20 bp, Homo sapiens
tgtccatgatgtccttgtta

SEQ ID NO: 371211 - DNA, 13 bp, Homo sapiens
tgtcccaaataaa

SEQ ID NO: 371212 - DNA, 22 bp, Homo sapiens
tgtcccaacaaccacacttaaa

SEQ ID NO: 371213 - DNA, 22 bp, Homo sapiens
tgtcccaatcttaccagatgct

SEQ ID NO: 371214 - DNA, 23 bp, Homo sapiens
tgtcccaatcttaccagatgcta

SEQ ID NO: 371215 - DNA, 15 bp, Homo sapiens
tgtcccacaaaatat

SEQ ID NO: 371216 - DNA, 15 bp, Homo sapiens
tgtcccactgggaca

SEQ ID NO: 371217 - DNA, 23 bp, Homo sapiens
tgtcccagagcttattggccact

SEQ ID NO: 371218 - DNA, 22 bp, Homo sapiens
tgtcccagaggttatctgcctg

SEQ ID NO: 371219 - DNA, 14 bp, Homo sapiens
tgtcccagcccctg

SEQ ID NO: 371220 - DNA, 21 bp, Homo sapiens
tgtcccaggggtctccctgag

SEQ ID NO: 371221 - DNA, 16 bp, Homo sapiens
tgtcccatgatccctg

SEQ ID NO: 371222 - DNA, 18 bp, Homo sapiens
tgtcccatgatccctgtg

SEQ ID NO: 371223 - DNA, 23 bp, Homo sapiens
tgtcccattctagatcctgcacc

SEQ ID NO: 371224 - DNA, 19 bp, Homo sapiens
tgtcccatttattatttta

SEQ ID NO: 371225 - DNA, 19 bp, Homo sapiens
tgtccccaacgtcccctcc

SEQ ID NO: 371226 - DNA, 16 bp, Homo sapiens
tgtccccagcccactg

SEQ ID NO: 371227 - DNA, 21 bp, Homo sapiens
tgtccccagccctgtcctggt

SEQ ID NO: 371228 - DNA, 13 bp, Homo sapiens
tgtccccagggcc

SEQ ID NO: 371229 - DNA, 22 bp, Homo sapiens
tgtccccaggggcacacttccc

SEQ ID NO: 371230 - DNA, 15 bp, Homo sapiens
tgtccccattctata

SEQ ID NO: 371231 - DNA, 21 bp, Homo sapiens
tgtcccccacctcttttccta

SEQ ID NO: 371232 - DNA, 14 bp, Homo sapiens
tgtcccccggggca

SEQ ID NO: 371233 - DNA, 19 bp, Homo sapiens
tgtccccctcccctcccag

SEQ ID NO: 371234 - DNA, 22 bp, Homo sapiens
tgtccccgagccgagctctcct

SEQ ID NO: 371235 - DNA, 16 bp, Homo sapiens
tgtccccgccttccct

SEQ ID NO: 371236 - DNA, 22 bp, Homo sapiens
tgtccccggggtattagcacct

SEQ ID NO: 371237 - DNA, 19 bp, Homo sapiens
tgtcccctccttccagcct

SEQ ID NO: 371238 - DNA, 14 bp, Homo sapiens
tgtcccctctgtca

SEQ ID NO: 371239 - DNA, 14 bp, Homo sapiens
tgtcccctgacctg

SEQ ID NO: 371240 - DNA, 14 bp, Homo sapiens
tgtcccctgtccca

SEQ ID NO: 371241 - DNA, 19 bp, Homo sapiens
tgtcccctgtcccaccaac

SEQ ID NO: 371242 - DNA, 16 bp, Homo sapiens
tgtccccttcccctgc

SEQ ID NO: 371243 - DNA, 17 bp, Homo sapiens
tgtccccttcccctgct

SEQ ID NO: 371244 - DNA, 18 bp, Homo sapiens
tgtccccttcccctgctg

SEQ ID NO: 371245 - DNA, 22 bp, Homo sapiens
tgtcccgccttcctcctccaca

SEQ ID NO: 371246 - DNA, 18 bp, Homo sapiens
tgtccctaccactgagcc

SEQ ID NO: 371247 - DNA, 21 bp, Homo sapiens
tgtccctaccgagtctcttct

SEQ ID NO: 371248 - DNA, 22 bp, Homo sapiens
tgtccctaccgagtctcttctc

SEQ ID NO: 371249 - DNA, 18 bp, Homo sapiens
tgtccctcccccgcttcc

SEQ ID NO: 371250 - DNA, 14 bp, Homo sapiens
tgtccctctcaggc

SEQ ID NO: 371251 - DNA, 15 bp, Homo sapiens
tgtccctctcaggca

SEQ ID NO: 371252 - DNA, 15 bp, Homo sapiens
tgtccctctctctgg

SEQ ID NO: 371253 - DNA, 16 bp, Homo sapiens
tgtccctctctctgga

SEQ ID NO: 371254 - DNA, 15 bp, Homo sapiens
tgtccctggccatct

SEQ ID NO: 371255 - DNA, 17 bp, Homo sapiens
tgtccctggccatctct

SEQ ID NO: 371256 - DNA, 13 bp, Homo sapiens
tgtccctgtccct

SEQ ID NO: 371257 - DNA, 15 bp, Homo sapiens
tgtccctgtccctgc

SEQ ID NO: 371258 - DNA, 18 bp, Homo sapiens
tgtccctgtccctgcccc

SEQ ID NO: 371259 - DNA, 12 bp, Homo sapiens
tgtccctgtggt

SEQ ID NO: 371260 - DNA, 22 bp, Homo sapiens
tgtcccttgcctcaatgccagt

SEQ ID NO: 371261 - DNA, 16 bp, Homo sapiens
tgtccctttcttggcc

SEQ ID NO: 371262 - DNA, 17 bp, Homo sapiens
tgtccgccctcttcccc

SEQ ID NO: 371263 - DNA, 17 bp, Homo sapiens
tgtccgctctctcatgt

SEQ ID NO: 371264 - DNA, 15 bp, Homo sapiens
tgtcctaaggacaca

SEQ ID NO: 371265 - DNA, 16 bp, Homo sapiens
tgtcctacccgcccgc

SEQ ID NO: 371266 - DNA, 21 bp, Homo sapiens
tgtcctaggggccgagggaaa

SEQ ID NO: 371267 - DNA, 23 bp, Homo sapiens
tgtcctaggggccgagggaaatg

SEQ ID NO: 371268 - DNA, 14 bp, Homo sapiens
tgtcctataattct

SEQ ID NO: 371269 - DNA, 21 bp, Homo sapiens
tgtcctcagagggtccctagg

SEQ ID NO: 371270 - DNA, 22 bp, Homo sapiens
tgtcctcagggctctaccaaga

SEQ ID NO: 371271 - DNA, 18 bp, Homo sapiens
tgtcctcaggtgaataac

SEQ ID NO: 371272 - DNA, 13 bp, Homo sapiens
tgtcctcatcctt

SEQ ID NO: 371273 - DNA, 14 bp, Homo sapiens
tgtcctcatctata

SEQ ID NO: 371274 - DNA, 20 bp, Homo sapiens
tgtcctcatctataaaatga

SEQ ID NO: 371275 - DNA, 16 bp, Homo sapiens
tgtcctcattcttctc

SEQ ID NO: 371276 - DNA, 18 bp, Homo sapiens
tgtcctccagaagcctct

SEQ ID NO: 371277 - DNA, 21 bp, Homo sapiens
tgtcctccagaagcctctggc

SEQ ID NO: 371278 - DNA, 17 bp, Homo sapiens
tgtcctctttactccct

SEQ ID NO: 371279 - DNA, 23 bp, Homo sapiens
tgtcctctttactcccttcctgg

SEQ ID NO: 371280 - DNA, 21 bp, Homo sapiens
tgtcctctttcagaaaacaga

SEQ ID NO: 371281 - DNA, 16 bp, Homo sapiens
tgtcctgactgtccta

SEQ ID NO: 371282 - DNA, 15 bp, Homo sapiens
tgtcctgatgctttt

SEQ ID NO: 371283 - DNA, 20 bp, Homo sapiens
tgtcctgatggtcagctccc

SEQ ID NO: 371284 - DNA, 14 bp, Homo sapiens
tgtcctgccagctg

SEQ ID NO: 371285 - DNA, 16 bp, Homo sapiens
tgtcctgccagctgcc

SEQ ID NO: 371286 - DNA, 17 bp, Homo sapiens
tgtcctgccagctgcct

SEQ ID NO: 371287 - DNA, 17 bp, Homo sapiens
tgtcctgctcacgtctg

SEQ ID NO: 371288 - DNA, 15 bp, Homo sapiens
tgtcctggctgtgca

SEQ ID NO: 371289 - DNA, 18 bp, Homo sapiens
tgtcctggctgtgcacat

SEQ ID NO: 371290 - DNA, 11 bp, Homo sapiens
tgtcctgggcg

SEQ ID NO: 371291 - DNA, 15 bp, Homo sapiens
tgtcctgtaaacact

SEQ ID NO: 371292 - DNA, 23 bp, Homo sapiens
tgtcctgtaaacactcagctgtt

SEQ ID NO: 371293 - DNA, 23 bp, Homo sapiens
tgtcctgtatagcaacctatttg

SEQ ID NO: 371294 - DNA, 15 bp, Homo sapiens
tgtcctgtgctttct

SEQ ID NO: 371295 - DNA, 23 bp, Homo sapiens
tgtcctgtgctttctgcatgctt

SEQ ID NO: 371296 - DNA, 15 bp, Homo sapiens
tgtccttcagagctc

SEQ ID NO: 371297 - DNA, 20 bp, Homo sapiens
tgtccttcccacggccactg

SEQ ID NO: 371298 - DNA, 23 bp, Homo sapiens
tgtccttcccacggccactgcag

SEQ ID NO: 371299 - DNA, 17 bp, Homo sapiens
tgtcctttccctccact

SEQ ID NO: 371300 - DNA, 19 bp, Homo sapiens
tgtcctttccctggagtca

SEQ ID NO: 371301 - DNA, 19 bp, Homo sapiens
tgtcctttctccaggccct

SEQ ID NO: 371302 - DNA, 19 bp, Homo sapiens
tgtcctttgagaaagaaat

SEQ ID NO: 371303 - DNA, 13 bp, Homo sapiens
tgtcgagacactt

SEQ ID NO: 371304 - DNA, 15 bp, Homo sapiens
tgtcgagacacttgc

SEQ ID NO: 371305 - DNA, 22 bp, Homo sapiens
tgtcgattaaaatcactctcag

SEQ ID NO: 371306 - DNA, 22 bp, Homo sapiens
tgtcgcccaggctggagggcag

SEQ ID NO: 371307 - DNA, 14 bp, Homo sapiens
tgtcggagaggctg

SEQ ID NO: 371308 - DNA, 22 bp, Homo sapiens
tgtcggagaggctgtctggggc

SEQ ID NO: 371309 - DNA, 20 bp, Homo sapiens
tgtcggttcttcctggaagt

SEQ ID NO: 371310 - DNA, 23 bp, Homo sapiens
tgtcggttttttttaaataaaag

SEQ ID NO: 371311 - DNA, 18 bp, Homo sapiens
tgtcgtcctgcagtgtga

SEQ ID NO: 371312 - DNA, 15 bp, Homo sapiens
tgtcgtgccagtcct

SEQ ID NO: 371313 - DNA, 17 bp, Homo sapiens
tgtcgtggtagcagatg

SEQ ID NO: 371314 - DNA, 13 bp, Homo sapiens
tgtcgttcatttt

SEQ ID NO: 371315 - DNA, 20 bp, Homo sapiens
tgtcgttcccttgtgtctgt

SEQ ID NO: 371316 - DNA, 24 bp, Homo sapiens
tgtcgttcccttgtgtctgttgct

SEQ ID NO: 371317 - DNA, 23 bp, Homo sapiens
tgtctaaaaataaaatgcattta

SEQ ID NO: 371318 - DNA, 22 bp, Homo sapiens
tgtctaaaagattctttaaact

SEQ ID NO: 371319 - DNA, 22 bp, Homo sapiens
tgtctaactttagaagtgcatt

SEQ ID NO: 371320 - DNA, 15 bp, Homo sapiens
tgtgcctgctatcca

SEQ ID NO: 371321 - DNA, 13 bp, Homo sapiens
tgtgcctggagct

SEQ ID NO: 371322 - DNA, 18 bp, Homo sapiens
tgtgcctggagctcctgg

SEQ ID NO: 371323 - DNA, 23 bp, Homo sapiens
tgtgcctggcttctttctctcag

SEQ ID NO: 371324 - DNA, 15 bp, Homo sapiens
tgtgcggtgcataca

SEQ ID NO: 371325 - DNA, 15 bp, Homo sapiens
tgtgcgtgaaacaca

SEQ ID NO: 371326 - DNA, 22 bp, Homo sapiens
tgtgcgtgaaacacaccaggct

SEQ ID NO: 371327 - DNA, 20 bp, Homo sapiens
tgtgcgtgtgtccatgtgtg

SEQ ID NO: 371328 - DNA, 23 bp, Homo sapiens
tgtgctaaccacgtctgtcttca

SEQ ID NO: 371329 - DNA, 22 bp, Homo sapiens
tgtgctaatttctgtccagaaa

SEQ ID NO: 371330 - DNA, 15 bp, Homo sapiens
tgtgctacagagaaa

SEQ ID NO: 371331 - DNA, 13 bp, Homo sapiens
tgtgctatagtgt

SEQ ID NO: 371332 - DNA, 15 bp, Homo sapiens
tgtgctatgaatttt

SEQ ID NO: 371333 - DNA, 22 bp, Homo sapiens
tgtgctcacccattgtctcatt

SEQ ID NO: 371334 - DNA, 14 bp, Homo sapiens
tgtgctcacgctcc

SEQ ID NO: 371335 - DNA, 17 bp, Homo sapiens
tgtgctcacgctccccc

SEQ ID NO: 371336 - DNA, 21 bp, Homo sapiens
tgtgctcacgctcccccgcag

SEQ ID NO: 371337 - DNA, 18 bp, Homo sapiens
tgtgctccagcagtgctg

SEQ ID NO: 371338 - DNA, 19 bp, Homo sapiens
tgtgctccagcagtgctgg

SEQ ID NO: 371339 - DNA, 20 bp, Homo sapiens
tgtgctccagcagtgctggg

SEQ ID NO: 371340 - DNA, 14 bp, Homo sapiens
tgtgctcggacaca

SEQ ID NO: 371341 - DNA, 16 bp, Homo sapiens
tgtgctctttgaagag

SEQ ID NO: 371342 - DNA, 20 bp, Homo sapiens
tgtgctgattcaataaaatg

SEQ ID NO: 371343 - DNA, 22 bp, Homo sapiens
tgtgctgattcaataaaatgca

SEQ ID NO: 371344 - DNA, 21 bp, Homo sapiens
tgtgctgcagacaaaaagaac

SEQ ID NO: 371345 - DNA, 21 bp, Homo sapiens
tgtgctgggccagtggctggg

SEQ ID NO: 371346 - DNA, 14 bp, Homo sapiens
tgtgctgtgcctgc

SEQ ID NO: 371347 - DNA, 21 bp, Homo sapiens
tgtgctgtgcctgctagagca

SEQ ID NO: 371348 - DNA, 14 bp, Homo sapiens
tgtgcttgtttaca

SEQ ID NO: 371349 - DNA, 18 bp, Homo sapiens
tgtgctttatgctgaaac

SEQ ID NO: 371350 - DNA, 20 bp, Homo sapiens
tgtgctttatgctgaaacag

SEQ ID NO: 371351 - DNA, 20 bp, Homo sapiens
tgtgcttttgcaaaagaagt

SEQ ID NO: 371352 - DNA, 12 bp, Homo sapiens
tgtggaaaacaa

SEQ ID NO: 371353 - DNA, 22 bp, Homo sapiens
tgtggaaaacaatttgcataat

SEQ ID NO: 371354 - DNA, 17 bp, Homo sapiens
tgtggaaaatgaaaatt

SEQ ID NO: 371355 - DNA, 22 bp, Homo sapiens
tgtggaaagtgaatttgaatga

SEQ ID NO: 371356 - DNA, 17 bp, Homo sapiens
tgtggaacactaaagag

SEQ ID NO: 371357 - DNA, 14 bp, Homo sapiens
tgtggaagggacta

SEQ ID NO: 371358 - DNA, 15 bp, Homo sapiens
tgtggaagggactag

SEQ ID NO: 371359 - DNA, 22 bp, Homo sapiens
tgtggactttatttaatttcat

SEQ ID NO: 371360 - DNA, 14 bp, Homo sapiens
tgtggagaatgtac

SEQ ID NO: 371361 - DNA, 19 bp, Homo sapiens
tgtggagaggggtgcaccc

SEQ ID NO: 371362 - DNA, 23 bp, Homo sapiens
tgtggagaggggtgcacccactc

SEQ ID NO: 371363 - DNA, 16 bp, Homo sapiens
tgtggagagtgagaat

SEQ ID NO: 371364 - DNA, 18 bp, Homo sapiens
tgtggagcaaaaggcagc

SEQ ID NO: 371365 - DNA, 19 bp, Homo sapiens
tgtggagcaaaaggcagct

SEQ ID NO: 371366 - DNA, 20 bp, Homo sapiens
tgtggagcaaaaggcagctc

SEQ ID NO: 371367 - DNA, 22 bp, Homo sapiens
tgtggagcaaaaggcagctcac

SEQ ID NO: 371368 - DNA, 18 bp, Homo sapiens
tgtggagcccgcaccccc

SEQ ID NO: 371369 - DNA, 23 bp, Homo sapiens
tgtggagggattgaacacaggca

SEQ ID NO: 371370 - DNA, 12 bp, Homo sapiens
tgtggagtggag

SEQ ID NO: 371371 - DNA, 14 bp, Homo sapiens
tgtggagtggaggg

SEQ ID NO: 371372 - DNA, 12 bp, Homo sapiens
tgtggagtgggg

SEQ ID NO: 371373 - DNA, 18 bp, Homo sapiens
tgtggagtggggcagtag

SEQ ID NO: 371374 - DNA, 21 bp, Homo sapiens
tgtggatgaaaaaaagggaaa

SEQ ID NO: 371375 - DNA, 16 bp, Homo sapiens
tgtggattctatattt

SEQ ID NO: 371376 - DNA, 19 bp, Homo sapiens
tgtggcaaaatatggtttg

SEQ ID NO: 371377 - DNA, 15 bp, Homo sapiens
tgtggcaaacattta

SEQ ID NO: 371378 - DNA, 16 bp, Homo sapiens
tgtggcaaagtgctgt

SEQ ID NO: 371379 - DNA, 22 bp, Homo sapiens
tgtggcaaatgccaggacagct

SEQ ID NO: 371380 - DNA, 15 bp, Homo sapiens
tgtggcacgcacctg

SEQ ID NO: 371381 - DNA, 13 bp, Homo sapiens
tgtggcagctggg

SEQ ID NO: 371382 - DNA, 16 bp, Homo sapiens
tgtggcagctgtctca

SEQ ID NO: 371383 - DNA, 17 bp, Homo sapiens
tgtggcagtggccaggc

SEQ ID NO: 371384 - DNA, 23 bp, Homo sapiens
tgtggccaagggctccagggcca

SEQ ID NO: 371385 - DNA, 22 bp, Homo sapiens
tgtggccagagcacctcaggac

SEQ ID NO: 371386 - DNA, 17 bp, Homo sapiens
tgtggccccaggtgcca

SEQ ID NO: 371387 - DNA, 21 bp, Homo sapiens
tgtggccccaggtgccaccaa

SEQ ID NO: 371388 - DNA, 17 bp, Homo sapiens
tgtggcccccgccccct

SEQ ID NO: 371389 - DNA, 18 bp, Homo sapiens
tgtggcccccgccccctc

SEQ ID NO: 371390 - DNA, 15 bp, Homo sapiens
tgtggcccctccttc

SEQ ID NO: 371391 - DNA, 17 bp, Homo sapiens
tgtggcccctccttctc

SEQ ID NO: 371392 - DNA, 22 bp, Homo sapiens
tgtggcccctccttctcccctc

SEQ ID NO: 371393 - DNA, 12 bp, Homo sapiens
tgtggccccttc

SEQ ID NO: 371394 - DNA, 17 bp, Homo sapiens
tgtggccctgcaagggc

SEQ ID NO: 371395 - DNA, 17 bp, Homo sapiens
tgtggccgtctcctccc

SEQ ID NO: 371396 - DNA, 10 bp, Homo sapiens
tgtggcctca

SEQ ID NO: 371397 - DNA, 20 bp, Homo sapiens
tgtggcgatatgagagggat

SEQ ID NO: 371398 - DNA, 17 bp, Homo sapiens
tgtggctcattcttttc

SEQ ID NO: 371399 - DNA, 13 bp, Homo sapiens
tgtggctcccctc

SEQ ID NO: 371400 - DNA, 14 bp, Homo sapiens
tgtggctcccctct

SEQ ID NO: 371401 - DNA, 15 bp, Homo sapiens
tgtggctcccctcta

SEQ ID NO: 371402 - DNA, 23 bp, Homo sapiens
tgtggctcccctctatttagcat

SEQ ID NO: 371403 - DNA, 21 bp, Homo sapiens
tgtggctcctgggggttcttt

SEQ ID NO: 371404 - DNA, 20 bp, Homo sapiens
tgtggctgctcccagcctct

SEQ ID NO: 371405 - DNA, 13 bp, Homo sapiens
tgtggctgggtgg

SEQ ID NO: 371406 - DNA, 19 bp, Homo sapiens
tgtggctggtgtccccttc

SEQ ID NO: 371407 - DNA, 20 bp, Homo sapiens
tgtggctggtgtccccttcc

SEQ ID NO: 371408 - DNA, 23 bp, Homo sapiens
tgtggctggtgtccccttcccct

SEQ ID NO: 371409 - DNA, 16 bp, Homo sapiens
tgtggcttaaacattt

SEQ ID NO: 371410 - DNA, 17 bp, Homo sapiens
tgtggcttaaacatttt

SEQ ID NO: 371411 - DNA, 12 bp, Homo sapiens
tgtggcttggaa

SEQ ID NO: 371412 - DNA, 22 bp, Homo sapiens
tgtggcttggtttggtcatgcc

SEQ ID NO: 371413 - DNA, 15 bp, Homo sapiens
tgtgggaagaaacaa

SEQ ID NO: 371414 - DNA, 19 bp, Homo sapiens
tgtgggaagaaacaaaccc

SEQ ID NO: 371415 - DNA, 17 bp, Homo sapiens
tgtgggaatctcccaga

SEQ ID NO: 371416 - DNA, 21 bp, Homo sapiens
tgtgggactccaggccagctc

SEQ ID NO: 371417 - DNA, 15 bp, Homo sapiens
tgtgggactggccca

SEQ ID NO: 371418 - DNA, 19 bp, Homo sapiens
tgtgggcctcaaggacttg

SEQ ID NO: 371419 - DNA, 21 bp, Homo sapiens
tgtgggcctcaaggacttgaa

SEQ ID NO: 371420 - DNA, 13 bp, Homo sapiens
tgtgggctgtgag

SEQ ID NO: 371421 - DNA, 13 bp, Homo sapiens
tgtggggagctgg

SEQ ID NO: 371422 - DNA, 13 bp, Homo sapiens
tgtgggggaaggc

SEQ ID NO: 371423 - DNA, 17 bp, Homo sapiens
tgtgggggaaggccttg

SEQ ID NO: 371424 - DNA, 13 bp, Homo sapiens
tgtggggtggggt

SEQ ID NO: 371425 - DNA, 21 bp, Homo sapiens
tgtgggtcagtgtgccaccct

SEQ ID NO: 371426 - DNA, 13 bp, Homo sapiens
tgtgggtgagcca

SEQ ID NO: 371427 - DNA, 19 bp, Homo sapiens
tgtgggtttactctgtgct

SEQ ID NO: 371428 - DNA, 23 bp, Homo sapiens
tgtggtaccctggcagagaagag

SEQ ID NO: 371429 - DNA, 21 bp, Homo sapiens
tgtggtattcaactaatacat

SEQ ID NO: 371430 - DNA, 15 bp, Homo sapiens
tgtggtccagaagaa

SEQ ID NO: 371431 - DNA, 20 bp, Homo sapiens
tgtggtccctccactaggag

SEQ ID NO: 371432 - DNA, 19 bp, Homo sapiens
tgtggtgaagtgtggctgg

SEQ ID NO: 371433 - DNA, 19 bp, Homo sapiens
tgtggtgaggttgggcagc

SEQ ID NO: 371434 - DNA, 20 bp, Homo sapiens
tgtggtgatcgcacaaggac

SEQ ID NO: 371435 - DNA, 15 bp, Homo sapiens
tgtggtggtttctat

SEQ ID NO: 371436 - DNA, 14 bp, Homo sapiens
tgtggttctatttt

SEQ ID NO: 371437 - DNA, 19 bp, Homo sapiens
tgtggttgacttatgggcc

SEQ ID NO: 371438 - DNA, 16 bp, Homo sapiens
tgtggttttcccctcc

SEQ ID NO: 371439 - DNA, 22 bp, Homo sapiens
tgtggttttcccctccctgggt

SEQ ID NO: 371440 - DNA, 14 bp, Homo sapiens
tgtgtaaaatgtga

SEQ ID NO: 371441 - DNA, 21 bp, Homo sapiens
tgtgtaaatatttttccctcc

SEQ ID NO: 371442 - DNA, 15 bp, Homo sapiens
tgtgtaaatgttatg

SEQ ID NO: 371443 - DNA, 21 bp, Homo sapiens
tgtgtaatagaaaactgaaaa

SEQ ID NO: 371444 - DNA, 17 bp, Homo sapiens
tgtgtaatatcatttca

SEQ ID NO: 371445 - DNA, 20 bp, Homo sapiens
tgtgtaatatcatttcataa

SEQ ID NO: 371446 - DNA, 23 bp, Homo sapiens
tgtgtaatattactttaacatgc

SEQ ID NO: 371447 - DNA, 21 bp, Homo sapiens
tgtgtaatcatttcttgggcc

SEQ ID NO: 371448 - DNA, 19 bp, Homo sapiens
tgtgtacaaagtagagaag

SEQ ID NO: 371449 - DNA, 23 bp, Homo sapiens
tgttgccaggttgcagctgctct

SEQ ID NO: 371450 - DNA, 14 bp, Homo sapiens
tgttgcccaggctg

SEQ ID NO: 371451 - DNA, 15 bp, Homo sapiens
tgttgccctttctgt

SEQ ID NO: 371452 - DNA, 15 bp, Homo sapiens
tgttgcctcctccca

SEQ ID NO: 371453 - DNA, 19 bp, Homo sapiens
tgttgcctcctctctccct

SEQ ID NO: 371454 - DNA, 16 bp, Homo sapiens
tgttgcctttgctctt

SEQ ID NO: 371455 - DNA, 23 bp, Homo sapiens
tgttgctcaaatctattcagaca

SEQ ID NO: 371456 - DNA, 14 bp, Homo sapiens
tgttgctgaaacac

SEQ ID NO: 371457 - DNA, 13 bp, Homo sapiens
tgttgctgtctgg

SEQ ID NO: 371458 - DNA, 18 bp, Homo sapiens
tgttgctgttgttcagaa

SEQ ID NO: 371459 - DNA, 14 bp, Homo sapiens
tgttgcttaatcta

SEQ ID NO: 371460 - DNA, 20 bp, Homo sapiens
tgttgcttaatctagagcta

SEQ ID NO: 371461 - DNA, 13 bp, Homo sapiens
tgttgctttctga

SEQ ID NO: 371462 - DNA, 13 bp, Homo sapiens
tgttgcttttacg

SEQ ID NO: 371463 - DNA, 23 bp, Homo sapiens
tgttggaaattgggtgtgccctg

SEQ ID NO: 371464 - DNA, 11 bp, Homo sapiens
tgttggatctt

SEQ ID NO: 371465 - DNA, 21 bp, Homo sapiens
tgttggatcttcaatggcttt

SEQ ID NO: 371466 - DNA, 16 bp, Homo sapiens
tgttggcccctctgct

SEQ ID NO: 371467 - DNA, 22 bp, Homo sapiens
tgttgggatgcgggcattttga

SEQ ID NO: 371468 - DNA, 12 bp, Homo sapiens
tgttgggcccca

SEQ ID NO: 371469 - DNA, 20 bp, Homo sapiens
tgttgggccccagggaacta

SEQ ID NO: 371470 - DNA, 11 bp, Homo sapiens
tgttggtgcaa

SEQ ID NO: 371471 - DNA, 14 bp, Homo sapiens
tgttggtgcaatta

SEQ ID NO: 371472 - DNA, 21 bp, Homo sapiens
tgttggtgcaattaactctgg

SEQ ID NO: 371473 - DNA, 23 bp, Homo sapiens
tgttggtgcaattaactctggac

SEQ ID NO: 371474 - DNA, 17 bp, Homo sapiens
tgttggttacatgaatg

SEQ ID NO: 371475 - DNA, 18 bp, Homo sapiens
tgttgtaataaaacttat

SEQ ID NO: 371476 - DNA, 21 bp, Homo sapiens
tgttgtagatacaatcagctg

SEQ ID NO: 371477 - DNA, 17 bp, Homo sapiens
tgttgtattcctgcctt

SEQ ID NO: 371478 - DNA, 16 bp, Homo sapiens
tgttgtcattgcttta

SEQ ID NO: 371479 - DNA, 21 bp, Homo sapiens
tgttgtcctgtgtcatctgtc

SEQ ID NO: 371480 - DNA, 13 bp, Homo sapiens
tgttgtgaatgtt

SEQ ID NO: 371481 - DNA, 12 bp, Homo sapiens
tgttgtgattaa

SEQ ID NO: 371482 - DNA, 22 bp, Homo sapiens
tgttgtgggcgctgcttccagg

SEQ ID NO: 371483 - DNA, 14 bp, Homo sapiens
tgttgttaaatatc

SEQ ID NO: 371484 - DNA, 11 bp, Homo sapiens
tgttgttgttg

SEQ ID NO: 371485 - DNA, 15 bp, Homo sapiens
tgttgtttgaagaac

SEQ ID NO: 371486 - DNA, 21 bp, Homo sapiens
tgttgtttgtaaataagagat

SEQ ID NO: 371487 - DNA, 12 bp, Homo sapiens
tgttgttttata

SEQ ID NO: 371488 - DNA, 18 bp, Homo sapiens
tgttgtttttaagtcctg

SEQ ID NO: 371489 - DNA, 16 bp, Homo sapiens
tgtttaaagaataaag

SEQ ID NO: 371490 - DNA, 16 bp, Homo sapiens
tgtttaaataaagacc

SEQ ID NO: 371491 - DNA, 20 bp, Homo sapiens
tgtttaaataaagtatcatg

SEQ ID NO: 371492 - DNA, 22 bp, Homo sapiens
tgtttaaataaagtatcatgca

SEQ ID NO: 371493 - DNA, 13 bp, Homo sapiens
tgtttaacaaatc

SEQ ID NO: 371494 - DNA, 22 bp, Homo sapiens
tgtttaacaaatctaatctctt

SEQ ID NO: 371495 - DNA, 16 bp, Homo sapiens
tgtttaaggttcttgc

SEQ ID NO: 371496 - DNA, 16 bp, Homo sapiens
tgtttaatattgagaa

SEQ ID NO: 371497 - DNA, 13 bp, Homo sapiens
tgtttaatgttat

SEQ ID NO: 371498 - DNA, 20 bp, Homo sapiens
tgtttacagcactactctgt

SEQ ID NO: 371499 - DNA, 21 bp, Homo sapiens
tgtttacagcactactctgtg

SEQ ID NO: 371500 - DNA, 22 bp, Homo sapiens
tgtttacagcactactctgtgc

SEQ ID NO: 371501 - DNA, 13 bp, Homo sapiens
tgtttaccctccc

SEQ ID NO: 371502 - DNA, 19 bp, Homo sapiens
tgtttaccctccctgtccc

SEQ ID NO: 371503 - DNA, 12 bp, Homo sapiens
tgtttacctcac

SEQ ID NO: 371504 - DNA, 15 bp, Homo sapiens
tgtttacttgtaaat

SEQ ID NO: 371505 - DNA, 21 bp, Homo sapiens
tgtttagagcagttaacatct

SEQ ID NO: 371506 - DNA, 20 bp, Homo sapiens
tgtttagtagctgataaaga

SEQ ID NO: 371507 - DNA, 20 bp, Homo sapiens
tgtttatgaagaaagatact

SEQ ID NO: 371508 - DNA, 14 bp, Homo sapiens
tgtttatgagccag

SEQ ID NO: 371509 - DNA, 14 bp, Homo sapiens
tgtttatggcctca

SEQ ID NO: 371510 - DNA, 24 bp, Homo sapiens
tgtttatggcctcagctgcctcac

SEQ ID NO: 371511 - DNA, 21 bp, Homo sapiens
tgtttatgttgcaatctggtt

SEQ ID NO: 371512 - DNA, 18 bp, Homo sapiens
tgtttattcctgataata

SEQ ID NO: 371513 - DNA, 17 bp, Homo sapiens
tgtttattgtcaaagtg

SEQ ID NO: 371514 - DNA, 14 bp, Homo sapiens
tgtttatttctgtt

SEQ ID NO: 371515 - DNA, 22 bp, Homo sapiens
tgtttatttttatatagcttga

SEQ ID NO: 371516 - DNA, 23 bp, Homo sapiens
tgtttatttttatatagcttgaa

SEQ ID NO: 371517 - DNA, 19 bp, Homo sapiens
tgtttcaatgacctgtatt

SEQ ID NO: 371518 - DNA, 21 bp, Homo sapiens
tgtttcatgttttgtgactat

SEQ ID NO: 371519 - DNA, 22 bp, Homo sapiens
tgtttcatgttttgtgactata

SEQ ID NO: 371520 - DNA, 21 bp, Homo sapiens
tgtttccaggcatgaccctgg

SEQ ID NO: 371521 - DNA, 19 bp, Homo sapiens
tgtttccatattttatagg

SEQ ID NO: 371522 - DNA, 17 bp, Homo sapiens
tgtttcccctcagaaca

SEQ ID NO: 371523 - DNA, 18 bp, Homo sapiens
tgtttccctagactctgt

SEQ ID NO: 371524 - DNA, 11 bp, Homo sapiens
tgtttccctgc

SEQ ID NO: 371525 - DNA, 15 bp, Homo sapiens
tgtttctaaaactat

SEQ ID NO: 371526 - DNA, 20 bp, Homo sapiens
tgtttctaagtggcctgcag

SEQ ID NO: 371527 - DNA, 14 bp, Homo sapiens
tgtttctctgagct

SEQ ID NO: 371528 - DNA, 24 bp, Homo sapiens
tgtttctctgagctttgttactga

SEQ ID NO: 371529 - DNA, 15 bp, Homo sapiens
tgtttctctgctgtt

SEQ ID NO: 371530 - DNA, 12 bp, Homo sapiens
tgtttctgcaga

SEQ ID NO: 371531 - DNA, 21 bp, Homo sapiens
tgtttctgcagaggcagcagg

SEQ ID NO: 371532 - DNA, 23 bp, Homo sapiens
tgtttctgcagcccttgggcagt

SEQ ID NO: 371533 - DNA, 11 bp, Homo sapiens
tgtttctgttc

SEQ ID NO: 371534 - DNA, 18 bp, Homo sapiens
tgtttcttccaaagcaca

SEQ ID NO: 371535 - DNA, 21 bp, Homo sapiens
tgtttctttctgtctctctct

SEQ ID NO: 371536 - DNA, 22 bp, Homo sapiens
tgtttgaaaatattatctttgt

SEQ ID NO: 371537 - DNA, 23 bp, Homo sapiens
tgtttgaaacactcgtgtgcatg

SEQ ID NO: 371538 - DNA, 20 bp, Homo sapiens
tgtttgccctgttcaaagta

SEQ ID NO: 371539 - DNA, 22 bp, Homo sapiens
tgtttgcctttaggcaggaagt

SEQ ID NO: 371540 - DNA, 17 bp, Homo sapiens
tgtttgctcagaacaca

SEQ ID NO: 371541 - DNA, 12 bp, Homo sapiens
tgtttgctgttt

SEQ ID NO: 371542 - DNA, 14 bp, Homo sapiens
tgtttgcttaaaca

SEQ ID NO: 371543 - DNA, 15 bp, Homo sapiens
tgtttgcttaaacaa

SEQ ID NO: 371544 - DNA, 18 bp, Homo sapiens
tgtttgcttattgttcca

SEQ ID NO: 371545 - DNA, 19 bp, Homo sapiens
tgtttggcttataaacaca

SEQ ID NO: 371546 - DNA, 23 bp, Homo sapiens
tgtttgggaatggtgcccttgga

SEQ ID NO: 371547 - DNA, 19 bp, Homo sapiens
tgtttgggatgtctgagat

SEQ ID NO: 371548 - DNA, 23 bp, Homo sapiens
tgtttgggtatcctgcccagtgt

SEQ ID NO: 371549 - DNA, 23 bp, Homo sapiens
tgtttgggtggtttgtgagcctt

SEQ ID NO: 371550 - DNA, 15 bp, Homo sapiens
tgtttgtaaataaga

SEQ ID NO: 371551 - DNA, 16 bp, Homo sapiens
tgtttgtaaataagag

SEQ ID NO: 371552 - DNA, 19 bp, Homo sapiens
tgtttgtaaataagagatt

SEQ ID NO: 371553 - DNA, 21 bp, Homo sapiens
tgtttgtaaataagagatttg

SEQ ID NO: 371554 - DNA, 13 bp, Homo sapiens
tgtttgtaaatta

SEQ ID NO: 371555 - DNA, 17 bp, Homo sapiens
tgtttgtctgtcttcat

SEQ ID NO: 371556 - DNA, 19 bp, Homo sapiens
tgtttgtctgtcttcatag

SEQ ID NO: 371557 - DNA, 19 bp, Homo sapiens
tgtttgtctgtgtgctgta

SEQ ID NO: 371558 - DNA, 15 bp, Homo sapiens
tgtttgtggcctcag

SEQ ID NO: 371559 - DNA, 19 bp, Homo sapiens
tgtttgtgtccataagaga

SEQ ID NO: 371560 - DNA, 19 bp, Homo sapiens
tgttttaaaagtttgtcct

SEQ ID NO: 371561 - DNA, 23 bp, Homo sapiens
tgttttaaaataaaaattctgaa

SEQ ID NO: 371562 - DNA, 19 bp, Homo sapiens
tgttttaaaataagttaaa

SEQ ID NO: 371563 - DNA, 23 bp, Homo sapiens
tgttttaaaataagttaaaggca

SEQ ID NO: 371564 - DNA, 19 bp, Homo sapiens
tgttttaaatatagaattt

SEQ ID NO: 371565 - DNA, 17 bp, Homo sapiens
tgttttaaggaagaaaa

SEQ ID NO: 371566 - DNA, 13 bp, Homo sapiens
tgttttactcttt

SEQ ID NO: 371567 - DNA, 12 bp, Homo sapiens
tgttttatgtca

SEQ ID NO: 371568 - DNA, 20 bp, Homo sapiens
tgttttatgtcatactctgt

SEQ ID NO: 371569 - DNA, 22 bp, Homo sapiens
tgttttattcacttgtgtttgt

SEQ ID NO: 371570 - DNA, 21 bp, Homo sapiens
tgttttattgagttctgaagg

SEQ ID NO: 371571 - DNA, 12 bp, Homo sapiens
tgttttcaaaat

SEQ ID NO: 371572 - DNA, 21 bp, Homo sapiens
tgttttcaacctagaaacctt

SEQ ID NO: 371573 - DNA, 20 bp, Homo sapiens
tgttttcatgtaaataaata

SEQ ID NO: 371574 - DNA, 18 bp, Homo sapiens
tgttttcatttacaggaa

SEQ ID NO: 371575 - DNA, 20 bp, Homo sapiens
tgttttctcagaacagctga

SEQ ID NO: 371576 - DNA, 22 bp, Homo sapiens
tgttttgaatggtgttgtatgc

SEQ ID NO: 371577 - DNA, 12 bp, Homo sapiens
tgttttgagaaa

SEQ ID NO: 371578 - DNA, 12 bp, Homo sapiens
ttaatctctaaa

SEQ ID NO: 371579 - DNA, 18 bp, Homo sapiens
ttaatctctaaaattcta

SEQ ID NO: 371580 - DNA, 19 bp, Homo sapiens
ttaatctctaaaattctag

SEQ ID NO: 371581 - DNA, 22 bp, Homo sapiens
ttaatctggtttatttttgttc

SEQ ID NO: 371582 - DNA, 17 bp, Homo sapiens
ttaatcttcagttttat

SEQ ID NO: 371583 - DNA, 13 bp, Homo sapiens
ttaatctttattt

SEQ ID NO: 371584 - DNA, 14 bp, Homo sapiens
ttaatctttcctga

SEQ ID NO: 371585 - DNA, 21 bp, Homo sapiens
ttaatctttctttacctgaga

SEQ ID NO: 371586 - DNA, 23 bp, Homo sapiens
ttaatctttctttacctgagacc

SEQ ID NO: 371587 - DNA, 24 bp, Homo sapiens
ttaatctttctttacctgagacca

SEQ ID NO: 371588 - DNA, 13 bp, Homo sapiens
ttaatgaactgtg

SEQ ID NO: 371589 - DNA, 15 bp, Homo sapiens
ttaatgaactgtgac

SEQ ID NO: 371590 - DNA, 17 bp, Homo sapiens
ttaatgaactgtgacag

SEQ ID NO: 371591 - DNA, 22 bp, Homo sapiens
ttaatgaactgtgacaggaagc

SEQ ID NO: 371592 - DNA, 20 bp, Homo sapiens
ttaatgatactgtctaagaa

SEQ ID NO: 371593 - DNA, 18 bp, Homo sapiens
ttaatgatttttgtgtat

SEQ ID NO: 371594 - DNA, 20 bp, Homo sapiens
ttaatggacttatttcttca

SEQ ID NO: 371595 - DNA, 21 bp, Homo sapiens
ttaatgtagacattatctttt

SEQ ID NO: 371596 - DNA, 19 bp, Homo sapiens
ttaatgtgagacagcaagt

SEQ ID NO: 371597 - DNA, 14 bp, Homo sapiens
ttaatgtttcttaa

SEQ ID NO: 371598 - DNA, 18 bp, Homo sapiens
ttaatgtttttaaatata

SEQ ID NO: 371599 - DNA, 22 bp, Homo sapiens
ttaattaaaacacaacatcttt

SEQ ID NO: 371600 - DNA, 13 bp, Homo sapiens
ttaattatgtgca

SEQ ID NO: 371601 - DNA, 17 bp, Homo sapiens
ttaattattaactacat

SEQ ID NO: 371602 - DNA, 18 bp, Homo sapiens
ttaattattaactacatt

SEQ ID NO: 371603 - DNA, 17 bp, Homo sapiens
ttaattattattcttca

SEQ ID NO: 371604 - DNA, 14 bp, Homo sapiens
ttaattattattta

SEQ ID NO: 371605 - DNA, 22 bp, Homo sapiens
ttaattcagcactgatttcaca

SEQ ID NO: 371606 - DNA, 13 bp, Homo sapiens
ttaattcattaaa

SEQ ID NO: 371607 - DNA, 17 bp, Homo sapiens
ttaattccaattatatg

SEQ ID NO: 371608 - DNA, 12 bp, Homo sapiens
ttaattcctggg

SEQ ID NO: 371609 - DNA, 16 bp, Homo sapiens
ttaattcctttctcat

SEQ ID NO: 371610 - DNA, 17 bp, Homo sapiens
ttaattctctttcaaag

SEQ ID NO: 371611 - DNA, 14 bp, Homo sapiens
ttaattcttacctc

SEQ ID NO: 371612 - DNA, 15 bp, Homo sapiens
ttaattcttacctca

SEQ ID NO: 371613 - DNA, 13 bp, Homo sapiens
ttaattcttctct

SEQ ID NO: 371614 - DNA, 17 bp, Homo sapiens
ttaattgattaaactgt

SEQ ID NO: 371615 - DNA, 19 bp, Homo sapiens
ttaattgttttgcactttt

SEQ ID NO: 371616 - DNA, 15 bp, Homo sapiens
ttaatttatgagttt

SEQ ID NO: 371617 - DNA, 14 bp, Homo sapiens
ttaatttcagtaag

SEQ ID NO: 371618 - DNA, 17 bp, Homo sapiens
ttaatttcataaattgg

SEQ ID NO: 371619 - DNA, 17 bp, Homo sapiens
ttaatttttaaaagact

SEQ ID NO: 371620 - DNA, 13 bp, Homo sapiens
ttaatttttccta

SEQ ID NO: 371621 - DNA, 16 bp, Homo sapiens
ttaattttttttaatg

SEQ ID NO: 371622 - DNA, 17 bp, Homo sapiens
ttaattttttttaatgt

SEQ ID NO: 371623 - DNA, 18 bp, Homo sapiens
ttacaaaatgaatgcatt

SEQ ID NO: 371624 - DNA, 13 bp, Homo sapiens
ttacaaactgcaa

SEQ ID NO: 371625 - DNA, 16 bp, Homo sapiens
ttacaaagcagttact

SEQ ID NO: 371626 - DNA, 22 bp, Homo sapiens
ttacaaataaaattggcaccat

SEQ ID NO: 371627 - DNA, 22 bp, Homo sapiens
ttacaaattttcactgctgctc

SEQ ID NO: 371628 - DNA, 13 bp, Homo sapiens
ttacaacaaacac

SEQ ID NO: 371629 - DNA, 19 bp, Homo sapiens
ttacaacataatctagttt

SEQ ID NO: 371630 - DNA, 16 bp, Homo sapiens
ttacaaccaagaacat

SEQ ID NO: 371631 - DNA, 15 bp, Homo sapiens
ttacaactaaataac

SEQ ID NO: 371632 - DNA, 22 bp, Homo sapiens
ttacaaggcaggcctttcctac

SEQ ID NO: 371633 - DNA, 18 bp, Homo sapiens
ttacaagtaatgaatttt

SEQ ID NO: 371634 - DNA, 20 bp, Homo sapiens
ttacaagtaatgaattttat

SEQ ID NO: 371635 - DNA, 17 bp, Homo sapiens
ttacaagtatacttata

SEQ ID NO: 371636 - DNA, 14 bp, Homo sapiens
ttacaatacaatag

SEQ ID NO: 371637 - DNA, 15 bp, Homo sapiens
ttacaatgtgcactg

SEQ ID NO: 371638 - DNA, 19 bp, Homo sapiens
ttacaattccctgctgtcg

SEQ ID NO: 371639 - DNA, 14 bp, Homo sapiens
ttacacccatgcac

SEQ ID NO: 371640 - DNA, 23 bp, Homo sapiens
ttacacgtggaggaatgctcccc

SEQ ID NO: 371641 - DNA, 21 bp, Homo sapiens
ttacactgttattttcagcat

SEQ ID NO: 371642 - DNA, 23 bp, Homo sapiens
ttacacttctcaaatgctactca

SEQ ID NO: 371643 - DNA, 21 bp, Homo sapiens
ttacacttggagcccgtgcag

SEQ ID NO: 371644 - DNA, 16 bp, Homo sapiens
ttacagaaatactata

SEQ ID NO: 371645 - DNA, 17 bp, Homo sapiens
ttacagaaatactataa

SEQ ID NO: 371646 - DNA, 17 bp, Homo sapiens
ttacagagaggagaaac

SEQ ID NO: 371647 - DNA, 18 bp, Homo sapiens
ttacagagaggagaaaca

SEQ ID NO: 371648 - DNA, 16 bp, Homo sapiens
ttacagattgcctcct

SEQ ID NO: 371649 - DNA, 14 bp, Homo sapiens
ttacaggaagtact

SEQ ID NO: 371650 - DNA, 22 bp, Homo sapiens
ttacagtaaataaattgtttga

SEQ ID NO: 371651 - DNA, 17 bp, Homo sapiens
ttacagtccttcaaaat

SEQ ID NO: 371652 - DNA, 16 bp, Homo sapiens
ttacagtgcagacagg

SEQ ID NO: 371653 - DNA, 18 bp, Homo sapiens
ttacagtgcagacaggcc

SEQ ID NO: 371654 - DNA, 13 bp, Homo sapiens
ttacagtgtatct

SEQ ID NO: 371655 - DNA, 15 bp, Homo sapiens
ttacagttacttcct

SEQ ID NO: 371656 - DNA, 20 bp, Homo sapiens
ttacagttacttccttcctg

SEQ ID NO: 371657 - DNA, 22 bp, Homo sapiens
ttacataacaggcattgcacta

SEQ ID NO: 371658 - DNA, 22 bp, Homo sapiens
ttacatagttttaaactcattt

SEQ ID NO: 371659 - DNA, 19 bp, Homo sapiens
ttacatgagttcaaatact

SEQ ID NO: 371660 - DNA, 23 bp, Homo sapiens
ttacatgcaatttattaaaatga

SEQ ID NO: 371661 - DNA, 16 bp, Homo sapiens
ttacattaatgttaat

SEQ ID NO: 371662 - DNA, 19 bp, Homo sapiens
ttacattattatcaacaat

SEQ ID NO: 371663 - DNA, 18 bp, Homo sapiens
ttacattccttgataatg

SEQ ID NO: 371664 - DNA, 21 bp, Homo sapiens
ttacattccttgataatgttg

SEQ ID NO: 371665 - DNA, 18 bp, Homo sapiens
ttacatttttacaataaa

SEQ ID NO: 371666 - DNA, 21 bp, Homo sapiens
ttaccaatttaactagtcctg

SEQ ID NO: 371667 - DNA, 20 bp, Homo sapiens
ttaccagatgctactggact

SEQ ID NO: 371668 - DNA, 19 bp, Homo sapiens
ttaccagatgctgactggc

SEQ ID NO: 371669 - DNA, 22 bp, Homo sapiens
ttaccagcaagaataaaaaaga

SEQ ID NO: 371670 - DNA, 20 bp, Homo sapiens
ttaccatttgtaataaagta

SEQ ID NO: 371671 - DNA, 23 bp, Homo sapiens
ttaccatttgtaataaagtatat

SEQ ID NO: 371672 - DNA, 22 bp, Homo sapiens
ttaccattttgcgatgtgtttt

SEQ ID NO: 371673 - DNA, 24 bp, Homo sapiens
ttacccaaaaactaaatctctaat

SEQ ID NO: 371674 - DNA, 22 bp, Homo sapiens
ttaccccgtccctttccctgca

SEQ ID NO: 371675 - DNA, 16 bp, Homo sapiens
ttaccccttagcctcc

SEQ ID NO: 371676 - DNA, 15 bp, Homo sapiens
ttaccctccctgtcc

SEQ ID NO: 371677 - DNA, 17 bp, Homo sapiens
ttaccctccctgtcccc

SEQ ID NO: 371678 - DNA, 13 bp, Homo sapiens
ttaccctctcttt

SEQ ID NO: 371679 - DNA, 15 bp, Homo sapiens
ttaccctctctttca

SEQ ID NO: 371680 - DNA, 16 bp, Homo sapiens
ttaccctttcttttga

SEQ ID NO: 371681 - DNA, 16 bp, Homo sapiens
ttaccgttcacttccc

SEQ ID NO: 371682 - DNA, 21 bp, Homo sapiens
ttacctaagagccacaataag

SEQ ID NO: 371683 - DNA, 21 bp, Homo sapiens
ttacctaagtgacatttgtag

SEQ ID NO: 371684 - DNA, 13 bp, Homo sapiens
ttacctaattaga

SEQ ID NO: 371685 - DNA, 17 bp, Homo sapiens
ttacctcactggtgcat

SEQ ID NO: 371686 - DNA, 18 bp, Homo sapiens
ttacctgggcattcttgt

SEQ ID NO: 371687 - DNA, 20 bp, Homo sapiens
ttacctgtaatagcctcacc

SEQ ID NO: 371688 - DNA, 22 bp, Homo sapiens
ttacctgtaatagcctcacctt

SEQ ID NO: 371689 - DNA, 19 bp, Homo sapiens
ttacctgtcatctgggcca

SEQ ID NO: 371690 - DNA, 18 bp, Homo sapiens
ttacctttattaatgaac

SEQ ID NO: 371691 - DNA, 13 bp, Homo sapiens
ttacgctctctgt

SEQ ID NO: 371692 - DNA, 13 bp, Homo sapiens
ttacggtacttgg

SEQ ID NO: 371693 - DNA, 15 bp, Homo sapiens
ttacggtgatattgt

SEQ ID NO: 371694 - DNA, 21 bp, Homo sapiens
ttacgtagtgtagatttgttt

SEQ ID NO: 371695 - DNA, 22 bp, Homo sapiens
ttactaaagcagtgttttcacc

SEQ ID NO: 371696 - DNA, 19 bp, Homo sapiens
ttactaagatgaaattgcc

SEQ ID NO: 371697 - DNA, 22 bp, Homo sapiens
ttactaagcactgtgtttatat

SEQ ID NO: 371698 - DNA, 20 bp, Homo sapiens
ttactaagccacaagaaatt

SEQ ID NO: 371699 - DNA, 14 bp, Homo sapiens
ttactacaaaattt

SEQ ID NO: 371700 - DNA, 20 bp, Homo sapiens
ttactacaaaatttgaaatt

SEQ ID NO: 371701 - DNA, 16 bp, Homo sapiens
ttactactattctgtt

SEQ ID NO: 371702 - DNA, 18 bp, Homo sapiens
ttactactgcaagttcaa

SEQ ID NO: 371703 - DNA, 15 bp, Homo sapiens
ttactactttaaatc

SEQ ID NO: 371704 - DNA, 16 bp, Homo sapiens
ttactattaactctgc

SEQ ID NO: 371705 - DNA, 13 bp, Homo sapiens
ttactattcccac

SEQ ID NO: 371706 - DNA, 17 bp, Homo sapiens
ttactcggcgtgctcct

SEQ ID NO: 371707 - DNA, 14 bp, Homo sapiens
ttagtgggaagagc

SEQ ID NO: 371708 - DNA, 21 bp, Homo sapiens
ttagtgggaagagctgggttt

SEQ ID NO: 371709 - DNA, 13 bp, Homo sapiens
ttagtgtattttc

SEQ ID NO: 371710 - DNA, 23 bp, Homo sapiens
ttagtgtcacttacctagattta

SEQ ID NO: 371711 - DNA, 11 bp, Homo sapiens
ttagtgtctgt

SEQ ID NO: 371712 - DNA, 23 bp, Homo sapiens
ttagtgtttagcattaaaaataa

SEQ ID NO: 371713 - DNA, 16 bp, Homo sapiens
ttagttcacctaccct

SEQ ID NO: 371714 - DNA, 13 bp, Homo sapiens
ttagttccctgtc

SEQ ID NO: 371715 - DNA, 15 bp, Homo sapiens
ttagttctttgttat

SEQ ID NO: 371716 - DNA, 12 bp, Homo sapiens
ttagttggaatg

SEQ ID NO: 371717 - DNA, 19 bp, Homo sapiens
ttagtttaggtgtttggga

SEQ ID NO: 371718 - DNA, 15 bp, Homo sapiens
ttagtttcaaaatgt

SEQ ID NO: 371719 - DNA, 15 bp, Homo sapiens
ttagttttagttgca

SEQ ID NO: 371720 - DNA, 22 bp, Homo sapiens
ttataaaaccatcaaaaatatt

SEQ ID NO: 371721 - DNA, 16 bp, Homo sapiens
ttataaaatctttcca

SEQ ID NO: 371722 - DNA, 21 bp, Homo sapiens
ttataaactctaagtgtaaaa

SEQ ID NO: 371723 - DNA, 20 bp, Homo sapiens
ttataaagatttttgttaag

SEQ ID NO: 371724 - DNA, 11 bp, Homo sapiens
ttataaataaa

SEQ ID NO: 371725 - DNA, 14 bp, Homo sapiens
ttataaatgtgtgg

SEQ ID NO: 371726 - DNA, 11 bp, Homo sapiens
ttataaattaa

SEQ ID NO: 371727 - DNA, 12 bp, Homo sapiens
ttataaattaaa

SEQ ID NO: 371728 - DNA, 15 bp, Homo sapiens
ttataaccccagcct

SEQ ID NO: 371729 - DNA, 16 bp, Homo sapiens
ttataactcatcataa

SEQ ID NO: 371730 - DNA, 12 bp, Homo sapiens
ttataactcatg

SEQ ID NO: 371731 - DNA, 16 bp, Homo sapiens
ttataactctgcacta

SEQ ID NO: 371732 - DNA, 20 bp, Homo sapiens
ttataagcaacatgaattaa

SEQ ID NO: 371733 - DNA, 15 bp, Homo sapiens
ttataagcattgaaa

SEQ ID NO: 371734 - DNA, 18 bp, Homo sapiens
ttataagcattgaaatta

SEQ ID NO: 371735 - DNA, 13 bp, Homo sapiens
ttataaggactgc

SEQ ID NO: 371736 - DNA, 14 bp, Homo sapiens
ttataagttgacct

SEQ ID NO: 371737 - DNA, 17 bp, Homo sapiens
ttataagttgaccttta

SEQ ID NO: 371738 - DNA, 19 bp, Homo sapiens
ttataataatgttctctgg

SEQ ID NO: 371739 - DNA, 13 bp, Homo sapiens
ttataatatacta

SEQ ID NO: 371740 - DNA, 21 bp, Homo sapiens
ttatacaagaagggagattca

SEQ ID NO: 371741 - DNA, 15 bp, Homo sapiens
ttatacaatatcatc

SEQ ID NO: 371742 - DNA, 19 bp, Homo sapiens
ttatacagttttaaagaat

SEQ ID NO: 371743 - DNA, 21 bp, Homo sapiens
ttatacagttttaaagaatca

SEQ ID NO: 371744 - DNA, 19 bp, Homo sapiens
ttataccaggttacctcac

SEQ ID NO: 371745 - DNA, 16 bp, Homo sapiens
ttataccccatttgat

SEQ ID NO: 371746 - DNA, 16 bp, Homo sapiens
ttatactgcactttag

SEQ ID NO: 371747 - DNA, 17 bp, Homo sapiens
ttatacttaaacagctt

SEQ ID NO: 371748 - DNA, 22 bp, Homo sapiens
ttatagaacatattttccttta

SEQ ID NO: 371749 - DNA, 23 bp, Homo sapiens
ttatagagtgtacttaactattc

SEQ ID NO: 371750 - DNA, 20 bp, Homo sapiens
ttatagtggtgttttaaaga

SEQ ID NO: 371751 - DNA, 17 bp, Homo sapiens
ttatagttgatatgtaa

SEQ ID NO: 371752 - DNA, 22 bp, Homo sapiens
ttatataaaaaaattgtaaatg

SEQ ID NO: 371753 - DNA, 19 bp, Homo sapiens
ttatatacctggcttttac

SEQ ID NO: 371754 - DNA, 14 bp, Homo sapiens
ttatatagcttgaa

SEQ ID NO: 371755 - DNA, 14 bp, Homo sapiens
ttatatataaaata

SEQ ID NO: 371756 - DNA, 16 bp, Homo sapiens
ttatatataaaataaa

SEQ ID NO: 371757 - DNA, 18 bp, Homo sapiens
ttatatataaaataaata

SEQ ID NO: 371758 - DNA, 12 bp, Homo sapiens
ttatatatgaag

SEQ ID NO: 371759 - DNA, 17 bp, Homo sapiens
ttatatatgtatttata

SEQ ID NO: 371760 - DNA, 13 bp, Homo sapiens
ttatatattataa

SEQ ID NO: 371761 - DNA, 15 bp, Homo sapiens
ttatatattataagt

SEQ ID NO: 371762 - DNA, 16 bp, Homo sapiens
ttatatattataagtt

SEQ ID NO: 371763 - DNA, 23 bp, Homo sapiens
ttatatattataagttgaccttt

SEQ ID NO: 371764 - DNA, 14 bp, Homo sapiens
ttatatatttataa

SEQ ID NO: 371765 - DNA, 15 bp, Homo sapiens
ttatatatttataac

SEQ ID NO: 371766 - DNA, 20 bp, Homo sapiens
ttatatatttataactcatc

SEQ ID NO: 371767 - DNA, 23 bp, Homo sapiens
ttatatatttataactcatcata

SEQ ID NO: 371768 - DNA, 17 bp, Homo sapiens
ttatatcagactgcttt

SEQ ID NO: 371769 - DNA, 15 bp, Homo sapiens
ttatatcagcctgag

SEQ ID NO: 371770 - DNA, 18 bp, Homo sapiens
ttatatcgaaatacagtt

SEQ ID NO: 371771 - DNA, 14 bp, Homo sapiens
ttatatctgtaaat

SEQ ID NO: 371772 - DNA, 15 bp, Homo sapiens
ttatatgatatgcat

SEQ ID NO: 371773 - DNA, 15 bp, Homo sapiens
ttatattaaaatatg

SEQ ID NO: 371774 - DNA, 19 bp, Homo sapiens
ttatattacttttgtaaat

SEQ ID NO: 371775 - DNA, 18 bp, Homo sapiens
ttatattagagtgccctt

SEQ ID NO: 371776 - DNA, 12 bp, Homo sapiens
ttatattcatca

SEQ ID NO: 371777 - DNA, 15 bp, Homo sapiens
ttatattgagacaaa

SEQ ID NO: 371778 - DNA, 20 bp, Homo sapiens
ttatattgtttttatatatt

SEQ ID NO: 371779 - DNA, 16 bp, Homo sapiens
ttatatttaattatta

SEQ ID NO: 371780 - DNA, 17 bp, Homo sapiens
ttatatttagttatagt

SEQ ID NO: 371781 - DNA, 20 bp, Homo sapiens
ttatatttccctaaaataca

SEQ ID NO: 371782 - DNA, 23 bp, Homo sapiens
ttatatttgacattcttcactgt

SEQ ID NO: 371783 - DNA, 21 bp, Homo sapiens
ttatcaaaaaaagactcagcc

SEQ ID NO: 371784 - DNA, 16 bp, Homo sapiens
ttatcaaaactttctt

SEQ ID NO: 371785 - DNA, 21 bp, Homo sapiens
ttatcaaatcattcaaaactt

SEQ ID NO: 371786 - DNA, 13 bp, Homo sapiens
ttatcaagctaat

SEQ ID NO: 371787 - DNA, 11 bp, Homo sapiens
ttatcaagtgt

SEQ ID NO: 371788 - DNA, 15 bp, Homo sapiens
ttatcaagtgtcttc

SEQ ID NO: 371789 - DNA, 20 bp, Homo sapiens
ttatcagtacaattctttgt

SEQ ID NO: 371790 - DNA, 21 bp, Homo sapiens
ttatcagtcataactaaataa

SEQ ID NO: 371791 - DNA, 16 bp, Homo sapiens
ttatcagtgacagagt

SEQ ID NO: 371792 - DNA, 19 bp, Homo sapiens
ttatcagtgcttaatgtga

SEQ ID NO: 371793 - DNA, 15 bp, Homo sapiens
ttatcagttggacag

SEQ ID NO: 371794 - DNA, 13 bp, Homo sapiens
ttatcagtttcca

SEQ ID NO: 371795 - DNA, 14 bp, Homo sapiens
ttatcattaaacat

SEQ ID NO: 371796 - DNA, 12 bp, Homo sapiens
ttatcattttca

SEQ ID NO: 371797 - DNA, 18 bp, Homo sapiens
ttatccctgcttatctga

SEQ ID NO: 371798 - DNA, 15 bp, Homo sapiens
ttatcctgtgctaca

SEQ ID NO: 371799 - DNA, 15 bp, Homo sapiens
ttatccttttatctc

SEQ ID NO: 371800 - DNA, 23 bp, Homo sapiens
ttatcgagcatgttgttttttca

SEQ ID NO: 371801 - DNA, 21 bp, Homo sapiens
ttatcgccttttgacagctgt

SEQ ID NO: 371802 - DNA, 16 bp, Homo sapiens
ttatcgggaacagtgt

SEQ ID NO: 371803 - DNA, 17 bp, Homo sapiens
ttatcgggaacagtgtt

SEQ ID NO: 371804 - DNA, 19 bp, Homo sapiens
ttatcgggagcagtgtctt

SEQ ID NO: 371805 - DNA, 20 bp, Homo sapiens
ttatctacccagtcatgtac

SEQ ID NO: 371806 - DNA, 14 bp, Homo sapiens
ttatctagcaagaa

SEQ ID NO: 371807 - DNA, 17 bp, Homo sapiens
ttatctagcaagaagat

SEQ ID NO: 371808 - DNA, 22 bp, Homo sapiens
ttatctagtaggtctgcacaca

SEQ ID NO: 371809 - DNA, 13 bp, Homo sapiens
ttatctcttcttc

SEQ ID NO: 371810 - DNA, 13 bp, Homo sapiens
ttatctgaaactt

SEQ ID NO: 371811 - DNA, 15 bp, Homo sapiens
ttatctgaaacttcc

SEQ ID NO: 371812 - DNA, 16 bp, Homo sapiens
ttatctgcctggcctg

SEQ ID NO: 371813 - DNA, 19 bp, Homo sapiens
ttatctgcctggcctggct

SEQ ID NO: 371814 - DNA, 21 bp, Homo sapiens
ttatctgcctggcctggctcc

SEQ ID NO: 371815 - DNA, 11 bp, Homo sapiens
ttatctgtctg

SEQ ID NO: 371816 - DNA, 20 bp, Homo sapiens
ttatctgtctgagccctgcc

SEQ ID NO: 371817 - DNA, 16 bp, Homo sapiens
ttatctgtctttatga

SEQ ID NO: 371818 - DNA, 12 bp, Homo sapiens
ttatctgtgaat

SEQ ID NO: 371819 - DNA, 20 bp, Homo sapiens
ttatcttacgctatttctgt

SEQ ID NO: 371820 - DNA, 14 bp, Homo sapiens
ttatcttatctagc

SEQ ID NO: 371821 - DNA, 15 bp, Homo sapiens
ttatcttctgttttt

SEQ ID NO: 371822 - DNA, 16 bp, Homo sapiens
ttatcttctgtttttc

SEQ ID NO: 371823 - DNA, 23 bp, Homo sapiens
ttatcttctgtttttctcaaata

SEQ ID NO: 371824 - DNA, 16 bp, Homo sapiens
ttatcttggactgaca

SEQ ID NO: 371825 - DNA, 12 bp, Homo sapiens
ttatctttaaaa

SEQ ID NO: 371826 - DNA, 12 bp, Homo sapiens
ttatcttttgag

SEQ ID NO: 371827 - DNA, 23 bp, Homo sapiens
ttatgaactgcatgtataaatga

SEQ ID NO: 371828 - DNA, 20 bp, Homo sapiens
ttatgaagaaagatactaat

SEQ ID NO: 371829 - DNA, 22 bp, Homo sapiens
ttatgaagttaacagtctcatt

SEQ ID NO: 371830 - DNA, 14 bp, Homo sapiens
ttatgacagttata

SEQ ID NO: 371831 - DNA, 17 bp, Homo sapiens
ttatgagaaaaaaacag

SEQ ID NO: 371832 - DNA, 13 bp, Homo sapiens
ttatgagaacatg

SEQ ID NO: 371833 - DNA, 14 bp, Homo sapiens
ttatgagaacatgg

SEQ ID NO: 371834 - DNA, 22 bp, Homo sapiens
ttatgagaacatggtgtgtgtc

SEQ ID NO: 371835 - DNA, 20 bp, Homo sapiens
ttatgagtaactattattat

SEQ ID NO: 371836 - DNA, 15 bp, Homo sapiens
ttatgagtttttgat

SEQ ID NO: 371837 - DNA, 22 bp, Homo sapiens
ttatgataaaggcttaggactt

SEQ ID NO: 371838 - DNA, 22 bp, Homo sapiens
ttcatgagattggtcattaaat

SEQ ID NO: 371839 - DNA, 23 bp, Homo sapiens
ttcatgatttcatttcaactgtt

SEQ ID NO: 371840 - DNA, 21 bp, Homo sapiens
ttcatgcctttgtaagttatt

SEQ ID NO: 371841 - DNA, 15 bp, Homo sapiens
ttcatgcttttctca

SEQ ID NO: 371842 - DNA, 22 bp, Homo sapiens
ttcatgtcaacttctggctcct

SEQ ID NO: 371843 - DNA, 20 bp, Homo sapiens
ttcatgtccagagctcattt

SEQ ID NO: 371844 - DNA, 14 bp, Homo sapiens
ttcatgtgatctat

SEQ ID NO: 371845 - DNA, 17 bp, Homo sapiens
ttcatgtgttgcaaatt

SEQ ID NO: 371846 - DNA, 22 bp, Homo sapiens
ttcatgttctgagctataacat

SEQ ID NO: 371847 - DNA, 17 bp, Homo sapiens
ttcatgttttgtgacta

SEQ ID NO: 371848 - DNA, 15 bp, Homo sapiens
ttcattaaaagtttt

SEQ ID NO: 371849 - DNA, 10 bp, Homo sapiens
ttcattaaag

SEQ ID NO: 371850 - DNA, 14 bp, Homo sapiens
ttcattaaagaaaa

SEQ ID NO: 371851 - DNA, 14 bp, Homo sapiens
ttcattaaatgttt

SEQ ID NO: 371852 - DNA, 14 bp, Homo sapiens
ttcattaataggaa

SEQ ID NO: 371853 - DNA, 23 bp, Homo sapiens
ttcattaattaccctactttcat

SEQ ID NO: 371854 - DNA, 21 bp, Homo sapiens
ttcattacttgattaagattt

SEQ ID NO: 371855 - DNA, 17 bp, Homo sapiens
ttcattattggaattaa

SEQ ID NO: 371856 - DNA, 20 bp, Homo sapiens
ttcattccgaaaaaaaaatg

SEQ ID NO: 371857 - DNA, 22 bp, Homo sapiens
ttcattccgttaggaataacac

SEQ ID NO: 371858 - DNA, 16 bp, Homo sapiens
ttcattgcccactagg

SEQ ID NO: 371859 - DNA, 18 bp, Homo sapiens
ttcattgtaatgttactg

SEQ ID NO: 371860 - DNA, 20 bp, Homo sapiens
ttcattgtaatgttactgat

SEQ ID NO: 371861 - DNA, 19 bp, Homo sapiens
ttcatttccaactcaggtt

SEQ ID NO: 371862 - DNA, 22 bp, Homo sapiens
ttcatttcctctgagctgttat

SEQ ID NO: 371863 - DNA, 15 bp, Homo sapiens
ttcatttggtgctgg

SEQ ID NO: 371864 - DNA, 12 bp, Homo sapiens
ttcattttctct

SEQ ID NO: 371865 - DNA, 17 bp, Homo sapiens
ttcattttctctcctcg

SEQ ID NO: 371866 - DNA, 23 bp, Homo sapiens
ttcattttggcaagaagactgta

SEQ ID NO: 371867 - DNA, 12 bp, Homo sapiens
ttccaaaaatac

SEQ ID NO: 371868 - DNA, 13 bp, Homo sapiens
ttccaaaattctt

SEQ ID NO: 371869 - DNA, 15 bp, Homo sapiens
ttccaaagaattctt

SEQ ID NO: 371870 - DNA, 19 bp, Homo sapiens
ttccaaagagaaggcctgg

SEQ ID NO: 371871 - DNA, 20 bp, Homo sapiens
ttccaaagcattttcagcat

SEQ ID NO: 371872 - DNA, 11 bp, Homo sapiens
ttccaaataaa

SEQ ID NO: 371873 - DNA, 13 bp, Homo sapiens
ttccaaataaaac

SEQ ID NO: 371874 - DNA, 15 bp, Homo sapiens
ttccaaattctgctt

SEQ ID NO: 371875 - DNA, 18 bp, Homo sapiens
ttccaacaccacagacac

SEQ ID NO: 371876 - DNA, 21 bp, Homo sapiens
ttccaacaccacagacacaca

SEQ ID NO: 371877 - DNA, 23 bp, Homo sapiens
ttccaacaccacagacacacaca

SEQ ID NO: 371878 - DNA, 13 bp, Homo sapiens
ttccaactgctgc

SEQ ID NO: 371879 - DNA, 16 bp, Homo sapiens
ttccaactgctgcccc

SEQ ID NO: 371880 - DNA, 13 bp, Homo sapiens
ttccaagcccttt

SEQ ID NO: 371881 - DNA, 17 bp, Homo sapiens
ttccaagcccttttaca

SEQ ID NO: 371882 - DNA, 15 bp, Homo sapiens
ttccaagcctgggcc

SEQ ID NO: 371883 - DNA, 12 bp, Homo sapiens
ttccaagggccc

SEQ ID NO: 371884 - DNA, 13 bp, Homo sapiens
ttccaagggccca

SEQ ID NO: 371885 - DNA, 18 bp, Homo sapiens
ttccaagggcccagaggg

SEQ ID NO: 371886 - DNA, 15 bp, Homo sapiens
ttccaagtagctggg

SEQ ID NO: 371887 - DNA, 12 bp, Homo sapiens
ttccaagtgtgt

SEQ ID NO: 371888 - DNA, 21 bp, Homo sapiens
ttccaataaaccaggtttaga

SEQ ID NO: 371889 - DNA, 16 bp, Homo sapiens
ttccaatatgatgact

SEQ ID NO: 371890 - DNA, 23 bp, Homo sapiens
ttccaatgtggtggcaataaatg

SEQ ID NO: 371891 - DNA, 13 bp, Homo sapiens
ttccacacaggcc

SEQ ID NO: 371892 - DNA, 16 bp, Homo sapiens
ttccacagcagcagaa

SEQ ID NO: 371893 - DNA, 22 bp, Homo sapiens
ttccacagcagcagaacaagtg

SEQ ID NO: 371894 - DNA, 13 bp, Homo sapiens
ttccacatttgtc

SEQ ID NO: 371895 - DNA, 20 bp, Homo sapiens
ttccaccccctccctggcct

SEQ ID NO: 371896 - DNA, 18 bp, Homo sapiens
ttccacccctccttccct

SEQ ID NO: 371897 - DNA, 20 bp, Homo sapiens
ttccacccctccttccctgg

SEQ ID NO: 371898 - DNA, 20 bp, Homo sapiens
ttccaccctgtctaggcaca

SEQ ID NO: 371899 - DNA, 23 bp, Homo sapiens
ttccaccgctggagctcctacat

SEQ ID NO: 371900 - DNA, 15 bp, Homo sapiens
ttccacctcacaact

SEQ ID NO: 371901 - DNA, 14 bp, Homo sapiens
ttccacctccctcc

SEQ ID NO: 371902 - DNA, 13 bp, Homo sapiens
ttccaccttaaat

SEQ ID NO: 371903 - DNA, 14 bp, Homo sapiens
ttccaccttaaatt

SEQ ID NO: 371904 - DNA, 12 bp, Homo sapiens
ttccaccttggc

SEQ ID NO: 371905 - DNA, 19 bp, Homo sapiens
ttccacgctgtctccagac

SEQ ID NO: 371906 - DNA, 23 bp, Homo sapiens
ttccacgggtctcacttatacca

SEQ ID NO: 371907 - DNA, 14 bp, Homo sapiens
ttccactcagcttg

SEQ ID NO: 371908 - DNA, 23 bp, Homo sapiens
ttccactcagcttggttcctgcc

SEQ ID NO: 371909 - DNA, 13 bp, Homo sapiens
ttccactgcctct

SEQ ID NO: 371910 - DNA, 17 bp, Homo sapiens
ttccactgcctctgcct

SEQ ID NO: 371911 - DNA, 22 bp, Homo sapiens
ttccactttgttggcccttcca

SEQ ID NO: 371912 - DNA, 14 bp, Homo sapiens
ttccagaaaggata

SEQ ID NO: 371913 - DNA, 15 bp, Homo sapiens
ttccagaaaggatat

SEQ ID NO: 371914 - DNA, 22 bp, Homo sapiens
ttccagaaaggatatttaagaa

SEQ ID NO: 371915 - DNA, 19 bp, Homo sapiens
ttccagaacagccctcggc

SEQ ID NO: 371916 - DNA, 20 bp, Homo sapiens
ttccagaacagccctcggcc

SEQ ID NO: 371917 - DNA, 10 bp, Homo sapiens
ttccagacag

SEQ ID NO: 371918 - DNA, 21 bp, Homo sapiens
ttccagactcaggttccagaa

SEQ ID NO: 371919 - DNA, 23 bp, Homo sapiens
ttccagacttcgctattcccagg

SEQ ID NO: 371920 - DNA, 18 bp, Homo sapiens
ttccagagagtggctcct

SEQ ID NO: 371921 - DNA, 17 bp, Homo sapiens
ttccagagcctaagaaa

SEQ ID NO: 371922 - DNA, 12 bp, Homo sapiens
ttccagagctgt

SEQ ID NO: 371923 - DNA, 22 bp, Homo sapiens
ttccagatgtctaaaagattct

SEQ ID NO: 371924 - DNA, 12 bp, Homo sapiens
ttccagcaaaat

SEQ ID NO: 371925 - DNA, 14 bp, Homo sapiens
ttccagcaattctc

SEQ ID NO: 371926 - DNA, 19 bp, Homo sapiens
ttccagcagtgaaacttgt

SEQ ID NO: 371927 - DNA, 20 bp, Homo sapiens
ttccagcccagacatcctgt

SEQ ID NO: 371928 - DNA, 23 bp, Homo sapiens
ttccagcccagacccccagtgta

SEQ ID NO: 371929 - DNA, 14 bp, Homo sapiens
ttccagctctgccc

SEQ ID NO: 371930 - DNA, 16 bp, Homo sapiens
ttccagctctgccccc

SEQ ID NO: 371931 - DNA, 19 bp, Homo sapiens
ttccagctgacatcttgca

SEQ ID NO: 371932 - DNA, 12 bp, Homo sapiens
ttccagctgcca

SEQ ID NO: 371933 - DNA, 13 bp, Homo sapiens
ttccagcttttgt

SEQ ID NO: 371934 - DNA, 18 bp, Homo sapiens
ttccaggaagcacaggcc

SEQ ID NO: 371935 - DNA, 11 bp, Homo sapiens
ttccaggcccc

SEQ ID NO: 371936 - DNA, 12 bp, Homo sapiens
ttccaggcccct

SEQ ID NO: 371937 - DNA, 19 bp, Homo sapiens
ttccaggcgtagggccagg

SEQ ID NO: 371938 - DNA, 20 bp, Homo sapiens
ttccaggctcttcctggacc

SEQ ID NO: 371939 - DNA, 20 bp, Homo sapiens
ttccagggactgtacctgta

SEQ ID NO: 371940 - DNA, 22 bp, Homo sapiens
ttccagggtctttactgggaag

SEQ ID NO: 371941 - DNA, 17 bp, Homo sapiens
ttccaggtgtttatagt

SEQ ID NO: 371942 - DNA, 19 bp, Homo sapiens
ttccaggttccatccacca

SEQ ID NO: 371943 - DNA, 21 bp, Homo sapiens
ttccaggttccatccaccacc

SEQ ID NO: 371944 - DNA, 23 bp, Homo sapiens
ttccaggttctggttagctcagc

SEQ ID NO: 371945 - DNA, 19 bp, Homo sapiens
ttccagtattgaaaacttc

SEQ ID NO: 371946 - DNA, 11 bp, Homo sapiens
ttccagtctcc

SEQ ID NO: 371947 - DNA, 17 bp, Homo sapiens
ttccagttttgttttga

SEQ ID NO: 371948 - DNA, 22 bp, Homo sapiens
ttccataatctggactcctctg

SEQ ID NO: 371949 - DNA, 14 bp, Homo sapiens
ttccataattatga

SEQ ID NO: 371950 - DNA, 22 bp, Homo sapiens
ttccataattatgacagttata

SEQ ID NO: 371951 - DNA, 15 bp, Homo sapiens
ttccatacagctcta

SEQ ID NO: 371952 - DNA, 23 bp, Homo sapiens
ttccataggacatactgcatgta

SEQ ID NO: 371953 - DNA, 15 bp, Homo sapiens
ttccatatggatttt

SEQ ID NO: 371954 - DNA, 20 bp, Homo sapiens
ttccatatggattttctatt

SEQ ID NO: 371955 - DNA, 13 bp, Homo sapiens
ttccatcacagcc

SEQ ID NO: 371956 - DNA, 21 bp, Homo sapiens
ttccatcacagccagcccagc

SEQ ID NO: 371957 - DNA, 14 bp, Homo sapiens
ttccatcatttctg

SEQ ID NO: 371958 - DNA, 19 bp, Homo sapiens
ttccatccaccaccttgcc

SEQ ID NO: 371959 - DNA, 23 bp, Homo sapiens
ttccatccataaatccagttcta

SEQ ID NO: 371960 - DNA, 18 bp, Homo sapiens
ttccatccttgactgaag

SEQ ID NO: 371961 - DNA, 16 bp, Homo sapiens
ttccatgaaggcagag

SEQ ID NO: 371962 - DNA, 16 bp, Homo sapiens
ttccatgacagtagca

SEQ ID NO: 371963 - DNA, 18 bp, Homo sapiens
ttccatgactgcatttta

SEQ ID NO: 371964 - DNA, 18 bp, Homo sapiens
ttccatgagaacagcagg

SEQ ID NO: 371965 - DNA, 14 bp, Homo sapiens
ttccatgcctgagg

SEQ ID NO: 371966 - DNA, 16 bp, Homo sapiens
ttccatgcctgagggt

SEQ ID NO: 371967 - DNA, 23 bp, Homo sapiens
ttccatgcctgagggtggagact

SEQ ID NO: 371968 - DNA, 18 bp, Homo sapiens
ttcgtttgtttgttttgt

SEQ ID NO: 371969 - DNA, 15 bp, Homo sapiens
ttctaaaacattctt

SEQ ID NO: 371970 - DNA, 11 bp, Homo sapiens
ttctaaacaga

SEQ ID NO: 371971 - DNA, 18 bp, Homo sapiens
ttctaaatgaatgtttac

SEQ ID NO: 371972 - DNA, 17 bp, Homo sapiens
ttctaagattgtacata

SEQ ID NO: 371973 - DNA, 14 bp, Homo sapiens
ttctaagcttattt

SEQ ID NO: 371974 - DNA, 17 bp, Homo sapiens
ttctaaggatagccttt

SEQ ID NO: 371975 - DNA, 20 bp, Homo sapiens
ttctaaggatagcctttgta

SEQ ID NO: 371976 - DNA, 15 bp, Homo sapiens
ttctaagtggcctgc

SEQ ID NO: 371977 - DNA, 14 bp, Homo sapiens
ttctaagtgtactt

SEQ ID NO: 371978 - DNA, 15 bp, Homo sapiens
ttctaagtgtacttc

SEQ ID NO: 371979 - DNA, 19 bp, Homo sapiens
ttctaagttatttactttt

SEQ ID NO: 371980 - DNA, 18 bp, Homo sapiens
ttctaataaatatactat

SEQ ID NO: 371981 - DNA, 22 bp, Homo sapiens
ttctaataaatatactatgaaa

SEQ ID NO: 371982 - DNA, 14 bp, Homo sapiens
ttctaatagaactc

SEQ ID NO: 371983 - DNA, 13 bp, Homo sapiens
ttctaatcaaaag

SEQ ID NO: 371984 - DNA, 18 bp, Homo sapiens
ttctaatgtagctatttt

SEQ ID NO: 371985 - DNA, 16 bp, Homo sapiens
ttctaatgtcttcatt

SEQ ID NO: 371986 - DNA, 23 bp, Homo sapiens
ttctaatgtgtgaatcagagcac

SEQ ID NO: 371987 - DNA, 16 bp, Homo sapiens
ttctaattagattaac

SEQ ID NO: 371988 - DNA, 14 bp, Homo sapiens
ttctaattgccatg

SEQ ID NO: 371989 - DNA, 15 bp, Homo sapiens
ttctaattgccatgt

SEQ ID NO: 371990 - DNA, 21 bp, Homo sapiens
ttctaatttcaaaaatataac

SEQ ID NO: 371991 - DNA, 16 bp, Homo sapiens
ttctaatttgctgctg

SEQ ID NO: 371992 - DNA, 15 bp, Homo sapiens
ttctaattttgtgct

SEQ ID NO: 371993 - DNA, 17 bp, Homo sapiens
ttctacaatctatttat

SEQ ID NO: 371994 - DNA, 14 bp, Homo sapiens
ttctacacctggac

SEQ ID NO: 371995 - DNA, 16 bp, Homo sapiens
ttctacatgactgggc

SEQ ID NO: 371996 - DNA, 14 bp, Homo sapiens
ttctacatttcacc

SEQ ID NO: 371997 - DNA, 22 bp, Homo sapiens
ttctacatttcacctactttgt

SEQ ID NO: 371998 - DNA, 16 bp, Homo sapiens
ttctacctcttccagg

SEQ ID NO: 371999 - DNA, 18 bp, Homo sapiens
ttctaccttgaggtcttt

SEQ ID NO: 372000 - DNA, 22 bp, Homo sapiens
ttctactcgagttacagacaaa

SEQ ID NO: 372001 - DNA, 17 bp, Homo sapiens
ttctactcttgtcattt

SEQ ID NO: 372002 - DNA, 18 bp, Homo sapiens
ttctactgaagttgggaa

SEQ ID NO: 372003 - DNA, 16 bp, Homo sapiens
ttctacttgatatttc

SEQ ID NO: 372004 - DNA, 18 bp, Homo sapiens
ttctactttaagcactac

SEQ ID NO: 372005 - DNA, 18 bp, Homo sapiens
ttctactttttccttcct

SEQ ID NO: 372006 - DNA, 22 bp, Homo sapiens
ttctactttttccttcctgccc

SEQ ID NO: 372007 - DNA, 23 bp, Homo sapiens
ttctactttttccttcctgccct

SEQ ID NO: 372008 - DNA, 19 bp, Homo sapiens
ttctagacgcccctcccaa

SEQ ID NO: 372009 - DNA, 20 bp, Homo sapiens
ttctagacttccccatcccg

SEQ ID NO: 372010 - DNA, 15 bp, Homo sapiens
ttctagaggcctcag

SEQ ID NO: 372011 - DNA, 20 bp, Homo sapiens
ttctagagtaattatctgtg

SEQ ID NO: 372012 - DNA, 16 bp, Homo sapiens
ttctagatcagagagc

SEQ ID NO: 372013 - DNA, 16 bp, Homo sapiens
ttctagatcctgcacc

SEQ ID NO: 372014 - DNA, 19 bp, Homo sapiens
ttctagctagaaatatgat

SEQ ID NO: 372015 - DNA, 22 bp, Homo sapiens
ttctagctagaaatatgatttt

SEQ ID NO: 372016 - DNA, 18 bp, Homo sapiens
ttctagctataacaactc

SEQ ID NO: 372017 - DNA, 21 bp, Homo sapiens
ttctagctgttgagctgtttt

SEQ ID NO: 372018 - DNA, 18 bp, Homo sapiens
ttctaggggagaagagcc

SEQ ID NO: 372019 - DNA, 15 bp, Homo sapiens
ttctagtcaactgct

SEQ ID NO: 372020 - DNA, 18 bp, Homo sapiens
ttctagtcaactgctgtt

SEQ ID NO: 372021 - DNA, 20 bp, Homo sapiens
ttctagtcaactgctgtttt

SEQ ID NO: 372022 - DNA, 21 bp, Homo sapiens
ttctagtcaactgctgtttta

SEQ ID NO: 372023 - DNA, 21 bp, Homo sapiens
ttctagtctcctttgcactga

SEQ ID NO: 372024 - DNA, 22 bp, Homo sapiens
ttctagtctcctttgcactgag

SEQ ID NO: 372025 - DNA, 13 bp, Homo sapiens
ttctagtctctga

SEQ ID NO: 372026 - DNA, 14 bp, Homo sapiens
ttctagtctctgat

SEQ ID NO: 372027 - DNA, 20 bp, Homo sapiens
ttctataggaacatatgaaa

SEQ ID NO: 372028 - DNA, 18 bp, Homo sapiens
ttctatataaaatgtatt

SEQ ID NO: 372029 - DNA, 22 bp, Homo sapiens
ttctatataaaatgtattcaag

SEQ ID NO: 372030 - DNA, 12 bp, Homo sapiens
ttctatatgaat

SEQ ID NO: 372031 - DNA, 20 bp, Homo sapiens
ttctatatgaatttaaatat

SEQ ID NO: 372032 - DNA, 17 bp, Homo sapiens
ttctatcaggaaaacaa

SEQ ID NO: 372033 - DNA, 20 bp, Homo sapiens
ttctatccccaagctggcca

SEQ ID NO: 372034 - DNA, 23 bp, Homo sapiens
ttctatcctacaacaagagttta

SEQ ID NO: 372035 - DNA, 18 bp, Homo sapiens
ttctatgagcatctctgt

SEQ ID NO: 372036 - DNA, 22 bp, Homo sapiens
ttctatggagcaaaacaaagct

SEQ ID NO: 372037 - DNA, 17 bp, Homo sapiens
ttctatggattcacttc

SEQ ID NO: 372038 - DNA, 22 bp, Homo sapiens
ttctatgtaaattattgtaaac

SEQ ID NO: 372039 - DNA, 24 bp, Homo sapiens
ttctatgtaaattattgtaaactt

SEQ ID NO: 372040 - DNA, 23 bp, Homo sapiens
ttctattaaaagtgggaattagg

SEQ ID NO: 372041 - DNA, 20 bp, Homo sapiens
ttctattacccctcatttaa

SEQ ID NO: 372042 - DNA, 18 bp, Homo sapiens
ttctattccttctggcct

SEQ ID NO: 372043 - DNA, 18 bp, Homo sapiens
ttctattgcagttataga

SEQ ID NO: 372044 - DNA, 14 bp, Homo sapiens
ttctattgttactc

SEQ ID NO: 372045 - DNA, 22 bp, Homo sapiens
ttctattgttactctggttctt

SEQ ID NO: 372046 - DNA, 16 bp, Homo sapiens
ttctatttaagtgtac

SEQ ID NO: 372047 - DNA, 15 bp, Homo sapiens
ttctatttatttact

SEQ ID NO: 372048 - DNA, 13 bp, Homo sapiens
ttctatttctatc

SEQ ID NO: 372049 - DNA, 16 bp, Homo sapiens
ttctatttctatctgc

SEQ ID NO: 372050 - DNA, 16 bp, Homo sapiens
ttctatttgctgggct

SEQ ID NO: 372051 - DNA, 17 bp, Homo sapiens
ttctatttgctgggctt

SEQ ID NO: 372052 - DNA, 16 bp, Homo sapiens
ttctattttactttgt

SEQ ID NO: 372053 - DNA, 16 bp, Homo sapiens
ttctcaaaagcattta

SEQ ID NO: 372054 - DNA, 22 bp, Homo sapiens
ttctcaaaccctgtttacggta

SEQ ID NO: 372055 - DNA, 15 bp, Homo sapiens
ttctcaaagcaggaa

SEQ ID NO: 372056 - DNA, 19 bp, Homo sapiens
ttctcaaatgctactcagt

SEQ ID NO: 372057 - DNA, 21 bp, Homo sapiens
ttctcaacaaagcacagtgtt

SEQ ID NO: 372058 - DNA, 22 bp, Homo sapiens
ttctcaacaaagcacagtgtta

SEQ ID NO: 372059 - DNA, 14 bp, Homo sapiens
ttctcaagcactga

SEQ ID NO: 372060 - DNA, 18 bp, Homo sapiens
ttctcaagcgctatccac

SEQ ID NO: 372061 - DNA, 21 bp, Homo sapiens
ttctcaagcgctatccacaga

SEQ ID NO: 372062 - DNA, 16 bp, Homo sapiens
ttctcactcctacctg

SEQ ID NO: 372063 - DNA, 18 bp, Homo sapiens
ttctcactctgctttgca

SEQ ID NO: 372064 - DNA, 19 bp, Homo sapiens
ttctcagagctccacagaa

SEQ ID NO: 372065 - DNA, 18 bp, Homo sapiens
ttctcagcaagtgtacag

SEQ ID NO: 372066 - DNA, 19 bp, Homo sapiens
ttctcaggaggtgtctcct

SEQ ID NO: 372067 - DNA, 14 bp, Homo sapiens
ttctcatagcatta

SEQ ID NO: 372068 - DNA, 22 bp, Homo sapiens
ttctcataggaaaagtacattt

SEQ ID NO: 372069 - DNA, 15 bp, Homo sapiens
ttctcatcacatttg

SEQ ID NO: 372070 - DNA, 11 bp, Homo sapiens
ttctcatgtgc

SEQ ID NO: 372071 - DNA, 14 bp, Homo sapiens
ttctcatgtttgtg

SEQ ID NO: 372072 - DNA, 15 bp, Homo sapiens
ttctcatgtttgtgc

SEQ ID NO: 372073 - DNA, 18 bp, Homo sapiens
ttctcattccaacagtga

SEQ ID NO: 372074 - DNA, 20 bp, Homo sapiens
ttctcattccaacagtgagt

SEQ ID NO: 372075 - DNA, 22 bp, Homo sapiens
ttctccaaaggcactgaccctc

SEQ ID NO: 372076 - DNA, 23 bp, Homo sapiens
ttctccaaatgattttcatcaat

SEQ ID NO: 372077 - DNA, 19 bp, Homo sapiens
ttctccaacccaaagtatt

SEQ ID NO: 372078 - DNA, 12 bp, Homo sapiens
ttctccacctcc

SEQ ID NO: 372079 - DNA, 14 bp, Homo sapiens
ttctccacctcccc

SEQ ID NO: 372080 - DNA, 22 bp, Homo sapiens
ttctccagaaccagtgtctgaa

SEQ ID NO: 372081 - DNA, 13 bp, Homo sapiens
ttctccagaatgt

SEQ ID NO: 372082 - DNA, 13 bp, Homo sapiens
ttctccagccagc

SEQ ID NO: 372083 - DNA, 13 bp, Homo sapiens
ttctccatcccca

SEQ ID NO: 372084 - DNA, 21 bp, Homo sapiens
ttctccatcccctccctgcct

SEQ ID NO: 372085 - DNA, 13 bp, Homo sapiens
ttctcccacactg

SEQ ID NO: 372086 - DNA, 22 bp, Homo sapiens
ttctccccgcagcccgcctgcc

SEQ ID NO: 372087 - DNA, 15 bp, Homo sapiens
ttctcccctccagac

SEQ ID NO: 372088 - DNA, 19 bp, Homo sapiens
ttctcccctccagacccct

SEQ ID NO: 372089 - DNA, 19 bp, Homo sapiens
ttctcccctgcactgtaaa

SEQ ID NO: 372090 - DNA, 18 bp, Homo sapiens
ttctccctgcacaagcca

SEQ ID NO: 372091 - DNA, 18 bp, Homo sapiens
ttctcccttttgacacag

SEQ ID NO: 372092 - DNA, 19 bp, Homo sapiens
ttctccggggtctgtgctg

SEQ ID NO: 372093 - DNA, 23 bp, Homo sapiens
ttctccggggtctgtgctgtgcc

SEQ ID NO: 372094 - DNA, 15 bp, Homo sapiens
ttctcctccaaatgc

SEQ ID NO: 372095 - DNA, 12 bp, Homo sapiens
ttctcctctccc

SEQ ID NO: 372096 - DNA, 14 bp, Homo sapiens
ttctcctctctggg

SEQ ID NO: 372097 - DNA, 19 bp, Homo sapiens
ttgaactgttagatgctga

SEQ ID NO: 372098 - DNA, 13 bp, Homo sapiens
ttgaagatacaca

SEQ ID NO: 372099 - DNA, 14 bp, Homo sapiens
ttgaagatacacaa

SEQ ID NO: 372100 - DNA, 18 bp, Homo sapiens
ttgaagatacacaagagg

SEQ ID NO: 372101 - DNA, 18 bp, Homo sapiens
ttgaagatgctgaaacag

SEQ ID NO: 372102 - DNA, 16 bp, Homo sapiens
ttgaagatgtagcttc

SEQ ID NO: 372103 - DNA, 19 bp, Homo sapiens
ttgaaggacctaaattcgt

SEQ ID NO: 372104 - DNA, 14 bp, Homo sapiens
ttgaaggcagtctg

SEQ ID NO: 372105 - DNA, 16 bp, Homo sapiens
ttgaaggcagtctgaa

SEQ ID NO: 372106 - DNA, 15 bp, Homo sapiens
ttgaagggcccagga

SEQ ID NO: 372107 - DNA, 19 bp, Homo sapiens
ttgaagtcatcataaaagg

SEQ ID NO: 372108 - DNA, 18 bp, Homo sapiens
ttgaagtcccaatttaag

SEQ ID NO: 372109 - DNA, 13 bp, Homo sapiens
ttgaagtggaaaa

SEQ ID NO: 372110 - DNA, 14 bp, Homo sapiens
ttgaataaaagtgc

SEQ ID NO: 372111 - DNA, 16 bp, Homo sapiens
ttgaataaaagtgcac

SEQ ID NO: 372112 - DNA, 20 bp, Homo sapiens
ttgaataatgttttttgaag

SEQ ID NO: 372113 - DNA, 21 bp, Homo sapiens
ttgaatatattttatcttggt

SEQ ID NO: 372114 - DNA, 23 bp, Homo sapiens
ttgaatctgattggacattttct

SEQ ID NO: 372115 - DNA, 18 bp, Homo sapiens
ttgaatgaaaaatttaag

SEQ ID NO: 372116 - DNA, 23 bp, Homo sapiens
ttgaatgaaaaatttaagcattg

SEQ ID NO: 372117 - DNA, 22 bp, Homo sapiens
ttgaatggttaataaaactgca

SEQ ID NO: 372118 - DNA, 16 bp, Homo sapiens
ttgaatgtacaaagat

SEQ ID NO: 372119 - DNA, 12 bp, Homo sapiens
ttgaatgtcaca

SEQ ID NO: 372120 - DNA, 18 bp, Homo sapiens
ttgaatgtcacaaattga

SEQ ID NO: 372121 - DNA, 19 bp, Homo sapiens
ttgaatgtcacaaattgat

SEQ ID NO: 372122 - DNA, 23 bp, Homo sapiens
ttgaatgtcacaaattgatcaag

SEQ ID NO: 372123 - DNA, 21 bp, Homo sapiens
ttgaatgtgatcatctttgct

SEQ ID NO: 372124 - DNA, 23 bp, Homo sapiens
ttgaatgttatttgttattttca

SEQ ID NO: 372125 - DNA, 21 bp, Homo sapiens
ttgaattaaaaaaaaaaacta

SEQ ID NO: 372126 - DNA, 17 bp, Homo sapiens
ttgaattaaattaggaa

SEQ ID NO: 372127 - DNA, 22 bp, Homo sapiens
ttgaattaaattaggaataaat

SEQ ID NO: 372128 - DNA, 23 bp, Homo sapiens
ttgaattgcattttttaaaacaa

SEQ ID NO: 372129 - DNA, 16 bp, Homo sapiens
ttgaatttaaataaag

SEQ ID NO: 372130 - DNA, 17 bp, Homo sapiens
ttgaatttaaataaagt

SEQ ID NO: 372131 - DNA, 22 bp, Homo sapiens
ttgaattttttttaacattcct

SEQ ID NO: 372132 - DNA, 18 bp, Homo sapiens
ttgacaacattttattac

SEQ ID NO: 372133 - DNA, 16 bp, Homo sapiens
ttgacaaccatgagac

SEQ ID NO: 372134 - DNA, 16 bp, Homo sapiens
ttgacaactgaagaga

SEQ ID NO: 372135 - DNA, 22 bp, Homo sapiens
ttgacaagtcattttaacttta

SEQ ID NO: 372136 - DNA, 11 bp, Homo sapiens
ttgacacagtt

SEQ ID NO: 372137 - DNA, 19 bp, Homo sapiens
ttgacaggattattggaaa

SEQ ID NO: 372138 - DNA, 21 bp, Homo sapiens
ttgacataatgagtaatgcag

SEQ ID NO: 372139 - DNA, 16 bp, Homo sapiens
ttgacatcaactgcat

SEQ ID NO: 372140 - DNA, 11 bp, Homo sapiens
ttgacatgcac

SEQ ID NO: 372141 - DNA, 19 bp, Homo sapiens
ttgacatgtgcaattgtga

SEQ ID NO: 372142 - DNA, 13 bp, Homo sapiens
ttgacattcttca

SEQ ID NO: 372143 - DNA, 17 bp, Homo sapiens
ttgaccaaactgtgggt

SEQ ID NO: 372144 - DNA, 15 bp, Homo sapiens
ttgaccaagaactgc

SEQ ID NO: 372145 - DNA, 17 bp, Homo sapiens
ttgaccacggctgttcc

SEQ ID NO: 372146 - DNA, 18 bp, Homo sapiens
ttgaccagtataaaatta

SEQ ID NO: 372147 - DNA, 19 bp, Homo sapiens
ttgaccagtataaaattac

SEQ ID NO: 372148 - DNA, 13 bp, Homo sapiens
ttgaccccttcct

SEQ ID NO: 372149 - DNA, 17 bp, Homo sapiens
ttgaccctactgtggat

SEQ ID NO: 372150 - DNA, 16 bp, Homo sapiens
ttgaccgtactctcac

SEQ ID NO: 372151 - DNA, 20 bp, Homo sapiens
ttgaccgtttttatattact

SEQ ID NO: 372152 - DNA, 15 bp, Homo sapiens
ttgacctcagctgca

SEQ ID NO: 372153 - DNA, 16 bp, Homo sapiens
ttgacctcagctgcac

SEQ ID NO: 372154 - DNA, 22 bp, Homo sapiens
ttgacctcagctgcacattcct

SEQ ID NO: 372155 - DNA, 18 bp, Homo sapiens
ttgacctgaactctgcaa

SEQ ID NO: 372156 - DNA, 23 bp, Homo sapiens
ttgaccttctccctcactcctgc

SEQ ID NO: 372157 - DNA, 17 bp, Homo sapiens
ttgacctttatttatta

SEQ ID NO: 372158 - DNA, 17 bp, Homo sapiens
ttgacctttgaggtcta

SEQ ID NO: 372159 - DNA, 21 bp, Homo sapiens
ttgacctttgaggtctaaaca

SEQ ID NO: 372160 - DNA, 21 bp, Homo sapiens
ttgacgaagaaacaaaaaaca

SEQ ID NO: 372161 - DNA, 18 bp, Homo sapiens
ttgacgagtcaccttcca

SEQ ID NO: 372162 - DNA, 19 bp, Homo sapiens
ttgactagggattcaggct

SEQ ID NO: 372163 - DNA, 15 bp, Homo sapiens
ttgactataacaaaa

SEQ ID NO: 372164 - DNA, 15 bp, Homo sapiens
ttgactcaggattta

SEQ ID NO: 372165 - DNA, 23 bp, Homo sapiens
ttgactcaggatttaaaaactgg

SEQ ID NO: 372166 - DNA, 17 bp, Homo sapiens
ttgactcattaatttct

SEQ ID NO: 372167 - DNA, 17 bp, Homo sapiens
ttgactctaaatgcagt

SEQ ID NO: 372168 - DNA, 15 bp, Homo sapiens
ttgactcttttgcca

SEQ ID NO: 372169 - DNA, 12 bp, Homo sapiens
ttgactggcttt

SEQ ID NO: 372170 - DNA, 14 bp, Homo sapiens
ttgactgtgattta

SEQ ID NO: 372171 - DNA, 20 bp, Homo sapiens
ttgactgtgatttatttgga

SEQ ID NO: 372172 - DNA, 16 bp, Homo sapiens
ttgacttattttctct

SEQ ID NO: 372173 - DNA, 23 bp, Homo sapiens
ttgacttcaagatgcctcttcta

SEQ ID NO: 372174 - DNA, 16 bp, Homo sapiens
ttgacttctatcctgt

SEQ ID NO: 372175 - DNA, 15 bp, Homo sapiens
ttgacttctgcccaa

SEQ ID NO: 372176 - DNA, 16 bp, Homo sapiens
ttgacttgattagtgc

SEQ ID NO: 372177 - DNA, 22 bp, Homo sapiens
ttgagaaaccttattgtacctc

SEQ ID NO: 372178 - DNA, 14 bp, Homo sapiens
ttgagaaagaaata

SEQ ID NO: 372179 - DNA, 21 bp, Homo sapiens
ttgagaaaggattaagataca

SEQ ID NO: 372180 - DNA, 15 bp, Homo sapiens
ttgagaaatgaataa

SEQ ID NO: 372181 - DNA, 16 bp, Homo sapiens
ttgagaaatgaataat

SEQ ID NO: 372182 - DNA, 15 bp, Homo sapiens
ttgagaactttccat

SEQ ID NO: 372183 - DNA, 17 bp, Homo sapiens
ttgagacaaaaattatc

SEQ ID NO: 372184 - DNA, 15 bp, Homo sapiens
ttgagacaagccctg

SEQ ID NO: 372185 - DNA, 18 bp, Homo sapiens
ttgagacaagccctggca

SEQ ID NO: 372186 - DNA, 19 bp, Homo sapiens
ttgagacaagccctggcaa

SEQ ID NO: 372187 - DNA, 20 bp, Homo sapiens
ttgagacaagccctggcaac

SEQ ID NO: 372188 - DNA, 21 bp, Homo sapiens
ttgagacactgtcaagattaa

SEQ ID NO: 372189 - DNA, 18 bp, Homo sapiens
ttgagacccccaagcttc

SEQ ID NO: 372190 - DNA, 20 bp, Homo sapiens
ttgagaccctcttctctggg

SEQ ID NO: 372191 - DNA, 16 bp, Homo sapiens
ttgagactatttaaac

SEQ ID NO: 372192 - DNA, 12 bp, Homo sapiens
ttgagagctgct

SEQ ID NO: 372193 - DNA, 17 bp, Homo sapiens
ttgagaggcatgacagc

SEQ ID NO: 372194 - DNA, 13 bp, Homo sapiens
ttgagatgtatga

SEQ ID NO: 372195 - DNA, 17 bp, Homo sapiens
ttgagattagagggagg

SEQ ID NO: 372196 - DNA, 23 bp, Homo sapiens
ttgagcaaggcaagaagtgggat

SEQ ID NO: 372197 - DNA, 22 bp, Homo sapiens
ttgagccaggcctgggtctgtg

SEQ ID NO: 372198 - DNA, 12 bp, Homo sapiens
ttgagcccctga

SEQ ID NO: 372199 - DNA, 16 bp, Homo sapiens
ttgagcccctgaggac

SEQ ID NO: 372200 - DNA, 15 bp, Homo sapiens
ttgagccttttatta

SEQ ID NO: 372201 - DNA, 14 bp, Homo sapiens
ttgagctgagatgg

SEQ ID NO: 372202 - DNA, 20 bp, Homo sapiens
ttgagctgcctgctctgcag

SEQ ID NO: 372203 - DNA, 12 bp, Homo sapiens
ttgagctgtttt

SEQ ID NO: 372204 - DNA, 15 bp, Homo sapiens
ttgaggacaaagaga

SEQ ID NO: 372205 - DNA, 16 bp, Homo sapiens
ttgaggacacatgtcc

SEQ ID NO: 372206 - DNA, 15 bp, Homo sapiens
ttgaggacaggagag

SEQ ID NO: 372207 - DNA, 21 bp, Homo sapiens
ttgaggacctccacctgggag

SEQ ID NO: 372208 - DNA, 12 bp, Homo sapiens
ttgaggaggaag

SEQ ID NO: 372209 - DNA, 16 bp, Homo sapiens
ttgaggagtggttttt

SEQ ID NO: 372210 - DNA, 16 bp, Homo sapiens
ttgaggattttgagta

SEQ ID NO: 372211 - DNA, 17 bp, Homo sapiens
ttgaggattttgagtat

SEQ ID NO: 372212 - DNA, 18 bp, Homo sapiens
ttgaggccgcatctttct

SEQ ID NO: 372213 - DNA, 21 bp, Homo sapiens
ttgaggtagaccaggatttct

SEQ ID NO: 372214 - DNA, 18 bp, Homo sapiens
ttgaggtcttttgacatg

SEQ ID NO: 372215 - DNA, 19 bp, Homo sapiens
ttgaggtcttttgacatgt

SEQ ID NO: 372216 - DNA, 19 bp, Homo sapiens
ttgaggtggtgccttctca

SEQ ID NO: 372217 - DNA, 13 bp, Homo sapiens
ttgagtagaggct

SEQ ID NO: 372218 - DNA, 19 bp, Homo sapiens
ttgagtatttgctgtttgt

SEQ ID NO: 372219 - DNA, 20 bp, Homo sapiens
ttgagtatttgctgtttgtc

SEQ ID NO: 372220 - DNA, 21 bp, Homo sapiens
ttgagtcaaaagcctgggtga

SEQ ID NO: 372221 - DNA, 17 bp, Homo sapiens
ttgagtcttcacattta

SEQ ID NO: 372222 - DNA, 15 bp, Homo sapiens
ttgagtgagccggga

SEQ ID NO: 372223 - DNA, 11 bp, Homo sapiens
ttgagtgcctt

SEQ ID NO: 372224 - DNA, 21 bp, Homo sapiens
ttgagtgctgtctccatgttt

SEQ ID NO: 372225 - DNA, 17 bp, Homo sapiens
ttgagtgggccccctct

SEQ ID NO: 372226 - DNA, 18 bp, Homo sapiens
ttgagtgggccccctctc

SEQ ID NO: 372227 - DNA, 14 bp, Homo sapiens
ttgcttatttatat

SEQ ID NO: 372228 - DNA, 17 bp, Homo sapiens
ttgcttggactacctat

SEQ ID NO: 372229 - DNA, 16 bp, Homo sapiens
ttgcttgggccactgc

SEQ ID NO: 372230 - DNA, 17 bp, Homo sapiens
ttgcttgtaaaaatatg

SEQ ID NO: 372231 - DNA, 14 bp, Homo sapiens
ttgctttgaagcag

SEQ ID NO: 372232 - DNA, 15 bp, Homo sapiens
ttgctttgaagcagt

SEQ ID NO: 372233 - DNA, 17 bp, Homo sapiens
ttgctttggatacacac

SEQ ID NO: 372234 - DNA, 16 bp, Homo sapiens
ttgcttttcatgtaga

SEQ ID NO: 372235 - DNA, 20 bp, Homo sapiens
ttggaaaacgatttaattta

SEQ ID NO: 372236 - DNA, 14 bp, Homo sapiens
ttggaaaagaaaca

SEQ ID NO: 372237 - DNA, 13 bp, Homo sapiens
ttggaaaagaaat

SEQ ID NO: 372238 - DNA, 14 bp, Homo sapiens
ttggaaaagaaatc

SEQ ID NO: 372239 - DNA, 16 bp, Homo sapiens
ttggaaaagaaatcaa

SEQ ID NO: 372240 - DNA, 21 bp, Homo sapiens
ttggaaaagaaatcaattttt

SEQ ID NO: 372241 - DNA, 22 bp, Homo sapiens
ttggaaaatgttctgacagcat

SEQ ID NO: 372242 - DNA, 20 bp, Homo sapiens
ttggaaacctgccctgcctg

SEQ ID NO: 372243 - DNA, 18 bp, Homo sapiens
ttggaaagaagaaagact

SEQ ID NO: 372244 - DNA, 16 bp, Homo sapiens
ttggaaagctgatgat

SEQ ID NO: 372245 - DNA, 13 bp, Homo sapiens
ttggaaataataa

SEQ ID NO: 372246 - DNA, 14 bp, Homo sapiens
ttggaaatattaaa

SEQ ID NO: 372247 - DNA, 22 bp, Homo sapiens
ttggaaattgggtgtgccctgg

SEQ ID NO: 372248 - DNA, 19 bp, Homo sapiens
ttggaacagtaatcagttt

SEQ ID NO: 372249 - DNA, 22 bp, Homo sapiens
ttggaacatgtcggagtagaaa

SEQ ID NO: 372250 - DNA, 22 bp, Homo sapiens
ttggaaccacggagatctcctt

SEQ ID NO: 372251 - DNA, 15 bp, Homo sapiens
ttggaagaccccacc

SEQ ID NO: 372252 - DNA, 16 bp, Homo sapiens
ttggaagagaggcacc

SEQ ID NO: 372253 - DNA, 19 bp, Homo sapiens
ttggaagagaggcacctgc

SEQ ID NO: 372254 - DNA, 22 bp, Homo sapiens
ttggaagagaggcacctgctgg

SEQ ID NO: 372255 - DNA, 20 bp, Homo sapiens
ttggaagctgattcccagag

SEQ ID NO: 372256 - DNA, 12 bp, Homo sapiens
ttggaagtgaaa

SEQ ID NO: 372257 - DNA, 16 bp, Homo sapiens
ttggaattaaaacaat

SEQ ID NO: 372258 - DNA, 17 bp, Homo sapiens
ttggaattaacctggtg

SEQ ID NO: 372259 - DNA, 17 bp, Homo sapiens
ttggaattggtgtatat

SEQ ID NO: 372260 - DNA, 23 bp, Homo sapiens
ttggacaatcatgaaatatgcat

SEQ ID NO: 372261 - DNA, 15 bp, Homo sapiens
ttggacacacacagc

SEQ ID NO: 372262 - DNA, 16 bp, Homo sapiens
ttggacacacacagct

SEQ ID NO: 372263 - DNA, 17 bp, Homo sapiens
ttggacacacacagctt

SEQ ID NO: 372264 - DNA, 14 bp, Homo sapiens
ttggacacactgta

SEQ ID NO: 372265 - DNA, 17 bp, Homo sapiens
ttggacacactgtaaac

SEQ ID NO: 372266 - DNA, 18 bp, Homo sapiens
ttggacagcaaaaccatt

SEQ ID NO: 372267 - DNA, 23 bp, Homo sapiens
ttggacagcaaaaccattgcttc

SEQ ID NO: 372268 - DNA, 16 bp, Homo sapiens
ttggacagtaagattt

SEQ ID NO: 372269 - DNA, 22 bp, Homo sapiens
ttggacataactgacttagttc

SEQ ID NO: 372270 - DNA, 23 bp, Homo sapiens
ttggacatgtccatgaccagaag

SEQ ID NO: 372271 - DNA, 17 bp, Homo sapiens
ttggacgcacacagctt

SEQ ID NO: 372272 - DNA, 21 bp, Homo sapiens
ttggacggcctgatgctccct

SEQ ID NO: 372273 - DNA, 19 bp, Homo sapiens
ttggactccctccccaccc

SEQ ID NO: 372274 - DNA, 15 bp, Homo sapiens
ttggactcttgctct

SEQ ID NO: 372275 - DNA, 17 bp, Homo sapiens
ttggactcttgctcttt

SEQ ID NO: 372276 - DNA, 13 bp, Homo sapiens
ttggacttgagga

SEQ ID NO: 372277 - DNA, 14 bp, Homo sapiens
ttggactttgttac

SEQ ID NO: 372278 - DNA, 12 bp, Homo sapiens
ttggagaaaatg

SEQ ID NO: 372279 - DNA, 14 bp, Homo sapiens
ttggagaaattatt

SEQ ID NO: 372280 - DNA, 20 bp, Homo sapiens
ttggagacacaactattttt

SEQ ID NO: 372281 - DNA, 13 bp, Homo sapiens
ttggagacataca

SEQ ID NO: 372282 - DNA, 21 bp, Homo sapiens
ttggagagggacgaagaaagg

SEQ ID NO: 372283 - DNA, 20 bp, Homo sapiens
ttggagatgacagaaatatg

SEQ ID NO: 372284 - DNA, 23 bp, Homo sapiens
ttggagcagagacggcagcccca

SEQ ID NO: 372285 - DNA, 22 bp, Homo sapiens
ttggagcaggcaaaaaagggac

SEQ ID NO: 372286 - DNA, 11 bp, Homo sapiens
ttggagccact

SEQ ID NO: 372287 - DNA, 13 bp, Homo sapiens
ttggagcctgcag

SEQ ID NO: 372288 - DNA, 11 bp, Homo sapiens
ttggagctgag

SEQ ID NO: 372289 - DNA, 15 bp, Homo sapiens
ttggagcttacatag

SEQ ID NO: 372290 - DNA, 21 bp, Homo sapiens
ttggagcttttttctttaaga

SEQ ID NO: 372291 - DNA, 22 bp, Homo sapiens
ttggaggcaacctcccatttta

SEQ ID NO: 372292 - DNA, 15 bp, Homo sapiens
ttggaggcctcaccc

SEQ ID NO: 372293 - DNA, 20 bp, Homo sapiens
ttggaggcctcaccctgctt

SEQ ID NO: 372294 - DNA, 23 bp, Homo sapiens
ttggaggcctcaccctgcttggg

SEQ ID NO: 372295 - DNA, 19 bp, Homo sapiens
ttggagtggaggcattgtt

SEQ ID NO: 372296 - DNA, 19 bp, Homo sapiens
ttggataaatcatttcagt

SEQ ID NO: 372297 - DNA, 14 bp, Homo sapiens
ttggatacacacat

SEQ ID NO: 372298 - DNA, 13 bp, Homo sapiens
ttggatcctgtgt

SEQ ID NO: 372299 - DNA, 22 bp, Homo sapiens
ttggatctatcacctgtcatca

SEQ ID NO: 372300 - DNA, 15 bp, Homo sapiens
ttggatgcagttgta

SEQ ID NO: 372301 - DNA, 21 bp, Homo sapiens
ttggatgggagtgagacagaa

SEQ ID NO: 372302 - DNA, 21 bp, Homo sapiens
ttggatgggagtgggcacctc

SEQ ID NO: 372303 - DNA, 23 bp, Homo sapiens
ttggatgggagtgggcacctcag

SEQ ID NO: 372304 - DNA, 20 bp, Homo sapiens
ttggattggtaccagagcct

SEQ ID NO: 372305 - DNA, 22 bp, Homo sapiens
ttggcaaaatggggtttgggcc

SEQ ID NO: 372306 - DNA, 20 bp, Homo sapiens
ttggcaatagtttgcataga

SEQ ID NO: 372307 - DNA, 20 bp, Homo sapiens
ttggcacccccatgctgcct

SEQ ID NO: 372308 - DNA, 13 bp, Homo sapiens
ttggcagagaagg

SEQ ID NO: 372309 - DNA, 18 bp, Homo sapiens
ttggcagagaaggcctct

SEQ ID NO: 372310 - DNA, 16 bp, Homo sapiens
ttggcagcttcaaaac

SEQ ID NO: 372311 - DNA, 17 bp, Homo sapiens
ttggcagcttcaaaaca

SEQ ID NO: 372312 - DNA, 20 bp, Homo sapiens
ttggcataatagtcaatttc

SEQ ID NO: 372313 - DNA, 23 bp, Homo sapiens
ttggcatggtggcacgtgcctgt

SEQ ID NO: 372314 - DNA, 15 bp, Homo sapiens
ttggcattaaaactt

SEQ ID NO: 372315 - DNA, 18 bp, Homo sapiens
ttggcattatctctttct

SEQ ID NO: 372316 - DNA, 15 bp, Homo sapiens
ttggccaaagtgtta

SEQ ID NO: 372317 - DNA, 18 bp, Homo sapiens
ttggccacggcctgggag

SEQ ID NO: 372318 - DNA, 14 bp, Homo sapiens
ttggcccaggaaaa

SEQ ID NO: 372319 - DNA, 23 bp, Homo sapiens
ttggcccaggaaaaacctgtggg

SEQ ID NO: 372320 - DNA, 16 bp, Homo sapiens
ttggcccccgagctgg

SEQ ID NO: 372321 - DNA, 15 bp, Homo sapiens
ttggcccttccagtg

SEQ ID NO: 372322 - DNA, 14 bp, Homo sapiens
ttggccggctggcc

SEQ ID NO: 372323 - DNA, 22 bp, Homo sapiens
ttggcctcaagcaaggaagcag

SEQ ID NO: 372324 - DNA, 12 bp, Homo sapiens
ttggcctcagaa

SEQ ID NO: 372325 - DNA, 13 bp, Homo sapiens
ttggcctccggcc

SEQ ID NO: 372326 - DNA, 16 bp, Homo sapiens
ttggcctgacctggca

SEQ ID NO: 372327 - DNA, 16 bp, Homo sapiens
ttggcctggaggtggg

SEQ ID NO: 372328 - DNA, 12 bp, Homo sapiens
ttggcctttgta

SEQ ID NO: 372329 - DNA, 13 bp, Homo sapiens
ttggcctttgtaa

SEQ ID NO: 372330 - DNA, 15 bp, Homo sapiens
ttggcgctattacaa

SEQ ID NO: 372331 - DNA, 14 bp, Homo sapiens
ttggcgggccaagg

SEQ ID NO: 372332 - DNA, 20 bp, Homo sapiens
ttggctaactatatttgctt

SEQ ID NO: 372333 - DNA, 16 bp, Homo sapiens
ttggctagaagaaagt

SEQ ID NO: 372334 - DNA, 17 bp, Homo sapiens
ttggctagaagaaagta

SEQ ID NO: 372335 - DNA, 14 bp, Homo sapiens
ttggctctgaagaa

SEQ ID NO: 372336 - DNA, 17 bp, Homo sapiens
ttggctggatcagggaa

SEQ ID NO: 372337 - DNA, 20 bp, Homo sapiens
ttggctggatgaaattttct

SEQ ID NO: 372338 - DNA, 16 bp, Homo sapiens
ttggctgggcccagaa

SEQ ID NO: 372339 - DNA, 15 bp, Homo sapiens
ttggctgtaatttaa

SEQ ID NO: 372340 - DNA, 15 bp, Homo sapiens
ttggctgttccagac

SEQ ID NO: 372341 - DNA, 16 bp, Homo sapiens
ttggcttcctccgtcc

SEQ ID NO: 372342 - DNA, 14 bp, Homo sapiens
ttggcttgactcag

SEQ ID NO: 372343 - DNA, 16 bp, Homo sapiens
ttggcttgcactttgt

SEQ ID NO: 372344 - DNA, 21 bp, Homo sapiens
ttgggaaaaactggctttttc

SEQ ID NO: 372345 - DNA, 16 bp, Homo sapiens
ttgggaaattcttgca

SEQ ID NO: 372346 - DNA, 15 bp, Homo sapiens
ttgggaacactggcc

SEQ ID NO: 372347 - DNA, 15 bp, Homo sapiens
ttgggaagccaggaa

SEQ ID NO: 372348 - DNA, 19 bp, Homo sapiens
ttgggaagctatttccttt

SEQ ID NO: 372349 - DNA, 20 bp, Homo sapiens
ttgggaatggtgcccttgga

SEQ ID NO: 372350 - DNA, 19 bp, Homo sapiens
ttgggactgtcttgagaaa

SEQ ID NO: 372351 - DNA, 11 bp, Homo sapiens
ttgggagcact

SEQ ID NO: 372352 - DNA, 11 bp, Homo sapiens
ttgggagcctg

SEQ ID NO: 372353 - DNA, 17 bp, Homo sapiens
ttgggaggccaaggcag

SEQ ID NO: 372354 - DNA, 12 bp, Homo sapiens
ttgggaggctga

SEQ ID NO: 372355 - DNA, 17 bp, Homo sapiens
ttgggatcagcctccgc

SEQ ID NO: 372356 - DNA, 13 bp, Homo sapiens
ttgggatgggcac

SEQ ID NO: 372357 - DNA, 14 bp, Homo sapiens
ttgggattgggggc

SEQ ID NO: 372358 - DNA, 22 bp, Homo sapiens
ttgttactctggttctttgttt

SEQ ID NO: 372359 - DNA, 13 bp, Homo sapiens
ttgttactgtcca

SEQ ID NO: 372360 - DNA, 19 bp, Homo sapiens
ttgttactgtctgtagtgt

SEQ ID NO: 372361 - DNA, 13 bp, Homo sapiens
ttgttaggggtgg

SEQ ID NO: 372362 - DNA, 17 bp, Homo sapiens
ttgttaggggtggggga

SEQ ID NO: 372363 - DNA, 17 bp, Homo sapiens
ttgttagtgatttgcta

SEQ ID NO: 372364 - DNA, 13 bp, Homo sapiens
ttgttatacttca

SEQ ID NO: 372365 - DNA, 16 bp, Homo sapiens
ttgttatcagtacaat

SEQ ID NO: 372366 - DNA, 14 bp, Homo sapiens
ttgttatcatttaa

SEQ ID NO: 372367 - DNA, 18 bp, Homo sapiens
ttgttatcatttaagatt

SEQ ID NO: 372368 - DNA, 19 bp, Homo sapiens
ttgttatgataaaaggaag

SEQ ID NO: 372369 - DNA, 12 bp, Homo sapiens
ttgttatgctat

SEQ ID NO: 372370 - DNA, 14 bp, Homo sapiens
ttgttatgctatta

SEQ ID NO: 372371 - DNA, 20 bp, Homo sapiens
ttgttcaataataaatattt

SEQ ID NO: 372372 - DNA, 18 bp, Homo sapiens
ttgttcatgttttgctaa

SEQ ID NO: 372373 - DNA, 18 bp, Homo sapiens
ttgttcccctaagtggat

SEQ ID NO: 372374 - DNA, 13 bp, Homo sapiens
ttgttcctgcttt

SEQ ID NO: 372375 - DNA, 15 bp, Homo sapiens
ttgttcctgctttct

SEQ ID NO: 372376 - DNA, 18 bp, Homo sapiens
ttgttctagacttcccca

SEQ ID NO: 372377 - DNA, 14 bp, Homo sapiens
ttgttctctcttgg

SEQ ID NO: 372378 - DNA, 13 bp, Homo sapiens
ttgttctgggtga

SEQ ID NO: 372379 - DNA, 21 bp, Homo sapiens
ttgttgaggtggtctgaatgt

SEQ ID NO: 372380 - DNA, 21 bp, Homo sapiens
ttgttgatgctcacatatgat

SEQ ID NO: 372381 - DNA, 17 bp, Homo sapiens
ttgttgcatcttttcta

SEQ ID NO: 372382 - DNA, 12 bp, Homo sapiens
ttgttgccaact

SEQ ID NO: 372383 - DNA, 16 bp, Homo sapiens
ttgttgcccaggctgg

SEQ ID NO: 372384 - DNA, 19 bp, Homo sapiens
ttgttggcccttccagtgg

SEQ ID NO: 372385 - DNA, 12 bp, Homo sapiens
ttgttggcctcc

SEQ ID NO: 372386 - DNA, 23 bp, Homo sapiens
ttgttgggaggcggtttgggaga

SEQ ID NO: 372387 - DNA, 15 bp, Homo sapiens
ttgttgtattcctgc

SEQ ID NO: 372388 - DNA, 14 bp, Homo sapiens
ttgttgttgtttta

SEQ ID NO: 372389 - DNA, 23 bp, Homo sapiens
ttgttgttttacatcttttggga

SEQ ID NO: 372390 - DNA, 21 bp, Homo sapiens
ttgtttaaaaaaataacatct

SEQ ID NO: 372391 - DNA, 18 bp, Homo sapiens
ttgtttaaagaataaagt

SEQ ID NO: 372392 - DNA, 15 bp, Homo sapiens
ttgtttaaatataaa

SEQ ID NO: 372393 - DNA, 14 bp, Homo sapiens
ttgtttaattgtag

SEQ ID NO: 372394 - DNA, 22 bp, Homo sapiens
ttgtttacagcactactctgtg

SEQ ID NO: 372395 - DNA, 18 bp, Homo sapiens
ttgtttatgatatttctt

SEQ ID NO: 372396 - DNA, 17 bp, Homo sapiens
ttgtttcaaacagcatc

SEQ ID NO: 372397 - DNA, 21 bp, Homo sapiens
ttgtttcaaacagcatcaaaa

SEQ ID NO: 372398 - DNA, 19 bp, Homo sapiens
ttgtttccctgctggccaa

SEQ ID NO: 372399 - DNA, 14 bp, Homo sapiens
ttgtttcctgtgcc

SEQ ID NO: 372400 - DNA, 15 bp, Homo sapiens
ttgtttctatactgt

SEQ ID NO: 372401 - DNA, 23 bp, Homo sapiens
ttgtttctcctctgaagcatttg

SEQ ID NO: 372402 - DNA, 13 bp, Homo sapiens
ttgtttctctgag

SEQ ID NO: 372403 - DNA, 21 bp, Homo sapiens
ttgtttctgaaaattccagaa

SEQ ID NO: 372404 - DNA, 14 bp, Homo sapiens
ttgtttctgaccca

SEQ ID NO: 372405 - DNA, 22 bp, Homo sapiens
ttgtttgatctacttcatagct

SEQ ID NO: 372406 - DNA, 13 bp, Homo sapiens
ttgtttgcttatt

SEQ ID NO: 372407 - DNA, 20 bp, Homo sapiens
ttgtttggagggatcatttt

SEQ ID NO: 372408 - DNA, 23 bp, Homo sapiens
ttgtttggatcaaaatctgtaga

SEQ ID NO: 372409 - DNA, 16 bp, Homo sapiens
ttgtttgggtatcctg

SEQ ID NO: 372410 - DNA, 19 bp, Homo sapiens
ttgtttgggtggtttgtga

SEQ ID NO: 372411 - DNA, 15 bp, Homo sapiens
ttgtttgtgtccata

SEQ ID NO: 372412 - DNA, 19 bp, Homo sapiens
ttgtttgttaataaagtgc

SEQ ID NO: 372413 - DNA, 12 bp, Homo sapiens
ttgtttgtttta

SEQ ID NO: 372414 - DNA, 23 bp, Homo sapiens
ttgttttaaaataagttaaaggc

SEQ ID NO: 372415 - DNA, 19 bp, Homo sapiens
ttgttttatcatgacatgt

SEQ ID NO: 372416 - DNA, 14 bp, Homo sapiens
ttgttttggatgcc

SEQ ID NO: 372417 - DNA, 13 bp, Homo sapiens
ttgttttgtttta

SEQ ID NO: 372418 - DNA, 12 bp, Homo sapiens
ttgtttttgatg

SEQ ID NO: 372419 - DNA, 22 bp, Homo sapiens
tttaaaaaaaaaagttacagaa

SEQ ID NO: 372420 - DNA, 18 bp, Homo sapiens
tttaaaaaagatggattt

SEQ ID NO: 372421 - DNA, 20 bp, Homo sapiens
tttaaaaaagcattatcctt

SEQ ID NO: 372422 - DNA, 14 bp, Homo sapiens
tttaaaaaataaca

SEQ ID NO: 372423 - DNA, 15 bp, Homo sapiens
tttaaaaaggccttt

SEQ ID NO: 372424 - DNA, 18 bp, Homo sapiens
tttaaaaaggcctttggg

SEQ ID NO: 372425 - DNA, 21 bp, Homo sapiens
tttaaaaaggcctttgggatt

SEQ ID NO: 372426 - DNA, 12 bp, Homo sapiens
tttaaaacattt

SEQ ID NO: 372427 - DNA, 13 bp, Homo sapiens
tttaaaaccacta

SEQ ID NO: 372428 - DNA, 12 bp, Homo sapiens
tttaaaagacaa

SEQ ID NO: 372429 - DNA, 13 bp, Homo sapiens
tttaaaagacaaa

SEQ ID NO: 372430 - DNA, 19 bp, Homo sapiens
tttaaaagaggaaattaaa

SEQ ID NO: 372431 - DNA, 22 bp, Homo sapiens
tttaaaaggtattttgaatacc

SEQ ID NO: 372432 - DNA, 19 bp, Homo sapiens
tttaaaataaaatttacct

SEQ ID NO: 372433 - DNA, 14 bp, Homo sapiens
tttaaaatgattag

SEQ ID NO: 372434 - DNA, 19 bp, Homo sapiens
tttaaaatggacttttgtt

SEQ ID NO: 372435 - DNA, 17 bp, Homo sapiens
tttaaaatgttggtgca

SEQ ID NO: 372436 - DNA, 12 bp, Homo sapiens
tttaaaattggc

SEQ ID NO: 372437 - DNA, 15 bp, Homo sapiens
tttaaaattggcacc

SEQ ID NO: 372438 - DNA, 13 bp, Homo sapiens
tttaaactactga

SEQ ID NO: 372439 - DNA, 13 bp, Homo sapiens
tttaaagaagtct

SEQ ID NO: 372440 - DNA, 18 bp, Homo sapiens
tttaaagaagtctcttaa

SEQ ID NO: 372441 - DNA, 17 bp, Homo sapiens
tttaaagaatcattatt

SEQ ID NO: 372442 - DNA, 23 bp, Homo sapiens
tttaaagaatcattatttattaa

SEQ ID NO: 372443 - DNA, 17 bp, Homo sapiens
tttaaagagaatgtaga

SEQ ID NO: 372444 - DNA, 15 bp, Homo sapiens
tttaaagagaggtta

SEQ ID NO: 372445 - DNA, 12 bp, Homo sapiens
tttaaagctttt

SEQ ID NO: 372446 - DNA, 17 bp, Homo sapiens
tttaaagtacctgtagt

SEQ ID NO: 372447 - DNA, 15 bp, Homo sapiens
tttaaagtcttgctg

SEQ ID NO: 372448 - DNA, 14 bp, Homo sapiens
tttaaagttatctt

SEQ ID NO: 372449 - DNA, 16 bp, Homo sapiens
tttaaagtttaaatac

SEQ ID NO: 372450 - DNA, 17 bp, Homo sapiens
tttaaagtttaaatacc

SEQ ID NO: 372451 - DNA, 19 bp, Homo sapiens
tttaaagttttatatgcat

SEQ ID NO: 372452 - DNA, 19 bp, Homo sapiens
tttaaataaaagtgatcaa

SEQ ID NO: 372453 - DNA, 19 bp, Homo sapiens
tttaaataaagacctatgt

SEQ ID NO: 372454 - DNA, 23 bp, Homo sapiens
tttaaataaagtatcatgcattc

SEQ ID NO: 372455 - DNA, 18 bp, Homo sapiens
tttaaataaatgttattg

SEQ ID NO: 372456 - DNA, 20 bp, Homo sapiens
tttaaatactccctttttga

SEQ ID NO: 372457 - DNA, 16 bp, Homo sapiens
tttaaatatattttca

SEQ ID NO: 372458 - DNA, 16 bp, Homo sapiens
tttaaatcctaccaaa

SEQ ID NO: 372459 - DNA, 20 bp, Homo sapiens
tttaaatgaattaaatattg

SEQ ID NO: 372460 - DNA, 17 bp, Homo sapiens
tttaaatggaattttct

SEQ ID NO: 372461 - DNA, 12 bp, Homo sapiens
tttaaatggcat

SEQ ID NO: 372462 - DNA, 19 bp, Homo sapiens
tttaaatgggtgaaaaatg

SEQ ID NO: 372463 - DNA, 15 bp, Homo sapiens
tttaaattaatcaga

SEQ ID NO: 372464 - DNA, 19 bp, Homo sapiens
tttaaattataaggactgc

SEQ ID NO: 372465 - DNA, 19 bp, Homo sapiens
tttaaattgttataacttc

SEQ ID NO: 372466 - DNA, 20 bp, Homo sapiens
tttaaattttaaaaagcagc

SEQ ID NO: 372467 - DNA, 14 bp, Homo sapiens
tttaaattttcacc

SEQ ID NO: 372468 - DNA, 22 bp, Homo sapiens
tttaacaaaacaagaaagaaac

SEQ ID NO: 372469 - DNA, 22 bp, Homo sapiens
tttaacaaacgcattaagaggt

SEQ ID NO: 372470 - DNA, 14 bp, Homo sapiens
tttaacaaatctaa

SEQ ID NO: 372471 - DNA, 17 bp, Homo sapiens
tttaacaaatctaatct

SEQ ID NO: 372472 - DNA, 23 bp, Homo sapiens
tttaacaatttcctttatattta

SEQ ID NO: 372473 - DNA, 19 bp, Homo sapiens
tttaacacaagtcctgtga

SEQ ID NO: 372474 - DNA, 15 bp, Homo sapiens
tttaacagctttctc

SEQ ID NO: 372475 - DNA, 20 bp, Homo sapiens
tttaacaggttttcttctaa

SEQ ID NO: 372476 - DNA, 15 bp, Homo sapiens
tttaacatacatcta

SEQ ID NO: 372477 - DNA, 12 bp, Homo sapiens
tttaacattcct

SEQ ID NO: 372478 - DNA, 13 bp, Homo sapiens
tttaacattcctc

SEQ ID NO: 372479 - DNA, 20 bp, Homo sapiens
tttaacatttgatgtctaga

SEQ ID NO: 372480 - DNA, 17 bp, Homo sapiens
tttaaccattttaacct

SEQ ID NO: 372481 - DNA, 21 bp, Homo sapiens
tttaaccattttaacctagat

SEQ ID NO: 372482 - DNA, 12 bp, Homo sapiens
tttaaccctgcc

SEQ ID NO: 372483 - DNA, 21 bp, Homo sapiens
tttaacctagatgtttaacaa

SEQ ID NO: 372484 - DNA, 15 bp, Homo sapiens
tttaactagaattta

SEQ ID NO: 372485 - DNA, 18 bp, Homo sapiens
tttaactagcactttata

SEQ ID NO: 372486 - DNA, 12 bp, Homo sapiens
tttaactcagat

SEQ ID NO: 372487 - DNA, 15 bp, Homo sapiens
tttaactcagatcac

SEQ ID NO: 372488 - DNA, 18 bp, Homo sapiens
tttaactcagatcactac

SEQ ID NO: 372489 - DNA, 16 bp, Homo sapiens
tttcagcttgtttcta

SEQ ID NO: 372490 - DNA, 16 bp, Homo sapiens
tttcaggaccttttga

SEQ ID NO: 372491 - DNA, 22 bp, Homo sapiens
tttcagggccttgacaagtaca

SEQ ID NO: 372492 - DNA, 20 bp, Homo sapiens
tttcaggggctttggaagct

SEQ ID NO: 372493 - DNA, 20 bp, Homo sapiens
tttcagtaataaaacatctt

SEQ ID NO: 372494 - DNA, 15 bp, Homo sapiens
tttcagtaatagctg

SEQ ID NO: 372495 - DNA, 21 bp, Homo sapiens
tttcagtaatagctgaacctg

SEQ ID NO: 372496 - DNA, 23 bp, Homo sapiens
tttcagtaatagctgaacctgtt

SEQ ID NO: 372497 - DNA, 17 bp, Homo sapiens
tttcagtatactgtgtg

SEQ ID NO: 372498 - DNA, 21 bp, Homo sapiens
tttcagtgctttctcaaaatt

SEQ ID NO: 372499 - DNA, 14 bp, Homo sapiens
tttcataaattggc

SEQ ID NO: 372500 - DNA, 20 bp, Homo sapiens
tttcataaggcctgccctcc

SEQ ID NO: 372501 - DNA, 21 bp, Homo sapiens
tttcatagataccattttgaa

SEQ ID NO: 372502 - DNA, 13 bp, Homo sapiens
tttcatagttctg

SEQ ID NO: 372503 - DNA, 14 bp, Homo sapiens
tttcatagttctgt

SEQ ID NO: 372504 - DNA, 15 bp, Homo sapiens
tttcatatgttgctc

SEQ ID NO: 372505 - DNA, 12 bp, Homo sapiens
tttcatattgtg

SEQ ID NO: 372506 - DNA, 13 bp, Homo sapiens
tttcatcaagtag

SEQ ID NO: 372507 - DNA, 17 bp, Homo sapiens
tttcatcctggcctcct

SEQ ID NO: 372508 - DNA, 13 bp, Homo sapiens
tttcatcctgtgt

SEQ ID NO: 372509 - DNA, 23 bp, Homo sapiens
tttcatcctgttggctgctgcca

SEQ ID NO: 372510 - DNA, 16 bp, Homo sapiens
tttcatctcttgtata

SEQ ID NO: 372511 - DNA, 15 bp, Homo sapiens
tttcatctttccaaa

SEQ ID NO: 372512 - DNA, 19 bp, Homo sapiens
tttcatctttccaaattga

SEQ ID NO: 372513 - DNA, 20 bp, Homo sapiens
tttcatgaccactgggcctg

SEQ ID NO: 372514 - DNA, 15 bp, Homo sapiens
tttcatgattagaca

SEQ ID NO: 372515 - DNA, 18 bp, Homo sapiens
tttcatgattagacaatg

SEQ ID NO: 372516 - DNA, 21 bp, Homo sapiens
tttcatggtgaaaatgtactg

SEQ ID NO: 372517 - DNA, 22 bp, Homo sapiens
tttcatggtgaaaatgtactga

SEQ ID NO: 372518 - DNA, 23 bp, Homo sapiens
tttcatgtaaccaagagtattcc

SEQ ID NO: 372519 - DNA, 13 bp, Homo sapiens
tttcatgtagaac

SEQ ID NO: 372520 - DNA, 17 bp, Homo sapiens
tttcatgtgttgcaaat

SEQ ID NO: 372521 - DNA, 21 bp, Homo sapiens
tttcatgtgttgcaaattatt

SEQ ID NO: 372522 - DNA, 17 bp, Homo sapiens
tttcatgttttgtgact

SEQ ID NO: 372523 - DNA, 18 bp, Homo sapiens
tttcatgttttgtgacta

SEQ ID NO: 372524 - DNA, 21 bp, Homo sapiens
tttcattaatacagggcattt

SEQ ID NO: 372525 - DNA, 12 bp, Homo sapiens
tttcattcacaa

SEQ ID NO: 372526 - DNA, 12 bp, Homo sapiens
tttcattcattt

SEQ ID NO: 372527 - DNA, 15 bp, Homo sapiens
tttcattgaatactt

SEQ ID NO: 372528 - DNA, 18 bp, Homo sapiens
tttcatttaggtgaggaa

SEQ ID NO: 372529 - DNA, 18 bp, Homo sapiens
tttcattttctctcctcg

SEQ ID NO: 372530 - DNA, 12 bp, Homo sapiens
tttccaaaaata

SEQ ID NO: 372531 - DNA, 13 bp, Homo sapiens
tttccaaaggttg

SEQ ID NO: 372532 - DNA, 15 bp, Homo sapiens
tttccaacaccacag

SEQ ID NO: 372533 - DNA, 21 bp, Homo sapiens
tttccaacaccacagacacac

SEQ ID NO: 372534 - DNA, 23 bp, Homo sapiens
tttccaacaccacagacacacac

SEQ ID NO: 372535 - DNA, 17 bp, Homo sapiens
tttccaagcctgggcca

SEQ ID NO: 372536 - DNA, 23 bp, Homo sapiens
tttccaagcctgggccactggca

SEQ ID NO: 372537 - DNA, 19 bp, Homo sapiens
tttccacatccccaccctc

SEQ ID NO: 372538 - DNA, 19 bp, Homo sapiens
tttccacggaaacagaact

SEQ ID NO: 372539 - DNA, 23 bp, Homo sapiens
tttccactttgttctttaggaga

SEQ ID NO: 372540 - DNA, 20 bp, Homo sapiens
tttccagccgtgttgtagct

SEQ ID NO: 372541 - DNA, 13 bp, Homo sapiens
tttccaggaaggc

SEQ ID NO: 372542 - DNA, 15 bp, Homo sapiens
tttccagtattgaaa

SEQ ID NO: 372543 - DNA, 21 bp, Homo sapiens
tttccagtattgaaaacttca

SEQ ID NO: 372544 - DNA, 21 bp, Homo sapiens
tttccagtctccaccaggaac

SEQ ID NO: 372545 - DNA, 22 bp, Homo sapiens
tttccagtggcctggctccgct

SEQ ID NO: 372546 - DNA, 22 bp, Homo sapiens
tttccagttttttgccactgca

SEQ ID NO: 372547 - DNA, 15 bp, Homo sapiens
tttccataaggaatg

SEQ ID NO: 372548 - DNA, 22 bp, Homo sapiens
tttccatatggattttctattg

SEQ ID NO: 372549 - DNA, 16 bp, Homo sapiens
tttccatcatttctgt

SEQ ID NO: 372550 - DNA, 16 bp, Homo sapiens
tttccatgaaaacgtt

SEQ ID NO: 372551 - DNA, 14 bp, Homo sapiens
tttccatgacagta

SEQ ID NO: 372552 - DNA, 23 bp, Homo sapiens
tttccatgacagtagcatactga

SEQ ID NO: 372553 - DNA, 21 bp, Homo sapiens
tttccatgcagactcctcaga

SEQ ID NO: 372554 - DNA, 18 bp, Homo sapiens
tttccatgtgttttgctt

SEQ ID NO: 372555 - DNA, 21 bp, Homo sapiens
tttccattatttatattagtt

SEQ ID NO: 372556 - DNA, 14 bp, Homo sapiens
tttccattccagaa

SEQ ID NO: 372557 - DNA, 20 bp, Homo sapiens
tttccattcttttaaatggg

SEQ ID NO: 372558 - DNA, 12 bp, Homo sapiens
tttcccaagctg

SEQ ID NO: 372559 - DNA, 19 bp, Homo sapiens
tttcccaggacaggaaata

SEQ ID NO: 372560 - DNA, 21 bp, Homo sapiens
tttcccatcaccccttcccca

SEQ ID NO: 372561 - DNA, 12 bp, Homo sapiens
tttccccccact

SEQ ID NO: 372562 - DNA, 13 bp, Homo sapiens
tttcccctatcct

SEQ ID NO: 372563 - DNA, 14 bp, Homo sapiens
tttcccctcttccc

SEQ ID NO: 372564 - DNA, 23 bp, Homo sapiens
tttcccctgtcctgatggtcagc

SEQ ID NO: 372565 - DNA, 12 bp, Homo sapiens
tttcccctttcc

SEQ ID NO: 372566 - DNA, 20 bp, Homo sapiens
tttccctaagccaagggcct

SEQ ID NO: 372567 - DNA, 19 bp, Homo sapiens
tttccctccactccttcct

SEQ ID NO: 372568 - DNA, 18 bp, Homo sapiens
tttccgaagaccttctga

SEQ ID NO: 372569 - DNA, 12 bp, Homo sapiens
tttccgcccaca

SEQ ID NO: 372570 - DNA, 21 bp, Homo sapiens
tttccggggaggagccttgga

SEQ ID NO: 372571 - DNA, 15 bp, Homo sapiens
tttcctaaatgcagt

SEQ ID NO: 372572 - DNA, 22 bp, Homo sapiens
tttcctaacaggattagacagt

SEQ ID NO: 372573 - DNA, 16 bp, Homo sapiens
tttcctattaatcttc

SEQ ID NO: 372574 - DNA, 11 bp, Homo sapiens
tttcctccctt

SEQ ID NO: 372575 - DNA, 21 bp, Homo sapiens
tttcctcccttctttgcttct

SEQ ID NO: 372576 - DNA, 19 bp, Homo sapiens
tttcctcgcctaggcctgt

SEQ ID NO: 372577 - DNA, 19 bp, Homo sapiens
tttcctctaactcattctt

SEQ ID NO: 372578 - DNA, 13 bp, Homo sapiens
tttcctctctatc

SEQ ID NO: 372579 - DNA, 15 bp, Homo sapiens
tttcctctgagctgt

SEQ ID NO: 372580 - DNA, 22 bp, Homo sapiens
tttcctctgagctgttatcttg

SEQ ID NO: 372581 - DNA, 16 bp, Homo sapiens
tttcctcttccttctc

SEQ ID NO: 372582 - DNA, 17 bp, Homo sapiens
tttcctcttccttctct

SEQ ID NO: 372583 - DNA, 20 bp, Homo sapiens
tttcctctttacctgttcaa

SEQ ID NO: 372584 - DNA, 18 bp, Homo sapiens
tttcctgcccttttcctg

SEQ ID NO: 372585 - DNA, 21 bp, Homo sapiens
tttcctggacatcctcttctg

SEQ ID NO: 372586 - DNA, 22 bp, Homo sapiens
tttcctgggagtgggagtcaag

SEQ ID NO: 372587 - DNA, 12 bp, Homo sapiens
tttcctgtcaat

SEQ ID NO: 372588 - DNA, 16 bp, Homo sapiens
tttcctgtcaatatat

SEQ ID NO: 372589 - DNA, 22 bp, Homo sapiens
tttcctgtgccaggactctctt

SEQ ID NO: 372590 - DNA, 23 bp, Homo sapiens
tttcctgtgcccatcatctctgc

SEQ ID NO: 372591 - DNA, 22 bp, Homo sapiens
tttcctgtgtccacatctaaca

SEQ ID NO: 372592 - DNA, 15 bp, Homo sapiens
tttccttatttcaag

SEQ ID NO: 372593 - DNA, 22 bp, Homo sapiens
tttccttcggaatccagtgctt

SEQ ID NO: 372594 - DNA, 13 bp, Homo sapiens
tttccttctcgtc

SEQ ID NO: 372595 - DNA, 22 bp, Homo sapiens
tttccttctcgtcttcctctct

SEQ ID NO: 372596 - DNA, 15 bp, Homo sapiens
tttcctttaaatact

SEQ ID NO: 372597 - DNA, 13 bp, Homo sapiens
tttcctttgctct

SEQ ID NO: 372598 - DNA, 12 bp, Homo sapiens
tttcgctttcct

SEQ ID NO: 372599 - DNA, 21 bp, Homo sapiens
tttcggggtgaagcaagttca

SEQ ID NO: 372600 - DNA, 22 bp, Homo sapiens
tttcggggtgaagcaagttcac

SEQ ID NO: 372601 - DNA, 23 bp, Homo sapiens
tttcggggtgaagcaagttcact

SEQ ID NO: 372602 - DNA, 14 bp, Homo sapiens
tttcgtgcatttgt

SEQ ID NO: 372603 - DNA, 20 bp, Homo sapiens
tttcgtgtaatattctctga

SEQ ID NO: 372604 - DNA, 13 bp, Homo sapiens
tttcgttgcatgg

SEQ ID NO: 372605 - DNA, 14 bp, Homo sapiens
tttcgttgcatggt

SEQ ID NO: 372606 - DNA, 20 bp, Homo sapiens
tttcgttggttgtttctctg

SEQ ID NO: 372607 - DNA, 22 bp, Homo sapiens
tttcgttggttgtttctctgag

SEQ ID NO: 372608 - DNA, 23 bp, Homo sapiens
tttctaaacagttgagtttcttc

SEQ ID NO: 372609 - DNA, 14 bp, Homo sapiens
tttctaaactgttt

SEQ ID NO: 372610 - DNA, 19 bp, Homo sapiens
tttctaaaggcctcttcct

SEQ ID NO: 372611 - DNA, 15 bp, Homo sapiens
tttctaaagtgttgg

SEQ ID NO: 372612 - DNA, 13 bp, Homo sapiens
tttctaaatgttt

SEQ ID NO: 372613 - DNA, 17 bp, Homo sapiens
tttctaatttgctgctg

SEQ ID NO: 372614 - DNA, 23 bp, Homo sapiens
tttctacatgactgggcctccct

SEQ ID NO: 372615 - DNA, 15 bp, Homo sapiens
tttctacctttctga

SEQ ID NO: 372616 - DNA, 15 bp, Homo sapiens
tttctactctgaact

SEQ ID NO: 372617 - DNA, 17 bp, Homo sapiens
tttctactctgaactaa

SEQ ID NO: 372618 - DNA, 18 bp, Homo sapiens
tttgtatgttatgaacat

SEQ ID NO: 372619 - DNA, 12 bp, Homo sapiens
tttgtattctct

SEQ ID NO: 372620 - DNA, 13 bp, Homo sapiens
tttgtatttatat

SEQ ID NO: 372621 - DNA, 16 bp, Homo sapiens
tttgtatttcttttat

SEQ ID NO: 372622 - DNA, 17 bp, Homo sapiens
tttgtatttcttttata

SEQ ID NO: 372623 - DNA, 16 bp, Homo sapiens
tttgtatttttgaata

SEQ ID NO: 372624 - DNA, 16 bp, Homo sapiens
tttgtcaaactgtaga

SEQ ID NO: 372625 - DNA, 20 bp, Homo sapiens
tttgtcactggaacctccct

SEQ ID NO: 372626 - DNA, 12 bp, Homo sapiens
tttgtcacttct

SEQ ID NO: 372627 - DNA, 19 bp, Homo sapiens
tttgtcagtctgagtcatc

SEQ ID NO: 372628 - DNA, 20 bp, Homo sapiens
tttgtcagtctgagtcatca

SEQ ID NO: 372629 - DNA, 16 bp, Homo sapiens
tttgtccaccattcct

SEQ ID NO: 372630 - DNA, 16 bp, Homo sapiens
tttgtcccacagcttg

SEQ ID NO: 372631 - DNA, 16 bp, Homo sapiens
tttgtcccccaacttg

SEQ ID NO: 372632 - DNA, 17 bp, Homo sapiens
tttgtcccccaacttga

SEQ ID NO: 372633 - DNA, 21 bp, Homo sapiens
tttgtcccccaacttgagatg

SEQ ID NO: 372634 - DNA, 19 bp, Homo sapiens
tttgtcctgatgcttttgt

SEQ ID NO: 372635 - DNA, 21 bp, Homo sapiens
tttgtctacgtttagtttccg

SEQ ID NO: 372636 - DNA, 18 bp, Homo sapiens
tttgtctcctactctgtg

SEQ ID NO: 372637 - DNA, 17 bp, Homo sapiens
tttgtcttagagagaga

SEQ ID NO: 372638 - DNA, 14 bp, Homo sapiens
tttgtcttatatat

SEQ ID NO: 372639 - DNA, 17 bp, Homo sapiens
tttgtctttaactgtca

SEQ ID NO: 372640 - DNA, 17 bp, Homo sapiens
tttgtctttttccttta

SEQ ID NO: 372641 - DNA, 19 bp, Homo sapiens
tttgtgaagtgattgacat

SEQ ID NO: 372642 - DNA, 14 bp, Homo sapiens
tttgtgactatata

SEQ ID NO: 372643 - DNA, 16 bp, Homo sapiens
tttgtgagccttgctg

SEQ ID NO: 372644 - DNA, 18 bp, Homo sapiens
tttgtgaggtgaatgtct

SEQ ID NO: 372645 - DNA, 13 bp, Homo sapiens
tttgtgagtatgt

SEQ ID NO: 372646 - DNA, 21 bp, Homo sapiens
tttgtgctgcagacaaaaaga

SEQ ID NO: 372647 - DNA, 12 bp, Homo sapiens
tttgtggctggg

SEQ ID NO: 372648 - DNA, 19 bp, Homo sapiens
tttgtgggtttctctgtgc

SEQ ID NO: 372649 - DNA, 20 bp, Homo sapiens
tttgtgggtttctctgtgct

SEQ ID NO: 372650 - DNA, 17 bp, Homo sapiens
tttgtgtaataaaaatt

SEQ ID NO: 372651 - DNA, 16 bp, Homo sapiens
tttgtgtacagtatgt

SEQ ID NO: 372652 - DNA, 12 bp, Homo sapiens
tttgtgtattct

SEQ ID NO: 372653 - DNA, 12 bp, Homo sapiens
tttgtgtctttt

SEQ ID NO: 372654 - DNA, 15 bp, Homo sapiens
tttgtgtgaaataat

SEQ ID NO: 372655 - DNA, 14 bp, Homo sapiens
tttgtgtgctgtgg

SEQ ID NO: 372656 - DNA, 13 bp, Homo sapiens
tttgtgtgtatat

SEQ ID NO: 372657 - DNA, 15 bp, Homo sapiens
tttgtgtgtatatat

SEQ ID NO: 372658 - DNA, 20 bp, Homo sapiens
tttgtgttgttggaaaaagt

SEQ ID NO: 372659 - DNA, 12 bp, Homo sapiens
tttgtgtttcta

SEQ ID NO: 372660 - DNA, 24 bp, Homo sapiens
tttgttaaaatacagttctgtcat

SEQ ID NO: 372661 - DNA, 17 bp, Homo sapiens
tttgttaagctcaggat

SEQ ID NO: 372662 - DNA, 18 bp, Homo sapiens
tttgttatcagtacaatt

SEQ ID NO: 372663 - DNA, 18 bp, Homo sapiens
tttgttatttgtacagtt

SEQ ID NO: 372664 - DNA, 12 bp, Homo sapiens
tttgttattttg

SEQ ID NO: 372665 - DNA, 10 bp, Homo sapiens
tttgttcatt

SEQ ID NO: 372666 - DNA, 20 bp, Homo sapiens
tttgttccaacagttaaact

SEQ ID NO: 372667 - DNA, 15 bp, Homo sapiens
tttgttgaaattatg

SEQ ID NO: 372668 - DNA, 13 bp, Homo sapiens
tttgttgtgactg

SEQ ID NO: 372669 - DNA, 18 bp, Homo sapiens
tttgtttaaagaataaag

SEQ ID NO: 372670 - DNA, 15 bp, Homo sapiens
tttgtttgtttgggt

SEQ ID NO: 372671 - DNA, 13 bp, Homo sapiens
tttgttttctttg

SEQ ID NO: 372672 - DNA, 12 bp, Homo sapiens
ttttaaaaaggc

SEQ ID NO: 372673 - DNA, 16 bp, Homo sapiens
ttttaaaaagttgata

SEQ ID NO: 372674 - DNA, 23 bp, Homo sapiens
ttttaaaaatgtcctgcctttta

SEQ ID NO: 372675 - DNA, 20 bp, Homo sapiens
ttttaaaagactttgatgtg

SEQ ID NO: 372676 - DNA, 14 bp, Homo sapiens
ttttaaaagaggaa

SEQ ID NO: 372677 - DNA, 22 bp, Homo sapiens
ttttaaaaggcagattaaaagc

SEQ ID NO: 372678 - DNA, 15 bp, Homo sapiens
ttttaaaagtttcaa

SEQ ID NO: 372679 - DNA, 19 bp, Homo sapiens
ttttaaaatgttggtgcaa

SEQ ID NO: 372680 - DNA, 18 bp, Homo sapiens
ttttaaaattcaccccca

SEQ ID NO: 372681 - DNA, 19 bp, Homo sapiens
ttttaaacagtgtttatga

SEQ ID NO: 372682 - DNA, 12 bp, Homo sapiens
ttttaaactcat

SEQ ID NO: 372683 - DNA, 17 bp, Homo sapiens
ttttaaaggacaaacag

SEQ ID NO: 372684 - DNA, 19 bp, Homo sapiens
ttttaaaggacaaacagtg

SEQ ID NO: 372685 - DNA, 22 bp, Homo sapiens
ttttaaaggacaaacagtgaat

SEQ ID NO: 372686 - DNA, 19 bp, Homo sapiens
ttttaaagtttaaatacca

SEQ ID NO: 372687 - DNA, 15 bp, Homo sapiens
ttttaaataaaagca

SEQ ID NO: 372688 - DNA, 17 bp, Homo sapiens
ttttaaataaaagcagc

SEQ ID NO: 372689 - DNA, 12 bp, Homo sapiens
ttttaaatcatt

SEQ ID NO: 372690 - DNA, 12 bp, Homo sapiens
ttttaaatgaat

SEQ ID NO: 372691 - DNA, 19 bp, Homo sapiens
ttttaaatgattccaaata

SEQ ID NO: 372692 - DNA, 13 bp, Homo sapiens
ttttaaatggcat

SEQ ID NO: 372693 - DNA, 13 bp, Homo sapiens
ttttaaatgtgtt

SEQ ID NO: 372694 - DNA, 23 bp, Homo sapiens
ttttaaattataaggactgcatg

SEQ ID NO: 372695 - DNA, 20 bp, Homo sapiens
ttttaaattatactgtagct

SEQ ID NO: 372696 - DNA, 18 bp, Homo sapiens
ttttaacaaatgttttca

SEQ ID NO: 372697 - DNA, 21 bp, Homo sapiens
ttttaacaataactactgtgt

SEQ ID NO: 372698 - DNA, 14 bp, Homo sapiens
ttttaacattcctc

SEQ ID NO: 372699 - DNA, 17 bp, Homo sapiens
ttttaacgtatgtattt

SEQ ID NO: 372700 - DNA, 17 bp, Homo sapiens
ttttaagaaaaacatgt

SEQ ID NO: 372701 - DNA, 12 bp, Homo sapiens
ttttaagaaaca

SEQ ID NO: 372702 - DNA, 15 bp, Homo sapiens
ttttaagatttgtgt

SEQ ID NO: 372703 - DNA, 21 bp, Homo sapiens
ttttaagcactcttaaagcaa

SEQ ID NO: 372704 - DNA, 21 bp, Homo sapiens
ttttaagcgtaattttgccaa

SEQ ID NO: 372705 - DNA, 20 bp, Homo sapiens
ttttaaggtgagttctcact

SEQ ID NO: 372706 - DNA, 18 bp, Homo sapiens
ttttaagtatttatatat

SEQ ID NO: 372707 - DNA, 19 bp, Homo sapiens
ttttaagtgctttgtaatg

SEQ ID NO: 372708 - DNA, 18 bp, Homo sapiens
ttttaatagaataaaata

SEQ ID NO: 372709 - DNA, 21 bp, Homo sapiens
ttttaatagtcattccaaata

SEQ ID NO: 372710 - DNA, 13 bp, Homo sapiens
ttttaatatgtaa

SEQ ID NO: 372711 - DNA, 19 bp, Homo sapiens
ttttaatattactgtcttt

SEQ ID NO: 372712 - DNA, 22 bp, Homo sapiens
ttttaatgatactgtctaagaa

SEQ ID NO: 372713 - DNA, 14 bp, Homo sapiens
ttttaatgtacaag

SEQ ID NO: 372714 - DNA, 16 bp, Homo sapiens
ttttaattattattct

SEQ ID NO: 372715 - DNA, 20 bp, Homo sapiens
ttttaatttgatgaaagctg

SEQ ID NO: 372716 - DNA, 21 bp, Homo sapiens
ttttaatttgatgaaagctga

SEQ ID NO: 372717 - DNA, 14 bp, Homo sapiens
ttttaatttgtttt

SEQ ID NO: 372718 - DNA, 19 bp, Homo sapiens
ttttacaaaaaagaaaaga

SEQ ID NO: 372719 - DNA, 12 bp, Homo sapiens
ttttacaataaa

SEQ ID NO: 372720 - DNA, 17 bp, Homo sapiens
ttttacaataaaatctt

SEQ ID NO: 372721 - DNA, 18 bp, Homo sapiens
ttttacaataaataatct

SEQ ID NO: 372722 - DNA, 17 bp, Homo sapiens
ttttacacagcaatttt

SEQ ID NO: 372723 - DNA, 12 bp, Homo sapiens
ttttacagtgta

SEQ ID NO: 372724 - DNA, 17 bp, Homo sapiens
ttttacatgtttccatc

SEQ ID NO: 372725 - DNA, 22 bp, Homo sapiens
ttttaccattttgcgatgtgtt

SEQ ID NO: 372726 - DNA, 15 bp, Homo sapiens
ttttactaaagcagt

SEQ ID NO: 372727 - DNA, 20 bp, Homo sapiens
ttttactaaagcagtgtttt

SEQ ID NO: 372728 - DNA, 14 bp, Homo sapiens
ttttactgaacaat

SEQ ID NO: 372729 - DNA, 22 bp, Homo sapiens
ttttacttgttcatttctgtct

SEQ ID NO: 372730 - DNA, 19 bp, Homo sapiens
ttttactttgtacttgtgt

SEQ ID NO: 372731 - DNA, 11 bp, Homo sapiens
ttttagaacaa

SEQ ID NO: 372732 - DNA, 14 bp, Homo sapiens
ttttagaacagaaa

SEQ ID NO: 372733 - DNA, 17 bp, Homo sapiens
ttttagaacagaaaaca

SEQ ID NO: 372734 - DNA, 18 bp, Homo sapiens
ttttagaggtgagtttta

SEQ ID NO: 372735 - DNA, 20 bp, Homo sapiens
ttttagatgagattgtttta

SEQ ID NO: 372736 - DNA, 13 bp, Homo sapiens
ttttagatttctt

SEQ ID NO: 372737 - DNA, 16 bp, Homo sapiens
ttttagatttctttga

SEQ ID NO: 372738 - DNA, 19 bp, Homo sapiens
ttttaggtgttgattttct

SEQ ID NO: 372739 - DNA, 17 bp, Homo sapiens
ttttagtttcaaaatgt

SEQ ID NO: 372740 - DNA, 13 bp, Homo sapiens
ttttagttttagt

SEQ ID NO: 372741 - DNA, 15 bp, Homo sapiens
ttttataaattaaat

SEQ ID NO: 372742 - DNA, 16 bp, Homo sapiens
ttttataggttgttct

SEQ ID NO: 372743 - DNA, 22 bp, Homo sapiens
ttttatatagaccccaagcatt

SEQ ID NO: 372744 - DNA, 14 bp, Homo sapiens
ttttatatataaaa

SEQ ID NO: 372745 - DNA, 19 bp, Homo sapiens
ttttatatataaaataaat

SEQ ID NO: 372746 - DNA, 17 bp, Homo sapiens
ttttatattacttttgt

SEQ ID NO: 372747 - DNA, 21 bp, Homo sapiens
ttttatattacttttgtaaat

SEQ ID NO: 372748 - DNA, 11 bp, Homo sapiens
ttttatattct

SEQ ID NO: 372749 - DNA, 13 bp, Homo sapiens
aaaaaaaaaacaa

SEQ ID NO: 372750 - DNA, 13 bp, Homo sapiens
aaaaaaaaaatat

SEQ ID NO: 372751 - DNA, 13 bp, Homo sapiens
aaaaaaactttta

SEQ ID NO: 372752 - DNA, 12 bp, Homo sapiens
aaaaaaatataa

SEQ ID NO: 372753 - DNA, 12 bp, Homo sapiens
aaaaaaatatga

SEQ ID NO: 372754 - DNA, 11 bp, Homo sapiens
aaaaaaatttg

SEQ ID NO: 372755 - DNA, 21 bp, Homo sapiens
aaaaaagagaaaaaccaatga

SEQ ID NO: 372756 - DNA, 13 bp, Homo sapiens
aaaaaagttgaag

SEQ ID NO: 372757 - DNA, 12 bp, Homo sapiens
aaaaaataaaat

SEQ ID NO: 372758 - DNA, 21 bp, Homo sapiens
aaaaaataacatattcttgct

SEQ ID NO: 372759 - DNA, 13 bp, Homo sapiens
aaaaaatatttta

SEQ ID NO: 372760 - DNA, 13 bp, Homo sapiens
aaaaaatgaatag

SEQ ID NO: 372761 - DNA, 21 bp, Homo sapiens
aaaaaatgatctattgcagat

SEQ ID NO: 372762 - DNA, 11 bp, Homo sapiens
aaaaacaaaaa

SEQ ID NO: 372763 - DNA, 18 bp, Homo sapiens
aaaaacaagactgcctcc

SEQ ID NO: 372764 - DNA, 18 bp, Homo sapiens
aaaaacacggcagctgta

SEQ ID NO: 372765 - DNA, 16 bp, Homo sapiens
aaaaacagaacatttc

SEQ ID NO: 372766 - DNA, 11 bp, Homo sapiens
aaaaacatgtc

SEQ ID NO: 372767 - DNA, 22 bp, Homo sapiens
aaaaacattttaaaatcaactt

SEQ ID NO: 372768 - DNA, 17 bp, Homo sapiens
aaaaaccaatgattcat

SEQ ID NO: 372769 - DNA, 22 bp, Homo sapiens
aaaaaccattataaaatctttc

SEQ ID NO: 372770 - DNA, 14 bp, Homo sapiens
aaaaactccttttg

SEQ ID NO: 372771 - DNA, 21 bp, Homo sapiens
aaaaactggctttttcccagc

SEQ ID NO: 372772 - DNA, 14 bp, Homo sapiens
aaaaacttccattc

SEQ ID NO: 372773 - DNA, 20 bp, Homo sapiens
aaaaactttccatgacagta

SEQ ID NO: 372774 - DNA, 23 bp, Homo sapiens
aaaaactttccatgacagtagca

SEQ ID NO: 372775 - DNA, 11 bp, Homo sapiens
aaaaagaaaag

SEQ ID NO: 372776 - DNA, 19 bp, Homo sapiens
aaaaagaaagctgtgaaat

SEQ ID NO: 372777 - DNA, 14 bp, Homo sapiens
aaaaagaagtttgg

SEQ ID NO: 372778 - DNA, 21 bp, Homo sapiens
aaaaagaatctgcatttagca

SEQ ID NO: 372779 - DNA, 22 bp, Homo sapiens
aaaaagatggcctttgcttatg

SEQ ID NO: 372780 - DNA, 13 bp, Homo sapiens
aaaaagcagacag

SEQ ID NO: 372781 - DNA, 22 bp, Homo sapiens
aaaaagcaggaaagatcccaag

SEQ ID NO: 372782 - DNA, 12 bp, Homo sapiens
aaaaaggaaaac

SEQ ID NO: 372783 - DNA, 23 bp, Homo sapiens
aaaaaggaaaactcaccatttca

SEQ ID NO: 372784 - DNA, 15 bp, Homo sapiens
aaaaaggcctttggg

SEQ ID NO: 372785 - DNA, 23 bp, Homo sapiens
aaaaaggctggctgaaaatcact

SEQ ID NO: 372786 - DNA, 12 bp, Homo sapiens
aaaaagggaaaa

SEQ ID NO: 372787 - DNA, 20 bp, Homo sapiens
aaaaagggaaaacaaatatt

SEQ ID NO: 372788 - DNA, 12 bp, Homo sapiens
aaaaaggtgcta

SEQ ID NO: 372789 - DNA, 15 bp, Homo sapiens
acacataacacacat

SEQ ID NO: 372790 - DNA, 13 bp, Homo sapiens
acacatacacaca

SEQ ID NO: 372791 - DNA, 22 bp, Homo sapiens
acacatacacactcatacgtgt

SEQ ID NO: 372792 - DNA, 14 bp, Homo sapiens
acacatataaacat

SEQ ID NO: 372793 - DNA, 17 bp, Homo sapiens
acacatccagacatcat

SEQ ID NO: 372794 - DNA, 17 bp, Homo sapiens
acacatccctaatgtgt

SEQ ID NO: 372795 - DNA, 14 bp, Homo sapiens
acacatctcctcca

SEQ ID NO: 372796 - DNA, 14 bp, Homo sapiens
acacatcttcccta

SEQ ID NO: 372797 - DNA, 22 bp, Homo sapiens
acacatgctctcaatatataat

SEQ ID NO: 372798 - DNA, 16 bp, Homo sapiens
acacattatagaaatt

SEQ ID NO: 372799 - DNA, 18 bp, Homo sapiens
acacattatagaaattac

SEQ ID NO: 372800 - DNA, 19 bp, Homo sapiens
acacattatagaaattact

SEQ ID NO: 372801 - DNA, 15 bp, Homo sapiens
acaccacagacacac

SEQ ID NO: 372802 - DNA, 18 bp, Homo sapiens
acaccacagacacacaca

SEQ ID NO: 372803 - DNA, 21 bp, Homo sapiens
acaccacagacacacacacgc

SEQ ID NO: 372804 - DNA, 21 bp, Homo sapiens
acaccacagacgccacctggc

SEQ ID NO: 372805 - DNA, 16 bp, Homo sapiens
acaccaccgccctcct

SEQ ID NO: 372806 - DNA, 17 bp, Homo sapiens
acaccaccgccctcctc

SEQ ID NO: 372807 - DNA, 21 bp, Homo sapiens
acaccaccgccctcctcgctg

SEQ ID NO: 372808 - DNA, 22 bp, Homo sapiens
acaccacgtccttattggaata

SEQ ID NO: 372809 - DNA, 18 bp, Homo sapiens
acaccactaaccatcccc

SEQ ID NO: 372810 - DNA, 13 bp, Homo sapiens
acaccactgccct

SEQ ID NO: 372811 - DNA, 16 bp, Homo sapiens
acaccagaagtgccat

SEQ ID NO: 372812 - DNA, 22 bp, Homo sapiens
acaccaggacttaagacaaatg

SEQ ID NO: 372813 - DNA, 16 bp, Homo sapiens
acaccatagtttacaa

SEQ ID NO: 372814 - DNA, 15 bp, Homo sapiens
acaccattattccag

SEQ ID NO: 372815 - DNA, 13 bp, Homo sapiens
acacccaggaagg

SEQ ID NO: 372816 - DNA, 14 bp, Homo sapiens
acacccaggaaggg

SEQ ID NO: 372817 - DNA, 21 bp, Homo sapiens
acacccatcgtataaggaaat

SEQ ID NO: 372818 - DNA, 19 bp, Homo sapiens
acaccccacaccccagccc

SEQ ID NO: 372819 - DNA, 12 bp, Homo sapiens
acaccccagccc

SEQ ID NO: 372820 - DNA, 14 bp, Homo sapiens
acaccccagcccac

SEQ ID NO: 372821 - DNA, 21 bp, Homo sapiens
acaccccccgccccccacctt

SEQ ID NO: 372822 - DNA, 18 bp, Homo sapiens
acaccccgtctgcccctt

SEQ ID NO: 372823 - DNA, 22 bp, Homo sapiens
acacccgccctgcccttccctg

SEQ ID NO: 372824 - DNA, 16 bp, Homo sapiens
acaccctaactcttgc

SEQ ID NO: 372825 - DNA, 20 bp, Homo sapiens
acaccctaactcttgctcac

SEQ ID NO: 372826 - DNA, 23 bp, Homo sapiens
acaccctacaagttgatcatgca

SEQ ID NO: 372827 - DNA, 15 bp, Homo sapiens
acaccctccagcaca

SEQ ID NO: 372828 - DNA, 18 bp, Homo sapiens
acaccctccagcacagac

SEQ ID NO: 372829 - DNA, 13 bp, Homo sapiens
acaccctgcaagg

SEQ ID NO: 372830 - DNA, 19 bp, Homo sapiens
acacccttccccactcccg

SEQ ID NO: 372831 - DNA, 14 bp, Homo sapiens
acaccgggcctgga

SEQ ID NO: 372832 - DNA, 16 bp, Homo sapiens
acaccgggcctggaga

SEQ ID NO: 372833 - DNA, 22 bp, Homo sapiens
acacctaaaaccagttttgctg

SEQ ID NO: 372834 - DNA, 15 bp, Homo sapiens
acacctaccatgctg

SEQ ID NO: 372835 - DNA, 17 bp, Homo sapiens
acacctaccctcctttt

SEQ ID NO: 372836 - DNA, 12 bp, Homo sapiens
acacctcagagc

SEQ ID NO: 372837 - DNA, 21 bp, Homo sapiens
acacctcagttcccttggcct

SEQ ID NO: 372838 - DNA, 13 bp, Homo sapiens
acacctctgggct

SEQ ID NO: 372839 - DNA, 23 bp, Homo sapiens
acacctgccctgccctgccacct

SEQ ID NO: 372840 - DNA, 17 bp, Homo sapiens
acacctgcctctgaact

SEQ ID NO: 372841 - DNA, 16 bp, Homo sapiens
acacctgcctgcagag

SEQ ID NO: 372842 - DNA, 22 bp, Homo sapiens
acacctggagactgtcccgaca

SEQ ID NO: 372843 - DNA, 17 bp, Homo sapiens
acacctgggcccgggca

SEQ ID NO: 372844 - DNA, 19 bp, Homo sapiens
acacctgtggataaaacat

SEQ ID NO: 372845 - DNA, 17 bp, Homo sapiens
acaccttttaactcacc

SEQ ID NO: 372846 - DNA, 23 bp, Homo sapiens
acacgcaagggcatcaggcactg

SEQ ID NO: 372847 - DNA, 24 bp, Homo sapiens
acacgcaagggcatcaggcactgg

SEQ ID NO: 372848 - DNA, 14 bp, Homo sapiens
acacgcacacacac

SEQ ID NO: 372849 - DNA, 17 bp, Homo sapiens
acacgcagacacacaca

SEQ ID NO: 372850 - DNA, 12 bp, Homo sapiens
aaaacagatgag

SEQ ID NO: 372851 - DNA, 19 bp, Homo sapiens
aaaacaggaaaaaaacttt

SEQ ID NO: 372852 - DNA, 17 bp, Homo sapiens
aaaacataaaaagttaa

SEQ ID NO: 372853 - DNA, 12 bp, Homo sapiens
aaaacatttgaa

SEQ ID NO: 372854 - DNA, 11 bp, Homo sapiens
aaaacatttgt

SEQ ID NO: 372855 - DNA, 13 bp, Homo sapiens
aaaaccaatgatt

SEQ ID NO: 372856 - DNA, 14 bp, Homo sapiens
aaaaccaatgattc

SEQ ID NO: 372857 - DNA, 20 bp, Homo sapiens
aaaaccacagccctgtcagt

SEQ ID NO: 372858 - DNA, 15 bp, Homo sapiens
aaaaccagaattagg

SEQ ID NO: 372859 - DNA, 20 bp, Homo sapiens
aaaaccatcaaaaatattcc

SEQ ID NO: 372860 - DNA, 22 bp, Homo sapiens
aaaacccaaatggctagaacgt

SEQ ID NO: 372861 - DNA, 21 bp, Homo sapiens
aaaaccctgctaaatgactta

SEQ ID NO: 372862 - DNA, 21 bp, Homo sapiens
aaaaccggcaacctgtaactg

SEQ ID NO: 372863 - DNA, 21 bp, Homo sapiens
aaaacctctttccaaaggctg

SEQ ID NO: 372864 - DNA, 17 bp, Homo sapiens
aaaacctgtcaatgata

SEQ ID NO: 372865 - DNA, 19 bp, Homo sapiens
aaaacctgtgccaggctga

SEQ ID NO: 372866 - DNA, 13 bp, Homo sapiens
aaaacctttcaaa

SEQ ID NO: 372867 - DNA, 20 bp, Homo sapiens
aaaacgaatcccctaaacaa

SEQ ID NO: 372868 - DNA, 15 bp, Homo sapiens
aaaacgatttaattt

SEQ ID NO: 372869 - DNA, 14 bp, Homo sapiens
aaaacgcatggagt

SEQ ID NO: 372870 - DNA, 17 bp, Homo sapiens
aaaacgcatggagtgtg

SEQ ID NO: 372871 - DNA, 19 bp, Homo sapiens
aaaactaaatctctaatat

SEQ ID NO: 372872 - DNA, 23 bp, Homo sapiens
aaaactagagctctaagcccatt

SEQ ID NO: 372873 - DNA, 20 bp, Homo sapiens
aaaactagataacttaaata

SEQ ID NO: 372874 - DNA, 21 bp, Homo sapiens
aaaactagataacttaaataa

SEQ ID NO: 372875 - DNA, 22 bp, Homo sapiens
aaaactagataacttaaataat

SEQ ID NO: 372876 - DNA, 13 bp, Homo sapiens
aaaactatttaaa

SEQ ID NO: 372877 - DNA, 17 bp, Homo sapiens
aaaactcaccatttcat

SEQ ID NO: 372878 - DNA, 16 bp, Homo sapiens
aaaactgcacagtgct

SEQ ID NO: 372879 - DNA, 23 bp, Homo sapiens
aaaactgcttttttttttccagc

SEQ ID NO: 372880 - DNA, 14 bp, Homo sapiens
aaaactggcttttt

SEQ ID NO: 372881 - DNA, 12 bp, Homo sapiens
aaaactgtaaat

SEQ ID NO: 372882 - DNA, 18 bp, Homo sapiens
aaaactgtaaatacaaaa

SEQ ID NO: 372883 - DNA, 21 bp, Homo sapiens
aaaactgtgacattccacaga

SEQ ID NO: 372884 - DNA, 12 bp, Homo sapiens
aaaactgtttat

SEQ ID NO: 372885 - DNA, 13 bp, Homo sapiens
aaaacttccacta

SEQ ID NO: 372886 - DNA, 19 bp, Homo sapiens
aaaacttccattctttctt

SEQ ID NO: 372887 - DNA, 22 bp, Homo sapiens
aaaacttgatgtgttatctctt

SEQ ID NO: 372888 - DNA, 15 bp, Homo sapiens
aaaactttccatgac

SEQ ID NO: 372889 - DNA, 17 bp, Homo sapiens
aaaactttccatgacag

SEQ ID NO: 372890 - DNA, 23 bp, Homo sapiens
aaaactttccatgacagtagcat

SEQ ID NO: 372891 - DNA, 13 bp, Homo sapiens
aaaacttttataa

SEQ ID NO: 372892 - DNA, 21 bp, Homo sapiens
aaaacttttataaattaaata

SEQ ID NO: 372893 - DNA, 15 bp, Homo sapiens
aaaagaaaaacaagt

SEQ ID NO: 372894 - DNA, 13 bp, Homo sapiens
aaaagaaaacatt

SEQ ID NO: 372895 - DNA, 19 bp, Homo sapiens
aaaagaaaacattccagat

SEQ ID NO: 372896 - DNA, 10 bp, Homo sapiens
aaaagaaaag

SEQ ID NO: 372897 - DNA, 13 bp, Homo sapiens
aaaagaaatcaat

SEQ ID NO: 372898 - DNA, 20 bp, Homo sapiens
aaaagaaattccctggacca

SEQ ID NO: 372899 - DNA, 13 bp, Homo sapiens
aaaagaaattctg

SEQ ID NO: 372900 - DNA, 14 bp, Homo sapiens
aaaagaagaaagtc

SEQ ID NO: 372901 - DNA, 17 bp, Homo sapiens
aaaagaatgtacattac

SEQ ID NO: 372902 - DNA, 20 bp, Homo sapiens
aaaagacacacttgtccaca

SEQ ID NO: 372903 - DNA, 13 bp, Homo sapiens
aaaagacattttt

SEQ ID NO: 372904 - DNA, 17 bp, Homo sapiens
aaaagaccaaattttga

SEQ ID NO: 372905 - DNA, 13 bp, Homo sapiens
aaaagacttcaaa

SEQ ID NO: 372906 - DNA, 12 bp, Homo sapiens
aaaagactttga

SEQ ID NO: 372907 - DNA, 12 bp, Homo sapiens
aaaagagaagaa

SEQ ID NO: 372908 - DNA, 12 bp, Homo sapiens
aaaagagaaggg

SEQ ID NO: 372909 - DNA, 13 bp, Homo sapiens
aaaagagaaggga

SEQ ID NO: 372910 - DNA, 23 bp, Homo sapiens
aaaagagaattagattatattgg

SEQ ID NO: 372911 - DNA, 15 bp, Homo sapiens
aaaagagccaagttc

SEQ ID NO: 372912 - DNA, 20 bp, Homo sapiens
aaaagaggaaattaaataat

SEQ ID NO: 372913 - DNA, 22 bp, Homo sapiens
aaaagagtcttaattttctaaa

SEQ ID NO: 372914 - DNA, 23 bp, Homo sapiens
aaaagagtcttaattttctaaaa

SEQ ID NO: 372915 - DNA, 13 bp, Homo sapiens
aaaagataaagat

SEQ ID NO: 372916 - DNA, 14 bp, Homo sapiens
aaaagataaagatg

SEQ ID NO: 372917 - DNA, 17 bp, Homo sapiens
aaaagataaagatgatc

SEQ ID NO: 372918 - DNA, 18 bp, Homo sapiens
aaaagataaagatgatct

SEQ ID NO: 372919 - DNA, 20 bp, Homo sapiens
aaaagataaagatgatctac

SEQ ID NO: 372920 - DNA, 12 bp, Homo sapiens
aaaatgtgtctg

SEQ ID NO: 372921 - DNA, 12 bp, Homo sapiens
aaaatgttaaca

SEQ ID NO: 372922 - DNA, 16 bp, Homo sapiens
aaaatgttaacaactt

SEQ ID NO: 372923 - DNA, 15 bp, Homo sapiens
aaaatgttaataaag

SEQ ID NO: 372924 - DNA, 12 bp, Homo sapiens
aaaatgttcatt

SEQ ID NO: 372925 - DNA, 19 bp, Homo sapiens
aaaatgttcattctatgac

SEQ ID NO: 372926 - DNA, 22 bp, Homo sapiens
aaaatgttcattctatgacaat

SEQ ID NO: 372927 - DNA, 24 bp, Homo sapiens
aaaatgtttgccctgttcaaagta

SEQ ID NO: 372928 - DNA, 22 bp, Homo sapiens
aaaatgttttatggtagctttt

SEQ ID NO: 372929 - DNA, 14 bp, Homo sapiens
aaaattaaaatcca

SEQ ID NO: 372930 - DNA, 22 bp, Homo sapiens
aaaattaaataaatctttcagc

SEQ ID NO: 372931 - DNA, 14 bp, Homo sapiens
aaaattagcatctg

SEQ ID NO: 372932 - DNA, 19 bp, Homo sapiens
aaaattaggatttcatgat

SEQ ID NO: 372933 - DNA, 14 bp, Homo sapiens
aaaattatctattt

SEQ ID NO: 372934 - DNA, 15 bp, Homo sapiens
aaaattatctatttg

SEQ ID NO: 372935 - DNA, 17 bp, Homo sapiens
aaaattatctatttgta

SEQ ID NO: 372936 - DNA, 18 bp, Homo sapiens
aaaattatctatttgtat

SEQ ID NO: 372937 - DNA, 20 bp, Homo sapiens
aaaattattaaaaattatag

SEQ ID NO: 372938 - DNA, 15 bp, Homo sapiens
aaaattatttgcctt

SEQ ID NO: 372939 - DNA, 18 bp, Homo sapiens
aaaattattttaaacaaa

SEQ ID NO: 372940 - DNA, 18 bp, Homo sapiens
aaaattcaaaaagtgttt

SEQ ID NO: 372941 - DNA, 15 bp, Homo sapiens
aaaattcatataaag

SEQ ID NO: 372942 - DNA, 12 bp, Homo sapiens
aaaattccagaa

SEQ ID NO: 372943 - DNA, 16 bp, Homo sapiens
aaaattccagaaagga

SEQ ID NO: 372944 - DNA, 21 bp, Homo sapiens
aaaattccatcccatcatctt

SEQ ID NO: 372945 - DNA, 11 bp, Homo sapiens
aaaattcttgt

SEQ ID NO: 372946 - DNA, 21 bp, Homo sapiens
aaaattgatgtgtttatttat

SEQ ID NO: 372947 - DNA, 15 bp, Homo sapiens
aaaattgtatagaga

SEQ ID NO: 372948 - DNA, 21 bp, Homo sapiens
aaaattgtcaaatgtcattat

SEQ ID NO: 372949 - DNA, 21 bp, Homo sapiens
aaaatttaagcattgtttgct

SEQ ID NO: 372950 - DNA, 17 bp, Homo sapiens
aaaatttccagtacctt

SEQ ID NO: 372951 - DNA, 18 bp, Homo sapiens
aaaatttgaaatttagct

SEQ ID NO: 372952 - DNA, 15 bp, Homo sapiens
aaaatttgaaccaaa

SEQ ID NO: 372953 - DNA, 16 bp, Homo sapiens
aaaatttgaaccaaaa

SEQ ID NO: 372954 - DNA, 19 bp, Homo sapiens
aaaatttgatggtgaatat

SEQ ID NO: 372955 - DNA, 23 bp, Homo sapiens
aaaatttgatggtgaatattaca

SEQ ID NO: 372956 - DNA, 13 bp, Homo sapiens
aaaatttgtttaa

SEQ ID NO: 372957 - DNA, 16 bp, Homo sapiens
aaaattttacttccat

SEQ ID NO: 372958 - DNA, 19 bp, Homo sapiens
aaaattttattgaatataa

SEQ ID NO: 372959 - DNA, 22 bp, Homo sapiens
aaaattttgctccccagtgaag

SEQ ID NO: 372960 - DNA, 23 bp, Homo sapiens
aaaattttgctccccagtgaagg

SEQ ID NO: 372961 - DNA, 17 bp, Homo sapiens
aaaatttttttaaggaa

SEQ ID NO: 372962 - DNA, 14 bp, Homo sapiens
aaacaaaaaacaat

SEQ ID NO: 372963 - DNA, 14 bp, Homo sapiens
aaacaaaaactttc

SEQ ID NO: 372964 - DNA, 15 bp, Homo sapiens
aaacaaaaactttcc

SEQ ID NO: 372965 - DNA, 18 bp, Homo sapiens
aaacaaaaactttccatg

SEQ ID NO: 372966 - DNA, 21 bp, Homo sapiens
aaacaaaaactttccatgaca

SEQ ID NO: 372967 - DNA, 14 bp, Homo sapiens
aaacaaaaccaagc

SEQ ID NO: 372968 - DNA, 13 bp, Homo sapiens
aaacaaaatattt

SEQ ID NO: 372969 - DNA, 15 bp, Homo sapiens
aaacaaaatctgaac

SEQ ID NO: 372970 - DNA, 16 bp, Homo sapiens
aaacaaaatctgaact

SEQ ID NO: 372971 - DNA, 16 bp, Homo sapiens
aaacaaagggtgggca

SEQ ID NO: 372972 - DNA, 16 bp, Homo sapiens
aaacaaagtgactgtt

SEQ ID NO: 372973 - DNA, 12 bp, Homo sapiens
aaacaaatatgc

SEQ ID NO: 372974 - DNA, 13 bp, Homo sapiens
aaacaaatatgca

SEQ ID NO: 372975 - DNA, 12 bp, Homo sapiens
aaacaacaaaaa

SEQ ID NO: 372976 - DNA, 13 bp, Homo sapiens
aaacaacagaaac

SEQ ID NO: 372977 - DNA, 12 bp, Homo sapiens
aaacaacagcaa

SEQ ID NO: 372978 - DNA, 14 bp, Homo sapiens
aaacaacagcaaca

SEQ ID NO: 372979 - DNA, 23 bp, Homo sapiens
aaacaaccattttttgttctgtg

SEQ ID NO: 372980 - DNA, 21 bp, Homo sapiens
aaacaacctgccacaatgtga

SEQ ID NO: 372981 - DNA, 12 bp, Homo sapiens
aaacaagaaaga

SEQ ID NO: 372982 - DNA, 15 bp, Homo sapiens
aaacaagaatactga

SEQ ID NO: 372983 - DNA, 19 bp, Homo sapiens
aaacaagacacccaagtcc

SEQ ID NO: 372984 - DNA, 17 bp, Homo sapiens
aaacaagactgcctccc

SEQ ID NO: 372985 - DNA, 22 bp, Homo sapiens
aaacaagttggctagaagaaag

SEQ ID NO: 372986 - DNA, 15 bp, Homo sapiens
aaacaataaatgtgc

SEQ ID NO: 372987 - DNA, 16 bp, Homo sapiens
aaacaataaatgtgca

SEQ ID NO: 372988 - DNA, 18 bp, Homo sapiens
aaacaatatttattgtat

SEQ ID NO: 372989 - DNA, 12 bp, Homo sapiens
aaacaatgttca

SEQ ID NO: 372990 - DNA, 13 bp, Homo sapiens
aaacaatttattt

SEQ ID NO: 372991 - DNA, 21 bp, Homo sapiens
aaacaatttgcataatactaa

SEQ ID NO: 372992 - DNA, 20 bp, Homo sapiens
acagagtggatctggagtct

SEQ ID NO: 372993 - DNA, 18 bp, Homo sapiens
acagagtggtctttctgg

SEQ ID NO: 372994 - DNA, 21 bp, Homo sapiens
acagagtggtctttctggaga

SEQ ID NO: 372995 - DNA, 15 bp, Homo sapiens
acagagtttgtagta

SEQ ID NO: 372996 - DNA, 18 bp, Homo sapiens
acagagtttgtagtaaat

SEQ ID NO: 372997 - DNA, 22 bp, Homo sapiens
acagataacattaggttgtcct

SEQ ID NO: 372998 - DNA, 20 bp, Homo sapiens
acagataagcaagagagatg

SEQ ID NO: 372999 - DNA, 20 bp, Homo sapiens
acagataatgcttttactaa

SEQ ID NO: 373000 - DNA, 19 bp, Homo sapiens
acagatactgaaacatttg

SEQ ID NO: 373001 - DNA, 14 bp, Homo sapiens
acagatataaatgg

SEQ ID NO: 373002 - DNA, 17 bp, Homo sapiens
acagatattccagacca

SEQ ID NO: 373003 - DNA, 18 bp, Homo sapiens
acagatattgttataaat

SEQ ID NO: 373004 - DNA, 17 bp, Homo sapiens
acagatcagaacatgaa

SEQ ID NO: 373005 - DNA, 16 bp, Homo sapiens
acagatccgcatgtgt

SEQ ID NO: 373006 - DNA, 23 bp, Homo sapiens
acagatccgcatgtgtctgtatt

SEQ ID NO: 373007 - DNA, 15 bp, Homo sapiens
acagatcctccattt

SEQ ID NO: 373008 - DNA, 14 bp, Homo sapiens
acagatcctctggg

SEQ ID NO: 373009 - DNA, 12 bp, Homo sapiens
acagatgaaaat

SEQ ID NO: 373010 - DNA, 13 bp, Homo sapiens
acagatgagaaga

SEQ ID NO: 373011 - DNA, 21 bp, Homo sapiens
acagatgagaagactagcagc

SEQ ID NO: 373012 - DNA, 21 bp, Homo sapiens
acagatgccatggcctgtgct

SEQ ID NO: 373013 - DNA, 21 bp, Homo sapiens
acagatgccccagagctgttt

SEQ ID NO: 373014 - DNA, 17 bp, Homo sapiens
acagatgctaataaact

SEQ ID NO: 373015 - DNA, 20 bp, Homo sapiens
acagatgctaataaactgtt

SEQ ID NO: 373016 - DNA, 13 bp, Homo sapiens
acagatggctgtg

SEQ ID NO: 373017 - DNA, 14 bp, Homo sapiens
acagatggctgtga

SEQ ID NO: 373018 - DNA, 16 bp, Homo sapiens
acagatgggcaaatta

SEQ ID NO: 373019 - DNA, 18 bp, Homo sapiens
acagatgggtattaaact

SEQ ID NO: 373020 - DNA, 20 bp, Homo sapiens
acagatgggtattaaacttg

SEQ ID NO: 373021 - DNA, 20 bp, Homo sapiens
acagatgtcagccgagccgg

SEQ ID NO: 373022 - DNA, 14 bp, Homo sapiens
acagatgtgcccag

SEQ ID NO: 373023 - DNA, 15 bp, Homo sapiens
acagattaaacttca

SEQ ID NO: 373024 - DNA, 13 bp, Homo sapiens
acagattgcctcc

SEQ ID NO: 373025 - DNA, 16 bp, Homo sapiens
acagattgcctcctta

SEQ ID NO: 373026 - DNA, 17 bp, Homo sapiens
acagattgctacacaca

SEQ ID NO: 373027 - DNA, 16 bp, Homo sapiens
acagattgctgcttct

SEQ ID NO: 373028 - DNA, 16 bp, Homo sapiens
acagatttgttcattc

SEQ ID NO: 373029 - DNA, 21 bp, Homo sapiens
acagcaaaaccattgcttcac

SEQ ID NO: 373030 - DNA, 22 bp, Homo sapiens
acagcaaaaccattgcttcact

SEQ ID NO: 373031 - DNA, 17 bp, Homo sapiens
acagcaagtttataaaa

SEQ ID NO: 373032 - DNA, 20 bp, Homo sapiens
acagcactactctgtgccag

SEQ ID NO: 373033 - DNA, 18 bp, Homo sapiens
acagcagcccctgcacaa

SEQ ID NO: 373034 - DNA, 16 bp, Homo sapiens
acagcagcctctgaag

SEQ ID NO: 373035 - DNA, 17 bp, Homo sapiens
acagcaggatgtgcctg

SEQ ID NO: 373036 - DNA, 15 bp, Homo sapiens
acagcaggcccacct

SEQ ID NO: 373037 - DNA, 19 bp, Homo sapiens
acagcaggcccacctacct

SEQ ID NO: 373038 - DNA, 17 bp, Homo sapiens
acagcagtacttgctca

SEQ ID NO: 373039 - DNA, 19 bp, Homo sapiens
acagcagtatgaatgatgt

SEQ ID NO: 373040 - DNA, 16 bp, Homo sapiens
acagcagtgtcatcag

SEQ ID NO: 373041 - DNA, 20 bp, Homo sapiens
acagcatcaatagaaagtca

SEQ ID NO: 373042 - DNA, 20 bp, Homo sapiens
acagcatctgttacggttaa

SEQ ID NO: 373043 - DNA, 13 bp, Homo sapiens
acagcatgcccct

SEQ ID NO: 373044 - DNA, 15 bp, Homo sapiens
acagcatgccccttg

SEQ ID NO: 373045 - DNA, 19 bp, Homo sapiens
acagcatgccccttggctg

SEQ ID NO: 373046 - DNA, 13 bp, Homo sapiens
acagcatgtgtat

SEQ ID NO: 373047 - DNA, 17 bp, Homo sapiens
acagccaagacccaaca

SEQ ID NO: 373048 - DNA, 16 bp, Homo sapiens
acagccaagcccaccc

SEQ ID NO: 373049 - DNA, 17 bp, Homo sapiens
acagccaagcccaccct

SEQ ID NO: 373050 - DNA, 21 bp, Homo sapiens
acagccaagcccaccctggga

SEQ ID NO: 373051 - DNA, 23 bp, Homo sapiens
acagtatgtgtctagcaaagcca

SEQ ID NO: 373052 - DNA, 19 bp, Homo sapiens
acagtattaacatcaaaga

SEQ ID NO: 373053 - DNA, 16 bp, Homo sapiens
acagtattcgtgaata

SEQ ID NO: 373054 - DNA, 18 bp, Homo sapiens
acagtattctcagtgctc

SEQ ID NO: 373055 - DNA, 14 bp, Homo sapiens
acagtattctgtac

SEQ ID NO: 373056 - DNA, 13 bp, Homo sapiens
acagtattgccac

SEQ ID NO: 373057 - DNA, 16 bp, Homo sapiens
acagtatttccacaat

SEQ ID NO: 373058 - DNA, 17 bp, Homo sapiens
acagtcacatgcttgat

SEQ ID NO: 373059 - DNA, 20 bp, Homo sapiens
acagtcagatttccagtctc

SEQ ID NO: 373060 - DNA, 13 bp, Homo sapiens
acagtcaggaagc

SEQ ID NO: 373061 - DNA, 15 bp, Homo sapiens
acagtcaggacacat

SEQ ID NO: 373062 - DNA, 20 bp, Homo sapiens
acagtcaggctactaaaata

SEQ ID NO: 373063 - DNA, 13 bp, Homo sapiens
acagtcatttaaa

SEQ ID NO: 373064 - DNA, 22 bp, Homo sapiens
acagtcccagcacatttcctct

SEQ ID NO: 373065 - DNA, 19 bp, Homo sapiens
acagtcctaactggtatag

SEQ ID NO: 373066 - DNA, 19 bp, Homo sapiens
acagtcctcacagcctctc

SEQ ID NO: 373067 - DNA, 20 bp, Homo sapiens
acagtcctcacagcctctcc

SEQ ID NO: 373068 - DNA, 22 bp, Homo sapiens
acagtcctcacagcctctccct

SEQ ID NO: 373069 - DNA, 23 bp, Homo sapiens
acagtccttcaaaatccttccaa

SEQ ID NO: 373070 - DNA, 14 bp, Homo sapiens
acagtctcaatttt

SEQ ID NO: 373071 - DNA, 21 bp, Homo sapiens
acagtctcaattttgtattta

SEQ ID NO: 373072 - DNA, 18 bp, Homo sapiens
acagtctcattacagatt

SEQ ID NO: 373073 - DNA, 18 bp, Homo sapiens
acagtctctccctggggt

SEQ ID NO: 373074 - DNA, 23 bp, Homo sapiens
acagtgaaattttggtgaatgtg

SEQ ID NO: 373075 - DNA, 13 bp, Homo sapiens
acagtgaacagct

SEQ ID NO: 373076 - DNA, 16 bp, Homo sapiens
acagtgaatttaagca

SEQ ID NO: 373077 - DNA, 20 bp, Homo sapiens
acagtgagagtactcacttt

SEQ ID NO: 373078 - DNA, 19 bp, Homo sapiens
acagtgatctccatatgtt

SEQ ID NO: 373079 - DNA, 22 bp, Homo sapiens
acagtgatttttttttagaaca

SEQ ID NO: 373080 - DNA, 18 bp, Homo sapiens
acagtgcatctcagccca

SEQ ID NO: 373081 - DNA, 18 bp, Homo sapiens
acagtgcctgggaatgta

SEQ ID NO: 373082 - DNA, 12 bp, Homo sapiens
acagtgccttct

SEQ ID NO: 373083 - DNA, 15 bp, Homo sapiens
acagtgctcagttgt

SEQ ID NO: 373084 - DNA, 16 bp, Homo sapiens
acagtgctgaccccag

SEQ ID NO: 373085 - DNA, 19 bp, Homo sapiens
acagtgctgaccccaggaa

SEQ ID NO: 373086 - DNA, 15 bp, Homo sapiens
acagtgctgttggtg

SEQ ID NO: 373087 - DNA, 15 bp, Homo sapiens
acagtggattgctca

SEQ ID NO: 373088 - DNA, 15 bp, Homo sapiens
acagtggcagcaaag

SEQ ID NO: 373089 - DNA, 16 bp, Homo sapiens
acagtggcagcaaagg

SEQ ID NO: 373090 - DNA, 19 bp, Homo sapiens
acagtggcagcaaaggaag

SEQ ID NO: 373091 - DNA, 20 bp, Homo sapiens
acagtggcagcaaaggaaga

SEQ ID NO: 373092 - DNA, 12 bp, Homo sapiens
acagtggctggg

SEQ ID NO: 373093 - DNA, 18 bp, Homo sapiens
acagtggctgggtgggcc

SEQ ID NO: 373094 - DNA, 22 bp, Homo sapiens
acagtggctgggtgggcccaga

SEQ ID NO: 373095 - DNA, 14 bp, Homo sapiens
acagtgggagccct

SEQ ID NO: 373096 - DNA, 15 bp, Homo sapiens
acagtgggagccctg

SEQ ID NO: 373097 - DNA, 20 bp, Homo sapiens
acagtgggccggccccaggc

SEQ ID NO: 373098 - DNA, 18 bp, Homo sapiens
acagtgggggtgcctggt

SEQ ID NO: 373099 - DNA, 23 bp, Homo sapiens
acagtgggggtgcctggtgcgct

SEQ ID NO: 373100 - DNA, 19 bp, Homo sapiens
acagtggttctacaatcta

SEQ ID NO: 373101 - DNA, 20 bp, Homo sapiens
acagtgtatctcgaagtctt

SEQ ID NO: 373102 - DNA, 23 bp, Homo sapiens
acagtgtctgtgccatggatttc

SEQ ID NO: 373103 - DNA, 20 bp, Homo sapiens
acagtgtggcttaaacattt

SEQ ID NO: 373104 - DNA, 17 bp, Homo sapiens
acagtgttctgagcccc

SEQ ID NO: 373105 - DNA, 18 bp, Homo sapiens
acagtgtttcccataatt

SEQ ID NO: 373106 - DNA, 13 bp, Homo sapiens
acagttaactttc

SEQ ID NO: 373107 - DNA, 15 bp, Homo sapiens
acagttaagagaaat

SEQ ID NO: 373108 - DNA, 14 bp, Homo sapiens
acagttaattatgt

SEQ ID NO: 373109 - DNA, 17 bp, Homo sapiens
acagttacttccttcct

SEQ ID NO: 373110 - DNA, 18 bp, Homo sapiens
acagttacttccttcctg

SEQ ID NO: 373111 - DNA, 13 bp, Homo sapiens
acagttatacata

SEQ ID NO: 373112 - DNA, 18 bp, Homo sapiens
acagttattaaaatgtta

SEQ ID NO: 373113 - DNA, 18 bp, Homo sapiens
acagttcacaaacagtaa

SEQ ID NO: 373114 - DNA, 16 bp, Homo sapiens
acagttcataaatttg

SEQ ID NO: 373115 - DNA, 17 bp, Homo sapiens
acagttctctccttctt

SEQ ID NO: 373116 - DNA, 19 bp, Homo sapiens
acagttcttcgggaagaga

SEQ ID NO: 373117 - DNA, 21 bp, Homo sapiens
acagttgactggctttcctct

SEQ ID NO: 373118 - DNA, 21 bp, Homo sapiens
acagttggcagagaaggcctc

SEQ ID NO: 373119 - DNA, 17 bp, Homo sapiens
acagttgtaccactgct

SEQ ID NO: 373120 - DNA, 20 bp, Homo sapiens
acagttgtctagagatatat

SEQ ID NO: 373121 - DNA, 19 bp, Homo sapiens
acagttgtctattctgagc

SEQ ID NO: 373122 - DNA, 21 bp, Homo sapiens
acagttgtctattctgagcct

SEQ ID NO: 373123 - DNA, 24 bp, Homo sapiens
acagttgtttcagaaagagctctc

SEQ ID NO: 373124 - DNA, 19 bp, Homo sapiens
acagtttcttttttcttac

SEQ ID NO: 373125 - DNA, 19 bp, Homo sapiens
acagttttaaagaatcatt

SEQ ID NO: 373126 - DNA, 15 bp, Homo sapiens
acagttttgaaagaa

SEQ ID NO: 373127 - DNA, 17 bp, Homo sapiens
acataaagaaacacttt

SEQ ID NO: 373128 - DNA, 17 bp, Homo sapiens
acataaagtaaatgcta

SEQ ID NO: 373129 - DNA, 14 bp, Homo sapiens
aaacacacagtatt

SEQ ID NO: 373130 - DNA, 23 bp, Homo sapiens
aaacacaccaggctgtgggcctc

SEQ ID NO: 373131 - DNA, 14 bp, Homo sapiens
aaacacacttttgc

SEQ ID NO: 373132 - DNA, 16 bp, Homo sapiens
aaacacacttttgcac

SEQ ID NO: 373133 - DNA, 17 bp, Homo sapiens
aaacacatacaaaagaa

SEQ ID NO: 373134 - DNA, 22 bp, Homo sapiens
aaacacatagattcacctgtaa

SEQ ID NO: 373135 - DNA, 14 bp, Homo sapiens
aaacacatcttccc

SEQ ID NO: 373136 - DNA, 13 bp, Homo sapiens
aaacacattgcct

SEQ ID NO: 373137 - DNA, 18 bp, Homo sapiens
aaacaccaagagtacagg

SEQ ID NO: 373138 - DNA, 16 bp, Homo sapiens
aaacaccacttaatct

SEQ ID NO: 373139 - DNA, 24 bp, Homo sapiens
aaacaccacttaatcttctctctt

SEQ ID NO: 373140 - DNA, 16 bp, Homo sapiens
aaacaccattattcca

SEQ ID NO: 373141 - DNA, 22 bp, Homo sapiens
aaacacctaagtgactaccact

SEQ ID NO: 373142 - DNA, 13 bp, Homo sapiens
aaacacctgacac

SEQ ID NO: 373143 - DNA, 14 bp, Homo sapiens
aaacactcagctgt

SEQ ID NO: 373144 - DNA, 15 bp, Homo sapiens
aaacactcagctgtt

SEQ ID NO: 373145 - DNA, 22 bp, Homo sapiens
aaacactcgtgtgcatgagaat

SEQ ID NO: 373146 - DNA, 16 bp, Homo sapiens
aaacactttcctggat

SEQ ID NO: 373147 - DNA, 12 bp, Homo sapiens
aaacagaaaaaa

SEQ ID NO: 373148 - DNA, 14 bp, Homo sapiens
aaacagaacatttc

SEQ ID NO: 373149 - DNA, 19 bp, Homo sapiens
aaacagaggatgctgaagt

SEQ ID NO: 373150 - DNA, 18 bp, Homo sapiens
aaacagatgagaagacta

SEQ ID NO: 373151 - DNA, 14 bp, Homo sapiens
aaacagatgtccct

SEQ ID NO: 373152 - DNA, 15 bp, Homo sapiens
aaacagatgtccctg

SEQ ID NO: 373153 - DNA, 13 bp, Homo sapiens
aaacagccactga

SEQ ID NO: 373154 - DNA, 21 bp, Homo sapiens
aaacagcttcatgcctttgta

SEQ ID NO: 373155 - DNA, 16 bp, Homo sapiens
aaacaggaaaaaaact

SEQ ID NO: 373156 - DNA, 18 bp, Homo sapiens
aaacaggaaaaaaacttt

SEQ ID NO: 373157 - DNA, 12 bp, Homo sapiens
aaacaggagaga

SEQ ID NO: 373158 - DNA, 11 bp, Homo sapiens
aaacaggcagt

SEQ ID NO: 373159 - DNA, 19 bp, Homo sapiens
aaacagggcatctccagga

SEQ ID NO: 373160 - DNA, 17 bp, Homo sapiens
aaacagggggaaaatgt

SEQ ID NO: 373161 - DNA, 18 bp, Homo sapiens
aaacagtgaatttaagca

SEQ ID NO: 373162 - DNA, 19 bp, Homo sapiens
aaacagtgtggcttaaaca

SEQ ID NO: 373163 - DNA, 23 bp, Homo sapiens
aaacagttgtaccactgctaata

SEQ ID NO: 373164 - DNA, 13 bp, Homo sapiens
aaacataaaaagt

SEQ ID NO: 373165 - DNA, 14 bp, Homo sapiens
aaacataaaatgag

SEQ ID NO: 373166 - DNA, 22 bp, Homo sapiens
aaacataatagaatttcctaat

SEQ ID NO: 373167 - DNA, 18 bp, Homo sapiens
aaacatagagggagagag

SEQ ID NO: 373168 - DNA, 13 bp, Homo sapiens
aaacatatttgtg

SEQ ID NO: 373169 - DNA, 16 bp, Homo sapiens
aaacatcaaataaatt

SEQ ID NO: 373170 - DNA, 18 bp, Homo sapiens
aaacatcaaataaatttc

SEQ ID NO: 373171 - DNA, 14 bp, Homo sapiens
aaacatcacacaca

SEQ ID NO: 373172 - DNA, 16 bp, Homo sapiens
aaacatcagacctgtc

SEQ ID NO: 373173 - DNA, 13 bp, Homo sapiens
aaacatgaaaaca

SEQ ID NO: 373174 - DNA, 17 bp, Homo sapiens
aaacatgaaaacattga

SEQ ID NO: 373175 - DNA, 12 bp, Homo sapiens
aaacatgtcatg

SEQ ID NO: 373176 - DNA, 21 bp, Homo sapiens
aaacattaaaagaagactgga

SEQ ID NO: 373177 - DNA, 13 bp, Homo sapiens
aaacattaaacac

SEQ ID NO: 373178 - DNA, 21 bp, Homo sapiens
aaacattaaacactgtaatct

SEQ ID NO: 373179 - DNA, 14 bp, Homo sapiens
aaacattagaagaa

SEQ ID NO: 373180 - DNA, 23 bp, Homo sapiens
aaacattagaagaaaacatatat

SEQ ID NO: 373181 - DNA, 18 bp, Homo sapiens
aaactttagggtaaaaat

SEQ ID NO: 373182 - DNA, 21 bp, Homo sapiens
aaactttattttatataataa

SEQ ID NO: 373183 - DNA, 19 bp, Homo sapiens
aaactttgatctctgctta

SEQ ID NO: 373184 - DNA, 14 bp, Homo sapiens
aaactttgctaaat

SEQ ID NO: 373185 - DNA, 16 bp, Homo sapiens
aaactttgtgcctttg

SEQ ID NO: 373186 - DNA, 14 bp, Homo sapiens
aaacttttataaat

SEQ ID NO: 373187 - DNA, 21 bp, Homo sapiens
aaacttttataaattaaatat

SEQ ID NO: 373188 - DNA, 13 bp, Homo sapiens
aaagaaaacattc

SEQ ID NO: 373189 - DNA, 9 bp, Homo sapiens
aaagaaaag

SEQ ID NO: 373190 - DNA, 18 bp, Homo sapiens
aaagaaaagaatgtacat

SEQ ID NO: 373191 - DNA, 12 bp, Homo sapiens
aaagaaacacaa

SEQ ID NO: 373192 - DNA, 16 bp, Homo sapiens
aaagaaacactttctt

SEQ ID NO: 373193 - DNA, 15 bp, Homo sapiens
aaagaaacagctttc

SEQ ID NO: 373194 - DNA, 21 bp, Homo sapiens
aaagaaaccatgcaaagcaac

SEQ ID NO: 373195 - DNA, 20 bp, Homo sapiens
aaagaaaccgtaattttatt

SEQ ID NO: 373196 - DNA, 22 bp, Homo sapiens
aaagaaaccgtaattttattat

SEQ ID NO: 373197 - DNA, 17 bp, Homo sapiens
aaagaaagggttctgta

SEQ ID NO: 373198 - DNA, 17 bp, Homo sapiens
aaagaacaacacttgtt

SEQ ID NO: 373199 - DNA, 24 bp, Homo sapiens
aaagaacccatttgccatgctgct

SEQ ID NO: 373200 - DNA, 21 bp, Homo sapiens
aaagaactccttattttgtat

SEQ ID NO: 373201 - DNA, 13 bp, Homo sapiens
aaagaagaaagtc

SEQ ID NO: 373202 - DNA, 16 bp, Homo sapiens
aaagaagaaagtctat

SEQ ID NO: 373203 - DNA, 16 bp, Homo sapiens
aaagaagaacagctgt

SEQ ID NO: 373204 - DNA, 18 bp, Homo sapiens
aaagaagacacacagcca

SEQ ID NO: 373205 - DNA, 12 bp, Homo sapiens
aaagaagatgtt

SEQ ID NO: 373206 - DNA, 17 bp, Homo sapiens
aaagaagcactctgctg

SEQ ID NO: 373207 - DNA, 20 bp, Homo sapiens
aaagaagtttgggctaacat

SEQ ID NO: 373208 - DNA, 14 bp, Homo sapiens
aaagaatacatttt

SEQ ID NO: 373209 - DNA, 21 bp, Homo sapiens
aaagaatagggagacaatcta

SEQ ID NO: 373210 - DNA, 15 bp, Homo sapiens
aaagaatcattattt

SEQ ID NO: 373211 - DNA, 18 bp, Homo sapiens
aaagaatcattatttatt

SEQ ID NO: 373212 - DNA, 19 bp, Homo sapiens
aaagaatcattatttatta

SEQ ID NO: 373213 - DNA, 13 bp, Homo sapiens
aaagaatgagaaa

SEQ ID NO: 373214 - DNA, 15 bp, Homo sapiens
aaagaatgagaaaga

SEQ ID NO: 373215 - DNA, 22 bp, Homo sapiens
aaagaattatttttgtgtttct

SEQ ID NO: 373216 - DNA, 18 bp, Homo sapiens
aaagaattcctacaatat

SEQ ID NO: 373217 - DNA, 17 bp, Homo sapiens
aaagacaaacaccttat

SEQ ID NO: 373218 - DNA, 22 bp, Homo sapiens
aaagacacacaggagtcctttc

SEQ ID NO: 373219 - DNA, 20 bp, Homo sapiens
aaagaccctgagactccaga

SEQ ID NO: 373220 - DNA, 15 bp, Homo sapiens
aaagacctgcctgtg

SEQ ID NO: 373221 - DNA, 14 bp, Homo sapiens
aaagactaatttaa

SEQ ID NO: 373222 - DNA, 20 bp, Homo sapiens
aaagactgaaagaatacatt

SEQ ID NO: 373223 - DNA, 20 bp, Homo sapiens
aaagacttagtatattttct

SEQ ID NO: 373224 - DNA, 22 bp, Homo sapiens
aaagacttgatgaataaacact

SEQ ID NO: 373225 - DNA, 19 bp, Homo sapiens
aaagactttgatgtgtttt

SEQ ID NO: 373226 - DNA, 21 bp, Homo sapiens
aaagagaaaggggcaagaaat

SEQ ID NO: 373227 - DNA, 15 bp, Homo sapiens
aaagagaaggcctgg

SEQ ID NO: 373228 - DNA, 19 bp, Homo sapiens
aaagagaattacttatatt

SEQ ID NO: 373229 - DNA, 14 bp, Homo sapiens
aaagagacaaatag

SEQ ID NO: 373230 - DNA, 13 bp, Homo sapiens
aaagagagaaaac

SEQ ID NO: 373231 - DNA, 22 bp, Homo sapiens
aaagagagaaaacttatttgag

SEQ ID NO: 373232 - DNA, 23 bp, Homo sapiens
aaagagagaaccaagcttgtctt

SEQ ID NO: 373233 - DNA, 19 bp, Homo sapiens
aaagagccaagttcaaaga

SEQ ID NO: 373234 - DNA, 23 bp, Homo sapiens
aaagagctaggaaagagttgagc

SEQ ID NO: 373235 - DNA, 22 bp, Homo sapiens
aaagagctttagtcctagagga

SEQ ID NO: 373236 - DNA, 18 bp, Homo sapiens
aaagaggaaattaaataa

SEQ ID NO: 373237 - DNA, 16 bp, Homo sapiens
aaagaggagaaggaga

SEQ ID NO: 373238 - DNA, 19 bp, Homo sapiens
aaagaggagaaggagaggg

SEQ ID NO: 373239 - DNA, 21 bp, Homo sapiens
aaagaggagaaggagagggag

SEQ ID NO: 373240 - DNA, 16 bp, Homo sapiens
aaagaggagaccctgg

SEQ ID NO: 373241 - DNA, 18 bp, Homo sapiens
aaagaggcgtcttgtatt

SEQ ID NO: 373242 - DNA, 21 bp, Homo sapiens
aaagaggcgtcttgtattttc

SEQ ID NO: 373243 - DNA, 16 bp, Homo sapiens
aaagaggctgaaagag

SEQ ID NO: 373244 - DNA, 19 bp, Homo sapiens
aaagaggctgaggcctgga

SEQ ID NO: 373245 - DNA, 21 bp, Homo sapiens
aaagagtatcaaaggcagaaa

SEQ ID NO: 373246 - DNA, 21 bp, Homo sapiens
aaagagtcttaattttctaaa

SEQ ID NO: 373247 - DNA, 22 bp, Homo sapiens
aaagagttatatgacttcttgt

SEQ ID NO: 373248 - DNA, 14 bp, Homo sapiens
aaagagttgagcac

SEQ ID NO: 373249 - DNA, 19 bp, Homo sapiens
aaagagttggcatgaaagt

SEQ ID NO: 373250 - DNA, 13 bp, Homo sapiens
aaagataaagatg

SEQ ID NO: 373251 - DNA, 15 bp, Homo sapiens
aaagataaagatgat

SEQ ID NO: 373252 - DNA, 19 bp, Homo sapiens
aaagataacgcaggagaga

SEQ ID NO: 373253 - DNA, 21 bp, Homo sapiens
aaagataacgcaggagagaga

SEQ ID NO: 373254 - DNA, 22 bp, Homo sapiens
aaagataacgcaggagagagag

SEQ ID NO: 373255 - DNA, 17 bp, Homo sapiens
aaagataatattactgt

SEQ ID NO: 373256 - DNA, 15 bp, Homo sapiens
aaagatacatttgta

SEQ ID NO: 373257 - DNA, 19 bp, Homo sapiens
aaagatacttgatgcactt

SEQ ID NO: 373258 - DNA, 20 bp, Homo sapiens
aaagatacttgatgcactta

SEQ ID NO: 373259 - DNA, 21 bp, Homo sapiens
aaagatacttgatgcacttat

SEQ ID NO: 373260 - DNA, 17 bp, Homo sapiens
aaagatcaaaataaaaa

SEQ ID NO: 373261 - DNA, 12 bp, Homo sapiens
aaagatggattt

SEQ ID NO: 373262 - DNA, 15 bp, Homo sapiens
aaagatgtactgaga

SEQ ID NO: 373263 - DNA, 12 bp, Homo sapiens
aaagattatgta

SEQ ID NO: 373264 - DNA, 21 bp, Homo sapiens
aaagattctttaaactactga

SEQ ID NO: 373265 - DNA, 13 bp, Homo sapiens
aaagattgtgtct

SEQ ID NO: 373266 - DNA, 20 bp, Homo sapiens
aaagatttaagcacaaactt

SEQ ID NO: 373267 - DNA, 23 bp, Homo sapiens
aaagaaatccatatcttaaagaa

SEQ ID NO: 373268 - DNA, 21 bp, Homo sapiens
aaagaaatgctaatgtaatca

SEQ ID NO: 373269 - DNA, 12 bp, Homo sapiens
aaagaacaaaaa

SEQ ID NO: 373270 - DNA, 16 bp, Homo sapiens
aaagaacccccctccc

SEQ ID NO: 373271 - DNA, 17 bp, Homo sapiens
aaagaacccccctcccc

SEQ ID NO: 373272 - DNA, 18 bp, Homo sapiens
aaagaacggcatgtgaat

SEQ ID NO: 373273 - DNA, 16 bp, Homo sapiens
aaagaactccttattt

SEQ ID NO: 373274 - DNA, 13 bp, Homo sapiens
aaagaactgcccc

SEQ ID NO: 373275 - DNA, 12 bp, Homo sapiens
aaagaagaacag

SEQ ID NO: 373276 - DNA, 15 bp, Homo sapiens
aaagaagaacagctg

SEQ ID NO: 373277 - DNA, 19 bp, Homo sapiens
aaagaagagtttacagaca

SEQ ID NO: 373278 - DNA, 14 bp, Homo sapiens
aaagaagtcaaatg

SEQ ID NO: 373279 - DNA, 19 bp, Homo sapiens
aaagaagtgtccgagaact

SEQ ID NO: 373280 - DNA, 21 bp, Homo sapiens
aaagaagtgtccgagaactaa

SEQ ID NO: 373281 - DNA, 18 bp, Homo sapiens
aaagaatagtgcctcagc

SEQ ID NO: 373282 - DNA, 22 bp, Homo sapiens
aaagaatggctgactgttgcct

SEQ ID NO: 373283 - DNA, 23 bp, Homo sapiens
aaagaattatttttgtgtttcta

SEQ ID NO: 373284 - DNA, 9 bp, Homo sapiens
aaagacaga

SEQ ID NO: 373285 - DNA, 16 bp, Homo sapiens
aaagacaggaagacca

SEQ ID NO: 373286 - DNA, 22 bp, Homo sapiens
aaagacagtggatcatgaaaag

SEQ ID NO: 373287 - DNA, 14 bp, Homo sapiens
aaagacatgaaatt

SEQ ID NO: 373288 - DNA, 13 bp, Homo sapiens
aaagacatttcaa

SEQ ID NO: 373289 - DNA, 19 bp, Homo sapiens
aaagaccaatgtgaagaca

SEQ ID NO: 373290 - DNA, 20 bp, Homo sapiens
aaagactaatttaaaaaata

SEQ ID NO: 373291 - DNA, 16 bp, Homo sapiens
aaagactagtttgtta

SEQ ID NO: 373292 - DNA, 14 bp, Homo sapiens
aaagactcagccaa

SEQ ID NO: 373293 - DNA, 13 bp, Homo sapiens
aaagactgtactg

SEQ ID NO: 373294 - DNA, 14 bp, Homo sapiens
aaagactgtactgg

SEQ ID NO: 373295 - DNA, 13 bp, Homo sapiens
aaagacttaagat

SEQ ID NO: 373296 - DNA, 15 bp, Homo sapiens
aaagacttaagatta

SEQ ID NO: 373297 - DNA, 15 bp, Homo sapiens
aaagacttcatgttc

SEQ ID NO: 373298 - DNA, 18 bp, Homo sapiens
aaagacttgatgaataaa

SEQ ID NO: 373299 - DNA, 20 bp, Homo sapiens
aaagacttgatgaataaaca

SEQ ID NO: 373300 - DNA, 15 bp, Homo sapiens
aaagagaaaaaccaa

SEQ ID NO: 373301 - DNA, 10 bp, Homo sapiens
aaagagaagg

SEQ ID NO: 373302 - DNA, 18 bp, Homo sapiens
aaagagaataaagacttc

SEQ ID NO: 373303 - DNA, 20 bp, Homo sapiens
aaagagaatgccattctctt

SEQ ID NO: 373304 - DNA, 15 bp, Homo sapiens
aaagagaattactta

SEQ ID NO: 373305 - DNA, 13 bp, Homo sapiens
aaagagagaatgt

SEQ ID NO: 373306 - DNA, 13 bp, Homo sapiens
aaagagagagaga

SEQ ID NO: 373307 - DNA, 11 bp, Homo sapiens
aaagagaggtt

SEQ ID NO: 373308 - DNA, 12 bp, Homo sapiens
aaagagaggtta

SEQ ID NO: 373309 - DNA, 20 bp, Homo sapiens
aaagagccaagttcaaagaa

SEQ ID NO: 373310 - DNA, 15 bp, Homo sapiens
aaagagctgttttgg

SEQ ID NO: 373311 - DNA, 19 bp, Homo sapiens
aaagaggaaattaaataat

SEQ ID NO: 373312 - DNA, 16 bp, Homo sapiens
aaagaggaagccttgc

SEQ ID NO: 373313 - DNA, 22 bp, Homo sapiens
aaagaggaagccttgcccagca

SEQ ID NO: 373314 - DNA, 12 bp, Homo sapiens
aaagaggagaag

SEQ ID NO: 373315 - DNA, 22 bp, Homo sapiens
aaagaggagaaggagagggagt

SEQ ID NO: 373316 - DNA, 15 bp, Homo sapiens
aaagaggcacagagc

SEQ ID NO: 373317 - DNA, 24 bp, Homo sapiens
aaagaggtgctgctttgcttcttc

SEQ ID NO: 373318 - DNA, 22 bp, Homo sapiens
aaagagtatcaaaggcagaaag

SEQ ID NO: 373319 - DNA, 23 bp, Homo sapiens
aaagagttctggaaaagaactgt

SEQ ID NO: 373320 - DNA, 16 bp, Homo sapiens
aaagatacgactttat

SEQ ID NO: 373321 - DNA, 12 bp, Homo sapiens
aaagatattatt

SEQ ID NO: 373322 - DNA, 15 bp, Homo sapiens
aaagatcaaaataaa

SEQ ID NO: 373323 - DNA, 13 bp, Homo sapiens
aaagatcccaaat

SEQ ID NO: 373324 - DNA, 21 bp, Homo sapiens
aaagatctttcgttggttgtt

SEQ ID NO: 373325 - DNA, 16 bp, Homo sapiens
aaagatgattttgctt

SEQ ID NO: 373326 - DNA, 20 bp, Homo sapiens
aaagatgcaaggaccaggac

SEQ ID NO: 373327 - DNA, 21 bp, Homo sapiens
aaagatgcagccgccttcctt

SEQ ID NO: 373328 - DNA, 21 bp, Homo sapiens
aaagatggatttgacacactc

SEQ ID NO: 373329 - DNA, 22 bp, Homo sapiens
aaagatggatttgacacactca

SEQ ID NO: 373330 - DNA, 21 bp, Homo sapiens
aaagatggctgtgcctctgcc

SEQ ID NO: 373331 - DNA, 18 bp, Homo sapiens
aaagatgtactgagagga

SEQ ID NO: 373332 - DNA, 21 bp, Homo sapiens
aaagatgtcaaatatctcaga

SEQ ID NO: 373333 - DNA, 13 bp, Homo sapiens
aaagattcactaa

SEQ ID NO: 373334 - DNA, 14 bp, Homo sapiens
aaagattctctgcg

SEQ ID NO: 373335 - DNA, 12 bp, Homo sapiens
aaagattcttta

SEQ ID NO: 373336 - DNA, 18 bp, Homo sapiens
aaagattctttaaactac

SEQ ID NO: 373337 - DNA, 14 bp, Homo sapiens
aaagattgtgtctg

SEQ ID NO: 373338 - DNA, 13 bp, Homo sapiens
aaagattttcaga

SEQ ID NO: 373339 - DNA, 17 bp, Homo sapiens
aaagcaaaaaataaaat

SEQ ID NO: 373340 - DNA, 15 bp, Homo sapiens
aaagcaaatcagaca

SEQ ID NO: 373341 - DNA, 17 bp, Homo sapiens
aaagcaaatcagacaca

SEQ ID NO: 373342 - DNA, 20 bp, Homo sapiens
aaagcaagggctccagcatc

SEQ ID NO: 373343 - DNA, 17 bp, Homo sapiens
aaagcaataaatgaatg

SEQ ID NO: 373344 - DNA, 14 bp, Homo sapiens
aaagcaattgccct

SEQ ID NO: 373345 - DNA, 17 bp, Homo sapiens
aaagcacaaaccctggg

SEQ ID NO: 373346 - DNA, 18 bp, Homo sapiens
aaagcacaaaccctgggg

SEQ ID NO: 373347 - DNA, 18 bp, Homo sapiens
aaagcacaaacttctgta

SEQ ID NO: 373348 - DNA, 12 bp, Homo sapiens
aaagcacatcca

SEQ ID NO: 373349 - DNA, 19 bp, Homo sapiens
aaagcacatgccagggaaa

SEQ ID NO: 373350 - DNA, 14 bp, Homo sapiens
aaagcactattgtt

SEQ ID NO: 373351 - DNA, 13 bp, Homo sapiens
aaagcagcatctg

SEQ ID NO: 373352 - DNA, 22 bp, Homo sapiens
aaagcagtagaaataatatgca

SEQ ID NO: 373353 - DNA, 18 bp, Homo sapiens
aaagcagtagacaatccc

SEQ ID NO: 373354 - DNA, 13 bp, Homo sapiens
aaagcagtgcatg

SEQ ID NO: 373355 - DNA, 13 bp, Homo sapiens
aaagcagtgtttt

SEQ ID NO: 373356 - DNA, 21 bp, Homo sapiens
aaagcagttgggagtacatat

SEQ ID NO: 373357 - DNA, 16 bp, Homo sapiens
aaagcatcaaataata

SEQ ID NO: 373358 - DNA, 18 bp, Homo sapiens
aaagcatcaaataataca

SEQ ID NO: 373359 - DNA, 18 bp, Homo sapiens
aaagcatcacacagtggc

SEQ ID NO: 373360 - DNA, 22 bp, Homo sapiens
aaagcatgctcagtattgagac

SEQ ID NO: 373361 - DNA, 14 bp, Homo sapiens
aaagcattgcagaa

SEQ ID NO: 373362 - DNA, 17 bp, Homo sapiens
aaagccagtgactccag

SEQ ID NO: 373363 - DNA, 13 bp, Homo sapiens
aaagccatattcc

SEQ ID NO: 373364 - DNA, 22 bp, Homo sapiens
aaagccatattccagcagtgaa

SEQ ID NO: 373365 - DNA, 13 bp, Homo sapiens
aaagcccacctgg

SEQ ID NO: 373366 - DNA, 14 bp, Homo sapiens
aaagcccagcccgg

SEQ ID NO: 373367 - DNA, 23 bp, Homo sapiens
aaagcccttccatgtcgcctctg

SEQ ID NO: 373368 - DNA, 15 bp, Homo sapiens
aaagcctaagaaaaa

SEQ ID NO: 373369 - DNA, 16 bp, Homo sapiens
aaagcctaagaaaaag

SEQ ID NO: 373370 - DNA, 20 bp, Homo sapiens
aaagcctcctgccccctgcc

SEQ ID NO: 373371 - DNA, 22 bp, Homo sapiens
aaagcctcctgccccctgccag

SEQ ID NO: 373372 - DNA, 17 bp, Homo sapiens
aaagcctctgtgctgca

SEQ ID NO: 373373 - DNA, 18 bp, Homo sapiens
aaagcctgcaatttcata

SEQ ID NO: 373374 - DNA, 13 bp, Homo sapiens
aaagcctttaaat

SEQ ID NO: 373375 - DNA, 15 bp, Homo sapiens
aaagcgggcagcccc

SEQ ID NO: 373376 - DNA, 16 bp, Homo sapiens
aaagcggggggagggt

SEQ ID NO: 373377 - DNA, 21 bp, Homo sapiens
aaagctagacaaaggcccaga

SEQ ID NO: 373378 - DNA, 18 bp, Homo sapiens
aaagctagaggagattgc

SEQ ID NO: 373379 - DNA, 14 bp, Homo sapiens
aaagctaggaaagg

SEQ ID NO: 373380 - DNA, 20 bp, Homo sapiens
aaagctaggaaaggcagaaa

SEQ ID NO: 373381 - DNA, 15 bp, Homo sapiens
aaagctatatatgaa

SEQ ID NO: 373382 - DNA, 13 bp, Homo sapiens
aaagctcatattt

SEQ ID NO: 373383 - DNA, 21 bp, Homo sapiens
aaagctcatattttgtatata

SEQ ID NO: 373384 - DNA, 17 bp, Homo sapiens
aaagctctgcatgtgtg

SEQ ID NO: 373385 - DNA, 17 bp, Homo sapiens
aaagctgccatttccct

SEQ ID NO: 373386 - DNA, 18 bp, Homo sapiens
aaagctggacaagaagct

SEQ ID NO: 373387 - DNA, 17 bp, Homo sapiens
aaagtttaaataccagt

SEQ ID NO: 373388 - DNA, 16 bp, Homo sapiens
aaagtttacaacataa

SEQ ID NO: 373389 - DNA, 19 bp, Homo sapiens
aaagtttacaagtgtatat

SEQ ID NO: 373390 - DNA, 15 bp, Homo sapiens
aaagtttacagtaaa

SEQ ID NO: 373391 - DNA, 13 bp, Homo sapiens
aaagtttcaatgt

SEQ ID NO: 373392 - DNA, 18 bp, Homo sapiens
aaagtttccatgtggcct

SEQ ID NO: 373393 - DNA, 14 bp, Homo sapiens
aaagtttgtccttt

SEQ ID NO: 373394 - DNA, 23 bp, Homo sapiens
aaagttttgccccatgataaaat

SEQ ID NO: 373395 - DNA, 13 bp, Homo sapiens
aaagttttgccta

SEQ ID NO: 373396 - DNA, 22 bp, Homo sapiens
aaataaaaaaaaaaggatgaaa

SEQ ID NO: 373397 - DNA, 15 bp, Homo sapiens
aaataaaaaagatcc

SEQ ID NO: 373398 - DNA, 12 bp, Homo sapiens
aaataaaaagta

SEQ ID NO: 373399 - DNA, 15 bp, Homo sapiens
aaataaaaagtgaca

SEQ ID NO: 373400 - DNA, 20 bp, Homo sapiens
aaataaaaatattctccatg

SEQ ID NO: 373401 - DNA, 14 bp, Homo sapiens
aaataaaaatattg

SEQ ID NO: 373402 - DNA, 20 bp, Homo sapiens
aaataaaaatattgtgttgt

SEQ ID NO: 373403 - DNA, 16 bp, Homo sapiens
aaataaaaattctgaa

SEQ ID NO: 373404 - DNA, 11 bp, Homo sapiens
aaataaaacct

SEQ ID NO: 373405 - DNA, 14 bp, Homo sapiens
aaataaaacctttc

SEQ ID NO: 373406 - DNA, 15 bp, Homo sapiens
aaataaaacctttca

SEQ ID NO: 373407 - DNA, 14 bp, Homo sapiens
aaataaaactattt

SEQ ID NO: 373408 - DNA, 13 bp, Homo sapiens
aaataaaatgatg

SEQ ID NO: 373409 - DNA, 14 bp, Homo sapiens
aaataaaatgatgt

SEQ ID NO: 373410 - DNA, 15 bp, Homo sapiens
aaataaaatgcattt

SEQ ID NO: 373411 - DNA, 13 bp, Homo sapiens
aaataaaattatg

SEQ ID NO: 373412 - DNA, 22 bp, Homo sapiens
aaataaaatttaaaaaactcct

SEQ ID NO: 373413 - DNA, 18 bp, Homo sapiens
aaataaacgaaacattta

SEQ ID NO: 373414 - DNA, 15 bp, Homo sapiens
aaataaactcttcaa

SEQ ID NO: 373415 - DNA, 19 bp, Homo sapiens
aaataaagaagaaaataac

SEQ ID NO: 373416 - DNA, 20 bp, Homo sapiens
aaataaagaagaaaataacc

SEQ ID NO: 373417 - DNA, 18 bp, Homo sapiens
aaataaagaatagcaatt

SEQ ID NO: 373418 - DNA, 11 bp, Homo sapiens
aaataaagacc

SEQ ID NO: 373419 - DNA, 13 bp, Homo sapiens
aaataaagtatat

SEQ ID NO: 373420 - DNA, 15 bp, Homo sapiens
aaataaagtatcatg

SEQ ID NO: 373421 - DNA, 15 bp, Homo sapiens
aaataaataatctca

SEQ ID NO: 373422 - DNA, 19 bp, Homo sapiens
aaataaataatctcatccc

SEQ ID NO: 373423 - DNA, 14 bp, Homo sapiens
aaataaatatacta

SEQ ID NO: 373424 - DNA, 18 bp, Homo sapiens
aaataaatatactaataa

SEQ ID NO: 373425 - DNA, 13 bp, Homo sapiens
aaataaatgtgca

SEQ ID NO: 373426 - DNA, 15 bp, Homo sapiens
aaataaattgtttga

SEQ ID NO: 373427 - DNA, 13 bp, Homo sapiens
aaataaatttctg

SEQ ID NO: 373428 - DNA, 13 bp, Homo sapiens
aaataacacacat

SEQ ID NO: 373429 - DNA, 20 bp, Homo sapiens
aaataacagaattctgaagt

SEQ ID NO: 373430 - DNA, 14 bp, Homo sapiens
aaataacagtattt

SEQ ID NO: 373431 - DNA, 14 bp, Homo sapiens
aaataacatattct

SEQ ID NO: 373432 - DNA, 15 bp, Homo sapiens
aaataacatctgaaa

SEQ ID NO: 373433 - DNA, 16 bp, Homo sapiens
aaataaccaaaaaatg

SEQ ID NO: 373434 - DNA, 14 bp, Homo sapiens
aaataacctatttt

SEQ ID NO: 373435 - DNA, 14 bp, Homo sapiens
aaataagtaacata

SEQ ID NO: 373436 - DNA, 18 bp, Homo sapiens
aaataagtaacatataaa

SEQ ID NO: 373437 - DNA, 21 bp, Homo sapiens
aaataagtaacatataaatta

SEQ ID NO: 373438 - DNA, 16 bp, Homo sapiens
aaataagtaatatctt

SEQ ID NO: 373439 - DNA, 20 bp, Homo sapiens
aaataagtggttatttctca

SEQ ID NO: 373440 - DNA, 15 bp, Homo sapiens
aaataagttaaaggc

SEQ ID NO: 373441 - DNA, 21 bp, Homo sapiens
aaataataaattaacattata

SEQ ID NO: 373442 - DNA, 18 bp, Homo sapiens
aaataatataaatgaatg

SEQ ID NO: 373443 - DNA, 14 bp, Homo sapiens
aaataatatgcatt

SEQ ID NO: 373444 - DNA, 23 bp, Homo sapiens
aaataatctcatccccaaactgt

SEQ ID NO: 373445 - DNA, 13 bp, Homo sapiens
aaataattaaaac

SEQ ID NO: 373446 - DNA, 15 bp, Homo sapiens
aaataattgtgtcat

SEQ ID NO: 373447 - DNA, 20 bp, Homo sapiens
aaataattttacatgtctca

SEQ ID NO: 373448 - DNA, 22 bp, Homo sapiens
aaataattttatgaactgcatg

SEQ ID NO: 373449 - DNA, 17 bp, Homo sapiens
aaatacaaaataaaatt

SEQ ID NO: 373450 - DNA, 18 bp, Homo sapiens
aaatacaaaataaaatta

SEQ ID NO: 373451 - DNA, 13 bp, Homo sapiens
aaatacaataaac

SEQ ID NO: 373452 - DNA, 19 bp, Homo sapiens
aaatacactacaaatgtta

SEQ ID NO: 373453 - DNA, 13 bp, Homo sapiens
aaatacagtgctt

SEQ ID NO: 373454 - DNA, 20 bp, Homo sapiens
aaatacatgatgatttcaga

SEQ ID NO: 373455 - DNA, 14 bp, Homo sapiens
aaatacatgtgtgg

SEQ ID NO: 373456 - DNA, 13 bp, Homo sapiens
aaatacattccag

SEQ ID NO: 373457 - DNA, 14 bp, Homo sapiens
aaataccaaagcag

SEQ ID NO: 373458 - DNA, 14 bp, Homo sapiens
aaatactcaccaaa

SEQ ID NO: 373459 - DNA, 14 bp, Homo sapiens
aaatagaaataagt

SEQ ID NO: 373460 - DNA, 17 bp, Homo sapiens
aaatagagtatatgcac

SEQ ID NO: 373461 - DNA, 19 bp, Homo sapiens
aaatagagtttttatattt

SEQ ID NO: 373462 - DNA, 14 bp, Homo sapiens
aaatagatactttt

SEQ ID NO: 373463 - DNA, 18 bp, Homo sapiens
aaatagcaacatgcttca

SEQ ID NO: 373464 - DNA, 13 bp, Homo sapiens
aaatagctataaa

SEQ ID NO: 373465 - DNA, 19 bp, Homo sapiens
aaatagctatatccatgta

SEQ ID NO: 373466 - DNA, 15 bp, Homo sapiens
aaatagcttgtatag

SEQ ID NO: 373467 - DNA, 22 bp, Homo sapiens
aaatagggtccttgaaacagaa

SEQ ID NO: 373468 - DNA, 16 bp, Homo sapiens
aaatagggtggacaga

SEQ ID NO: 373469 - DNA, 21 bp, Homo sapiens
aaatagtaggaccaatgttgt

SEQ ID NO: 373470 - DNA, 14 bp, Homo sapiens
aaatagtatttgag

SEQ ID NO: 373471 - DNA, 23 bp, Homo sapiens
aaatagtcctccaaaacacaagg

SEQ ID NO: 373472 - DNA, 21 bp, Homo sapiens
aaatagtgcagaatctcatag

SEQ ID NO: 373473 - DNA, 17 bp, Homo sapiens
aaatagtgttgatcaga

SEQ ID NO: 373474 - DNA, 20 bp, Homo sapiens
aaatagtgttgatcagatct

SEQ ID NO: 373475 - DNA, 13 bp, Homo sapiens
aaatagttctatt

SEQ ID NO: 373476 - DNA, 15 bp, Homo sapiens
aaatagttctatttc

SEQ ID NO: 373477 - DNA, 16 bp, Homo sapiens
aaatagttctatttct

SEQ ID NO: 373478 - DNA, 17 bp, Homo sapiens
aaatagttctatttcta

SEQ ID NO: 373479 - DNA, 18 bp, Homo sapiens
aaatagtttaggagaaac

SEQ ID NO: 373480 - DNA, 12 bp, Homo sapiens
aaatataaaaat

SEQ ID NO: 373481 - DNA, 18 bp, Homo sapiens
aaatataaacaatgttca

SEQ ID NO: 373482 - DNA, 14 bp, Homo sapiens
aaatataaactgtg

SEQ ID NO: 373483 - DNA, 16 bp, Homo sapiens
aaatataaactgtgag

SEQ ID NO: 373484 - DNA, 17 bp, Homo sapiens
aaatataaactgtgaga

SEQ ID NO: 373485 - DNA, 18 bp, Homo sapiens
aaatataaactgtgagat

SEQ ID NO: 373486 - DNA, 14 bp, Homo sapiens
aaatataaattaag

SEQ ID NO: 373487 - DNA, 15 bp, Homo sapiens
aaatataaattaaga

SEQ ID NO: 373488 - DNA, 18 bp, Homo sapiens
aaatataaattaagactt

SEQ ID NO: 373489 - DNA, 18 bp, Homo sapiens
acataaagtaaatgctac

SEQ ID NO: 373490 - DNA, 13 bp, Homo sapiens
acataaatctgtc

SEQ ID NO: 373491 - DNA, 20 bp, Homo sapiens
acataaatctgtctgattct

SEQ ID NO: 373492 - DNA, 20 bp, Homo sapiens
acataaattgcataaagcat

SEQ ID NO: 373493 - DNA, 20 bp, Homo sapiens
acataacaacctttcccatt

SEQ ID NO: 373494 - DNA, 12 bp, Homo sapiens
acataacacaca

SEQ ID NO: 373495 - DNA, 18 bp, Homo sapiens
acataacaggcattgcac

SEQ ID NO: 373496 - DNA, 22 bp, Homo sapiens
acataacaggcattgcactaaa

SEQ ID NO: 373497 - DNA, 20 bp, Homo sapiens
acataacagggtaaattatt

SEQ ID NO: 373498 - DNA, 14 bp, Homo sapiens
acataaccagcggg

SEQ ID NO: 373499 - DNA, 14 bp, Homo sapiens
acataatagaattt

SEQ ID NO: 373500 - DNA, 16 bp, Homo sapiens
acataatagaatttcc

SEQ ID NO: 373501 - DNA, 21 bp, Homo sapiens
acataatccacgctcatcttg

SEQ ID NO: 373502 - DNA, 18 bp, Homo sapiens
acataatgcttaatttct

SEQ ID NO: 373503 - DNA, 12 bp, Homo sapiens
acataatttttt

SEQ ID NO: 373504 - DNA, 18 bp, Homo sapiens
acataattttttattcaa

SEQ ID NO: 373505 - DNA, 15 bp, Homo sapiens
acatacacaaatggg

SEQ ID NO: 373506 - DNA, 16 bp, Homo sapiens
acatacaggagagctg

SEQ ID NO: 373507 - DNA, 23 bp, Homo sapiens
acataccaccaccaagaaagcct

SEQ ID NO: 373508 - DNA, 13 bp, Homo sapiens
acataccatctgt

SEQ ID NO: 373509 - DNA, 22 bp, Homo sapiens
acatacctctctctatatatac

SEQ ID NO: 373510 - DNA, 14 bp, Homo sapiens
acatactgcatgta

SEQ ID NO: 373511 - DNA, 17 bp, Homo sapiens
acatacttctttcaaga

SEQ ID NO: 373512 - DNA, 21 bp, Homo sapiens
acatagatcctctgatataca

SEQ ID NO: 373513 - DNA, 13 bp, Homo sapiens
acatagatgtccc

SEQ ID NO: 373514 - DNA, 15 bp, Homo sapiens
acatagatgtccctt

SEQ ID NO: 373515 - DNA, 22 bp, Homo sapiens
acatagattcacctgtaaaact

SEQ ID NO: 373516 - DNA, 22 bp, Homo sapiens
acatagtgaattttaaaatgta

SEQ ID NO: 373517 - DNA, 21 bp, Homo sapiens
acatagtgatggttcccctgt

SEQ ID NO: 373518 - DNA, 20 bp, Homo sapiens
acatagttttaaactcattt

SEQ ID NO: 373519 - DNA, 17 bp, Homo sapiens
acaactaatcaagagtg

SEQ ID NO: 373520 - DNA, 23 bp, Homo sapiens
acaactaatcaagagtgagtgaa

SEQ ID NO: 373521 - DNA, 18 bp, Homo sapiens
acaactatcctgacttct

SEQ ID NO: 373522 - DNA, 20 bp, Homo sapiens
acaactccagccacccagcc

SEQ ID NO: 373523 - DNA, 13 bp, Homo sapiens
acaactctatttt

SEQ ID NO: 373524 - DNA, 14 bp, Homo sapiens
acaactctattttt

SEQ ID NO: 373525 - DNA, 17 bp, Homo sapiens
acaactgtctaacttta

SEQ ID NO: 373526 - DNA, 14 bp, Homo sapiens
acaacttaaaaagt

SEQ ID NO: 373527 - DNA, 15 bp, Homo sapiens
acaacttaaaaagtc

SEQ ID NO: 373528 - DNA, 16 bp, Homo sapiens
acaacttaaaaagtct

SEQ ID NO: 373529 - DNA, 14 bp, Homo sapiens
acaacttcagcagt

SEQ ID NO: 373530 - DNA, 17 bp, Homo sapiens
acaacttctaattgcca

SEQ ID NO: 373531 - DNA, 15 bp, Homo sapiens
acaacttgaattaca

SEQ ID NO: 373532 - DNA, 12 bp, Homo sapiens
acaagaaaacat

SEQ ID NO: 373533 - DNA, 13 bp, Homo sapiens
acaagaaagaaac

SEQ ID NO: 373534 - DNA, 12 bp, Homo sapiens
acaagaaagagt

SEQ ID NO: 373535 - DNA, 21 bp, Homo sapiens
acaagaaagtttccccaccag

SEQ ID NO: 373536 - DNA, 13 bp, Homo sapiens
acaagaagctgct

SEQ ID NO: 373537 - DNA, 22 bp, Homo sapiens
acaagaagtgggagtgggagag

SEQ ID NO: 373538 - DNA, 14 bp, Homo sapiens
acaagactgcctcc

SEQ ID NO: 373539 - DNA, 21 bp, Homo sapiens
acaagagacttaaaggacagg

SEQ ID NO: 373540 - DNA, 18 bp, Homo sapiens
acaagagcagcctgtggc

SEQ ID NO: 373541 - DNA, 19 bp, Homo sapiens
acaagagcagcctgtggca

SEQ ID NO: 373542 - DNA, 20 bp, Homo sapiens
acaagagcagcctgtggcat

SEQ ID NO: 373543 - DNA, 23 bp, Homo sapiens
acaagagccatgtaccagtgtac

SEQ ID NO: 373544 - DNA, 14 bp, Homo sapiens
acaagaggagcagg

SEQ ID NO: 373545 - DNA, 18 bp, Homo sapiens
acaagaggagcaggaagc

SEQ ID NO: 373546 - DNA, 17 bp, Homo sapiens
acaagagggactgtatt

SEQ ID NO: 373547 - DNA, 18 bp, Homo sapiens
acaagagtttatttccaa

SEQ ID NO: 373548 - DNA, 14 bp, Homo sapiens
acaagatttagaaa

SEQ ID NO: 373549 - DNA, 16 bp, Homo sapiens
acaagatttagaaaaa

SEQ ID NO: 373550 - DNA, 19 bp, Homo sapiens
acaagatttccctaaaaat

SEQ ID NO: 373551 - DNA, 17 bp, Homo sapiens
acaagcaaaccttctca

SEQ ID NO: 373552 - DNA, 14 bp, Homo sapiens
acaagccaacttgt

SEQ ID NO: 373553 - DNA, 19 bp, Homo sapiens
acaagccccaggcaggctg

SEQ ID NO: 373554 - DNA, 11 bp, Homo sapiens
acaagccctgg

SEQ ID NO: 373555 - DNA, 11 bp, Homo sapiens
acaagctgcct

SEQ ID NO: 373556 - DNA, 14 bp, Homo sapiens
acaaggaataaatg

SEQ ID NO: 373557 - DNA, 20 bp, Homo sapiens
acaaggaatgcctgtgccaa

SEQ ID NO: 373558 - DNA, 17 bp, Homo sapiens
acaaggagagcggagga

SEQ ID NO: 373559 - DNA, 15 bp, Homo sapiens
acaaggcaaggctgt

SEQ ID NO: 373560 - DNA, 17 bp, Homo sapiens
acaaggcaaggctgtca

SEQ ID NO: 373561 - DNA, 20 bp, Homo sapiens
acaaggcaaggctgtcaatt

SEQ ID NO: 373562 - DNA, 16 bp, Homo sapiens
acaaggcaggcctttc

SEQ ID NO: 373563 - DNA, 17 bp, Homo sapiens
acaaggcaggcctttcc

SEQ ID NO: 373564 - DNA, 19 bp, Homo sapiens
acaaggcaggcctttccta

SEQ ID NO: 373565 - DNA, 17 bp, Homo sapiens
acaaggcattcaagtgt

SEQ ID NO: 373566 - DNA, 14 bp, Homo sapiens
acaagggattctgg

SEQ ID NO: 373567 - DNA, 14 bp, Homo sapiens
acaagtaatgaatt

SEQ ID NO: 373568 - DNA, 15 bp, Homo sapiens
acaagtaattttgca

SEQ ID NO: 373569 - DNA, 17 bp, Homo sapiens
acaagtagattgatcta

SEQ ID NO: 373570 - DNA, 16 bp, Homo sapiens
acaagtatacttatat

SEQ ID NO: 373571 - DNA, 14 bp, Homo sapiens
acaagtcacagctg

SEQ ID NO: 373572 - DNA, 19 bp, Homo sapiens
acaagtcacagctgcagct

SEQ ID NO: 373573 - DNA, 22 bp, Homo sapiens
acaagtctcaggggaccattcc

SEQ ID NO: 373574 - DNA, 18 bp, Homo sapiens
acaagtgctcagttccaa

SEQ ID NO: 373575 - DNA, 14 bp, Homo sapiens
acaagtgctgaaca

SEQ ID NO: 373576 - DNA, 13 bp, Homo sapiens
acaagtgtacaga

SEQ ID NO: 373577 - DNA, 15 bp, Homo sapiens
acaagtgtacagaag

SEQ ID NO: 373578 - DNA, 18 bp, Homo sapiens
acaagtgtacagaagaat

SEQ ID NO: 373579 - DNA, 20 bp, Homo sapiens
acaagtgtatatcagaaaag

SEQ ID NO: 373580 - DNA, 15 bp, Homo sapiens
acaagttaagattct

SEQ ID NO: 373581 - DNA, 19 bp, Homo sapiens
acaagttcctggtttgaat

SEQ ID NO: 373582 - DNA, 17 bp, Homo sapiens
acaagttgcgacggaga

SEQ ID NO: 373583 - DNA, 18 bp, Homo sapiens
acaagttggctagaagaa

SEQ ID NO: 373584 - DNA, 18 bp, Homo sapiens
acaagttgtttggtactt

SEQ ID NO: 373585 - DNA, 17 bp, Homo sapiens
acaagtttcagacaggg

SEQ ID NO: 373586 - DNA, 13 bp, Homo sapiens
acaataaaacatt

SEQ ID NO: 373587 - DNA, 18 bp, Homo sapiens
acaataaacatccttgta

SEQ ID NO: 373588 - DNA, 16 bp, Homo sapiens
acaataaatgtattca

SEQ ID NO: 373589 - DNA, 18 bp, Homo sapiens
acaataactactgtgttc

SEQ ID NO: 373590 - DNA, 19 bp, Homo sapiens
acaataactactgtgttcc

SEQ ID NO: 373591 - DNA, 21 bp, Homo sapiens
acaataactactgtgttcctg

SEQ ID NO: 373592 - DNA, 21 bp, Homo sapiens
acaataagcagaggtggaaaa

SEQ ID NO: 373593 - DNA, 14 bp, Homo sapiens
acaataagccactg

SEQ ID NO: 373594 - DNA, 13 bp, Homo sapiens
acaataataaatg

SEQ ID NO: 373595 - DNA, 17 bp, Homo sapiens
acaatacagataacatt

SEQ ID NO: 373596 - DNA, 19 bp, Homo sapiens
acaatactttgtgtctttt

SEQ ID NO: 373597 - DNA, 22 bp, Homo sapiens
acaatatgagtaatgtttaaga

SEQ ID NO: 373598 - DNA, 14 bp, Homo sapiens
acaatatttattgt

SEQ ID NO: 373599 - DNA, 19 bp, Homo sapiens
acaatatttattgtatttt

SEQ ID NO: 373600 - DNA, 23 bp, Homo sapiens
acaatcaactctaatagtgctta

SEQ ID NO: 373601 - DNA, 19 bp, Homo sapiens
acaatcatgaaatatgcat

SEQ ID NO: 373602 - DNA, 17 bp, Homo sapiens
acaatcctaccttttga

SEQ ID NO: 373603 - DNA, 16 bp, Homo sapiens
acaatcctataaatgt

SEQ ID NO: 373604 - DNA, 14 bp, Homo sapiens
acaatcctccccac

SEQ ID NO: 373605 - DNA, 11 bp, Homo sapiens
acaatctattt

SEQ ID NO: 373606 - DNA, 17 bp, Homo sapiens
acaatctatttattgga

SEQ ID NO: 373607 - DNA, 16 bp, Homo sapiens
acaatgatgatgataa

SEQ ID NO: 373608 - DNA, 16 bp, Homo sapiens
acaatgcaaaaccttt

SEQ ID NO: 373609 - DNA, 20 bp, Homo sapiens
acaatgcagatgccagagca

SEQ ID NO: 373610 - DNA, 15 bp, Homo sapiens
acaatggccatggaa

SEQ ID NO: 373611 - DNA, 14 bp, Homo sapiens
acaatggctatatt

SEQ ID NO: 373612 - DNA, 17 bp, Homo sapiens
acaatggctatattaat

SEQ ID NO: 373613 - DNA, 18 bp, Homo sapiens
acaatggctgggtttggg

SEQ ID NO: 373614 - DNA, 13 bp, Homo sapiens
acaatgtactata

SEQ ID NO: 373615 - DNA, 20 bp, Homo sapiens
acaatgtatgtgaaagtgta

SEQ ID NO: 373616 - DNA, 20 bp, Homo sapiens
acaatgtcgagtatattatt

SEQ ID NO: 373617 - DNA, 21 bp, Homo sapiens
acaatgtcgagtatattatta

SEQ ID NO: 373618 - DNA, 22 bp, Homo sapiens
acaatgtcgagtatattattat

SEQ ID NO: 373619 - DNA, 23 bp, Homo sapiens
acaatgtgatatgtgtaatatca

SEQ ID NO: 373620 - DNA, 23 bp, Homo sapiens
acaatgtggaattacataacagg

SEQ ID NO: 373621 - DNA, 21 bp, Homo sapiens
acaatgtggccgaggactttg

SEQ ID NO: 373622 - DNA, 18 bp, Homo sapiens
acaatgttggcctgtcag

SEQ ID NO: 373623 - DNA, 19 bp, Homo sapiens
acaattcaaagaatcacct

SEQ ID NO: 373624 - DNA, 23 bp, Homo sapiens
acaattcagttttagtttcaaaa

SEQ ID NO: 373625 - DNA, 23 bp, Homo sapiens
acaattcctagataaaaagatgg

SEQ ID NO: 373626 - DNA, 15 bp, Homo sapiens
acaattctacattgt

SEQ ID NO: 373627 - DNA, 15 bp, Homo sapiens
acaattctgtccctg

SEQ ID NO: 373628 - DNA, 17 bp, Homo sapiens
acaattctgtccctgtc

SEQ ID NO: 373629 - DNA, 23 bp, Homo sapiens
acaattctgtccctgtccctgcc

SEQ ID NO: 373630 - DNA, 19 bp, Homo sapiens
acaattgaaatttttaaat

SEQ ID NO: 373631 - DNA, 17 bp, Homo sapiens
acaattgcactgctgtt

SEQ ID NO: 373632 - DNA, 20 bp, Homo sapiens
acaattgtaaaactgaggca

SEQ ID NO: 373633 - DNA, 20 bp, Homo sapiens
acaatttaggaatgctcaat

SEQ ID NO: 373634 - DNA, 14 bp, Homo sapiens
acaatttattttat

SEQ ID NO: 373635 - DNA, 15 bp, Homo sapiens
acaatttattttatt

SEQ ID NO: 373636 - DNA, 13 bp, Homo sapiens
acaatttcaaaat

SEQ ID NO: 373637 - DNA, 18 bp, Homo sapiens
acaatttcaaaatgcatg

SEQ ID NO: 373638 - DNA, 20 bp, Homo sapiens
acaatttcctttatatttag

SEQ ID NO: 373639 - DNA, 11 bp, Homo sapiens
acaatttctgt

SEQ ID NO: 373640 - DNA, 19 bp, Homo sapiens
acaatttgccttaggaagt

SEQ ID NO: 373641 - DNA, 19 bp, Homo sapiens
acaatttggtcttagcttt

SEQ ID NO: 373642 - DNA, 15 bp, Homo sapiens
acaattttcatccca

SEQ ID NO: 373643 - DNA, 12 bp, Homo sapiens
acaattttgtac

SEQ ID NO: 373644 - DNA, 13 bp, Homo sapiens
acacaaaaagaaa

SEQ ID NO: 373645 - DNA, 20 bp, Homo sapiens
acacaaaaagaaagctgtga

SEQ ID NO: 373646 - DNA, 21 bp, Homo sapiens
acacaaaaagaaagctgtgaa

SEQ ID NO: 373647 - DNA, 16 bp, Homo sapiens
acacaaacacctccta

SEQ ID NO: 373648 - DNA, 17 bp, Homo sapiens
acacaaatgcagacaca

SEQ ID NO: 373649 - DNA, 22 bp, Homo sapiens
acacaaatgcagacacacaaca

SEQ ID NO: 373650 - DNA, 12 bp, Homo sapiens
acacaacaccag

SEQ ID NO: 373651 - DNA, 18 bp, Homo sapiens
acacaactatttttccaa

SEQ ID NO: 373652 - DNA, 15 bp, Homo sapiens
acacaagtcctgtga

SEQ ID NO: 373653 - DNA, 16 bp, Homo sapiens
acacaagtcctgtgaa

SEQ ID NO: 373654 - DNA, 18 bp, Homo sapiens
aatatgaggggactgcat

SEQ ID NO: 373655 - DNA, 20 bp, Homo sapiens
aatatgaggggactgcatgc

SEQ ID NO: 373656 - DNA, 15 bp, Homo sapiens
aatatgatatatatg

SEQ ID NO: 373657 - DNA, 18 bp, Homo sapiens
aatatgatatatatgtat

SEQ ID NO: 373658 - DNA, 15 bp, Homo sapiens
aatatgatctgtgga

SEQ ID NO: 373659 - DNA, 19 bp, Homo sapiens
aatatgattctcctctccc

SEQ ID NO: 373660 - DNA, 21 bp, Homo sapiens
aatatgattctcctctcccaa

SEQ ID NO: 373661 - DNA, 13 bp, Homo sapiens
aatatgcactttc

SEQ ID NO: 373662 - DNA, 12 bp, Homo sapiens
aatatgcatgta

SEQ ID NO: 373663 - DNA, 20 bp, Homo sapiens
aatatgcccctccccagtag

SEQ ID NO: 373664 - DNA, 14 bp, Homo sapiens
aatatgccccttct

SEQ ID NO: 373665 - DNA, 14 bp, Homo sapiens
aatatgctaaatgt

SEQ ID NO: 373666 - DNA, 15 bp, Homo sapiens
aatatggaacatatg

SEQ ID NO: 373667 - DNA, 14 bp, Homo sapiens
aatatggaacttct

SEQ ID NO: 373668 - DNA, 20 bp, Homo sapiens
aatatggaacttctaatata

SEQ ID NO: 373669 - DNA, 19 bp, Homo sapiens
aatatgggcattgtagtta

SEQ ID NO: 373670 - DNA, 19 bp, Homo sapiens
aatatggtggccctgggga

SEQ ID NO: 373671 - DNA, 20 bp, Homo sapiens
aatatgtattgtaaacatgt

SEQ ID NO: 373672 - DNA, 15 bp, Homo sapiens
aatatgtcttcataa

SEQ ID NO: 373673 - DNA, 21 bp, Homo sapiens
aatatgttaacctcagtgtca

SEQ ID NO: 373674 - DNA, 22 bp, Homo sapiens
aatatgttaacctcagtgtcat

SEQ ID NO: 373675 - DNA, 12 bp, Homo sapiens
aatattaaaaga

SEQ ID NO: 373676 - DNA, 14 bp, Homo sapiens
aatattaaatacag

SEQ ID NO: 373677 - DNA, 15 bp, Homo sapiens
aatattaagaaacaa

SEQ ID NO: 373678 - DNA, 20 bp, Homo sapiens
aatattaatttatatttgtc

SEQ ID NO: 373679 - DNA, 21 bp, Homo sapiens
aatattaatttatatttgtct

SEQ ID NO: 373680 - DNA, 22 bp, Homo sapiens
aatattaccatcttaatcttta

SEQ ID NO: 373681 - DNA, 20 bp, Homo sapiens
aatattactgtttatttctg

SEQ ID NO: 373682 - DNA, 19 bp, Homo sapiens
aatattactttaacatgcc

SEQ ID NO: 373683 - DNA, 21 bp, Homo sapiens
aatattatacttctttattca

SEQ ID NO: 373684 - DNA, 13 bp, Homo sapiens
aatattattatga

SEQ ID NO: 373685 - DNA, 14 bp, Homo sapiens
aatattcaataaag

SEQ ID NO: 373686 - DNA, 15 bp, Homo sapiens
aatattcctgaatga

SEQ ID NO: 373687 - DNA, 20 bp, Homo sapiens
aatattctatatgaatttaa

SEQ ID NO: 373688 - DNA, 18 bp, Homo sapiens
aatattctgataatgtat

SEQ ID NO: 373689 - DNA, 21 bp, Homo sapiens
aatattcttgtccacattcta

SEQ ID NO: 373690 - DNA, 20 bp, Homo sapiens
aatattgagaaagaaactaa

SEQ ID NO: 373691 - DNA, 13 bp, Homo sapiens
aatattggtttgt

SEQ ID NO: 373692 - DNA, 19 bp, Homo sapiens
aatattgtcacaacactga

SEQ ID NO: 373693 - DNA, 11 bp, Homo sapiens
aatatttataa

SEQ ID NO: 373694 - DNA, 12 bp, Homo sapiens
aatatttataac

SEQ ID NO: 373695 - DNA, 17 bp, Homo sapiens
aatatttataacagcat

SEQ ID NO: 373696 - DNA, 17 bp, Homo sapiens
aatatttatatttcact

SEQ ID NO: 373697 - DNA, 23 bp, Homo sapiens
aatatttatgacctcaacaaaga

SEQ ID NO: 373698 - DNA, 14 bp, Homo sapiens
aatatttatgttta

SEQ ID NO: 373699 - DNA, 15 bp, Homo sapiens
aatatttattacctc

SEQ ID NO: 373700 - DNA, 17 bp, Homo sapiens
aatatttattacctctg

SEQ ID NO: 373701 - DNA, 16 bp, Homo sapiens
aatatttcttcaagtg

SEQ ID NO: 373702 - DNA, 15 bp, Homo sapiens
aatattttagaagct

SEQ ID NO: 373703 - DNA, 14 bp, Homo sapiens
aatattttgataat

SEQ ID NO: 373704 - DNA, 21 bp, Homo sapiens
aatattttttatttctaagta

SEQ ID NO: 373705 - DNA, 19 bp, Homo sapiens
aatatttttttctagctat

SEQ ID NO: 373706 - DNA, 16 bp, Homo sapiens
aatcaaacctttttat

SEQ ID NO: 373707 - DNA, 22 bp, Homo sapiens
aatcaaatttgtagggtttcta

SEQ ID NO: 373708 - DNA, 19 bp, Homo sapiens
aatcaacagtgaacagctt

SEQ ID NO: 373709 - DNA, 14 bp, Homo sapiens
aatcaacctgcact

SEQ ID NO: 373710 - DNA, 16 bp, Homo sapiens
aatcaatacccttggc

SEQ ID NO: 373711 - DNA, 15 bp, Homo sapiens
aatcaatctggcttc

SEQ ID NO: 373712 - DNA, 16 bp, Homo sapiens
aatcaatctggcttct

SEQ ID NO: 373713 - DNA, 13 bp, Homo sapiens
aatcaatgaatat

SEQ ID NO: 373714 - DNA, 14 bp, Homo sapiens
aatcaatgaatatt

SEQ ID NO: 373715 - DNA, 16 bp, Homo sapiens
aatcaatgaatattga

SEQ ID NO: 373716 - DNA, 19 bp, Homo sapiens
aatcaatgaatattgaagt

SEQ ID NO: 373717 - DNA, 18 bp, Homo sapiens
aatcaattattacattta

SEQ ID NO: 373718 - DNA, 22 bp, Homo sapiens
aatcacaaaagctgtgtctctg

SEQ ID NO: 373719 - DNA, 17 bp, Homo sapiens
aatcacattcaggcatg

SEQ ID NO: 373720 - DNA, 12 bp, Homo sapiens
aatcaccaaagt

SEQ ID NO: 373721 - DNA, 13 bp, Homo sapiens
aatcaccaaagta

SEQ ID NO: 373722 - DNA, 19 bp, Homo sapiens
aatcacctaattaatttca

SEQ ID NO: 373723 - DNA, 17 bp, Homo sapiens
aatcaccttttctaaaa

SEQ ID NO: 373724 - DNA, 20 bp, Homo sapiens
aatcacgagatcttccttcc

SEQ ID NO: 373725 - DNA, 13 bp, Homo sapiens
aatcactattctt

SEQ ID NO: 373726 - DNA, 22 bp, Homo sapiens
aatcagaaaccccacttccatt

SEQ ID NO: 373727 - DNA, 13 bp, Homo sapiens
aatcagaaatttt

SEQ ID NO: 373728 - DNA, 12 bp, Homo sapiens
aatcagacacaa

SEQ ID NO: 373729 - DNA, 20 bp, Homo sapiens
aatcagagcagtgattctct

SEQ ID NO: 373730 - DNA, 19 bp, Homo sapiens
aatcagaggagagacggtg

SEQ ID NO: 373731 - DNA, 23 bp, Homo sapiens
aatcagctatttactgccaaagg

SEQ ID NO: 373732 - DNA, 17 bp, Homo sapiens
aatcagctgctttgtta

SEQ ID NO: 373733 - DNA, 18 bp, Homo sapiens
aatcagcttttaataaaa

SEQ ID NO: 373734 - DNA, 19 bp, Homo sapiens
aatcagcttttgttctaga

SEQ ID NO: 373735 - DNA, 19 bp, Homo sapiens
aatcagggaggtcattttg

SEQ ID NO: 373736 - DNA, 24 bp, Homo sapiens
aatcagtgggcaggataaactgaa

SEQ ID NO: 373737 - DNA, 16 bp, Homo sapiens
aatcagtgtagcccca

SEQ ID NO: 373738 - DNA, 18 bp, Homo sapiens
aatcagtgtgtctaaatt

SEQ ID NO: 373739 - DNA, 17 bp, Homo sapiens
aatcagtgtttaaataa

SEQ ID NO: 373740 - DNA, 22 bp, Homo sapiens
aatcagtgtttaaataaagacc

SEQ ID NO: 373741 - DNA, 15 bp, Homo sapiens
aatcagttttgtgta

SEQ ID NO: 373742 - DNA, 19 bp, Homo sapiens
aatcagttttgtgtacagt

SEQ ID NO: 373743 - DNA, 13 bp, Homo sapiens
aatcataatcatc

SEQ ID NO: 373744 - DNA, 18 bp, Homo sapiens
aatcatataataaatgta

SEQ ID NO: 373745 - DNA, 15 bp, Homo sapiens
aatcatctattgagt

SEQ ID NO: 373746 - DNA, 17 bp, Homo sapiens
aatcatgaaatatgcat

SEQ ID NO: 373747 - DNA, 21 bp, Homo sapiens
aatcatggctaagcttaaaaa

SEQ ID NO: 373748 - DNA, 15 bp, Homo sapiens
aatcatgtgaacccg

SEQ ID NO: 373749 - DNA, 12 bp, Homo sapiens
aatcattcaaaa

SEQ ID NO: 373750 - DNA, 12 bp, Homo sapiens
aatcattgctta

SEQ ID NO: 373751 - DNA, 14 bp, Homo sapiens
aatcattgctttga

SEQ ID NO: 373752 - DNA, 13 bp, Homo sapiens
aatcattgtagaa

SEQ ID NO: 373753 - DNA, 14 bp, Homo sapiens
aatcatttatctta

SEQ ID NO: 373754 - DNA, 19 bp, Homo sapiens
aatcatttatcttatctag

SEQ ID NO: 373755 - DNA, 21 bp, Homo sapiens
aatcatttccagcaaaatata

SEQ ID NO: 373756 - DNA, 22 bp, Homo sapiens
aatcatttccagcaaaatatat

SEQ ID NO: 373757 - DNA, 22 bp, Homo sapiens
aatcatttcttgggccctcctg

SEQ ID NO: 373758 - DNA, 17 bp, Homo sapiens
aatcattttaattatta

SEQ ID NO: 373759 - DNA, 14 bp, Homo sapiens
aatccaacacaagt

SEQ ID NO: 373760 - DNA, 15 bp, Homo sapiens
aatccacagtattgt

SEQ ID NO: 373761 - DNA, 19 bp, Homo sapiens
aatccacagtattgttctt

SEQ ID NO: 373762 - DNA, 12 bp, Homo sapiens
aatccacccatc

SEQ ID NO: 373763 - DNA, 18 bp, Homo sapiens
aatccacctgcctcggcc

SEQ ID NO: 373764 - DNA, 19 bp, Homo sapiens
aatccacctgcctcggcct

SEQ ID NO: 373765 - DNA, 13 bp, Homo sapiens
aatccagaaggaa

SEQ ID NO: 373766 - DNA, 18 bp, Homo sapiens
aatccagaaggaagctcg

SEQ ID NO: 373767 - DNA, 22 bp, Homo sapiens
aatccagccccatagaaaacaa

SEQ ID NO: 373768 - DNA, 13 bp, Homo sapiens
aatccagctccct

SEQ ID NO: 373769 - DNA, 23 bp, Homo sapiens
aatccagtgcttccacagagatt

SEQ ID NO: 373770 - DNA, 19 bp, Homo sapiens
aatccatctttgtagaaga

SEQ ID NO: 373771 - DNA, 15 bp, Homo sapiens
aatccatgtgctgct

SEQ ID NO: 373772 - DNA, 14 bp, Homo sapiens
aatccattttaaca

SEQ ID NO: 373773 - DNA, 13 bp, Homo sapiens
aatccattttcta

SEQ ID NO: 373774 - DNA, 18 bp, Homo sapiens
aatccattttctaaactg

SEQ ID NO: 373775 - DNA, 15 bp, Homo sapiens
aatcccaatctttct

SEQ ID NO: 373776 - DNA, 14 bp, Homo sapiens
aatcccacttcagt

SEQ ID NO: 373777 - DNA, 21 bp, Homo sapiens
aatcccagggaaggacttgga

SEQ ID NO: 373778 - DNA, 13 bp, Homo sapiens
aatcccagttcat

SEQ ID NO: 373779 - DNA, 15 bp, Homo sapiens
aatccccttctcccc

SEQ ID NO: 373780 - DNA, 18 bp, Homo sapiens
aatcccggtttcagaagc

SEQ ID NO: 373781 - DNA, 20 bp, Homo sapiens
aatccctcttcctccaaagc

SEQ ID NO: 373782 - DNA, 22 bp, Homo sapiens
aatccctcttcctccaaagcct

SEQ ID NO: 373783 - DNA, 14 bp, Homo sapiens
aatccctgttcatt

SEQ ID NO: 373784 - DNA, 15 bp, Homo sapiens
aagaaccgcattttg

SEQ ID NO: 373785 - DNA, 18 bp, Homo sapiens
aagaactgcatggaccta

SEQ ID NO: 373786 - DNA, 18 bp, Homo sapiens
aagaactgccccatctcc

SEQ ID NO: 373787 - DNA, 21 bp, Homo sapiens
aagaactgtttactgcttgat

SEQ ID NO: 373788 - DNA, 23 bp, Homo sapiens
aagaacttgatttgcatggattt

SEQ ID NO: 373789 - DNA, 15 bp, Homo sapiens
aagaagaaagactct

SEQ ID NO: 373790 - DNA, 20 bp, Homo sapiens
aagaagaaagtctatgctta

SEQ ID NO: 373791 - DNA, 16 bp, Homo sapiens
aagaagacatgaacca

SEQ ID NO: 373792 - DNA, 17 bp, Homo sapiens
aagaagacatggagact

SEQ ID NO: 373793 - DNA, 19 bp, Homo sapiens
aagaagaccagtcacagcc

SEQ ID NO: 373794 - DNA, 19 bp, Homo sapiens
aagaagaggttcatttttc

SEQ ID NO: 373795 - DNA, 14 bp, Homo sapiens
aagaagagtttaca

SEQ ID NO: 373796 - DNA, 15 bp, Homo sapiens
aagaagagtttacag

SEQ ID NO: 373797 - DNA, 17 bp, Homo sapiens
aagaagatgttgaagaa

SEQ ID NO: 373798 - DNA, 19 bp, Homo sapiens
aagaagcccgatccacatt

SEQ ID NO: 373799 - DNA, 15 bp, Homo sapiens
aagaaggcccgggag

SEQ ID NO: 373800 - DNA, 12 bp, Homo sapiens
aagaaggctggg

SEQ ID NO: 373801 - DNA, 14 bp, Homo sapiens
aagaagggaaattc

SEQ ID NO: 373802 - DNA, 21 bp, Homo sapiens
aagaagggaaattcacactgt

SEQ ID NO: 373803 - DNA, 24 bp, Homo sapiens
aagaagggtccttccctctcccca

SEQ ID NO: 373804 - DNA, 20 bp, Homo sapiens
aagaagtcagagaaaacact

SEQ ID NO: 373805 - DNA, 23 bp, Homo sapiens
aagaagtgggagtgggagaggaa

SEQ ID NO: 373806 - DNA, 16 bp, Homo sapiens
aagaagtggtgttcca

SEQ ID NO: 373807 - DNA, 18 bp, Homo sapiens
aagaagtggtgttccatg

SEQ ID NO: 373808 - DNA, 16 bp, Homo sapiens
aagaagtgtccgagaa

SEQ ID NO: 373809 - DNA, 19 bp, Homo sapiens
aagaagtgtccgagaacta

SEQ ID NO: 373810 - DNA, 16 bp, Homo sapiens
aagaataaaaaagaag

SEQ ID NO: 373811 - DNA, 17 bp, Homo sapiens
aagaatacagaaaatgc

SEQ ID NO: 373812 - DNA, 13 bp, Homo sapiens
aagaatagtgcct

SEQ ID NO: 373813 - DNA, 21 bp, Homo sapiens
aagaatcacctaattaatttc

SEQ ID NO: 373814 - DNA, 19 bp, Homo sapiens
aagaatcggcatgtatact

SEQ ID NO: 373815 - DNA, 21 bp, Homo sapiens
aagaatgcagattcctgggcc

SEQ ID NO: 373816 - DNA, 14 bp, Homo sapiens
aagaatggtgtgtt

SEQ ID NO: 373817 - DNA, 15 bp, Homo sapiens
aagaatgtacattac

SEQ ID NO: 373818 - DNA, 17 bp, Homo sapiens
aagaatgtcgattaaaa

SEQ ID NO: 373819 - DNA, 14 bp, Homo sapiens
aagaattaatgaca

SEQ ID NO: 373820 - DNA, 15 bp, Homo sapiens
aagaattatttttgt

SEQ ID NO: 373821 - DNA, 17 bp, Homo sapiens
aagaattatttttgtgt

SEQ ID NO: 373822 - DNA, 19 bp, Homo sapiens
aagaattcttatacacatt

SEQ ID NO: 373823 - DNA, 20 bp, Homo sapiens
aagaattgtttttgaattta

SEQ ID NO: 373824 - DNA, 14 bp, Homo sapiens
aagaattttaaaaa

SEQ ID NO: 373825 - DNA, 17 bp, Homo sapiens
aagacacacagcctttc

SEQ ID NO: 373826 - DNA, 20 bp, Homo sapiens
aagacacacagcctttctgt

SEQ ID NO: 373827 - DNA, 17 bp, Homo sapiens
aagacacgtgtttttgt

SEQ ID NO: 373828 - DNA, 13 bp, Homo sapiens
aagacactacaga

SEQ ID NO: 373829 - DNA, 12 bp, Homo sapiens
aagacagagtct

SEQ ID NO: 373830 - DNA, 14 bp, Homo sapiens
aagacagcctaatg

SEQ ID NO: 373831 - DNA, 17 bp, Homo sapiens
aagacagtggatcatga

SEQ ID NO: 373832 - DNA, 20 bp, Homo sapiens
aagacagtggcagcaaagga

SEQ ID NO: 373833 - DNA, 18 bp, Homo sapiens
aagacatatcatgtgtga

SEQ ID NO: 373834 - DNA, 15 bp, Homo sapiens
aagacatatctctaa

SEQ ID NO: 373835 - DNA, 13 bp, Homo sapiens
aagacatcaagat

SEQ ID NO: 373836 - DNA, 19 bp, Homo sapiens
aagacatgcactatgagga

SEQ ID NO: 373837 - DNA, 19 bp, Homo sapiens
aagacatggagactcctgc

SEQ ID NO: 373838 - DNA, 20 bp, Homo sapiens
aagacattcaccaacaacag

SEQ ID NO: 373839 - DNA, 21 bp, Homo sapiens
aagacattcttccaaaaagat

SEQ ID NO: 373840 - DNA, 20 bp, Homo sapiens
aagaccaatgtgaagacact

SEQ ID NO: 373841 - DNA, 13 bp, Homo sapiens
aagaccagcctgg

SEQ ID NO: 373842 - DNA, 22 bp, Homo sapiens
aagaccagtcacagccatttca

SEQ ID NO: 373843 - DNA, 22 bp, Homo sapiens
aagaccatttagtcctcacctt

SEQ ID NO: 373844 - DNA, 18 bp, Homo sapiens
aagaccggaagctcctgg

SEQ ID NO: 373845 - DNA, 18 bp, Homo sapiens
aagacctccctgtgagag

SEQ ID NO: 373846 - DNA, 11 bp, Homo sapiens
aagacctgcct

SEQ ID NO: 373847 - DNA, 15 bp, Homo sapiens
aagaccttctgaaga

SEQ ID NO: 373848 - DNA, 19 bp, Homo sapiens
aagaccttctgaagatctc

SEQ ID NO: 373849 - DNA, 23 bp, Homo sapiens
aagaccttgcttatgattgcaga

SEQ ID NO: 373850 - DNA, 15 bp, Homo sapiens
aagactcctttcctg

SEQ ID NO: 373851 - DNA, 12 bp, Homo sapiens
aagactgcctcc

SEQ ID NO: 373852 - DNA, 13 bp, Homo sapiens
aagactggaagca

SEQ ID NO: 373853 - DNA, 20 bp, Homo sapiens
aagactgtattttcaggaag

SEQ ID NO: 373854 - DNA, 16 bp, Homo sapiens
aagactgttgctcaaa

SEQ ID NO: 373855 - DNA, 24 bp, Homo sapiens
aagactgttgctcaaatctattca

SEQ ID NO: 373856 - DNA, 15 bp, Homo sapiens
aagacttaagattaa

SEQ ID NO: 373857 - DNA, 21 bp, Homo sapiens
aagacttaatcatatcaactt

SEQ ID NO: 373858 - DNA, 19 bp, Homo sapiens
aagacttaatctttgctga

SEQ ID NO: 373859 - DNA, 21 bp, Homo sapiens
aagacttagatctgagccctc

SEQ ID NO: 373860 - DNA, 16 bp, Homo sapiens
aagacttggcaacaga

SEQ ID NO: 373861 - DNA, 18 bp, Homo sapiens
aagacttggcaacagaag

SEQ ID NO: 373862 - DNA, 18 bp, Homo sapiens
aagacttggcccaggaaa

SEQ ID NO: 373863 - DNA, 21 bp, Homo sapiens
aagactttccccatactctgt

SEQ ID NO: 373864 - DNA, 19 bp, Homo sapiens
aagacttttctttcagcca

SEQ ID NO: 373865 - DNA, 17 bp, Homo sapiens
aagagaaaaaccaatga

SEQ ID NO: 373866 - DNA, 20 bp, Homo sapiens
aagagaaagtactcagaggc

SEQ ID NO: 373867 - DNA, 18 bp, Homo sapiens
aagagaaagtgatttcta

SEQ ID NO: 373868 - DNA, 17 bp, Homo sapiens
aagagaaatgaggaaga

SEQ ID NO: 373869 - DNA, 13 bp, Homo sapiens
aagagaaatggta

SEQ ID NO: 373870 - DNA, 16 bp, Homo sapiens
aagagaaccgagcaaa

SEQ ID NO: 373871 - DNA, 13 bp, Homo sapiens
aagagaagaaaga

SEQ ID NO: 373872 - DNA, 18 bp, Homo sapiens
acttagtggtatgtctct

SEQ ID NO: 373873 - DNA, 15 bp, Homo sapiens
acttagtttgtgaat

SEQ ID NO: 373874 - DNA, 14 bp, Homo sapiens
acttataccaaagg

SEQ ID NO: 373875 - DNA, 15 bp, Homo sapiens
acttataccaaaggg

SEQ ID NO: 373876 - DNA, 17 bp, Homo sapiens
acttatatatttgaaag

SEQ ID NO: 373877 - DNA, 18 bp, Homo sapiens
acttatcctaaaacaaat

SEQ ID NO: 373878 - DNA, 19 bp, Homo sapiens
acttatcctaaaacaaata

SEQ ID NO: 373879 - DNA, 21 bp, Homo sapiens
acttatctagaaagaaaagac

SEQ ID NO: 373880 - DNA, 14 bp, Homo sapiens
acttatcttatgcc

SEQ ID NO: 373881 - DNA, 16 bp, Homo sapiens
acttatgctagtttat

SEQ ID NO: 373882 - DNA, 13 bp, Homo sapiens
acttatgctgctg

SEQ ID NO: 373883 - DNA, 19 bp, Homo sapiens
acttattgcctgggcagtg

SEQ ID NO: 373884 - DNA, 16 bp, Homo sapiens
acttattgctttgaaa

SEQ ID NO: 373885 - DNA, 22 bp, Homo sapiens
acttatttaaaaatgcatgata

SEQ ID NO: 373886 - DNA, 13 bp, Homo sapiens
acttatttccatg

SEQ ID NO: 373887 - DNA, 13 bp, Homo sapiens
acttatttctaaa

SEQ ID NO: 373888 - DNA, 14 bp, Homo sapiens
acttatttctaaat

SEQ ID NO: 373889 - DNA, 15 bp, Homo sapiens
acttatttcttcaaa

SEQ ID NO: 373890 - DNA, 12 bp, Homo sapiens
acttatttgagt

SEQ ID NO: 373891 - DNA, 15 bp, Homo sapiens
acttattttacacag

SEQ ID NO: 373892 - DNA, 19 bp, Homo sapiens
acttattttacacagcaat

SEQ ID NO: 373893 - DNA, 15 bp, Homo sapiens
acttattttctctgt

SEQ ID NO: 373894 - DNA, 15 bp, Homo sapiens
acttattttctgaat

SEQ ID NO: 373895 - DNA, 22 bp, Homo sapiens
acttattttctgaattcataaa

SEQ ID NO: 373896 - DNA, 14 bp, Homo sapiens
acttcaaaaggtga

SEQ ID NO: 373897 - DNA, 15 bp, Homo sapiens
acttcaaaatcagtg

SEQ ID NO: 373898 - DNA, 19 bp, Homo sapiens
acttcaaaatcagtgatgg

SEQ ID NO: 373899 - DNA, 23 bp, Homo sapiens
acttcaaatcagagcagtgattc

SEQ ID NO: 373900 - DNA, 20 bp, Homo sapiens
acttcaatgggagtgaacat

SEQ ID NO: 373901 - DNA, 15 bp, Homo sapiens
acttcagagagctgg

SEQ ID NO: 373902 - DNA, 18 bp, Homo sapiens
acttcagagagctggtag

SEQ ID NO: 373903 - DNA, 20 bp, Homo sapiens
acttcagagagctggtagtt

SEQ ID NO: 373904 - DNA, 22 bp, Homo sapiens
acttcagcaaccctacagtata

SEQ ID NO: 373905 - DNA, 11 bp, Homo sapiens
acttcagcagg

SEQ ID NO: 373906 - DNA, 14 bp, Homo sapiens
acttcagcaggggt

SEQ ID NO: 373907 - DNA, 13 bp, Homo sapiens
acttcagctctgt

SEQ ID NO: 373908 - DNA, 14 bp, Homo sapiens
acttcagctctgtt

SEQ ID NO: 373909 - DNA, 16 bp, Homo sapiens
acttcaggctcttctc

SEQ ID NO: 373910 - DNA, 21 bp, Homo sapiens
acttcagggttctcctctccc

SEQ ID NO: 373911 - DNA, 22 bp, Homo sapiens
acttcagggttctcctctcccc

SEQ ID NO: 373912 - DNA, 20 bp, Homo sapiens
acttcaggttgttctgtata

SEQ ID NO: 373913 - DNA, 16 bp, Homo sapiens
acttcagtcctgggag

SEQ ID NO: 373914 - DNA, 15 bp, Homo sapiens
aagaggctagcccca

SEQ ID NO: 373915 - DNA, 23 bp, Homo sapiens
aagagggactgtatttctgtgga

SEQ ID NO: 373916 - DNA, 17 bp, Homo sapiens
aagagggagaaggagag

SEQ ID NO: 373917 - DNA, 19 bp, Homo sapiens
aagagggcctgtgggagcc

SEQ ID NO: 373918 - DNA, 16 bp, Homo sapiens
aagagggctgagctga

SEQ ID NO: 373919 - DNA, 19 bp, Homo sapiens
aagaggggaccagaagcca

SEQ ID NO: 373920 - DNA, 21 bp, Homo sapiens
aagaggggaggggcctaggga

SEQ ID NO: 373921 - DNA, 18 bp, Homo sapiens
aagaggtgctgctttgct

SEQ ID NO: 373922 - DNA, 19 bp, Homo sapiens
aagaggtggggtgaagctg

SEQ ID NO: 373923 - DNA, 14 bp, Homo sapiens
aagaggttctcagc

SEQ ID NO: 373924 - DNA, 23 bp, Homo sapiens
aagagtagttgatgttgcatttt

SEQ ID NO: 373925 - DNA, 16 bp, Homo sapiens
aagagtatactttgta

SEQ ID NO: 373926 - DNA, 23 bp, Homo sapiens
aagagtatcaaaggcagaaagga

SEQ ID NO: 373927 - DNA, 15 bp, Homo sapiens
aagagtattccattt

SEQ ID NO: 373928 - DNA, 19 bp, Homo sapiens
aagagtgggggagagcagg

SEQ ID NO: 373929 - DNA, 18 bp, Homo sapiens
aagagtgtcactgagctg

SEQ ID NO: 373930 - DNA, 14 bp, Homo sapiens
aagagttggctggt

SEQ ID NO: 373931 - DNA, 17 bp, Homo sapiens
aagataaagatgatcta

SEQ ID NO: 373932 - DNA, 21 bp, Homo sapiens
aagataatcttagctgccaag

SEQ ID NO: 373933 - DNA, 22 bp, Homo sapiens
aagataatgaaatagttatttt

SEQ ID NO: 373934 - DNA, 23 bp, Homo sapiens
aagataatgttctttaatgttgt

SEQ ID NO: 373935 - DNA, 21 bp, Homo sapiens
aagataattaaatgaaatact

SEQ ID NO: 373936 - DNA, 19 bp, Homo sapiens
aagataatttgcatattct

SEQ ID NO: 373937 - DNA, 15 bp, Homo sapiens
aagatacaagtttca

SEQ ID NO: 373938 - DNA, 19 bp, Homo sapiens
aagatacactcctgctgtg

SEQ ID NO: 373939 - DNA, 21 bp, Homo sapiens
aagatacactgacttggtgca

SEQ ID NO: 373940 - DNA, 19 bp, Homo sapiens
aagatacacttgtaaataa

SEQ ID NO: 373941 - DNA, 13 bp, Homo sapiens
aagatacatcaca

SEQ ID NO: 373942 - DNA, 18 bp, Homo sapiens
aagataccatcagcaaag

SEQ ID NO: 373943 - DNA, 14 bp, Homo sapiens
aagatacgacttta

SEQ ID NO: 373944 - DNA, 18 bp, Homo sapiens
aagatacgactttatttt

SEQ ID NO: 373945 - DNA, 20 bp, Homo sapiens
aagatactaatagagtactt

SEQ ID NO: 373946 - DNA, 17 bp, Homo sapiens
aagatactgctgatgct

SEQ ID NO: 373947 - DNA, 23 bp, Homo sapiens
aagatactgctgatgctgaaata

SEQ ID NO: 373948 - DNA, 23 bp, Homo sapiens
aagatagatttggaataggaata

SEQ ID NO: 373949 - DNA, 21 bp, Homo sapiens
aagatagctccttcatgcttt

SEQ ID NO: 373950 - DNA, 16 bp, Homo sapiens
aagataggctctgcac

SEQ ID NO: 373951 - DNA, 21 bp, Homo sapiens
aagataggtttgagttcaaat

SEQ ID NO: 373952 - DNA, 20 bp, Homo sapiens
aagatatcagagctcttaat

SEQ ID NO: 373953 - DNA, 22 bp, Homo sapiens
aagatatcagagctcttaatgt

SEQ ID NO: 373954 - DNA, 16 bp, Homo sapiens
aagatattctttacaa

SEQ ID NO: 373955 - DNA, 15 bp, Homo sapiens
aagatatttatatat

SEQ ID NO: 373956 - DNA, 22 bp, Homo sapiens
aagatcacgccactgcactcca

SEQ ID NO: 373957 - DNA, 21 bp, Homo sapiens
aagatccaaatgctgtgcaaa

SEQ ID NO: 373958 - DNA, 16 bp, Homo sapiens
aagatcccaagtcaaa

SEQ ID NO: 373959 - DNA, 16 bp, Homo sapiens
aagatctataaagcga

SEQ ID NO: 373960 - DNA, 18 bp, Homo sapiens
aagatcttgagagctgct

SEQ ID NO: 373961 - DNA, 23 bp, Homo sapiens
aagatctttcgttggttgtttct

SEQ ID NO: 373962 - DNA, 20 bp, Homo sapiens
aagatgaaaaatggtccctt

SEQ ID NO: 373963 - DNA, 13 bp, Homo sapiens
aagatgaaattgc

SEQ ID NO: 373964 - DNA, 16 bp, Homo sapiens
aagatgaaattgccaa

SEQ ID NO: 373965 - DNA, 14 bp, Homo sapiens
aagatgaagaggat

SEQ ID NO: 373966 - DNA, 16 bp, Homo sapiens
aagatgaatcagtatg

SEQ ID NO: 373967 - DNA, 17 bp, Homo sapiens
aagatgagaagccaaag

SEQ ID NO: 373968 - DNA, 21 bp, Homo sapiens
aagatgagattggcatggctt

SEQ ID NO: 373969 - DNA, 18 bp, Homo sapiens
aagatgagatttgccagc

SEQ ID NO: 373970 - DNA, 19 bp, Homo sapiens
aagatgagatttgccagca

SEQ ID NO: 373971 - DNA, 15 bp, Homo sapiens
aagatgcaaggacca

SEQ ID NO: 373972 - DNA, 20 bp, Homo sapiens
aagatgcaaggaccaggact

SEQ ID NO: 373973 - DNA, 21 bp, Homo sapiens
aagatgccctccaatcctttc

SEQ ID NO: 373974 - DNA, 13 bp, Homo sapiens
aagatggaaaaaa

SEQ ID NO: 373975 - DNA, 15 bp, Homo sapiens
aagatggaaaggatt

SEQ ID NO: 373976 - DNA, 16 bp, Homo sapiens
aagatggattctcaga

SEQ ID NO: 373977 - DNA, 19 bp, Homo sapiens
aagatggatttgacacact

SEQ ID NO: 373978 - DNA, 20 bp, Homo sapiens
aagatggatttgacacactc

SEQ ID NO: 373979 - DNA, 16 bp, Homo sapiens
aagatggctgtgcctc

SEQ ID NO: 373980 - DNA, 18 bp, Homo sapiens
aagatggctgtgcctctg

SEQ ID NO: 373981 - DNA, 23 bp, Homo sapiens
aagatggctgtgcctctgcctgt

SEQ ID NO: 373982 - DNA, 16 bp, Homo sapiens
aagatggtatatttgg

SEQ ID NO: 373983 - DNA, 23 bp, Homo sapiens
aagatgtattaacctacctgtga

SEQ ID NO: 373984 - DNA, 18 bp, Homo sapiens
aagatgtattcagagcca

SEQ ID NO: 373985 - DNA, 14 bp, Homo sapiens
aagatgtgacatgt

SEQ ID NO: 373986 - DNA, 20 bp, Homo sapiens
aagattaagttataccagca

SEQ ID NO: 373987 - DNA, 14 bp, Homo sapiens
aagattccatttta

SEQ ID NO: 373988 - DNA, 12 bp, Homo sapiens
aagattctttaa

SEQ ID NO: 373989 - DNA, 18 bp, Homo sapiens
aagattctttaaactact

SEQ ID NO: 373990 - DNA, 16 bp, Homo sapiens
aagattgcaaggaagg

SEQ ID NO: 373991 - DNA, 12 bp, Homo sapiens
aagattgtgtct

SEQ ID NO: 373992 - DNA, 22 bp, Homo sapiens
aagatttgatgctggagaggtt

SEQ ID NO: 373993 - DNA, 17 bp, Homo sapiens
aagatttggaataaagt

SEQ ID NO: 373994 - DNA, 22 bp, Homo sapiens
aagatttgtgtttttctttttc

SEQ ID NO: 373995 - DNA, 18 bp, Homo sapiens
aagattttatccctttct

SEQ ID NO: 373996 - DNA, 13 bp, Homo sapiens
aagattttcagaa

SEQ ID NO: 373997 - DNA, 15 bp, Homo sapiens
aagattttctttctc

SEQ ID NO: 373998 - DNA, 17 bp, Homo sapiens
aagattttgaatgcttc

SEQ ID NO: 373999 - DNA, 14 bp, Homo sapiens
aagatttttgttaa

SEQ ID NO: 374000 - DNA, 15 bp, Homo sapiens
aagatttttgttaag

SEQ ID NO: 374001 - DNA, 18 bp, Homo sapiens
aagatttttgttaagctc

SEQ ID NO: 374002 - DNA, 22 bp, Homo sapiens
aagcaaaattatagaagtttag

SEQ ID NO: 374003 - DNA, 13 bp, Homo sapiens
aagcaaacatcaa

SEQ ID NO: 374004 - DNA, 22 bp, Homo sapiens
aagcaaacatcaaataaatttc

SEQ ID NO: 374005 - DNA, 12 bp, Homo sapiens
aagcaaagtgaa

SEQ ID NO: 374006 - DNA, 22 bp, Homo sapiens
aagcaaataccaaagcagttgg

SEQ ID NO: 374007 - DNA, 19 bp, Homo sapiens
aagcaaatatttatgacct

SEQ ID NO: 374008 - DNA, 16 bp, Homo sapiens
aagcaacaactttgtt

SEQ ID NO: 374009 - DNA, 14 bp, Homo sapiens
acttgcgcagaaaa

SEQ ID NO: 374010 - DNA, 15 bp, Homo sapiens
acttgctcaataaag

SEQ ID NO: 374011 - DNA, 17 bp, Homo sapiens
acttgctcagacgagac

SEQ ID NO: 374012 - DNA, 22 bp, Homo sapiens
acttgctcagacgagacaccct

SEQ ID NO: 374013 - DNA, 14 bp, Homo sapiens
acttgctcccaacc

SEQ ID NO: 374014 - DNA, 23 bp, Homo sapiens
acttgctctctggccttttccta

SEQ ID NO: 374015 - DNA, 12 bp, Homo sapiens
acttgctgtgaa

SEQ ID NO: 374016 - DNA, 22 bp, Homo sapiens
acttgcttcttgtgtttgaaac

SEQ ID NO: 374017 - DNA, 15 bp, Homo sapiens
acttggaaataataa

SEQ ID NO: 374018 - DNA, 16 bp, Homo sapiens
acttggaaataataaa

SEQ ID NO: 374019 - DNA, 15 bp, Homo sapiens
acttggaaatattaa

SEQ ID NO: 374020 - DNA, 19 bp, Homo sapiens
acttggaaatattaaaaga

SEQ ID NO: 374021 - DNA, 22 bp, Homo sapiens
acttggaatttgtaacctcagc

SEQ ID NO: 374022 - DNA, 15 bp, Homo sapiens
acttggactcttgct

SEQ ID NO: 374023 - DNA, 12 bp, Homo sapiens
acttggagcccg

SEQ ID NO: 374024 - DNA, 15 bp, Homo sapiens
acttggagcccgtgc

SEQ ID NO: 374025 - DNA, 14 bp, Homo sapiens
acttggagctgtcc

SEQ ID NO: 374026 - DNA, 20 bp, Homo sapiens
acttggagctgtcctccaga

SEQ ID NO: 374027 - DNA, 22 bp, Homo sapiens
acttggataggagcttccagat

SEQ ID NO: 374028 - DNA, 22 bp, Homo sapiens
acttgggagagggagcaagcct

SEQ ID NO: 374029 - DNA, 14 bp, Homo sapiens
acttgggagcctga

SEQ ID NO: 374030 - DNA, 15 bp, Homo sapiens
acttgggtcttccct

SEQ ID NO: 374031 - DNA, 19 bp, Homo sapiens
acttggtgaggaggaggca

SEQ ID NO: 374032 - DNA, 14 bp, Homo sapiens
acttggtgtactgg

SEQ ID NO: 374033 - DNA, 21 bp, Homo sapiens
acttggtgtcctttccctcca

SEQ ID NO: 374034 - DNA, 15 bp, Homo sapiens
acttggttctgcttc

SEQ ID NO: 374035 - DNA, 13 bp, Homo sapiens
acttgtaaataca

SEQ ID NO: 374036 - DNA, 15 bp, Homo sapiens
acttgtacagttgac

SEQ ID NO: 374037 - DNA, 21 bp, Homo sapiens
acttgtacagttgactggctt

SEQ ID NO: 374038 - DNA, 22 bp, Homo sapiens
acttgtaggaatctgccttcca

SEQ ID NO: 374039 - DNA, 17 bp, Homo sapiens
acttgtctttttctgga

SEQ ID NO: 374040 - DNA, 16 bp, Homo sapiens
acttgtgactgaaggg

SEQ ID NO: 374041 - DNA, 22 bp, Homo sapiens
acttgtgctgatcgtgctaaat

SEQ ID NO: 374042 - DNA, 14 bp, Homo sapiens
acttgtgcttttgc

SEQ ID NO: 374043 - DNA, 22 bp, Homo sapiens
aagcagccagccagtcttgcct

SEQ ID NO: 374044 - DNA, 15 bp, Homo sapiens
aagcagcctttctgt

SEQ ID NO: 374045 - DNA, 19 bp, Homo sapiens
aagcagctgcattttttat

SEQ ID NO: 374046 - DNA, 20 bp, Homo sapiens
aagcaggaaagatcccaagt

SEQ ID NO: 374047 - DNA, 13 bp, Homo sapiens
aagcaggagcagc

SEQ ID NO: 374048 - DNA, 22 bp, Homo sapiens
aagcagggaatttctatctaaa

SEQ ID NO: 374049 - DNA, 17 bp, Homo sapiens
aagcagggacacccccc

SEQ ID NO: 374050 - DNA, 17 bp, Homo sapiens
aagcaggtttcttgctt

SEQ ID NO: 374051 - DNA, 14 bp, Homo sapiens
aagcagtaaaaact

SEQ ID NO: 374052 - DNA, 12 bp, Homo sapiens
aagcagtgcatg

SEQ ID NO: 374053 - DNA, 20 bp, Homo sapiens
aagcagtgcatgctgtccct

SEQ ID NO: 374054 - DNA, 17 bp, Homo sapiens
aagcagtgcctcgaggc

SEQ ID NO: 374055 - DNA, 21 bp, Homo sapiens
aagcagtgcctcgaggcaccg

SEQ ID NO: 374056 - DNA, 17 bp, Homo sapiens
aagcagtgccttccata

SEQ ID NO: 374057 - DNA, 18 bp, Homo sapiens
aagcagtgccttccataa

SEQ ID NO: 374058 - DNA, 18 bp, Homo sapiens
aagcagtgcttgtaaacc

SEQ ID NO: 374059 - DNA, 19 bp, Homo sapiens
aagcataagcttaagcatt

SEQ ID NO: 374060 - DNA, 15 bp, Homo sapiens
aagcataatgaaaat

SEQ ID NO: 374061 - DNA, 21 bp, Homo sapiens
aagcataatgttgaacattca

SEQ ID NO: 374062 - DNA, 15 bp, Homo sapiens
aagcatatataaaac

SEQ ID NO: 374063 - DNA, 16 bp, Homo sapiens
aagcatcaaataatac

SEQ ID NO: 374064 - DNA, 18 bp, Homo sapiens
aagcatcaaataatacat

SEQ ID NO: 374065 - DNA, 17 bp, Homo sapiens
aagcatcacacagtggc

SEQ ID NO: 374066 - DNA, 20 bp, Homo sapiens
aagcatccatgtgtggactc

SEQ ID NO: 374067 - DNA, 18 bp, Homo sapiens
aagcatcggagggaattg

SEQ ID NO: 374068 - DNA, 15 bp, Homo sapiens
aagcatgagtggcct

SEQ ID NO: 374069 - DNA, 17 bp, Homo sapiens
aagcatgctcagtattg

SEQ ID NO: 374070 - DNA, 18 bp, Homo sapiens
aagcatgctcagtattga

SEQ ID NO: 374071 - DNA, 19 bp, Homo sapiens
aagcatgtggcatgttcat

SEQ ID NO: 374072 - DNA, 16 bp, Homo sapiens
aagcatgttgaatgta

SEQ ID NO: 374073 - DNA, 14 bp, Homo sapiens
aagcatgtttcatg

SEQ ID NO: 374074 - DNA, 18 bp, Homo sapiens
aagcattaacttctctgg

SEQ ID NO: 374075 - DNA, 22 bp, Homo sapiens
aagcattccttagcagctcagg

SEQ ID NO: 374076 - DNA, 18 bp, Homo sapiens
aagcattctgagctgggc

SEQ ID NO: 374077 - DNA, 21 bp, Homo sapiens
aagcattctgtgcataaaagt

SEQ ID NO: 374078 - DNA, 13 bp, Homo sapiens
aagcattgaaatt

SEQ ID NO: 374079 - DNA, 22 bp, Homo sapiens
aagcattgggtgggtaaattca

SEQ ID NO: 374080 - DNA, 22 bp, Homo sapiens
aagcattgtttgcttattgttc

SEQ ID NO: 374081 - DNA, 19 bp, Homo sapiens
aagcatttatcattcttgt

SEQ ID NO: 374082 - DNA, 12 bp, Homo sapiens
aagcatttcacc

SEQ ID NO: 374083 - DNA, 18 bp, Homo sapiens
aagcattttactgtctgt

SEQ ID NO: 374084 - DNA, 15 bp, Homo sapiens
aagcattttcagcat

SEQ ID NO: 374085 - DNA, 16 bp, Homo sapiens
aagcattttcagcatc

SEQ ID NO: 374086 - DNA, 22 bp, Homo sapiens
aagcattttctttctgtttttt

SEQ ID NO: 374087 - DNA, 19 bp, Homo sapiens
aagccaaacattcttattt

SEQ ID NO: 374088 - DNA, 16 bp, Homo sapiens
aagccaaagacttagt

SEQ ID NO: 374089 - DNA, 16 bp, Homo sapiens
aagccaacttgtaaat

SEQ ID NO: 374090 - DNA, 17 bp, Homo sapiens
aagccaacttgtaaata

SEQ ID NO: 374091 - DNA, 19 bp, Homo sapiens
aagccaacttgtaaataca

SEQ ID NO: 374092 - DNA, 20 bp, Homo sapiens
aagccaagaagtgaggcctg

SEQ ID NO: 374093 - DNA, 20 bp, Homo sapiens
aagccaagacagtggcagca

SEQ ID NO: 374094 - DNA, 17 bp, Homo sapiens
aagccaagctagaagga

SEQ ID NO: 374095 - DNA, 13 bp, Homo sapiens
aagccaagggcct

SEQ ID NO: 374096 - DNA, 19 bp, Homo sapiens
aagccaataaataatatta

SEQ ID NO: 374097 - DNA, 18 bp, Homo sapiens
aagccaccaagggcctca

SEQ ID NO: 374098 - DNA, 20 bp, Homo sapiens
aagccaccatgtatgtggaa

SEQ ID NO: 374099 - DNA, 11 bp, Homo sapiens
aagccacctct

SEQ ID NO: 374100 - DNA, 13 bp, Homo sapiens
aagccacctctcc

SEQ ID NO: 374101 - DNA, 20 bp, Homo sapiens
aagccacgtgctggagagta

SEQ ID NO: 374102 - DNA, 11 bp, Homo sapiens
aagccaggaga

SEQ ID NO: 374103 - DNA, 13 bp, Homo sapiens
aagccaggagacc

SEQ ID NO: 374104 - DNA, 22 bp, Homo sapiens
aagccaggaggctttaagctcc

SEQ ID NO: 374105 - DNA, 23 bp, Homo sapiens
aagccagggatggggccacagcc

SEQ ID NO: 374106 - DNA, 16 bp, Homo sapiens
aagccagggtgtgtct

SEQ ID NO: 374107 - DNA, 17 bp, Homo sapiens
aagccagggttccagac

SEQ ID NO: 374108 - DNA, 18 bp, Homo sapiens
aagccagtgactccagga

SEQ ID NO: 374109 - DNA, 18 bp, Homo sapiens
aagccatatgacaatttc

SEQ ID NO: 374110 - DNA, 20 bp, Homo sapiens
aagccatatgacaatttcaa

SEQ ID NO: 374111 - DNA, 24 bp, Homo sapiens
aagccatatgacaatttcaaaatg

SEQ ID NO: 374112 - DNA, 19 bp, Homo sapiens
aagccatattccagcagtg

SEQ ID NO: 374113 - DNA, 17 bp, Homo sapiens
aagccatcaattttaac

SEQ ID NO: 374114 - DNA, 19 bp, Homo sapiens
aagccatcaattttaacat

SEQ ID NO: 374115 - DNA, 20 bp, Homo sapiens
aagccattttttgaggagag

SEQ ID NO: 374116 - DNA, 19 bp, Homo sapiens
aagcccaaggcagtgttcc

SEQ ID NO: 374117 - DNA, 14 bp, Homo sapiens
aagcccacccgccc

SEQ ID NO: 374118 - DNA, 18 bp, Homo sapiens
aagcccacccgccccaga

SEQ ID NO: 374119 - DNA, 19 bp, Homo sapiens
aagcccacccgccccagag

SEQ ID NO: 374120 - DNA, 23 bp, Homo sapiens
aagcccacccgccccagagactg

SEQ ID NO: 374121 - DNA, 11 bp, Homo sapiens
aagcccagccc

SEQ ID NO: 374122 - DNA, 13 bp, Homo sapiens
aagcccagcccgg

SEQ ID NO: 374123 - DNA, 15 bp, Homo sapiens
aagcccagcccggct

SEQ ID NO: 374124 - DNA, 15 bp, Homo sapiens
aagcccaggaggacc

SEQ ID NO: 374125 - DNA, 21 bp, Homo sapiens
aagccccaggcaggctgtgcg

SEQ ID NO: 374126 - DNA, 13 bp, Homo sapiens
aagccccagggcc

SEQ ID NO: 374127 - DNA, 17 bp, Homo sapiens
aagccccagggcctggg

SEQ ID NO: 374128 - DNA, 18 bp, Homo sapiens
aagccccctcttgagagg

SEQ ID NO: 374129 - DNA, 15 bp, Homo sapiens
aagcccctcacctca

SEQ ID NO: 374130 - DNA, 18 bp, Homo sapiens
aagcccctcacctcagga

SEQ ID NO: 374131 - DNA, 19 bp, Homo sapiens
aagcccctcagcccttgcc

SEQ ID NO: 374132 - DNA, 11 bp, Homo sapiens
aagccctgcaa

SEQ ID NO: 374133 - DNA, 11 bp, Homo sapiens
aagccctggca

SEQ ID NO: 374134 - DNA, 15 bp, Homo sapiens
aagcccttccatgtc

SEQ ID NO: 374135 - DNA, 15 bp, Homo sapiens
aagccctttgcctgt

SEQ ID NO: 374136 - DNA, 18 bp, Homo sapiens
aagccctttgcctgtaga

SEQ ID NO: 374137 - DNA, 22 bp, Homo sapiens
aagccctttgcctgtagagcca

SEQ ID NO: 374138 - DNA, 15 bp, Homo sapiens
aagccgccaggaccg

SEQ ID NO: 374139 - DNA, 23 bp, Homo sapiens
aagccggccccccctcttttggc

SEQ ID NO: 374140 - DNA, 13 bp, Homo sapiens
aagccggcggccc

SEQ ID NO: 374141 - DNA, 14 bp, Homo sapiens
aagccggcggccca

SEQ ID NO: 374142 - DNA, 19 bp, Homo sapiens
aagccgtctgactccagag

SEQ ID NO: 374143 - DNA, 14 bp, Homo sapiens
aagccgtggcttcc

SEQ ID NO: 374144 - DNA, 13 bp, Homo sapiens
aagcctaagaaaa

SEQ ID NO: 374145 - DNA, 23 bp, Homo sapiens
aagcctcagtccctccctcctgg

SEQ ID NO: 374146 - DNA, 23 bp, Homo sapiens
aagcctcatgggagtcagggagc

SEQ ID NO: 374147 - DNA, 15 bp, Homo sapiens
acttttattgtataa

SEQ ID NO: 374148 - DNA, 18 bp, Homo sapiens
acttttatttgcaacatt

SEQ ID NO: 374149 - DNA, 17 bp, Homo sapiens
acttttccatgtatcta

SEQ ID NO: 374150 - DNA, 21 bp, Homo sapiens
acttttccatgtatctacctc

SEQ ID NO: 374151 - DNA, 17 bp, Homo sapiens
acttttcgttaacattg

SEQ ID NO: 374152 - DNA, 22 bp, Homo sapiens
acttttcgttaacattgaccaa

SEQ ID NO: 374153 - DNA, 16 bp, Homo sapiens
acttttgaaatttaaa

SEQ ID NO: 374154 - DNA, 23 bp, Homo sapiens
acttttgaagaacaaaaggcttt

SEQ ID NO: 374155 - DNA, 12 bp, Homo sapiens
acttttgcacat

SEQ ID NO: 374156 - DNA, 18 bp, Homo sapiens
acttttgcacatatattt

SEQ ID NO: 374157 - DNA, 12 bp, Homo sapiens
acttttgtaaat

SEQ ID NO: 374158 - DNA, 15 bp, Homo sapiens
acttttgtaaatatt

SEQ ID NO: 374159 - DNA, 18 bp, Homo sapiens
acttttgtaaatattctt

SEQ ID NO: 374160 - DNA, 18 bp, Homo sapiens
actttttaaaatgttggt

SEQ ID NO: 374161 - DNA, 14 bp, Homo sapiens
actttttaaacagt

SEQ ID NO: 374162 - DNA, 17 bp, Homo sapiens
actttttaaacagtgtt

SEQ ID NO: 374163 - DNA, 22 bp, Homo sapiens
actttttaaacagtgtttatga

SEQ ID NO: 374164 - DNA, 10 bp, Homo sapiens
actttttagc

SEQ ID NO: 374165 - DNA, 15 bp, Homo sapiens
actttttcaatggtt

SEQ ID NO: 374166 - DNA, 18 bp, Homo sapiens
actttttcacataagcca

SEQ ID NO: 374167 - DNA, 21 bp, Homo sapiens
actttttccatttcttcagag

SEQ ID NO: 374168 - DNA, 19 bp, Homo sapiens
actttttccttcctgccct

SEQ ID NO: 374169 - DNA, 20 bp, Homo sapiens
actttttccttcctgccctg

SEQ ID NO: 374170 - DNA, 13 bp, Homo sapiens
actttttgcagct

SEQ ID NO: 374171 - DNA, 15 bp, Homo sapiens
acttttttcctgtca

SEQ ID NO: 374172 - DNA, 21 bp, Homo sapiens
acttttttcctgtcaatatat

SEQ ID NO: 374173 - DNA, 20 bp, Homo sapiens
accgtggtgtgaggcccccg

SEQ ID NO: 374174 - DNA, 18 bp, Homo sapiens
accgtttggtgtctgatg

SEQ ID NO: 374175 - DNA, 19 bp, Homo sapiens
accgttttcatcctggcct

SEQ ID NO: 374176 - DNA, 20 bp, Homo sapiens
accgttttcatcctggcctc

SEQ ID NO: 374177 - DNA, 19 bp, Homo sapiens
accgtttttatattacttt

SEQ ID NO: 374178 - DNA, 17 bp, Homo sapiens
acctaaatccattttct

SEQ ID NO: 374179 - DNA, 18 bp, Homo sapiens
acctaaatccattttcta

SEQ ID NO: 374180 - DNA, 19 bp, Homo sapiens
acctaacattcgatctcat

SEQ ID NO: 374181 - DNA, 18 bp, Homo sapiens
acctaagtgacatttgta

SEQ ID NO: 374182 - DNA, 15 bp, Homo sapiens
acctaattagagcag

SEQ ID NO: 374183 - DNA, 16 bp, Homo sapiens
acctaattagagcaga

SEQ ID NO: 374184 - DNA, 19 bp, Homo sapiens
acctaattagagcagatga

SEQ ID NO: 374185 - DNA, 23 bp, Homo sapiens
acctacaaaaaaacctttattct

SEQ ID NO: 374186 - DNA, 16 bp, Homo sapiens
acctaccaccccactg

SEQ ID NO: 374187 - DNA, 15 bp, Homo sapiens
acctaccatgctgct

SEQ ID NO: 374188 - DNA, 16 bp, Homo sapiens
acctaccatgctgctt

SEQ ID NO: 374189 - DNA, 22 bp, Homo sapiens
acctaccccagttcatctctgc

SEQ ID NO: 374190 - DNA, 18 bp, Homo sapiens
acctacctgtaacttttt

SEQ ID NO: 374191 - DNA, 18 bp, Homo sapiens
acctaccttcaaagctga

SEQ ID NO: 374192 - DNA, 18 bp, Homo sapiens
acctaccttcatttcagg

SEQ ID NO: 374193 - DNA, 15 bp, Homo sapiens
acctacgaccccaga

SEQ ID NO: 374194 - DNA, 15 bp, Homo sapiens
acctactatgtgctg

SEQ ID NO: 374195 - DNA, 15 bp, Homo sapiens
acctacttcctcctc

SEQ ID NO: 374196 - DNA, 20 bp, Homo sapiens
acctacttgtgactgaaggg

SEQ ID NO: 374197 - DNA, 23 bp, Homo sapiens
acctagtactctctgctctagcc

SEQ ID NO: 374198 - DNA, 19 bp, Homo sapiens
acctataaagtaaagctaa

SEQ ID NO: 374199 - DNA, 14 bp, Homo sapiens
acctataaatacta

SEQ ID NO: 374200 - DNA, 14 bp, Homo sapiens
acctatagaaatgt

SEQ ID NO: 374201 - DNA, 17 bp, Homo sapiens
acctatatgatttatag

SEQ ID NO: 374202 - DNA, 15 bp, Homo sapiens
acctatctcgtggga

SEQ ID NO: 374203 - DNA, 17 bp, Homo sapiens
acctatctcgtgggaga

SEQ ID NO: 374204 - DNA, 21 bp, Homo sapiens
acctatgagatggccatgctc

SEQ ID NO: 374205 - DNA, 12 bp, Homo sapiens
acctatgcctgt

SEQ ID NO: 374206 - DNA, 21 bp, Homo sapiens
acctatgcctgtggtgaagtg

SEQ ID NO: 374207 - DNA, 21 bp, Homo sapiens
acctatgcttctagaaagccc

SEQ ID NO: 374208 - DNA, 17 bp, Homo sapiens
acctatgtcctaaggac

SEQ ID NO: 374209 - DNA, 19 bp, Homo sapiens
acctatgtcctaaggacac

SEQ ID NO: 374210 - DNA, 22 bp, Homo sapiens
acctatgtcctaaggacacact

SEQ ID NO: 374211 - DNA, 22 bp, Homo sapiens
acctattgctgtaaataaaaat

SEQ ID NO: 374212 - DNA, 21 bp, Homo sapiens
acctcaacccccatttctatt

SEQ ID NO: 374213 - DNA, 20 bp, Homo sapiens
acctcaagggggactgtctt

SEQ ID NO: 374214 - DNA, 15 bp, Homo sapiens
acctcaatgccctgc

SEQ ID NO: 374215 - DNA, 18 bp, Homo sapiens
acctcaatgccctgccat

SEQ ID NO: 374216 - DNA, 17 bp, Homo sapiens
acctcaatggaggtttg

SEQ ID NO: 374217 - DNA, 20 bp, Homo sapiens
acctcacaactccttccatc

SEQ ID NO: 374218 - DNA, 14 bp, Homo sapiens
acctcacgctctgg

SEQ ID NO: 374219 - DNA, 16 bp, Homo sapiens
acctcactgccctccc

SEQ ID NO: 374220 - DNA, 17 bp, Homo sapiens
acctcactggtgcattt

SEQ ID NO: 374221 - DNA, 22 bp, Homo sapiens
acctcagacttaccaggaagca

SEQ ID NO: 374222 - DNA, 15 bp, Homo sapiens
acctcagctctggga

SEQ ID NO: 374223 - DNA, 22 bp, Homo sapiens
acctcagctctgggagaggatt

SEQ ID NO: 374224 - DNA, 23 bp, Homo sapiens
acctcagctctgggagaggattt

SEQ ID NO: 374225 - DNA, 16 bp, Homo sapiens
acctcagctgcacatt

SEQ ID NO: 374226 - DNA, 20 bp, Homo sapiens
acctcagctgcacattcctg

SEQ ID NO: 374227 - DNA, 16 bp, Homo sapiens
acctcaggaccccaga

SEQ ID NO: 374228 - DNA, 18 bp, Homo sapiens
acctcaggaccccagagg

SEQ ID NO: 374229 - DNA, 15 bp, Homo sapiens
acctcaggcaggaag

SEQ ID NO: 374230 - DNA, 21 bp, Homo sapiens
acctcagtgtcatttatgaaa

SEQ ID NO: 374231 - DNA, 22 bp, Homo sapiens
acctcagttcccttggcctcag

SEQ ID NO: 374232 - DNA, 14 bp, Homo sapiens
acctcagtttctgt

SEQ ID NO: 374233 - DNA, 14 bp, Homo sapiens
acctcatatgctat

SEQ ID NO: 374234 - DNA, 19 bp, Homo sapiens
acctcatctccaagatagc

SEQ ID NO: 374235 - DNA, 23 bp, Homo sapiens
acctcatgcctggcccccctcca

SEQ ID NO: 374236 - DNA, 22 bp, Homo sapiens
acctcattaaatggtgatttct

SEQ ID NO: 374237 - DNA, 23 bp, Homo sapiens
acctcattaaatggtgatttctt

SEQ ID NO: 374238 - DNA, 14 bp, Homo sapiens
acctcatttgcatc

SEQ ID NO: 374239 - DNA, 21 bp, Homo sapiens
acctccaagcaagtagctttc

SEQ ID NO: 374240 - DNA, 14 bp, Homo sapiens
acctccacccagcc

SEQ ID NO: 374241 - DNA, 14 bp, Homo sapiens
acctccacccgtcc

SEQ ID NO: 374242 - DNA, 14 bp, Homo sapiens
acctccacctggga

SEQ ID NO: 374243 - DNA, 13 bp, Homo sapiens
acctccagcccac

SEQ ID NO: 374244 - DNA, 20 bp, Homo sapiens
acctccagcccacagtgctc

SEQ ID NO: 374245 - DNA, 14 bp, Homo sapiens
acctcccacctttg

SEQ ID NO: 374246 - DNA, 16 bp, Homo sapiens
acctcccacctttggt

SEQ ID NO: 374247 - DNA, 20 bp, Homo sapiens
acctccccaggccgtggctg

SEQ ID NO: 374248 - DNA, 18 bp, Homo sapiens
acctcccccaaaccctgc

SEQ ID NO: 374249 - DNA, 13 bp, Homo sapiens
acctcccctcctt

SEQ ID NO: 374250 - DNA, 19 bp, Homo sapiens
acctcccctccttgcctcc

SEQ ID NO: 374251 - DNA, 21 bp, Homo sapiens
acctcccctccttgcctcctg

SEQ ID NO: 374252 - DNA, 22 bp, Homo sapiens
acctcccctccttgcctcctgt

SEQ ID NO: 374253 - DNA, 18 bp, Homo sapiens
acctcccctcttcctgga

SEQ ID NO: 374254 - DNA, 15 bp, Homo sapiens
acctccctcccggca

SEQ ID NO: 374255 - DNA, 13 bp, Homo sapiens
acctccctgaccc

SEQ ID NO: 374256 - DNA, 15 bp, Homo sapiens
acctccctgcccagg

SEQ ID NO: 374257 - DNA, 18 bp, Homo sapiens
acctccctgcccaggccg

SEQ ID NO: 374258 - DNA, 18 bp, Homo sapiens
acctccctgggcctgtct

SEQ ID NO: 374259 - DNA, 19 bp, Homo sapiens
acctccctgggcctgtctc

SEQ ID NO: 374260 - DNA, 20 bp, Homo sapiens
acctccctgtctctacaaaa

SEQ ID NO: 374261 - DNA, 22 bp, Homo sapiens
acctcccttcagtcaccactcc

SEQ ID NO: 374262 - DNA, 21 bp, Homo sapiens
acctcctatccttggagagca

SEQ ID NO: 374263 - DNA, 16 bp, Homo sapiens
acctcctccacaccag

SEQ ID NO: 374264 - DNA, 15 bp, Homo sapiens
acctcctctctgctg

SEQ ID NO: 374265 - DNA, 19 bp, Homo sapiens
acctccttgtcactttatt

SEQ ID NO: 374266 - DNA, 23 bp, Homo sapiens
acctcgtcccgttctccattctg

SEQ ID NO: 374267 - DNA, 24 bp, Homo sapiens
acctctaacaccacactgaccaca

SEQ ID NO: 374268 - DNA, 14 bp, Homo sapiens
acctctacaggcat

SEQ ID NO: 374269 - DNA, 14 bp, Homo sapiens
acctctactttcca

SEQ ID NO: 374270 - DNA, 16 bp, Homo sapiens
acctctaggcctcagt

SEQ ID NO: 374271 - DNA, 12 bp, Homo sapiens
acctctcaatat

SEQ ID NO: 374272 - DNA, 19 bp, Homo sapiens
acctctcaatattcaataa

SEQ ID NO: 374273 - DNA, 23 bp, Homo sapiens
acctctcaatattcaataaagct

SEQ ID NO: 374274 - DNA, 17 bp, Homo sapiens
acctctcagatccctcg

SEQ ID NO: 374275 - DNA, 17 bp, Homo sapiens
acctctcatcagcccag

SEQ ID NO: 374276 - DNA, 18 bp, Homo sapiens
acctctcatcagtgtcct

SEQ ID NO: 374277 - DNA, 16 bp, Homo sapiens
acctctccaagtctct

SEQ ID NO: 374278 - DNA, 18 bp, Homo sapiens
acctctccagcctcagct

SEQ ID NO: 374279 - DNA, 23 bp, Homo sapiens
acctctctcctttgctgaggcct

SEQ ID NO: 374280 - DNA, 17 bp, Homo sapiens
acctctctctatatata

SEQ ID NO: 374281 - DNA, 16 bp, Homo sapiens
acctctctctgctcct

SEQ ID NO: 374282 - DNA, 19 bp, Homo sapiens
acctctctgtagtttatgg

SEQ ID NO: 374283 - DNA, 20 bp, Homo sapiens
acctctctgtagtttatggc

SEQ ID NO: 374284 - DNA, 13 bp, Homo sapiens
acctctctgtctt

SEQ ID NO: 374285 - DNA, 22 bp, Homo sapiens
acctctcttatagaatatttat

SEQ ID NO: 374286 - DNA, 15 bp, Homo sapiens
acctctgaagagctg

SEQ ID NO: 374287 - DNA, 19 bp, Homo sapiens
acctctgaaggcaaatata

SEQ ID NO: 374288 - DNA, 10 bp, Homo sapiens
acctctgagg

SEQ ID NO: 374289 - DNA, 17 bp, Homo sapiens
acctctgaggactctgg

SEQ ID NO: 374290 - DNA, 14 bp, Homo sapiens
acctctggactggc

SEQ ID NO: 374291 - DNA, 14 bp, Homo sapiens
acctctggctagag

SEQ ID NO: 374292 - DNA, 23 bp, Homo sapiens
acctctggctccttcagcagcta

SEQ ID NO: 374293 - DNA, 16 bp, Homo sapiens
acctctgggccctgca

SEQ ID NO: 374294 - DNA, 12 bp, Homo sapiens
acctctgggctt

SEQ ID NO: 374295 - DNA, 14 bp, Homo sapiens
acctctgttgtcct

SEQ ID NO: 374296 - DNA, 16 bp, Homo sapiens
acctctgttgtcctcc

SEQ ID NO: 374297 - DNA, 20 bp, Homo sapiens
acctctgttgtcctcccctt

SEQ ID NO: 374298 - DNA, 22 bp, Homo sapiens
acctctgttgtcctccccttgg

SEQ ID NO: 374299 - DNA, 20 bp, Homo sapiens
acctcttaacaatttctgtc

SEQ ID NO: 374300 - DNA, 14 bp, Homo sapiens
acctcttcccatga

SEQ ID NO: 374301 - DNA, 12 bp, Homo sapiens
acctcttgtttt

SEQ ID NO: 374302 - DNA, 21 bp, Homo sapiens
acattaaaagaagactggaag

SEQ ID NO: 374303 - DNA, 14 bp, Homo sapiens
acattaaaataact

SEQ ID NO: 374304 - DNA, 21 bp, Homo sapiens
acattaaacactgtaatctta

SEQ ID NO: 374305 - DNA, 18 bp, Homo sapiens
acattaacagttttccat

SEQ ID NO: 374306 - DNA, 15 bp, Homo sapiens
acattaatgttaatt

SEQ ID NO: 374307 - DNA, 22 bp, Homo sapiens
acattaatgttaattcagcact

SEQ ID NO: 374308 - DNA, 18 bp, Homo sapiens
acattacaaacaaaggat

SEQ ID NO: 374309 - DNA, 15 bp, Homo sapiens
acattacaaatttct

SEQ ID NO: 374310 - DNA, 14 bp, Homo sapiens
acattactgccttc

SEQ ID NO: 374311 - DNA, 13 bp, Homo sapiens
acattagaagaaa

SEQ ID NO: 374312 - DNA, 16 bp, Homo sapiens
acattagaagaaaaca

SEQ ID NO: 374313 - DNA, 18 bp, Homo sapiens
acattagaagaaaacata

SEQ ID NO: 374314 - DNA, 21 bp, Homo sapiens
acattagaagaaaacatatat

SEQ ID NO: 374315 - DNA, 18 bp, Homo sapiens
acattagcagtttgcttt

SEQ ID NO: 374316 - DNA, 22 bp, Homo sapiens
acattagcagtttgctttgtat

SEQ ID NO: 374317 - DNA, 14 bp, Homo sapiens
acattatagaaatt

SEQ ID NO: 374318 - DNA, 18 bp, Homo sapiens
acattattatcaacaata

SEQ ID NO: 374319 - DNA, 13 bp, Homo sapiens
acattatttgcat

SEQ ID NO: 374320 - DNA, 16 bp, Homo sapiens
acattcaaaagcacaa

SEQ ID NO: 374321 - DNA, 23 bp, Homo sapiens
acattcaagattaaactgagtga

SEQ ID NO: 374322 - DNA, 20 bp, Homo sapiens
acattcacacagggctcttt

SEQ ID NO: 374323 - DNA, 13 bp, Homo sapiens
acattcaccaaca

SEQ ID NO: 374324 - DNA, 16 bp, Homo sapiens
acattcagaacaccaa

SEQ ID NO: 374325 - DNA, 23 bp, Homo sapiens
acattcattcaacagctgatgcc

SEQ ID NO: 374326 - DNA, 17 bp, Homo sapiens
acattccatcacagcca

SEQ ID NO: 374327 - DNA, 18 bp, Homo sapiens
acattccatcacagccag

SEQ ID NO: 374328 - DNA, 19 bp, Homo sapiens
acattccatcacagccagc

SEQ ID NO: 374329 - DNA, 17 bp, Homo sapiens
acattcccatctgtcac

SEQ ID NO: 374330 - DNA, 13 bp, Homo sapiens
acattcccctccc

SEQ ID NO: 374331 - DNA, 12 bp, Homo sapiens
acattccctctc

SEQ ID NO: 374332 - DNA, 14 bp, Homo sapiens
acattccctctcct

SEQ ID NO: 374333 - DNA, 15 bp, Homo sapiens
acattccgaagaggg

SEQ ID NO: 374334 - DNA, 15 bp, Homo sapiens
acattcctcagctgc

SEQ ID NO: 374335 - DNA, 17 bp, Homo sapiens
acattcctcagctgcca

SEQ ID NO: 374336 - DNA, 18 bp, Homo sapiens
acattcctcatgaatgta

SEQ ID NO: 374337 - DNA, 13 bp, Homo sapiens
acattcctccagc

SEQ ID NO: 374338 - DNA, 17 bp, Homo sapiens
acattcctccagcctcc

SEQ ID NO: 374339 - DNA, 23 bp, Homo sapiens
acattcctccagcctcccctccc

SEQ ID NO: 374340 - DNA, 17 bp, Homo sapiens
acattcctgagattctg

SEQ ID NO: 374341 - DNA, 19 bp, Homo sapiens
acattcctggccccgggct

SEQ ID NO: 374342 - DNA, 19 bp, Homo sapiens
acattccttgtcaccagca

SEQ ID NO: 374343 - DNA, 23 bp, Homo sapiens
acattcgaggtgtcaccctgcag

SEQ ID NO: 374344 - DNA, 16 bp, Homo sapiens
acattcgatctcattc

SEQ ID NO: 374345 - DNA, 12 bp, Homo sapiens
acattctgctgc

SEQ ID NO: 374346 - DNA, 18 bp, Homo sapiens
acattctttaacatacat

SEQ ID NO: 374347 - DNA, 15 bp, Homo sapiens
acattgaagtaatga

SEQ ID NO: 374348 - DNA, 16 bp, Homo sapiens
acattgaccaagaact

SEQ ID NO: 374349 - DNA, 19 bp, Homo sapiens
acattgcccacacctgcct

SEQ ID NO: 374350 - DNA, 22 bp, Homo sapiens
acattgcccacacctgcctctg

SEQ ID NO: 374351 - DNA, 12 bp, Homo sapiens
acattgccccaa

SEQ ID NO: 374352 - DNA, 15 bp, Homo sapiens
acattgccccaagat

SEQ ID NO: 374353 - DNA, 22 bp, Homo sapiens
acattgtaatctgctttgttaa

SEQ ID NO: 374354 - DNA, 12 bp, Homo sapiens
acatttaaaaca

SEQ ID NO: 374355 - DNA, 20 bp, Homo sapiens
acatttaataactttgctgg

SEQ ID NO: 374356 - DNA, 19 bp, Homo sapiens
acatttacatgttcttcca

SEQ ID NO: 374357 - DNA, 15 bp, Homo sapiens
acatttatacatcac

SEQ ID NO: 374358 - DNA, 11 bp, Homo sapiens
acatttatctt

SEQ ID NO: 374359 - DNA, 15 bp, Homo sapiens
acatttatcttctgt

SEQ ID NO: 374360 - DNA, 17 bp, Homo sapiens
acatttatcttctgttt

SEQ ID NO: 374361 - DNA, 18 bp, Homo sapiens
acatttatgagtaactat

SEQ ID NO: 374362 - DNA, 14 bp, Homo sapiens
acatttatgtgtga

SEQ ID NO: 374363 - DNA, 24 bp, Homo sapiens
acatttcacctactttgtaagtga

SEQ ID NO: 374364 - DNA, 23 bp, Homo sapiens
acatttcattaaccaaagaaagt

SEQ ID NO: 374365 - DNA, 17 bp, Homo sapiens
acatttctaatttgaat

SEQ ID NO: 374366 - DNA, 14 bp, Homo sapiens
acatttctcatgtg

SEQ ID NO: 374367 - DNA, 16 bp, Homo sapiens
acatttctcatgtgct

SEQ ID NO: 374368 - DNA, 22 bp, Homo sapiens
acatttctcatgtgctttgtag

SEQ ID NO: 374369 - DNA, 22 bp, Homo sapiens
acatttgacacataaaagtaat

SEQ ID NO: 374370 - DNA, 15 bp, Homo sapiens
acatttgcatgcctt

SEQ ID NO: 374371 - DNA, 18 bp, Homo sapiens
acatttgggactgtcttg

SEQ ID NO: 374372 - DNA, 17 bp, Homo sapiens
acatttgggtaaatcat

SEQ ID NO: 374373 - DNA, 23 bp, Homo sapiens
acatttggtggtactttattctt

SEQ ID NO: 374374 - DNA, 22 bp, Homo sapiens
acatttgtcctgcagagctggg

SEQ ID NO: 374375 - DNA, 13 bp, Homo sapiens
acatttgtgcata

SEQ ID NO: 374376 - DNA, 13 bp, Homo sapiens
acattttaaaatc

SEQ ID NO: 374377 - DNA, 17 bp, Homo sapiens
acattttaaataaaaga

SEQ ID NO: 374378 - DNA, 20 bp, Homo sapiens
acattttaacagtacctgtg

SEQ ID NO: 374379 - DNA, 10 bp, Homo sapiens
acattttatt

SEQ ID NO: 374380 - DNA, 22 bp, Homo sapiens
acattttatttattagctgtaa

SEQ ID NO: 374381 - DNA, 18 bp, Homo sapiens
acattttcagtaccaaag

SEQ ID NO: 374382 - DNA, 19 bp, Homo sapiens
acattttcagtaccaaaga

SEQ ID NO: 374383 - DNA, 18 bp, Homo sapiens
acattttgacacaatgtt

SEQ ID NO: 374384 - DNA, 16 bp, Homo sapiens
acattttgctttataa

SEQ ID NO: 374385 - DNA, 16 bp, Homo sapiens
acattttgtagctagt

SEQ ID NO: 374386 - DNA, 19 bp, Homo sapiens
acattttttgtttcttggt

SEQ ID NO: 374387 - DNA, 17 bp, Homo sapiens
acattttttttcaagtg

SEQ ID NO: 374388 - DNA, 16 bp, Homo sapiens
accaaaataatacaac

SEQ ID NO: 374389 - DNA, 18 bp, Homo sapiens
accaaacggaactcttca

SEQ ID NO: 374390 - DNA, 11 bp, Homo sapiens
accaaagctga

SEQ ID NO: 374391 - DNA, 23 bp, Homo sapiens
accaaagctgacgaggctgggcc

SEQ ID NO: 374392 - DNA, 16 bp, Homo sapiens
accaaataaaaatatt

SEQ ID NO: 374393 - DNA, 19 bp, Homo sapiens
accaaatgcctctgccttg

SEQ ID NO: 374394 - DNA, 23 bp, Homo sapiens
accaaattaaaaatttttttaag

SEQ ID NO: 374395 - DNA, 13 bp, Homo sapiens
accaaattgctga

SEQ ID NO: 374396 - DNA, 16 bp, Homo sapiens
accaaattgctgagat

SEQ ID NO: 374397 - DNA, 13 bp, Homo sapiens
accaaatttgtac

SEQ ID NO: 374398 - DNA, 21 bp, Homo sapiens
accaaattttgaggtctttta

SEQ ID NO: 374399 - DNA, 16 bp, Homo sapiens
accaacaacagtcagc

SEQ ID NO: 374400 - DNA, 22 bp, Homo sapiens
accaacaattaggtctgcattt

SEQ ID NO: 374401 - DNA, 17 bp, Homo sapiens
accaacccatgccctgc

SEQ ID NO: 374402 - DNA, 14 bp, Homo sapiens
accaacccatgtat

SEQ ID NO: 374403 - DNA, 14 bp, Homo sapiens
accaacgggtctgt

SEQ ID NO: 374404 - DNA, 16 bp, Homo sapiens
accaacgggtctgtgg

SEQ ID NO: 374405 - DNA, 13 bp, Homo sapiens
accaactgcctta

SEQ ID NO: 374406 - DNA, 14 bp, Homo sapiens
accaactgggccca

SEQ ID NO: 374407 - DNA, 12 bp, Homo sapiens
accaactttctg

SEQ ID NO: 374408 - DNA, 18 bp, Homo sapiens
accaactttctgtaaact

SEQ ID NO: 374409 - DNA, 21 bp, Homo sapiens
accaacttttctattaaaagt

SEQ ID NO: 374410 - DNA, 22 bp, Homo sapiens
accaagaattctccaaaacaat

SEQ ID NO: 374411 - DNA, 16 bp, Homo sapiens
accaagatcacaaata

SEQ ID NO: 374412 - DNA, 20 bp, Homo sapiens
accaagatctataaagcgat

SEQ ID NO: 374413 - DNA, 16 bp, Homo sapiens
accaagccgtggcttc

SEQ ID NO: 374414 - DNA, 18 bp, Homo sapiens
aaatgatatgtctttaaa

SEQ ID NO: 374415 - DNA, 19 bp, Homo sapiens
aaatgatatgtctttaaaa

SEQ ID NO: 374416 - DNA, 20 bp, Homo sapiens
aaatgatatgtctttaaaat

SEQ ID NO: 374417 - DNA, 11 bp, Homo sapiens
aaatgattcca

SEQ ID NO: 374418 - DNA, 12 bp, Homo sapiens
aaatgattccaa

SEQ ID NO: 374419 - DNA, 15 bp, Homo sapiens
aaatgattgtaaaat

SEQ ID NO: 374420 - DNA, 22 bp, Homo sapiens
aaatgattgtaaaatagcttgt

SEQ ID NO: 374421 - DNA, 19 bp, Homo sapiens
aaatgattttcatcaattt

SEQ ID NO: 374422 - DNA, 18 bp, Homo sapiens
aaatgcacatttgtcact

SEQ ID NO: 374423 - DNA, 15 bp, Homo sapiens
aaatgcagacacaca

SEQ ID NO: 374424 - DNA, 21 bp, Homo sapiens
aaatgcagggaggggaggcag

SEQ ID NO: 374425 - DNA, 16 bp, Homo sapiens
aaatgcagttttaaga

SEQ ID NO: 374426 - DNA, 19 bp, Homo sapiens
aaatgcatatcctgagcca

SEQ ID NO: 374427 - DNA, 16 bp, Homo sapiens
aaatgcatgataatga

SEQ ID NO: 374428 - DNA, 15 bp, Homo sapiens
aaatgcattcatgtt

SEQ ID NO: 374429 - DNA, 18 bp, Homo sapiens
aaatgcattgaaagaatt

SEQ ID NO: 374430 - DNA, 17 bp, Homo sapiens
aaatgccacattttgct

SEQ ID NO: 374431 - DNA, 16 bp, Homo sapiens
aaatgccacttaacag

SEQ ID NO: 374432 - DNA, 23 bp, Homo sapiens
accaatcccgtgaaagaattatt

SEQ ID NO: 374433 - DNA, 16 bp, Homo sapiens
accaatctctgtgact

SEQ ID NO: 374434 - DNA, 12 bp, Homo sapiens
accaatgattca

SEQ ID NO: 374435 - DNA, 22 bp, Homo sapiens
accaatgcatgcagccactgtg

SEQ ID NO: 374436 - DNA, 14 bp, Homo sapiens
accaatgtgaagac

SEQ ID NO: 374437 - DNA, 16 bp, Homo sapiens
accaatgttgtgatta

SEQ ID NO: 374438 - DNA, 13 bp, Homo sapiens
accacaagagctc

SEQ ID NO: 374439 - DNA, 12 bp, Homo sapiens
accacaaggaaa

SEQ ID NO: 374440 - DNA, 20 bp, Homo sapiens
accacaaggctgaaaagtgc

SEQ ID NO: 374441 - DNA, 19 bp, Homo sapiens
accacacacacccttcccc

SEQ ID NO: 374442 - DNA, 21 bp, Homo sapiens
accacacttcctgtccagaga

SEQ ID NO: 374443 - DNA, 18 bp, Homo sapiens
accacacttcttgaaaca

SEQ ID NO: 374444 - DNA, 14 bp, Homo sapiens
accacagacacaca

SEQ ID NO: 374445 - DNA, 18 bp, Homo sapiens
accacagacacacacacg

SEQ ID NO: 374446 - DNA, 18 bp, Homo sapiens
accacagacgccacctgg

SEQ ID NO: 374447 - DNA, 21 bp, Homo sapiens
accacagatactgaaacattt

SEQ ID NO: 374448 - DNA, 17 bp, Homo sapiens
accacagccctgtcagt

SEQ ID NO: 374449 - DNA, 16 bp, Homo sapiens
accacaggatctgaac

SEQ ID NO: 374450 - DNA, 11 bp, Homo sapiens
accacagtgtc

SEQ ID NO: 374451 - DNA, 12 bp, Homo sapiens
accacagtgtct

SEQ ID NO: 374452 - DNA, 13 bp, Homo sapiens
accacagtgtctg

SEQ ID NO: 374453 - DNA, 13 bp, Homo sapiens
accaccaaatgac

SEQ ID NO: 374454 - DNA, 15 bp, Homo sapiens
accaccacacccctg

SEQ ID NO: 374455 - DNA, 23 bp, Homo sapiens
accaccacttatgcccctagaag

SEQ ID NO: 374456 - DNA, 13 bp, Homo sapiens
accaccatttccc

SEQ ID NO: 374457 - DNA, 16 bp, Homo sapiens
accacccctccctctg

SEQ ID NO: 374458 - DNA, 13 bp, Homo sapiens
accaccctgaggg

SEQ ID NO: 374459 - DNA, 17 bp, Homo sapiens
accaccgcatatgcatg

SEQ ID NO: 374460 - DNA, 21 bp, Homo sapiens
accaccgcatatgcatgccag

SEQ ID NO: 374461 - DNA, 22 bp, Homo sapiens
accaccgccctcctcgctgtgc

SEQ ID NO: 374462 - DNA, 13 bp, Homo sapiens
accaccgctcccc

SEQ ID NO: 374463 - DNA, 15 bp, Homo sapiens
accaccgctccccag

SEQ ID NO: 374464 - DNA, 22 bp, Homo sapiens
accaccggggcactggctgctc

SEQ ID NO: 374465 - DNA, 16 bp, Homo sapiens
accacctctctgtctt

SEQ ID NO: 374466 - DNA, 13 bp, Homo sapiens
accacctctggcc

SEQ ID NO: 374467 - DNA, 19 bp, Homo sapiens
accacctggagcggctcat

SEQ ID NO: 374468 - DNA, 16 bp, Homo sapiens
accacctgtacataca

SEQ ID NO: 374469 - DNA, 21 bp, Homo sapiens
accaccttctgtccccagccc

SEQ ID NO: 374470 - DNA, 13 bp, Homo sapiens
accacgaggaaaa

SEQ ID NO: 374471 - DNA, 19 bp, Homo sapiens
accacgcccagctaatttt

SEQ ID NO: 374472 - DNA, 19 bp, Homo sapiens
accacggggtcgggggagg

SEQ ID NO: 374473 - DNA, 14 bp, Homo sapiens
accacgtccagctg

SEQ ID NO: 374474 - DNA, 19 bp, Homo sapiens
accacgtctgccaggccca

SEQ ID NO: 374475 - DNA, 22 bp, Homo sapiens
accacgtctgccaggcccatct

SEQ ID NO: 374476 - DNA, 17 bp, Homo sapiens
accacgtctgtcttcac

SEQ ID NO: 374477 - DNA, 15 bp, Homo sapiens
accactaaccatccc

SEQ ID NO: 374478 - DNA, 18 bp, Homo sapiens
accactaaccatccccaa

SEQ ID NO: 374479 - DNA, 21 bp, Homo sapiens
accactaatttgtcactggaa

SEQ ID NO: 374480 - DNA, 17 bp, Homo sapiens
accactacatgcagccc

SEQ ID NO: 374481 - DNA, 13 bp, Homo sapiens
accactcttgact

SEQ ID NO: 374482 - DNA, 14 bp, Homo sapiens
accactgagccctt

SEQ ID NO: 374483 - DNA, 18 bp, Homo sapiens
accactgagcccttgcac

SEQ ID NO: 374484 - DNA, 17 bp, Homo sapiens
accactgccctgcctgc

SEQ ID NO: 374485 - DNA, 15 bp, Homo sapiens
accactgctaataaa

SEQ ID NO: 374486 - DNA, 20 bp, Homo sapiens
accactgctaataaatgacc

SEQ ID NO: 374487 - DNA, 23 bp, Homo sapiens
accactgctaataaatgaccagt

SEQ ID NO: 374488 - DNA, 13 bp, Homo sapiens
accactgggcctg

SEQ ID NO: 374489 - DNA, 16 bp, Homo sapiens
accactgggcctgcta

SEQ ID NO: 374490 - DNA, 12 bp, Homo sapiens
accacttaatct

SEQ ID NO: 374491 - DNA, 13 bp, Homo sapiens
accacttaatctt

SEQ ID NO: 374492 - DNA, 14 bp, Homo sapiens
accacttaatcttc

SEQ ID NO: 374493 - DNA, 22 bp, Homo sapiens
accacttggagatctttgcttc

SEQ ID NO: 374494 - DNA, 17 bp, Homo sapiens
accactttttgcagctt

SEQ ID NO: 374495 - DNA, 14 bp, Homo sapiens
accagaagggaaac

SEQ ID NO: 374496 - DNA, 16 bp, Homo sapiens
accagaatgattttga

SEQ ID NO: 374497 - DNA, 17 bp, Homo sapiens
accagaattgtgcaaat

SEQ ID NO: 374498 - DNA, 21 bp, Homo sapiens
accagaattgtgcaaatggaa

SEQ ID NO: 374499 - DNA, 20 bp, Homo sapiens
accagagcatttccaacacc

SEQ ID NO: 374500 - DNA, 23 bp, Homo sapiens
accagagccatggactctacact

SEQ ID NO: 374501 - DNA, 11 bp, Homo sapiens
accagagcccc

SEQ ID NO: 374502 - DNA, 15 bp, Homo sapiens
accagagctctggag

SEQ ID NO: 374503 - DNA, 23 bp, Homo sapiens
accagagctctggagccacctgt

SEQ ID NO: 374504 - DNA, 20 bp, Homo sapiens
accagataagaatgctggtt

SEQ ID NO: 374505 - DNA, 24 bp, Homo sapiens
accagatgagaagttaagcagcct

SEQ ID NO: 374506 - DNA, 19 bp, Homo sapiens
accagcaacatctcgagcc

SEQ ID NO: 374507 - DNA, 23 bp, Homo sapiens
accagcaacatctcgagccccct

SEQ ID NO: 374508 - DNA, 23 bp, Homo sapiens
accagcaacttgtctttttctgg

SEQ ID NO: 374509 - DNA, 17 bp, Homo sapiens
accagcaatatatctga

SEQ ID NO: 374510 - DNA, 17 bp, Homo sapiens
accagcaatatgtaaat

SEQ ID NO: 374511 - DNA, 12 bp, Homo sapiens
accagcactccc

SEQ ID NO: 374512 - DNA, 15 bp, Homo sapiens
accagcactcccagg

SEQ ID NO: 374513 - DNA, 16 bp, Homo sapiens
accagcactcccaggg

SEQ ID NO: 374514 - DNA, 23 bp, Homo sapiens
accagcactcccagggcccgagc

SEQ ID NO: 374515 - DNA, 15 bp, Homo sapiens
accagcactgtctca

SEQ ID NO: 374516 - DNA, 16 bp, Homo sapiens
accagcactgtctcag

SEQ ID NO: 374517 - DNA, 12 bp, Homo sapiens
accagcagcaca

SEQ ID NO: 374518 - DNA, 13 bp, Homo sapiens
accagcagcacaa

SEQ ID NO: 374519 - DNA, 15 bp, Homo sapiens
accagcagcacaatt

SEQ ID NO: 374520 - DNA, 13 bp, Homo sapiens
accagcaggtgtg

SEQ ID NO: 374521 - DNA, 16 bp, Homo sapiens
accagcagtcacaggt

SEQ ID NO: 374522 - DNA, 15 bp, Homo sapiens
accagccccagcaag

SEQ ID NO: 374523 - DNA, 18 bp, Homo sapiens
accagccccagcaagagc

SEQ ID NO: 374524 - DNA, 19 bp, Homo sapiens
accagccccccaccccaca

SEQ ID NO: 374525 - DNA, 14 bp, Homo sapiens
accagccccctgga

SEQ ID NO: 374526 - DNA, 19 bp, Homo sapiens
accagccccctggatgggc

SEQ ID NO: 374527 - DNA, 14 bp, Homo sapiens
accagcccggcctg

SEQ ID NO: 374528 - DNA, 16 bp, Homo sapiens
accagcccggcctgct

SEQ ID NO: 374529 - DNA, 21 bp, Homo sapiens
accagcccggcctgctcccag

SEQ ID NO: 374530 - DNA, 13 bp, Homo sapiens
accagccctccag

SEQ ID NO: 374531 - DNA, 20 bp, Homo sapiens
accagccctccagagcagga

SEQ ID NO: 374532 - DNA, 20 bp, Homo sapiens
accagccctgctgcttccta

SEQ ID NO: 374533 - DNA, 23 bp, Homo sapiens
accagccctgctgcttcctaact

SEQ ID NO: 374534 - DNA, 16 bp, Homo sapiens
accagcccttccctgc

SEQ ID NO: 374535 - DNA, 18 bp, Homo sapiens
accagcccttccctgctt

SEQ ID NO: 374536 - DNA, 15 bp, Homo sapiens
accagccgccccagc

SEQ ID NO: 374537 - DNA, 19 bp, Homo sapiens
accagcctccatgctgcct

SEQ ID NO: 374538 - DNA, 20 bp, Homo sapiens
accagcctccatgctgcctc

SEQ ID NO: 374539 - DNA, 14 bp, Homo sapiens
accagcctgagcca

SEQ ID NO: 374540 - DNA, 20 bp, Homo sapiens
accagcctggtcaacatggt

SEQ ID NO: 374541 - DNA, 11 bp, Homo sapiens
accagcctttc

SEQ ID NO: 374542 - DNA, 12 bp, Homo sapiens
accagcctttct

SEQ ID NO: 374543 - DNA, 17 bp, Homo sapiens
accagcgcccgctgggc

SEQ ID NO: 374544 - DNA, 20 bp, Homo sapiens
accagcgcccgctgggctga

SEQ ID NO: 374545 - DNA, 18 bp, Homo sapiens
accagctagaaagtggca

SEQ ID NO: 374546 - DNA, 14 bp, Homo sapiens
accagctccactgg

SEQ ID NO: 374547 - DNA, 17 bp, Homo sapiens
accagctccactggcct

SEQ ID NO: 374548 - DNA, 20 bp, Homo sapiens
accagctcccaacagaggcc

SEQ ID NO: 374549 - DNA, 13 bp, Homo sapiens
accagctctgtgg

SEQ ID NO: 374550 - DNA, 14 bp, Homo sapiens
accagctgctctgc

SEQ ID NO: 374551 - DNA, 15 bp, Homo sapiens
accagctgctctgcc

SEQ ID NO: 374552 - DNA, 15 bp, Homo sapiens
accaggaagaaggcc

SEQ ID NO: 374553 - DNA, 13 bp, Homo sapiens
aaattgcttttgt

SEQ ID NO: 374554 - DNA, 23 bp, Homo sapiens
aaattgcttttgttgtgactttt

SEQ ID NO: 374555 - DNA, 15 bp, Homo sapiens
aaattggcaccatgt

SEQ ID NO: 374556 - DNA, 17 bp, Homo sapiens
aaattggcattaaaact

SEQ ID NO: 374557 - DNA, 19 bp, Homo sapiens
aaattggctcctttcccac

SEQ ID NO: 374558 - DNA, 21 bp, Homo sapiens
aaattggctcctttcccacag

SEQ ID NO: 374559 - DNA, 21 bp, Homo sapiens
aaattgggcttgtgatttcca

SEQ ID NO: 374560 - DNA, 18 bp, Homo sapiens
aaattgggtgtgccctgg

SEQ ID NO: 374561 - DNA, 19 bp, Homo sapiens
aaattggtgataagtggaa

SEQ ID NO: 374562 - DNA, 20 bp, Homo sapiens
aaattggtgataagtggaaa

SEQ ID NO: 374563 - DNA, 21 bp, Homo sapiens
acccacccttctcccctgccc

SEQ ID NO: 374564 - DNA, 20 bp, Homo sapiens
acccaccgatggagccccca

SEQ ID NO: 374565 - DNA, 16 bp, Homo sapiens
acccacctcagcctcc

SEQ ID NO: 374566 - DNA, 13 bp, Homo sapiens
acccacctccacc

SEQ ID NO: 374567 - DNA, 16 bp, Homo sapiens
acccacctccacccag

SEQ ID NO: 374568 - DNA, 17 bp, Homo sapiens
acccacctccacccagc

SEQ ID NO: 374569 - DNA, 18 bp, Homo sapiens
acccacctccacccagcc

SEQ ID NO: 374570 - DNA, 20 bp, Homo sapiens
acccacctccacccagcccc

SEQ ID NO: 374571 - DNA, 13 bp, Homo sapiens
acccacctgagct

SEQ ID NO: 374572 - DNA, 14 bp, Homo sapiens
acccacctgagctt

SEQ ID NO: 374573 - DNA, 19 bp, Homo sapiens
acccacctggtggcctctg

SEQ ID NO: 374574 - DNA, 19 bp, Homo sapiens
acccaccttgttggagcct

SEQ ID NO: 374575 - DNA, 22 bp, Homo sapiens
acccaccttgttggagcctgca

SEQ ID NO: 374576 - DNA, 23 bp, Homo sapiens
acccaccttgttggagcctgcag

SEQ ID NO: 374577 - DNA, 16 bp, Homo sapiens
acccactagccctctt

SEQ ID NO: 374578 - DNA, 14 bp, Homo sapiens
acccactcaccagg

SEQ ID NO: 374579 - DNA, 17 bp, Homo sapiens
acccactcaccagggtc

SEQ ID NO: 374580 - DNA, 13 bp, Homo sapiens
acccactcaggat

SEQ ID NO: 374581 - DNA, 23 bp, Homo sapiens
acccactccggattccggccctg

SEQ ID NO: 374582 - DNA, 17 bp, Homo sapiens
acccactgtccgcctct

SEQ ID NO: 374583 - DNA, 18 bp, Homo sapiens
acccactgtccgcctctg

SEQ ID NO: 374584 - DNA, 15 bp, Homo sapiens
acccacttagtccac

SEQ ID NO: 374585 - DNA, 19 bp, Homo sapiens
acccagaacctttttatag

SEQ ID NO: 374586 - DNA, 14 bp, Homo sapiens
acccagagagaaaa

SEQ ID NO: 374587 - DNA, 19 bp, Homo sapiens
acccagagagaaaaagaga

SEQ ID NO: 374588 - DNA, 21 bp, Homo sapiens
acccagagagaaaaagagaga

SEQ ID NO: 374589 - DNA, 14 bp, Homo sapiens
acccagccaccttc

SEQ ID NO: 374590 - DNA, 23 bp, Homo sapiens
acccagccaccttcctgactggg

SEQ ID NO: 374591 - DNA, 14 bp, Homo sapiens
acccagcccctggc

SEQ ID NO: 374592 - DNA, 16 bp, Homo sapiens
acccagccccttgaga

SEQ ID NO: 374593 - DNA, 17 bp, Homo sapiens
acccagccccttgagaa

SEQ ID NO: 374594 - DNA, 17 bp, Homo sapiens
acccagcgttcttcagg

SEQ ID NO: 374595 - DNA, 21 bp, Homo sapiens
acccagctactctgtccaggc

SEQ ID NO: 374596 - DNA, 17 bp, Homo sapiens
acccagctccaggggcc

SEQ ID NO: 374597 - DNA, 19 bp, Homo sapiens
acccaggagggagggggct

SEQ ID NO: 374598 - DNA, 17 bp, Homo sapiens
acccaggccctccatgg

SEQ ID NO: 374599 - DNA, 20 bp, Homo sapiens
acccaggccctccatgggct

SEQ ID NO: 374600 - DNA, 17 bp, Homo sapiens
acccaggctgcactgca

SEQ ID NO: 374601 - DNA, 20 bp, Homo sapiens
acccaggctgcactgcagtg

SEQ ID NO: 374602 - DNA, 15 bp, Homo sapiens
acccagggcccggca

SEQ ID NO: 374603 - DNA, 16 bp, Homo sapiens
acccagtgctgccatg

SEQ ID NO: 374604 - DNA, 18 bp, Homo sapiens
acccagtgctgccatgcc

SEQ ID NO: 374605 - DNA, 22 bp, Homo sapiens
acccagtgctgccatgccactg

SEQ ID NO: 374606 - DNA, 21 bp, Homo sapiens
acccatagatcttctgaaatg

SEQ ID NO: 374607 - DNA, 15 bp, Homo sapiens
acccatagcttccat

SEQ ID NO: 374608 - DNA, 21 bp, Homo sapiens
acccatcctaccaatgcatgc

SEQ ID NO: 374609 - DNA, 21 bp, Homo sapiens
acccatcggtgtccatttata

SEQ ID NO: 374610 - DNA, 19 bp, Homo sapiens
acccatcgtataaggaaat

SEQ ID NO: 374611 - DNA, 20 bp, Homo sapiens
acccatcgtggtatgtgaat

SEQ ID NO: 374612 - DNA, 16 bp, Homo sapiens
acccatcttcctgctg

SEQ ID NO: 374613 - DNA, 18 bp, Homo sapiens
acccatcttcctgctgct

SEQ ID NO: 374614 - DNA, 20 bp, Homo sapiens
acccatcttcctgctgctgt

SEQ ID NO: 374615 - DNA, 15 bp, Homo sapiens
acccatgactgcccc

SEQ ID NO: 374616 - DNA, 13 bp, Homo sapiens
acccatgagcctg

SEQ ID NO: 374617 - DNA, 14 bp, Homo sapiens
acccatgagcctgc

SEQ ID NO: 374618 - DNA, 19 bp, Homo sapiens
acccatgagcctgcccgct

SEQ ID NO: 374619 - DNA, 20 bp, Homo sapiens
acccatgcatggcctcccag

SEQ ID NO: 374620 - DNA, 21 bp, Homo sapiens
acccatgttgggaaaaactgg

SEQ ID NO: 374621 - DNA, 18 bp, Homo sapiens
acccattcactacaggtg

SEQ ID NO: 374622 - DNA, 13 bp, Homo sapiens
acccattgtctca

SEQ ID NO: 374623 - DNA, 14 bp, Homo sapiens
acccattgtctcat

SEQ ID NO: 374624 - DNA, 18 bp, Homo sapiens
acccatttaatcaccatg

SEQ ID NO: 374625 - DNA, 17 bp, Homo sapiens
acccatttgccatgctg

SEQ ID NO: 374626 - DNA, 19 bp, Homo sapiens
acccatttgccatgctgct

SEQ ID NO: 374627 - DNA, 22 bp, Homo sapiens
acccatttgccatgctgctatg

SEQ ID NO: 374628 - DNA, 20 bp, Homo sapiens
accccaaaccccagccccaa

SEQ ID NO: 374629 - DNA, 15 bp, Homo sapiens
accccaaagctttcc

SEQ ID NO: 374630 - DNA, 17 bp, Homo sapiens
accccaaagctttcctg

SEQ ID NO: 374631 - DNA, 16 bp, Homo sapiens
accccaactcccagcc

SEQ ID NO: 374632 - DNA, 17 bp, Homo sapiens
accccaactctccccag

SEQ ID NO: 374633 - DNA, 13 bp, Homo sapiens
accccaagcattc

SEQ ID NO: 374634 - DNA, 15 bp, Homo sapiens
accccaagtccacct

SEQ ID NO: 374635 - DNA, 19 bp, Homo sapiens
accccaattaactgaagca

SEQ ID NO: 374636 - DNA, 16 bp, Homo sapiens
accccacaccaggccg

SEQ ID NO: 374637 - DNA, 20 bp, Homo sapiens
accccacaccccagcccacc

SEQ ID NO: 374638 - DNA, 15 bp, Homo sapiens
accccacacgccggg

SEQ ID NO: 374639 - DNA, 23 bp, Homo sapiens
accccacacgccggggctggccc

SEQ ID NO: 374640 - DNA, 11 bp, Homo sapiens
accccacactt

SEQ ID NO: 374641 - DNA, 21 bp, Homo sapiens
accccaccctagtttccctga

SEQ ID NO: 374642 - DNA, 14 bp, Homo sapiens
accccactgggaga

SEQ ID NO: 374643 - DNA, 18 bp, Homo sapiens
accccacttatgctgctg

SEQ ID NO: 374644 - DNA, 19 bp, Homo sapiens
accccacttatgctgctgt

SEQ ID NO: 374645 - DNA, 21 bp, Homo sapiens
accccagagggaccagctggg

SEQ ID NO: 374646 - DNA, 20 bp, Homo sapiens
accccagcattccagctctg

SEQ ID NO: 374647 - DNA, 18 bp, Homo sapiens
accccagccactcctcaa

SEQ ID NO: 374648 - DNA, 11 bp, Homo sapiens
accccagccca

SEQ ID NO: 374649 - DNA, 20 bp, Homo sapiens
accccagcccaccctgctcc

SEQ ID NO: 374650 - DNA, 12 bp, Homo sapiens
accccagcctaa

SEQ ID NO: 374651 - DNA, 12 bp, Homo sapiens
accccagcctga

SEQ ID NO: 374652 - DNA, 19 bp, Homo sapiens
accccagcctgacctgaga

SEQ ID NO: 374653 - DNA, 16 bp, Homo sapiens
accccagctccatcct

SEQ ID NO: 374654 - DNA, 14 bp, Homo sapiens
accccagcttttct

SEQ ID NO: 374655 - DNA, 18 bp, Homo sapiens
accccagtccccgggaaa

SEQ ID NO: 374656 - DNA, 14 bp, Homo sapiens
accccagtgcctgt

SEQ ID NO: 374657 - DNA, 19 bp, Homo sapiens
accccagttcatctctgct

SEQ ID NO: 374658 - DNA, 21 bp, Homo sapiens
accccagttcatctctgctga

SEQ ID NO: 374659 - DNA, 19 bp, Homo sapiens
accccagttctaggggaga

SEQ ID NO: 374660 - DNA, 19 bp, Homo sapiens
accccatagtgaccggctg

SEQ ID NO: 374661 - DNA, 13 bp, Homo sapiens
accccatccagcc

SEQ ID NO: 374662 - DNA, 16 bp, Homo sapiens
accccatccagccagg

SEQ ID NO: 374663 - DNA, 15 bp, Homo sapiens
accccatcccacacc

SEQ ID NO: 374664 - DNA, 14 bp, Homo sapiens
accccatctctctt

SEQ ID NO: 374665 - DNA, 18 bp, Homo sapiens
acccccaaagacctgcct

SEQ ID NO: 374666 - DNA, 12 bp, Homo sapiens
acccccaacacc

SEQ ID NO: 374667 - DNA, 23 bp, Homo sapiens
acccccaagaaacctccatcctg

SEQ ID NO: 374668 - DNA, 16 bp, Homo sapiens
acccccaaggggcagt

SEQ ID NO: 374669 - DNA, 14 bp, Homo sapiens
acccccacccacct

SEQ ID NO: 374670 - DNA, 17 bp, Homo sapiens
acccccacccacctcca

SEQ ID NO: 374671 - DNA, 22 bp, Homo sapiens
acccccacccacctccacccag

SEQ ID NO: 374672 - DNA, 23 bp, Homo sapiens
acccccacccacctccacccagc

SEQ ID NO: 374673 - DNA, 13 bp, Homo sapiens
acccccacccctg

SEQ ID NO: 374674 - DNA, 14 bp, Homo sapiens
acccccacccctgt

SEQ ID NO: 374675 - DNA, 17 bp, Homo sapiens
acccccacccctgtacc

SEQ ID NO: 374676 - DNA, 15 bp, Homo sapiens
acccccaccccttcc

SEQ ID NO: 374677 - DNA, 20 bp, Homo sapiens
acccccaccccttccccact

SEQ ID NO: 374678 - DNA, 16 bp, Homo sapiens
acccccacctcccggt

SEQ ID NO: 374679 - DNA, 12 bp, Homo sapiens
acccccagcctc

SEQ ID NO: 374680 - DNA, 14 bp, Homo sapiens
acccccagcctccc

SEQ ID NO: 374681 - DNA, 20 bp, Homo sapiens
acccccagcctcccccaggc

SEQ ID NO: 374682 - DNA, 17 bp, Homo sapiens
acccccaggaggagaga

SEQ ID NO: 374683 - DNA, 23 bp, Homo sapiens
acccccaggaggagagagatgct

SEQ ID NO: 374684 - DNA, 22 bp, Homo sapiens
acccccagtgtattttgtccaa

SEQ ID NO: 374685 - DNA, 17 bp, Homo sapiens
acccccatctctccctc

SEQ ID NO: 374686 - DNA, 14 bp, Homo sapiens
acccccattgtgaa

SEQ ID NO: 374687 - DNA, 12 bp, Homo sapiens
accccccactcc

SEQ ID NO: 374688 - DNA, 14 bp, Homo sapiens
acccccctcccaga

SEQ ID NO: 374689 - DNA, 17 bp, Homo sapiens
acccccctcccagacag

SEQ ID NO: 374690 - DNA, 18 bp, Homo sapiens
acccccctcccagacagg

SEQ ID NO: 374691 - DNA, 15 bp, Homo sapiens
acccccgccacggcc

SEQ ID NO: 374692 - DNA, 17 bp, Homo sapiens
acccccggcctccaggc

SEQ ID NO: 374693 - DNA, 17 bp, Homo sapiens
accctccacctcctctc

SEQ ID NO: 374694 - DNA, 14 bp, Homo sapiens
accctccagcacag

SEQ ID NO: 374695 - DNA, 20 bp, Homo sapiens
accctcccacccccttctct

SEQ ID NO: 374696 - DNA, 18 bp, Homo sapiens
accctcccccaccattcc

SEQ ID NO: 374697 - DNA, 21 bp, Homo sapiens
accctcccccaccattccaca

SEQ ID NO: 374698 - DNA, 14 bp, Homo sapiens
agaaattgcctcct

SEQ ID NO: 374699 - DNA, 16 bp, Homo sapiens
agaaattgttcctgat

SEQ ID NO: 374700 - DNA, 18 bp, Homo sapiens
agaaattgttcctgatgt

SEQ ID NO: 374701 - DNA, 19 bp, Homo sapiens
agaaattgttcctgatgtg

SEQ ID NO: 374702 - DNA, 19 bp, Homo sapiens
agaaatttaatcagtgtga

SEQ ID NO: 374703 - DNA, 16 bp, Homo sapiens
agaaatttgatttcta

SEQ ID NO: 374704 - DNA, 20 bp, Homo sapiens
agaaatttgatttctattca

SEQ ID NO: 374705 - DNA, 22 bp, Homo sapiens
agaaattttacaataggtgctt

SEQ ID NO: 374706 - DNA, 15 bp, Homo sapiens
agaaatttttatcag

SEQ ID NO: 374707 - DNA, 22 bp, Homo sapiens
agaaatttttttccagaattga

SEQ ID NO: 374708 - DNA, 12 bp, Homo sapiens
agaacaaacaaa

SEQ ID NO: 374709 - DNA, 16 bp, Homo sapiens
agaacaaacaaaactt

SEQ ID NO: 374710 - DNA, 20 bp, Homo sapiens
agaacaaacacctccccagc

SEQ ID NO: 374711 - DNA, 23 bp, Homo sapiens
agaacaaagaccaatgtgaagac

SEQ ID NO: 374712 - DNA, 22 bp, Homo sapiens
agaacaaagggccaaatagagt

SEQ ID NO: 374713 - DNA, 14 bp, Homo sapiens
agaacaacacttgt

SEQ ID NO: 374714 - DNA, 20 bp, Homo sapiens
agaacaagtcacagctgcag

SEQ ID NO: 374715 - DNA, 22 bp, Homo sapiens
agaacaagtcacagctgcagct

SEQ ID NO: 374716 - DNA, 18 bp, Homo sapiens
agaacaagtgcctcctgg

SEQ ID NO: 374717 - DNA, 14 bp, Homo sapiens
agaacaatcactat

SEQ ID NO: 374718 - DNA, 17 bp, Homo sapiens
agaacaatcactattct

SEQ ID NO: 374719 - DNA, 13 bp, Homo sapiens
agaacacagcatg

SEQ ID NO: 374720 - DNA, 20 bp, Homo sapiens
agaacacagcatgtgccaag

SEQ ID NO: 374721 - DNA, 21 bp, Homo sapiens
agaacacagcatgtgccaaga

SEQ ID NO: 374722 - DNA, 22 bp, Homo sapiens
agaacacagtgcctggcaaggc

SEQ ID NO: 374723 - DNA, 11 bp, Homo sapiens
agaacacctgg

SEQ ID NO: 374724 - DNA, 10 bp, Homo sapiens
agaacagaaa

SEQ ID NO: 374725 - DNA, 15 bp, Homo sapiens
agaacagaaaacaac

SEQ ID NO: 374726 - DNA, 20 bp, Homo sapiens
agaacagatctccaaagctt

SEQ ID NO: 374727 - DNA, 18 bp, Homo sapiens
agaacagctgttcctgtg

SEQ ID NO: 374728 - DNA, 13 bp, Homo sapiens
agaacagtacatt

SEQ ID NO: 374729 - DNA, 19 bp, Homo sapiens
agaacagtctgaaatacct

SEQ ID NO: 374730 - DNA, 20 bp, Homo sapiens
agaacagtctgaaatacctt

SEQ ID NO: 374731 - DNA, 16 bp, Homo sapiens
agaacatattttcctt

SEQ ID NO: 374732 - DNA, 20 bp, Homo sapiens
agaacatctgccttgctgca

SEQ ID NO: 374733 - DNA, 12 bp, Homo sapiens
agaacatttctc

SEQ ID NO: 374734 - DNA, 16 bp, Homo sapiens
agaaccaacgggtctg

SEQ ID NO: 374735 - DNA, 19 bp, Homo sapiens
agaaccaacgggtctgtgg

SEQ ID NO: 374736 - DNA, 13 bp, Homo sapiens
agaaccacactgt

SEQ ID NO: 374737 - DNA, 14 bp, Homo sapiens
agaaccagcactcc

SEQ ID NO: 374738 - DNA, 17 bp, Homo sapiens
agaaccagcactcccag

SEQ ID NO: 374739 - DNA, 20 bp, Homo sapiens
agaaccagcactcccagggc

SEQ ID NO: 374740 - DNA, 18 bp, Homo sapiens
agaaccagtttcaggtgt

SEQ ID NO: 374741 - DNA, 23 bp, Homo sapiens
agaacccatttgccatgctgcta

SEQ ID NO: 374742 - DNA, 14 bp, Homo sapiens
agaacccccctccc

SEQ ID NO: 374743 - DNA, 15 bp, Homo sapiens
agaacccccctcccc

SEQ ID NO: 374744 - DNA, 19 bp, Homo sapiens
agaacccccctccccaagg

SEQ ID NO: 374745 - DNA, 23 bp, Homo sapiens
agaaccctagcacaaatttgctt

SEQ ID NO: 374746 - DNA, 17 bp, Homo sapiens
agaacccttctgctttc

SEQ ID NO: 374747 - DNA, 15 bp, Homo sapiens
agaaccgagcaaaga

SEQ ID NO: 374748 - DNA, 20 bp, Homo sapiens
agaacctaatagcaccaata

SEQ ID NO: 374749 - DNA, 14 bp, Homo sapiens
agaacctcctattt

SEQ ID NO: 374750 - DNA, 13 bp, Homo sapiens
agaacctcttccc

SEQ ID NO: 374751 - DNA, 15 bp, Homo sapiens
agaacctcttcccca

SEQ ID NO: 374752 - DNA, 14 bp, Homo sapiens
agaacctggtggct

SEQ ID NO: 374753 - DNA, 16 bp, Homo sapiens
agaacctggtggctgg

SEQ ID NO: 374754 - DNA, 19 bp, Homo sapiens
agaaccttttgagtgcctt

SEQ ID NO: 374755 - DNA, 21 bp, Homo sapiens
agaacgcaccccactgggaga

SEQ ID NO: 374756 - DNA, 19 bp, Homo sapiens
agaacgggcctccccgggg

SEQ ID NO: 374757 - DNA, 16 bp, Homo sapiens
agaacgtctctcacct

SEQ ID NO: 374758 - DNA, 17 bp, Homo sapiens
agaactcagttttaact

SEQ ID NO: 374759 - DNA, 22 bp, Homo sapiens
agaactcctgtgtgtggaaggc

SEQ ID NO: 374760 - DNA, 23 bp, Homo sapiens
agaactctctagttccctcagtg

SEQ ID NO: 374761 - DNA, 20 bp, Homo sapiens
agaactctctgtcttctctc

SEQ ID NO: 374762 - DNA, 13 bp, Homo sapiens
agaactgaaaaca

SEQ ID NO: 374763 - DNA, 12 bp, Homo sapiens
agaactgagctc

SEQ ID NO: 374764 - DNA, 18 bp, Homo sapiens
agaactgctaccatgaag

SEQ ID NO: 374765 - DNA, 20 bp, Homo sapiens
agaactgcttgcatttcttt

SEQ ID NO: 374766 - DNA, 17 bp, Homo sapiens
agaactgtcccacaaaa

SEQ ID NO: 374767 - DNA, 12 bp, Homo sapiens
agaactgtgctc

SEQ ID NO: 374768 - DNA, 14 bp, Homo sapiens
agaactgtgctctc

SEQ ID NO: 374769 - DNA, 17 bp, Homo sapiens
agaactgttcatttcca

SEQ ID NO: 374770 - DNA, 18 bp, Homo sapiens
agaactgttcatttccac

SEQ ID NO: 374771 - DNA, 14 bp, Homo sapiens
agaacttagttttg

SEQ ID NO: 374772 - DNA, 15 bp, Homo sapiens
agaacttagttttgt

SEQ ID NO: 374773 - DNA, 16 bp, Homo sapiens
agaacttagttttgtt

SEQ ID NO: 374774 - DNA, 13 bp, Homo sapiens
agaacttttcata

SEQ ID NO: 374775 - DNA, 23 bp, Homo sapiens
agaacttttcatagatgaacttt

SEQ ID NO: 374776 - DNA, 19 bp, Homo sapiens
agaagaaaaggttcttact

SEQ ID NO: 374777 - DNA, 16 bp, Homo sapiens
agaagaaaatggatga

SEQ ID NO: 374778 - DNA, 19 bp, Homo sapiens
agaagaaagaagcactctg

SEQ ID NO: 374779 - DNA, 15 bp, Homo sapiens
agaagaaagactcta

SEQ ID NO: 374780 - DNA, 13 bp, Homo sapiens
agaagaaagtaaa

SEQ ID NO: 374781 - DNA, 13 bp, Homo sapiens
agaagaaattatt

SEQ ID NO: 374782 - DNA, 16 bp, Homo sapiens
agaagaaattatttaa

SEQ ID NO: 374783 - DNA, 14 bp, Homo sapiens
agaagaacagcaga

SEQ ID NO: 374784 - DNA, 14 bp, Homo sapiens
agaagaatattcag

SEQ ID NO: 374785 - DNA, 19 bp, Homo sapiens
agaagaatattcaggactt

SEQ ID NO: 374786 - DNA, 16 bp, Homo sapiens
agaagacacgtgtttt

SEQ ID NO: 374787 - DNA, 20 bp, Homo sapiens
agaagacacgtgtttttgta

SEQ ID NO: 374788 - DNA, 21 bp, Homo sapiens
agaagacacgtgtttttgtat

SEQ ID NO: 374789 - DNA, 12 bp, Homo sapiens
agaagacatgaa

SEQ ID NO: 374790 - DNA, 14 bp, Homo sapiens
agaagacatggaga

SEQ ID NO: 374791 - DNA, 22 bp, Homo sapiens
agaagacatggagactcctgcc

SEQ ID NO: 374792 - DNA, 18 bp, Homo sapiens
agaagaccagtcacagcc

SEQ ID NO: 374793 - DNA, 19 bp, Homo sapiens
agaagaccagtcacagcca

SEQ ID NO: 374794 - DNA, 22 bp, Homo sapiens
agaagagatgggcttgttttct

SEQ ID NO: 374795 - DNA, 17 bp, Homo sapiens
agaagaggcagattcaa

SEQ ID NO: 374796 - DNA, 16 bp, Homo sapiens
agaagagggagaagga

SEQ ID NO: 374797 - DNA, 20 bp, Homo sapiens
agaagagggagaaggagagg

SEQ ID NO: 374798 - DNA, 19 bp, Homo sapiens
agaagagttttagagaaaa

SEQ ID NO: 374799 - DNA, 23 bp, Homo sapiens
agaagagttttagagaaaataaa

SEQ ID NO: 374800 - DNA, 15 bp, Homo sapiens
agaagatgccctcca

SEQ ID NO: 374801 - DNA, 16 bp, Homo sapiens
agaagatggactctga

SEQ ID NO: 374802 - DNA, 22 bp, Homo sapiens
agaagatgttgaagaatacagt

SEQ ID NO: 374803 - DNA, 23 bp, Homo sapiens
agaagatgttgaagaatacagtt

SEQ ID NO: 374804 - DNA, 14 bp, Homo sapiens
agaagattctaaaa

SEQ ID NO: 374805 - DNA, 22 bp, Homo sapiens
agaagatttgatgctggagagg

SEQ ID NO: 374806 - DNA, 22 bp, Homo sapiens
agaagcaattatttaaagaaag

SEQ ID NO: 374807 - DNA, 22 bp, Homo sapiens
agaagcacaggaatagtgagtg

SEQ ID NO: 374808 - DNA, 21 bp, Homo sapiens
agaagcattaacttctctgga

SEQ ID NO: 374809 - DNA, 15 bp, Homo sapiens
agaagccaagacagt

SEQ ID NO: 374810 - DNA, 17 bp, Homo sapiens
agaagccctccttgcca

SEQ ID NO: 374811 - DNA, 15 bp, Homo sapiens
agaagcctattgtaa

SEQ ID NO: 374812 - DNA, 23 bp, Homo sapiens
agaagcctattgtaaatacaagt

SEQ ID NO: 374813 - DNA, 14 bp, Homo sapiens
aaggagcgggcagg

SEQ ID NO: 374814 - DNA, 16 bp, Homo sapiens
aaggagcgggcagggc

SEQ ID NO: 374815 - DNA, 24 bp, Homo sapiens
aaggagctgatttccaggcccctg

SEQ ID NO: 374816 - DNA, 21 bp, Homo sapiens
aaggagcttacctcccacctt

SEQ ID NO: 374817 - DNA, 16 bp, Homo sapiens
aaggaggaaggagcct

SEQ ID NO: 374818 - DNA, 16 bp, Homo sapiens
aaggaggaagggactg

SEQ ID NO: 374819 - DNA, 21 bp, Homo sapiens
aaggaggaagggactggtcca

SEQ ID NO: 374820 - DNA, 13 bp, Homo sapiens
aaggagggcagag

SEQ ID NO: 374821 - DNA, 14 bp, Homo sapiens
aaggagggcagagc

SEQ ID NO: 374822 - DNA, 15 bp, Homo sapiens
aaggagggcagagcc

SEQ ID NO: 374823 - DNA, 12 bp, Homo sapiens
aaggagggcctc

SEQ ID NO: 374824 - DNA, 16 bp, Homo sapiens
aaggagggcctcagag

SEQ ID NO: 374825 - DNA, 15 bp, Homo sapiens
aaggaggggaagctg

SEQ ID NO: 374826 - DNA, 20 bp, Homo sapiens
aaggaggtgggccacaccca

SEQ ID NO: 374827 - DNA, 17 bp, Homo sapiens
aaggagtaagtacaaat

SEQ ID NO: 374828 - DNA, 14 bp, Homo sapiens
agaaggaggaaggg

SEQ ID NO: 374829 - DNA, 19 bp, Homo sapiens
agaaggaggaagggactgg

SEQ ID NO: 374830 - DNA, 22 bp, Homo sapiens
agaaggaggaagggactggtcc

SEQ ID NO: 374831 - DNA, 19 bp, Homo sapiens
agaaggaggaattttagaa

SEQ ID NO: 374832 - DNA, 17 bp, Homo sapiens
agaaggagggcagagcc

SEQ ID NO: 374833 - DNA, 20 bp, Homo sapiens
agaaggcaagccaaccttag

SEQ ID NO: 374834 - DNA, 18 bp, Homo sapiens
agaaggcaagctggcagg

SEQ ID NO: 374835 - DNA, 19 bp, Homo sapiens
agaaggcagagaaaacaca

SEQ ID NO: 374836 - DNA, 15 bp, Homo sapiens
agaaggcccgggagg

SEQ ID NO: 374837 - DNA, 17 bp, Homo sapiens
agaaggccctgtgccct

SEQ ID NO: 374838 - DNA, 21 bp, Homo sapiens
agaaggcctgccccccttccc

SEQ ID NO: 374839 - DNA, 18 bp, Homo sapiens
agaaggcctggtcagcag

SEQ ID NO: 374840 - DNA, 21 bp, Homo sapiens
agaaggcctggtcagcagagc

SEQ ID NO: 374841 - DNA, 15 bp, Homo sapiens
agaaggcgaggagag

SEQ ID NO: 374842 - DNA, 16 bp, Homo sapiens
agaaggctggggctat

SEQ ID NO: 374843 - DNA, 12 bp, Homo sapiens
agaagggaaatt

SEQ ID NO: 374844 - DNA, 22 bp, Homo sapiens
agaagggaaattcacactgtgc

SEQ ID NO: 374845 - DNA, 16 bp, Homo sapiens
agaagggctgaataaa

SEQ ID NO: 374846 - DNA, 13 bp, Homo sapiens
agaaggggcgagg

SEQ ID NO: 374847 - DNA, 15 bp, Homo sapiens
agaaggtaataggaa

SEQ ID NO: 374848 - DNA, 17 bp, Homo sapiens
agaaggtaataggaaga

SEQ ID NO: 374849 - DNA, 22 bp, Homo sapiens
agaaggtgccgtgagcaggctt

SEQ ID NO: 374850 - DNA, 23 bp, Homo sapiens
agaaggtgggggttggctgggta

SEQ ID NO: 374851 - DNA, 23 bp, Homo sapiens
agaagtaaccaactgaacgacaa

SEQ ID NO: 374852 - DNA, 23 bp, Homo sapiens
agaagtaagtttatccaaatctt

SEQ ID NO: 374853 - DNA, 15 bp, Homo sapiens
agaagtacagaatgt

SEQ ID NO: 374854 - DNA, 13 bp, Homo sapiens
agaagtactggca

SEQ ID NO: 374855 - DNA, 13 bp, Homo sapiens
agaagtatatttt

SEQ ID NO: 374856 - DNA, 14 bp, Homo sapiens
agaagtatccaatt

SEQ ID NO: 374857 - DNA, 21 bp, Homo sapiens
agaagtatccaattatgtgac

SEQ ID NO: 374858 - DNA, 22 bp, Homo sapiens
agaagtatccaattatgtgaca

SEQ ID NO: 374859 - DNA, 18 bp, Homo sapiens
agaagtcaaatgaatgag

SEQ ID NO: 374860 - DNA, 17 bp, Homo sapiens
agaagtcaacagtgaaa

SEQ ID NO: 374861 - DNA, 23 bp, Homo sapiens
agaagtcagcccgaatgcctgtc

SEQ ID NO: 374862 - DNA, 16 bp, Homo sapiens
agaagtgaaaaagact

SEQ ID NO: 374863 - DNA, 21 bp, Homo sapiens
agaagtgaaaaagacttcaaa

SEQ ID NO: 374864 - DNA, 17 bp, Homo sapiens
agaagtgaatgggaaag

SEQ ID NO: 374865 - DNA, 14 bp, Homo sapiens
agaagtgcatttct

SEQ ID NO: 374866 - DNA, 22 bp, Homo sapiens
agaagtgctctttgtggcagtg

SEQ ID NO: 374867 - DNA, 14 bp, Homo sapiens
agaagtgtgttttg

SEQ ID NO: 374868 - DNA, 14 bp, Homo sapiens
agaagttaagcagc

SEQ ID NO: 374869 - DNA, 20 bp, Homo sapiens
agaagttaagcagcctttct

SEQ ID NO: 374870 - DNA, 19 bp, Homo sapiens
agaagttcatgggcacctc

SEQ ID NO: 374871 - DNA, 23 bp, Homo sapiens
agaagttccacttaacacatgaa

SEQ ID NO: 374872 - DNA, 19 bp, Homo sapiens
agaagtttctacattctct

SEQ ID NO: 374873 - DNA, 12 bp, Homo sapiens
agaagtttcttc

SEQ ID NO: 374874 - DNA, 22 bp, Homo sapiens
agaagtttgggctaacatttag

SEQ ID NO: 374875 - DNA, 12 bp, Homo sapiens
agaataaaattg

SEQ ID NO: 374876 - DNA, 15 bp, Homo sapiens
agaataagaaaacaa

SEQ ID NO: 374877 - DNA, 14 bp, Homo sapiens
agaataagagaaag

SEQ ID NO: 374878 - DNA, 16 bp, Homo sapiens
agaataagagaaagaa

SEQ ID NO: 374879 - DNA, 21 bp, Homo sapiens
agaataatgtgggaagaaaca

SEQ ID NO: 374880 - DNA, 15 bp, Homo sapiens
agaatacaattcagt

SEQ ID NO: 374881 - DNA, 22 bp, Homo sapiens
agaatacagtaagctgctctat

SEQ ID NO: 374882 - DNA, 14 bp, Homo sapiens
agaatactgtattg

SEQ ID NO: 374883 - DNA, 19 bp, Homo sapiens
agaatactgttaaaggaaa

SEQ ID NO: 374884 - DNA, 14 bp, Homo sapiens
agaatactttttaa

SEQ ID NO: 374885 - DNA, 23 bp, Homo sapiens
agaatagatctgatggtgagctg

SEQ ID NO: 374886 - DNA, 14 bp, Homo sapiens
agaatagtctctgg

SEQ ID NO: 374887 - DNA, 20 bp, Homo sapiens
agaatagtgcctcagcgctg

SEQ ID NO: 374888 - DNA, 22 bp, Homo sapiens
agaatagtgcctcagcgctgcc

SEQ ID NO: 374889 - DNA, 23 bp, Homo sapiens
agaatagtgcctcagcgctgccc

SEQ ID NO: 374890 - DNA, 14 bp, Homo sapiens
agaatataaataaa

SEQ ID NO: 374891 - DNA, 13 bp, Homo sapiens
agaatatatacat

SEQ ID NO: 374892 - DNA, 21 bp, Homo sapiens
agaatatgacctaaatccatt

SEQ ID NO: 374893 - DNA, 18 bp, Homo sapiens
agaatattataaaaatat

SEQ ID NO: 374894 - DNA, 12 bp, Homo sapiens
agaatattcagg

SEQ ID NO: 374895 - DNA, 22 bp, Homo sapiens
agaatcacctaattaatttcag

SEQ ID NO: 374896 - DNA, 22 bp, Homo sapiens
agaatcattatttattaaattt

SEQ ID NO: 374897 - DNA, 13 bp, Homo sapiens
agaatcattgctt

SEQ ID NO: 374898 - DNA, 23 bp, Homo sapiens
agaatcccatggatgtttcttct

SEQ ID NO: 374899 - DNA, 20 bp, Homo sapiens
agaatcgacctcactgtcag

SEQ ID NO: 374900 - DNA, 20 bp, Homo sapiens
agaatctgctgttgccatag

SEQ ID NO: 374901 - DNA, 17 bp, Homo sapiens
agaatctggctcctgtt

SEQ ID NO: 374902 - DNA, 19 bp, Homo sapiens
agaatctgtagaggagcct

SEQ ID NO: 374903 - DNA, 16 bp, Homo sapiens
agaatgagaaagaaaa

SEQ ID NO: 374904 - DNA, 16 bp, Homo sapiens
agaatgaggaggaagg

SEQ ID NO: 374905 - DNA, 17 bp, Homo sapiens
agaatgaggaggaagga

SEQ ID NO: 374906 - DNA, 16 bp, Homo sapiens
agaatgattttgacat

SEQ ID NO: 374907 - DNA, 16 bp, Homo sapiens
agaatgcattcaaaat

SEQ ID NO: 374908 - DNA, 16 bp, Homo sapiens
agaatgccattctctt

SEQ ID NO: 374909 - DNA, 14 bp, Homo sapiens
agaatggaaaaaaa

SEQ ID NO: 374910 - DNA, 15 bp, Homo sapiens
agaatggctctggct

SEQ ID NO: 374911 - DNA, 20 bp, Homo sapiens
agaatggtgggctccagagt

SEQ ID NO: 374912 - DNA, 23 bp, Homo sapiens
agaatggttgccttaaagaaagt

SEQ ID NO: 374913 - DNA, 11 bp, Homo sapiens
agaatgtcatt

SEQ ID NO: 374914 - DNA, 14 bp, Homo sapiens
agaatgtcatttgc

SEQ ID NO: 374915 - DNA, 16 bp, Homo sapiens
agaatgtcatttgcta

SEQ ID NO: 374916 - DNA, 19 bp, Homo sapiens
agaatgtcatttgctaatg

SEQ ID NO: 374917 - DNA, 23 bp, Homo sapiens
agaatgtcatttgctaatgaatt

SEQ ID NO: 374918 - DNA, 15 bp, Homo sapiens
agaatgttgtattca

SEQ ID NO: 374919 - DNA, 14 bp, Homo sapiens
agaattagattata

SEQ ID NO: 374920 - DNA, 13 bp, Homo sapiens
agaattagtcctc

SEQ ID NO: 374921 - DNA, 22 bp, Homo sapiens
agaattatataggttgtgcaaa

SEQ ID NO: 374922 - DNA, 18 bp, Homo sapiens
agaattattacatcttta

SEQ ID NO: 374923 - DNA, 18 bp, Homo sapiens
agaattattcatagctgt

SEQ ID NO: 374924 - DNA, 14 bp, Homo sapiens
agaattatttttgt

SEQ ID NO: 374925 - DNA, 12 bp, Homo sapiens
agaattcacttt

SEQ ID NO: 374926 - DNA, 15 bp, Homo sapiens
agaattcagctgccc

SEQ ID NO: 374927 - DNA, 17 bp, Homo sapiens
agaattcagctgccccc

SEQ ID NO: 374928 - DNA, 19 bp, Homo sapiens
agaattcctacaatatata

SEQ ID NO: 374929 - DNA, 23 bp, Homo sapiens
agaattccttttataagatttaa

SEQ ID NO: 374930 - DNA, 16 bp, Homo sapiens
agaattgaagaaaatc

SEQ ID NO: 374931 - DNA, 18 bp, Homo sapiens
agaattgtgcaaatggaa

SEQ ID NO: 374932 - DNA, 21 bp, Homo sapiens
agaattgtttttagaaattta

SEQ ID NO: 374933 - DNA, 18 bp, Homo sapiens
agaattgtttttgaattt

SEQ ID NO: 374934 - DNA, 15 bp, Homo sapiens
agaatttaattttta

SEQ ID NO: 374935 - DNA, 18 bp, Homo sapiens
agaatttaatttttaaaa

SEQ ID NO: 374936 - DNA, 20 bp, Homo sapiens
agaatttaatttttaaaaga

SEQ ID NO: 374937 - DNA, 13 bp, Homo sapiens
agaatttattcaa

SEQ ID NO: 374938 - DNA, 16 bp, Homo sapiens
agaatttcctaatgag

SEQ ID NO: 374939 - DNA, 21 bp, Homo sapiens
agaatttctttgtcattcaag

SEQ ID NO: 374940 - DNA, 19 bp, Homo sapiens
agacaaaaagaacaaaaaa

SEQ ID NO: 374941 - DNA, 14 bp, Homo sapiens
agacaaaaattatc

SEQ ID NO: 374942 - DNA, 15 bp, Homo sapiens
agacaaaggcccaga

SEQ ID NO: 374943 - DNA, 14 bp, Homo sapiens
agacaaatgggact

SEQ ID NO: 374944 - DNA, 14 bp, Homo sapiens
agacaacacacaca

SEQ ID NO: 374945 - DNA, 14 bp, Homo sapiens
agacaacaggcatt

SEQ ID NO: 374946 - DNA, 18 bp, Homo sapiens
agacaaccatagaactgt

SEQ ID NO: 374947 - DNA, 13 bp, Homo sapiens
agacaagccctgg

SEQ ID NO: 374948 - DNA, 16 bp, Homo sapiens
agacaagccctggcaa

SEQ ID NO: 374949 - DNA, 16 bp, Homo sapiens
agacaataaaacattc

SEQ ID NO: 374950 - DNA, 20 bp, Homo sapiens
agacaatctaaaaaatatct

SEQ ID NO: 374951 - DNA, 20 bp, Homo sapiens
aaggtctccttactctgagc

SEQ ID NO: 374952 - DNA, 20 bp, Homo sapiens
aaggtcttcttgtgtcctga

SEQ ID NO: 374953 - DNA, 23 bp, Homo sapiens
aaggtcttcttgtgtcctgatga

SEQ ID NO: 374954 - DNA, 16 bp, Homo sapiens
aaggtgaaacacacac

SEQ ID NO: 374955 - DNA, 21 bp, Homo sapiens
aaggtgaaacacacacacatt

SEQ ID NO: 374956 - DNA, 17 bp, Homo sapiens
aaggtgaccgcccagct

SEQ ID NO: 374957 - DNA, 14 bp, Homo sapiens
aaggtgcagttccc

SEQ ID NO: 374958 - DNA, 20 bp, Homo sapiens
agacaatgtggaattacata

SEQ ID NO: 374959 - DNA, 22 bp, Homo sapiens
agacaatgtggaattacataac

SEQ ID NO: 374960 - DNA, 13 bp, Homo sapiens
agacaatttgcct

SEQ ID NO: 374961 - DNA, 17 bp, Homo sapiens
agacacacaacatcaag

SEQ ID NO: 374962 - DNA, 14 bp, Homo sapiens
agacacacacacac

SEQ ID NO: 374963 - DNA, 16 bp, Homo sapiens
agacacacacacacac

SEQ ID NO: 374964 - DNA, 15 bp, Homo sapiens
agacacacacacgca

SEQ ID NO: 374965 - DNA, 14 bp, Homo sapiens
agacacacagcctt

SEQ ID NO: 374966 - DNA, 16 bp, Homo sapiens
agacacacagcctttc

SEQ ID NO: 374967 - DNA, 11 bp, Homo sapiens
agacacccagt

SEQ ID NO: 374968 - DNA, 15 bp, Homo sapiens
agacaccctaactct

SEQ ID NO: 374969 - DNA, 22 bp, Homo sapiens
agacactaacgacttcagggca

SEQ ID NO: 374970 - DNA, 18 bp, Homo sapiens
agacactagtagagcaaa

SEQ ID NO: 374971 - DNA, 12 bp, Homo sapiens
agacactgtcaa

SEQ ID NO: 374972 - DNA, 13 bp, Homo sapiens
agacacttgcctt

SEQ ID NO: 374973 - DNA, 16 bp, Homo sapiens
agacagaagcaggctg

SEQ ID NO: 374974 - DNA, 19 bp, Homo sapiens
agacagaagcaggctggag

SEQ ID NO: 374975 - DNA, 12 bp, Homo sapiens
agacagaatctc

SEQ ID NO: 374976 - DNA, 15 bp, Homo sapiens
agacagacacacaca

SEQ ID NO: 374977 - DNA, 15 bp, Homo sapiens
agacagacttgagaa

SEQ ID NO: 374978 - DNA, 19 bp, Homo sapiens
agacagagtggatctggag

SEQ ID NO: 374979 - DNA, 15 bp, Homo sapiens
agacagatactcctc

SEQ ID NO: 374980 - DNA, 14 bp, Homo sapiens
agacagatgcccca

SEQ ID NO: 374981 - DNA, 15 bp, Homo sapiens
agacagatgccccag

SEQ ID NO: 374982 - DNA, 19 bp, Homo sapiens
agacagatgccccagagct

SEQ ID NO: 374983 - DNA, 17 bp, Homo sapiens
agacagcctaatgaagg

SEQ ID NO: 374984 - DNA, 11 bp, Homo sapiens
agacagcctct

SEQ ID NO: 374985 - DNA, 19 bp, Homo sapiens
agacaggccctccctgtct

SEQ ID NO: 374986 - DNA, 19 bp, Homo sapiens
agacagggtctgaaggact

SEQ ID NO: 374987 - DNA, 17 bp, Homo sapiens
agacagggtggggctta

SEQ ID NO: 374988 - DNA, 23 bp, Homo sapiens
agacagggtggggcttagaatgg

SEQ ID NO: 374989 - DNA, 17 bp, Homo sapiens
agacagtaagtatcttc

SEQ ID NO: 374990 - DNA, 22 bp, Homo sapiens
agacagtatgagtcaatgtgca

SEQ ID NO: 374991 - DNA, 13 bp, Homo sapiens
agacagtattgcc

SEQ ID NO: 374992 - DNA, 15 bp, Homo sapiens
agacagtgatctcca

SEQ ID NO: 374993 - DNA, 18 bp, Homo sapiens
agacagtgatctccatat

SEQ ID NO: 374994 - DNA, 18 bp, Homo sapiens
agacatagtctctaccta

SEQ ID NO: 374995 - DNA, 17 bp, Homo sapiens
agacatccatgtttgta

SEQ ID NO: 374996 - DNA, 19 bp, Homo sapiens
agacatccccctccttgcc

SEQ ID NO: 374997 - DNA, 22 bp, Homo sapiens
agacatcctcaaaagaaagaga

SEQ ID NO: 374998 - DNA, 24 bp, Homo sapiens
agacatcctgtgatgtcatgaaag

SEQ ID NO: 374999 - DNA, 20 bp, Homo sapiens
agacattatcttttggctct

SEQ ID NO: 375000 - DNA, 18 bp, Homo sapiens
agacattcaccaacaaca

SEQ ID NO: 375001 - DNA, 13 bp, Homo sapiens
agacattgtcaat

SEQ ID NO: 375002 - DNA, 17 bp, Homo sapiens
agacatttttatttagt

SEQ ID NO: 375003 - DNA, 17 bp, Homo sapiens
agaccaaaatgacaatg

SEQ ID NO: 375004 - DNA, 14 bp, Homo sapiens
agaccaaattttga

SEQ ID NO: 375005 - DNA, 20 bp, Homo sapiens
agaccaagccggtgcccacc

SEQ ID NO: 375006 - DNA, 21 bp, Homo sapiens
agaccaagcttgtttccctgc

SEQ ID NO: 375007 - DNA, 16 bp, Homo sapiens
agaccacaaaaattga

SEQ ID NO: 375008 - DNA, 20 bp, Homo sapiens
agaccaccagccgccccagc

SEQ ID NO: 375009 - DNA, 22 bp, Homo sapiens
agaccaccagccgccccagccc

SEQ ID NO: 375010 - DNA, 23 bp, Homo sapiens
agaccaccagccgccccagcccc

SEQ ID NO: 375011 - DNA, 12 bp, Homo sapiens
agaccacctctc

SEQ ID NO: 375012 - DNA, 17 bp, Homo sapiens
agaccagagctctggag

SEQ ID NO: 375013 - DNA, 12 bp, Homo sapiens
agaccagcctgg

SEQ ID NO: 375014 - DNA, 16 bp, Homo sapiens
agaccagcctttcttc

SEQ ID NO: 375015 - DNA, 16 bp, Homo sapiens
agaccaggactctgcc

SEQ ID NO: 375016 - DNA, 13 bp, Homo sapiens
agaccagtactgg

SEQ ID NO: 375017 - DNA, 14 bp, Homo sapiens
agaccagtctggcc

SEQ ID NO: 375018 - DNA, 21 bp, Homo sapiens
agaccagttgggagcactgga

SEQ ID NO: 375019 - DNA, 22 bp, Homo sapiens
agaccagttgggagcactggag

SEQ ID NO: 375020 - DNA, 23 bp, Homo sapiens
agaccagttgggagcactggagt

SEQ ID NO: 375021 - DNA, 16 bp, Homo sapiens
agaccatcctggcccc

SEQ ID NO: 375022 - DNA, 19 bp, Homo sapiens
agaccatcctggcccctcc

SEQ ID NO: 375023 - DNA, 20 bp, Homo sapiens
agaccatcctggcccctcca

SEQ ID NO: 375024 - DNA, 13 bp, Homo sapiens
agaccatctccta

SEQ ID NO: 375025 - DNA, 18 bp, Homo sapiens
agaccatctcctatcttt

SEQ ID NO: 375026 - DNA, 13 bp, Homo sapiens
agacccaataaag

SEQ ID NO: 375027 - DNA, 13 bp, Homo sapiens
agacccagggcag

SEQ ID NO: 375028 - DNA, 20 bp, Homo sapiens
agaccccacccaagcttggc

SEQ ID NO: 375029 - DNA, 13 bp, Homo sapiens
agacccccacacc

SEQ ID NO: 375030 - DNA, 14 bp, Homo sapiens
agacccccacacct

SEQ ID NO: 375031 - DNA, 13 bp, Homo sapiens
agacccccacccc

SEQ ID NO: 375032 - DNA, 16 bp, Homo sapiens
agacccccaccccttc

SEQ ID NO: 375033 - DNA, 20 bp, Homo sapiens
agacccccagcaaccctcct

SEQ ID NO: 375034 - DNA, 17 bp, Homo sapiens
agacccctaccctttcc

SEQ ID NO: 375035 - DNA, 18 bp, Homo sapiens
agacccctctcaacaccc

SEQ ID NO: 375036 - DNA, 14 bp, Homo sapiens
agacccctctggcc

SEQ ID NO: 375037 - DNA, 19 bp, Homo sapiens
agacccctctggccaggat

SEQ ID NO: 375038 - DNA, 11 bp, Homo sapiens
agacccctgcc

SEQ ID NO: 375039 - DNA, 13 bp, Homo sapiens
agacccctgcctg

SEQ ID NO: 375040 - DNA, 18 bp, Homo sapiens
agacccctgcctggactt

SEQ ID NO: 375041 - DNA, 14 bp, Homo sapiens
agacccgccaggtc

SEQ ID NO: 375042 - DNA, 11 bp, Homo sapiens
agaccctcact

SEQ ID NO: 375043 - DNA, 16 bp, Homo sapiens
agaccctcttctctgg

SEQ ID NO: 375044 - DNA, 11 bp, Homo sapiens
agaccctgaga

SEQ ID NO: 375045 - DNA, 16 bp, Homo sapiens
agaccctgtctttgct

SEQ ID NO: 375046 - DNA, 16 bp, Homo sapiens
agaccgagtgaaccta

SEQ ID NO: 375047 - DNA, 23 bp, Homo sapiens
agaccgagtgtggagctgcttcc

SEQ ID NO: 375048 - DNA, 21 bp, Homo sapiens
agaccgcttcacccctgcact

SEQ ID NO: 375049 - DNA, 18 bp, Homo sapiens
agaccggaagctcctggt

SEQ ID NO: 375050 - DNA, 19 bp, Homo sapiens
agaccggaattgagaggtg

SEQ ID NO: 375051 - DNA, 14 bp, Homo sapiens
agaccgtgagcgcc

SEQ ID NO: 375052 - DNA, 18 bp, Homo sapiens
agacctaatatcatttta

SEQ ID NO: 375053 - DNA, 14 bp, Homo sapiens
agacctagggagga

SEQ ID NO: 375054 - DNA, 15 bp, Homo sapiens
agacctagggaggac

SEQ ID NO: 375055 - DNA, 19 bp, Homo sapiens
agacctagggaggacctta

SEQ ID NO: 375056 - DNA, 13 bp, Homo sapiens
agacctccacatt

SEQ ID NO: 375057 - DNA, 16 bp, Homo sapiens
agacctcccctcttcc

SEQ ID NO: 375058 - DNA, 16 bp, Homo sapiens
agacctcggctgtgtg

SEQ ID NO: 375059 - DNA, 20 bp, Homo sapiens
agacctgagatgctggtcaa

SEQ ID NO: 375060 - DNA, 10 bp, Homo sapiens
agacctgcct

SEQ ID NO: 375061 - DNA, 15 bp, Homo sapiens
agacctgcctgtgtg

SEQ ID NO: 375062 - DNA, 13 bp, Homo sapiens
agacctgggactt

SEQ ID NO: 375063 - DNA, 14 bp, Homo sapiens
agacctgggccctg

SEQ ID NO: 375064 - DNA, 15 bp, Homo sapiens
agacctgtcttccaa

SEQ ID NO: 375065 - DNA, 12 bp, Homo sapiens
agacctgtgcta

SEQ ID NO: 375066 - DNA, 15 bp, Homo sapiens
agaccttccacaaag

SEQ ID NO: 375067 - DNA, 18 bp, Homo sapiens
agaccttctccaaatgag

SEQ ID NO: 375068 - DNA, 15 bp, Homo sapiens
agaccttcttccaca

SEQ ID NO: 375069 - DNA, 17 bp, Homo sapiens
agacgagacaccctaac

SEQ ID NO: 375070 - DNA, 15 bp, Homo sapiens
agacgagaggacgag

SEQ ID NO: 375071 - DNA, 13 bp, Homo sapiens
agacgaggcaggg

SEQ ID NO: 375072 - DNA, 15 bp, Homo sapiens
agacgaggcaggggc

SEQ ID NO: 375073 - DNA, 16 bp, Homo sapiens
agacgcaccttgctgc

SEQ ID NO: 375074 - DNA, 15 bp, Homo sapiens
agacggacgggacag

SEQ ID NO: 375075 - DNA, 17 bp, Homo sapiens
agacggatggaaggaga

SEQ ID NO: 375076 - DNA, 13 bp, Homo sapiens
agacggcagcccc

SEQ ID NO: 375077 - DNA, 15 bp, Homo sapiens
agacgtcctggaatg

SEQ ID NO: 375078 - DNA, 19 bp, Homo sapiens
agacgtcctggaatgaagc

SEQ ID NO: 375079 - DNA, 23 bp, Homo sapiens
agactaatgaatgcaaaaagata

SEQ ID NO: 375080 - DNA, 15 bp, Homo sapiens
agactaatttaaaaa

SEQ ID NO: 375081 - DNA, 13 bp, Homo sapiens
agactactcaata

SEQ ID NO: 375082 - DNA, 15 bp, Homo sapiens
agactactggcctct

SEQ ID NO: 375083 - DNA, 16 bp, Homo sapiens
agactagattgccttt

SEQ ID NO: 375084 - DNA, 17 bp, Homo sapiens
agactaggagaccagaa

SEQ ID NO: 375085 - DNA, 21 bp, Homo sapiens
agactaggagaccagaagtga

SEQ ID NO: 375086 - DNA, 17 bp, Homo sapiens
agactagtttgttatta

SEQ ID NO: 375087 - DNA, 20 bp, Homo sapiens
agactatgtgtcatgatttc

SEQ ID NO: 375088 - DNA, 17 bp, Homo sapiens
agactatttaacttgag

SEQ ID NO: 375089 - DNA, 11 bp, Homo sapiens
agactcagcca

SEQ ID NO: 375090 - DNA, 18 bp, Homo sapiens
aataaaaaacatttgtac

SEQ ID NO: 375091 - DNA, 13 bp, Homo sapiens
aataaaaaatgga

SEQ ID NO: 375092 - DNA, 13 bp, Homo sapiens
aataaaaagtata

SEQ ID NO: 375093 - DNA, 16 bp, Homo sapiens
aataaaaataaatttg

SEQ ID NO: 375094 - DNA, 13 bp, Homo sapiens
aataaaaatggat

SEQ ID NO: 375095 - DNA, 21 bp, Homo sapiens
agactcagccaagacaaggag

SEQ ID NO: 375096 - DNA, 13 bp, Homo sapiens
agactcaggccca

SEQ ID NO: 375097 - DNA, 20 bp, Homo sapiens
agactcaggcccacattgcc

SEQ ID NO: 375098 - DNA, 21 bp, Homo sapiens
agactcagtttgtcagacttt

SEQ ID NO: 375099 - DNA, 18 bp, Homo sapiens
agactcatacagaaggtg

SEQ ID NO: 375100 - DNA, 14 bp, Homo sapiens
agactccagaatct

SEQ ID NO: 375101 - DNA, 19 bp, Homo sapiens
agactccagaatctgctgt

SEQ ID NO: 375102 - DNA, 14 bp, Homo sapiens
agactcctgccctg

SEQ ID NO: 375103 - DNA, 12 bp, Homo sapiens
agactccttctc

SEQ ID NO: 375104 - DNA, 16 bp, Homo sapiens
agactccttctcccca

SEQ ID NO: 375105 - DNA, 18 bp, Homo sapiens
agactcgagagggctgag

SEQ ID NO: 375106 - DNA, 21 bp, Homo sapiens
agactcgagagggctgagccc

SEQ ID NO: 375107 - DNA, 15 bp, Homo sapiens
agactcgatgcaagt

SEQ ID NO: 375108 - DNA, 21 bp, Homo sapiens
agactcgttctcgtgacccag

SEQ ID NO: 375109 - DNA, 23 bp, Homo sapiens
agactcgttctcgtgacccagtg

SEQ ID NO: 375110 - DNA, 22 bp, Homo sapiens
agactctaaacacacaagtaga

SEQ ID NO: 375111 - DNA, 14 bp, Homo sapiens
agactctctcctct

SEQ ID NO: 375112 - DNA, 14 bp, Homo sapiens
agactctgtctcag

SEQ ID NO: 375113 - DNA, 18 bp, Homo sapiens
agactctgtgagattcta

SEQ ID NO: 375114 - DNA, 15 bp, Homo sapiens
agactctttgcatat

SEQ ID NO: 375115 - DNA, 18 bp, Homo sapiens
agactgaaagcagcagct

SEQ ID NO: 375116 - DNA, 15 bp, Homo sapiens
agactgaacagccaa

SEQ ID NO: 375117 - DNA, 20 bp, Homo sapiens
agactgactcacattgcctt

SEQ ID NO: 375118 - DNA, 13 bp, Homo sapiens
agactgagaggca

SEQ ID NO: 375119 - DNA, 15 bp, Homo sapiens
agactgagaggcaga

SEQ ID NO: 375120 - DNA, 21 bp, Homo sapiens
agactgagcttgattctaaag

SEQ ID NO: 375121 - DNA, 17 bp, Homo sapiens
agactgcaaaagaataa

SEQ ID NO: 375122 - DNA, 18 bp, Homo sapiens
agactgcaggttggaccc

SEQ ID NO: 375123 - DNA, 16 bp, Homo sapiens
agactgcccaccctgg

SEQ ID NO: 375124 - DNA, 21 bp, Homo sapiens
agactgcccaccctgggcctc

SEQ ID NO: 375125 - DNA, 21 bp, Homo sapiens
agactgccccacggccctgtc

SEQ ID NO: 375126 - DNA, 21 bp, Homo sapiens
agactgcctccctctcttccg

SEQ ID NO: 375127 - DNA, 14 bp, Homo sapiens
agactggcagccag

SEQ ID NO: 375128 - DNA, 22 bp, Homo sapiens
agactggcagccagggagcccg

SEQ ID NO: 375129 - DNA, 15 bp, Homo sapiens
agactggccatgcaa

SEQ ID NO: 375130 - DNA, 17 bp, Homo sapiens
agactggccatgcaagt

SEQ ID NO: 375131 - DNA, 22 bp, Homo sapiens
agactgggaagataggctctgc

SEQ ID NO: 375132 - DNA, 20 bp, Homo sapiens
agactgggaccttagaaatc

SEQ ID NO: 375133 - DNA, 18 bp, Homo sapiens
agactggtgagcagactg

SEQ ID NO: 375134 - DNA, 15 bp, Homo sapiens
agactgtaagatgtt

SEQ ID NO: 375135 - DNA, 16 bp, Homo sapiens
agactgtaagatgttg

SEQ ID NO: 375136 - DNA, 19 bp, Homo sapiens
agactgtactggccagtgt

SEQ ID NO: 375137 - DNA, 21 bp, Homo sapiens
agactgtactggccagtgtca

SEQ ID NO: 375138 - DNA, 23 bp, Homo sapiens
agactgtagattgcttctgtagt

SEQ ID NO: 375139 - DNA, 16 bp, Homo sapiens
agactgtccacttcta

SEQ ID NO: 375140 - DNA, 19 bp, Homo sapiens
agactgtcccgacacagcg

SEQ ID NO: 375141 - DNA, 24 bp, Homo sapiens
agactgtcggagaggctgtctggg

SEQ ID NO: 375142 - DNA, 23 bp, Homo sapiens
agactgttgctcaaatctattca

SEQ ID NO: 375143 - DNA, 19 bp, Homo sapiens
agacttagatctgagccct

SEQ ID NO: 375144 - DNA, 19 bp, Homo sapiens
agacttagtatattttctt

SEQ ID NO: 375145 - DNA, 14 bp, Homo sapiens
agacttcaggttgt

SEQ ID NO: 375146 - DNA, 24 bp, Homo sapiens
agacttcaggttgttctgtataaa

SEQ ID NO: 375147 - DNA, 17 bp, Homo sapiens
agacttcccaacagcct

SEQ ID NO: 375148 - DNA, 19 bp, Homo sapiens
agacttcccaacagcctta

SEQ ID NO: 375149 - DNA, 14 bp, Homo sapiens
agacttccccatcc

SEQ ID NO: 375150 - DNA, 17 bp, Homo sapiens
agacttccccatcccga

SEQ ID NO: 375151 - DNA, 20 bp, Homo sapiens
agacttccccatcccgaagc

SEQ ID NO: 375152 - DNA, 21 bp, Homo sapiens
agacttcgctattcccaggca

SEQ ID NO: 375153 - DNA, 15 bp, Homo sapiens
agacttctagcagaa

SEQ ID NO: 375154 - DNA, 20 bp, Homo sapiens
agacttctaggaggatgctg

SEQ ID NO: 375155 - DNA, 13 bp, Homo sapiens
agacttctggaag

SEQ ID NO: 375156 - DNA, 15 bp, Homo sapiens
agacttctggaaggc

SEQ ID NO: 375157 - DNA, 19 bp, Homo sapiens
agacttctggaaggctggc

SEQ ID NO: 375158 - DNA, 18 bp, Homo sapiens
agacttctggttgtattt

SEQ ID NO: 375159 - DNA, 22 bp, Homo sapiens
agacttctggttgtatttctat

SEQ ID NO: 375160 - DNA, 14 bp, Homo sapiens
agacttgaaagttt

SEQ ID NO: 375161 - DNA, 23 bp, Homo sapiens
agacttgccaacaccacagaaat

SEQ ID NO: 375162 - DNA, 13 bp, Homo sapiens
agacttgctctct

SEQ ID NO: 375163 - DNA, 18 bp, Homo sapiens
agacttgtatgaaagatg

SEQ ID NO: 375164 - DNA, 16 bp, Homo sapiens
agacttgtttcctgtg

SEQ ID NO: 375165 - DNA, 14 bp, Homo sapiens
agacttgtttcttt

SEQ ID NO: 375166 - DNA, 22 bp, Homo sapiens
agacttgtttctttctgtctct

SEQ ID NO: 375167 - DNA, 20 bp, Homo sapiens
agactttaattcttctcttt

SEQ ID NO: 375168 - DNA, 12 bp, Homo sapiens
agactttagaaa

SEQ ID NO: 375169 - DNA, 16 bp, Homo sapiens
agactttagaaataaa

SEQ ID NO: 375170 - DNA, 18 bp, Homo sapiens
agactttagaaataaatg

SEQ ID NO: 375171 - DNA, 18 bp, Homo sapiens
agactttccccatactct

SEQ ID NO: 375172 - DNA, 12 bp, Homo sapiens
agactttctgtt

SEQ ID NO: 375173 - DNA, 18 bp, Homo sapiens
agacttttaatcagacaa

SEQ ID NO: 375174 - DNA, 21 bp, Homo sapiens
agactttttaaattcctgctt

SEQ ID NO: 375175 - DNA, 16 bp, Homo sapiens
agagaaaaaccaatga

SEQ ID NO: 375176 - DNA, 12 bp, Homo sapiens
agagaaaaagag

SEQ ID NO: 375177 - DNA, 18 bp, Homo sapiens
agagaaaaagagagagca

SEQ ID NO: 375178 - DNA, 22 bp, Homo sapiens
agagaaaaagagagagcagggt

SEQ ID NO: 375179 - DNA, 13 bp, Homo sapiens
agagaaaacactt

SEQ ID NO: 375180 - DNA, 18 bp, Homo sapiens
agagaaaacttatttgag

SEQ ID NO: 375181 - DNA, 12 bp, Homo sapiens
agagaaaataaa

SEQ ID NO: 375182 - DNA, 23 bp, Homo sapiens
agagaaaataaatttaactttaa

SEQ ID NO: 375183 - DNA, 16 bp, Homo sapiens
agagaaagaaaatgaa

SEQ ID NO: 375184 - DNA, 13 bp, Homo sapiens
agagaaagaatga

SEQ ID NO: 375185 - DNA, 18 bp, Homo sapiens
agagaaagtgatttctag

SEQ ID NO: 375186 - DNA, 19 bp, Homo sapiens
agagaaagtgatttctaga

SEQ ID NO: 375187 - DNA, 15 bp, Homo sapiens
agagaaatgaggaag

SEQ ID NO: 375188 - DNA, 16 bp, Homo sapiens
agagaaatgaggaaga

SEQ ID NO: 375189 - DNA, 11 bp, Homo sapiens
agagaacagtt

SEQ ID NO: 375190 - DNA, 21 bp, Homo sapiens
agagaaccgagcaaagatcaa

SEQ ID NO: 375191 - DNA, 17 bp, Homo sapiens
agagaacctttccactc

SEQ ID NO: 375192 - DNA, 13 bp, Homo sapiens
agagaactagtgg

SEQ ID NO: 375193 - DNA, 12 bp, Homo sapiens
agagaagagacc

SEQ ID NO: 375194 - DNA, 14 bp, Homo sapiens
agagaagcacccca

SEQ ID NO: 375195 - DNA, 23 bp, Homo sapiens
agagaaggaaaagactgaatcta

SEQ ID NO: 375196 - DNA, 15 bp, Homo sapiens
agagaagggagctga

SEQ ID NO: 375197 - DNA, 20 bp, Homo sapiens
agagaagggagctgaggcca

SEQ ID NO: 375198 - DNA, 15 bp, Homo sapiens
agagaaggggaggag

SEQ ID NO: 375199 - DNA, 21 bp, Homo sapiens
agagaagtatccaattatgtg

SEQ ID NO: 375200 - DNA, 14 bp, Homo sapiens
agagaagtgcccct

SEQ ID NO: 375201 - DNA, 13 bp, Homo sapiens
agagaatctgcct

SEQ ID NO: 375202 - DNA, 17 bp, Homo sapiens
agagaatgtagatattg

SEQ ID NO: 375203 - DNA, 21 bp, Homo sapiens
agagaattctaagattgtaca

SEQ ID NO: 375204 - DNA, 22 bp, Homo sapiens
agagaattctaagattgtacat

SEQ ID NO: 375205 - DNA, 14 bp, Homo sapiens
agagacaaatcttt

SEQ ID NO: 375206 - DNA, 18 bp, Homo sapiens
agagacaaatctttaaga

SEQ ID NO: 375207 - DNA, 14 bp, Homo sapiens
agagacaagaagca

SEQ ID NO: 375208 - DNA, 15 bp, Homo sapiens
agagacaataaaaca

SEQ ID NO: 375209 - DNA, 14 bp, Homo sapiens
agagacagaagcag

SEQ ID NO: 375210 - DNA, 15 bp, Homo sapiens
agagacagaagcagg

SEQ ID NO: 375211 - DNA, 18 bp, Homo sapiens
agagacagacttgagaac

SEQ ID NO: 375212 - DNA, 15 bp, Homo sapiens
agagacagtgttttg

SEQ ID NO: 375213 - DNA, 17 bp, Homo sapiens
agagacatgggcctccc

SEQ ID NO: 375214 - DNA, 22 bp, Homo sapiens
agagaccaagcttgtttccctg

SEQ ID NO: 375215 - DNA, 13 bp, Homo sapiens
agagaccacacca

SEQ ID NO: 375216 - DNA, 14 bp, Homo sapiens
agagaccattgcat

SEQ ID NO: 375217 - DNA, 21 bp, Homo sapiens
agagaccctcactgctgggga

SEQ ID NO: 375218 - DNA, 23 bp, Homo sapiens
agagaccctcactgctggggagt

SEQ ID NO: 375219 - DNA, 14 bp, Homo sapiens
agagaccctgccaa

SEQ ID NO: 375220 - DNA, 14 bp, Homo sapiens
aataccagtacttg

SEQ ID NO: 375221 - DNA, 18 bp, Homo sapiens
aataccattaaaactgct

SEQ ID NO: 375222 - DNA, 20 bp, Homo sapiens
aataccattaaaactgcttt

SEQ ID NO: 375223 - DNA, 12 bp, Homo sapiens
aatacccacatt

SEQ ID NO: 375224 - DNA, 21 bp, Homo sapiens
aatacccttgtgagagcccat

SEQ ID NO: 375225 - DNA, 20 bp, Homo sapiens
aatacctttaaatatcattc

SEQ ID NO: 375226 - DNA, 17 bp, Homo sapiens
aatactaaatatgaaat

SEQ ID NO: 375227 - DNA, 18 bp, Homo sapiens
aatactataaatatattg

SEQ ID NO: 375228 - DNA, 13 bp, Homo sapiens
aatactcaccaaa

SEQ ID NO: 375229 - DNA, 14 bp, Homo sapiens
aatactcacctcct

SEQ ID NO: 375230 - DNA, 23 bp, Homo sapiens
aatactcttaggaagagaaacca

SEQ ID NO: 375231 - DNA, 15 bp, Homo sapiens
aatactgagtgcctg

SEQ ID NO: 375232 - DNA, 13 bp, Homo sapiens
agagactgggaag

SEQ ID NO: 375233 - DNA, 23 bp, Homo sapiens
agagactgggaagataggctctg

SEQ ID NO: 375234 - DNA, 22 bp, Homo sapiens
agagactgggagccacttctcc

SEQ ID NO: 375235 - DNA, 14 bp, Homo sapiens
agagactgtagatt

SEQ ID NO: 375236 - DNA, 21 bp, Homo sapiens
agagactgtgaggcggcagct

SEQ ID NO: 375237 - DNA, 16 bp, Homo sapiens
agagacttttaatcag

SEQ ID NO: 375238 - DNA, 13 bp, Homo sapiens
agagagaaaaaga

SEQ ID NO: 375239 - DNA, 20 bp, Homo sapiens
agagagaaaaagagagagca

SEQ ID NO: 375240 - DNA, 23 bp, Homo sapiens
agagagaccctcactgctgggga

SEQ ID NO: 375241 - DNA, 13 bp, Homo sapiens
agagagagaaaga

SEQ ID NO: 375242 - DNA, 14 bp, Homo sapiens
agagagagagagaa

SEQ ID NO: 375243 - DNA, 14 bp, Homo sapiens
agagagagcagggt

SEQ ID NO: 375244 - DNA, 13 bp, Homo sapiens
agagagaggaggc

SEQ ID NO: 375245 - DNA, 22 bp, Homo sapiens
agagagaggaggcagccccctc

SEQ ID NO: 375246 - DNA, 22 bp, Homo sapiens
agagagcaagaaaaaagtacag

SEQ ID NO: 375247 - DNA, 22 bp, Homo sapiens
agagagcaatcttgctgtgaaa

SEQ ID NO: 375248 - DNA, 22 bp, Homo sapiens
agagagcctgcccggccggaga

SEQ ID NO: 375249 - DNA, 23 bp, Homo sapiens
agagagccttggttcatcagtgt

SEQ ID NO: 375250 - DNA, 20 bp, Homo sapiens
agagagcgcgggagagagtg

SEQ ID NO: 375251 - DNA, 12 bp, Homo sapiens
agagagctggta

SEQ ID NO: 375252 - DNA, 23 bp, Homo sapiens
agagagctggtagttagtagcat

SEQ ID NO: 375253 - DNA, 18 bp, Homo sapiens
agagaggacagtttagga

SEQ ID NO: 375254 - DNA, 18 bp, Homo sapiens
agagaggacgtgggcggc

SEQ ID NO: 375255 - DNA, 13 bp, Homo sapiens
agagaggaggcag

SEQ ID NO: 375256 - DNA, 17 bp, Homo sapiens
agagaggcacctgctgg

SEQ ID NO: 375257 - DNA, 17 bp, Homo sapiens
agagagggaattctctt

SEQ ID NO: 375258 - DNA, 18 bp, Homo sapiens
agagagggaattctcttg

SEQ ID NO: 375259 - DNA, 15 bp, Homo sapiens
agagagggcccagct

SEQ ID NO: 375260 - DNA, 16 bp, Homo sapiens
agagagggggccacct

SEQ ID NO: 375261 - DNA, 16 bp, Homo sapiens
agagaggtagcgagct

SEQ ID NO: 375262 - DNA, 15 bp, Homo sapiens
agagagtgagagaga

SEQ ID NO: 375263 - DNA, 18 bp, Homo sapiens
agagagtgagagagagtg

SEQ ID NO: 375264 - DNA, 18 bp, Homo sapiens
agagagtgagagcacaaa

SEQ ID NO: 375265 - DNA, 16 bp, Homo sapiens
agagagtggctcctcc

SEQ ID NO: 375266 - DNA, 17 bp, Homo sapiens
agagagtggctcctccc

SEQ ID NO: 375267 - DNA, 23 bp, Homo sapiens
agagatatttaaaagacaaacac

SEQ ID NO: 375268 - DNA, 14 bp, Homo sapiens
agagatgagctttc

SEQ ID NO: 375269 - DNA, 23 bp, Homo sapiens
agagatgatcgtgcctataaata

SEQ ID NO: 375270 - DNA, 23 bp, Homo sapiens
agagatgctactgtcagtgtcct

SEQ ID NO: 375271 - DNA, 13 bp, Homo sapiens
agagatggaggag

SEQ ID NO: 375272 - DNA, 18 bp, Homo sapiens
agagatggaggaggaggc

SEQ ID NO: 375273 - DNA, 23 bp, Homo sapiens
agagatgggactgggagggccca

SEQ ID NO: 375274 - DNA, 17 bp, Homo sapiens
agagatgttttgttgat

SEQ ID NO: 375275 - DNA, 12 bp, Homo sapiens
agagatgttttt

SEQ ID NO: 375276 - DNA, 14 bp, Homo sapiens
agagattaatttgt

SEQ ID NO: 375277 - DNA, 17 bp, Homo sapiens
agagattaatttgtgta

SEQ ID NO: 375278 - DNA, 15 bp, Homo sapiens
agagattcccctgga

SEQ ID NO: 375279 - DNA, 17 bp, Homo sapiens
agagattcccctggacc

SEQ ID NO: 375280 - DNA, 18 bp, Homo sapiens
agagattcccctggacca

SEQ ID NO: 375281 - DNA, 23 bp, Homo sapiens
agagattgaactttgaggaggaa

SEQ ID NO: 375282 - DNA, 18 bp, Homo sapiens
agagatttatataaatgt

SEQ ID NO: 375283 - DNA, 21 bp, Homo sapiens
agagatttatataaatgtaaa

SEQ ID NO: 375284 - DNA, 17 bp, Homo sapiens
agagcaaagatggcttc

SEQ ID NO: 375285 - DNA, 18 bp, Homo sapiens
agagcaaatgagggaggg

SEQ ID NO: 375286 - DNA, 24 bp, Homo sapiens
agagcaacccattaatcttttgta

SEQ ID NO: 375287 - DNA, 13 bp, Homo sapiens
agagcaacccctg

SEQ ID NO: 375288 - DNA, 20 bp, Homo sapiens
agagcaagactctgtctcaa

SEQ ID NO: 375289 - DNA, 16 bp, Homo sapiens
agagcaatcttgctgt

SEQ ID NO: 375290 - DNA, 15 bp, Homo sapiens
agagcacaaagataa

SEQ ID NO: 375291 - DNA, 12 bp, Homo sapiens
agagcacctcag

SEQ ID NO: 375292 - DNA, 16 bp, Homo sapiens
agagcacctcaggacc

SEQ ID NO: 375293 - DNA, 20 bp, Homo sapiens
agagcactgggttgcagggg

SEQ ID NO: 375294 - DNA, 16 bp, Homo sapiens
agagcacttcacacag

SEQ ID NO: 375295 - DNA, 11 bp, Homo sapiens
agagcagcctg

SEQ ID NO: 375296 - DNA, 14 bp, Homo sapiens
agagcagctcccca

SEQ ID NO: 375297 - DNA, 16 bp, Homo sapiens
agagcagctccccagg

SEQ ID NO: 375298 - DNA, 18 bp, Homo sapiens
agagcagctccccaggag

SEQ ID NO: 375299 - DNA, 20 bp, Homo sapiens
agagcagctccccaggagct

SEQ ID NO: 375300 - DNA, 22 bp, Homo sapiens
agagcagggattaacctctgca

SEQ ID NO: 375301 - DNA, 22 bp, Homo sapiens
agagcaggtctgcaggccacca

SEQ ID NO: 375302 - DNA, 23 bp, Homo sapiens
agagcagttaacatctgaagtgt

SEQ ID NO: 375303 - DNA, 20 bp, Homo sapiens
agagcatctgctctgagacg

SEQ ID NO: 375304 - DNA, 23 bp, Homo sapiens
agagcatctgtcccactgggaca

SEQ ID NO: 375305 - DNA, 24 bp, Homo sapiens
agagccaaggcctatgccacctgc

SEQ ID NO: 375306 - DNA, 18 bp, Homo sapiens
agagccaagttcaaagaa

SEQ ID NO: 375307 - DNA, 23 bp, Homo sapiens
agagccacccaggccactgacct

SEQ ID NO: 375308 - DNA, 12 bp, Homo sapiens
agagccagcctg

SEQ ID NO: 375309 - DNA, 13 bp, Homo sapiens
agagccagctccc

SEQ ID NO: 375310 - DNA, 9 bp, Homo sapiens
agagccagg

SEQ ID NO: 375311 - DNA, 11 bp, Homo sapiens
agagccagggc

SEQ ID NO: 375312 - DNA, 13 bp, Homo sapiens
agagccagggctg

SEQ ID NO: 375313 - DNA, 19 bp, Homo sapiens
agagccagggctgtcctta

SEQ ID NO: 375314 - DNA, 18 bp, Homo sapiens
agagccatgggcctgggc

SEQ ID NO: 375315 - DNA, 22 bp, Homo sapiens
agagccccactcccggccaggc

SEQ ID NO: 375316 - DNA, 12 bp, Homo sapiens
agagccccggag

SEQ ID NO: 375317 - DNA, 15 bp, Homo sapiens
agagcccctggggcc

SEQ ID NO: 375318 - DNA, 18 bp, Homo sapiens
agagcccgcccacctggg

SEQ ID NO: 375319 - DNA, 22 bp, Homo sapiens
agagccctctgctgctttccaa

SEQ ID NO: 375320 - DNA, 18 bp, Homo sapiens
agagccctggacacccct

SEQ ID NO: 375321 - DNA, 23 bp, Homo sapiens
agagccctggacacccctgctct

SEQ ID NO: 375322 - DNA, 13 bp, Homo sapiens
agagccctggctg

SEQ ID NO: 375323 - DNA, 15 bp, Homo sapiens
agagccctggctggg

SEQ ID NO: 375324 - DNA, 21 bp, Homo sapiens
agagccctgtatcaacccaga

SEQ ID NO: 375325 - DNA, 15 bp, Homo sapiens
agagcccttcactgc

SEQ ID NO: 375326 - DNA, 19 bp, Homo sapiens
agagcccttcactgccatg

SEQ ID NO: 375327 - DNA, 15 bp, Homo sapiens
agagcccttcatttg

SEQ ID NO: 375328 - DNA, 15 bp, Homo sapiens
agagccgggccccgg

SEQ ID NO: 375329 - DNA, 15 bp, Homo sapiens
agagccgttcctggg

SEQ ID NO: 375330 - DNA, 16 bp, Homo sapiens
agagccgttcctggga

SEQ ID NO: 375331 - DNA, 17 bp, Homo sapiens
agagcctgctgcatggg

SEQ ID NO: 375332 - DNA, 23 bp, Homo sapiens
agagcctgtccccgccttccctc

SEQ ID NO: 375333 - DNA, 11 bp, Homo sapiens
agagcctttga

SEQ ID NO: 375334 - DNA, 17 bp, Homo sapiens
agagcgagattccgtct

SEQ ID NO: 375335 - DNA, 17 bp, Homo sapiens
agagcgccacccgcccg

SEQ ID NO: 375336 - DNA, 18 bp, Homo sapiens
agagcgctcctctgcctt

SEQ ID NO: 375337 - DNA, 20 bp, Homo sapiens
agagcgctcctctgccttgg

SEQ ID NO: 375338 - DNA, 14 bp, Homo sapiens
agagcggaggagga

SEQ ID NO: 375339 - DNA, 21 bp, Homo sapiens
agagctaacagacatagactg

SEQ ID NO: 375340 - DNA, 20 bp, Homo sapiens
agagctaataaatctcttct

SEQ ID NO: 375341 - DNA, 23 bp, Homo sapiens
agagctaggcccccaaattgcct

SEQ ID NO: 375342 - DNA, 17 bp, Homo sapiens
agagctatgcacaccaa

SEQ ID NO: 375343 - DNA, 20 bp, Homo sapiens
agagctatgcacaccaaatt

SEQ ID NO: 375344 - DNA, 15 bp, Homo sapiens
agagctatggtgagg

SEQ ID NO: 375345 - DNA, 13 bp, Homo sapiens
agagctcagagga

SEQ ID NO: 375346 - DNA, 20 bp, Homo sapiens
agagctcagaggagtctggg

SEQ ID NO: 375347 - DNA, 17 bp, Homo sapiens
agagctcagcacagcct

SEQ ID NO: 375348 - DNA, 16 bp, Homo sapiens
agagctcaggagaagg

SEQ ID NO: 375349 - DNA, 14 bp, Homo sapiens
agagctccacagaa

SEQ ID NO: 375350 - DNA, 21 bp, Homo sapiens
agagtagggttgccagtcctg

SEQ ID NO: 375351 - DNA, 13 bp, Homo sapiens
agagtatatatgt

SEQ ID NO: 375352 - DNA, 14 bp, Homo sapiens
agagtatatatgta

SEQ ID NO: 375353 - DNA, 13 bp, Homo sapiens
agagtatatgcac

SEQ ID NO: 375354 - DNA, 19 bp, Homo sapiens
agagtatcaaaggcagaaa

SEQ ID NO: 375355 - DNA, 18 bp, Homo sapiens
agagtatgtagtggcttc

SEQ ID NO: 375356 - DNA, 20 bp, Homo sapiens
agagtcacagctttcccagg

SEQ ID NO: 375357 - DNA, 20 bp, Homo sapiens
agagtcagccattcctgttc

SEQ ID NO: 375358 - DNA, 14 bp, Homo sapiens
agagtcatctccat

SEQ ID NO: 375359 - DNA, 20 bp, Homo sapiens
agagtcctgaggcagaacct

SEQ ID NO: 375360 - DNA, 13 bp, Homo sapiens
agagtctgaacag

SEQ ID NO: 375361 - DNA, 14 bp, Homo sapiens
agagtctgacagga

SEQ ID NO: 375362 - DNA, 16 bp, Homo sapiens
agagtctgacaggaag

SEQ ID NO: 375363 - DNA, 15 bp, Homo sapiens
agagtctgagccccc

SEQ ID NO: 375364 - DNA, 18 bp, Homo sapiens
agagtctggcctgccagg

SEQ ID NO: 375365 - DNA, 13 bp, Homo sapiens
agagtctgggcct

SEQ ID NO: 375366 - DNA, 22 bp, Homo sapiens
agagtctttgtaagtaaactgc

SEQ ID NO: 375367 - DNA, 21 bp, Homo sapiens
agagtgaaaccatgactgtga

SEQ ID NO: 375368 - DNA, 21 bp, Homo sapiens
agagtgagaataattgtgtac

SEQ ID NO: 375369 - DNA, 23 bp, Homo sapiens
agagtgagaataattgtgtacaa

SEQ ID NO: 375370 - DNA, 12 bp, Homo sapiens
agagtgagagag

SEQ ID NO: 375371 - DNA, 19 bp, Homo sapiens
agagtgagagcacaaagat

SEQ ID NO: 375372 - DNA, 23 bp, Homo sapiens
agagtgaggtcatcccggggcca

SEQ ID NO: 375373 - DNA, 20 bp, Homo sapiens
aatattaatcccagccctac

SEQ ID NO: 375374 - DNA, 15 bp, Homo sapiens
aatattacattgcat

SEQ ID NO: 375375 - DNA, 20 bp, Homo sapiens
aatattaccatcttaatctt

SEQ ID NO: 375376 - DNA, 21 bp, Homo sapiens
aatattactgtctttattctt

SEQ ID NO: 375377 - DNA, 22 bp, Homo sapiens
aatattatactaagaaaagata

SEQ ID NO: 375378 - DNA, 21 bp, Homo sapiens
aatattatattgtatttaacc

SEQ ID NO: 375379 - DNA, 20 bp, Homo sapiens
aatattatcatttctccttt

SEQ ID NO: 375380 - DNA, 11 bp, Homo sapiens
aatattatctt

SEQ ID NO: 375381 - DNA, 15 bp, Homo sapiens
aatattatctttgta

SEQ ID NO: 375382 - DNA, 16 bp, Homo sapiens
aatattatgattttat

SEQ ID NO: 375383 - DNA, 15 bp, Homo sapiens
aatattcagtcctgt

SEQ ID NO: 375384 - DNA, 20 bp, Homo sapiens
aatattcccctatctctaga

SEQ ID NO: 375385 - DNA, 20 bp, Homo sapiens
aatattcttgtccacattct

SEQ ID NO: 375386 - DNA, 19 bp, Homo sapiens
aatattgaaacactgtaca

SEQ ID NO: 375387 - DNA, 18 bp, Homo sapiens
aatattgatatgcttata

SEQ ID NO: 375388 - DNA, 18 bp, Homo sapiens
aatattgcccaaataata

SEQ ID NO: 375389 - DNA, 21 bp, Homo sapiens
aatattgcccaaataatattt

SEQ ID NO: 375390 - DNA, 17 bp, Homo sapiens
aatattgcttggactac

SEQ ID NO: 375391 - DNA, 20 bp, Homo sapiens
aatattgctttggtcatatg

SEQ ID NO: 375392 - DNA, 18 bp, Homo sapiens
aatattgtgttgtgaatg

SEQ ID NO: 375393 - DNA, 24 bp, Homo sapiens
aatatttaaaaaaaaacattcaaa

SEQ ID NO: 375394 - DNA, 15 bp, Homo sapiens
aatatttatagggct

SEQ ID NO: 375395 - DNA, 18 bp, Homo sapiens
aatatttatatttcacta

SEQ ID NO: 375396 - DNA, 21 bp, Homo sapiens
aatatttatgtttaagtgctt

SEQ ID NO: 375397 - DNA, 12 bp, Homo sapiens
aatatttattac

SEQ ID NO: 375398 - DNA, 13 bp, Homo sapiens
aatatttattacc

SEQ ID NO: 375399 - DNA, 20 bp, Homo sapiens
aatatttattattttcacct

SEQ ID NO: 375400 - DNA, 22 bp, Homo sapiens
aatatttattgaattattttgt

SEQ ID NO: 375401 - DNA, 14 bp, Homo sapiens
aatatttattgtat

SEQ ID NO: 375402 - DNA, 18 bp, Homo sapiens
aatatttatttccagagt

SEQ ID NO: 375403 - DNA, 13 bp, Homo sapiens
aatatttccatat

SEQ ID NO: 375404 - DNA, 16 bp, Homo sapiens
aatatttgcttattta

SEQ ID NO: 375405 - DNA, 15 bp, Homo sapiens
aatatttttccctcc

SEQ ID NO: 375406 - DNA, 22 bp, Homo sapiens
aatatttttccctccgggcagg

SEQ ID NO: 375407 - DNA, 23 bp, Homo sapiens
aatatttttccctccgggcaggg

SEQ ID NO: 375408 - DNA, 17 bp, Homo sapiens
aatattttttatttcta

SEQ ID NO: 375409 - DNA, 20 bp, Homo sapiens
aatattttttatttctaagt

SEQ ID NO: 375410 - DNA, 16 bp, Homo sapiens
aatattttttttaact

SEQ ID NO: 375411 - DNA, 13 bp, Homo sapiens
aatcaaaaaatta

SEQ ID NO: 375412 - DNA, 16 bp, Homo sapiens
aatcaaaaaattatct

SEQ ID NO: 375413 - DNA, 20 bp, Homo sapiens
aatcaaaataacgccccaga

SEQ ID NO: 375414 - DNA, 13 bp, Homo sapiens
aatcaaagcaagg

SEQ ID NO: 375415 - DNA, 18 bp, Homo sapiens
aatcaacctgcacttcat

SEQ ID NO: 375416 - DNA, 21 bp, Homo sapiens
aatcaatacccttggcactga

SEQ ID NO: 375417 - DNA, 21 bp, Homo sapiens
aatcaatctggcttctgcatt

SEQ ID NO: 375418 - DNA, 17 bp, Homo sapiens
aatcaatgtcacttaaa

SEQ ID NO: 375419 - DNA, 11 bp, Homo sapiens
aatcacattca

SEQ ID NO: 375420 - DNA, 15 bp, Homo sapiens
aatcaccttttctaa

SEQ ID NO: 375421 - DNA, 19 bp, Homo sapiens
aatcacgagatcttccttc

SEQ ID NO: 375422 - DNA, 21 bp, Homo sapiens
aatcactataaccatcagtta

SEQ ID NO: 375423 - DNA, 21 bp, Homo sapiens
aatcactgaggcatttttact

SEQ ID NO: 375424 - DNA, 15 bp, Homo sapiens
aatcactgagtttgt

SEQ ID NO: 375425 - DNA, 12 bp, Homo sapiens
aatcactgccta

SEQ ID NO: 375426 - DNA, 13 bp, Homo sapiens
aatcactgctccc

SEQ ID NO: 375427 - DNA, 13 bp, Homo sapiens
aatcagacaaagt

SEQ ID NO: 375428 - DNA, 18 bp, Homo sapiens
aatcagcattctcactcc

SEQ ID NO: 375429 - DNA, 19 bp, Homo sapiens
aatcagcattctcactcct

SEQ ID NO: 375430 - DNA, 23 bp, Homo sapiens
aatcagcctaggggtcagggacc

SEQ ID NO: 375431 - DNA, 12 bp, Homo sapiens
aatcagcctctt

SEQ ID NO: 375432 - DNA, 12 bp, Homo sapiens
aatcagctgctt

SEQ ID NO: 375433 - DNA, 13 bp, Homo sapiens
aatcagctgcttt

SEQ ID NO: 375434 - DNA, 18 bp, Homo sapiens
aatcaggattttagtgct

SEQ ID NO: 375435 - DNA, 21 bp, Homo sapiens
aatcagtagacctgattttca

SEQ ID NO: 375436 - DNA, 19 bp, Homo sapiens
aatcagtgggcaggataaa

SEQ ID NO: 375437 - DNA, 21 bp, Homo sapiens
aatcagtgtagccccaagaag

SEQ ID NO: 375438 - DNA, 22 bp, Homo sapiens
aatcagtgtgtctaaatttgaa

SEQ ID NO: 375439 - DNA, 15 bp, Homo sapiens
aatcagtgtttaaat

SEQ ID NO: 375440 - DNA, 21 bp, Homo sapiens
aatcagtgtttaaataaagac

SEQ ID NO: 375441 - DNA, 21 bp, Homo sapiens
aatcagttgcgcgttctgaaa

SEQ ID NO: 375442 - DNA, 16 bp, Homo sapiens
aatcatatcaacttaa

SEQ ID NO: 375443 - DNA, 22 bp, Homo sapiens
aatcatatcaacttaattctgt

SEQ ID NO: 375444 - DNA, 14 bp, Homo sapiens
aatcatattgatga

SEQ ID NO: 375445 - DNA, 18 bp, Homo sapiens
aatcatattgatgaaaag

SEQ ID NO: 375446 - DNA, 12 bp, Homo sapiens
aatcatctattg

SEQ ID NO: 375447 - DNA, 15 bp, Homo sapiens
aatcatctgtgtgaa

SEQ ID NO: 375448 - DNA, 15 bp, Homo sapiens
aatcatcttctcttt

SEQ ID NO: 375449 - DNA, 20 bp, Homo sapiens
aatcatgaagtaaattgaaa

SEQ ID NO: 375450 - DNA, 18 bp, Homo sapiens
aatcatgccctgccttgt

SEQ ID NO: 375451 - DNA, 21 bp, Homo sapiens
aatcatggggtggaataaagg

SEQ ID NO: 375452 - DNA, 12 bp, Homo sapiens
aatcattattta

SEQ ID NO: 375453 - DNA, 20 bp, Homo sapiens
aatcattatttattaaattt

SEQ ID NO: 375454 - DNA, 22 bp, Homo sapiens
aatcattccccccgtgaagtct

SEQ ID NO: 375455 - DNA, 21 bp, Homo sapiens
aatcattgctttgaagcagtt

SEQ ID NO: 375456 - DNA, 14 bp, Homo sapiens
aatcatttgctttt

SEQ ID NO: 375457 - DNA, 15 bp, Homo sapiens
aatcattttaattat

SEQ ID NO: 375458 - DNA, 16 bp, Homo sapiens
aatcattttgggaaat

SEQ ID NO: 375459 - DNA, 13 bp, Homo sapiens
aatccaaactact

SEQ ID NO: 375460 - DNA, 17 bp, Homo sapiens
aatccaacacaagttgt

SEQ ID NO: 375461 - DNA, 17 bp, Homo sapiens
aatccaacccatgcatg

SEQ ID NO: 375462 - DNA, 12 bp, Homo sapiens
aatccaactcca

SEQ ID NO: 375463 - DNA, 14 bp, Homo sapiens
aatccaactccagg

SEQ ID NO: 375464 - DNA, 14 bp, Homo sapiens
aatccacacatatt

SEQ ID NO: 375465 - DNA, 23 bp, Homo sapiens
aatccacccatcctaccaatgca

SEQ ID NO: 375466 - DNA, 15 bp, Homo sapiens
aatccagaaggaagc

SEQ ID NO: 375467 - DNA, 23 bp, Homo sapiens
aatccagaagttttaacttccag

SEQ ID NO: 375468 - DNA, 17 bp, Homo sapiens
aatccagcatcccaaga

SEQ ID NO: 375469 - DNA, 11 bp, Homo sapiens
aatccagcccc

SEQ ID NO: 375470 - DNA, 12 bp, Homo sapiens
aatccagcccca

SEQ ID NO: 375471 - DNA, 19 bp, Homo sapiens
aatccagccccatagaaaa

SEQ ID NO: 375472 - DNA, 12 bp, Homo sapiens
aatccagctccc

SEQ ID NO: 375473 - DNA, 22 bp, Homo sapiens
aatccagctccctagactgcat

SEQ ID NO: 375474 - DNA, 18 bp, Homo sapiens
aatccagtggggaaaaaa

SEQ ID NO: 375475 - DNA, 19 bp, Homo sapiens
aatccagtggggaaaaaaa

SEQ ID NO: 375476 - DNA, 17 bp, Homo sapiens
aatccataccccctgcc

SEQ ID NO: 375477 - DNA, 22 bp, Homo sapiens
aatccatgccataagcaggagt

SEQ ID NO: 375478 - DNA, 19 bp, Homo sapiens
aatccatgtgctgctgtgg

SEQ ID NO: 375479 - DNA, 14 bp, Homo sapiens
aatccatttaatca

SEQ ID NO: 375480 - DNA, 12 bp, Homo sapiens
aatgaatgaaat

SEQ ID NO: 375481 - DNA, 13 bp, Homo sapiens
aatgaatgcattg

SEQ ID NO: 375482 - DNA, 13 bp, Homo sapiens
aatgaatgtcagt

SEQ ID NO: 375483 - DNA, 18 bp, Homo sapiens
aatgaattgaatgctcta

SEQ ID NO: 375484 - DNA, 16 bp, Homo sapiens
aatgaatttgactggt

SEQ ID NO: 375485 - DNA, 19 bp, Homo sapiens
aatgaattttaaaagcata

SEQ ID NO: 375486 - DNA, 13 bp, Homo sapiens
aatgacacagtct

SEQ ID NO: 375487 - DNA, 21 bp, Homo sapiens
aatgacatgtgtcaagctgct

SEQ ID NO: 375488 - DNA, 14 bp, Homo sapiens
aatgacattcccct

SEQ ID NO: 375489 - DNA, 16 bp, Homo sapiens
aatgaccagtttacct

SEQ ID NO: 375490 - DNA, 21 bp, Homo sapiens
aatgactgaaagaagaacagc

SEQ ID NO: 375491 - DNA, 15 bp, Homo sapiens
aatgacttattgatt

SEQ ID NO: 375492 - DNA, 14 bp, Homo sapiens
aatgacttcatttc

SEQ ID NO: 375493 - DNA, 23 bp, Homo sapiens
aatgagaaagaaaaggaatgcaa

SEQ ID NO: 375494 - DNA, 24 bp, Homo sapiens
aatgagattcagtgaactaatttg

SEQ ID NO: 375495 - DNA, 16 bp, Homo sapiens
aatgagcgttaacaca

SEQ ID NO: 375496 - DNA, 22 bp, Homo sapiens
aatgagctcgcatttgtcaatg

SEQ ID NO: 375497 - DNA, 23 bp, Homo sapiens
aatgagctctctaatagaagtcc

SEQ ID NO: 375498 - DNA, 14 bp, Homo sapiens
aatgagctgggccc

SEQ ID NO: 375499 - DNA, 19 bp, Homo sapiens
aatgagctgggccctgggt

SEQ ID NO: 375500 - DNA, 17 bp, Homo sapiens
aatgaggtggtactatg

SEQ ID NO: 375501 - DNA, 17 bp, Homo sapiens
aatgaggttatgagaaa

SEQ ID NO: 375502 - DNA, 20 bp, Homo sapiens
aatgaggttatgagaaaaaa

SEQ ID NO: 375503 - DNA, 13 bp, Homo sapiens
aatgagtaaataa

SEQ ID NO: 375504 - DNA, 19 bp, Homo sapiens
aatgagtaaataaactctt

SEQ ID NO: 375505 - DNA, 21 bp, Homo sapiens
aatgagtaaataaactcttca

SEQ ID NO: 375506 - DNA, 23 bp, Homo sapiens
aatgagtaaataaactcttcaag

SEQ ID NO: 375507 - DNA, 20 bp, Homo sapiens
aatgagtaatgcagacattt

SEQ ID NO: 375508 - DNA, 18 bp, Homo sapiens
aatgagtttaaaaaaata

SEQ ID NO: 375509 - DNA, 19 bp, Homo sapiens
aatgagtttaaaaaaataa

SEQ ID NO: 375510 - DNA, 21 bp, Homo sapiens
aatgagtttaaaaaaataaca

SEQ ID NO: 375511 - DNA, 22 bp, Homo sapiens
aatgagtttaaaaaaataacat

SEQ ID NO: 375512 - DNA, 15 bp, Homo sapiens
aatgatactgtctaa

SEQ ID NO: 375513 - DNA, 18 bp, Homo sapiens
aatgatactgtctaagaa

SEQ ID NO: 375514 - DNA, 19 bp, Homo sapiens
agatgagattggcatggct

SEQ ID NO: 375515 - DNA, 18 bp, Homo sapiens
agatgagatttgccagca

SEQ ID NO: 375516 - DNA, 16 bp, Homo sapiens
agatgagcaaggacat

SEQ ID NO: 375517 - DNA, 17 bp, Homo sapiens
agatgagcaaggacatt

SEQ ID NO: 375518 - DNA, 21 bp, Homo sapiens
agatgagccccacgtggagct

SEQ ID NO: 375519 - DNA, 20 bp, Homo sapiens
agatgataaaaggaatctgg

SEQ ID NO: 375520 - DNA, 21 bp, Homo sapiens
agatgatcgtgcctataaata

SEQ ID NO: 375521 - DNA, 21 bp, Homo sapiens
agatgatgtgatggaacacac

SEQ ID NO: 375522 - DNA, 21 bp, Homo sapiens
agatgatttctagcaggcagg

SEQ ID NO: 375523 - DNA, 15 bp, Homo sapiens
agatgcaaggaccag

SEQ ID NO: 375524 - DNA, 17 bp, Homo sapiens
agatgcaaggaccagga

SEQ ID NO: 375525 - DNA, 22 bp, Homo sapiens
agatgcaccaagtacagccttc

SEQ ID NO: 375526 - DNA, 21 bp, Homo sapiens
agatgcatgatccagctgtgt

SEQ ID NO: 375527 - DNA, 11 bp, Homo sapiens
agatgccaaaa

SEQ ID NO: 375528 - DNA, 14 bp, Homo sapiens
agatgccaaggagg

SEQ ID NO: 375529 - DNA, 20 bp, Homo sapiens
agatgccaaggaggtcccag

SEQ ID NO: 375530 - DNA, 12 bp, Homo sapiens
agatgccagagc

SEQ ID NO: 375531 - DNA, 21 bp, Homo sapiens
agatgccagagcaaagggcca

SEQ ID NO: 375532 - DNA, 17 bp, Homo sapiens
agatgccatggcctgtg

SEQ ID NO: 375533 - DNA, 16 bp, Homo sapiens
agatgccgcatttgga

SEQ ID NO: 375534 - DNA, 21 bp, Homo sapiens
agatgcctccctgaccctgca

SEQ ID NO: 375535 - DNA, 22 bp, Homo sapiens
agatgcctccctgaccctgcag

SEQ ID NO: 375536 - DNA, 14 bp, Homo sapiens
agatgcgcaaagag

SEQ ID NO: 375537 - DNA, 15 bp, Homo sapiens
agatgctaataaact

SEQ ID NO: 375538 - DNA, 11 bp, Homo sapiens
agatgctactg

SEQ ID NO: 375539 - DNA, 15 bp, Homo sapiens
agatgctactgtcag

SEQ ID NO: 375540 - DNA, 22 bp, Homo sapiens
agatgctgaaacaggagagaaa

SEQ ID NO: 375541 - DNA, 20 bp, Homo sapiens
agatgctgaatatctgttca

SEQ ID NO: 375542 - DNA, 13 bp, Homo sapiens
agatgctgcctag

SEQ ID NO: 375543 - DNA, 23 bp, Homo sapiens
agatgctgctcccgcctgattgg

SEQ ID NO: 375544 - DNA, 15 bp, Homo sapiens
agatgctggccccaa

SEQ ID NO: 375545 - DNA, 18 bp, Homo sapiens
agatggaaaaaaaaaaca

SEQ ID NO: 375546 - DNA, 22 bp, Homo sapiens
agatggaagttgcagtgagctg

SEQ ID NO: 375547 - DNA, 12 bp, Homo sapiens
agatggagaaaa

SEQ ID NO: 375548 - DNA, 16 bp, Homo sapiens
agatggaggaggaggc

SEQ ID NO: 375549 - DNA, 14 bp, Homo sapiens
agatggatgaatta

SEQ ID NO: 375550 - DNA, 11 bp, Homo sapiens
agatggattct

SEQ ID NO: 375551 - DNA, 18 bp, Homo sapiens
agatggattctcagatat

SEQ ID NO: 375552 - DNA, 23 bp, Homo sapiens
agatggcacctgtggccagagca

SEQ ID NO: 375553 - DNA, 14 bp, Homo sapiens
agatggccatgctc

SEQ ID NO: 375554 - DNA, 15 bp, Homo sapiens
agatggccatgctca

SEQ ID NO: 375555 - DNA, 15 bp, Homo sapiens
agatggcgcacccgg

SEQ ID NO: 375556 - DNA, 19 bp, Homo sapiens
agatggcgcacccggcagc

SEQ ID NO: 375557 - DNA, 21 bp, Homo sapiens
agatggcgcacccggcagccc

SEQ ID NO: 375558 - DNA, 14 bp, Homo sapiens
agatggctgtgaaa

SEQ ID NO: 375559 - DNA, 17 bp, Homo sapiens
agatggctgtgaaaatt

SEQ ID NO: 375560 - DNA, 17 bp, Homo sapiens
agatggctgtgcctctg

SEQ ID NO: 375561 - DNA, 19 bp, Homo sapiens
agatgggaagggcttatct

SEQ ID NO: 375562 - DNA, 19 bp, Homo sapiens
agatgggcaaggcctttgg

SEQ ID NO: 375563 - DNA, 18 bp, Homo sapiens
agatgggcagtaaacagg

SEQ ID NO: 375564 - DNA, 19 bp, Homo sapiens
agatgggcttgttttcttg

SEQ ID NO: 375565 - DNA, 14 bp, Homo sapiens
agatggtcagtgtg

SEQ ID NO: 375566 - DNA, 23 bp, Homo sapiens
agatggtcagtgtggagaggggt

SEQ ID NO: 375567 - DNA, 15 bp, Homo sapiens
agatggtgccccctg

SEQ ID NO: 375568 - DNA, 14 bp, Homo sapiens
agatggtgctgaga

SEQ ID NO: 375569 - DNA, 17 bp, Homo sapiens
agatggtgctgagaagc

SEQ ID NO: 375570 - DNA, 23 bp, Homo sapiens
agatgtaagaagcccgatccaca

SEQ ID NO: 375571 - DNA, 14 bp, Homo sapiens
agatgtaccatgtt

SEQ ID NO: 375572 - DNA, 22 bp, Homo sapiens
agatgtactgagaggaggggta

SEQ ID NO: 375573 - DNA, 17 bp, Homo sapiens
agatgtattcagagcca

SEQ ID NO: 375574 - DNA, 15 bp, Homo sapiens
agatgtattttcaat

SEQ ID NO: 375575 - DNA, 20 bp, Homo sapiens
agatgtcagccgagccgggc

SEQ ID NO: 375576 - DNA, 22 bp, Homo sapiens
agatgtcccccaggggcccagg

SEQ ID NO: 375577 - DNA, 15 bp, Homo sapiens
agatgtccctgaagt

SEQ ID NO: 375578 - DNA, 18 bp, Homo sapiens
agatgtccctgaagtctt

SEQ ID NO: 375579 - DNA, 22 bp, Homo sapiens
agatgtctctggcgtgtgggta

SEQ ID NO: 375580 - DNA, 13 bp, Homo sapiens
agatgtcttcgta

SEQ ID NO: 375581 - DNA, 15 bp, Homo sapiens
agatgtcttcgtaca

SEQ ID NO: 375582 - DNA, 22 bp, Homo sapiens
agatgtgaaaaagcctaagaaa

SEQ ID NO: 375583 - DNA, 21 bp, Homo sapiens
agatgtgacccaccagtgcct

SEQ ID NO: 375584 - DNA, 16 bp, Homo sapiens
agatgtgcaaatgcaa

SEQ ID NO: 375585 - DNA, 19 bp, Homo sapiens
agatgtgcatttcacctgt

SEQ ID NO: 375586 - DNA, 23 bp, Homo sapiens
agatgtgcatttcacctgtgaca

SEQ ID NO: 375587 - DNA, 14 bp, Homo sapiens
agatgtgcccagag

SEQ ID NO: 375588 - DNA, 15 bp, Homo sapiens
agatgtgcccagagt

SEQ ID NO: 375589 - DNA, 23 bp, Homo sapiens
agatgtgcccagagtagcccagg

SEQ ID NO: 375590 - DNA, 22 bp, Homo sapiens
agatgtgtccatgtgaaattta

SEQ ID NO: 375591 - DNA, 19 bp, Homo sapiens
agatgtgttgctatcctga

SEQ ID NO: 375592 - DNA, 18 bp, Homo sapiens
agatgtttaacaaatcta

SEQ ID NO: 375593 - DNA, 14 bp, Homo sapiens
agatgtttgttttc

SEQ ID NO: 375594 - DNA, 23 bp, Homo sapiens
agatgtttgttttcaaaatactt

SEQ ID NO: 375595 - DNA, 13 bp, Homo sapiens
agatgtttttaaa

SEQ ID NO: 375596 - DNA, 16 bp, Homo sapiens
agatgtttttaaaagt

SEQ ID NO: 375597 - DNA, 18 bp, Homo sapiens
agatgtttttaaaagttt

SEQ ID NO: 375598 - DNA, 20 bp, Homo sapiens
agattaaaattagtgagatt

SEQ ID NO: 375599 - DNA, 13 bp, Homo sapiens
agattaatttgtg

SEQ ID NO: 375600 - DNA, 19 bp, Homo sapiens
agattacaggattaatata

SEQ ID NO: 375601 - DNA, 15 bp, Homo sapiens
agattaggacacagt

SEQ ID NO: 375602 - DNA, 21 bp, Homo sapiens
agattatgtattggcatttat

SEQ ID NO: 375603 - DNA, 22 bp, Homo sapiens
agattatgtattggcatttatt

SEQ ID NO: 375604 - DNA, 17 bp, Homo sapiens
agattcaattttcttta

SEQ ID NO: 375605 - DNA, 15 bp, Homo sapiens
agattcacctgtaaa

SEQ ID NO: 375606 - DNA, 21 bp, Homo sapiens
agattcactgtcttttgattc

SEQ ID NO: 375607 - DNA, 16 bp, Homo sapiens
agattcatatttactt

SEQ ID NO: 375608 - DNA, 18 bp, Homo sapiens
agattccagagagtggct

SEQ ID NO: 375609 - DNA, 19 bp, Homo sapiens
aattacattttatatgtga

SEQ ID NO: 375610 - DNA, 21 bp, Homo sapiens
aattaccttgagccagtaatt

SEQ ID NO: 375611 - DNA, 24 bp, Homo sapiens
aattactaaattgtatacattttg

SEQ ID NO: 375612 - DNA, 22 bp, Homo sapiens
aattactggagccatgtctaca

SEQ ID NO: 375613 - DNA, 19 bp, Homo sapiens
aattagagatatttttata

SEQ ID NO: 375614 - DNA, 12 bp, Homo sapiens
aattagagcaga

SEQ ID NO: 375615 - DNA, 17 bp, Homo sapiens
aattaggaagtgattat

SEQ ID NO: 375616 - DNA, 16 bp, Homo sapiens
aattaggccttatgta

SEQ ID NO: 375617 - DNA, 20 bp, Homo sapiens
aattagggctacattgtaat

SEQ ID NO: 375618 - DNA, 21 bp, Homo sapiens
aattagggctacattgtaatc

SEQ ID NO: 375619 - DNA, 16 bp, Homo sapiens
aattaggtctgcattt

SEQ ID NO: 375620 - DNA, 16 bp, Homo sapiens
aattagtgagatttgt

SEQ ID NO: 375621 - DNA, 18 bp, Homo sapiens
aattagtggcacttgctt

SEQ ID NO: 375622 - DNA, 16 bp, Homo sapiens
aattataaggactgca

SEQ ID NO: 375623 - DNA, 17 bp, Homo sapiens
aattataaggactgcat

SEQ ID NO: 375624 - DNA, 21 bp, Homo sapiens
aattatataggttgtgcaaat

SEQ ID NO: 375625 - DNA, 15 bp, Homo sapiens
aattatatgatatgc

SEQ ID NO: 375626 - DNA, 16 bp, Homo sapiens
aattatcaagctaata

SEQ ID NO: 375627 - DNA, 19 bp, Homo sapiens
aattatcaagctaataaaa

SEQ ID NO: 375628 - DNA, 21 bp, Homo sapiens
aattatcggaagcagtgcctt

SEQ ID NO: 375629 - DNA, 17 bp, Homo sapiens
aattatcgggaacagtg

SEQ ID NO: 375630 - DNA, 16 bp, Homo sapiens
aattatctttaaaact

SEQ ID NO: 375631 - DNA, 21 bp, Homo sapiens
aattatgggaacaagtgtaca

SEQ ID NO: 375632 - DNA, 15 bp, Homo sapiens
aattatggtgaaatt

SEQ ID NO: 375633 - DNA, 15 bp, Homo sapiens
aattatgtaatgcaa

SEQ ID NO: 375634 - DNA, 16 bp, Homo sapiens
aattatgtgacaacct

SEQ ID NO: 375635 - DNA, 19 bp, Homo sapiens
aattatgtgacaacctttg

SEQ ID NO: 375636 - DNA, 20 bp, Homo sapiens
aattatgtgacaacctttgt

SEQ ID NO: 375637 - DNA, 14 bp, Homo sapiens
aattatgttattga

SEQ ID NO: 375638 - DNA, 19 bp, Homo sapiens
aattatgttattgaaaaaa

SEQ ID NO: 375639 - DNA, 13 bp, Homo sapiens
aattattaaaaat

SEQ ID NO: 375640 - DNA, 15 bp, Homo sapiens
aattattaaaaatta

SEQ ID NO: 375641 - DNA, 17 bp, Homo sapiens
aattattaaaaattata

SEQ ID NO: 375642 - DNA, 18 bp, Homo sapiens
aattattaaaaattatag

SEQ ID NO: 375643 - DNA, 15 bp, Homo sapiens
aattattacatcttt

SEQ ID NO: 375644 - DNA, 15 bp, Homo sapiens
aattattactttaaa

SEQ ID NO: 375645 - DNA, 18 bp, Homo sapiens
aattattactttaaatta

SEQ ID NO: 375646 - DNA, 18 bp, Homo sapiens
aattattataagcattga

SEQ ID NO: 375647 - DNA, 21 bp, Homo sapiens
aattattattcttcataacaa

SEQ ID NO: 375648 - DNA, 11 bp, Homo sapiens
aattattattt

SEQ ID NO: 375649 - DNA, 16 bp, Homo sapiens
aattattatttatata

SEQ ID NO: 375650 - DNA, 13 bp, Homo sapiens
aattattcagtta

SEQ ID NO: 375651 - DNA, 20 bp, Homo sapiens
aattattcagttaagaaaaa

SEQ ID NO: 375652 - DNA, 14 bp, Homo sapiens
aattattctagtca

SEQ ID NO: 375653 - DNA, 22 bp, Homo sapiens
aattattctagtcaactgctgt

SEQ ID NO: 375654 - DNA, 18 bp, Homo sapiens
aattatttgccttttaaa

SEQ ID NO: 375655 - DNA, 18 bp, Homo sapiens
aattatttgtgtaataga

SEQ ID NO: 375656 - DNA, 19 bp, Homo sapiens
aattatttgtgtaatagaa

SEQ ID NO: 375657 - DNA, 14 bp, Homo sapiens
aattattttaaaca

SEQ ID NO: 375658 - DNA, 17 bp, Homo sapiens
aattatttttaatatgt

SEQ ID NO: 375659 - DNA, 16 bp, Homo sapiens
agcactcgagaccatc

SEQ ID NO: 375660 - DNA, 14 bp, Homo sapiens
agcactctgctggc

SEQ ID NO: 375661 - DNA, 13 bp, Homo sapiens
agcactgatttca

SEQ ID NO: 375662 - DNA, 17 bp, Homo sapiens
agcactgatttcacaac

SEQ ID NO: 375663 - DNA, 17 bp, Homo sapiens
agcactggagtgcaggg

SEQ ID NO: 375664 - DNA, 20 bp, Homo sapiens
agcactggagtgcagggagg

SEQ ID NO: 375665 - DNA, 22 bp, Homo sapiens
agcactggagtgcagggaggag

SEQ ID NO: 375666 - DNA, 13 bp, Homo sapiens
agcactggccaga

SEQ ID NO: 375667 - DNA, 15 bp, Homo sapiens
agcactggccagaga

SEQ ID NO: 375668 - DNA, 17 bp, Homo sapiens
agcactggccagagagg

SEQ ID NO: 375669 - DNA, 14 bp, Homo sapiens
agcactggctctct

SEQ ID NO: 375670 - DNA, 20 bp, Homo sapiens
agcactggctctctccagga

SEQ ID NO: 375671 - DNA, 18 bp, Homo sapiens
agcactgtgtaaccagca

SEQ ID NO: 375672 - DNA, 14 bp, Homo sapiens
agcactgtgtttat

SEQ ID NO: 375673 - DNA, 14 bp, Homo sapiens
agcacttgcgtcct

SEQ ID NO: 375674 - DNA, 18 bp, Homo sapiens
agcacttgcgtcctgcag

SEQ ID NO: 375675 - DNA, 13 bp, Homo sapiens
agcacttggactc

SEQ ID NO: 375676 - DNA, 18 bp, Homo sapiens
agcacttggactcttgct

SEQ ID NO: 375677 - DNA, 20 bp, Homo sapiens
agcacttggactcttgctct

SEQ ID NO: 375678 - DNA, 21 bp, Homo sapiens
agcacttggactcttgctctt

SEQ ID NO: 375679 - DNA, 19 bp, Homo sapiens
agcactttgaaaatatttc

SEQ ID NO: 375680 - DNA, 20 bp, Homo sapiens
agcactttgaaaatatttct

SEQ ID NO: 375681 - DNA, 23 bp, Homo sapiens
agcactttgaaaatatttctatg

SEQ ID NO: 375682 - DNA, 14 bp, Homo sapiens
agcactttgggagg

SEQ ID NO: 375683 - DNA, 17 bp, Homo sapiens
agcagaaaaatgaaaga

SEQ ID NO: 375684 - DNA, 18 bp, Homo sapiens
agcagaaacccccaggag

SEQ ID NO: 375685 - DNA, 21 bp, Homo sapiens
agcagaatctttgcaagaaag

SEQ ID NO: 375686 - DNA, 14 bp, Homo sapiens
agcagacactccag

SEQ ID NO: 375687 - DNA, 16 bp, Homo sapiens
agcagagacggcagcc

SEQ ID NO: 375688 - DNA, 21 bp, Homo sapiens
agcagagacggcagccccatc

SEQ ID NO: 375689 - DNA, 16 bp, Homo sapiens
agcagagccgttcctg

SEQ ID NO: 375690 - DNA, 19 bp, Homo sapiens
agcagaggctggcctcaga

SEQ ID NO: 375691 - DNA, 18 bp, Homo sapiens
agcagagggactttgtat

SEQ ID NO: 375692 - DNA, 18 bp, Homo sapiens
agcagaggtggaaaatga

SEQ ID NO: 375693 - DNA, 15 bp, Homo sapiens
agcagagtctgggcc

SEQ ID NO: 375694 - DNA, 21 bp, Homo sapiens
agcagagtctgggcctctgac

SEQ ID NO: 375695 - DNA, 20 bp, Homo sapiens
agcagatacatatgagtgtg

SEQ ID NO: 375696 - DNA, 15 bp, Homo sapiens
agcagatatgtatta

SEQ ID NO: 375697 - DNA, 17 bp, Homo sapiens
agcagatggaaagaaag

SEQ ID NO: 375698 - DNA, 21 bp, Homo sapiens
agcagatggaatgctgtgtta

SEQ ID NO: 375699 - DNA, 22 bp, Homo sapiens
agcagattttaattttgaataa

SEQ ID NO: 375700 - DNA, 18 bp, Homo sapiens
agcagcacaaagaaacag

SEQ ID NO: 375701 - DNA, 12 bp, Homo sapiens
agcagcacaatt

SEQ ID NO: 375702 - DNA, 14 bp, Homo sapiens
agcagcacaattct

SEQ ID NO: 375703 - DNA, 23 bp, Homo sapiens
agcagcagccgctgccaggggct

SEQ ID NO: 375704 - DNA, 12 bp, Homo sapiens
agcagccagcca

SEQ ID NO: 375705 - DNA, 14 bp, Homo sapiens
agcagccagccagt

SEQ ID NO: 375706 - DNA, 15 bp, Homo sapiens
agcagccagccgtga

SEQ ID NO: 375707 - DNA, 17 bp, Homo sapiens
agcagcccagcttcctg

SEQ ID NO: 375708 - DNA, 14 bp, Homo sapiens
agcagcctccaaga

SEQ ID NO: 375709 - DNA, 16 bp, Homo sapiens
agcagcctccaagaaa

SEQ ID NO: 375710 - DNA, 19 bp, Homo sapiens
agcagcctccactgtgtcc

SEQ ID NO: 375711 - DNA, 21 bp, Homo sapiens
agcagcctccactgtgtccag

SEQ ID NO: 375712 - DNA, 16 bp, Homo sapiens
agcagcctccctgtca

SEQ ID NO: 375713 - DNA, 17 bp, Homo sapiens
agcagcctctgccaggc

SEQ ID NO: 375714 - DNA, 20 bp, Homo sapiens
agcagcctctgccaggcctg

SEQ ID NO: 375715 - DNA, 20 bp, Homo sapiens
agcagcctgatggccaaggg

SEQ ID NO: 375716 - DNA, 16 bp, Homo sapiens
agcagcctgcttccca

SEQ ID NO: 375717 - DNA, 22 bp, Homo sapiens
agcagcctgcttcccacctccc

SEQ ID NO: 375718 - DNA, 14 bp, Homo sapiens
agcagcctgtggca

SEQ ID NO: 375719 - DNA, 17 bp, Homo sapiens
agcagcggtttggggag

SEQ ID NO: 375720 - DNA, 23 bp, Homo sapiens
agcagcggtttggggagcagaga

SEQ ID NO: 375721 - DNA, 14 bp, Homo sapiens
agcagctagagctc

SEQ ID NO: 375722 - DNA, 14 bp, Homo sapiens
agcagctagcaagg

SEQ ID NO: 375723 - DNA, 19 bp, Homo sapiens
agcagctcaggcgcagccc

SEQ ID NO: 375724 - DNA, 22 bp, Homo sapiens
agcagctcaggcgcagccctag

SEQ ID NO: 375725 - DNA, 15 bp, Homo sapiens
agcagctccccagga

SEQ ID NO: 375726 - DNA, 19 bp, Homo sapiens
agcagctccccaggagctc

SEQ ID NO: 375727 - DNA, 16 bp, Homo sapiens
agcagctgcgggtctg

SEQ ID NO: 375728 - DNA, 15 bp, Homo sapiens
agcagcttcaccaga

SEQ ID NO: 375729 - DNA, 17 bp, Homo sapiens
agcagcttcagttgttt

SEQ ID NO: 375730 - DNA, 16 bp, Homo sapiens
agcagcttccagattg

SEQ ID NO: 375731 - DNA, 17 bp, Homo sapiens
agcagcttgctgcaccc

SEQ ID NO: 375732 - DNA, 16 bp, Homo sapiens
agcagcttggctgagc

SEQ ID NO: 375733 - DNA, 16 bp, Homo sapiens
agcaggaagcaaggcc

SEQ ID NO: 375734 - DNA, 20 bp, Homo sapiens
agcaggaagcaaggccagcc

SEQ ID NO: 375735 - DNA, 14 bp, Homo sapiens
agcaggaaggcctg

SEQ ID NO: 375736 - DNA, 16 bp, Homo sapiens
agcaggaaggcctggg

SEQ ID NO: 375737 - DNA, 20 bp, Homo sapiens
agcaggcaccagcagcagaa

SEQ ID NO: 375738 - DNA, 11 bp, Homo sapiens
agcaggcagga

SEQ ID NO: 375739 - DNA, 19 bp, Homo sapiens
aattttaaaagcatatata

SEQ ID NO: 375740 - DNA, 22 bp, Homo sapiens
aattttaaaagcatatataaaa

SEQ ID NO: 375741 - DNA, 14 bp, Homo sapiens
aattttaaaatgta

SEQ ID NO: 375742 - DNA, 19 bp, Homo sapiens
aattttaaaatgtagaaga

SEQ ID NO: 375743 - DNA, 21 bp, Homo sapiens
aattttaaaatgtagaagaaa

SEQ ID NO: 375744 - DNA, 15 bp, Homo sapiens
aattttaaaattgca

SEQ ID NO: 375745 - DNA, 17 bp, Homo sapiens
aattttaaaattgcagc

SEQ ID NO: 375746 - DNA, 22 bp, Homo sapiens
aattttaaataaaagtgatcaa

SEQ ID NO: 375747 - DNA, 19 bp, Homo sapiens
aattttaagtgctttgtaa

SEQ ID NO: 375748 - DNA, 17 bp, Homo sapiens
aattttagtccaaataa

SEQ ID NO: 375749 - DNA, 21 bp, Homo sapiens
aattttataaggctgactctt

SEQ ID NO: 375750 - DNA, 22 bp, Homo sapiens
aattttatgaactgcatgtata

SEQ ID NO: 375751 - DNA, 13 bp, Homo sapiens
aattttattgctg

SEQ ID NO: 375752 - DNA, 15 bp, Homo sapiens
aattttcactgctgc

SEQ ID NO: 375753 - DNA, 12 bp, Homo sapiens
aattttctaaaa

SEQ ID NO: 375754 - DNA, 15 bp, Homo sapiens
aattttctagacttt

SEQ ID NO: 375755 - DNA, 13 bp, Homo sapiens
aattttcttcatg

SEQ ID NO: 375756 - DNA, 19 bp, Homo sapiens
aattttcttcatgcaatga

SEQ ID NO: 375757 - DNA, 21 bp, Homo sapiens
aattttgaggtcttttacata

SEQ ID NO: 375758 - DNA, 14 bp, Homo sapiens
aattttgtacaaat

SEQ ID NO: 375759 - DNA, 17 bp, Homo sapiens
aattttgtcacagctct

SEQ ID NO: 375760 - DNA, 20 bp, Homo sapiens
aatttttaaatgtaaaacat

SEQ ID NO: 375761 - DNA, 18 bp, Homo sapiens
aattttttagttaaaatc

SEQ ID NO: 375762 - DNA, 18 bp, Homo sapiens
aatttttttatgttttgt

SEQ ID NO: 375763 - DNA, 15 bp, Homo sapiens
aatttttttattact

SEQ ID NO: 375764 - DNA, 17 bp, Homo sapiens
aatttttttattactga

SEQ ID NO: 375765 - DNA, 15 bp, Homo sapiens
aatttttttcaatat

SEQ ID NO: 375766 - DNA, 14 bp, Homo sapiens
aatttttttctagt

SEQ ID NO: 375767 - DNA, 15 bp, Homo sapiens
aattttttttaacat

SEQ ID NO: 375768 - DNA, 19 bp, Homo sapiens
aattttttttaacattcct

SEQ ID NO: 375769 - DNA, 15 bp, Homo sapiens
aattttttttaatgt

SEQ ID NO: 375770 - DNA, 17 bp, Homo sapiens
aattttttttaatgtac

SEQ ID NO: 375771 - DNA, 13 bp, Homo sapiens
acaaaaaacaata

SEQ ID NO: 375772 - DNA, 12 bp, Homo sapiens
acaaaaaatact

SEQ ID NO: 375773 - DNA, 14 bp, Homo sapiens
acaaaaagcacaag

SEQ ID NO: 375774 - DNA, 20 bp, Homo sapiens
acaaaaaggagcgggcaggg

SEQ ID NO: 375775 - DNA, 14 bp, Homo sapiens
acaaaaaggtgcta

SEQ ID NO: 375776 - DNA, 20 bp, Homo sapiens
acaaaaaggttctcaggtgt

SEQ ID NO: 375777 - DNA, 19 bp, Homo sapiens
acaaaaatgaactgaagtt

SEQ ID NO: 375778 - DNA, 15 bp, Homo sapiens
acaaaaattgactca

SEQ ID NO: 375779 - DNA, 21 bp, Homo sapiens
acaaaacaacagcaacaacaa

SEQ ID NO: 375780 - DNA, 16 bp, Homo sapiens
acaaaacaagaaagaa

SEQ ID NO: 375781 - DNA, 16 bp, Homo sapiens
acaaaacctaacttgc

SEQ ID NO: 375782 - DNA, 21 bp, Homo sapiens
acaaaacctaacttgcgcaga

SEQ ID NO: 375783 - DNA, 23 bp, Homo sapiens
acaaaacttaaaagtattcatac

SEQ ID NO: 375784 - DNA, 13 bp, Homo sapiens
acaaaacttcctg

SEQ ID NO: 375785 - DNA, 13 bp, Homo sapiens
acaaaagatgaaa

SEQ ID NO: 375786 - DNA, 12 bp, Homo sapiens
acaaaaggcttt

SEQ ID NO: 375787 - DNA, 16 bp, Homo sapiens
acaaaagggagaacat

SEQ ID NO: 375788 - DNA, 21 bp, Homo sapiens
acaaaagtctcaatgttccat

SEQ ID NO: 375789 - DNA, 12 bp, Homo sapiens
acaaaatagaag

SEQ ID NO: 375790 - DNA, 15 bp, Homo sapiens
acaaaatatttctaa

SEQ ID NO: 375791 - DNA, 20 bp, Homo sapiens
acaaaatccttgccttcaaa

SEQ ID NO: 375792 - DNA, 14 bp, Homo sapiens
acaaaatctgaact

SEQ ID NO: 375793 - DNA, 23 bp, Homo sapiens
acaaaatctgaactctcaaaagt

SEQ ID NO: 375794 - DNA, 13 bp, Homo sapiens
acaaaatgaaacg

SEQ ID NO: 375795 - DNA, 11 bp, Homo sapiens
acaaaatgaat

SEQ ID NO: 375796 - DNA, 15 bp, Homo sapiens
acaaaatgataatca

SEQ ID NO: 375797 - DNA, 22 bp, Homo sapiens
acaaaatgtgtgcttggaaaat

SEQ ID NO: 375798 - DNA, 14 bp, Homo sapiens
acaaacacctccta

SEQ ID NO: 375799 - DNA, 13 bp, Homo sapiens
acaaacagtgaat

SEQ ID NO: 375800 - DNA, 17 bp, Homo sapiens
acaaacctctatatgtt

SEQ ID NO: 375801 - DNA, 21 bp, Homo sapiens
acaaacctgtttctgcagcca

SEQ ID NO: 375802 - DNA, 18 bp, Homo sapiens
acaaacgtaatttgttat

SEQ ID NO: 375803 - DNA, 18 bp, Homo sapiens
acaaactccttaatatga

SEQ ID NO: 375804 - DNA, 17 bp, Homo sapiens
acaaactgaaaaatcta

SEQ ID NO: 375805 - DNA, 10 bp, Homo sapiens
acaaactgca

SEQ ID NO: 375806 - DNA, 16 bp, Homo sapiens
agccacgtgctggaga

SEQ ID NO: 375807 - DNA, 18 bp, Homo sapiens
agccacgtgctggagagt

SEQ ID NO: 375808 - DNA, 19 bp, Homo sapiens
agccacgtgctggagagta

SEQ ID NO: 375809 - DNA, 20 bp, Homo sapiens
agccacgttggtggtattgg

SEQ ID NO: 375810 - DNA, 22 bp, Homo sapiens
agccactcccgccacacgctca

SEQ ID NO: 375811 - DNA, 14 bp, Homo sapiens
agccactcctgtcc

SEQ ID NO: 375812 - DNA, 23 bp, Homo sapiens
agccactcctgtcccgccttcct

SEQ ID NO: 375813 - DNA, 11 bp, Homo sapiens
agccactggca

SEQ ID NO: 375814 - DNA, 13 bp, Homo sapiens
agccactggcata

SEQ ID NO: 375815 - DNA, 18 bp, Homo sapiens
agccactgtgctgaattc

SEQ ID NO: 375816 - DNA, 15 bp, Homo sapiens
agccacttctcccca

SEQ ID NO: 375817 - DNA, 16 bp, Homo sapiens
agccagaaccccgagc

SEQ ID NO: 375818 - DNA, 12 bp, Homo sapiens
agccagaattca

SEQ ID NO: 375819 - DNA, 21 bp, Homo sapiens
agccagacagcaacggggagg

SEQ ID NO: 375820 - DNA, 12 bp, Homo sapiens
agccagagagga

SEQ ID NO: 375821 - DNA, 17 bp, Homo sapiens
agccagagcccttcact

SEQ ID NO: 375822 - DNA, 12 bp, Homo sapiens
agccagagctgg

SEQ ID NO: 375823 - DNA, 16 bp, Homo sapiens
agccagagctgggtgg

SEQ ID NO: 375824 - DNA, 14 bp, Homo sapiens
agccagatgacagg

SEQ ID NO: 375825 - DNA, 18 bp, Homo sapiens
agccagcacctgtaagaa

SEQ ID NO: 375826 - DNA, 13 bp, Homo sapiens
agccagcagggcg

SEQ ID NO: 375827 - DNA, 22 bp, Homo sapiens
agccagcagggcgggccaggag

SEQ ID NO: 375828 - DNA, 14 bp, Homo sapiens
agccagcagggctg

SEQ ID NO: 375829 - DNA, 13 bp, Homo sapiens
agccagccaccct

SEQ ID NO: 375830 - DNA, 16 bp, Homo sapiens
agccagcccagctcca

SEQ ID NO: 375831 - DNA, 15 bp, Homo sapiens
agccagcccttccca

SEQ ID NO: 375832 - DNA, 16 bp, Homo sapiens
agccagcctgggactc

SEQ ID NO: 375833 - DNA, 16 bp, Homo sapiens
agccagctctgcatta

SEQ ID NO: 375834 - DNA, 13 bp, Homo sapiens
agccagctctggg

SEQ ID NO: 375835 - DNA, 19 bp, Homo sapiens
agccagctgcagctgggct

SEQ ID NO: 375836 - DNA, 12 bp, Homo sapiens
agccagcttggt

SEQ ID NO: 375837 - DNA, 22 bp, Homo sapiens
agccaggacaccgggcagggcc

SEQ ID NO: 375838 - DNA, 18 bp, Homo sapiens
agccaggagaccctgtct

SEQ ID NO: 375839 - DNA, 16 bp, Homo sapiens
agccaggagcctcctg

SEQ ID NO: 375840 - DNA, 20 bp, Homo sapiens
agccaggagcctcctgaccc

SEQ ID NO: 375841 - DNA, 13 bp, Homo sapiens
agccaggcctccc

SEQ ID NO: 375842 - DNA, 20 bp, Homo sapiens
agccaggctgccaaggccag

SEQ ID NO: 375843 - DNA, 15 bp, Homo sapiens
agccagggagcccgg

SEQ ID NO: 375844 - DNA, 21 bp, Homo sapiens
agccagggatggggccacagc

SEQ ID NO: 375845 - DNA, 13 bp, Homo sapiens
agccagggttcca

SEQ ID NO: 375846 - DNA, 15 bp, Homo sapiens
agccagggttccaga

SEQ ID NO: 375847 - DNA, 18 bp, Homo sapiens
agccagggttccagacag

SEQ ID NO: 375848 - DNA, 14 bp, Homo sapiens
agccaggtgtcctg

SEQ ID NO: 375849 - DNA, 15 bp, Homo sapiens
agccagtcattgtaa

SEQ ID NO: 375850 - DNA, 23 bp, Homo sapiens
agccagtcattgtaacctcgtgt

SEQ ID NO: 375851 - DNA, 17 bp, Homo sapiens
agccagtcttgcctagg

SEQ ID NO: 375852 - DNA, 19 bp, Homo sapiens
agccagtgactccaggaga

SEQ ID NO: 375853 - DNA, 21 bp, Homo sapiens
agccagtgactccaggagagg

SEQ ID NO: 375854 - DNA, 18 bp, Homo sapiens
agccatagcttgattgct

SEQ ID NO: 375855 - DNA, 16 bp, Homo sapiens
agccatatcaccagtc

SEQ ID NO: 375856 - DNA, 22 bp, Homo sapiens
agccatatgacaatttcaaaat

SEQ ID NO: 375857 - DNA, 23 bp, Homo sapiens
agccatatgacaatttcaaaatg

SEQ ID NO: 375858 - DNA, 12 bp, Homo sapiens
agccatattcca

SEQ ID NO: 375859 - DNA, 19 bp, Homo sapiens
agccatattccagcagtga

SEQ ID NO: 375860 - DNA, 20 bp, Homo sapiens
agccatcaattttaacattt

SEQ ID NO: 375861 - DNA, 22 bp, Homo sapiens
agccatcggtgaaactaacaga

SEQ ID NO: 375862 - DNA, 14 bp, Homo sapiens
agccatcttcccgc

SEQ ID NO: 375863 - DNA, 14 bp, Homo sapiens
agccatgcctcatg

SEQ ID NO: 375864 - DNA, 14 bp, Homo sapiens
agccatggctcagg

SEQ ID NO: 375865 - DNA, 13 bp, Homo sapiens
agccatggctggc

SEQ ID NO: 375866 - DNA, 19 bp, Homo sapiens
agccatgggccctctgagc

SEQ ID NO: 375867 - DNA, 14 bp, Homo sapiens
agccatgggcctgg

SEQ ID NO: 375868 - DNA, 22 bp, Homo sapiens
agccatgtaccagtgtactgct

SEQ ID NO: 375869 - DNA, 23 bp, Homo sapiens
agccatgtaccagtgtactgctt

SEQ ID NO: 375870 - DNA, 19 bp, Homo sapiens
agcctcatgggagtcaggg

SEQ ID NO: 375871 - DNA, 22 bp, Homo sapiens
agcctcattcactgtcctggct

SEQ ID NO: 375872 - DNA, 13 bp, Homo sapiens
agcctccagagcc

SEQ ID NO: 375873 - DNA, 22 bp, Homo sapiens
agcctccagagccagcctggga

SEQ ID NO: 375874 - DNA, 15 bp, Homo sapiens
agcctccatttagtt

SEQ ID NO: 375875 - DNA, 13 bp, Homo sapiens
agcctcccacccc

SEQ ID NO: 375876 - DNA, 13 bp, Homo sapiens
agcctcccccagg

SEQ ID NO: 375877 - DNA, 12 bp, Homo sapiens
agcctccctgaa

SEQ ID NO: 375878 - DNA, 18 bp, Homo sapiens
agcctccgtttatgggcc

SEQ ID NO: 375879 - DNA, 13 bp, Homo sapiens
agcctcctcctga

SEQ ID NO: 375880 - DNA, 19 bp, Homo sapiens
agcctcctcctgaccacgg

SEQ ID NO: 375881 - DNA, 11 bp, Homo sapiens
agcctcctgag

SEQ ID NO: 375882 - DNA, 12 bp, Homo sapiens
agcctcctgagc

SEQ ID NO: 375883 - DNA, 16 bp, Homo sapiens
agcctcctgagcctgt

SEQ ID NO: 375884 - DNA, 18 bp, Homo sapiens
agcctcctgagcctgtgg

SEQ ID NO: 375885 - DNA, 16 bp, Homo sapiens
agcctcctgccccctg

SEQ ID NO: 375886 - DNA, 12 bp, Homo sapiens
agcctcctgctg

SEQ ID NO: 375887 - DNA, 16 bp, Homo sapiens
agcctcgaactcctgg

SEQ ID NO: 375888 - DNA, 17 bp, Homo sapiens
agcctcgaactcctggg

SEQ ID NO: 375889 - DNA, 21 bp, Homo sapiens
agcctcgaactcctgggctca

SEQ ID NO: 375890 - DNA, 17 bp, Homo sapiens
agcctctacagccgtcc

SEQ ID NO: 375891 - DNA, 14 bp, Homo sapiens
agcctctcatcccc

SEQ ID NO: 375892 - DNA, 11 bp, Homo sapiens
agcctctccca

SEQ ID NO: 375893 - DNA, 12 bp, Homo sapiens
agcctctcccac

SEQ ID NO: 375894 - DNA, 13 bp, Homo sapiens
agcctctcccacc

SEQ ID NO: 375895 - DNA, 15 bp, Homo sapiens
agcctctccccgctc

SEQ ID NO: 375896 - DNA, 13 bp, Homo sapiens
agcctctcccggc

SEQ ID NO: 375897 - DNA, 16 bp, Homo sapiens
agcctctcccggctgc

SEQ ID NO: 375898 - DNA, 19 bp, Homo sapiens
agcctctcccggctgcctg

SEQ ID NO: 375899 - DNA, 21 bp, Homo sapiens
agcctctcccggctgcctgcc

SEQ ID NO: 375900 - DNA, 18 bp, Homo sapiens
agcctctccttgccccag

SEQ ID NO: 375901 - DNA, 18 bp, Homo sapiens
agcctctgagcccctggg

SEQ ID NO: 375902 - DNA, 14 bp, Homo sapiens
agcctctgccaggc

SEQ ID NO: 375903 - DNA, 17 bp, Homo sapiens
agcctctgccctgcctc

SEQ ID NO: 375904 - DNA, 13 bp, Homo sapiens
agcctctggccag

SEQ ID NO: 375905 - DNA, 15 bp, Homo sapiens
agcctctggccagac

SEQ ID NO: 375906 - DNA, 13 bp, Homo sapiens
agcctctggctag

SEQ ID NO: 375907 - DNA, 15 bp, Homo sapiens
agcctctggctagag

SEQ ID NO: 375908 - DNA, 22 bp, Homo sapiens
agcctcttaaagctgcctgtag

SEQ ID NO: 375909 - DNA, 23 bp, Homo sapiens
agcctcttaaagctgcctgtagt

SEQ ID NO: 375910 - DNA, 22 bp, Homo sapiens
agcctcttagtgattgtgtctg

SEQ ID NO: 375911 - DNA, 17 bp, Homo sapiens
agcctcttctgaagatg

SEQ ID NO: 375912 - DNA, 21 bp, Homo sapiens
agcctctttaacagctttctc

SEQ ID NO: 375913 - DNA, 23 bp, Homo sapiens
agcctctttgtgtttttgttgtt

SEQ ID NO: 375914 - DNA, 20 bp, Homo sapiens
agcctgaaatagtggttctt

SEQ ID NO: 375915 - DNA, 22 bp, Homo sapiens
agcctgaaatagtggttcttgg

SEQ ID NO: 375916 - DNA, 17 bp, Homo sapiens
agcctgacaagtgaagt

SEQ ID NO: 375917 - DNA, 24 bp, Homo sapiens
agcctgaccaaaagtgagatggga

SEQ ID NO: 375918 - DNA, 14 bp, Homo sapiens
agcctgacctgaga

SEQ ID NO: 375919 - DNA, 18 bp, Homo sapiens
agcctgacctgagactgt

SEQ ID NO: 375920 - DNA, 23 bp, Homo sapiens
agcctgagatgtaggctccacct

SEQ ID NO: 375921 - DNA, 19 bp, Homo sapiens
agcctgagccacagtgggg

SEQ ID NO: 375922 - DNA, 20 bp, Homo sapiens
agcctgagccacagtggggc

SEQ ID NO: 375923 - DNA, 13 bp, Homo sapiens
agcctgagctcca

SEQ ID NO: 375924 - DNA, 16 bp, Homo sapiens
agcctgagctccaccc

SEQ ID NO: 375925 - DNA, 14 bp, Homo sapiens
agcctgaggccttc

SEQ ID NO: 375926 - DNA, 17 bp, Homo sapiens
agcctgagtcagggccc

SEQ ID NO: 375927 - DNA, 18 bp, Homo sapiens
agcctgagtctcctgtgc

SEQ ID NO: 375928 - DNA, 15 bp, Homo sapiens
agcctgatggccaag

SEQ ID NO: 375929 - DNA, 18 bp, Homo sapiens
agcctgcaaactcactgc

SEQ ID NO: 375930 - DNA, 19 bp, Homo sapiens
agcctgcaatttcatatgc

SEQ ID NO: 375931 - DNA, 20 bp, Homo sapiens
agcctgcacacacctgcctg

SEQ ID NO: 375932 - DNA, 21 bp, Homo sapiens
agcctgcagggtggtgctggg

SEQ ID NO: 375933 - DNA, 22 bp, Homo sapiens
agcctgcagggtggtgctggga

SEQ ID NO: 375934 - DNA, 15 bp, Homo sapiens
agcctgccccagctg

SEQ ID NO: 375935 - DNA, 17 bp, Homo sapiens
agcctgcgtggcctggg

SEQ ID NO: 375936 - DNA, 23 bp, Homo sapiens
agcctgcttcccacctccctgcc

SEQ ID NO: 375937 - DNA, 17 bp, Homo sapiens
agcctggagcccctgtg

SEQ ID NO: 375938 - DNA, 23 bp, Homo sapiens
agcctggaggccgggtgctcagg

SEQ ID NO: 375939 - DNA, 20 bp, Homo sapiens
agcctggatgccaaggagcc

SEQ ID NO: 375940 - DNA, 18 bp, Homo sapiens
agcctggcacagggcagt

SEQ ID NO: 375941 - DNA, 23 bp, Homo sapiens
agcctggccacgcagccaggaca

SEQ ID NO: 375942 - DNA, 15 bp, Homo sapiens
agcctggcttgggtt

SEQ ID NO: 375943 - DNA, 22 bp, Homo sapiens
agcctggcttttctggctgggg

SEQ ID NO: 375944 - DNA, 18 bp, Homo sapiens
agcctgggcaacagagca

SEQ ID NO: 375945 - DNA, 17 bp, Homo sapiens
agcctgggcagaaatgt

SEQ ID NO: 375946 - DNA, 17 bp, Homo sapiens
agcctgggcagccaggc

SEQ ID NO: 375947 - DNA, 20 bp, Homo sapiens
agcctgggcagccaggctgc

SEQ ID NO: 375948 - DNA, 17 bp, Homo sapiens
agcctgggccactggca

SEQ ID NO: 375949 - DNA, 23 bp, Homo sapiens
agcctgggccactggcatctctg

SEQ ID NO: 375950 - DNA, 13 bp, Homo sapiens
agcctgggccaga

SEQ ID NO: 375951 - DNA, 13 bp, Homo sapiens
agcctggggcctg

SEQ ID NO: 375952 - DNA, 21 bp, Homo sapiens
agcctggggcctggggatgta

SEQ ID NO: 375953 - DNA, 11 bp, Homo sapiens
agcctgggtga

SEQ ID NO: 375954 - DNA, 18 bp, Homo sapiens
agcctgggtgacagagcg

SEQ ID NO: 375955 - DNA, 13 bp, Homo sapiens
agcctgggtgaga

SEQ ID NO: 375956 - DNA, 15 bp, Homo sapiens
agcctggtgacaggc

SEQ ID NO: 375957 - DNA, 15 bp, Homo sapiens
agcctggtgctgctg

SEQ ID NO: 375958 - DNA, 17 bp, Homo sapiens
acacatcgttcgattta

SEQ ID NO: 375959 - DNA, 13 bp, Homo sapiens
acacatcttccct

SEQ ID NO: 375960 - DNA, 18 bp, Homo sapiens
acacattcttaaggcaat

SEQ ID NO: 375961 - DNA, 22 bp, Homo sapiens
acacattgaatgcgctttattg

SEQ ID NO: 375962 - DNA, 21 bp, Homo sapiens
acacattgtgtcacatcatga

SEQ ID NO: 375963 - DNA, 12 bp, Homo sapiens
acacatttaaaa

SEQ ID NO: 375964 - DNA, 17 bp, Homo sapiens
acacatttaaaacattt

SEQ ID NO: 375965 - DNA, 14 bp, Homo sapiens
acacatttctaatt

SEQ ID NO: 375966 - DNA, 16 bp, Homo sapiens
acaccaaattgctgag

SEQ ID NO: 375967 - DNA, 20 bp, Homo sapiens
acaccaaattgctgagatgt

SEQ ID NO: 375968 - DNA, 15 bp, Homo sapiens
acaccaagagtacag

SEQ ID NO: 375969 - DNA, 15 bp, Homo sapiens
acaccacactgacca

SEQ ID NO: 375970 - DNA, 14 bp, Homo sapiens
acaccacagacaca

SEQ ID NO: 375971 - DNA, 16 bp, Homo sapiens
acaccacagacacaca

SEQ ID NO: 375972 - DNA, 22 bp, Homo sapiens
acaccacagacacacacacgca

SEQ ID NO: 375973 - DNA, 15 bp, Homo sapiens
acaccacaggatctg

SEQ ID NO: 375974 - DNA, 23 bp, Homo sapiens
acaccaccaaatgacaagtcaca

SEQ ID NO: 375975 - DNA, 14 bp, Homo sapiens
acaccaccttatta

SEQ ID NO: 375976 - DNA, 19 bp, Homo sapiens
acaccactaaccatcccca

SEQ ID NO: 375977 - DNA, 11 bp, Homo sapiens
acaccactgcc

SEQ ID NO: 375978 - DNA, 14 bp, Homo sapiens
acaccactgccctg

SEQ ID NO: 375979 - DNA, 15 bp, Homo sapiens
acaccactgccctgc

SEQ ID NO: 375980 - DNA, 21 bp, Homo sapiens
acaccactgccctgcctgccc

SEQ ID NO: 375981 - DNA, 22 bp, Homo sapiens
acaccacttggagatctttgct

SEQ ID NO: 375982 - DNA, 15 bp, Homo sapiens
acaccagaagtgcca

SEQ ID NO: 375983 - DNA, 22 bp, Homo sapiens
acaccagccctgctgcttccta

SEQ ID NO: 375984 - DNA, 23 bp, Homo sapiens
acaccagccctgctgcttcctaa

SEQ ID NO: 375985 - DNA, 13 bp, Homo sapiens
acaccaggactta

SEQ ID NO: 375986 - DNA, 18 bp, Homo sapiens
acaccaggctgtgggcct

SEQ ID NO: 375987 - DNA, 19 bp, Homo sapiens
acaccatcacagcttgttt

SEQ ID NO: 375988 - DNA, 21 bp, Homo sapiens
acaccatcacagcttgttttg

SEQ ID NO: 375989 - DNA, 14 bp, Homo sapiens
acaccattattcca

SEQ ID NO: 375990 - DNA, 21 bp, Homo sapiens
acacccaattttaaaaaataa

SEQ ID NO: 375991 - DNA, 14 bp, Homo sapiens
acacccagccccag

SEQ ID NO: 375992 - DNA, 15 bp, Homo sapiens
acacccaggaaggga

SEQ ID NO: 375993 - DNA, 17 bp, Homo sapiens
acacccatgactgcccc

SEQ ID NO: 375994 - DNA, 18 bp, Homo sapiens
acaccccacaccccagcc

SEQ ID NO: 375995 - DNA, 11 bp, Homo sapiens
acaccccagcc

SEQ ID NO: 375996 - DNA, 13 bp, Homo sapiens
acaccccagccca

SEQ ID NO: 375997 - DNA, 13 bp, Homo sapiens
acaccccagcgcc

SEQ ID NO: 375998 - DNA, 20 bp, Homo sapiens
acaccccccgccccccacct

SEQ ID NO: 375999 - DNA, 15 bp, Homo sapiens
acaccccgtctgccc

SEQ ID NO: 376000 - DNA, 13 bp, Homo sapiens
acacccctgccgg

SEQ ID NO: 376001 - DNA, 21 bp, Homo sapiens
aagggggctattccctggaga

SEQ ID NO: 376002 - DNA, 23 bp, Homo sapiens
aagggggctattccctggagacc

SEQ ID NO: 376003 - DNA, 16 bp, Homo sapiens
aaggggggagggggag

SEQ ID NO: 376004 - DNA, 21 bp, Homo sapiens
aaggggggttgcagtggagag

SEQ ID NO: 376005 - DNA, 18 bp, Homo sapiens
aagggtatgggaagccat

SEQ ID NO: 376006 - DNA, 21 bp, Homo sapiens
aagggtcctacggagggacca

SEQ ID NO: 376007 - DNA, 15 bp, Homo sapiens
aagggtctgataaac

SEQ ID NO: 376008 - DNA, 16 bp, Homo sapiens
aagggtgacatcccag

SEQ ID NO: 376009 - DNA, 16 bp, Homo sapiens
aagggtgctgcttccc

SEQ ID NO: 376010 - DNA, 19 bp, Homo sapiens
aagggtgctgcttccctct

SEQ ID NO: 376011 - DNA, 20 bp, Homo sapiens
aagggtgtgggtcagggagg

SEQ ID NO: 376012 - DNA, 17 bp, Homo sapiens
aagggttgaaggcagtc

SEQ ID NO: 376013 - DNA, 14 bp, Homo sapiens
aaggtaatactata

SEQ ID NO: 376014 - DNA, 22 bp, Homo sapiens
aaggtaatactataaatatatt

SEQ ID NO: 376015 - DNA, 18 bp, Homo sapiens
aaggtaggtgcatgcctt

SEQ ID NO: 376016 - DNA, 19 bp, Homo sapiens
aaggtattttgaataccat

SEQ ID NO: 376017 - DNA, 19 bp, Homo sapiens
aaggtcacatagctgggat

SEQ ID NO: 376018 - DNA, 20 bp, Homo sapiens
aaggtccactccctgctcca

SEQ ID NO: 376019 - DNA, 13 bp, Homo sapiens
aaggtcctgccct

SEQ ID NO: 376020 - DNA, 24 bp, Homo sapiens
aaggtcctgctcaactctacccct

SEQ ID NO: 376021 - DNA, 18 bp, Homo sapiens
aaggtcggaggcttggga

SEQ ID NO: 376022 - DNA, 20 bp, Homo sapiens
aaggtcggaggcttgggacc

SEQ ID NO: 376023 - DNA, 22 bp, Homo sapiens
aaggtcggaggcttgggaccgc

SEQ ID NO: 376024 - DNA, 20 bp, Homo sapiens
aaggtcgtttttttcattcc

SEQ ID NO: 376025 - DNA, 15 bp, Homo sapiens
aaggtgaaacacaca

SEQ ID NO: 376026 - DNA, 11 bp, Homo sapiens
aaggtgcacat

SEQ ID NO: 376027 - DNA, 21 bp, Homo sapiens
aagtgaggaagcctaaataaa

SEQ ID NO: 376028 - DNA, 16 bp, Homo sapiens
aagtgaggatgaaaaa

SEQ ID NO: 376029 - DNA, 11 bp, Homo sapiens
aagtgaggcct

SEQ ID NO: 376030 - DNA, 22 bp, Homo sapiens
aagtgatcaataaaatgtgatt

SEQ ID NO: 376031 - DNA, 15 bp, Homo sapiens
aagtgatgtgattta

SEQ ID NO: 376032 - DNA, 17 bp, Homo sapiens
aagtgatgtgatttatg

SEQ ID NO: 376033 - DNA, 14 bp, Homo sapiens
aagtgattgacatt

SEQ ID NO: 376034 - DNA, 17 bp, Homo sapiens
aagtgcaggctggcacc

SEQ ID NO: 376035 - DNA, 14 bp, Homo sapiens
aagtgcatttctga

SEQ ID NO: 376036 - DNA, 22 bp, Homo sapiens
aagtgccactgcccgagctggt

SEQ ID NO: 376037 - DNA, 11 bp, Homo sapiens
aagtgcccaaa

SEQ ID NO: 376038 - DNA, 12 bp, Homo sapiens
aagtgcccaaag

SEQ ID NO: 376039 - DNA, 14 bp, Homo sapiens
aagtgcccaaagtg

SEQ ID NO: 376040 - DNA, 17 bp, Homo sapiens
aagtgcccaaagtgggg

SEQ ID NO: 376041 - DNA, 12 bp, Homo sapiens
aagtgcccctgc

SEQ ID NO: 376042 - DNA, 13 bp, Homo sapiens
aagtgcccctgct

SEQ ID NO: 376043 - DNA, 16 bp, Homo sapiens
aagtgccttgagctgc

SEQ ID NO: 376044 - DNA, 17 bp, Homo sapiens
aagtgccttgagctgcc

SEQ ID NO: 376045 - DNA, 20 bp, Homo sapiens
aagtgcttggttgaaaagat

SEQ ID NO: 376046 - DNA, 10 bp, Homo sapiens
aagtggaaaa

SEQ ID NO: 376047 - DNA, 17 bp, Homo sapiens
aagtggaaaaaagagaa

SEQ ID NO: 376048 - DNA, 16 bp, Homo sapiens
aagtggaaaaagaaat

SEQ ID NO: 376049 - DNA, 17 bp, Homo sapiens
aagtggaaaaagaaatt

SEQ ID NO: 376050 - DNA, 21 bp, Homo sapiens
aagtggaaaaagaaattctgt

SEQ ID NO: 376051 - DNA, 22 bp, Homo sapiens
aagtggaaaaagaaattctgtt

SEQ ID NO: 376052 - DNA, 12 bp, Homo sapiens
aagtggacccag

SEQ ID NO: 376053 - DNA, 21 bp, Homo sapiens
aagtggaggaaatgttggaac

SEQ ID NO: 376054 - DNA, 18 bp, Homo sapiens
aagtggaggttgagtgag

SEQ ID NO: 376055 - DNA, 11 bp, Homo sapiens
aagtgggagaa

SEQ ID NO: 376056 - DNA, 15 bp, Homo sapiens
aagtgggagaagtgg

SEQ ID NO: 376057 - DNA, 17 bp, Homo sapiens
aagtgggagtgggagag

SEQ ID NO: 376058 - DNA, 23 bp, Homo sapiens
aagtgggagtgggagaggaagcc

SEQ ID NO: 376059 - DNA, 17 bp, Homo sapiens
aagtgggtttcaattta

SEQ ID NO: 376060 - DNA, 11 bp, Homo sapiens
aagtgtaaaaa

SEQ ID NO: 376061 - DNA, 15 bp, Homo sapiens
aagtgtaacagctga

SEQ ID NO: 376062 - DNA, 16 bp, Homo sapiens
aagtgtaacagctgag

SEQ ID NO: 376063 - DNA, 17 bp, Homo sapiens
aagtgtaacagctgagg

SEQ ID NO: 376064 - DNA, 21 bp, Homo sapiens
aagtgtaacagctgaggtctc

SEQ ID NO: 376065 - DNA, 13 bp, Homo sapiens
aagtgtacaattt

SEQ ID NO: 376066 - DNA, 15 bp, Homo sapiens
aagtgtacaattttc

SEQ ID NO: 376067 - DNA, 15 bp, Homo sapiens
aagtgtcatttcttt

SEQ ID NO: 376068 - DNA, 20 bp, Homo sapiens
aagtgtgagtaagagctggt

SEQ ID NO: 376069 - DNA, 21 bp, Homo sapiens
aagtgtgagtaagagctggtg

SEQ ID NO: 376070 - DNA, 21 bp, Homo sapiens
aagtgtgcctgctatccagcc

SEQ ID NO: 376071 - DNA, 12 bp, Homo sapiens
aagtgtggctgg

SEQ ID NO: 376072 - DNA, 19 bp, Homo sapiens
aagtgtggctggtgtcccc

SEQ ID NO: 376073 - DNA, 22 bp, Homo sapiens
aagtgtggggcgggggtctata

SEQ ID NO: 376074 - DNA, 18 bp, Homo sapiens
aagtgttcaagaaataaa

SEQ ID NO: 376075 - DNA, 19 bp, Homo sapiens
aagtgttcaagaaataaaa

SEQ ID NO: 376076 - DNA, 16 bp, Homo sapiens
aagtgttggtctttct

SEQ ID NO: 376077 - DNA, 22 bp, Homo sapiens
aagtgttttctcagaacagctg

SEQ ID NO: 376078 - DNA, 17 bp, Homo sapiens
aagttaaaaaaaataat

SEQ ID NO: 376079 - DNA, 17 bp, Homo sapiens
aagttaaagagacaaat

SEQ ID NO: 376080 - DNA, 14 bp, Homo sapiens
aagttaaaggcagt

SEQ ID NO: 376081 - DNA, 22 bp, Homo sapiens
aagttaaaggcagtccagagct

SEQ ID NO: 376082 - DNA, 20 bp, Homo sapiens
aagttaatattggaagtgaa

SEQ ID NO: 376083 - DNA, 13 bp, Homo sapiens
aagttacagaaat

SEQ ID NO: 376084 - DNA, 16 bp, Homo sapiens
aagttactatcctggc

SEQ ID NO: 376085 - DNA, 17 bp, Homo sapiens
aagttactgggcattct

SEQ ID NO: 376086 - DNA, 18 bp, Homo sapiens
aagttataaatcaatgtc

SEQ ID NO: 376087 - DNA, 17 bp, Homo sapiens
aagttataccagcaaaa

SEQ ID NO: 376088 - DNA, 17 bp, Homo sapiens
aagttattaatttcttc

SEQ ID NO: 376089 - DNA, 23 bp, Homo sapiens
aagttatttacttttaccactat

SEQ ID NO: 376090 - DNA, 15 bp, Homo sapiens
aagttcaagactgaa

SEQ ID NO: 376091 - DNA, 22 bp, Homo sapiens
aagttcaagactgaaatggctt

SEQ ID NO: 376092 - DNA, 18 bp, Homo sapiens
aagttcaattgtgtctgt

SEQ ID NO: 376093 - DNA, 21 bp, Homo sapiens
aagttcaccagactctataaa

SEQ ID NO: 376094 - DNA, 22 bp, Homo sapiens
aagttcaccgtagtaacacata

SEQ ID NO: 376095 - DNA, 21 bp, Homo sapiens
aagttcacgtaagatacaagt

SEQ ID NO: 376096 - DNA, 16 bp, Homo sapiens
aagttcatagtttctg

SEQ ID NO: 376097 - DNA, 21 bp, Homo sapiens
aagttcatagtttctgtaatt

SEQ ID NO: 376098 - DNA, 12 bp, Homo sapiens
aagttctattta

SEQ ID NO: 376099 - DNA, 16 bp, Homo sapiens
aagttctcaatgtgaa

SEQ ID NO: 376100 - DNA, 22 bp, Homo sapiens
aagttctgggcagctaaaagca

SEQ ID NO: 376101 - DNA, 15 bp, Homo sapiens
aagttcttcacctct

SEQ ID NO: 376102 - DNA, 17 bp, Homo sapiens
aagttgaagctaagatt

SEQ ID NO: 376103 - DNA, 16 bp, Homo sapiens
aagttgaggggagagg

SEQ ID NO: 376104 - DNA, 19 bp, Homo sapiens
aagttgataggagacttgt

SEQ ID NO: 376105 - DNA, 20 bp, Homo sapiens
aagttgataggagacttgta

SEQ ID NO: 376106 - DNA, 16 bp, Homo sapiens
aagttgcagtgagctg

SEQ ID NO: 376107 - DNA, 21 bp, Homo sapiens
aagttgctgtaagcacctggg

SEQ ID NO: 376108 - DNA, 13 bp, Homo sapiens
aagttggactggg

SEQ ID NO: 376109 - DNA, 16 bp, Homo sapiens
aagttgggagcctgaa

SEQ ID NO: 376110 - DNA, 19 bp, Homo sapiens
aagttgtgccttttatagc

SEQ ID NO: 376111 - DNA, 20 bp, Homo sapiens
aagttgtgccttttatagct

SEQ ID NO: 376112 - DNA, 19 bp, Homo sapiens
aagttgtttcaaacagcat

SEQ ID NO: 376113 - DNA, 11 bp, Homo sapiens
aagtttaaata

SEQ ID NO: 376114 - DNA, 12 bp, Homo sapiens
aagtttaaatac

SEQ ID NO: 376115 - DNA, 23 bp, Homo sapiens
aagtttacaagtgtatatcagaa

SEQ ID NO: 376116 - DNA, 18 bp, Homo sapiens
aagtttacaatcaaagga

SEQ ID NO: 376117 - DNA, 18 bp, Homo sapiens
aagtttacagtaaataaa

SEQ ID NO: 376118 - DNA, 21 bp, Homo sapiens
aagtttacagtaaataaattg

SEQ ID NO: 376119 - DNA, 11 bp, Homo sapiens
aagtttagaga

SEQ ID NO: 376120 - DNA, 18 bp, Homo sapiens
aagtttatacagtacagt

SEQ ID NO: 376121 - DNA, 20 bp, Homo sapiens
aagtttatgtggcacacaat

SEQ ID NO: 376122 - DNA, 21 bp, Homo sapiens
aagtttattgtaaaagtgaca

SEQ ID NO: 376123 - DNA, 22 bp, Homo sapiens
aagtttattgtaaaagtgacat

SEQ ID NO: 376124 - DNA, 16 bp, Homo sapiens
aagtttcaatgtgatt

SEQ ID NO: 376125 - DNA, 19 bp, Homo sapiens
aagtttcaggatacatgtg

SEQ ID NO: 376126 - DNA, 16 bp, Homo sapiens
aagtttcagtaatagc

SEQ ID NO: 376127 - DNA, 21 bp, Homo sapiens
aagtttcagtaatagctgaac

SEQ ID NO: 376128 - DNA, 12 bp, Homo sapiens
aagtttcattta

SEQ ID NO: 376129 - DNA, 17 bp, Homo sapiens
aagtttccccaccagtg

SEQ ID NO: 376130 - DNA, 19 bp, Homo sapiens
aagtttctagctagaaata

SEQ ID NO: 376131 - DNA, 15 bp, Homo sapiens
aagtttgatttcatt

SEQ ID NO: 376132 - DNA, 19 bp, Homo sapiens
aagtttggcaatagtttgc

SEQ ID NO: 376133 - DNA, 21 bp, Homo sapiens
aagtttgtgttctgtttgtta

SEQ ID NO: 376134 - DNA, 22 bp, Homo sapiens
aagtttgtgttctgtttgttaa

SEQ ID NO: 376135 - DNA, 21 bp, Homo sapiens
aagtttgttctgcagagactt

SEQ ID NO: 376136 - DNA, 13 bp, Homo sapiens
aagttttcagatt

SEQ ID NO: 376137 - DNA, 22 bp, Homo sapiens
aagttttcagattgtaaaggta

SEQ ID NO: 376138 - DNA, 13 bp, Homo sapiens
aagttttccagta

SEQ ID NO: 376139 - DNA, 20 bp, Homo sapiens
aataaaactttatgtactgc

SEQ ID NO: 376140 - DNA, 18 bp, Homo sapiens
aataaaagcagcatctgc

SEQ ID NO: 376141 - DNA, 12 bp, Homo sapiens
aataaaagtgac

SEQ ID NO: 376142 - DNA, 14 bp, Homo sapiens
aataaaagtgcaca

SEQ ID NO: 376143 - DNA, 19 bp, Homo sapiens
aataaaagtgcacacctta

SEQ ID NO: 376144 - DNA, 15 bp, Homo sapiens
aataaaatatcattc

SEQ ID NO: 376145 - DNA, 16 bp, Homo sapiens
aataaaatatcattca

SEQ ID NO: 376146 - DNA, 18 bp, Homo sapiens
aataaaatatcattcagc

SEQ ID NO: 376147 - DNA, 16 bp, Homo sapiens
aataaaattcatttct

SEQ ID NO: 376148 - DNA, 21 bp, Homo sapiens
aataaacagcttcatgccttt

SEQ ID NO: 376149 - DNA, 22 bp, Homo sapiens
aataaacagcttcatgcctttg

SEQ ID NO: 376150 - DNA, 20 bp, Homo sapiens
aataaaccacacttagtcct

SEQ ID NO: 376151 - DNA, 14 bp, Homo sapiens
aataaaccttgttt

SEQ ID NO: 376152 - DNA, 17 bp, Homo sapiens
aataaaccttgtttctt

SEQ ID NO: 376153 - DNA, 22 bp, Homo sapiens
aataaaccttgtttctttctga

SEQ ID NO: 376154 - DNA, 17 bp, Homo sapiens
aataaacgaaacacaga

SEQ ID NO: 376155 - DNA, 14 bp, Homo sapiens
aataaactagggtt

SEQ ID NO: 376156 - DNA, 15 bp, Homo sapiens
aataaactctaaaca

SEQ ID NO: 376157 - DNA, 17 bp, Homo sapiens
aataaactcttcaaggc

SEQ ID NO: 376158 - DNA, 20 bp, Homo sapiens
aataaactcttcaaggccaa

SEQ ID NO: 376159 - DNA, 13 bp, Homo sapiens
aataaactgtttt

SEQ ID NO: 376160 - DNA, 22 bp, Homo sapiens
aataaacttagaataaaattgt

SEQ ID NO: 376161 - DNA, 20 bp, Homo sapiens
aataaagaaaaaaatagttt

SEQ ID NO: 376162 - DNA, 21 bp, Homo sapiens
aataaagaaaaaaatagtttt

SEQ ID NO: 376163 - DNA, 23 bp, Homo sapiens
aataaagaactccttattttgta

SEQ ID NO: 376164 - DNA, 12 bp, Homo sapiens
aataaagaagaa

SEQ ID NO: 376165 - DNA, 21 bp, Homo sapiens
aataaagcactattgtttaga

SEQ ID NO: 376166 - DNA, 21 bp, Homo sapiens
aataaagctggacaagaagct

SEQ ID NO: 376167 - DNA, 20 bp, Homo sapiens
aataaaggtttcgttgcatg

SEQ ID NO: 376168 - DNA, 9 bp, Homo sapiens
aataaagta

SEQ ID NO: 376169 - DNA, 15 bp, Homo sapiens
aataaagtatatata

SEQ ID NO: 376170 - DNA, 11 bp, Homo sapiens
aataaagtatc

SEQ ID NO: 376171 - DNA, 16 bp, Homo sapiens
aataaagtatcatgca

SEQ ID NO: 376172 - DNA, 17 bp, Homo sapiens
aataaagtatcatgcat

SEQ ID NO: 376173 - DNA, 19 bp, Homo sapiens
aataaagtatcatgcattc

SEQ ID NO: 376174 - DNA, 11 bp, Homo sapiens
aataaagtatt

SEQ ID NO: 376175 - DNA, 15 bp, Homo sapiens
aataaagtattccac

SEQ ID NO: 376176 - DNA, 15 bp, Homo sapiens
aataaagttaaaagt

SEQ ID NO: 376177 - DNA, 14 bp, Homo sapiens
aataaataaagaag

SEQ ID NO: 376178 - DNA, 14 bp, Homo sapiens
aataaatatactaa

SEQ ID NO: 376179 - DNA, 16 bp, Homo sapiens
aataaatatactaata

SEQ ID NO: 376180 - DNA, 14 bp, Homo sapiens
aataaatatttatg

SEQ ID NO: 376181 - DNA, 22 bp, Homo sapiens
aataaatctcttctttgctgca

SEQ ID NO: 376182 - DNA, 22 bp, Homo sapiens
aataaatctgttgccaagctgg

SEQ ID NO: 376183 - DNA, 15 bp, Homo sapiens
aataaatctttggaa

SEQ ID NO: 376184 - DNA, 16 bp, Homo sapiens
aataaatctttggaaa

SEQ ID NO: 376185 - DNA, 12 bp, Homo sapiens
aataaatgacca

SEQ ID NO: 376186 - DNA, 20 bp, Homo sapiens
aataaatgtcccaaataaat

SEQ ID NO: 376187 - DNA, 21 bp, Homo sapiens
aataaattaaataaaataacc

SEQ ID NO: 376188 - DNA, 21 bp, Homo sapiens
aataaattggtgataagtgga

SEQ ID NO: 376189 - DNA, 22 bp, Homo sapiens
aataaattggtgataagtggaa

SEQ ID NO: 376190 - DNA, 12 bp, Homo sapiens
aataaatttctg

SEQ ID NO: 376191 - DNA, 21 bp, Homo sapiens
aataaatttctgggatattta

SEQ ID NO: 376192 - DNA, 22 bp, Homo sapiens
aataaatttctgggatatttaa

SEQ ID NO: 376193 - DNA, 18 bp, Homo sapiens
aataaatttggttctaat

SEQ ID NO: 376194 - DNA, 12 bp, Homo sapiens
aataaattttat

SEQ ID NO: 376195 - DNA, 16 bp, Homo sapiens
aataacacagagagac

SEQ ID NO: 376196 - DNA, 11 bp, Homo sapiens
aataacactgc

SEQ ID NO: 376197 - DNA, 15 bp, Homo sapiens
aataacatattcttg

SEQ ID NO: 376198 - DNA, 15 bp, Homo sapiens
aataacatctgaaaa

SEQ ID NO: 376199 - DNA, 17 bp, Homo sapiens
aataacatctgaaaaga

SEQ ID NO: 376200 - DNA, 13 bp, Homo sapiens
aataacattgcac

SEQ ID NO: 376201 - DNA, 14 bp, Homo sapiens
aataacattgcact

SEQ ID NO: 376202 - DNA, 15 bp, Homo sapiens
aataacattgcactt

SEQ ID NO: 376203 - DNA, 20 bp, Homo sapiens
aataactactgcaaaaagta

SEQ ID NO: 376204 - DNA, 15 bp, Homo sapiens
aataactactgtgtt

SEQ ID NO: 376205 - DNA, 19 bp, Homo sapiens
aataactactgtgttcctg

SEQ ID NO: 376206 - DNA, 19 bp, Homo sapiens
aataactcctcattgtaaa

SEQ ID NO: 376207 - DNA, 19 bp, Homo sapiens
aataactctgtggcattat

SEQ ID NO: 376208 - DNA, 14 bp, Homo sapiens
aataactgtgaagt

SEQ ID NO: 376209 - DNA, 20 bp, Homo sapiens
aataactgtgaagtttacat

SEQ ID NO: 376210 - DNA, 15 bp, Homo sapiens
aataacttcagagaa

SEQ ID NO: 376211 - DNA, 18 bp, Homo sapiens
aataacttcagagaagtc

SEQ ID NO: 376212 - DNA, 14 bp, Homo sapiens
aataagaatttagg

SEQ ID NO: 376213 - DNA, 14 bp, Homo sapiens
aataagagaaagaa

SEQ ID NO: 376214 - DNA, 14 bp, Homo sapiens
aataagctctagtt

SEQ ID NO: 376215 - DNA, 14 bp, Homo sapiens
aataagtaacatat

SEQ ID NO: 376216 - DNA, 15 bp, Homo sapiens
aataagtaacatata

SEQ ID NO: 376217 - DNA, 17 bp, Homo sapiens
aataagtgaatctaata

SEQ ID NO: 376218 - DNA, 17 bp, Homo sapiens
aataagtggttatttct

SEQ ID NO: 376219 - DNA, 13 bp, Homo sapiens
aataataaataca

SEQ ID NO: 376220 - DNA, 12 bp, Homo sapiens
aataataaatta

SEQ ID NO: 376221 - DNA, 14 bp, Homo sapiens
aataataaattaac

SEQ ID NO: 376222 - DNA, 15 bp, Homo sapiens
aataataaattaaca

SEQ ID NO: 376223 - DNA, 18 bp, Homo sapiens
aataataaattaacatta

SEQ ID NO: 376224 - DNA, 22 bp, Homo sapiens
aataataaattaacattatatt

SEQ ID NO: 376225 - DNA, 20 bp, Homo sapiens
aataataatttttatattta

SEQ ID NO: 376226 - DNA, 15 bp, Homo sapiens
aataatacatcttta

SEQ ID NO: 376227 - DNA, 16 bp, Homo sapiens
aataatattatattgt

SEQ ID NO: 376228 - DNA, 15 bp, Homo sapiens
aataatcacattgac

SEQ ID NO: 376229 - DNA, 17 bp, Homo sapiens
aataatcacattgactt

SEQ ID NO: 376230 - DNA, 13 bp, Homo sapiens
aataatgaataat

SEQ ID NO: 376231 - DNA, 22 bp, Homo sapiens
aataatgacgtattgtgaaatt

SEQ ID NO: 376232 - DNA, 12 bp, Homo sapiens
aataatgattta

SEQ ID NO: 376233 - DNA, 19 bp, Homo sapiens
aataatgtacatctggcct

SEQ ID NO: 376234 - DNA, 19 bp, Homo sapiens
aataatgtcctttccctgg

SEQ ID NO: 376235 - DNA, 21 bp, Homo sapiens
aataatgtgggaagaaacaaa

SEQ ID NO: 376236 - DNA, 19 bp, Homo sapiens
aataatgttaacatggaca

SEQ ID NO: 376237 - DNA, 16 bp, Homo sapiens
aataatgttctattgt

SEQ ID NO: 376238 - DNA, 13 bp, Homo sapiens
aataattagaaac

SEQ ID NO: 376239 - DNA, 14 bp, Homo sapiens
aataattggttctt

SEQ ID NO: 376240 - DNA, 14 bp, Homo sapiens
aataattgtgtaca

SEQ ID NO: 376241 - DNA, 20 bp, Homo sapiens
aataattgtgtacaaagtag

SEQ ID NO: 376242 - DNA, 21 bp, Homo sapiens
aataattttaagaaatcaaag

SEQ ID NO: 376243 - DNA, 23 bp, Homo sapiens
aataattttatgaactgcatgta

SEQ ID NO: 376244 - DNA, 22 bp, Homo sapiens
aataatttttatatttaattat

SEQ ID NO: 376245 - DNA, 21 bp, Homo sapiens
aatacaaaaaattagccgagc

SEQ ID NO: 376246 - DNA, 17 bp, Homo sapiens
aatacaaaataaaatta

SEQ ID NO: 376247 - DNA, 18 bp, Homo sapiens
aatacaacttaaataata

SEQ ID NO: 376248 - DNA, 19 bp, Homo sapiens
aatacaagccaagctagaa

SEQ ID NO: 376249 - DNA, 16 bp, Homo sapiens
aatacaagttctattt

SEQ ID NO: 376250 - DNA, 23 bp, Homo sapiens
aatacaagttctatttaagtgta

SEQ ID NO: 376251 - DNA, 13 bp, Homo sapiens
aatacaataaact

SEQ ID NO: 376252 - DNA, 19 bp, Homo sapiens
aatacaatagtatgcagct

SEQ ID NO: 376253 - DNA, 17 bp, Homo sapiens
aatacaattcagtttta

SEQ ID NO: 376254 - DNA, 15 bp, Homo sapiens
aatacagacactaag

SEQ ID NO: 376255 - DNA, 21 bp, Homo sapiens
aatacagacactaagttatag

SEQ ID NO: 376256 - DNA, 18 bp, Homo sapiens
aagcctgttcccctcact

SEQ ID NO: 376257 - DNA, 24 bp, Homo sapiens
aagccttacggtcatgatgtctgc

SEQ ID NO: 376258 - DNA, 23 bp, Homo sapiens
aagccttatcaagtgtcttccat

SEQ ID NO: 376259 - DNA, 21 bp, Homo sapiens
aagccttttccataaagtgta

SEQ ID NO: 376260 - DNA, 22 bp, Homo sapiens
aagccttttccataaagtgtaa

SEQ ID NO: 376261 - DNA, 15 bp, Homo sapiens
aagcgaacatcttca

SEQ ID NO: 376262 - DNA, 16 bp, Homo sapiens
aagcgaacatcttcat

SEQ ID NO: 376263 - DNA, 15 bp, Homo sapiens
aagcgggcagccccg

SEQ ID NO: 376264 - DNA, 13 bp, Homo sapiens
aagcgtctccctt

SEQ ID NO: 376265 - DNA, 18 bp, Homo sapiens
aagcgtctcccttggcca

SEQ ID NO: 376266 - DNA, 19 bp, Homo sapiens
aagcgttcctggccttctg

SEQ ID NO: 376267 - DNA, 20 bp, Homo sapiens
aagctaataaaatatcattc

SEQ ID NO: 376268 - DNA, 19 bp, Homo sapiens
aagctaatgtttaaaagca

SEQ ID NO: 376269 - DNA, 19 bp, Homo sapiens
aagctacctcaaacttcca

SEQ ID NO: 376270 - DNA, 15 bp, Homo sapiens
aagctagaaggaagc

SEQ ID NO: 376271 - DNA, 19 bp, Homo sapiens
aagctagacaaaggcccag

SEQ ID NO: 376272 - DNA, 20 bp, Homo sapiens
aagctagacaaaggcccaga

SEQ ID NO: 376273 - DNA, 17 bp, Homo sapiens
aagctaggaaaggcaga

SEQ ID NO: 376274 - DNA, 19 bp, Homo sapiens
aagctagggtggcccttgc

SEQ ID NO: 376275 - DNA, 22 bp, Homo sapiens
aagctagggtggcccttgcagt

SEQ ID NO: 376276 - DNA, 18 bp, Homo sapiens
aagctcaaataaaaataa

SEQ ID NO: 376277 - DNA, 14 bp, Homo sapiens
aagctcaaatgtat

SEQ ID NO: 376278 - DNA, 14 bp, Homo sapiens
aagctcagaataga

SEQ ID NO: 376279 - DNA, 16 bp, Homo sapiens
aagctcagtttggctg

SEQ ID NO: 376280 - DNA, 21 bp, Homo sapiens
aagctcatattttgtatatat

SEQ ID NO: 376281 - DNA, 22 bp, Homo sapiens
aagctcatattttgtatatatc

SEQ ID NO: 376282 - DNA, 21 bp, Homo sapiens
aagctccacggtgcgtggctg

SEQ ID NO: 376283 - DNA, 13 bp, Homo sapiens
aagctccagcttt

SEQ ID NO: 376284 - DNA, 14 bp, Homo sapiens
aagctccaggtgcc

SEQ ID NO: 376285 - DNA, 18 bp, Homo sapiens
aagctccagtcctgctct

SEQ ID NO: 376286 - DNA, 19 bp, Homo sapiens
aagctccagtcctgctctc

SEQ ID NO: 376287 - DNA, 21 bp, Homo sapiens
aagctccagtcctgctctcta

SEQ ID NO: 376288 - DNA, 11 bp, Homo sapiens
aagctctgttg

SEQ ID NO: 376289 - DNA, 15 bp, Homo sapiens
aagctctttgagaac

SEQ ID NO: 376290 - DNA, 16 bp, Homo sapiens
aagctctttgagaact

SEQ ID NO: 376291 - DNA, 14 bp, Homo sapiens
aagctgaagaaaat

SEQ ID NO: 376292 - DNA, 14 bp, Homo sapiens
aagctgaatatttt

SEQ ID NO: 376293 - DNA, 23 bp, Homo sapiens
aagctgaatattttttatttcta

SEQ ID NO: 376294 - DNA, 20 bp, Homo sapiens
aagctgagcgggtctagtgg

SEQ ID NO: 376295 - DNA, 23 bp, Homo sapiens
aagctgagttacttgtctgaggc

SEQ ID NO: 376296 - DNA, 21 bp, Homo sapiens
aagctgatgatgtctcttgta

SEQ ID NO: 376297 - DNA, 15 bp, Homo sapiens
aagctgattcccaga

SEQ ID NO: 376298 - DNA, 16 bp, Homo sapiens
aagctgattcccagag

SEQ ID NO: 376299 - DNA, 22 bp, Homo sapiens
aagctgattcccagagcagacc

SEQ ID NO: 376300 - DNA, 17 bp, Homo sapiens
aagctgcctccctgtcc

SEQ ID NO: 376301 - DNA, 19 bp, Homo sapiens
aagctgcctccctgtccac

SEQ ID NO: 376302 - DNA, 20 bp, Homo sapiens
aagctgcctccctgtccacc

SEQ ID NO: 376303 - DNA, 22 bp, Homo sapiens
aagctgcctccctgtccacccc

SEQ ID NO: 376304 - DNA, 11 bp, Homo sapiens
aagctgcctct

SEQ ID NO: 376305 - DNA, 13 bp, Homo sapiens
aagctgcctctga

SEQ ID NO: 376306 - DNA, 15 bp, Homo sapiens
aagctgcctgtagtt

SEQ ID NO: 376307 - DNA, 19 bp, Homo sapiens
aagctgcctgtagttagga

SEQ ID NO: 376308 - DNA, 21 bp, Homo sapiens
aagctgctgagaatctagcct

SEQ ID NO: 376309 - DNA, 18 bp, Homo sapiens
aagctggacaagaagctg

SEQ ID NO: 376310 - DNA, 23 bp, Homo sapiens
aagctggagccaatggtgagggc

SEQ ID NO: 376311 - DNA, 16 bp, Homo sapiens
aagctggcaacatgaa

SEQ ID NO: 376312 - DNA, 15 bp, Homo sapiens
aagctggcaggagac

SEQ ID NO: 376313 - DNA, 16 bp, Homo sapiens
aagctggcaggagaca

SEQ ID NO: 376314 - DNA, 21 bp, Homo sapiens
aagctggccgagggtcctggc

SEQ ID NO: 376315 - DNA, 23 bp, Homo sapiens
aagctggggacagctttcctggg

SEQ ID NO: 376316 - DNA, 17 bp, Homo sapiens
aagctggtaaactattt

SEQ ID NO: 376317 - DNA, 20 bp, Homo sapiens
aagctgtactcagagcagag

SEQ ID NO: 376318 - DNA, 16 bp, Homo sapiens
aagctgtgaaatgtgc

SEQ ID NO: 376319 - DNA, 13 bp, Homo sapiens
aagctgtgaaatt

SEQ ID NO: 376320 - DNA, 16 bp, Homo sapiens
aagctgtgtctctgta

SEQ ID NO: 376321 - DNA, 23 bp, Homo sapiens
aagctgtttagtttgttaattga

SEQ ID NO: 376322 - DNA, 12 bp, Homo sapiens
aagctgtttcta

SEQ ID NO: 376323 - DNA, 22 bp, Homo sapiens
aagcttaaattgcttttgttgt

SEQ ID NO: 376324 - DNA, 14 bp, Homo sapiens
aagcttaaggagag

SEQ ID NO: 376325 - DNA, 18 bp, Homo sapiens
aagcttagattttctgta

SEQ ID NO: 376326 - DNA, 14 bp, Homo sapiens
aagcttcattctca

SEQ ID NO: 376327 - DNA, 21 bp, Homo sapiens
aagcttggcagccgagctcgt

SEQ ID NO: 376328 - DNA, 23 bp, Homo sapiens
aagcttgtattatcagtgaatat

SEQ ID NO: 376329 - DNA, 23 bp, Homo sapiens
aagcttgtggccccttttacttt

SEQ ID NO: 376330 - DNA, 15 bp, Homo sapiens
aagcttgtttccctg

SEQ ID NO: 376331 - DNA, 21 bp, Homo sapiens
aagcttgtttccctgctggcc

SEQ ID NO: 376332 - DNA, 16 bp, Homo sapiens
aagctttaaaaaataa

SEQ ID NO: 376333 - DNA, 16 bp, Homo sapiens
aagctttcctgcccca

SEQ ID NO: 376334 - DNA, 21 bp, Homo sapiens
aagctttcctgccccaggcct

SEQ ID NO: 376335 - DNA, 14 bp, Homo sapiens
aagctttctccttt

SEQ ID NO: 376336 - DNA, 19 bp, Homo sapiens
aagctttctctgcttcagc

SEQ ID NO: 376337 - DNA, 23 bp, Homo sapiens
aagctttctctgcttcagcttgc

SEQ ID NO: 376338 - DNA, 20 bp, Homo sapiens
aagctttcttacaatgtgga

SEQ ID NO: 376339 - DNA, 23 bp, Homo sapiens
aagctttcttctacaaccagagc

SEQ ID NO: 376340 - DNA, 14 bp, Homo sapiens
aagcttttcctttc

SEQ ID NO: 376341 - DNA, 13 bp, Homo sapiens
aagctttttgaaa

SEQ ID NO: 376342 - DNA, 16 bp, Homo sapiens
aaggaaaaacagaaca

SEQ ID NO: 376343 - DNA, 23 bp, Homo sapiens
aaggaaaaacagaacatttctca

SEQ ID NO: 376344 - DNA, 14 bp, Homo sapiens
aaggaaaaggctgg

SEQ ID NO: 376345 - DNA, 16 bp, Homo sapiens
aaggaaagcaataaat

SEQ ID NO: 376346 - DNA, 16 bp, Homo sapiens
aagatttaatgttaca

SEQ ID NO: 376347 - DNA, 12 bp, Homo sapiens
aagatttattat

SEQ ID NO: 376348 - DNA, 23 bp, Homo sapiens
aagattttctgggcctaaaggat

SEQ ID NO: 376349 - DNA, 20 bp, Homo sapiens
aagcaaaaaatgaatgtcta

SEQ ID NO: 376350 - DNA, 14 bp, Homo sapiens
aagcaaacatcaaa

SEQ ID NO: 376351 - DNA, 18 bp, Homo sapiens
aagcaaacatcaaataaa

SEQ ID NO: 376352 - DNA, 14 bp, Homo sapiens
aagcaaaccttctc

SEQ ID NO: 376353 - DNA, 16 bp, Homo sapiens
aagcaaataccaaagc

SEQ ID NO: 376354 - DNA, 18 bp, Homo sapiens
aagcaaataccaaagcag

SEQ ID NO: 376355 - DNA, 17 bp, Homo sapiens
aagcaaatcagaaactt

SEQ ID NO: 376356 - DNA, 14 bp, Homo sapiens
aagcaaatcagaca

SEQ ID NO: 376357 - DNA, 20 bp, Homo sapiens
aagcaaatcccaacatttct

SEQ ID NO: 376358 - DNA, 20 bp, Homo sapiens
aagcaaatttctagatatga

SEQ ID NO: 376359 - DNA, 19 bp, Homo sapiens
aagcaacaaagagcgagtc

SEQ ID NO: 376360 - DNA, 15 bp, Homo sapiens
aagcaacaactttgt

SEQ ID NO: 376361 - DNA, 14 bp, Homo sapiens
aagcaacaggtttt

SEQ ID NO: 376362 - DNA, 16 bp, Homo sapiens
aagcaacgactacttt

SEQ ID NO: 376363 - DNA, 19 bp, Homo sapiens
aagcaagacgtcctggaat

SEQ ID NO: 376364 - DNA, 23 bp, Homo sapiens
aagcaagacgtcctggaatgaag

SEQ ID NO: 376365 - DNA, 16 bp, Homo sapiens
aagcaagtagctttcc

SEQ ID NO: 376366 - DNA, 14 bp, Homo sapiens
aagcaataaatgaa

SEQ ID NO: 376367 - DNA, 15 bp, Homo sapiens
aagcaataagttcat

SEQ ID NO: 376368 - DNA, 21 bp, Homo sapiens
aagcaataagttcattaaaca

SEQ ID NO: 376369 - DNA, 20 bp, Homo sapiens
aagcaattatttaaagaaag

SEQ ID NO: 376370 - DNA, 15 bp, Homo sapiens
aagcaattgccctgt

SEQ ID NO: 376371 - DNA, 16 bp, Homo sapiens
aagcacaaaccctggg

SEQ ID NO: 376372 - DNA, 11 bp, Homo sapiens
aagcacaggcc

SEQ ID NO: 376373 - DNA, 13 bp, Homo sapiens
aagcacagtgtta

SEQ ID NO: 376374 - DNA, 20 bp, Homo sapiens
aagcacagtgttaaatgaaa

SEQ ID NO: 376375 - DNA, 14 bp, Homo sapiens
aagcactattgttt

SEQ ID NO: 376376 - DNA, 19 bp, Homo sapiens
aagcagatggaatgctgtg

SEQ ID NO: 376377 - DNA, 10 bp, Homo sapiens
aagcagccag

SEQ ID NO: 376378 - DNA, 12 bp, Homo sapiens
aagcagccagcc

SEQ ID NO: 376379 - DNA, 17 bp, Homo sapiens
aagcagccagccagtct

SEQ ID NO: 376380 - DNA, 19 bp, Homo sapiens
aagcagcctttctgtggag

SEQ ID NO: 376381 - DNA, 21 bp, Homo sapiens
aagcaggaaagatcccaagtc

SEQ ID NO: 376382 - DNA, 15 bp, Homo sapiens
aagcaggagcagctg

SEQ ID NO: 376383 - DNA, 15 bp, Homo sapiens
aagcaggatggctgg

SEQ ID NO: 376384 - DNA, 16 bp, Homo sapiens
aagcaggcttgtgctt

SEQ ID NO: 376385 - DNA, 20 bp, Homo sapiens
aagcagggaaagctccacgg

SEQ ID NO: 376386 - DNA, 16 bp, Homo sapiens
aagcagggaatttcta

SEQ ID NO: 376387 - DNA, 18 bp, Homo sapiens
aagcaggtcagaagaggg

SEQ ID NO: 376388 - DNA, 19 bp, Homo sapiens
aagcagtctacccacctca

SEQ ID NO: 376389 - DNA, 20 bp, Homo sapiens
aagcagttaagccccctcct

SEQ ID NO: 376390 - DNA, 13 bp, Homo sapiens
aagcagttgggag

SEQ ID NO: 376391 - DNA, 21 bp, Homo sapiens
aagcagttgggagtacatatg

SEQ ID NO: 376392 - DNA, 15 bp, Homo sapiens
aagcagttgtgtcag

SEQ ID NO: 376393 - DNA, 17 bp, Homo sapiens
aagcatcagcaagacaa

SEQ ID NO: 376394 - DNA, 16 bp, Homo sapiens
aagcatgccaatttct

SEQ ID NO: 376395 - DNA, 19 bp, Homo sapiens
aagcatgccaatttctctt

SEQ ID NO: 376396 - DNA, 20 bp, Homo sapiens
aagcatgctcagtattgaga

SEQ ID NO: 376397 - DNA, 16 bp, Homo sapiens
aagcatgctttgctgc

SEQ ID NO: 376398 - DNA, 19 bp, Homo sapiens
aagcatgctttgctgctat

SEQ ID NO: 376399 - DNA, 20 bp, Homo sapiens
aagcatgctttgctgctatg

SEQ ID NO: 376400 - DNA, 15 bp, Homo sapiens
aagcatgtctctgct

SEQ ID NO: 376401 - DNA, 13 bp, Homo sapiens
aagcatgtggcat

SEQ ID NO: 376402 - DNA, 15 bp, Homo sapiens
aagcatgtttcatgt

SEQ ID NO: 376403 - DNA, 20 bp, Homo sapiens
aagcatgtttcatgttttgt

SEQ ID NO: 376404 - DNA, 17 bp, Homo sapiens
aagcattaacttctctg

SEQ ID NO: 376405 - DNA, 20 bp, Homo sapiens
aagcattccttagcagctca

SEQ ID NO: 376406 - DNA, 23 bp, Homo sapiens
aagcattccttagcagctcaggc

SEQ ID NO: 376407 - DNA, 16 bp, Homo sapiens
aagcattctgagctgg

SEQ ID NO: 376408 - DNA, 18 bp, Homo sapiens
aagcattgcagaacatga

SEQ ID NO: 376409 - DNA, 11 bp, Homo sapiens
aagcattgttt

SEQ ID NO: 376410 - DNA, 17 bp, Homo sapiens
aagcattttcagcatca

SEQ ID NO: 376411 - DNA, 21 bp, Homo sapiens
aagccaaaaaccttagctccc

SEQ ID NO: 376412 - DNA, 22 bp, Homo sapiens
aagccaagaagtgaggcctggg

SEQ ID NO: 376413 - DNA, 14 bp, Homo sapiens
aagccaagacagtg

SEQ ID NO: 376414 - DNA, 16 bp, Homo sapiens
aagccaagggcctctt

SEQ ID NO: 376415 - DNA, 15 bp, Homo sapiens
aagccacaaggctgg

SEQ ID NO: 376416 - DNA, 18 bp, Homo sapiens
aagccacaaggctggcca

SEQ ID NO: 376417 - DNA, 15 bp, Homo sapiens
aagccacataaccag

SEQ ID NO: 376418 - DNA, 17 bp, Homo sapiens
aagccacctctccctca

SEQ ID NO: 376419 - DNA, 20 bp, Homo sapiens
aagccacctctccctcaaca

SEQ ID NO: 376420 - DNA, 14 bp, Homo sapiens
aagccacgtgctgg

SEQ ID NO: 376421 - DNA, 19 bp, Homo sapiens
aagccacgtgctggagagt

SEQ ID NO: 376422 - DNA, 17 bp, Homo sapiens
aagccactagactcttc

SEQ ID NO: 376423 - DNA, 21 bp, Homo sapiens
aagccactcccgccacacgct

SEQ ID NO: 376424 - DNA, 17 bp, Homo sapiens
aagccactgttacattt

SEQ ID NO: 376425 - DNA, 21 bp, Homo sapiens
aagccagctgcagctgggctg

SEQ ID NO: 376426 - DNA, 12 bp, Homo sapiens
aagccaggagac

SEQ ID NO: 376427 - DNA, 20 bp, Homo sapiens
aagccaggagaccctgtctt

SEQ ID NO: 376428 - DNA, 12 bp, Homo sapiens
aagaatgtacat

SEQ ID NO: 376429 - DNA, 19 bp, Homo sapiens
aagaattctccaaaacaat

SEQ ID NO: 376430 - DNA, 12 bp, Homo sapiens
aagaattcttat

SEQ ID NO: 376431 - DNA, 22 bp, Homo sapiens
aagaattgctaaatataaaaac

SEQ ID NO: 376432 - DNA, 15 bp, Homo sapiens
aagaatttagggaga

SEQ ID NO: 376433 - DNA, 15 bp, Homo sapiens
aagaatttcaatttg

SEQ ID NO: 376434 - DNA, 14 bp, Homo sapiens
aagacaaagaagga

SEQ ID NO: 376435 - DNA, 19 bp, Homo sapiens
aagacaaatatttctttct

SEQ ID NO: 376436 - DNA, 13 bp, Homo sapiens
aagacaaatggga

SEQ ID NO: 376437 - DNA, 14 bp, Homo sapiens
aagacaacaggcat

SEQ ID NO: 376438 - DNA, 15 bp, Homo sapiens
aagacacacagcctt

SEQ ID NO: 376439 - DNA, 18 bp, Homo sapiens
aagacacacagcctttct

SEQ ID NO: 376440 - DNA, 23 bp, Homo sapiens
aagacacacaggagtcctttctt

SEQ ID NO: 376441 - DNA, 12 bp, Homo sapiens
aagacacccagt

SEQ ID NO: 376442 - DNA, 13 bp, Homo sapiens
aagacacgtgttt

SEQ ID NO: 376443 - DNA, 19 bp, Homo sapiens
aagacacgtgtttttgtat

SEQ ID NO: 376444 - DNA, 22 bp, Homo sapiens
aagacagaaggccttgaagaat

SEQ ID NO: 376445 - DNA, 20 bp, Homo sapiens
aagacagatgccccagagct

SEQ ID NO: 376446 - DNA, 19 bp, Homo sapiens
aagacagggaatagtggga

SEQ ID NO: 376447 - DNA, 16 bp, Homo sapiens
aagacatatctctaat

SEQ ID NO: 376448 - DNA, 21 bp, Homo sapiens
aagacatcaagatacacttgt

SEQ ID NO: 376449 - DNA, 18 bp, Homo sapiens
aagacatggagactcctg

SEQ ID NO: 376450 - DNA, 13 bp, Homo sapiens
aagacattgtcaa

SEQ ID NO: 376451 - DNA, 13 bp, Homo sapiens
aagacatttttat

SEQ ID NO: 376452 - DNA, 19 bp, Homo sapiens
aagaccaaaatgacaatga

SEQ ID NO: 376453 - DNA, 20 bp, Homo sapiens
aagaccagcctggccatcat

SEQ ID NO: 376454 - DNA, 20 bp, Homo sapiens
aagaccagtcacagccattt

SEQ ID NO: 376455 - DNA, 22 bp, Homo sapiens
aagaccccacccaagcttggca

SEQ ID NO: 376456 - DNA, 14 bp, Homo sapiens
aagacccctgctcc

SEQ ID NO: 376457 - DNA, 15 bp, Homo sapiens
aagaccctgagactc

SEQ ID NO: 376458 - DNA, 22 bp, Homo sapiens
aagaccgtgtcccaaggagctg

SEQ ID NO: 376459 - DNA, 15 bp, Homo sapiens
aagacctgcctgtgt

SEQ ID NO: 376460 - DNA, 21 bp, Homo sapiens
aagaccttctccaaatgagat

SEQ ID NO: 376461 - DNA, 14 bp, Homo sapiens
aagaccttctgaag

SEQ ID NO: 376462 - DNA, 17 bp, Homo sapiens
aagacgtggctctgggt

SEQ ID NO: 376463 - DNA, 15 bp, Homo sapiens
aagactaacctttgt

SEQ ID NO: 376464 - DNA, 23 bp, Homo sapiens
aagactagactactcaatattaa

SEQ ID NO: 376465 - DNA, 20 bp, Homo sapiens
aagactagaggcttgcataa

SEQ ID NO: 376466 - DNA, 19 bp, Homo sapiens
aagactcttacctacaaaa

SEQ ID NO: 376467 - DNA, 13 bp, Homo sapiens
aagactgaaagaa

SEQ ID NO: 376468 - DNA, 23 bp, Homo sapiens
aagactggagactgtccacttct

SEQ ID NO: 376469 - DNA, 13 bp, Homo sapiens
aagactgtactgg

SEQ ID NO: 376470 - DNA, 20 bp, Homo sapiens
aagactgtactggccagtgt

SEQ ID NO: 376471 - DNA, 13 bp, Homo sapiens
aagacttaagatt

SEQ ID NO: 376472 - DNA, 14 bp, Homo sapiens
aagacttaagatta

SEQ ID NO: 376473 - DNA, 20 bp, Homo sapiens
aagacttagatctgagccct

SEQ ID NO: 376474 - DNA, 15 bp, Homo sapiens
aagacttctagcaga

SEQ ID NO: 376475 - DNA, 14 bp, Homo sapiens
aagacttgatgaat

SEQ ID NO: 376476 - DNA, 20 bp, Homo sapiens
aagacttggcccaggaaaaa

SEQ ID NO: 376477 - DNA, 17 bp, Homo sapiens
aagacttgtttctttct

SEQ ID NO: 376478 - DNA, 12 bp, Homo sapiens
aagacttgtttt

SEQ ID NO: 376479 - DNA, 23 bp, Homo sapiens
aagactttccccatactctgtct

SEQ ID NO: 376480 - DNA, 23 bp, Homo sapiens
aagactttgatgtgtttttgtat

SEQ ID NO: 376481 - DNA, 12 bp, Homo sapiens
aagacttttctt

SEQ ID NO: 376482 - DNA, 20 bp, Homo sapiens
aagagaaaaaccaatgattc

SEQ ID NO: 376483 - DNA, 12 bp, Homo sapiens
aagagaaaagat

SEQ ID NO: 376484 - DNA, 11 bp, Homo sapiens
aagagaaatga

SEQ ID NO: 376485 - DNA, 20 bp, Homo sapiens
aagagaaatgaaatattttt

SEQ ID NO: 376486 - DNA, 18 bp, Homo sapiens
aagagaaatgaggaagaa

SEQ ID NO: 376487 - DNA, 13 bp, Homo sapiens
aagagaaggagat

SEQ ID NO: 376488 - DNA, 10 bp, Homo sapiens
aagagaatgt

SEQ ID NO: 376489 - DNA, 21 bp, Homo sapiens
aagagaattattacatcttta

SEQ ID NO: 376490 - DNA, 11 bp, Homo sapiens
aagagaattct

SEQ ID NO: 376491 - DNA, 15 bp, Homo sapiens
aagagacaaatagta

SEQ ID NO: 376492 - DNA, 19 bp, Homo sapiens
aagagacttaaaggacagg

SEQ ID NO: 376493 - DNA, 20 bp, Homo sapiens
aagagacttaaaggacagga

SEQ ID NO: 376494 - DNA, 20 bp, Homo sapiens
aagagacttctgcttttcaa

SEQ ID NO: 376495 - DNA, 14 bp, Homo sapiens
aagagagaaaataa

SEQ ID NO: 376496 - DNA, 13 bp, Homo sapiens
aagagagaatgta

SEQ ID NO: 376497 - DNA, 13 bp, Homo sapiens
aagagagcctgcc

SEQ ID NO: 376498 - DNA, 12 bp, Homo sapiens
aagagaggcacc

SEQ ID NO: 376499 - DNA, 17 bp, Homo sapiens
aagagaggcacctgctg

SEQ ID NO: 376500 - DNA, 11 bp, Homo sapiens
aagagaggtta

SEQ ID NO: 376501 - DNA, 13 bp, Homo sapiens
aagagatgctcta

SEQ ID NO: 376502 - DNA, 19 bp, Homo sapiens
aagagattaagaatattgc

SEQ ID NO: 376503 - DNA, 19 bp, Homo sapiens
aagagattctattaaaagc

SEQ ID NO: 376504 - DNA, 13 bp, Homo sapiens
aagagcagagtct

SEQ ID NO: 376505 - DNA, 19 bp, Homo sapiens
aagagcagagtctgggcct

SEQ ID NO: 376506 - DNA, 17 bp, Homo sapiens
aagagcagcctgtggca

SEQ ID NO: 376507 - DNA, 14 bp, Homo sapiens
aagagccaatggag

SEQ ID NO: 376508 - DNA, 9 bp, Homo sapiens
aagagccat

SEQ ID NO: 376509 - DNA, 17 bp, Homo sapiens
aagagcgctcctctgcc

SEQ ID NO: 376510 - DNA, 20 bp, Homo sapiens
aagagcgctcctctgccttg

SEQ ID NO: 376511 - DNA, 19 bp, Homo sapiens
aagagctcaggagaaggcc

SEQ ID NO: 376512 - DNA, 21 bp, Homo sapiens
aagagctgggtaccaggccac

SEQ ID NO: 376513 - DNA, 22 bp, Homo sapiens
aagagctgttttggatgaatgc

SEQ ID NO: 376514 - DNA, 23 bp, Homo sapiens
aagagctgttttggatgaatgca

SEQ ID NO: 376515 - DNA, 19 bp, Homo sapiens
aagaggaaaatattgacaa

SEQ ID NO: 376516 - DNA, 16 bp, Homo sapiens
aagaggaagccttgcc

SEQ ID NO: 376517 - DNA, 15 bp, Homo sapiens
aagaggccaatgccc

SEQ ID NO: 376518 - DNA, 21 bp, Homo sapiens
aagaggccagcgtgaaggacc

SEQ ID NO: 376519 - DNA, 13 bp, Homo sapiens
aagaggccttggg

SEQ ID NO: 376520 - DNA, 17 bp, Homo sapiens
aagaggctagccccagg

SEQ ID NO: 376521 - DNA, 18 bp, Homo sapiens
aagaggctagccccaggg

SEQ ID NO: 376522 - DNA, 15 bp, Homo sapiens
aagaggctgaggcct

SEQ ID NO: 376523 - DNA, 12 bp, Homo sapiens
aagagggagaag

SEQ ID NO: 376524 - DNA, 17 bp, Homo sapiens
aagagggagaagcatga

SEQ ID NO: 376525 - DNA, 21 bp, Homo sapiens
aagagggagccggtttgggag

SEQ ID NO: 376526 - DNA, 12 bp, Homo sapiens
aagagggcctgt

SEQ ID NO: 376527 - DNA, 17 bp, Homo sapiens
aagaggtgctgctttgc

SEQ ID NO: 376528 - DNA, 15 bp, Homo sapiens
aagaggttctcagca

SEQ ID NO: 376529 - DNA, 22 bp, Homo sapiens
aagaggttctcagcaagtgtac

SEQ ID NO: 376530 - DNA, 19 bp, Homo sapiens
aagaggttctcgactggag

SEQ ID NO: 376531 - DNA, 21 bp, Homo sapiens
aagagtaacactgaggcgctc

SEQ ID NO: 376532 - DNA, 21 bp, Homo sapiens
aagagtacaggtcttctttaa

SEQ ID NO: 376533 - DNA, 19 bp, Homo sapiens
aagagtagttgatgttgca

SEQ ID NO: 376534 - DNA, 22 bp, Homo sapiens
aagagtagttgatgttgcattt

SEQ ID NO: 376535 - DNA, 14 bp, Homo sapiens
aagagtatactttg

SEQ ID NO: 376536 - DNA, 16 bp, Homo sapiens
aagagtatgagaaata

SEQ ID NO: 376537 - DNA, 22 bp, Homo sapiens
aagagtatgagaaatacagtgc

SEQ ID NO: 376538 - DNA, 23 bp, Homo sapiens
aagagtatgagaaatacagtgct

SEQ ID NO: 376539 - DNA, 14 bp, Homo sapiens
aagagtatgtagtg

SEQ ID NO: 376540 - DNA, 20 bp, Homo sapiens
aagagtcctgaggcagaacc

SEQ ID NO: 376541 - DNA, 21 bp, Homo sapiens
aagagtcctgaggcagaacct

SEQ ID NO: 376542 - DNA, 23 bp, Homo sapiens
aagagtcctgaggcagaacctgg

SEQ ID NO: 376543 - DNA, 22 bp, Homo sapiens
aagagtgacagtggattgcatt

SEQ ID NO: 376544 - DNA, 18 bp, Homo sapiens
aagagtgactagtacaaa

SEQ ID NO: 376545 - DNA, 19 bp, Homo sapiens
aagagtggcatataatttt

SEQ ID NO: 376546 - DNA, 22 bp, Homo sapiens
aagagttatatgacttcttgtt

SEQ ID NO: 376547 - DNA, 20 bp, Homo sapiens
aagagttctatccccaagct

SEQ ID NO: 376548 - DNA, 21 bp, Homo sapiens
aagagttctatccccaagctg

SEQ ID NO: 376549 - DNA, 16 bp, Homo sapiens
aagagttgagcacagg

SEQ ID NO: 376550 - DNA, 20 bp, Homo sapiens
aagataaaaggataggaaaa

SEQ ID NO: 376551 - DNA, 12 bp, Homo sapiens
aagataaagatg

SEQ ID NO: 376552 - DNA, 14 bp, Homo sapiens
aagataaagatgat

SEQ ID NO: 376553 - DNA, 20 bp, Homo sapiens
aagataaatccaactctgac

SEQ ID NO: 376554 - DNA, 18 bp, Homo sapiens
aagataacgcaggagaga

SEQ ID NO: 376555 - DNA, 21 bp, Homo sapiens
aagataacgcaggagagagag

SEQ ID NO: 376556 - DNA, 20 bp, Homo sapiens
aagataatggataatcttcg

SEQ ID NO: 376557 - DNA, 16 bp, Homo sapiens
aagataatgttcttta

SEQ ID NO: 376558 - DNA, 19 bp, Homo sapiens
aagataattaaatgaaata

SEQ ID NO: 376559 - DNA, 18 bp, Homo sapiens
aagatacacaagagggac

SEQ ID NO: 376560 - DNA, 16 bp, Homo sapiens
aagatacactcctgct

SEQ ID NO: 376561 - DNA, 14 bp, Homo sapiens
aagatacatttgta

SEQ ID NO: 376562 - DNA, 16 bp, Homo sapiens
aacttaaataatttaa

SEQ ID NO: 376563 - DNA, 16 bp, Homo sapiens
aacttaacattgcatc

SEQ ID NO: 376564 - DNA, 18 bp, Homo sapiens
aacttaaccgcatcagaa

SEQ ID NO: 376565 - DNA, 22 bp, Homo sapiens
aacttaaccgcatcagaagcct

SEQ ID NO: 376566 - DNA, 21 bp, Homo sapiens
aacttaagtttagaaattaca

SEQ ID NO: 376567 - DNA, 20 bp, Homo sapiens
aacttaatgttctgaataat

SEQ ID NO: 376568 - DNA, 20 bp, Homo sapiens
aacttaattcaatgctttct

SEQ ID NO: 376569 - DNA, 23 bp, Homo sapiens
aacttacctaagtgacatttgta

SEQ ID NO: 376570 - DNA, 20 bp, Homo sapiens
aacttactatggtatatatt

SEQ ID NO: 376571 - DNA, 16 bp, Homo sapiens
aacttagtgtttagca

SEQ ID NO: 376572 - DNA, 23 bp, Homo sapiens
aacttagtttgtgaattgatttt

SEQ ID NO: 376573 - DNA, 13 bp, Homo sapiens
aacttagttttgt

SEQ ID NO: 376574 - DNA, 15 bp, Homo sapiens
aacttataaatcata

SEQ ID NO: 376575 - DNA, 21 bp, Homo sapiens
aacttatctagaaagaaaaga

SEQ ID NO: 376576 - DNA, 19 bp, Homo sapiens
aacttatttgagtgattat

SEQ ID NO: 376577 - DNA, 13 bp, Homo sapiens
aacttcaaagctg

SEQ ID NO: 376578 - DNA, 19 bp, Homo sapiens
aacttcaaagctgaatatt

SEQ ID NO: 376579 - DNA, 15 bp, Homo sapiens
aacttcaccaccccc

SEQ ID NO: 376580 - DNA, 12 bp, Homo sapiens
aacttcacctta

SEQ ID NO: 376581 - DNA, 14 bp, Homo sapiens
aacttcagagaagt

SEQ ID NO: 376582 - DNA, 11 bp, Homo sapiens
aacttcagcaa

SEQ ID NO: 376583 - DNA, 12 bp, Homo sapiens
aacttcagcaac

SEQ ID NO: 376584 - DNA, 15 bp, Homo sapiens
aacttcagtcctggg

SEQ ID NO: 376585 - DNA, 21 bp, Homo sapiens
aacttcattctaaaccaaaac

SEQ ID NO: 376586 - DNA, 14 bp, Homo sapiens
aacttcatttgatg

SEQ ID NO: 376587 - DNA, 21 bp, Homo sapiens
aacttccattctttcttcctc

SEQ ID NO: 376588 - DNA, 14 bp, Homo sapiens
aacttctaatatat

SEQ ID NO: 376589 - DNA, 16 bp, Homo sapiens
aacttctaatatattt

SEQ ID NO: 376590 - DNA, 16 bp, Homo sapiens
aacttctaattgccat

SEQ ID NO: 376591 - DNA, 21 bp, Homo sapiens
aacttctagttgctcttgctt

SEQ ID NO: 376592 - DNA, 19 bp, Homo sapiens
aacttctcgtagatgctgc

SEQ ID NO: 376593 - DNA, 23 bp, Homo sapiens
aacttctgtcccttgtttttgat

SEQ ID NO: 376594 - DNA, 20 bp, Homo sapiens
aacttgagatgtatgaaggc

SEQ ID NO: 376595 - DNA, 14 bp, Homo sapiens
aacttgaggacaca

SEQ ID NO: 376596 - DNA, 16 bp, Homo sapiens
aacttgaggacacatg

SEQ ID NO: 376597 - DNA, 15 bp, Homo sapiens
aacttgatttgcatg

SEQ ID NO: 376598 - DNA, 20 bp, Homo sapiens
aacttgatttgcatggattt

SEQ ID NO: 376599 - DNA, 14 bp, Homo sapiens
aacttgctgtgaaa

SEQ ID NO: 376600 - DNA, 14 bp, Homo sapiens
aacttgtaaataca

SEQ ID NO: 376601 - DNA, 19 bp, Homo sapiens
aacttgtgcttttgcaaaa

SEQ ID NO: 376602 - DNA, 21 bp, Homo sapiens
aacttgtgtactgataaaata

SEQ ID NO: 376603 - DNA, 21 bp, Homo sapiens
aactttaattctctttcaaag

SEQ ID NO: 376604 - DNA, 21 bp, Homo sapiens
aactttagaagtgcatttctg

SEQ ID NO: 376605 - DNA, 19 bp, Homo sapiens
aactttagggggtgggagg

SEQ ID NO: 376606 - DNA, 15 bp, Homo sapiens
aactttcacctcaga

SEQ ID NO: 376607 - DNA, 14 bp, Homo sapiens
aactttcagaactg

SEQ ID NO: 376608 - DNA, 20 bp, Homo sapiens
aactttccatgacagtagca

SEQ ID NO: 376609 - DNA, 14 bp, Homo sapiens
aactttcctcgcct

SEQ ID NO: 376610 - DNA, 14 bp, Homo sapiens
aactttctcttgta

SEQ ID NO: 376611 - DNA, 11 bp, Homo sapiens
aactttctgta

SEQ ID NO: 376612 - DNA, 21 bp, Homo sapiens
aactttgaggaggaagcagaa

SEQ ID NO: 376613 - DNA, 16 bp, Homo sapiens
aactttgctggaaaat

SEQ ID NO: 376614 - DNA, 11 bp, Homo sapiens
aactttgtcac

SEQ ID NO: 376615 - DNA, 20 bp, Homo sapiens
aactttgtcacttctgctgt

SEQ ID NO: 376616 - DNA, 16 bp, Homo sapiens
aactttgtgcctttga

SEQ ID NO: 376617 - DNA, 20 bp, Homo sapiens
aactttgtggatgtcttcct

SEQ ID NO: 376618 - DNA, 17 bp, Homo sapiens
aacttttataaattaaa

SEQ ID NO: 376619 - DNA, 21 bp, Homo sapiens
aacttttcttaaaaagttata

SEQ ID NO: 376620 - DNA, 18 bp, Homo sapiens
aagaaaaaaaaggcagta

SEQ ID NO: 376621 - DNA, 16 bp, Homo sapiens
aagaaaaaaaataaca

SEQ ID NO: 376622 - DNA, 18 bp, Homo sapiens
aagaaaaaaaataacaca

SEQ ID NO: 376623 - DNA, 12 bp, Homo sapiens
aagaaaaaaata

SEQ ID NO: 376624 - DNA, 24 bp, Homo sapiens
aagaaaaaaataattttatgaact

SEQ ID NO: 376625 - DNA, 19 bp, Homo sapiens
aagaaaaacatgtcatgta

SEQ ID NO: 376626 - DNA, 12 bp, Homo sapiens
aagaaaaaggaa

SEQ ID NO: 376627 - DNA, 13 bp, Homo sapiens
aagaaaaaggaaa

SEQ ID NO: 376628 - DNA, 9 bp, Homo sapiens
aagaaaaat

SEQ ID NO: 376629 - DNA, 14 bp, Homo sapiens
aagaaaacaacttc

SEQ ID NO: 376630 - DNA, 12 bp, Homo sapiens
aagaaaacatat

SEQ ID NO: 376631 - DNA, 13 bp, Homo sapiens
aagaaaacatata

SEQ ID NO: 376632 - DNA, 15 bp, Homo sapiens
aagaaaacatatatt

SEQ ID NO: 376633 - DNA, 22 bp, Homo sapiens
aaaggaaaaacagaacatttct

SEQ ID NO: 376634 - DNA, 21 bp, Homo sapiens
aaaggaaaactcaccatttca

SEQ ID NO: 376635 - DNA, 17 bp, Homo sapiens
aaaggaacacccggaaa

SEQ ID NO: 376636 - DNA, 12 bp, Homo sapiens
aaaggaagacta

SEQ ID NO: 376637 - DNA, 22 bp, Homo sapiens
aaaggaagacttggcccaggaa

SEQ ID NO: 376638 - DNA, 19 bp, Homo sapiens
aaaggaagagctaataaat

SEQ ID NO: 376639 - DNA, 19 bp, Homo sapiens
aaaggaataggtaggagac

SEQ ID NO: 376640 - DNA, 22 bp, Homo sapiens
aaaggaatataccacaccgagg

SEQ ID NO: 376641 - DNA, 12 bp, Homo sapiens
aaaggaatgcaa

SEQ ID NO: 376642 - DNA, 16 bp, Homo sapiens
aaaggacaaacagtga

SEQ ID NO: 376643 - DNA, 13 bp, Homo sapiens
aaaggactgacct

SEQ ID NO: 376644 - DNA, 16 bp, Homo sapiens
aaaggactgacctgcc

SEQ ID NO: 376645 - DNA, 16 bp, Homo sapiens
aaaggagcgggcaggg

SEQ ID NO: 376646 - DNA, 19 bp, Homo sapiens
aaaggatatttaagaaaat

SEQ ID NO: 376647 - DNA, 13 bp, Homo sapiens
aaaggatgaagaa

SEQ ID NO: 376648 - DNA, 16 bp, Homo sapiens
aaaggatgatttaaca

SEQ ID NO: 376649 - DNA, 22 bp, Homo sapiens
aaaggatggcagcctcagggct

SEQ ID NO: 376650 - DNA, 13 bp, Homo sapiens
aaaggattaagat

SEQ ID NO: 376651 - DNA, 19 bp, Homo sapiens
aaaggattaagatacactc

SEQ ID NO: 376652 - DNA, 18 bp, Homo sapiens
aaaggattttggaaaaga

SEQ ID NO: 376653 - DNA, 16 bp, Homo sapiens
aaaggcagagattggg

SEQ ID NO: 376654 - DNA, 20 bp, Homo sapiens
aaaggcctttgggatttgcc

SEQ ID NO: 376655 - DNA, 14 bp, Homo sapiens
aaaggctgaacata

SEQ ID NO: 376656 - DNA, 19 bp, Homo sapiens
aaaggctttggcaacagaa

SEQ ID NO: 376657 - DNA, 16 bp, Homo sapiens
aaagggaaaagggaga

SEQ ID NO: 376658 - DNA, 22 bp, Homo sapiens
aaagggacagcatgccccttgg

SEQ ID NO: 376659 - DNA, 18 bp, Homo sapiens
aaagggagccatgctctt

SEQ ID NO: 376660 - DNA, 17 bp, Homo sapiens
aaagggcagcccctccc

SEQ ID NO: 376661 - DNA, 19 bp, Homo sapiens
aaagggcagcccctcccca

SEQ ID NO: 376662 - DNA, 22 bp, Homo sapiens
aaagggcagcccctccccatgg

SEQ ID NO: 376663 - DNA, 23 bp, Homo sapiens
aaaggggagaaactgaaagtgtt

SEQ ID NO: 376664 - DNA, 15 bp, Homo sapiens
aaaggggctgctggg

SEQ ID NO: 376665 - DNA, 22 bp, Homo sapiens
aaagggggctattccctggaga

SEQ ID NO: 376666 - DNA, 14 bp, Homo sapiens
aaaggtaggtgcat

SEQ ID NO: 376667 - DNA, 16 bp, Homo sapiens
aaaggtcatattggaa

SEQ ID NO: 376668 - DNA, 18 bp, Homo sapiens
aaaggtcattgtggctat

SEQ ID NO: 376669 - DNA, 14 bp, Homo sapiens
aaaggtcctgccct

SEQ ID NO: 376670 - DNA, 15 bp, Homo sapiens
aaaggtcctgccctc

SEQ ID NO: 376671 - DNA, 16 bp, Homo sapiens
aaaggtgacccttctg

SEQ ID NO: 376672 - DNA, 15 bp, Homo sapiens
aaaggtgattaaata

SEQ ID NO: 376673 - DNA, 14 bp, Homo sapiens
aaaggtgattttcc

SEQ ID NO: 376674 - DNA, 11 bp, Homo sapiens
aaaggtgctca

SEQ ID NO: 376675 - DNA, 21 bp, Homo sapiens
aaaggtgctcaaagatgtact

SEQ ID NO: 376676 - DNA, 15 bp, Homo sapiens
aaaggttaacagtaa

SEQ ID NO: 376677 - DNA, 21 bp, Homo sapiens
aaaggttaacagtaaaaattt

SEQ ID NO: 376678 - DNA, 16 bp, Homo sapiens
aaaggttgaattaatt

SEQ ID NO: 376679 - DNA, 19 bp, Homo sapiens
aaaggtttcactgttcatg

SEQ ID NO: 376680 - DNA, 22 bp, Homo sapiens
aaaggtttcactgttcatgaat

SEQ ID NO: 376681 - DNA, 12 bp, Homo sapiens
aaagtaaaagag

SEQ ID NO: 376682 - DNA, 23 bp, Homo sapiens
aaagtaaagctaaaatgatttta

SEQ ID NO: 376683 - DNA, 18 bp, Homo sapiens
aaagtacaaagcatattt

SEQ ID NO: 376684 - DNA, 13 bp, Homo sapiens
aaagtacatagtg

SEQ ID NO: 376685 - DNA, 14 bp, Homo sapiens
aaagtactaaaact

SEQ ID NO: 376686 - DNA, 19 bp, Homo sapiens
aaagtactaaaactagata

SEQ ID NO: 376687 - DNA, 22 bp, Homo sapiens
aaagtatacttttgtttcaggg

SEQ ID NO: 376688 - DNA, 12 bp, Homo sapiens
aaagtatcatgc

SEQ ID NO: 376689 - DNA, 16 bp, Homo sapiens
aaagtatcatgcattc

SEQ ID NO: 376690 - DNA, 14 bp, Homo sapiens
aaagtattcttctt

SEQ ID NO: 376691 - DNA, 15 bp, Homo sapiens
aaagtcaattcatct

SEQ ID NO: 376692 - DNA, 23 bp, Homo sapiens
aaagtcacagccgtttgaatata

SEQ ID NO: 376693 - DNA, 21 bp, Homo sapiens
aaagtcatctttgagataatt

SEQ ID NO: 376694 - DNA, 23 bp, Homo sapiens
aaagtcatgaagctcagtttggc

SEQ ID NO: 376695 - DNA, 14 bp, Homo sapiens
aaagtcctcttccc

SEQ ID NO: 376696 - DNA, 15 bp, Homo sapiens
aaagtcgaattaata

SEQ ID NO: 376697 - DNA, 16 bp, Homo sapiens
aaagtctaaagtttac

SEQ ID NO: 376698 - DNA, 13 bp, Homo sapiens
aaagtctatgctt

SEQ ID NO: 376699 - DNA, 12 bp, Homo sapiens
aaagtctatttt

SEQ ID NO: 376700 - DNA, 21 bp, Homo sapiens
aaagtctatttttttaactga

SEQ ID NO: 376701 - DNA, 19 bp, Homo sapiens
aaagtctcaatgttccatt

SEQ ID NO: 376702 - DNA, 17 bp, Homo sapiens
aaagtctcctgtatcat

SEQ ID NO: 376703 - DNA, 19 bp, Homo sapiens
aaagtctgcattacattcc

SEQ ID NO: 376704 - DNA, 19 bp, Homo sapiens
aaagtcttaacaacagctt

SEQ ID NO: 376705 - DNA, 18 bp, Homo sapiens
aaagtcttgtgactagtg

SEQ ID NO: 376706 - DNA, 13 bp, Homo sapiens
aaagtgaagcaaa

SEQ ID NO: 376707 - DNA, 15 bp, Homo sapiens
aaagtgaataaaaat

SEQ ID NO: 376708 - DNA, 22 bp, Homo sapiens
aaagtgaatttgaatgaaaaat

SEQ ID NO: 376709 - DNA, 14 bp, Homo sapiens
aaagtgacacagca

SEQ ID NO: 376710 - DNA, 16 bp, Homo sapiens
aaagtgagatgggaag

SEQ ID NO: 376711 - DNA, 21 bp, Homo sapiens
aaagtgagatgggaagggctt

SEQ ID NO: 376712 - DNA, 21 bp, Homo sapiens
aaagtgcaattgcacaaatac

SEQ ID NO: 376713 - DNA, 21 bp, Homo sapiens
aaagtgcagcccttcctcctg

SEQ ID NO: 376714 - DNA, 12 bp, Homo sapiens
aaagtgctggga

SEQ ID NO: 376715 - DNA, 21 bp, Homo sapiens
aaagtgctttgctggagtcct

SEQ ID NO: 376716 - DNA, 23 bp, Homo sapiens
aaagtgctttgctggagtcctgt

SEQ ID NO: 376717 - DNA, 19 bp, Homo sapiens
aaagtggcaagaccaaaat

SEQ ID NO: 376718 - DNA, 17 bp, Homo sapiens
aaagtgtgttgttgctt

SEQ ID NO: 376719 - DNA, 19 bp, Homo sapiens
aaagtgttattttgtataa

SEQ ID NO: 376720 - DNA, 18 bp, Homo sapiens
aaagtgttggtctttcta

SEQ ID NO: 376721 - DNA, 17 bp, Homo sapiens
aaagtgtttatttttca

SEQ ID NO: 376722 - DNA, 22 bp, Homo sapiens
aaagttaaaaaaaataataaat

SEQ ID NO: 376723 - DNA, 12 bp, Homo sapiens
aaagttaaaagt

SEQ ID NO: 376724 - DNA, 14 bp, Homo sapiens
aaagttacagaaat

SEQ ID NO: 376725 - DNA, 15 bp, Homo sapiens
aaagttattttcaga

SEQ ID NO: 376726 - DNA, 22 bp, Homo sapiens
aaagttcatagggtctcttcag

SEQ ID NO: 376727 - DNA, 21 bp, Homo sapiens
aaagttccctacttcctgtga

SEQ ID NO: 376728 - DNA, 18 bp, Homo sapiens
aaagttgtgattccagat

SEQ ID NO: 376729 - DNA, 15 bp, Homo sapiens
aaagttgttttgatt

SEQ ID NO: 376730 - DNA, 13 bp, Homo sapiens
aaagtttaaatac

SEQ ID NO: 376731 - DNA, 18 bp, Homo sapiens
aaagtttacagtaaataa

SEQ ID NO: 376732 - DNA, 12 bp, Homo sapiens
aaagtttcaatg

SEQ ID NO: 376733 - DNA, 13 bp, Homo sapiens
aaagtttccatat

SEQ ID NO: 376734 - DNA, 22 bp, Homo sapiens
aaagtttccccaccagtgaatg

SEQ ID NO: 376735 - DNA, 12 bp, Homo sapiens
aaagttttcaga

SEQ ID NO: 376736 - DNA, 14 bp, Homo sapiens
aaagttttccagta

SEQ ID NO: 376737 - DNA, 16 bp, Homo sapiens
aaagttttccagtatt

SEQ ID NO: 376738 - DNA, 21 bp, Homo sapiens
aaagttttccatttttgtcag

SEQ ID NO: 376739 - DNA, 14 bp, Homo sapiens
aaataaaaagtgac

SEQ ID NO: 376740 - DNA, 19 bp, Homo sapiens
aaataaaaagtgacacagc

SEQ ID NO: 376741 - DNA, 13 bp, Homo sapiens
aaataaaaatatt

SEQ ID NO: 376742 - DNA, 16 bp, Homo sapiens
aaataaaaatattctc

SEQ ID NO: 376743 - DNA, 18 bp, Homo sapiens
aaataaaacgttatctca

SEQ ID NO: 376744 - DNA, 19 bp, Homo sapiens
aaataaaactaaggaaccc

SEQ ID NO: 376745 - DNA, 21 bp, Homo sapiens
aaataaaactaaggaaccctg

SEQ ID NO: 376746 - DNA, 15 bp, Homo sapiens
aaataaaactattta

SEQ ID NO: 376747 - DNA, 16 bp, Homo sapiens
aaataaaactatttaa

SEQ ID NO: 376748 - DNA, 11 bp, Homo sapiens
aaataaaagca

SEQ ID NO: 376749 - DNA, 13 bp, Homo sapiens
aaataaaataaac

SEQ ID NO: 376750 - DNA, 13 bp, Homo sapiens
aaataaaataacc

SEQ ID NO: 376751 - DNA, 12 bp, Homo sapiens
aaataaaataag

SEQ ID NO: 376752 - DNA, 13 bp, Homo sapiens
aaataaaataagt

SEQ ID NO: 376753 - DNA, 13 bp, Homo sapiens
aaataaaatactg

SEQ ID NO: 376754 - DNA, 11 bp, Homo sapiens
aaataaaatga

SEQ ID NO: 376755 - DNA, 17 bp, Homo sapiens
aaataaacgaaacattt

SEQ ID NO: 376756 - DNA, 21 bp, Homo sapiens
aaataaactagggttttggcc

SEQ ID NO: 376757 - DNA, 11 bp, Homo sapiens
aaataaactct

SEQ ID NO: 376758 - DNA, 12 bp, Homo sapiens
aaataaactctt

SEQ ID NO: 376759 - DNA, 14 bp, Homo sapiens
aaataaactcttca

SEQ ID NO: 376760 - DNA, 16 bp, Homo sapiens
aaataaactcttcaag

SEQ ID NO: 376761 - DNA, 16 bp, Homo sapiens
aaataaacttgacaaa

SEQ ID NO: 376762 - DNA, 23 bp, Homo sapiens
aactattaggaggaatgtgcttt

SEQ ID NO: 376763 - DNA, 20 bp, Homo sapiens
aactattagtattattaaca

SEQ ID NO: 376764 - DNA, 15 bp, Homo sapiens
aactattcagaggaa

SEQ ID NO: 376765 - DNA, 23 bp, Homo sapiens
aactattcaggagagtagaacag

SEQ ID NO: 376766 - DNA, 18 bp, Homo sapiens
aactatttaaaattggca

SEQ ID NO: 376767 - DNA, 20 bp, Homo sapiens
aactatttaaaattggcacc

SEQ ID NO: 376768 - DNA, 15 bp, Homo sapiens
aactcaaaaggagaa

SEQ ID NO: 376769 - DNA, 16 bp, Homo sapiens
aactcaaacacagaga

SEQ ID NO: 376770 - DNA, 14 bp, Homo sapiens
aactcaccatttca

SEQ ID NO: 376771 - DNA, 19 bp, Homo sapiens
aactcaccatttcatccat

SEQ ID NO: 376772 - DNA, 22 bp, Homo sapiens
aactcacccccaaggggcagtc

SEQ ID NO: 376773 - DNA, 17 bp, Homo sapiens
aactcaccgctcaccct

SEQ ID NO: 376774 - DNA, 21 bp, Homo sapiens
aactcacctaatgtttatgag

SEQ ID NO: 376775 - DNA, 22 bp, Homo sapiens
aactcacctgctggcccctcac

SEQ ID NO: 376776 - DNA, 14 bp, Homo sapiens
aactcagatcacta

SEQ ID NO: 376777 - DNA, 20 bp, Homo sapiens
aactcagatcactactgcag

SEQ ID NO: 376778 - DNA, 14 bp, Homo sapiens
aactcagcagttga

SEQ ID NO: 376779 - DNA, 20 bp, Homo sapiens
aactcagctattaagaaaat

SEQ ID NO: 376780 - DNA, 14 bp, Homo sapiens
aactcatcataaaa

SEQ ID NO: 376781 - DNA, 17 bp, Homo sapiens
aactcatctgttatcct

SEQ ID NO: 376782 - DNA, 19 bp, Homo sapiens
aactcatgactgagtctgg

SEQ ID NO: 376783 - DNA, 18 bp, Homo sapiens
aactccaaggcaaatgtc

SEQ ID NO: 376784 - DNA, 21 bp, Homo sapiens
aactccagccacccagccagg

SEQ ID NO: 376785 - DNA, 15 bp, Homo sapiens
aactccaggggcacc

SEQ ID NO: 376786 - DNA, 21 bp, Homo sapiens
aactccagtgttcccttctgg

SEQ ID NO: 376787 - DNA, 16 bp, Homo sapiens
aactccatacagcctc

SEQ ID NO: 376788 - DNA, 18 bp, Homo sapiens
aactccatgaccaggcca

SEQ ID NO: 376789 - DNA, 19 bp, Homo sapiens
aactccatgaccaggccac

SEQ ID NO: 376790 - DNA, 14 bp, Homo sapiens
aactcccagccacc

SEQ ID NO: 376791 - DNA, 16 bp, Homo sapiens
aactcccagccaccac

SEQ ID NO: 376792 - DNA, 21 bp, Homo sapiens
aactcccagccaccaccactg

SEQ ID NO: 376793 - DNA, 14 bp, Homo sapiens
aactcccaggacct

SEQ ID NO: 376794 - DNA, 21 bp, Homo sapiens
aactccctagttacccaccct

SEQ ID NO: 376795 - DNA, 16 bp, Homo sapiens
aactccgcccagcctc

SEQ ID NO: 376796 - DNA, 17 bp, Homo sapiens
aactccgcccagcctct

SEQ ID NO: 376797 - DNA, 17 bp, Homo sapiens
aactcctactgcttcct

SEQ ID NO: 376798 - DNA, 16 bp, Homo sapiens
aactcctgacagtctt

SEQ ID NO: 376799 - DNA, 17 bp, Homo sapiens
aactcctgattttgtag

SEQ ID NO: 376800 - DNA, 10 bp, Homo sapiens
aactcctgcc

SEQ ID NO: 376801 - DNA, 12 bp, Homo sapiens
aactcctgcctg

SEQ ID NO: 376802 - DNA, 18 bp, Homo sapiens
aactccttccatccttga

SEQ ID NO: 376803 - DNA, 12 bp, Homo sapiens
aactccttcctc

SEQ ID NO: 376804 - DNA, 13 bp, Homo sapiens
aactccttggcct

SEQ ID NO: 376805 - DNA, 16 bp, Homo sapiens
aactcgatgcactgac

SEQ ID NO: 376806 - DNA, 14 bp, Homo sapiens
aactcgtctgatgt

SEQ ID NO: 376807 - DNA, 15 bp, Homo sapiens
aactctacccctgct

SEQ ID NO: 376808 - DNA, 18 bp, Homo sapiens
aactctacccctgctccc

SEQ ID NO: 376809 - DNA, 19 bp, Homo sapiens
aactctaccctggtaggaa

SEQ ID NO: 376810 - DNA, 23 bp, Homo sapiens
aactctaccctggtaggaaagca

SEQ ID NO: 376811 - DNA, 14 bp, Homo sapiens
aactctatctgggc

SEQ ID NO: 376812 - DNA, 18 bp, Homo sapiens
aactctatctgggcctgg

SEQ ID NO: 376813 - DNA, 19 bp, Homo sapiens
aactctatctgggcctggg

SEQ ID NO: 376814 - DNA, 15 bp, Homo sapiens
aactctattttttac

SEQ ID NO: 376815 - DNA, 15 bp, Homo sapiens
aactctcaaaagtct

SEQ ID NO: 376816 - DNA, 13 bp, Homo sapiens
aactctcaggact

SEQ ID NO: 376817 - DNA, 15 bp, Homo sapiens
aactctccagtgcct

SEQ ID NO: 376818 - DNA, 19 bp, Homo sapiens
aactctccccagtgcctgc

SEQ ID NO: 376819 - DNA, 23 bp, Homo sapiens
aactctccccagtgcctgccact

SEQ ID NO: 376820 - DNA, 13 bp, Homo sapiens
aactctcctcttt

SEQ ID NO: 376821 - DNA, 19 bp, Homo sapiens
aactctgcatagacaaagg

SEQ ID NO: 376822 - DNA, 23 bp, Homo sapiens
aactctggccttggttcctccag

SEQ ID NO: 376823 - DNA, 19 bp, Homo sapiens
aactctggctccttctcca

SEQ ID NO: 376824 - DNA, 21 bp, Homo sapiens
aactctgtgcaggtgctgcct

SEQ ID NO: 376825 - DNA, 15 bp, Homo sapiens
aactctgttccccca

SEQ ID NO: 376826 - DNA, 19 bp, Homo sapiens
aactctgttcccccaccct

SEQ ID NO: 376827 - DNA, 21 bp, Homo sapiens
aactcttcaatctcttgcact

SEQ ID NO: 376828 - DNA, 21 bp, Homo sapiens
aactcttcagcctcattcact

SEQ ID NO: 376829 - DNA, 21 bp, Homo sapiens
aactcttcatcttaaactaca

SEQ ID NO: 376830 - DNA, 16 bp, Homo sapiens
aactcttgctcactcc

SEQ ID NO: 376831 - DNA, 14 bp, Homo sapiens
aactcttgtattgc

SEQ ID NO: 376832 - DNA, 21 bp, Homo sapiens
aactcttgtattgctccattt

SEQ ID NO: 376833 - DNA, 17 bp, Homo sapiens
aactgaaaactgtaaat

SEQ ID NO: 376834 - DNA, 13 bp, Homo sapiens
aactgaaaatgta

SEQ ID NO: 376835 - DNA, 17 bp, Homo sapiens
aactgaaaatgtaaatt

SEQ ID NO: 376836 - DNA, 17 bp, Homo sapiens
aactgaaagtgttttac

SEQ ID NO: 376837 - DNA, 20 bp, Homo sapiens
aactgaagacctccacatta

SEQ ID NO: 376838 - DNA, 17 bp, Homo sapiens
aactgaagcaaatacca

SEQ ID NO: 376839 - DNA, 15 bp, Homo sapiens
aactgaccctccctt

SEQ ID NO: 376840 - DNA, 15 bp, Homo sapiens
aactgactaaccatt

SEQ ID NO: 376841 - DNA, 20 bp, Homo sapiens
aactgactattcttgatgta

SEQ ID NO: 376842 - DNA, 13 bp, Homo sapiens
aactgacttctgc

SEQ ID NO: 376843 - DNA, 13 bp, Homo sapiens
aactgactttctc

SEQ ID NO: 376844 - DNA, 18 bp, Homo sapiens
aactgactttttcccccc

SEQ ID NO: 376845 - DNA, 19 bp, Homo sapiens
aactgactttttcccccca

SEQ ID NO: 376846 - DNA, 12 bp, Homo sapiens
aactgagagaag

SEQ ID NO: 376847 - DNA, 19 bp, Homo sapiens
aactgagccgtgcagctgg

SEQ ID NO: 376848 - DNA, 22 bp, Homo sapiens
aactgagccgtgcagctgggat

SEQ ID NO: 376849 - DNA, 14 bp, Homo sapiens
aactgagctcctct

SEQ ID NO: 376850 - DNA, 17 bp, Homo sapiens
aactgagctgccagtgg

SEQ ID NO: 376851 - DNA, 13 bp, Homo sapiens
aactgaggcccag

SEQ ID NO: 376852 - DNA, 16 bp, Homo sapiens
aactgatgatagactt

SEQ ID NO: 376853 - DNA, 17 bp, Homo sapiens
aactgatggaccgggtg

SEQ ID NO: 376854 - DNA, 23 bp, Homo sapiens
aactgcaaattgtagcccagttg

SEQ ID NO: 376855 - DNA, 22 bp, Homo sapiens
aactgcaatagagactgtagat

SEQ ID NO: 376856 - DNA, 17 bp, Homo sapiens
aactgcacacacagctc

SEQ ID NO: 376857 - DNA, 14 bp, Homo sapiens
aactgcacagtgct

SEQ ID NO: 376858 - DNA, 16 bp, Homo sapiens
aactgcacagtgctgt

SEQ ID NO: 376859 - DNA, 18 bp, Homo sapiens
aactgcacagtgctgttg

SEQ ID NO: 376860 - DNA, 21 bp, Homo sapiens
aactgcatggacctaacattc

SEQ ID NO: 376861 - DNA, 18 bp, Homo sapiens
aactgcatgtataaatga

SEQ ID NO: 376862 - DNA, 16 bp, Homo sapiens
aactgcccccaacttt

SEQ ID NO: 376863 - DNA, 14 bp, Homo sapiens
aactgcccccactg

SEQ ID NO: 376864 - DNA, 21 bp, Homo sapiens
aactgcccttttaaatggcat

SEQ ID NO: 376865 - DNA, 10 bp, Homo sapiens
aactgctgag

SEQ ID NO: 376866 - DNA, 12 bp, Homo sapiens
aactgctgagcc

SEQ ID NO: 376867 - DNA, 13 bp, Homo sapiens
aactgctgagcca

SEQ ID NO: 376868 - DNA, 21 bp, Homo sapiens
aactgctgttttatgtcatac

SEQ ID NO: 376869 - DNA, 19 bp, Homo sapiens
aactggaacggtgaaggtg

SEQ ID NO: 376870 - DNA, 13 bp, Homo sapiens
aactggccccagg

SEQ ID NO: 376871 - DNA, 16 bp, Homo sapiens
aactgggaagatgctg

SEQ ID NO: 376872 - DNA, 23 bp, Homo sapiens
aactggggtgatgttttactttt

SEQ ID NO: 376873 - DNA, 15 bp, Homo sapiens
aactgtaaaatactt

SEQ ID NO: 376874 - DNA, 13 bp, Homo sapiens
aactgtaaataca

SEQ ID NO: 376875 - DNA, 16 bp, Homo sapiens
aactgtagaaatgatg

SEQ ID NO: 376876 - DNA, 17 bp, Homo sapiens
aactgtatcaaatctgt

SEQ ID NO: 376877 - DNA, 14 bp, Homo sapiens
aactgtatgtctta

SEQ ID NO: 376878 - DNA, 23 bp, Homo sapiens
aactgtatgtcttataagaaaac

SEQ ID NO: 376879 - DNA, 17 bp, Homo sapiens
aactgtcccacaaaata

SEQ ID NO: 376880 - DNA, 21 bp, Homo sapiens
aactgtcctctttcagaaaac

SEQ ID NO: 376881 - DNA, 19 bp, Homo sapiens
aactgtgaagtttacattg

SEQ ID NO: 376882 - DNA, 15 bp, Homo sapiens
aactgtgacaggaag

SEQ ID NO: 376883 - DNA, 17 bp, Homo sapiens
aactgtgacattccaca

SEQ ID NO: 376884 - DNA, 22 bp, Homo sapiens
aactgtgtaactgcccaaagca

SEQ ID NO: 376885 - DNA, 15 bp, Homo sapiens
aactgttagatgctg

SEQ ID NO: 376886 - DNA, 21 bp, Homo sapiens
aactgttctctattagacttt

SEQ ID NO: 376887 - DNA, 21 bp, Homo sapiens
aactgttctggcctcagacca

SEQ ID NO: 376888 - DNA, 17 bp, Homo sapiens
aactgttggataataac

SEQ ID NO: 376889 - DNA, 15 bp, Homo sapiens
aactgttggctgctc

SEQ ID NO: 376890 - DNA, 18 bp, Homo sapiens
aactgttgtttgatgtgt

SEQ ID NO: 376891 - DNA, 19 bp, Homo sapiens
aactgttgtttgatgtgta

SEQ ID NO: 376892 - DNA, 14 bp, Homo sapiens
aactgtttttgaag

SEQ ID NO: 376893 - DNA, 13 bp, Homo sapiens
aacttaaaaatgt

SEQ ID NO: 376894 - DNA, 21 bp, Homo sapiens
aacttaaaaatgtaaatattc

SEQ ID NO: 376895 - DNA, 14 bp, Homo sapiens
aacttaaataattt

SEQ ID NO: 376896 - DNA, 14 bp, Homo sapiens
aacccccctcccca

SEQ ID NO: 376897 - DNA, 20 bp, Homo sapiens
aaccccgcggtgctctggcg

SEQ ID NO: 376898 - DNA, 21 bp, Homo sapiens
aaccccgcggtgctctggcgg

SEQ ID NO: 376899 - DNA, 12 bp, Homo sapiens
aacccctgcctg

SEQ ID NO: 376900 - DNA, 17 bp, Homo sapiens
aacccctgtacccagct

SEQ ID NO: 376901 - DNA, 15 bp, Homo sapiens
aaccctataaaagtg

SEQ ID NO: 376902 - DNA, 21 bp, Homo sapiens
aaccctccacctcctctcttg

SEQ ID NO: 376903 - DNA, 13 bp, Homo sapiens
aaccctccctcag

SEQ ID NO: 376904 - DNA, 15 bp, Homo sapiens
aaccctccctcagcc

SEQ ID NO: 376905 - DNA, 16 bp, Homo sapiens
aaccctccctcagccc

SEQ ID NO: 376906 - DNA, 17 bp, Homo sapiens
aaccctccctcagcccc

SEQ ID NO: 376907 - DNA, 18 bp, Homo sapiens
aaccctccctcagcccct

SEQ ID NO: 376908 - DNA, 15 bp, Homo sapiens
aaccctgccctgcac

SEQ ID NO: 376909 - DNA, 15 bp, Homo sapiens
aaccctgcttctgct

SEQ ID NO: 376910 - DNA, 22 bp, Homo sapiens
aaccctgcttctgctgccctga

SEQ ID NO: 376911 - DNA, 16 bp, Homo sapiens
aacccttttggccccc

SEQ ID NO: 376912 - DNA, 23 bp, Homo sapiens
aaccgagccagcagctgaagtct

SEQ ID NO: 376913 - DNA, 13 bp, Homo sapiens
aaccgatgctcca

SEQ ID NO: 376914 - DNA, 17 bp, Homo sapiens
aaccgatgctccagcca

SEQ ID NO: 376915 - DNA, 22 bp, Homo sapiens
aaccgcatctgctcatctgata

SEQ ID NO: 376916 - DNA, 15 bp, Homo sapiens
aaccggcaacctgta

SEQ ID NO: 376917 - DNA, 16 bp, Homo sapiens
aaccggcaacctgtaa

SEQ ID NO: 376918 - DNA, 18 bp, Homo sapiens
aaccggcaacctgtaact

SEQ ID NO: 376919 - DNA, 15 bp, Homo sapiens
aaccgggaaaggcat

SEQ ID NO: 376920 - DNA, 23 bp, Homo sapiens
aaccgtgagcaggaaggcctggg

SEQ ID NO: 376921 - DNA, 19 bp, Homo sapiens
aaccgtgcaacgtgtaact

SEQ ID NO: 376922 - DNA, 22 bp, Homo sapiens
aacctaaataaacacatagatt

SEQ ID NO: 376923 - DNA, 22 bp, Homo sapiens
aacctaaatttggttctaggcc

SEQ ID NO: 376924 - DNA, 15 bp, Homo sapiens
aacctacctgtgaat

SEQ ID NO: 376925 - DNA, 15 bp, Homo sapiens
aacctagatgtttaa

SEQ ID NO: 376926 - DNA, 22 bp, Homo sapiens
aacctaggatggatagaaggaa

SEQ ID NO: 376927 - DNA, 21 bp, Homo sapiens
aacctagtactctctgctcta

SEQ ID NO: 376928 - DNA, 14 bp, Homo sapiens
aacctatttgactg

SEQ ID NO: 376929 - DNA, 15 bp, Homo sapiens
aacctcaatgccctg

SEQ ID NO: 376930 - DNA, 23 bp, Homo sapiens
aacctcactgccctccctcggcc

SEQ ID NO: 376931 - DNA, 22 bp, Homo sapiens
aacctcagacttaccaggaagc

SEQ ID NO: 376932 - DNA, 21 bp, Homo sapiens
aacctcagctctgggagagga

SEQ ID NO: 376933 - DNA, 16 bp, Homo sapiens
aacctcaggttccaaa

SEQ ID NO: 376934 - DNA, 13 bp, Homo sapiens
aacctcagtgtca

SEQ ID NO: 376935 - DNA, 18 bp, Homo sapiens
aacctcagtgtcatttat

SEQ ID NO: 376936 - DNA, 19 bp, Homo sapiens
aacctcagtgtcatttatg

SEQ ID NO: 376937 - DNA, 11 bp, Homo sapiens
aacctcattaa

SEQ ID NO: 376938 - DNA, 19 bp, Homo sapiens
aacctcggcttgtgggctg

SEQ ID NO: 376939 - DNA, 23 bp, Homo sapiens
aacctctatatctttaaataaat

SEQ ID NO: 376940 - DNA, 15 bp, Homo sapiens
aacctctcagatccc

SEQ ID NO: 376941 - DNA, 19 bp, Homo sapiens
aacctctcagatccctcgg

SEQ ID NO: 376942 - DNA, 18 bp, Homo sapiens
aacctctttcctctctgg

SEQ ID NO: 376943 - DNA, 11 bp, Homo sapiens
aacctgaaaaa

SEQ ID NO: 376944 - DNA, 21 bp, Homo sapiens
aacctgaaaaaaagtttacaa

SEQ ID NO: 376945 - DNA, 17 bp, Homo sapiens
aacctgcacttcatatc

SEQ ID NO: 376946 - DNA, 17 bp, Homo sapiens
aacctgcagttcctgag

SEQ ID NO: 376947 - DNA, 15 bp, Homo sapiens
aacctgccacaatgt

SEQ ID NO: 376948 - DNA, 17 bp, Homo sapiens
aacctgccacaatgtga

SEQ ID NO: 376949 - DNA, 22 bp, Homo sapiens
aacctgcccctccccagccctt

SEQ ID NO: 376950 - DNA, 15 bp, Homo sapiens
aacctgccctgcctg

SEQ ID NO: 376951 - DNA, 15 bp, Homo sapiens
aacctgctctcctct

SEQ ID NO: 376952 - DNA, 20 bp, Homo sapiens
aacctgctctcctcttgcca

SEQ ID NO: 376953 - DNA, 22 bp, Homo sapiens
aacctggctgcgaactgtgcag

SEQ ID NO: 376954 - DNA, 23 bp, Homo sapiens
aacctggtcacaggactctgcct

SEQ ID NO: 376955 - DNA, 16 bp, Homo sapiens
aacctgtaaattattt

SEQ ID NO: 376956 - DNA, 17 bp, Homo sapiens
aacctgtaaattatttt

SEQ ID NO: 376957 - DNA, 14 bp, Homo sapiens
aacctgtaactgcc

SEQ ID NO: 376958 - DNA, 12 bp, Homo sapiens
aacctgtgtctc

SEQ ID NO: 376959 - DNA, 18 bp, Homo sapiens
aacctgttcaaaatgtta

SEQ ID NO: 376960 - DNA, 19 bp, Homo sapiens
aaccttaaagcaataagtt

SEQ ID NO: 376961 - DNA, 13 bp, Homo sapiens
aaccttcctgtct

SEQ ID NO: 376962 - DNA, 23 bp, Homo sapiens
aaccttctgcccatcctgtctgt

SEQ ID NO: 376963 - DNA, 16 bp, Homo sapiens
aaccttgagacagctt

SEQ ID NO: 376964 - DNA, 17 bp, Homo sapiens
aaccttgtttctttctg

SEQ ID NO: 376965 - DNA, 14 bp, Homo sapiens
aacctttattcttt

SEQ ID NO: 376966 - DNA, 18 bp, Homo sapiens
aacctttcaaatttcaca

SEQ ID NO: 376967 - DNA, 15 bp, Homo sapiens
aacctttgtgtaata

SEQ ID NO: 376968 - DNA, 22 bp, Homo sapiens
aaccttttaaaaaaataatata

SEQ ID NO: 376969 - DNA, 23 bp, Homo sapiens
aaccttttatcaataaagcacta

SEQ ID NO: 376970 - DNA, 16 bp, Homo sapiens
aaccttttgagtgcct

SEQ ID NO: 376971 - DNA, 18 bp, Homo sapiens
aacctttttttttgaaac

SEQ ID NO: 376972 - DNA, 15 bp, Homo sapiens
aacgaaactgctcta

SEQ ID NO: 376973 - DNA, 13 bp, Homo sapiens
aacgaagaaaaaa

SEQ ID NO: 376974 - DNA, 14 bp, Homo sapiens
aacgagcactggcc

SEQ ID NO: 376975 - DNA, 16 bp, Homo sapiens
aacgagcactggccag

SEQ ID NO: 376976 - DNA, 17 bp, Homo sapiens
aacgatcatatctgtat

SEQ ID NO: 376977 - DNA, 22 bp, Homo sapiens
aacgatgatgcttgtaacaaga

SEQ ID NO: 376978 - DNA, 12 bp, Homo sapiens
aacgatttagaa

SEQ ID NO: 376979 - DNA, 12 bp, Homo sapiens
aacgcagccctg

SEQ ID NO: 376980 - DNA, 14 bp, Homo sapiens
aacgcaggagagag

SEQ ID NO: 376981 - DNA, 16 bp, Homo sapiens
aacgcaggagagagag

SEQ ID NO: 376982 - DNA, 21 bp, Homo sapiens
aacgcatggagtgtgtattgt

SEQ ID NO: 376983 - DNA, 23 bp, Homo sapiens
aacgcatggagtgtgtattgttc

SEQ ID NO: 376984 - DNA, 15 bp, Homo sapiens
aacgccagtctccca

SEQ ID NO: 376985 - DNA, 20 bp, Homo sapiens
aacgccagtctcccaggccc

SEQ ID NO: 376986 - DNA, 20 bp, Homo sapiens
aacgcctgccttctgggcaa

SEQ ID NO: 376987 - DNA, 12 bp, Homo sapiens
aacgggttgtgt

SEQ ID NO: 376988 - DNA, 23 bp, Homo sapiens
aacggtgaaatctctagcctctt

SEQ ID NO: 376989 - DNA, 18 bp, Homo sapiens
aacgtcattcagtactta

SEQ ID NO: 376990 - DNA, 15 bp, Homo sapiens
aacgtccatctctct

SEQ ID NO: 376991 - DNA, 15 bp, Homo sapiens
aacgtgatgatcagc

SEQ ID NO: 376992 - DNA, 23 bp, Homo sapiens
aacgtgatgtgctcatcagaaac

SEQ ID NO: 376993 - DNA, 13 bp, Homo sapiens
aacgtgccctctg

SEQ ID NO: 376994 - DNA, 23 bp, Homo sapiens
aacgtgggagttcagctgcttct

SEQ ID NO: 376995 - DNA, 18 bp, Homo sapiens
aacgtggggcagcacaga

SEQ ID NO: 376996 - DNA, 23 bp, Homo sapiens
aacgtggttcagagactggcagc

SEQ ID NO: 376997 - DNA, 17 bp, Homo sapiens
aacgtgtatagtgccta

SEQ ID NO: 376998 - DNA, 16 bp, Homo sapiens
aacgttaaaagacagt

SEQ ID NO: 376999 - DNA, 18 bp, Homo sapiens
aacgttttgtttgaaaaa

SEQ ID NO: 377000 - DNA, 16 bp, Homo sapiens
aactaaaattcaacaa

SEQ ID NO: 377001 - DNA, 12 bp, Homo sapiens
aactaaagaata

SEQ ID NO: 377002 - DNA, 18 bp, Homo sapiens
aactaaagtatttaaaga

SEQ ID NO: 377003 - DNA, 19 bp, Homo sapiens
aactaaataacacagatat

SEQ ID NO: 377004 - DNA, 20 bp, Homo sapiens
aactaaatagatttttagat

SEQ ID NO: 377005 - DNA, 16 bp, Homo sapiens
aactaacaatgccttg

SEQ ID NO: 377006 - DNA, 15 bp, Homo sapiens
aactaagcaagtata

SEQ ID NO: 377007 - DNA, 21 bp, Homo sapiens
aactaagttttgtgtgtatat

SEQ ID NO: 377008 - DNA, 20 bp, Homo sapiens
aactaatgtgatatgaaaat

SEQ ID NO: 377009 - DNA, 23 bp, Homo sapiens
aactaatttgaatgtggttactt

SEQ ID NO: 377010 - DNA, 20 bp, Homo sapiens
aactaatttggtttttactc

SEQ ID NO: 377011 - DNA, 15 bp, Homo sapiens
aactacatttatgag

SEQ ID NO: 377012 - DNA, 18 bp, Homo sapiens
aactactaagaataaata

SEQ ID NO: 377013 - DNA, 13 bp, Homo sapiens
aactactgtacat

SEQ ID NO: 377014 - DNA, 14 bp, Homo sapiens
aactactgtacatt

SEQ ID NO: 377015 - DNA, 16 bp, Homo sapiens
aactactgtacatttt

SEQ ID NO: 377016 - DNA, 15 bp, Homo sapiens
aactactgtgttcct

SEQ ID NO: 377017 - DNA, 19 bp, Homo sapiens
aactagaatttattcaatt

SEQ ID NO: 377018 - DNA, 22 bp, Homo sapiens
aactagataacttaaataattt

SEQ ID NO: 377019 - DNA, 17 bp, Homo sapiens
aactagatctcctattt

SEQ ID NO: 377020 - DNA, 20 bp, Homo sapiens
aactagatctcctatttttc

SEQ ID NO: 377021 - DNA, 23 bp, Homo sapiens
aactagatctcctatttttcaga

SEQ ID NO: 377022 - DNA, 14 bp, Homo sapiens
aactagcctcatct

SEQ ID NO: 377023 - DNA, 17 bp, Homo sapiens
aactagggttttggcct

SEQ ID NO: 377024 - DNA, 19 bp, Homo sapiens
aactagggttttggcctgc

SEQ ID NO: 377025 - DNA, 21 bp, Homo sapiens
aactagtgtttctgcagaggc

SEQ ID NO: 377026 - DNA, 16 bp, Homo sapiens
aactagttaaaagcct

SEQ ID NO: 377027 - DNA, 21 bp, Homo sapiens
aactatatttggagaaaacag

SEQ ID NO: 377028 - DNA, 20 bp, Homo sapiens
aactatggttcccaataaaa

SEQ ID NO: 377029 - DNA, 19 bp, Homo sapiens
aacagttgtaccactgcta

SEQ ID NO: 377030 - DNA, 22 bp, Homo sapiens
aacagttgtgaaccaagatcta

SEQ ID NO: 377031 - DNA, 22 bp, Homo sapiens
aacagtttatgcagtgctgctt

SEQ ID NO: 377032 - DNA, 11 bp, Homo sapiens
aacagttttcc

SEQ ID NO: 377033 - DNA, 14 bp, Homo sapiens
aacagttttccatg

SEQ ID NO: 377034 - DNA, 16 bp, Homo sapiens
aacagttttccatgaa

SEQ ID NO: 377035 - DNA, 21 bp, Homo sapiens
aacagttttttatgctaatca

SEQ ID NO: 377036 - DNA, 15 bp, Homo sapiens
aacataaaagtgcta

SEQ ID NO: 377037 - DNA, 14 bp, Homo sapiens
aacataaaatgagg

SEQ ID NO: 377038 - DNA, 18 bp, Homo sapiens
aacataaagaaacacttt

SEQ ID NO: 377039 - DNA, 15 bp, Homo sapiens
aacataacaaccttt

SEQ ID NO: 377040 - DNA, 15 bp, Homo sapiens
aacataatagaattt

SEQ ID NO: 377041 - DNA, 23 bp, Homo sapiens
aacataatagaatttcctaatga

SEQ ID NO: 377042 - DNA, 12 bp, Homo sapiens
aacataattaaa

SEQ ID NO: 377043 - DNA, 18 bp, Homo sapiens
aacatagagtagacctga

SEQ ID NO: 377044 - DNA, 17 bp, Homo sapiens
aacatagcccctgcccc

SEQ ID NO: 377045 - DNA, 19 bp, Homo sapiens
aacatataaattaatacat

SEQ ID NO: 377046 - DNA, 22 bp, Homo sapiens
aacatataaattaatacataag

SEQ ID NO: 377047 - DNA, 14 bp, Homo sapiens
aacatataatatat

SEQ ID NO: 377048 - DNA, 21 bp, Homo sapiens
aacatataatatatgttttaa

SEQ ID NO: 377049 - DNA, 21 bp, Homo sapiens
aacatataatgttgttattta

SEQ ID NO: 377050 - DNA, 13 bp, Homo sapiens
aacatatatgaaa

SEQ ID NO: 377051 - DNA, 17 bp, Homo sapiens
aacatatgaaaatacaa

SEQ ID NO: 377052 - DNA, 16 bp, Homo sapiens
aacatatgtacataaa

SEQ ID NO: 377053 - DNA, 20 bp, Homo sapiens
aacatatttcttgagtaatt

SEQ ID NO: 377054 - DNA, 22 bp, Homo sapiens
aacatatttcttgagtaattta

SEQ ID NO: 377055 - DNA, 13 bp, Homo sapiens
aacatcaaataaa

SEQ ID NO: 377056 - DNA, 15 bp, Homo sapiens
aacatcaaataaatt

SEQ ID NO: 377057 - DNA, 17 bp, Homo sapiens
aacatcaaataaatttc

SEQ ID NO: 377058 - DNA, 17 bp, Homo sapiens
aacatcaagataccttt

SEQ ID NO: 377059 - DNA, 13 bp, Homo sapiens
aacatcaatgttc

SEQ ID NO: 377060 - DNA, 19 bp, Homo sapiens
aacatcatcaggcttggaa

SEQ ID NO: 377061 - DNA, 17 bp, Homo sapiens
aacatccatataggatt

SEQ ID NO: 377062 - DNA, 17 bp, Homo sapiens
aacatcccaataaagtc

SEQ ID NO: 377063 - DNA, 22 bp, Homo sapiens
aacatcctatcaacaacaaggt

SEQ ID NO: 377064 - DNA, 12 bp, Homo sapiens
aacatctgaaaa

SEQ ID NO: 377065 - DNA, 13 bp, Homo sapiens
aacatctgaaaag

SEQ ID NO: 377066 - DNA, 14 bp, Homo sapiens
aacatctgaaaaga

SEQ ID NO: 377067 - DNA, 13 bp, Homo sapiens
aacatcttcatat

SEQ ID NO: 377068 - DNA, 17 bp, Homo sapiens
aacatcttcatataaac

SEQ ID NO: 377069 - DNA, 18 bp, Homo sapiens
aacatctttttcctccct

SEQ ID NO: 377070 - DNA, 21 bp, Homo sapiens
aacatgaaaaacacggcagct

SEQ ID NO: 377071 - DNA, 12 bp, Homo sapiens
aacatgaaaaca

SEQ ID NO: 377072 - DNA, 20 bp, Homo sapiens
aacatgaaaacattgatgaa

SEQ ID NO: 377073 - DNA, 21 bp, Homo sapiens
aacatgaaaacattgatgaat

SEQ ID NO: 377074 - DNA, 14 bp, Homo sapiens
aacatgaagaatgc

SEQ ID NO: 377075 - DNA, 22 bp, Homo sapiens
aacatgaattaagaactgacac

SEQ ID NO: 377076 - DNA, 15 bp, Homo sapiens
aacatgaatttaatg

SEQ ID NO: 377077 - DNA, 12 bp, Homo sapiens
aacatgagtgtc

SEQ ID NO: 377078 - DNA, 14 bp, Homo sapiens
aacatgctgtgtaa

SEQ ID NO: 377079 - DNA, 19 bp, Homo sapiens
aacatgctgtgtaagctgt

SEQ ID NO: 377080 - DNA, 15 bp, Homo sapiens
aacatggattccaaa

SEQ ID NO: 377081 - DNA, 22 bp, Homo sapiens
aacatggccaatagtcatatgt

SEQ ID NO: 377082 - DNA, 23 bp, Homo sapiens
aacatggcctttgcttgaaagaa

SEQ ID NO: 377083 - DNA, 22 bp, Homo sapiens
aacatgggcattgggttctaaa

SEQ ID NO: 377084 - DNA, 23 bp, Homo sapiens
aacatggggttggctgggcccag

SEQ ID NO: 377085 - DNA, 21 bp, Homo sapiens
aacatggtgtgtgtctctgac

SEQ ID NO: 377086 - DNA, 12 bp, Homo sapiens
aacatgtatgtg

SEQ ID NO: 377087 - DNA, 14 bp, Homo sapiens
aacattaaaagaag

SEQ ID NO: 377088 - DNA, 11 bp, Homo sapiens
aacattaaaca

SEQ ID NO: 377089 - DNA, 13 bp, Homo sapiens
aacattaaacact

SEQ ID NO: 377090 - DNA, 16 bp, Homo sapiens
aacattagaagaaaac

SEQ ID NO: 377091 - DNA, 15 bp, Homo sapiens
aacattcaaaagcac

SEQ ID NO: 377092 - DNA, 20 bp, Homo sapiens
aacattcacacagggctctt

SEQ ID NO: 377093 - DNA, 22 bp, Homo sapiens
aacattcatatttgcaataaaa

SEQ ID NO: 377094 - DNA, 20 bp, Homo sapiens
aacattcctcatgaatgtaa

SEQ ID NO: 377095 - DNA, 22 bp, Homo sapiens
aacattcctcatgaatgtaaat

SEQ ID NO: 377096 - DNA, 19 bp, Homo sapiens
aacattgaagtaatgaatt

SEQ ID NO: 377097 - DNA, 23 bp, Homo sapiens
aacattgcactttataaacactg

SEQ ID NO: 377098 - DNA, 15 bp, Homo sapiens
aacatttacagtcct

SEQ ID NO: 377099 - DNA, 16 bp, Homo sapiens
aacatttgacacataa

SEQ ID NO: 377100 - DNA, 22 bp, Homo sapiens
aacatttggaaaccatgcacta

SEQ ID NO: 377101 - DNA, 21 bp, Homo sapiens
aacatttgggacctggataat

SEQ ID NO: 377102 - DNA, 23 bp, Homo sapiens
aacatttgtaatttttttctagt

SEQ ID NO: 377103 - DNA, 20 bp, Homo sapiens
aacattttaaataaaagaaa

SEQ ID NO: 377104 - DNA, 11 bp, Homo sapiens
aaccaaaacag

SEQ ID NO: 377105 - DNA, 16 bp, Homo sapiens
aaccaaaacccatcgt

SEQ ID NO: 377106 - DNA, 19 bp, Homo sapiens
aaccaaattaaaaattttt

SEQ ID NO: 377107 - DNA, 14 bp, Homo sapiens
aaccaactgcctta

SEQ ID NO: 377108 - DNA, 21 bp, Homo sapiens
aaccaacttggttctgcttca

SEQ ID NO: 377109 - DNA, 13 bp, Homo sapiens
aaccaagcagctt

SEQ ID NO: 377110 - DNA, 16 bp, Homo sapiens
aaccaagccgtggctt

SEQ ID NO: 377111 - DNA, 13 bp, Homo sapiens
aaccaagccttgg

SEQ ID NO: 377112 - DNA, 11 bp, Homo sapiens
aaccaagctgt

SEQ ID NO: 377113 - DNA, 14 bp, Homo sapiens
aaccaaggcagcct

SEQ ID NO: 377114 - DNA, 22 bp, Homo sapiens
aaccaaggcagcctccagagcc

SEQ ID NO: 377115 - DNA, 18 bp, Homo sapiens
aaccaatcccgtgaaaga

SEQ ID NO: 377116 - DNA, 19 bp, Homo sapiens
aaccaatgattcataacaa

SEQ ID NO: 377117 - DNA, 23 bp, Homo sapiens
aaccaatgattcataacaatgta

SEQ ID NO: 377118 - DNA, 15 bp, Homo sapiens
aaccacacttcttga

SEQ ID NO: 377119 - DNA, 13 bp, Homo sapiens
aaccacagccctg

SEQ ID NO: 377120 - DNA, 13 bp, Homo sapiens
aaccaccctgagg

SEQ ID NO: 377121 - DNA, 19 bp, Homo sapiens
aaccaccgcatatgcatgc

SEQ ID NO: 377122 - DNA, 20 bp, Homo sapiens
aaccaccgcatatgcatgcc

SEQ ID NO: 377123 - DNA, 23 bp, Homo sapiens
aaccaccgcatatgcatgccagg

SEQ ID NO: 377124 - DNA, 18 bp, Homo sapiens
aaccaccgctccccagcc

SEQ ID NO: 377125 - DNA, 22 bp, Homo sapiens
aaccactaatgcttgccaagaa

SEQ ID NO: 377126 - DNA, 14 bp, Homo sapiens
aaccactgcaacgg

SEQ ID NO: 377127 - DNA, 15 bp, Homo sapiens
aaccactgtaaaatg

SEQ ID NO: 377128 - DNA, 17 bp, Homo sapiens
aaccactttttgcagct

SEQ ID NO: 377129 - DNA, 18 bp, Homo sapiens
aaccagagccatggactc

SEQ ID NO: 377130 - DNA, 11 bp, Homo sapiens
aaccagcaggt

SEQ ID NO: 377131 - DNA, 15 bp, Homo sapiens
aaccagccctccaga

SEQ ID NO: 377132 - DNA, 18 bp, Homo sapiens
aaccagctattggaacag

SEQ ID NO: 377133 - DNA, 15 bp, Homo sapiens
aaccagctctttggt

SEQ ID NO: 377134 - DNA, 15 bp, Homo sapiens
aaccaggactctgcc

SEQ ID NO: 377135 - DNA, 22 bp, Homo sapiens
aaccaggagcattttgtgtctt

SEQ ID NO: 377136 - DNA, 17 bp, Homo sapiens
aaccaggccccagcctc

SEQ ID NO: 377137 - DNA, 20 bp, Homo sapiens
aaccagtaagtatgggagtc

SEQ ID NO: 377138 - DNA, 17 bp, Homo sapiens
aaccagtcttctccctg

SEQ ID NO: 377139 - DNA, 18 bp, Homo sapiens
aaccagtttcaggtgttt

SEQ ID NO: 377140 - DNA, 17 bp, Homo sapiens
aaccataaaataaataa

SEQ ID NO: 377141 - DNA, 23 bp, Homo sapiens
aaccatatgattgaaaagaagaa

SEQ ID NO: 377142 - DNA, 13 bp, Homo sapiens
aaccatctggcct

SEQ ID NO: 377143 - DNA, 15 bp, Homo sapiens
aaccatctggcctgg

SEQ ID NO: 377144 - DNA, 17 bp, Homo sapiens
aaccatctggcctggcc

SEQ ID NO: 377145 - DNA, 12 bp, Homo sapiens
aaccatgactgt

SEQ ID NO: 377146 - DNA, 13 bp, Homo sapiens
aaccattactgta

SEQ ID NO: 377147 - DNA, 12 bp, Homo sapiens
aaccattgcttc

SEQ ID NO: 377148 - DNA, 23 bp, Homo sapiens
aaccattgcttcactacccatcg

SEQ ID NO: 377149 - DNA, 17 bp, Homo sapiens
aaccattgttcagaaga

SEQ ID NO: 377150 - DNA, 17 bp, Homo sapiens
aacccaagtggaatcat

SEQ ID NO: 377151 - DNA, 17 bp, Homo sapiens
aacccaggacgcttctg

SEQ ID NO: 377152 - DNA, 15 bp, Homo sapiens
aacccatgccctgcc

SEQ ID NO: 377153 - DNA, 17 bp, Homo sapiens
aacccattaatcttttg

SEQ ID NO: 377154 - DNA, 20 bp, Homo sapiens
aacccatttgccatgctgct

SEQ ID NO: 377155 - DNA, 22 bp, Homo sapiens
aaccccaaaatgaagattattt

SEQ ID NO: 377156 - DNA, 15 bp, Homo sapiens
aaccccaactcccag

SEQ ID NO: 377157 - DNA, 19 bp, Homo sapiens
aaccccaactcccagccta

SEQ ID NO: 377158 - DNA, 14 bp, Homo sapiens
aaccccacttccat

SEQ ID NO: 377159 - DNA, 19 bp, Homo sapiens
aaccccacttccattgtat

SEQ ID NO: 377160 - DNA, 15 bp, Homo sapiens
aaccccagcctgacc

SEQ ID NO: 377161 - DNA, 21 bp, Homo sapiens
aaccccagcctgacctgagac

SEQ ID NO: 377162 - DNA, 13 bp, Homo sapiens
aacccccctccca

SEQ ID NO: 377163 - DNA, 16 bp, Homo sapiens
aacaagaaagtttccc

SEQ ID NO: 377164 - DNA, 14 bp, Homo sapiens
aacaagaatactga

SEQ ID NO: 377165 - DNA, 18 bp, Homo sapiens
aacaagaatattgtatgt

SEQ ID NO: 377166 - DNA, 14 bp, Homo sapiens
aacaagatttccct

SEQ ID NO: 377167 - DNA, 21 bp, Homo sapiens
aacaagccaaacattcttatt

SEQ ID NO: 377168 - DNA, 20 bp, Homo sapiens
aacaaggaatgcctgtgcca

SEQ ID NO: 377169 - DNA, 21 bp, Homo sapiens
aacaaggcaaggctgtcaatt

SEQ ID NO: 377170 - DNA, 23 bp, Homo sapiens
aacaaggcaaggctgtcaattac

SEQ ID NO: 377171 - DNA, 20 bp, Homo sapiens
aacaagggagagacctcatc

SEQ ID NO: 377172 - DNA, 19 bp, Homo sapiens
aacaagggtggcatcccag

SEQ ID NO: 377173 - DNA, 17 bp, Homo sapiens
aacaagtcacagctgca

SEQ ID NO: 377174 - DNA, 20 bp, Homo sapiens
aacaagtcacagctgcagct

SEQ ID NO: 377175 - DNA, 21 bp, Homo sapiens
aacaagtcacagctgcagctg

SEQ ID NO: 377176 - DNA, 17 bp, Homo sapiens
aacaagtgcctcctgga

SEQ ID NO: 377177 - DNA, 13 bp, Homo sapiens
aacaagtgtacag

SEQ ID NO: 377178 - DNA, 14 bp, Homo sapiens
aacaagtgtacaga

SEQ ID NO: 377179 - DNA, 18 bp, Homo sapiens
aacaagtgtacagaagaa

SEQ ID NO: 377180 - DNA, 20 bp, Homo sapiens
aacaagtgtacagaagaatt

SEQ ID NO: 377181 - DNA, 17 bp, Homo sapiens
aacaagtttagaaagct

SEQ ID NO: 377182 - DNA, 14 bp, Homo sapiens
aacaataataaatg

SEQ ID NO: 377183 - DNA, 14 bp, Homo sapiens
aacaatatgcttta

SEQ ID NO: 377184 - DNA, 15 bp, Homo sapiens
aacaatatgctttac

SEQ ID NO: 377185 - DNA, 23 bp, Homo sapiens
aacaatcaaagcacttggactct

SEQ ID NO: 377186 - DNA, 18 bp, Homo sapiens
aacaatcaaggcaactag

SEQ ID NO: 377187 - DNA, 20 bp, Homo sapiens
aacaatcacaaaagctgtgt

SEQ ID NO: 377188 - DNA, 23 bp, Homo sapiens
aacaatccaaatgcattcatgtt

SEQ ID NO: 377189 - DNA, 18 bp, Homo sapiens
aacaatcccaatctttct

SEQ ID NO: 377190 - DNA, 19 bp, Homo sapiens
aacaatcccaatctttcta

SEQ ID NO: 377191 - DNA, 19 bp, Homo sapiens
aacaatgcatgctttggaa

SEQ ID NO: 377192 - DNA, 16 bp, Homo sapiens
aacaatgccttgttgt

SEQ ID NO: 377193 - DNA, 23 bp, Homo sapiens
aacaatgccttgttgtattcctg

SEQ ID NO: 377194 - DNA, 11 bp, Homo sapiens
aacaatgtgtg

SEQ ID NO: 377195 - DNA, 15 bp, Homo sapiens
aacaatgtttgtcat

SEQ ID NO: 377196 - DNA, 15 bp, Homo sapiens
aacaattgtgttttc

SEQ ID NO: 377197 - DNA, 20 bp, Homo sapiens
aacaatttaggaatgctcaa

SEQ ID NO: 377198 - DNA, 22 bp, Homo sapiens
aacaatttattttattttagca

SEQ ID NO: 377199 - DNA, 19 bp, Homo sapiens
aacaatttgcataatacta

SEQ ID NO: 377200 - DNA, 14 bp, Homo sapiens
aacaattttctgca

SEQ ID NO: 377201 - DNA, 19 bp, Homo sapiens
aacacaaagcggggggagg

SEQ ID NO: 377202 - DNA, 15 bp, Homo sapiens
aacacaaatgtgtac

SEQ ID NO: 377203 - DNA, 17 bp, Homo sapiens
aacacaaatgtgtactt

SEQ ID NO: 377204 - DNA, 17 bp, Homo sapiens
aacacaagcaaaccttc

SEQ ID NO: 377205 - DNA, 19 bp, Homo sapiens
aacacaagcaaaccttctc

SEQ ID NO: 377206 - DNA, 13 bp, Homo sapiens
aacacaatgttat

SEQ ID NO: 377207 - DNA, 20 bp, Homo sapiens
aacacacaaaagattatgta

SEQ ID NO: 377208 - DNA, 23 bp, Homo sapiens
aacacacacacacgcagacacac

SEQ ID NO: 377209 - DNA, 12 bp, Homo sapiens
aacacacagaca

SEQ ID NO: 377210 - DNA, 15 bp, Homo sapiens
aacacaccaggctgt

SEQ ID NO: 377211 - DNA, 17 bp, Homo sapiens
aacacagcatgtgccaa

SEQ ID NO: 377212 - DNA, 19 bp, Homo sapiens
aacacagctgagagacttt

SEQ ID NO: 377213 - DNA, 17 bp, Homo sapiens
aacacagggttttgtat

SEQ ID NO: 377214 - DNA, 20 bp, Homo sapiens
aacacagttttgaaagaaaa

SEQ ID NO: 377215 - DNA, 23 bp, Homo sapiens
aacacataaagtaaatgctacct

SEQ ID NO: 377216 - DNA, 13 bp, Homo sapiens
aacacatggcaga

SEQ ID NO: 377217 - DNA, 18 bp, Homo sapiens
aacacattgaatgcgctt

SEQ ID NO: 377218 - DNA, 19 bp, Homo sapiens
aacacattgaatgcgcttt

SEQ ID NO: 377219 - DNA, 18 bp, Homo sapiens
aacacatttgattctgtg

SEQ ID NO: 377220 - DNA, 12 bp, Homo sapiens
aacaccacactg

SEQ ID NO: 377221 - DNA, 14 bp, Homo sapiens
aacaccacactgac

SEQ ID NO: 377222 - DNA, 16 bp, Homo sapiens
aacaccacactgacca

SEQ ID NO: 377223 - DNA, 12 bp, Homo sapiens
aacaccaggact

SEQ ID NO: 377224 - DNA, 13 bp, Homo sapiens
aacacccaagtcc

SEQ ID NO: 377225 - DNA, 15 bp, Homo sapiens
aacacccaagtccac

SEQ ID NO: 377226 - DNA, 19 bp, Homo sapiens
aacacccgccccccccatg

SEQ ID NO: 377227 - DNA, 16 bp, Homo sapiens
aacacccggaaagact

SEQ ID NO: 377228 - DNA, 20 bp, Homo sapiens
aacacctgtggataaaacat

SEQ ID NO: 377229 - DNA, 16 bp, Homo sapiens
aacactatgtttattt

SEQ ID NO: 377230 - DNA, 13 bp, Homo sapiens
aacactcagctgt

SEQ ID NO: 377231 - DNA, 14 bp, Homo sapiens
aacactcagctgtt

SEQ ID NO: 377232 - DNA, 16 bp, Homo sapiens
aacactcgtgtgcatg

SEQ ID NO: 377233 - DNA, 23 bp, Homo sapiens
aacactcgtgtgcatgagaatgt

SEQ ID NO: 377234 - DNA, 21 bp, Homo sapiens
aacactctctgagatgcccct

SEQ ID NO: 377235 - DNA, 13 bp, Homo sapiens
aacactggcccct

SEQ ID NO: 377236 - DNA, 15 bp, Homo sapiens
aacactggcccctag

SEQ ID NO: 377237 - DNA, 23 bp, Homo sapiens
aacactggtggaggatggaaagg

SEQ ID NO: 377238 - DNA, 19 bp, Homo sapiens
aacactgtaatatctttaa

SEQ ID NO: 377239 - DNA, 13 bp, Homo sapiens
aacactgtactga

SEQ ID NO: 377240 - DNA, 14 bp, Homo sapiens
aacactgtattgta

SEQ ID NO: 377241 - DNA, 22 bp, Homo sapiens
aacacttaagggttttagaaaa

SEQ ID NO: 377242 - DNA, 19 bp, Homo sapiens
aacacttattgctttgaaa

SEQ ID NO: 377243 - DNA, 11 bp, Homo sapiens
aacacttccat

SEQ ID NO: 377244 - DNA, 20 bp, Homo sapiens
aacacttgtgttgctttctg

SEQ ID NO: 377245 - DNA, 16 bp, Homo sapiens
aacagaaaaaaaacac

SEQ ID NO: 377246 - DNA, 13 bp, Homo sapiens
aacagaaaacaac

SEQ ID NO: 377247 - DNA, 20 bp, Homo sapiens
aacagaaaagagaagaaaga

SEQ ID NO: 377248 - DNA, 15 bp, Homo sapiens
aacagaacatttctc

SEQ ID NO: 377249 - DNA, 16 bp, Homo sapiens
aacagaactcgatgca

SEQ ID NO: 377250 - DNA, 22 bp, Homo sapiens
aacagaatattgacaagctagg

SEQ ID NO: 377251 - DNA, 15 bp, Homo sapiens
aacagacactacatt

SEQ ID NO: 377252 - DNA, 22 bp, Homo sapiens
aacagacctcactgctttgtag

SEQ ID NO: 377253 - DNA, 18 bp, Homo sapiens
aacagacctcggctgtgt

SEQ ID NO: 377254 - DNA, 22 bp, Homo sapiens
aacagactcgatgcaagtgttt

SEQ ID NO: 377255 - DNA, 13 bp, Homo sapiens
aacagaggcagga

SEQ ID NO: 377256 - DNA, 20 bp, Homo sapiens
aacagaggcaggagtggcag

SEQ ID NO: 377257 - DNA, 20 bp, Homo sapiens
aacagagtagttttggtttt

SEQ ID NO: 377258 - DNA, 18 bp, Homo sapiens
aacagagtatatatgtac

SEQ ID NO: 377259 - DNA, 21 bp, Homo sapiens
aacagagtatatatgtacagt

SEQ ID NO: 377260 - DNA, 16 bp, Homo sapiens
aacagatggctgtgaa

SEQ ID NO: 377261 - DNA, 15 bp, Homo sapiens
aacagatgtccctga

SEQ ID NO: 377262 - DNA, 18 bp, Homo sapiens
aacagcactggctctctc

SEQ ID NO: 377263 - DNA, 20 bp, Homo sapiens
aacagcactggctctctcca

SEQ ID NO: 377264 - DNA, 18 bp, Homo sapiens
aacagcatcaaaatacaa

SEQ ID NO: 377265 - DNA, 15 bp, Homo sapiens
aacagcatgtctact

SEQ ID NO: 377266 - DNA, 22 bp, Homo sapiens
aacagccgtcagccaaatgtaa

SEQ ID NO: 377267 - DNA, 23 bp, Homo sapiens
aacagcctgtttgggaggctgga

SEQ ID NO: 377268 - DNA, 12 bp, Homo sapiens
aacagccttagc

SEQ ID NO: 377269 - DNA, 21 bp, Homo sapiens
aacagcgggagacctgtgcta

SEQ ID NO: 377270 - DNA, 22 bp, Homo sapiens
aacagcgtgtcaactttcattt

SEQ ID NO: 377271 - DNA, 18 bp, Homo sapiens
aacagctatgggagcccc

SEQ ID NO: 377272 - DNA, 22 bp, Homo sapiens
aacagctatgggagccccaggg

SEQ ID NO: 377273 - DNA, 19 bp, Homo sapiens
aacagcttcttgcttgtaa

SEQ ID NO: 377274 - DNA, 16 bp, Homo sapiens
aacagctttcaagtgc

SEQ ID NO: 377275 - DNA, 16 bp, Homo sapiens
aacaggaaaaaaactt

SEQ ID NO: 377276 - DNA, 22 bp, Homo sapiens
aacaggaaaaaaacttttataa

SEQ ID NO: 377277 - DNA, 14 bp, Homo sapiens
aacaggaaaagaaa

SEQ ID NO: 377278 - DNA, 22 bp, Homo sapiens
aacaggaagatcttaaattttg

SEQ ID NO: 377279 - DNA, 16 bp, Homo sapiens
aacaggaccaggagcc

SEQ ID NO: 377280 - DNA, 16 bp, Homo sapiens
aacaggattagacagt

SEQ ID NO: 377281 - DNA, 19 bp, Homo sapiens
aacaggcattgcactaaaa

SEQ ID NO: 377282 - DNA, 22 bp, Homo sapiens
aacaggcattgcactaaaagtg

SEQ ID NO: 377283 - DNA, 21 bp, Homo sapiens
aacaggctcaatattcctgaa

SEQ ID NO: 377284 - DNA, 17 bp, Homo sapiens
aacagggcccaggcctg

SEQ ID NO: 377285 - DNA, 13 bp, Homo sapiens
aacaggggctggt

SEQ ID NO: 377286 - DNA, 15 bp, Homo sapiens
aacagggtaaattat

SEQ ID NO: 377287 - DNA, 16 bp, Homo sapiens
aacagggtaaattatt

SEQ ID NO: 377288 - DNA, 16 bp, Homo sapiens
aacaggttttataatt

SEQ ID NO: 377289 - DNA, 14 bp, Homo sapiens
aacagtaaaggcca

SEQ ID NO: 377290 - DNA, 13 bp, Homo sapiens
aacagtacatttt

SEQ ID NO: 377291 - DNA, 12 bp, Homo sapiens
aacagtgaattt

SEQ ID NO: 377292 - DNA, 20 bp, Homo sapiens
aacagtgaatttaagcatga

SEQ ID NO: 377293 - DNA, 23 bp, Homo sapiens
aacagtgattaaagcaagagaat

SEQ ID NO: 377294 - DNA, 19 bp, Homo sapiens
aacagtgggagccctgacc

SEQ ID NO: 377295 - DNA, 17 bp, Homo sapiens
aacagtgtggatgtaaa

SEQ ID NO: 377296 - DNA, 22 bp, Homo sapiens
aaatcctagagattcttagctc

SEQ ID NO: 377297 - DNA, 14 bp, Homo sapiens
aaatcgattggctt

SEQ ID NO: 377298 - DNA, 15 bp, Homo sapiens
aaatcgattggcttt

SEQ ID NO: 377299 - DNA, 21 bp, Homo sapiens
aaatcgctgctcaaaaatgat

SEQ ID NO: 377300 - DNA, 15 bp, Homo sapiens
aaatctaaattaact

SEQ ID NO: 377301 - DNA, 17 bp, Homo sapiens
aaatctaatattaaaaa

SEQ ID NO: 377302 - DNA, 19 bp, Homo sapiens
aaatctaatctcttattct

SEQ ID NO: 377303 - DNA, 19 bp, Homo sapiens
aaatctagacatagatcct

SEQ ID NO: 377304 - DNA, 19 bp, Homo sapiens
aaatctattcagacaagca

SEQ ID NO: 377305 - DNA, 17 bp, Homo sapiens
aaatctcctcttttgta

SEQ ID NO: 377306 - DNA, 15 bp, Homo sapiens
aaatctctaatatgg

SEQ ID NO: 377307 - DNA, 15 bp, Homo sapiens
aaatctctagcctct

SEQ ID NO: 377308 - DNA, 17 bp, Homo sapiens
aaatctctctctgttgt

SEQ ID NO: 377309 - DNA, 20 bp, Homo sapiens
aaatctgaactctcaaaagt

SEQ ID NO: 377310 - DNA, 21 bp, Homo sapiens
aaatctgtccaaaggaggctg

SEQ ID NO: 377311 - DNA, 19 bp, Homo sapiens
aaatctgtctgattctatg

SEQ ID NO: 377312 - DNA, 20 bp, Homo sapiens
aaatctgtctgattctatgc

SEQ ID NO: 377313 - DNA, 23 bp, Homo sapiens
aaatctgtctgattctatgcctg

SEQ ID NO: 377314 - DNA, 19 bp, Homo sapiens
aaatctgtgatgatcctca

SEQ ID NO: 377315 - DNA, 18 bp, Homo sapiens
aaatctgtttgatccctg

SEQ ID NO: 377316 - DNA, 21 bp, Homo sapiens
aaatcttaagattacaagata

SEQ ID NO: 377317 - DNA, 16 bp, Homo sapiens
aaatcttcagctggtg

SEQ ID NO: 377318 - DNA, 17 bp, Homo sapiens
aaatcttcctctggagc

SEQ ID NO: 377319 - DNA, 17 bp, Homo sapiens
aaatcttgaatttctgc

SEQ ID NO: 377320 - DNA, 16 bp, Homo sapiens
aaatcttgtcatgtgt

SEQ ID NO: 377321 - DNA, 13 bp, Homo sapiens
aaatctttaagaa

SEQ ID NO: 377322 - DNA, 12 bp, Homo sapiens
aaatctttcaga

SEQ ID NO: 377323 - DNA, 19 bp, Homo sapiens
aaatctttcagaatacaat

SEQ ID NO: 377324 - DNA, 16 bp, Homo sapiens
aaatctttcagcctgc

SEQ ID NO: 377325 - DNA, 18 bp, Homo sapiens
aaatctttccatctcatt

SEQ ID NO: 377326 - DNA, 22 bp, Homo sapiens
aaatgaaaggtagtgagtaatt

SEQ ID NO: 377327 - DNA, 17 bp, Homo sapiens
aaatgaaatacttgaca

SEQ ID NO: 377328 - DNA, 14 bp, Homo sapiens
aaatgaacacatgg

SEQ ID NO: 377329 - DNA, 17 bp, Homo sapiens
aaatgaacacatggcag

SEQ ID NO: 377330 - DNA, 21 bp, Homo sapiens
aaatgaactgaagtttcacat

SEQ ID NO: 377331 - DNA, 15 bp, Homo sapiens
aaatgaataatttcc

SEQ ID NO: 377332 - DNA, 14 bp, Homo sapiens
aaatgaatagtaca

SEQ ID NO: 377333 - DNA, 19 bp, Homo sapiens
aaatgaatgcattggccct

SEQ ID NO: 377334 - DNA, 19 bp, Homo sapiens
aaatgaatgtctaaaattg

SEQ ID NO: 377335 - DNA, 15 bp, Homo sapiens
aaatgaccaatatta

SEQ ID NO: 377336 - DNA, 11 bp, Homo sapiens
aaatgaccagt

SEQ ID NO: 377337 - DNA, 12 bp, Homo sapiens
aaatgaccagtt

SEQ ID NO: 377338 - DNA, 14 bp, Homo sapiens
aaatgaccagttta

SEQ ID NO: 377339 - DNA, 15 bp, Homo sapiens
aaatgaccagtttac

SEQ ID NO: 377340 - DNA, 14 bp, Homo sapiens
aaatgacttattga

SEQ ID NO: 377341 - DNA, 12 bp, Homo sapiens
aaatgaggaaga

SEQ ID NO: 377342 - DNA, 14 bp, Homo sapiens
aaatgaggacatgt

SEQ ID NO: 377343 - DNA, 20 bp, Homo sapiens
aaatgagtttaaaaaaataa

SEQ ID NO: 377344 - DNA, 18 bp, Homo sapiens
aaatgataaagatgtcaa

SEQ ID NO: 377345 - DNA, 12 bp, Homo sapiens
aaatgatctatt

SEQ ID NO: 377346 - DNA, 15 bp, Homo sapiens
aaatgatctattgca

SEQ ID NO: 377347 - DNA, 19 bp, Homo sapiens
aaatgatgatgtggaagaa

SEQ ID NO: 377348 - DNA, 13 bp, Homo sapiens
aaatgattatctt

SEQ ID NO: 377349 - DNA, 21 bp, Homo sapiens
aaatgattcacttttattgta

SEQ ID NO: 377350 - DNA, 13 bp, Homo sapiens
aaatgattccaaa

SEQ ID NO: 377351 - DNA, 20 bp, Homo sapiens
aaatgattttcatcaattta

SEQ ID NO: 377352 - DNA, 21 bp, Homo sapiens
aaatgattttcatcaatttaa

SEQ ID NO: 377353 - DNA, 19 bp, Homo sapiens
aaatgcacatagctatcaa

SEQ ID NO: 377354 - DNA, 20 bp, Homo sapiens
aaatgcatatcctgagccat

SEQ ID NO: 377355 - DNA, 14 bp, Homo sapiens
aaatgcatgatatt

SEQ ID NO: 377356 - DNA, 14 bp, Homo sapiens
aaatgcattcatgt

SEQ ID NO: 377357 - DNA, 21 bp, Homo sapiens
aaatgctgatttaaacttctt

SEQ ID NO: 377358 - DNA, 13 bp, Homo sapiens
aaatgctgcctgc

SEQ ID NO: 377359 - DNA, 16 bp, Homo sapiens
aaatgctgcctgcctg

SEQ ID NO: 377360 - DNA, 19 bp, Homo sapiens
aaatgctgttggtgagaat

SEQ ID NO: 377361 - DNA, 20 bp, Homo sapiens
aaatgctgttggtgagaatc

SEQ ID NO: 377362 - DNA, 19 bp, Homo sapiens
aaatgctttgtgtgattga

SEQ ID NO: 377363 - DNA, 18 bp, Homo sapiens
aaatgctttgttttccca

SEQ ID NO: 377364 - DNA, 14 bp, Homo sapiens
aaatggaaagaaaa

SEQ ID NO: 377365 - DNA, 20 bp, Homo sapiens
aaatggaaaggtcctgctgt

SEQ ID NO: 377366 - DNA, 22 bp, Homo sapiens
aaatggaatgtgcccctggccc

SEQ ID NO: 377367 - DNA, 14 bp, Homo sapiens
aaatggacgtgtta

SEQ ID NO: 377368 - DNA, 20 bp, Homo sapiens
aaatggacgtgttatgactc

SEQ ID NO: 377369 - DNA, 22 bp, Homo sapiens
aaatggacgtgttatgactcca

SEQ ID NO: 377370 - DNA, 14 bp, Homo sapiens
aaatggacttgctt

SEQ ID NO: 377371 - DNA, 19 bp, Homo sapiens
aaatggacttgcttcttgt

SEQ ID NO: 377372 - DNA, 19 bp, Homo sapiens
aaatggacttttgttcatg

SEQ ID NO: 377373 - DNA, 17 bp, Homo sapiens
aaatggatgacaaagaa

SEQ ID NO: 377374 - DNA, 18 bp, Homo sapiens
aaatggatgacaaagaaa

SEQ ID NO: 377375 - DNA, 19 bp, Homo sapiens
aaatggatgacaaagaaaa

SEQ ID NO: 377376 - DNA, 23 bp, Homo sapiens
aaatggatgacaaagaaaatgag

SEQ ID NO: 377377 - DNA, 13 bp, Homo sapiens
aaatggcacctgt

SEQ ID NO: 377378 - DNA, 17 bp, Homo sapiens
aaatggcacctgtatac

SEQ ID NO: 377379 - DNA, 18 bp, Homo sapiens
aaatgggactgatgtcat

SEQ ID NO: 377380 - DNA, 20 bp, Homo sapiens
aaatgggactgatgtcatct

SEQ ID NO: 377381 - DNA, 22 bp, Homo sapiens
aaatgggttggtgcttctaacc

SEQ ID NO: 377382 - DNA, 20 bp, Homo sapiens
aaatggtagaagatgaatca

SEQ ID NO: 377383 - DNA, 20 bp, Homo sapiens
aaatggtcagtgtgcaaaga

SEQ ID NO: 377384 - DNA, 19 bp, Homo sapiens
aaatggtgttttcatgtaa

SEQ ID NO: 377385 - DNA, 14 bp, Homo sapiens
aaatggtgtttttt

SEQ ID NO: 377386 - DNA, 17 bp, Homo sapiens
aaatgtaaaagtactct

SEQ ID NO: 377387 - DNA, 18 bp, Homo sapiens
aaatgtaaatttataaat

SEQ ID NO: 377388 - DNA, 21 bp, Homo sapiens
aaatgtactacatttgcatgc

SEQ ID NO: 377389 - DNA, 14 bp, Homo sapiens
aaatgtagaagaaa

SEQ ID NO: 377390 - DNA, 17 bp, Homo sapiens
aaatgtatatttaactt

SEQ ID NO: 377391 - DNA, 14 bp, Homo sapiens
aaatgtatcttatt

SEQ ID NO: 377392 - DNA, 15 bp, Homo sapiens
aaatgtattcaagca

SEQ ID NO: 377393 - DNA, 14 bp, Homo sapiens
aaatgtattttgaa

SEQ ID NO: 377394 - DNA, 16 bp, Homo sapiens
aaatgtcccaaataaa

SEQ ID NO: 377395 - DNA, 22 bp, Homo sapiens
aaatgtcctgtggtgacaggcc

SEQ ID NO: 377396 - DNA, 21 bp, Homo sapiens
aaatgtctgttttagttggaa

SEQ ID NO: 377397 - DNA, 15 bp, Homo sapiens
aaatgtgatcaactg

SEQ ID NO: 377398 - DNA, 13 bp, Homo sapiens
aaatgtgcaagag

SEQ ID NO: 377399 - DNA, 19 bp, Homo sapiens
aaatgtgcaagagtatact

SEQ ID NO: 377400 - DNA, 18 bp, Homo sapiens
aaatgtgtgcttggaaaa

SEQ ID NO: 377401 - DNA, 14 bp, Homo sapiens
aaatgttaataaag

SEQ ID NO: 377402 - DNA, 22 bp, Homo sapiens
aaatgttaataaaggtttcgtt

SEQ ID NO: 377403 - DNA, 16 bp, Homo sapiens
aaatgttagcaagatg

SEQ ID NO: 377404 - DNA, 20 bp, Homo sapiens
aaatgttagcaagatgattt

SEQ ID NO: 377405 - DNA, 17 bp, Homo sapiens
aaatgttcattctatga

SEQ ID NO: 377406 - DNA, 12 bp, Homo sapiens
aaatgttttatg

SEQ ID NO: 377407 - DNA, 21 bp, Homo sapiens
aaattaaaacgaaaataaagt

SEQ ID NO: 377408 - DNA, 13 bp, Homo sapiens
aaattaaaagaag

SEQ ID NO: 377409 - DNA, 22 bp, Homo sapiens
aaattaaaatccagcatcccaa

SEQ ID NO: 377410 - DNA, 13 bp, Homo sapiens
aaattaaacaatt

SEQ ID NO: 377411 - DNA, 17 bp, Homo sapiens
aaattaaacgagcgaag

SEQ ID NO: 377412 - DNA, 17 bp, Homo sapiens
aaattaaataattttac

SEQ ID NO: 377413 - DNA, 12 bp, Homo sapiens
aaattaaatata

SEQ ID NO: 377414 - DNA, 23 bp, Homo sapiens
aaattaaatatatgtatgtaaaa

SEQ ID NO: 377415 - DNA, 17 bp, Homo sapiens
aaattaaattctctcta

SEQ ID NO: 377416 - DNA, 21 bp, Homo sapiens
aaattaaattctctctaacat

SEQ ID NO: 377417 - DNA, 12 bp, Homo sapiens
aaattaacatta

SEQ ID NO: 377418 - DNA, 13 bp, Homo sapiens
aaattaacattat

SEQ ID NO: 377419 - DNA, 16 bp, Homo sapiens
aaattaacattatatt

SEQ ID NO: 377420 - DNA, 17 bp, Homo sapiens
aaattaagaagtacaat

SEQ ID NO: 377421 - DNA, 15 bp, Homo sapiens
aaattaagactttaa

SEQ ID NO: 377422 - DNA, 22 bp, Homo sapiens
aaattaataaatcatgttttga

SEQ ID NO: 377423 - DNA, 16 bp, Homo sapiens
aaattacacccatgca

SEQ ID NO: 377424 - DNA, 20 bp, Homo sapiens
aaattagaaaaaaacaaact

SEQ ID NO: 377425 - DNA, 14 bp, Homo sapiens
aaattagatgaact

SEQ ID NO: 377426 - DNA, 18 bp, Homo sapiens
aaattaggaataaataaa

SEQ ID NO: 377427 - DNA, 18 bp, Homo sapiens
aaattaggatttcatgat

SEQ ID NO: 377428 - DNA, 18 bp, Homo sapiens
aaattagggctctaattt

SEQ ID NO: 377429 - DNA, 16 bp, Homo sapiens
aaattagtaatgtact

SEQ ID NO: 377430 - DNA, 15 bp, Homo sapiens
aaattataaggactg

SEQ ID NO: 377431 - DNA, 17 bp, Homo sapiens
aaattataaggactgca

SEQ ID NO: 377432 - DNA, 20 bp, Homo sapiens
aaattataagtagatttgta

SEQ ID NO: 377433 - DNA, 16 bp, Homo sapiens
aaattatactgtagct

SEQ ID NO: 377434 - DNA, 18 bp, Homo sapiens
aaattatatgatatgcat

SEQ ID NO: 377435 - DNA, 16 bp, Homo sapiens
aaattatcaagctaat

SEQ ID NO: 377436 - DNA, 15 bp, Homo sapiens
aaattatctttaaaa

SEQ ID NO: 377437 - DNA, 13 bp, Homo sapiens
aaattatgtaatg

SEQ ID NO: 377438 - DNA, 17 bp, Homo sapiens
aaattattactttaaat

SEQ ID NO: 377439 - DNA, 18 bp, Homo sapiens
aaattattactttaaatt

SEQ ID NO: 377440 - DNA, 17 bp, Homo sapiens
aaattattgtaaacttt

SEQ ID NO: 377441 - DNA, 13 bp, Homo sapiens
aaattatttaata

SEQ ID NO: 377442 - DNA, 15 bp, Homo sapiens
aaattatttaataaa

SEQ ID NO: 377443 - DNA, 21 bp, Homo sapiens
aaattatttctaaaacattaa

SEQ ID NO: 377444 - DNA, 19 bp, Homo sapiens
aaattatttgccttttaaa

SEQ ID NO: 377445 - DNA, 21 bp, Homo sapiens
aaattatttgtgtaatagaaa

SEQ ID NO: 377446 - DNA, 14 bp, Homo sapiens
aaattcaaaaagtg

SEQ ID NO: 377447 - DNA, 14 bp, Homo sapiens
aaattcaacaaatg

SEQ ID NO: 377448 - DNA, 16 bp, Homo sapiens
aaattcaacaaatgat

SEQ ID NO: 377449 - DNA, 17 bp, Homo sapiens
aaattcaacacttattt

SEQ ID NO: 377450 - DNA, 16 bp, Homo sapiens
aaattcaagaaaataa

SEQ ID NO: 377451 - DNA, 13 bp, Homo sapiens
aaattcacactgt

SEQ ID NO: 377452 - DNA, 14 bp, Homo sapiens
aaattcatataaag

SEQ ID NO: 377453 - DNA, 22 bp, Homo sapiens
aaattccccatatttgtgttca

SEQ ID NO: 377454 - DNA, 12 bp, Homo sapiens
aaattccctgga

SEQ ID NO: 377455 - DNA, 14 bp, Homo sapiens
aaattcctctgtag

SEQ ID NO: 377456 - DNA, 12 bp, Homo sapiens
aaattcctgttg

SEQ ID NO: 377457 - DNA, 13 bp, Homo sapiens
aaattcctgttgt

SEQ ID NO: 377458 - DNA, 15 bp, Homo sapiens
aaattcgtagcaaat

SEQ ID NO: 377459 - DNA, 16 bp, Homo sapiens
aaattctagtctctga

SEQ ID NO: 377460 - DNA, 17 bp, Homo sapiens
aaattctcaagtgatag

SEQ ID NO: 377461 - DNA, 15 bp, Homo sapiens
aaattctgctgcttg

SEQ ID NO: 377462 - DNA, 17 bp, Homo sapiens
aaattctgtggcagttt

SEQ ID NO: 377463 - DNA, 23 bp, Homo sapiens
aaattcttattggccaaatgcct

SEQ ID NO: 377464 - DNA, 18 bp, Homo sapiens
aaattcttgaagttcatg

SEQ ID NO: 377465 - DNA, 15 bp, Homo sapiens
aaattcttgaataaa

SEQ ID NO: 377466 - DNA, 21 bp, Homo sapiens
aaattcttgcactgtatccaa

SEQ ID NO: 377467 - DNA, 23 bp, Homo sapiens
aaattgaaagcttccatgtttaa

SEQ ID NO: 377468 - DNA, 13 bp, Homo sapiens
aaattgaaattgt

SEQ ID NO: 377469 - DNA, 14 bp, Homo sapiens
aaattgatcattca

SEQ ID NO: 377470 - DNA, 14 bp, Homo sapiens
aaattgatgggtgg

SEQ ID NO: 377471 - DNA, 14 bp, Homo sapiens
aaattgatgtgttt

SEQ ID NO: 377472 - DNA, 21 bp, Homo sapiens
aaattgatgtgtttatttata

SEQ ID NO: 377473 - DNA, 21 bp, Homo sapiens
aaattgcaaagaaaattctca

SEQ ID NO: 377474 - DNA, 16 bp, Homo sapiens
aaattgcataaagcat

SEQ ID NO: 377475 - DNA, 17 bp, Homo sapiens
aaattgcatgctgcttt

SEQ ID NO: 377476 - DNA, 19 bp, Homo sapiens
aaattgcatgctgctttaa

SEQ ID NO: 377477 - DNA, 18 bp, Homo sapiens
aaattgcatttcctgaca

SEQ ID NO: 377478 - DNA, 13 bp, Homo sapiens
aaattgctcataa

SEQ ID NO: 377479 - DNA, 13 bp, Homo sapiens
aaattgctccttg

SEQ ID NO: 377480 - DNA, 14 bp, Homo sapiens
aaattgctccttga

SEQ ID NO: 377481 - DNA, 20 bp, Homo sapiens
aaattgctgagatgtttagt

SEQ ID NO: 377482 - DNA, 18 bp, Homo sapiens
aaattgcttttgttgtga

SEQ ID NO: 377483 - DNA, 18 bp, Homo sapiens
aaattggattagcctgga

SEQ ID NO: 377484 - DNA, 18 bp, Homo sapiens
aaattggctcctttccca

SEQ ID NO: 377485 - DNA, 22 bp, Homo sapiens
aaattggctcctttcccacagt

SEQ ID NO: 377486 - DNA, 22 bp, Homo sapiens
aaattgggtgtgccctggctcc

SEQ ID NO: 377487 - DNA, 18 bp, Homo sapiens
aaattggtgataagtgga

SEQ ID NO: 377488 - DNA, 22 bp, Homo sapiens
aaattggtgataagtggaaaaa

SEQ ID NO: 377489 - DNA, 19 bp, Homo sapiens
aaattgtgaactcattgct

SEQ ID NO: 377490 - DNA, 17 bp, Homo sapiens
aaattgtgtccacataa

SEQ ID NO: 377491 - DNA, 18 bp, Homo sapiens
aaattgtgtccacataat

SEQ ID NO: 377492 - DNA, 13 bp, Homo sapiens
aaattgttcctga

SEQ ID NO: 377493 - DNA, 12 bp, Homo sapiens
aaatttaaaaaa

SEQ ID NO: 377494 - DNA, 18 bp, Homo sapiens
aaatttaaaacaaacaac

SEQ ID NO: 377495 - DNA, 12 bp, Homo sapiens
aaatttaagcat

SEQ ID NO: 377496 - DNA, 13 bp, Homo sapiens
aaatttaagcatt

SEQ ID NO: 377497 - DNA, 14 bp, Homo sapiens
aaatttaagcattg

SEQ ID NO: 377498 - DNA, 23 bp, Homo sapiens
aaatttaagtatcttttttcaaa

SEQ ID NO: 377499 - DNA, 16 bp, Homo sapiens
aaatttaatgtagaca

SEQ ID NO: 377500 - DNA, 17 bp, Homo sapiens
aaatttacatcatttct

SEQ ID NO: 377501 - DNA, 15 bp, Homo sapiens
aaatttacgtatatt

SEQ ID NO: 377502 - DNA, 22 bp, Homo sapiens
aaatttataaactaattttgta

SEQ ID NO: 377503 - DNA, 19 bp, Homo sapiens
aaatttctgggatatttaa

SEQ ID NO: 377504 - DNA, 18 bp, Homo sapiens
aaatttgaaccaaaacat

SEQ ID NO: 377505 - DNA, 14 bp, Homo sapiens
aaatttgagactat

SEQ ID NO: 377506 - DNA, 20 bp, Homo sapiens
aaatttgatggtgaatatta

SEQ ID NO: 377507 - DNA, 13 bp, Homo sapiens
aaatttgtactat

SEQ ID NO: 377508 - DNA, 19 bp, Homo sapiens
aaatttgtactatttaact

SEQ ID NO: 377509 - DNA, 20 bp, Homo sapiens
aaatttgtactatttaactg

SEQ ID NO: 377510 - DNA, 12 bp, Homo sapiens
aaatttgtgtaa

SEQ ID NO: 377511 - DNA, 20 bp, Homo sapiens
aaatttgttatacttcaaaa

SEQ ID NO: 377512 - DNA, 22 bp, Homo sapiens
aaatttgttgtcatgtgtatga

SEQ ID NO: 377513 - DNA, 15 bp, Homo sapiens
aaatttgtttaaagt

SEQ ID NO: 377514 - DNA, 22 bp, Homo sapiens
aaatttgttttgacggatgatt

SEQ ID NO: 377515 - DNA, 14 bp, Homo sapiens
aaattttaatgtaa

SEQ ID NO: 377516 - DNA, 21 bp, Homo sapiens
aaattttataaaattaagcaa

SEQ ID NO: 377517 - DNA, 12 bp, Homo sapiens
aaattttattga

SEQ ID NO: 377518 - DNA, 19 bp, Homo sapiens
aaattttattgaatataat

SEQ ID NO: 377519 - DNA, 17 bp, Homo sapiens
aaattttgaggtctttt

SEQ ID NO: 377520 - DNA, 21 bp, Homo sapiens
aaattttgtgatatggagccc

SEQ ID NO: 377521 - DNA, 14 bp, Homo sapiens
aaatttttaaatca

SEQ ID NO: 377522 - DNA, 20 bp, Homo sapiens
aaatttttaaatcatttcat

SEQ ID NO: 377523 - DNA, 13 bp, Homo sapiens
aaatttttgaaaa

SEQ ID NO: 377524 - DNA, 19 bp, Homo sapiens
aaattttttgatgtcagcc

SEQ ID NO: 377525 - DNA, 20 bp, Homo sapiens
aaattttttgatgtcagcct

SEQ ID NO: 377526 - DNA, 15 bp, Homo sapiens
aaatttttttccaga

SEQ ID NO: 377527 - DNA, 20 bp, Homo sapiens
aaatttttttgtatttttag

SEQ ID NO: 377528 - DNA, 17 bp, Homo sapiens
aaattttttttttaata

SEQ ID NO: 377529 - DNA, 16 bp, Homo sapiens
aacaaaaaccagcagg

SEQ ID NO: 377530 - DNA, 11 bp, Homo sapiens
aacaaaaattt

SEQ ID NO: 377531 - DNA, 16 bp, Homo sapiens
aacaaaacaagaaaga

SEQ ID NO: 377532 - DNA, 20 bp, Homo sapiens
aacaaaatgaagttaactta

SEQ ID NO: 377533 - DNA, 15 bp, Homo sapiens
aacaaacaaaactta

SEQ ID NO: 377534 - DNA, 21 bp, Homo sapiens
aacaaacagaaacgagatttg

SEQ ID NO: 377535 - DNA, 18 bp, Homo sapiens
aacaaacgtaatttgtta

SEQ ID NO: 377536 - DNA, 19 bp, Homo sapiens
aacaaacgtaatttgttat

SEQ ID NO: 377537 - DNA, 15 bp, Homo sapiens
aacaaactgaaaaat

SEQ ID NO: 377538 - DNA, 16 bp, Homo sapiens
aacaaactgaaaaatc

SEQ ID NO: 377539 - DNA, 20 bp, Homo sapiens
aacaaactgtgtaactgccc

SEQ ID NO: 377540 - DNA, 11 bp, Homo sapiens
aacaaagaaga

SEQ ID NO: 377541 - DNA, 20 bp, Homo sapiens
aacaaagaccaatgtgaaga

SEQ ID NO: 377542 - DNA, 14 bp, Homo sapiens
aacaaagcatgctc

SEQ ID NO: 377543 - DNA, 22 bp, Homo sapiens
aacaaagcatgctcagtattga

SEQ ID NO: 377544 - DNA, 15 bp, Homo sapiens
aacaaagctgatttc

SEQ ID NO: 377545 - DNA, 18 bp, Homo sapiens
aacaaagtcaagattccc

SEQ ID NO: 377546 - DNA, 20 bp, Homo sapiens
aacaaagtgactgtttggct

SEQ ID NO: 377547 - DNA, 21 bp, Homo sapiens
aacaaagtgactgtttggctt

SEQ ID NO: 377548 - DNA, 13 bp, Homo sapiens
aacaaatatgcaa

SEQ ID NO: 377549 - DNA, 13 bp, Homo sapiens
aacaacaaaaaat

SEQ ID NO: 377550 - DNA, 17 bp, Homo sapiens
aacaacaaagcatgctc

SEQ ID NO: 377551 - DNA, 18 bp, Homo sapiens
aacaacaaagcatgctca

SEQ ID NO: 377552 - DNA, 14 bp, Homo sapiens
aacaacaacaaagc

SEQ ID NO: 377553 - DNA, 19 bp, Homo sapiens
aacaacagtcagccagctt

SEQ ID NO: 377554 - DNA, 15 bp, Homo sapiens
aacaaccctgttgag

SEQ ID NO: 377555 - DNA, 24 bp, Homo sapiens
aacaacctgccacaatgtgatatg

SEQ ID NO: 377556 - DNA, 19 bp, Homo sapiens
aacaactaattataatgca

SEQ ID NO: 377557 - DNA, 18 bp, Homo sapiens
aacaactatttataaact

SEQ ID NO: 377558 - DNA, 13 bp, Homo sapiens
aacaactctattt

SEQ ID NO: 377559 - DNA, 14 bp, Homo sapiens
aacaacttactaaa

SEQ ID NO: 377560 - DNA, 17 bp, Homo sapiens
aacaactttgtttctca

SEQ ID NO: 377561 - DNA, 13 bp, Homo sapiens
aacaagaaaacat

SEQ ID NO: 377562 - DNA, 23 bp, Homo sapiens
aacaagaaaccaagtgggctggt

SEQ ID NO: 377563 - DNA, 13 bp, Homo sapiens
aacaagaaagaaa

SEQ ID NO: 377564 - DNA, 17 bp, Homo sapiens
aacaagaaagaaacgta

SEQ ID NO: 377565 - DNA, 16 bp, Homo sapiens
aaataaatagctatat

SEQ ID NO: 377566 - DNA, 12 bp, Homo sapiens
aaataaatgaaa

SEQ ID NO: 377567 - DNA, 23 bp, Homo sapiens
aaataaattggtgataagtggaa

SEQ ID NO: 377568 - DNA, 21 bp, Homo sapiens
aaataaatttaactttaacca

SEQ ID NO: 377569 - DNA, 19 bp, Homo sapiens
aaataaatttggttctaat

SEQ ID NO: 377570 - DNA, 18 bp, Homo sapiens
aaataacacagatattgt

SEQ ID NO: 377571 - DNA, 12 bp, Homo sapiens
aaataacattgc

SEQ ID NO: 377572 - DNA, 12 bp, Homo sapiens
aaataaccacaa

SEQ ID NO: 377573 - DNA, 20 bp, Homo sapiens
aaataaccacaaggtccact

SEQ ID NO: 377574 - DNA, 19 bp, Homo sapiens
aaataactactgcaaaaag

SEQ ID NO: 377575 - DNA, 21 bp, Homo sapiens
aaataactactgcaaaaagta

SEQ ID NO: 377576 - DNA, 15 bp, Homo sapiens
aaataagaaattagc

SEQ ID NO: 377577 - DNA, 14 bp, Homo sapiens
aaataagagatttg

SEQ ID NO: 377578 - DNA, 15 bp, Homo sapiens
aaataagtaacatat

SEQ ID NO: 377579 - DNA, 18 bp, Homo sapiens
aaataagtcctaaagtga

SEQ ID NO: 377580 - DNA, 22 bp, Homo sapiens
aaataagtgaatctaataaaat

SEQ ID NO: 377581 - DNA, 12 bp, Homo sapiens
aaataagttaaa

SEQ ID NO: 377582 - DNA, 13 bp, Homo sapiens
aaataataaatta

SEQ ID NO: 377583 - DNA, 17 bp, Homo sapiens
aaataataaattaacat

SEQ ID NO: 377584 - DNA, 18 bp, Homo sapiens
aaataataaattaacatt

SEQ ID NO: 377585 - DNA, 19 bp, Homo sapiens
aaataataaattaacatta

SEQ ID NO: 377586 - DNA, 15 bp, Homo sapiens
aaataataataatgt

SEQ ID NO: 377587 - DNA, 19 bp, Homo sapiens
aaataatattatattgtat

SEQ ID NO: 377588 - DNA, 13 bp, Homo sapiens
aaataatgattta

SEQ ID NO: 377589 - DNA, 15 bp, Homo sapiens
aaataattaaaacaa

SEQ ID NO: 377590 - DNA, 14 bp, Homo sapiens
aaataattatcaca

SEQ ID NO: 377591 - DNA, 13 bp, Homo sapiens
aaatacaaaataa

SEQ ID NO: 377592 - DNA, 19 bp, Homo sapiens
aaatacaacttaaataata

SEQ ID NO: 377593 - DNA, 12 bp, Homo sapiens
aaatacaataaa

SEQ ID NO: 377594 - DNA, 14 bp, Homo sapiens
aaatacaataaact

SEQ ID NO: 377595 - DNA, 15 bp, Homo sapiens
aaatacaataaacta

SEQ ID NO: 377596 - DNA, 18 bp, Homo sapiens
aaatacaattactcacca

SEQ ID NO: 377597 - DNA, 16 bp, Homo sapiens
aaatacactacaaatg

SEQ ID NO: 377598 - DNA, 18 bp, Homo sapiens
aaatacactacaaatgtt

SEQ ID NO: 377599 - DNA, 17 bp, Homo sapiens
aaataccatgtctctaa

SEQ ID NO: 377600 - DNA, 19 bp, Homo sapiens
aaataccatgtctctaagc

SEQ ID NO: 377601 - DNA, 17 bp, Homo sapiens
aaatactattggacaga

SEQ ID NO: 377602 - DNA, 23 bp, Homo sapiens
aaatactgcttttgcaaacagaa

SEQ ID NO: 377603 - DNA, 19 bp, Homo sapiens
aaatacttctttttcatta

SEQ ID NO: 377604 - DNA, 16 bp, Homo sapiens
aaatacttgtgatttt

SEQ ID NO: 377605 - DNA, 16 bp, Homo sapiens
aaatagaaccactatg

SEQ ID NO: 377606 - DNA, 15 bp, Homo sapiens
aaatagagcttttaa

SEQ ID NO: 377607 - DNA, 20 bp, Homo sapiens
aaatagagcttttaaaaatg

SEQ ID NO: 377608 - DNA, 19 bp, Homo sapiens
aaatagagtatatgcactt

SEQ ID NO: 377609 - DNA, 20 bp, Homo sapiens
aaatagagtttttatatttg

SEQ ID NO: 377610 - DNA, 15 bp, Homo sapiens
aaatagctaaatggc

SEQ ID NO: 377611 - DNA, 16 bp, Homo sapiens
aaatagctaaatggca

SEQ ID NO: 377612 - DNA, 18 bp, Homo sapiens
aaatagctataaatagtg

SEQ ID NO: 377613 - DNA, 16 bp, Homo sapiens
aaatagcttgtatagt

SEQ ID NO: 377614 - DNA, 18 bp, Homo sapiens
aaatagggcaaagaatca

SEQ ID NO: 377615 - DNA, 20 bp, Homo sapiens
aaatagtaggaccaatgttg

SEQ ID NO: 377616 - DNA, 20 bp, Homo sapiens
aaatagtgcagaatctcata

SEQ ID NO: 377617 - DNA, 15 bp, Homo sapiens
aaatagtgttctttt

SEQ ID NO: 377618 - DNA, 21 bp, Homo sapiens
aaatagttattttaatacctt

SEQ ID NO: 377619 - DNA, 19 bp, Homo sapiens
aaatagtttatttttcaca

SEQ ID NO: 377620 - DNA, 12 bp, Homo sapiens
aaatataaatta

SEQ ID NO: 377621 - DNA, 23 bp, Homo sapiens
aaatataacaggtgcttctttgt

SEQ ID NO: 377622 - DNA, 14 bp, Homo sapiens
aaatatacaacttt

SEQ ID NO: 377623 - DNA, 16 bp, Homo sapiens
aaatatactaataaaa

SEQ ID NO: 377624 - DNA, 18 bp, Homo sapiens
aaatatactaataaaaag

SEQ ID NO: 377625 - DNA, 19 bp, Homo sapiens
aaatatactaataaaaagg

SEQ ID NO: 377626 - DNA, 20 bp, Homo sapiens
aaatatactaataaaaaggt

SEQ ID NO: 377627 - DNA, 21 bp, Homo sapiens
aaatatactaataaaaaggtt

SEQ ID NO: 377628 - DNA, 16 bp, Homo sapiens
aaatatagaattttta

SEQ ID NO: 377629 - DNA, 22 bp, Homo sapiens
aaatatagttgtctttctttgc

SEQ ID NO: 377630 - DNA, 22 bp, Homo sapiens
aaatatagtttgattcttcatt

SEQ ID NO: 377631 - DNA, 13 bp, Homo sapiens
aaatatatataac

SEQ ID NO: 377632 - DNA, 15 bp, Homo sapiens
aaatatatgtatgta

SEQ ID NO: 377633 - DNA, 19 bp, Homo sapiens
aaatatatgtatgtaaaaa

SEQ ID NO: 377634 - DNA, 20 bp, Homo sapiens
aaatatatgtatgtaaaaat

SEQ ID NO: 377635 - DNA, 17 bp, Homo sapiens
aaatatatgtttggctg

SEQ ID NO: 377636 - DNA, 19 bp, Homo sapiens
aaatatatgtttggctgaa

SEQ ID NO: 377637 - DNA, 14 bp, Homo sapiens
aaatatattaaaaa

SEQ ID NO: 377638 - DNA, 15 bp, Homo sapiens
aaatatattaaaaat

SEQ ID NO: 377639 - DNA, 23 bp, Homo sapiens
aaatatattcaggagttggaatg

SEQ ID NO: 377640 - DNA, 14 bp, Homo sapiens
aaatatattgtata

SEQ ID NO: 377641 - DNA, 23 bp, Homo sapiens
aaatatatttttccctgtttgcc

SEQ ID NO: 377642 - DNA, 16 bp, Homo sapiens
aaatatcactttgtat

SEQ ID NO: 377643 - DNA, 19 bp, Homo sapiens
aaatatcattatagcatgt

SEQ ID NO: 377644 - DNA, 22 bp, Homo sapiens
aaatatcattatagcatgtaat

SEQ ID NO: 377645 - DNA, 15 bp, Homo sapiens
aaatatcattcagca

SEQ ID NO: 377646 - DNA, 18 bp, Homo sapiens
aaatatcatttatttttt

SEQ ID NO: 377647 - DNA, 17 bp, Homo sapiens
aaatatgagattggaaa

SEQ ID NO: 377648 - DNA, 15 bp, Homo sapiens
aaatatgatatatat

SEQ ID NO: 377649 - DNA, 21 bp, Homo sapiens
aaatatgattctcctctccca

SEQ ID NO: 377650 - DNA, 19 bp, Homo sapiens
aaatatgattttatttgac

SEQ ID NO: 377651 - DNA, 20 bp, Homo sapiens
aaatatgattttatttgaca

SEQ ID NO: 377652 - DNA, 10 bp, Homo sapiens
aaatatgcaa

SEQ ID NO: 377653 - DNA, 19 bp, Homo sapiens
aaatatgcactttccctag

SEQ ID NO: 377654 - DNA, 13 bp, Homo sapiens
aaatatgcatgta

SEQ ID NO: 377655 - DNA, 22 bp, Homo sapiens
aaatatgcccctccccagtagc

SEQ ID NO: 377656 - DNA, 17 bp, Homo sapiens
aaatatggaacttctaa

SEQ ID NO: 377657 - DNA, 18 bp, Homo sapiens
aaatatggaacttctaat

SEQ ID NO: 377658 - DNA, 20 bp, Homo sapiens
aaatatggaacttctaatat

SEQ ID NO: 377659 - DNA, 19 bp, Homo sapiens
aaatatggctataaatata

SEQ ID NO: 377660 - DNA, 16 bp, Homo sapiens
aaatatgtcctggggt

SEQ ID NO: 377661 - DNA, 20 bp, Homo sapiens
aaatatgtgagcatgaaact

SEQ ID NO: 377662 - DNA, 21 bp, Homo sapiens
aaatatgtgagcatgaaacta

SEQ ID NO: 377663 - DNA, 18 bp, Homo sapiens
aaatattaaaagaaaggg

SEQ ID NO: 377664 - DNA, 22 bp, Homo sapiens
aaatattatctttgtaattatt

SEQ ID NO: 377665 - DNA, 15 bp, Homo sapiens
aaatattatgatttt

SEQ ID NO: 377666 - DNA, 23 bp, Homo sapiens
aaatattattgtggaaatgaata

SEQ ID NO: 377667 - DNA, 20 bp, Homo sapiens
aaatattattttatgaaagg

SEQ ID NO: 377668 - DNA, 23 bp, Homo sapiens
aaatattccatccatatactttg

SEQ ID NO: 377669 - DNA, 17 bp, Homo sapiens
aaatattcttgtccaca

SEQ ID NO: 377670 - DNA, 20 bp, Homo sapiens
aaatattcttgtccacattc

SEQ ID NO: 377671 - DNA, 17 bp, Homo sapiens
aaatatttatgacctca

SEQ ID NO: 377672 - DNA, 22 bp, Homo sapiens
aaatatttatgacctcaacaaa

SEQ ID NO: 377673 - DNA, 20 bp, Homo sapiens
aaatatttctaagcttattt

SEQ ID NO: 377674 - DNA, 17 bp, Homo sapiens
aaatatttctatgtaaa

SEQ ID NO: 377675 - DNA, 18 bp, Homo sapiens
aaatatttctatgtaaat

SEQ ID NO: 377676 - DNA, 14 bp, Homo sapiens
aaatatttttgtac

SEQ ID NO: 377677 - DNA, 16 bp, Homo sapiens
aaatatttttttctag

SEQ ID NO: 377678 - DNA, 19 bp, Homo sapiens
aaatatttttttctagcta

SEQ ID NO: 377679 - DNA, 21 bp, Homo sapiens
aaatatttttttctagctata

SEQ ID NO: 377680 - DNA, 22 bp, Homo sapiens
aaatatttttttctagctataa

SEQ ID NO: 377681 - DNA, 15 bp, Homo sapiens
aaatcaaatttttct

SEQ ID NO: 377682 - DNA, 17 bp, Homo sapiens
aaatcaccttttctaaa

SEQ ID NO: 377683 - DNA, 21 bp, Homo sapiens
aaatcaccttttctaaaaagt

SEQ ID NO: 377684 - DNA, 12 bp, Homo sapiens
aaatcagacaca

SEQ ID NO: 377685 - DNA, 14 bp, Homo sapiens
aaatcagacacaat

SEQ ID NO: 377686 - DNA, 17 bp, Homo sapiens
aaatcaggattttagtg

SEQ ID NO: 377687 - DNA, 18 bp, Homo sapiens
aaatcagtgtttaaataa

SEQ ID NO: 377688 - DNA, 19 bp, Homo sapiens
aaatcagttttgtgtacag

SEQ ID NO: 377689 - DNA, 22 bp, Homo sapiens
aaatcataggaaagtatttttt

SEQ ID NO: 377690 - DNA, 13 bp, Homo sapiens
aaatcatattgat

SEQ ID NO: 377691 - DNA, 19 bp, Homo sapiens
aaatcattcaaaactttca

SEQ ID NO: 377692 - DNA, 17 bp, Homo sapiens
aaatccagaagttttaa

SEQ ID NO: 377693 - DNA, 12 bp, Homo sapiens
aaatccagcccc

SEQ ID NO: 377694 - DNA, 20 bp, Homo sapiens
aaatccagccccatagaaaa

SEQ ID NO: 377695 - DNA, 22 bp, Homo sapiens
aaatccataccccctgccccag

SEQ ID NO: 377696 - DNA, 20 bp, Homo sapiens
aaatccatatcttaaagaaa

SEQ ID NO: 377697 - DNA, 16 bp, Homo sapiens
aaatcccagttcatgt

SEQ ID NO: 377698 - DNA, 14 bp, Homo sapiens
cacaggggcaggcc

SEQ ID NO: 377699 - DNA, 18 bp, Homo sapiens
cacaggggcaggcctggg

SEQ ID NO: 377700 - DNA, 13 bp, Homo sapiens
cacaggggcccca

SEQ ID NO: 377701 - DNA, 18 bp, Homo sapiens
cacaggggccccagatct

SEQ ID NO: 377702 - DNA, 19 bp, Homo sapiens
cacaggggccccagatctg

SEQ ID NO: 377703 - DNA, 16 bp, Homo sapiens
cacaggggcggggcag

SEQ ID NO: 377704 - DNA, 18 bp, Homo sapiens
cacaggggcggggcagga

SEQ ID NO: 377705 - DNA, 22 bp, Homo sapiens
cacaggggctatcccttctcag

SEQ ID NO: 377706 - DNA, 23 bp, Homo sapiens
cacaggggctatcccttctcaga

SEQ ID NO: 377707 - DNA, 14 bp, Homo sapiens
cacagggttgggcc

SEQ ID NO: 377708 - DNA, 19 bp, Homo sapiens
cacaggttcatgccaccat

SEQ ID NO: 377709 - DNA, 18 bp, Homo sapiens
cacagtacaatgtttcag

SEQ ID NO: 377710 - DNA, 15 bp, Homo sapiens
cacagtccctcctgt

SEQ ID NO: 377711 - DNA, 14 bp, Homo sapiens
cacagtcctcacag

SEQ ID NO: 377712 - DNA, 17 bp, Homo sapiens
cacagtcctcacagcct

SEQ ID NO: 377713 - DNA, 17 bp, Homo sapiens
cacagtctctccctggg

SEQ ID NO: 377714 - DNA, 21 bp, Homo sapiens
cacagtgagagtactcacttt

SEQ ID NO: 377715 - DNA, 14 bp, Homo sapiens
cacagtgcatctca

SEQ ID NO: 377716 - DNA, 13 bp, Homo sapiens
cacagtgctcagt

SEQ ID NO: 377717 - DNA, 17 bp, Homo sapiens
cacagtgctgcttctct

SEQ ID NO: 377718 - DNA, 21 bp, Homo sapiens
cacagtgggccggccccaggc

SEQ ID NO: 377719 - DNA, 22 bp, Homo sapiens
cacagtgggccggccccaggct

SEQ ID NO: 377720 - DNA, 14 bp, Homo sapiens
cacagtggggccca

SEQ ID NO: 377721 - DNA, 18 bp, Homo sapiens
cacagtgggtggcacctc

SEQ ID NO: 377722 - DNA, 20 bp, Homo sapiens
cacagtgtaatccaggggtg

SEQ ID NO: 377723 - DNA, 19 bp, Homo sapiens
cacagtgttgcccaggctg

SEQ ID NO: 377724 - DNA, 14 bp, Homo sapiens
cacagttctctcct

SEQ ID NO: 377725 - DNA, 15 bp, Homo sapiens
cacagttctctcctt

SEQ ID NO: 377726 - DNA, 22 bp, Homo sapiens
cacagttggctggatgaaattt

SEQ ID NO: 377727 - DNA, 24 bp, Homo sapiens
cacagttgtctattctgagccttg

SEQ ID NO: 377728 - DNA, 14 bp, Homo sapiens
cacagtttgcaatc

SEQ ID NO: 377729 - DNA, 22 bp, Homo sapiens
cacagtttgctatttgctttag

SEQ ID NO: 377730 - DNA, 15 bp, Homo sapiens
cacagttttgaaaga

SEQ ID NO: 377731 - DNA, 18 bp, Homo sapiens
cacataaatctgtctgat

SEQ ID NO: 377732 - DNA, 22 bp, Homo sapiens
cacataatccacgctcatcttg

SEQ ID NO: 377733 - DNA, 13 bp, Homo sapiens
cacatacacacac

SEQ ID NO: 377734 - DNA, 15 bp, Homo sapiens
cacataccctccccc

SEQ ID NO: 377735 - DNA, 22 bp, Homo sapiens
cacatagattcacctgtaaaac

SEQ ID NO: 377736 - DNA, 21 bp, Homo sapiens
cacatagtgggccttcattaa

SEQ ID NO: 377737 - DNA, 14 bp, Homo sapiens
cacatcattggaat

SEQ ID NO: 377738 - DNA, 15 bp, Homo sapiens
cacatcccagcagcc

SEQ ID NO: 377739 - DNA, 16 bp, Homo sapiens
cacatcccagcagccc

SEQ ID NO: 377740 - DNA, 22 bp, Homo sapiens
cacatcccagcagcccaagctt

SEQ ID NO: 377741 - DNA, 22 bp, Homo sapiens
cacatcccaggcttcaccctga

SEQ ID NO: 377742 - DNA, 17 bp, Homo sapiens
cacatcccggcctcttc

SEQ ID NO: 377743 - DNA, 19 bp, Homo sapiens
cacatcccggcctcttcca

SEQ ID NO: 377744 - DNA, 21 bp, Homo sapiens
cacatcccggcctcttccacc

SEQ ID NO: 377745 - DNA, 14 bp, Homo sapiens
cacatcctccgtcc

SEQ ID NO: 377746 - DNA, 22 bp, Homo sapiens
cacatctcctccatactcagga

SEQ ID NO: 377747 - DNA, 11 bp, Homo sapiens
cacatctctgc

SEQ ID NO: 377748 - DNA, 13 bp, Homo sapiens
cacatctgcattt

SEQ ID NO: 377749 - DNA, 12 bp, Homo sapiens
cacatcttccct

SEQ ID NO: 377750 - DNA, 22 bp, Homo sapiens
cacatcttccctagagggttcc

SEQ ID NO: 377751 - DNA, 14 bp, Homo sapiens
cacatcttgtcttt

SEQ ID NO: 377752 - DNA, 16 bp, Homo sapiens
cacatgaatttctgcc

SEQ ID NO: 377753 - DNA, 14 bp, Homo sapiens
cacatgagtcccag

SEQ ID NO: 377754 - DNA, 16 bp, Homo sapiens
cacatgcactcagtgt

SEQ ID NO: 377755 - DNA, 20 bp, Homo sapiens
cacatgctctcaatatataa

SEQ ID NO: 377756 - DNA, 13 bp, Homo sapiens
cacatgctggcca

SEQ ID NO: 377757 - DNA, 14 bp, Homo sapiens
cacatgctggccag

SEQ ID NO: 377758 - DNA, 17 bp, Homo sapiens
cacatgctggccagcct

SEQ ID NO: 377759 - DNA, 21 bp, Homo sapiens
cacatgcttgatggtttatgt

SEQ ID NO: 377760 - DNA, 21 bp, Homo sapiens
cacatggtccatttcatgtga

SEQ ID NO: 377761 - DNA, 16 bp, Homo sapiens
cacattatagaaatta

SEQ ID NO: 377762 - DNA, 20 bp, Homo sapiens
cacattatcgggagcagtgt

SEQ ID NO: 377763 - DNA, 23 bp, Homo sapiens
cacattatcgggagcagtgtctt

SEQ ID NO: 377764 - DNA, 18 bp, Homo sapiens
cacattatgttagagagg

SEQ ID NO: 377765 - DNA, 14 bp, Homo sapiens
cacattatttgcat

SEQ ID NO: 377766 - DNA, 15 bp, Homo sapiens
cacattatttgcatg

SEQ ID NO: 377767 - DNA, 13 bp, Homo sapiens
cacattccctctc

SEQ ID NO: 377768 - DNA, 16 bp, Homo sapiens
cacattccctctcatc

SEQ ID NO: 377769 - DNA, 15 bp, Homo sapiens
cacattcctggcccc

SEQ ID NO: 377770 - DNA, 13 bp, Homo sapiens
cacattctacttc

SEQ ID NO: 377771 - DNA, 12 bp, Homo sapiens
cacattctccct

SEQ ID NO: 377772 - DNA, 18 bp, Homo sapiens
cacattctgctgccccca

SEQ ID NO: 377773 - DNA, 22 bp, Homo sapiens
cacattctgctgcccccagacc

SEQ ID NO: 377774 - DNA, 13 bp, Homo sapiens
cacattcttaagg

SEQ ID NO: 377775 - DNA, 21 bp, Homo sapiens
cacattcttaaggcaataaaa

SEQ ID NO: 377776 - DNA, 21 bp, Homo sapiens
cacattgccagtgacatgaga

SEQ ID NO: 377777 - DNA, 20 bp, Homo sapiens
cacattgtgtcacatcatga

SEQ ID NO: 377778 - DNA, 13 bp, Homo sapiens
cacatttaaaaca

SEQ ID NO: 377779 - DNA, 14 bp, Homo sapiens
cacatttaaaacat

SEQ ID NO: 377780 - DNA, 15 bp, Homo sapiens
cacatttaaaacatt

SEQ ID NO: 377781 - DNA, 17 bp, Homo sapiens
cacatttaaaacatttg

SEQ ID NO: 377782 - DNA, 19 bp, Homo sapiens
cacatttctggccatttaa

SEQ ID NO: 377783 - DNA, 19 bp, Homo sapiens
cacatttgtaaatgtcttt

SEQ ID NO: 377784 - DNA, 20 bp, Homo sapiens
cacatttgtcactgaataat

SEQ ID NO: 377785 - DNA, 21 bp, Homo sapiens
cacattttaacagtacctgtg

SEQ ID NO: 377786 - DNA, 21 bp, Homo sapiens
cacattttccacggaaacaga

SEQ ID NO: 377787 - DNA, 17 bp, Homo sapiens
caccaaagatgcagccg

SEQ ID NO: 377788 - DNA, 18 bp, Homo sapiens
caccaaagatgcagccgc

SEQ ID NO: 377789 - DNA, 15 bp, Homo sapiens
caccaaatctgtcta

SEQ ID NO: 377790 - DNA, 19 bp, Homo sapiens
caccaaatgcctctgcctt

SEQ ID NO: 377791 - DNA, 18 bp, Homo sapiens
caccaaattgctgagatg

SEQ ID NO: 377792 - DNA, 19 bp, Homo sapiens
caccaacaacagtcagcca

SEQ ID NO: 377793 - DNA, 20 bp, Homo sapiens
caccaacaacagtcagccag

SEQ ID NO: 377794 - DNA, 16 bp, Homo sapiens
caccaacctcactgcc

SEQ ID NO: 377795 - DNA, 17 bp, Homo sapiens
caccaacctcactgccc

SEQ ID NO: 377796 - DNA, 18 bp, Homo sapiens
caccaacctcactgccct

SEQ ID NO: 377797 - DNA, 15 bp, Homo sapiens
caccaactctgcact

SEQ ID NO: 377798 - DNA, 22 bp, Homo sapiens
caccaactctgcactccatggc

SEQ ID NO: 377799 - DNA, 13 bp, Homo sapiens
caccaagaagggg

SEQ ID NO: 377800 - DNA, 19 bp, Homo sapiens
caccaagacttgaaggtgc

SEQ ID NO: 377801 - DNA, 15 bp, Homo sapiens
caccaagcccacagg

SEQ ID NO: 377802 - DNA, 17 bp, Homo sapiens
caccaagccctgcaaat

SEQ ID NO: 377803 - DNA, 22 bp, Homo sapiens
caccaagctgctctccttcact

SEQ ID NO: 377804 - DNA, 17 bp, Homo sapiens
caccaagggtatctgct

SEQ ID NO: 377805 - DNA, 16 bp, Homo sapiens
caccaataaaaatcct

SEQ ID NO: 377806 - DNA, 23 bp, Homo sapiens
caccacaactaacaatgccttgt

SEQ ID NO: 377807 - DNA, 16 bp, Homo sapiens
caccacaagagctcct

SEQ ID NO: 377808 - DNA, 14 bp, Homo sapiens
caccacactgacca

SEQ ID NO: 377809 - DNA, 21 bp, Homo sapiens
caccacagaagcttgtattat

SEQ ID NO: 377810 - DNA, 18 bp, Homo sapiens
caccacagacgccacctg

SEQ ID NO: 377811 - DNA, 13 bp, Homo sapiens
caccacagcaggt

SEQ ID NO: 377812 - DNA, 22 bp, Homo sapiens
caccaccagatgagaagttaag

SEQ ID NO: 377813 - DNA, 15 bp, Homo sapiens
caccaccagccagcg

SEQ ID NO: 377814 - DNA, 12 bp, Homo sapiens
caccacccaccc

SEQ ID NO: 377815 - DNA, 16 bp, Homo sapiens
caccaccccagctgct

SEQ ID NO: 377816 - DNA, 17 bp, Homo sapiens
caccaccccctgtccca

SEQ ID NO: 377817 - DNA, 20 bp, Homo sapiens
caccacccctccctctgctc

SEQ ID NO: 377818 - DNA, 21 bp, Homo sapiens
caccacccctccctctgctct

SEQ ID NO: 377819 - DNA, 22 bp, Homo sapiens
caccaccctagtcccttcccct

SEQ ID NO: 377820 - DNA, 16 bp, Homo sapiens
caccacctcactcctg

SEQ ID NO: 377821 - DNA, 20 bp, Homo sapiens
caccacctggatggatctgc

SEQ ID NO: 377822 - DNA, 21 bp, Homo sapiens
caccacctggatggatctgct

SEQ ID NO: 377823 - DNA, 15 bp, Homo sapiens
caccacgtccagctg

SEQ ID NO: 377824 - DNA, 15 bp, Homo sapiens
caccacgtctgccag

SEQ ID NO: 377825 - DNA, 16 bp, Homo sapiens
caccacgtctgccagg

SEQ ID NO: 377826 - DNA, 21 bp, Homo sapiens
caccacgtctgccaggcccat

SEQ ID NO: 377827 - DNA, 18 bp, Homo sapiens
caccactaaccatcccca

SEQ ID NO: 377828 - DNA, 19 bp, Homo sapiens
cacccctccctctgctctc

SEQ ID NO: 377829 - DNA, 17 bp, Homo sapiens
cacccctcctgggccca

SEQ ID NO: 377830 - DNA, 20 bp, Homo sapiens
cacccctcctgggcccaggc

SEQ ID NO: 377831 - DNA, 13 bp, Homo sapiens
cacccctccttcc

SEQ ID NO: 377832 - DNA, 14 bp, Homo sapiens
cacccctccttccc

SEQ ID NO: 377833 - DNA, 17 bp, Homo sapiens
cacccctccttccctgg

SEQ ID NO: 377834 - DNA, 11 bp, Homo sapiens
cacccctgcac

SEQ ID NO: 377835 - DNA, 12 bp, Homo sapiens
cacccctgcact

SEQ ID NO: 377836 - DNA, 14 bp, Homo sapiens
cacccctgcccagg

SEQ ID NO: 377837 - DNA, 20 bp, Homo sapiens
cacccctgccggccttggcc

SEQ ID NO: 377838 - DNA, 15 bp, Homo sapiens
cacccctggaaccag

SEQ ID NO: 377839 - DNA, 14 bp, Homo sapiens
cacccctgggcagg

SEQ ID NO: 377840 - DNA, 19 bp, Homo sapiens
cacccctgtacccagccac

SEQ ID NO: 377841 - DNA, 15 bp, Homo sapiens
caccccttccccact

SEQ ID NO: 377842 - DNA, 13 bp, Homo sapiens
caccccttgccca

SEQ ID NO: 377843 - DNA, 15 bp, Homo sapiens
cacccctttctagtt

SEQ ID NO: 377844 - DNA, 22 bp, Homo sapiens
cacccctttctagttcaatgcc

SEQ ID NO: 377845 - DNA, 20 bp, Homo sapiens
cacccgacaccagccctgct

SEQ ID NO: 377846 - DNA, 22 bp, Homo sapiens
cacccgacaccagccctgctgc

SEQ ID NO: 377847 - DNA, 23 bp, Homo sapiens
cacccgccccagagactgcccac

SEQ ID NO: 377848 - DNA, 14 bp, Homo sapiens
cacccgcccgcccc

SEQ ID NO: 377849 - DNA, 14 bp, Homo sapiens
cacccgccctttcc

SEQ ID NO: 377850 - DNA, 16 bp, Homo sapiens
cacccgctgcccagcc

SEQ ID NO: 377851 - DNA, 17 bp, Homo sapiens
cacccgctgcccagccc

SEQ ID NO: 377852 - DNA, 18 bp, Homo sapiens
cacccgctgcccagccct

SEQ ID NO: 377853 - DNA, 15 bp, Homo sapiens
cacccgcttcctgtt

SEQ ID NO: 377854 - DNA, 17 bp, Homo sapiens
cacccggaaagactgaa

SEQ ID NO: 377855 - DNA, 15 bp, Homo sapiens
cacccggatctccag

SEQ ID NO: 377856 - DNA, 21 bp, Homo sapiens
cacccggatctccaggcccag

SEQ ID NO: 377857 - DNA, 13 bp, Homo sapiens
cacccggcagccc

SEQ ID NO: 377858 - DNA, 21 bp, Homo sapiens
cacccggcagccccccagtgt

SEQ ID NO: 377859 - DNA, 18 bp, Homo sapiens
cacccggccacagctgct

SEQ ID NO: 377860 - DNA, 17 bp, Homo sapiens
cacccgtaggcagcctc

SEQ ID NO: 377861 - DNA, 21 bp, Homo sapiens
cacccgtaggcagcctctctg

SEQ ID NO: 377862 - DNA, 17 bp, Homo sapiens
cacccgtcctggggtgg

SEQ ID NO: 377863 - DNA, 21 bp, Homo sapiens
cacccgtcttcaatctctgtt

SEQ ID NO: 377864 - DNA, 16 bp, Homo sapiens
cacccgtggagatggg

SEQ ID NO: 377865 - DNA, 21 bp, Homo sapiens
cacccgttctgctggcctgga

SEQ ID NO: 377866 - DNA, 16 bp, Homo sapiens
caccctaactcttgct

SEQ ID NO: 377867 - DNA, 20 bp, Homo sapiens
caccctaactcttgctcact

SEQ ID NO: 377868 - DNA, 21 bp, Homo sapiens
caccctaactgagctgccagt

SEQ ID NO: 377869 - DNA, 22 bp, Homo sapiens
caccctaatttgcccttcagga

SEQ ID NO: 377870 - DNA, 22 bp, Homo sapiens
caccctacaagttgatcatgca

SEQ ID NO: 377871 - DNA, 12 bp, Homo sapiens
caccctacctgt

SEQ ID NO: 377872 - DNA, 14 bp, Homo sapiens
caccctacctgttc

SEQ ID NO: 377873 - DNA, 17 bp, Homo sapiens
caccctagtcccttccc

SEQ ID NO: 377874 - DNA, 16 bp, Homo sapiens
caccctagtttccctg

SEQ ID NO: 377875 - DNA, 14 bp, Homo sapiens
caccctcacacaca

SEQ ID NO: 377876 - DNA, 16 bp, Homo sapiens
aggacccacccatctt

SEQ ID NO: 377877 - DNA, 14 bp, Homo sapiens
aggacccaggccct

SEQ ID NO: 377878 - DNA, 16 bp, Homo sapiens
aggacccaggccctcc

SEQ ID NO: 377879 - DNA, 21 bp, Homo sapiens
aggaccccagagggaccagct

SEQ ID NO: 377880 - DNA, 17 bp, Homo sapiens
aggaccccatctgctga

SEQ ID NO: 377881 - DNA, 18 bp, Homo sapiens
aggaccccatctgctgag

SEQ ID NO: 377882 - DNA, 22 bp, Homo sapiens
aggaccccatctgctgagctct

SEQ ID NO: 377883 - DNA, 13 bp, Homo sapiens
aggacccctcacc

SEQ ID NO: 377884 - DNA, 11 bp, Homo sapiens
agctgtgaaat

SEQ ID NO: 377885 - DNA, 15 bp, Homo sapiens
agctgtgaaattgaa

SEQ ID NO: 377886 - DNA, 18 bp, Homo sapiens
agctgtgaaattgaagtc

SEQ ID NO: 377887 - DNA, 18 bp, Homo sapiens
agctgtgactgagggcct

SEQ ID NO: 377888 - DNA, 16 bp, Homo sapiens
agctgtggggagctgg

SEQ ID NO: 377889 - DNA, 17 bp, Homo sapiens
agctgtggggagctggt

SEQ ID NO: 377890 - DNA, 21 bp, Homo sapiens
agctgtgggtacagagaggtc

SEQ ID NO: 377891 - DNA, 20 bp, Homo sapiens
agctgtgtttgagtttctgg

SEQ ID NO: 377892 - DNA, 15 bp, Homo sapiens
agctgttactttctt

SEQ ID NO: 377893 - DNA, 17 bp, Homo sapiens
agctgttactttctttc

SEQ ID NO: 377894 - DNA, 21 bp, Homo sapiens
agctgttcaacaagagtaaat

SEQ ID NO: 377895 - DNA, 16 bp, Homo sapiens
agctgttgagctgttt

SEQ ID NO: 377896 - DNA, 19 bp, Homo sapiens
agctgtttatggcctcagc

SEQ ID NO: 377897 - DNA, 20 bp, Homo sapiens
agctgtttatggcctcagct

SEQ ID NO: 377898 - DNA, 18 bp, Homo sapiens
agctgttttagttaaatt

SEQ ID NO: 377899 - DNA, 14 bp, Homo sapiens
agctgttttggatg

SEQ ID NO: 377900 - DNA, 12 bp, Homo sapiens
agcttaaaaaaa

SEQ ID NO: 377901 - DNA, 20 bp, Homo sapiens
agcttaaaataaacagttgt

SEQ ID NO: 377902 - DNA, 14 bp, Homo sapiens
agcttaaaataagt

SEQ ID NO: 377903 - DNA, 24 bp, Homo sapiens
agcttaaattgcttttgttgtgac

SEQ ID NO: 377904 - DNA, 21 bp, Homo sapiens
agcttaatagccctccccctc

SEQ ID NO: 377905 - DNA, 15 bp, Homo sapiens
agcttacaagccagc

SEQ ID NO: 377906 - DNA, 22 bp, Homo sapiens
agcttagattttctgtaaatga

SEQ ID NO: 377907 - DNA, 17 bp, Homo sapiens
agcttagccaatgtggg

SEQ ID NO: 377908 - DNA, 13 bp, Homo sapiens
agcttagccttgt

SEQ ID NO: 377909 - DNA, 16 bp, Homo sapiens
agcttatctccctgct

SEQ ID NO: 377910 - DNA, 19 bp, Homo sapiens
agcttatctccctgcttca

SEQ ID NO: 377911 - DNA, 20 bp, Homo sapiens
agcttatctccctgcttcat

SEQ ID NO: 377912 - DNA, 21 bp, Homo sapiens
agcttattaatgctaagggca

SEQ ID NO: 377913 - DNA, 15 bp, Homo sapiens
agcttattggccact

SEQ ID NO: 377914 - DNA, 17 bp, Homo sapiens
agcttattggccactgg

SEQ ID NO: 377915 - DNA, 21 bp, Homo sapiens
agcttatttagcacattttga

SEQ ID NO: 377916 - DNA, 12 bp, Homo sapiens
agcttcaaaaca

SEQ ID NO: 377917 - DNA, 15 bp, Homo sapiens
agcttcaaaacagaa

SEQ ID NO: 377918 - DNA, 15 bp, Homo sapiens
agcttcaaagttggc

SEQ ID NO: 377919 - DNA, 19 bp, Homo sapiens
agcttcaagtctgtgcctg

SEQ ID NO: 377920 - DNA, 17 bp, Homo sapiens
agcttcatgcctttgta

SEQ ID NO: 377921 - DNA, 18 bp, Homo sapiens
agcttcatgcctttgtaa

SEQ ID NO: 377922 - DNA, 19 bp, Homo sapiens
agcttcatttgtgtcaatg

SEQ ID NO: 377923 - DNA, 18 bp, Homo sapiens
agcttccaaatttgaatg

SEQ ID NO: 377924 - DNA, 13 bp, Homo sapiens
agcttccagatgg

SEQ ID NO: 377925 - DNA, 18 bp, Homo sapiens
agcttcccaacaatactt

SEQ ID NO: 377926 - DNA, 18 bp, Homo sapiens
agcttcctccagaggagg

SEQ ID NO: 377927 - DNA, 13 bp, Homo sapiens
agcttcctgtttc

SEQ ID NO: 377928 - DNA, 14 bp, Homo sapiens
agcttcctgtttct

SEQ ID NO: 377929 - DNA, 14 bp, Homo sapiens
agcttccttccaag

SEQ ID NO: 377930 - DNA, 19 bp, Homo sapiens
agcttccttctgtgaaagt

SEQ ID NO: 377931 - DNA, 21 bp, Homo sapiens
agcttcggagggcccctgcgt

SEQ ID NO: 377932 - DNA, 17 bp, Homo sapiens
agcttcgtgctggagga

SEQ ID NO: 377933 - DNA, 17 bp, Homo sapiens
agcttctatcccaggag

SEQ ID NO: 377934 - DNA, 18 bp, Homo sapiens
agcttctctgccaagccc

SEQ ID NO: 377935 - DNA, 23 bp, Homo sapiens
agcttcttaatataactgcctta

SEQ ID NO: 377936 - DNA, 14 bp, Homo sapiens
agcttcttgctcct

SEQ ID NO: 377937 - DNA, 12 bp, Homo sapiens
agcttgaatgtc

SEQ ID NO: 377938 - DNA, 13 bp, Homo sapiens
agcttgaatgtcc

SEQ ID NO: 377939 - DNA, 23 bp, Homo sapiens
agcttgaatgtccccattctata

SEQ ID NO: 377940 - DNA, 20 bp, Homo sapiens
agcttgagctcccctggagc

SEQ ID NO: 377941 - DNA, 23 bp, Homo sapiens
agcttgcgttagaatgaggagga

SEQ ID NO: 377942 - DNA, 17 bp, Homo sapiens
agcttggcagccgagct

SEQ ID NO: 377943 - DNA, 20 bp, Homo sapiens
agcttggcagccgagctcgt

SEQ ID NO: 377944 - DNA, 15 bp, Homo sapiens
agcttggctgagccc

SEQ ID NO: 377945 - DNA, 21 bp, Homo sapiens
agcttggctgagccccctctc

SEQ ID NO: 377946 - DNA, 18 bp, Homo sapiens
agcttgggagagcccctg

SEQ ID NO: 377947 - DNA, 24 bp, Homo sapiens
agcttgggagagcccctggggcct

SEQ ID NO: 377948 - DNA, 18 bp, Homo sapiens
agcttgggcccagctggg

SEQ ID NO: 377949 - DNA, 21 bp, Homo sapiens
agcttgggcccagctgggctc

SEQ ID NO: 377950 - DNA, 18 bp, Homo sapiens
agcttggggaacccatga

SEQ ID NO: 377951 - DNA, 17 bp, Homo sapiens
agcttggttcctgcccc

SEQ ID NO: 377952 - DNA, 16 bp, Homo sapiens
agcttgtctttaaagt

SEQ ID NO: 377953 - DNA, 19 bp, Homo sapiens
agcttgtttccctgctggc

SEQ ID NO: 377954 - DNA, 22 bp, Homo sapiens
agcttgtttccctgctggccaa

SEQ ID NO: 377955 - DNA, 19 bp, Homo sapiens
agcttgttttggactttgt

SEQ ID NO: 377956 - DNA, 20 bp, Homo sapiens
agcttgttttggactttgtt

SEQ ID NO: 377957 - DNA, 19 bp, Homo sapiens
agctttattttttaagtat

SEQ ID NO: 377958 - DNA, 12 bp, Homo sapiens
agctttcagagc

SEQ ID NO: 377959 - DNA, 19 bp, Homo sapiens
agctttcagagccagtgaa

SEQ ID NO: 377960 - DNA, 21 bp, Homo sapiens
agctttcccaaataaactcta

SEQ ID NO: 377961 - DNA, 15 bp, Homo sapiens
agctttccctggctc

SEQ ID NO: 377962 - DNA, 16 bp, Homo sapiens
agctttccctggctca

SEQ ID NO: 377963 - DNA, 17 bp, Homo sapiens
agctttccctggctcag

SEQ ID NO: 377964 - DNA, 20 bp, Homo sapiens
agctttccctggctcaggga

SEQ ID NO: 377965 - DNA, 18 bp, Homo sapiens
agctttccggggaggagc

SEQ ID NO: 377966 - DNA, 22 bp, Homo sapiens
agctttccggggaggagccttg

SEQ ID NO: 377967 - DNA, 12 bp, Homo sapiens
agctttcctggg

SEQ ID NO: 377968 - DNA, 14 bp, Homo sapiens
agctttcctgggtg

SEQ ID NO: 377969 - DNA, 23 bp, Homo sapiens
agctttctaagctttcttacaat

SEQ ID NO: 377970 - DNA, 13 bp, Homo sapiens
agctttctccaga

SEQ ID NO: 377971 - DNA, 13 bp, Homo sapiens
agctttctctgct

SEQ ID NO: 377972 - DNA, 18 bp, Homo sapiens
agctttctctgcttcagc

SEQ ID NO: 377973 - DNA, 11 bp, Homo sapiens
agctttcttct

SEQ ID NO: 377974 - DNA, 17 bp, Homo sapiens
agctttcttctacaacc

SEQ ID NO: 377975 - DNA, 23 bp, Homo sapiens
agctttcttctacaaccagagcc

SEQ ID NO: 377976 - DNA, 19 bp, Homo sapiens
agctttggacgcacacagc

SEQ ID NO: 377977 - DNA, 16 bp, Homo sapiens
agcttttaataaaatt

SEQ ID NO: 377978 - DNA, 19 bp, Homo sapiens
agcttttagtacccacctg

SEQ ID NO: 377979 - DNA, 17 bp, Homo sapiens
agcttttcatggaagtg

SEQ ID NO: 377980 - DNA, 14 bp, Homo sapiens
agcttttcctccct

SEQ ID NO: 377981 - DNA, 12 bp, Homo sapiens
agcttttccttt

SEQ ID NO: 377982 - DNA, 16 bp, Homo sapiens
agcttttcctttcttt

SEQ ID NO: 377983 - DNA, 15 bp, Homo sapiens
agcttttcttgccag

SEQ ID NO: 377984 - DNA, 17 bp, Homo sapiens
agcttttcttgccagct

SEQ ID NO: 377985 - DNA, 20 bp, Homo sapiens
agcttttcttgccagctcag

SEQ ID NO: 377986 - DNA, 18 bp, Homo sapiens
agcttttgaataaaaact

SEQ ID NO: 377987 - DNA, 21 bp, Homo sapiens
agctttttaccgttcacttcc

SEQ ID NO: 377988 - DNA, 15 bp, Homo sapiens
agctttttgaaaacc

SEQ ID NO: 377989 - DNA, 14 bp, Homo sapiens
agcttttttacaca

SEQ ID NO: 377990 - DNA, 15 bp, Homo sapiens
aggaaaaaaactttt

SEQ ID NO: 377991 - DNA, 16 bp, Homo sapiens
aggaaaaaaactttta

SEQ ID NO: 377992 - DNA, 17 bp, Homo sapiens
aggaaaaaaacttttat

SEQ ID NO: 377993 - DNA, 19 bp, Homo sapiens
aggaaaaacagaacatttc

SEQ ID NO: 377994 - DNA, 18 bp, Homo sapiens
aggaaaacaaatcactgt

SEQ ID NO: 377995 - DNA, 19 bp, Homo sapiens
aggaaaaccaagccgtggc

SEQ ID NO: 377996 - DNA, 20 bp, Homo sapiens
aggaaaaccaagccgtggct

SEQ ID NO: 377997 - DNA, 16 bp, Homo sapiens
aggaaaactgaatcca

SEQ ID NO: 377998 - DNA, 23 bp, Homo sapiens
aggaaaagaacaaacaaaactta

SEQ ID NO: 377999 - DNA, 11 bp, Homo sapiens
aggaaaagagt

SEQ ID NO: 378000 - DNA, 15 bp, Homo sapiens
aggaaaaggctggca

SEQ ID NO: 378001 - DNA, 16 bp, Homo sapiens
aggaaaaggctggcaa

SEQ ID NO: 378002 - DNA, 18 bp, Homo sapiens
aggaaaaggtgatatcca

SEQ ID NO: 378003 - DNA, 21 bp, Homo sapiens
aggaaaaggtgatatccattc

SEQ ID NO: 378004 - DNA, 16 bp, Homo sapiens
aggaaaagtacattta

SEQ ID NO: 378005 - DNA, 19 bp, Homo sapiens
aggaaaagtacatttaata

SEQ ID NO: 378006 - DNA, 16 bp, Homo sapiens
aggaaaatagtaatgt

SEQ ID NO: 378007 - DNA, 21 bp, Homo sapiens
aggaaactctgcattctagta

SEQ ID NO: 378008 - DNA, 19 bp, Homo sapiens
aggaaactgaggcccagag

SEQ ID NO: 378009 - DNA, 20 bp, Homo sapiens
aggaaactgaggcccagaga

SEQ ID NO: 378010 - DNA, 14 bp, Homo sapiens
caatctttgccttt

SEQ ID NO: 378011 - DNA, 15 bp, Homo sapiens
caatgaaaagaaaat

SEQ ID NO: 378012 - DNA, 17 bp, Homo sapiens
caatgaaaccttcctct

SEQ ID NO: 378013 - DNA, 23 bp, Homo sapiens
caatgaaatatttgcttatttat

SEQ ID NO: 378014 - DNA, 15 bp, Homo sapiens
atttatataaatgta

SEQ ID NO: 378015 - DNA, 18 bp, Homo sapiens
atttatataaatgtaaaa

SEQ ID NO: 378016 - DNA, 22 bp, Homo sapiens
atttatataattatgttattga

SEQ ID NO: 378017 - DNA, 15 bp, Homo sapiens
atttatatatttata

SEQ ID NO: 378018 - DNA, 13 bp, Homo sapiens
atttatattagag

SEQ ID NO: 378019 - DNA, 13 bp, Homo sapiens
atttatatttcac

SEQ ID NO: 378020 - DNA, 14 bp, Homo sapiens
atttatatttgtct

SEQ ID NO: 378021 - DNA, 17 bp, Homo sapiens
atttatcagtgacagag

SEQ ID NO: 378022 - DNA, 16 bp, Homo sapiens
atttatccaaagcatt

SEQ ID NO: 378023 - DNA, 23 bp, Homo sapiens
atttatcttatctagcaagaaga

SEQ ID NO: 378024 - DNA, 14 bp, Homo sapiens
atttatcttctgtt

SEQ ID NO: 378025 - DNA, 24 bp, Homo sapiens
atttatcttctgtttttctcaaat

SEQ ID NO: 378026 - DNA, 19 bp, Homo sapiens
atttatcttgtctctgggc

SEQ ID NO: 378027 - DNA, 13 bp, Homo sapiens
atttatgaaaaga

SEQ ID NO: 378028 - DNA, 20 bp, Homo sapiens
atttatgacctcaacaaaga

SEQ ID NO: 378029 - DNA, 21 bp, Homo sapiens
atttatgacctcaacaaagaa

SEQ ID NO: 378030 - DNA, 18 bp, Homo sapiens
atttatgagtttttgata

SEQ ID NO: 378031 - DNA, 19 bp, Homo sapiens
atttatgagtttttgatag

SEQ ID NO: 378032 - DNA, 13 bp, Homo sapiens
atttatgcatgag

SEQ ID NO: 378033 - DNA, 22 bp, Homo sapiens
atttatgcatgagaactaaata

SEQ ID NO: 378034 - DNA, 12 bp, Homo sapiens
atttatgcattt

SEQ ID NO: 378035 - DNA, 13 bp, Homo sapiens
atttatgcattta

SEQ ID NO: 378036 - DNA, 18 bp, Homo sapiens
atttatggtcaacactta

SEQ ID NO: 378037 - DNA, 14 bp, Homo sapiens
atttatgtagatgt

SEQ ID NO: 378038 - DNA, 20 bp, Homo sapiens
atttatgtagatgtgcattt

SEQ ID NO: 378039 - DNA, 21 bp, Homo sapiens
atttatgtagatgtgcatttt

SEQ ID NO: 378040 - DNA, 19 bp, Homo sapiens
atttatgtgtgaggagctg

SEQ ID NO: 378041 - DNA, 18 bp, Homo sapiens
atttatgtttaagtgctt

SEQ ID NO: 378042 - DNA, 13 bp, Homo sapiens
atttattaaactt

SEQ ID NO: 378043 - DNA, 15 bp, Homo sapiens
atttattacctctga

SEQ ID NO: 378044 - DNA, 16 bp, Homo sapiens
atttattagctgtaaa

SEQ ID NO: 378045 - DNA, 18 bp, Homo sapiens
atttattagctgtaaata

SEQ ID NO: 378046 - DNA, 13 bp, Homo sapiens
atttattattgta

SEQ ID NO: 378047 - DNA, 18 bp, Homo sapiens
atttattcaattcctctg

SEQ ID NO: 378048 - DNA, 15 bp, Homo sapiens
atttattcatctgca

SEQ ID NO: 378049 - DNA, 15 bp, Homo sapiens
atttattcttatctt

SEQ ID NO: 378050 - DNA, 20 bp, Homo sapiens
atttatttaataacaattgt

SEQ ID NO: 378051 - DNA, 16 bp, Homo sapiens
atttatttatgtgcaa

SEQ ID NO: 378052 - DNA, 17 bp, Homo sapiens
atttatttatgtgcaag

SEQ ID NO: 378053 - DNA, 13 bp, Homo sapiens
atttatttattgt

SEQ ID NO: 378054 - DNA, 14 bp, Homo sapiens
atttatttatttaa

SEQ ID NO: 378055 - DNA, 12 bp, Homo sapiens
atttatttggag

SEQ ID NO: 378056 - DNA, 20 bp, Homo sapiens
atttattttcctccccagca

SEQ ID NO: 378057 - DNA, 20 bp, Homo sapiens
atttatttttgtactgtgct

SEQ ID NO: 378058 - DNA, 19 bp, Homo sapiens
atttattttttacattatt

SEQ ID NO: 378059 - DNA, 18 bp, Homo sapiens
atttcaaaaatataactt

SEQ ID NO: 378060 - DNA, 14 bp, Homo sapiens
atttcaaaatgcat

SEQ ID NO: 378061 - DNA, 17 bp, Homo sapiens
accttcagactttgctt

SEQ ID NO: 378062 - DNA, 21 bp, Homo sapiens
accttcatttcaggagggatt

SEQ ID NO: 378063 - DNA, 16 bp, Homo sapiens
accttcatttcatcct

SEQ ID NO: 378064 - DNA, 17 bp, Homo sapiens
accttcatttcatcctg

SEQ ID NO: 378065 - DNA, 14 bp, Homo sapiens
accttccaggaccc

SEQ ID NO: 378066 - DNA, 15 bp, Homo sapiens
accttccaggacccc

SEQ ID NO: 378067 - DNA, 20 bp, Homo sapiens
accttccctccacctgcttg

SEQ ID NO: 378068 - DNA, 22 bp, Homo sapiens
accttcctgggcagcccagaga

SEQ ID NO: 378069 - DNA, 13 bp, Homo sapiens
accttcctgtctt

SEQ ID NO: 378070 - DNA, 23 bp, Homo sapiens
accttctaatccatgtgctgctg

SEQ ID NO: 378071 - DNA, 15 bp, Homo sapiens
accttctagaattat

SEQ ID NO: 378072 - DNA, 16 bp, Homo sapiens
accttctagaattata

SEQ ID NO: 378073 - DNA, 19 bp, Homo sapiens
accttctgaacatgagtgt

SEQ ID NO: 378074 - DNA, 21 bp, Homo sapiens
accttctgacctccccacccc

SEQ ID NO: 378075 - DNA, 14 bp, Homo sapiens
accttctgtcccca

SEQ ID NO: 378076 - DNA, 15 bp, Homo sapiens
accttctgtccccag

SEQ ID NO: 378077 - DNA, 21 bp, Homo sapiens
accttctgtccccagccctgt

SEQ ID NO: 378078 - DNA, 22 bp, Homo sapiens
accttctgtccccagccctgtc

SEQ ID NO: 378079 - DNA, 12 bp, Homo sapiens
accttctgtggc

SEQ ID NO: 378080 - DNA, 16 bp, Homo sapiens
accttctgtggctcac

SEQ ID NO: 378081 - DNA, 13 bp, Homo sapiens
accttcttccaca

SEQ ID NO: 378082 - DNA, 23 bp, Homo sapiens
accttcttggcttctgggacctg

SEQ ID NO: 378083 - DNA, 15 bp, Homo sapiens
accttgaatgatgcc

SEQ ID NO: 378084 - DNA, 17 bp, Homo sapiens
accttgacttgattagt

SEQ ID NO: 378085 - DNA, 17 bp, Homo sapiens
accttgagaccctcttc

SEQ ID NO: 378086 - DNA, 11 bp, Homo sapiens
accttgaggtc

SEQ ID NO: 378087 - DNA, 19 bp, Homo sapiens
accttgcaacacacagaca

SEQ ID NO: 378088 - DNA, 21 bp, Homo sapiens
accttgccaagctttcttcta

SEQ ID NO: 378089 - DNA, 16 bp, Homo sapiens
accttgccgagagagg

SEQ ID NO: 378090 - DNA, 18 bp, Homo sapiens
accttgccgagagaggcg

SEQ ID NO: 378091 - DNA, 14 bp, Homo sapiens
accttgcctcccct

SEQ ID NO: 378092 - DNA, 20 bp, Homo sapiens
accttgcctcccctcctctc

SEQ ID NO: 378093 - DNA, 13 bp, Homo sapiens
accttgctaattt

SEQ ID NO: 378094 - DNA, 18 bp, Homo sapiens
accttgctgcagtgtcca

SEQ ID NO: 378095 - DNA, 18 bp, Homo sapiens
accttggagagctcagga

SEQ ID NO: 378096 - DNA, 18 bp, Homo sapiens
accttgggcaagtccctt

SEQ ID NO: 378097 - DNA, 21 bp, Homo sapiens
accttgtgactcagtgtattt

SEQ ID NO: 378098 - DNA, 18 bp, Homo sapiens
accttgttgatgccagct

SEQ ID NO: 378099 - DNA, 16 bp, Homo sapiens
accttgttggagcctg

SEQ ID NO: 378100 - DNA, 18 bp, Homo sapiens
accttgttggagcctgca

SEQ ID NO: 378101 - DNA, 16 bp, Homo sapiens
accttgtttctttctg

SEQ ID NO: 378102 - DNA, 13 bp, Homo sapiens
accttgtttgttt

SEQ ID NO: 378103 - DNA, 17 bp, Homo sapiens
accttgtttgttttatt

SEQ ID NO: 378104 - DNA, 15 bp, Homo sapiens
acctttaaaataata

SEQ ID NO: 378105 - DNA, 16 bp, Homo sapiens
acctttaaatatcatt

SEQ ID NO: 378106 - DNA, 13 bp, Homo sapiens
acctttatgaggt

SEQ ID NO: 378107 - DNA, 14 bp, Homo sapiens
acctttattcttta

SEQ ID NO: 378108 - DNA, 17 bp, Homo sapiens
acctttcaaatttcaca

SEQ ID NO: 378109 - DNA, 21 bp, Homo sapiens
acctttccactcccactgcca

SEQ ID NO: 378110 - DNA, 14 bp, Homo sapiens
acctttctgaggag

SEQ ID NO: 378111 - DNA, 22 bp, Homo sapiens
acctttgcgtggatcaagcttg

SEQ ID NO: 378112 - DNA, 18 bp, Homo sapiens
acctttggagcaaagctg

SEQ ID NO: 378113 - DNA, 15 bp, Homo sapiens
acctttggcttaatt

SEQ ID NO: 378114 - DNA, 19 bp, Homo sapiens
acctttgggatcagcctcc

SEQ ID NO: 378115 - DNA, 13 bp, Homo sapiens
acctttgtgtaat

SEQ ID NO: 378116 - DNA, 16 bp, Homo sapiens
acctttgtgtaataaa

SEQ ID NO: 378117 - DNA, 12 bp, Homo sapiens
accttttctaaa

SEQ ID NO: 378118 - DNA, 23 bp, Homo sapiens
accttttctaaaaagtcaattca

SEQ ID NO: 378119 - DNA, 14 bp, Homo sapiens
accttttgagtgcc

SEQ ID NO: 378120 - DNA, 20 bp, Homo sapiens
accttttgagtgccttacac

SEQ ID NO: 378121 - DNA, 18 bp, Homo sapiens
accttttgataaaatgtt

SEQ ID NO: 378122 - DNA, 21 bp, Homo sapiens
acctttttataggttgttctt

SEQ ID NO: 378123 - DNA, 20 bp, Homo sapiens
acctttttatattttatact

SEQ ID NO: 378124 - DNA, 19 bp, Homo sapiens
acctttttttttgaaacag

SEQ ID NO: 378125 - DNA, 13 bp, Homo sapiens
acgaaacacagaa

SEQ ID NO: 378126 - DNA, 23 bp, Homo sapiens
acgaaatgttattttttaattat

SEQ ID NO: 378127 - DNA, 17 bp, Homo sapiens
acgaacatggcatgtga

SEQ ID NO: 378128 - DNA, 12 bp, Homo sapiens
acgaagaaaaaa

SEQ ID NO: 378129 - DNA, 20 bp, Homo sapiens
acgacaaaaacaagactgcc

SEQ ID NO: 378130 - DNA, 20 bp, Homo sapiens
acgacaacgatgatgcttgt

SEQ ID NO: 378131 - DNA, 20 bp, Homo sapiens
acgacaatagctttaccctc

SEQ ID NO: 378132 - DNA, 14 bp, Homo sapiens
acgactactttgct

SEQ ID NO: 378133 - DNA, 22 bp, Homo sapiens
acgacttcagggcagggctctg

SEQ ID NO: 378134 - DNA, 13 bp, Homo sapiens
acgagatcttcct

SEQ ID NO: 378135 - DNA, 14 bp, Homo sapiens
acgagcactggcca

SEQ ID NO: 378136 - DNA, 16 bp, Homo sapiens
acgagcactggccaga

SEQ ID NO: 378137 - DNA, 18 bp, Homo sapiens
acgagcactggccagaga

SEQ ID NO: 378138 - DNA, 18 bp, Homo sapiens
acgaggcaatgactgtga

SEQ ID NO: 378139 - DNA, 14 bp, Homo sapiens
acgaggcaggggct

SEQ ID NO: 378140 - DNA, 17 bp, Homo sapiens
acgaggcaggggctctg

SEQ ID NO: 378141 - DNA, 20 bp, Homo sapiens
acgaggtggtagctctgagc

SEQ ID NO: 378142 - DNA, 14 bp, Homo sapiens
acgagtcacctgca

SEQ ID NO: 378143 - DNA, 18 bp, Homo sapiens
acgagtcacctgcaagcc

SEQ ID NO: 378144 - DNA, 20 bp, Homo sapiens
acgagtcacctgcaagcccc

SEQ ID NO: 378145 - DNA, 13 bp, Homo sapiens
acgatctcagctc

SEQ ID NO: 378146 - DNA, 22 bp, Homo sapiens
acgattcttaccctttcttttg

SEQ ID NO: 378147 - DNA, 15 bp, Homo sapiens
acgattttaaaatga

SEQ ID NO: 378148 - DNA, 18 bp, Homo sapiens
acgattttaaaatgactt

SEQ ID NO: 378149 - DNA, 18 bp, Homo sapiens
acgcaagggcatcaggca

SEQ ID NO: 378150 - DNA, 15 bp, Homo sapiens
acgcacatgcgaccc

SEQ ID NO: 378151 - DNA, 18 bp, Homo sapiens
acgcaccccactgggaga

SEQ ID NO: 378152 - DNA, 14 bp, Homo sapiens
acgcacctgtagtc

SEQ ID NO: 378153 - DNA, 18 bp, Homo sapiens
acgcacctgtagtcccag

SEQ ID NO: 378154 - DNA, 13 bp, Homo sapiens
acgcacgcacaca

SEQ ID NO: 378155 - DNA, 19 bp, Homo sapiens
acgcacgtgggtcttcagg

SEQ ID NO: 378156 - DNA, 20 bp, Homo sapiens
acgcacgtgggtcttcaggg

SEQ ID NO: 378157 - DNA, 11 bp, Homo sapiens
acgcagacaca

SEQ ID NO: 378158 - DNA, 15 bp, Homo sapiens
acgcagacacacaca

SEQ ID NO: 378159 - DNA, 17 bp, Homo sapiens
acgcagagccccggagc

SEQ ID NO: 378160 - DNA, 15 bp, Homo sapiens
acgcagaggaatttt

SEQ ID NO: 378161 - DNA, 19 bp, Homo sapiens
acgcagatgatccatgagt

SEQ ID NO: 378162 - DNA, 11 bp, Homo sapiens
acgcagcagct

SEQ ID NO: 378163 - DNA, 14 bp, Homo sapiens
acgcagccaggaca

SEQ ID NO: 378164 - DNA, 12 bp, Homo sapiens
acgcaggaatgg

SEQ ID NO: 378165 - DNA, 17 bp, Homo sapiens
attatcgggagcagtgt

SEQ ID NO: 378166 - DNA, 13 bp, Homo sapiens
attatctctttct

SEQ ID NO: 378167 - DNA, 17 bp, Homo sapiens
attatcttctggtgcat

SEQ ID NO: 378168 - DNA, 12 bp, Homo sapiens
attatcttgaaa

SEQ ID NO: 378169 - DNA, 18 bp, Homo sapiens
attatctttgtaattatt

SEQ ID NO: 378170 - DNA, 17 bp, Homo sapiens
attatcttttggctctg

SEQ ID NO: 378171 - DNA, 12 bp, Homo sapiens
attatgacagtt

SEQ ID NO: 378172 - DNA, 15 bp, Homo sapiens
attatgacagttata

SEQ ID NO: 378173 - DNA, 12 bp, Homo sapiens
attatgataaag

SEQ ID NO: 378174 - DNA, 21 bp, Homo sapiens
attatggctttgtgcttgttc

SEQ ID NO: 378175 - DNA, 16 bp, Homo sapiens
attatgggaacaagtg

SEQ ID NO: 378176 - DNA, 19 bp, Homo sapiens
attatgggaacaagtgtac

SEQ ID NO: 378177 - DNA, 18 bp, Homo sapiens
attatgggtatgtgttgc

SEQ ID NO: 378178 - DNA, 23 bp, Homo sapiens
attatgggtatgtgttgccaaag

SEQ ID NO: 378179 - DNA, 17 bp, Homo sapiens
attatgggtcacaggaa

SEQ ID NO: 378180 - DNA, 14 bp, Homo sapiens
attatgtataacaa

SEQ ID NO: 378181 - DNA, 17 bp, Homo sapiens
attatgtattggcattt

SEQ ID NO: 378182 - DNA, 23 bp, Homo sapiens
attatgtcaaatggatgtaatat

SEQ ID NO: 378183 - DNA, 15 bp, Homo sapiens
attatgtccattatt

SEQ ID NO: 378184 - DNA, 20 bp, Homo sapiens
attatgtgacaacctttgtg

SEQ ID NO: 378185 - DNA, 22 bp, Homo sapiens
attattaaatcagttttgtgta

SEQ ID NO: 378186 - DNA, 14 bp, Homo sapiens
attattaacactaa

SEQ ID NO: 378187 - DNA, 19 bp, Homo sapiens
attattaacactaataata

SEQ ID NO: 378188 - DNA, 18 bp, Homo sapiens
attattaactacatttat

SEQ ID NO: 378189 - DNA, 19 bp, Homo sapiens
attattaactacatttatg

SEQ ID NO: 378190 - DNA, 14 bp, Homo sapiens
attattattactgt

SEQ ID NO: 378191 - DNA, 14 bp, Homo sapiens
attattatttgctt

SEQ ID NO: 378192 - DNA, 15 bp, Homo sapiens
attattatttgtact

SEQ ID NO: 378193 - DNA, 21 bp, Homo sapiens
attattcaccatgtaaaacaa

SEQ ID NO: 378194 - DNA, 16 bp, Homo sapiens
attattcatagctgta

SEQ ID NO: 378195 - DNA, 22 bp, Homo sapiens
attattcatagctgtatatttg

SEQ ID NO: 378196 - DNA, 18 bp, Homo sapiens
attattcatcaaactctt

SEQ ID NO: 378197 - DNA, 14 bp, Homo sapiens
attattcatttaaa

SEQ ID NO: 378198 - DNA, 16 bp, Homo sapiens
attattcatttaaaat

SEQ ID NO: 378199 - DNA, 18 bp, Homo sapiens
attattcatttaaaatga

SEQ ID NO: 378200 - DNA, 19 bp, Homo sapiens
attattcatttaaaatgat

SEQ ID NO: 378201 - DNA, 21 bp, Homo sapiens
attattcatttaaaatgatta

SEQ ID NO: 378202 - DNA, 13 bp, Homo sapiens
attattgaatgtt

SEQ ID NO: 378203 - DNA, 12 bp, Homo sapiens
attattgcatta

SEQ ID NO: 378204 - DNA, 17 bp, Homo sapiens
attattggcttgcactt

SEQ ID NO: 378205 - DNA, 17 bp, Homo sapiens
attattgtaaacttttt

SEQ ID NO: 378206 - DNA, 11 bp, Homo sapiens
attatttaaag

SEQ ID NO: 378207 - DNA, 13 bp, Homo sapiens
attatttaaagca

SEQ ID NO: 378208 - DNA, 16 bp, Homo sapiens
attatttatatatgta

SEQ ID NO: 378209 - DNA, 19 bp, Homo sapiens
attatttatcgaaagtaaa

SEQ ID NO: 378210 - DNA, 13 bp, Homo sapiens
attatttcatcat

SEQ ID NO: 378211 - DNA, 22 bp, Homo sapiens
attatttctccatcccctccct

SEQ ID NO: 378212 - DNA, 13 bp, Homo sapiens
attatttgccttt

SEQ ID NO: 378213 - DNA, 17 bp, Homo sapiens
attatttgtactttgtt

SEQ ID NO: 378214 - DNA, 15 bp, Homo sapiens
attatttgtgtaata

SEQ ID NO: 378215 - DNA, 14 bp, Homo sapiens
attattttaaatta

SEQ ID NO: 378216 - DNA, 20 bp, Homo sapiens
attattttaaattataagga

SEQ ID NO: 378217 - DNA, 23 bp, Homo sapiens
attattttaaattataaggactg

SEQ ID NO: 378218 - DNA, 21 bp, Homo sapiens
attattttgaatgtcacaaat

SEQ ID NO: 378219 - DNA, 14 bp, Homo sapiens
attattttgttact

SEQ ID NO: 378220 - DNA, 20 bp, Homo sapiens
attattttgttactgtctgt

SEQ ID NO: 378221 - DNA, 12 bp, Homo sapiens
attatttttaat

SEQ ID NO: 378222 - DNA, 18 bp, Homo sapiens
attatttttgtgtttcta

SEQ ID NO: 378223 - DNA, 20 bp, Homo sapiens
attatttttgtgtttctaaa

SEQ ID NO: 378224 - DNA, 13 bp, Homo sapiens
attcaaaaaaaaa

SEQ ID NO: 378225 - DNA, 22 bp, Homo sapiens
attcaaaaaaatcctagagatt

SEQ ID NO: 378226 - DNA, 17 bp, Homo sapiens
attcaaaaagtgtttat

SEQ ID NO: 378227 - DNA, 14 bp, Homo sapiens
attcaaaagcacaa

SEQ ID NO: 378228 - DNA, 19 bp, Homo sapiens
attcaaaatataacaggtg

SEQ ID NO: 378229 - DNA, 13 bp, Homo sapiens
attcaaaatcttc

SEQ ID NO: 378230 - DNA, 17 bp, Homo sapiens
attcaaacacacagtat

SEQ ID NO: 378231 - DNA, 14 bp, Homo sapiens
attcaaataccaat

SEQ ID NO: 378232 - DNA, 13 bp, Homo sapiens
attcaaatgcatg

SEQ ID NO: 378233 - DNA, 11 bp, Homo sapiens
attcaacaaat

SEQ ID NO: 378234 - DNA, 14 bp, Homo sapiens
attcaacacttatt

SEQ ID NO: 378235 - DNA, 20 bp, Homo sapiens
attcaaggagaatatgataa

SEQ ID NO: 378236 - DNA, 17 bp, Homo sapiens
attcaaggagatataaa

SEQ ID NO: 378237 - DNA, 19 bp, Homo sapiens
attcaaggagatataaaat

SEQ ID NO: 378238 - DNA, 21 bp, Homo sapiens
attcaaggcatttctatcaca

SEQ ID NO: 378239 - DNA, 12 bp, Homo sapiens
attcaagtatta

SEQ ID NO: 378240 - DNA, 16 bp, Homo sapiens
attcaagttattgtac

SEQ ID NO: 378241 - DNA, 22 bp, Homo sapiens
attcaataactattgctgcttt

SEQ ID NO: 378242 - DNA, 15 bp, Homo sapiens
attcaatgctttcta

SEQ ID NO: 378243 - DNA, 23 bp, Homo sapiens
attcaattaagttattaacattt

SEQ ID NO: 378244 - DNA, 17 bp, Homo sapiens
attcaattcctctggga

SEQ ID NO: 378245 - DNA, 13 bp, Homo sapiens
attcaatttctca

SEQ ID NO: 378246 - DNA, 14 bp, Homo sapiens
attcaatttctcac

SEQ ID NO: 378247 - DNA, 15 bp, Homo sapiens
attcaatttctcaca

SEQ ID NO: 378248 - DNA, 22 bp, Homo sapiens
attcaattttctttaaccagtc

SEQ ID NO: 378249 - DNA, 16 bp, Homo sapiens
attcacaagctgcctc

SEQ ID NO: 378250 - DNA, 23 bp, Homo sapiens
attcacaagttaagattcttggt

SEQ ID NO: 378251 - DNA, 11 bp, Homo sapiens
attcacacaca

SEQ ID NO: 378252 - DNA, 14 bp, Homo sapiens
attcacacacagcc

SEQ ID NO: 378253 - DNA, 15 bp, Homo sapiens
attcacacacagcct

SEQ ID NO: 378254 - DNA, 17 bp, Homo sapiens
attcacacacagcctgg

SEQ ID NO: 378255 - DNA, 18 bp, Homo sapiens
attcacactgtgcgtttt

SEQ ID NO: 378256 - DNA, 23 bp, Homo sapiens
attcacactgtgcgttttagagt

SEQ ID NO: 378257 - DNA, 16 bp, Homo sapiens
attcacatatgtctta

SEQ ID NO: 378258 - DNA, 12 bp, Homo sapiens
attcaccaccct

SEQ ID NO: 378259 - DNA, 15 bp, Homo sapiens
attcacctgtaaaac

SEQ ID NO: 378260 - DNA, 17 bp, Homo sapiens
attcacctgtaaaactt

SEQ ID NO: 378261 - DNA, 13 bp, Homo sapiens
attcactaaaata

SEQ ID NO: 378262 - DNA, 14 bp, Homo sapiens
attcactattagag

SEQ ID NO: 378263 - DNA, 19 bp, Homo sapiens
attcactattagagaaaca

SEQ ID NO: 378264 - DNA, 18 bp, Homo sapiens
attcactctcccagaggc

SEQ ID NO: 378265 - DNA, 19 bp, Homo sapiens
attcagaacaccaagactt

SEQ ID NO: 378266 - DNA, 20 bp, Homo sapiens
attcagaacttgtaactaaa

SEQ ID NO: 378267 - DNA, 13 bp, Homo sapiens
attcagacaagca

SEQ ID NO: 378268 - DNA, 19 bp, Homo sapiens
attcagattaggacacagt

SEQ ID NO: 378269 - DNA, 17 bp, Homo sapiens
attcagattgttatcta

SEQ ID NO: 378270 - DNA, 14 bp, Homo sapiens
attcagattttaaa

SEQ ID NO: 378271 - DNA, 19 bp, Homo sapiens
attcagattttaaaaagtc

SEQ ID NO: 378272 - DNA, 19 bp, Homo sapiens
attcagcactgatttcaca

SEQ ID NO: 378273 - DNA, 12 bp, Homo sapiens
attcagctgccc

SEQ ID NO: 378274 - DNA, 22 bp, Homo sapiens
attcaggacttaacggctccag

SEQ ID NO: 378275 - DNA, 20 bp, Homo sapiens
attcagtaccctatggagta

SEQ ID NO: 378276 - DNA, 15 bp, Homo sapiens
attcagttaagaaaa

SEQ ID NO: 378277 - DNA, 16 bp, Homo sapiens
attcagttaagaaaaa

SEQ ID NO: 378278 - DNA, 21 bp, Homo sapiens
attcagttttagtttcaaaat

SEQ ID NO: 378279 - DNA, 23 bp, Homo sapiens
attcagttttagtttcaaaatgt

SEQ ID NO: 378280 - DNA, 18 bp, Homo sapiens
attcataacaatgtatgt

SEQ ID NO: 378281 - DNA, 14 bp, Homo sapiens
attcataatgactt

SEQ ID NO: 378282 - DNA, 13 bp, Homo sapiens
attcatacctgtt

SEQ ID NO: 378283 - DNA, 19 bp, Homo sapiens
attcatagctgtatatttg

SEQ ID NO: 378284 - DNA, 20 bp, Homo sapiens
attcatatttacttcttata

SEQ ID NO: 378285 - DNA, 19 bp, Homo sapiens
attcatcaaataaaccttg

SEQ ID NO: 378286 - DNA, 20 bp, Homo sapiens
attcatctagttaagtcgct

SEQ ID NO: 378287 - DNA, 13 bp, Homo sapiens
attcatctgcaat

SEQ ID NO: 378288 - DNA, 18 bp, Homo sapiens
attcatctgggctggcag

SEQ ID NO: 378289 - DNA, 19 bp, Homo sapiens
attcatctgggctggcaga

SEQ ID NO: 378290 - DNA, 18 bp, Homo sapiens
attcatgctttctccttt

SEQ ID NO: 378291 - DNA, 19 bp, Homo sapiens
attcatgctttctcctttt

SEQ ID NO: 378292 - DNA, 16 bp, Homo sapiens
attcattaataggaaa

SEQ ID NO: 378293 - DNA, 19 bp, Homo sapiens
attcattatttttccactt

SEQ ID NO: 378294 - DNA, 20 bp, Homo sapiens
attcattatttttccacttt

SEQ ID NO: 378295 - DNA, 13 bp, Homo sapiens
attcattctttat

SEQ ID NO: 378296 - DNA, 14 bp, Homo sapiens
attcatttaaaatg

SEQ ID NO: 378297 - DNA, 15 bp, Homo sapiens
attcatttaaaatga

SEQ ID NO: 378298 - DNA, 15 bp, Homo sapiens
attccaacagtgagt

SEQ ID NO: 378299 - DNA, 15 bp, Homo sapiens
attccaagggcccag

SEQ ID NO: 378300 - DNA, 22 bp, Homo sapiens
attccaagggtatgggaagcca

SEQ ID NO: 378301 - DNA, 17 bp, Homo sapiens
attccaatatgatgact

SEQ ID NO: 378302 - DNA, 22 bp, Homo sapiens
attccacagggataccttaatt

SEQ ID NO: 378303 - DNA, 20 bp, Homo sapiens
attccaccaggattaatctc

SEQ ID NO: 378304 - DNA, 21 bp, Homo sapiens
attccacccctccttccctgg

SEQ ID NO: 378305 - DNA, 16 bp, Homo sapiens
attccacctgcaatca

SEQ ID NO: 378306 - DNA, 20 bp, Homo sapiens
attccaccttaaattaaaca

SEQ ID NO: 378307 - DNA, 16 bp, Homo sapiens
attccagaatatctgg

SEQ ID NO: 378308 - DNA, 18 bp, Homo sapiens
attccagaatatctggga

SEQ ID NO: 378309 - DNA, 19 bp, Homo sapiens
attccagagagtggctcct

SEQ ID NO: 378310 - DNA, 19 bp, Homo sapiens
attccagcgtcttctagag

SEQ ID NO: 378311 - DNA, 15 bp, Homo sapiens
attccagctctgccc

SEQ ID NO: 378312 - DNA, 17 bp, Homo sapiens
attccagctctgccccc

SEQ ID NO: 378313 - DNA, 18 bp, Homo sapiens
attccagtgtattttctg

SEQ ID NO: 378314 - DNA, 12 bp, Homo sapiens
attccagttgcg

SEQ ID NO: 378315 - DNA, 15 bp, Homo sapiens
attccatcacagcca

SEQ ID NO: 378316 - DNA, 18 bp, Homo sapiens
attccatcacagccagcc

SEQ ID NO: 378317 - DNA, 23 bp, Homo sapiens
attccatcacagccagcccagct

SEQ ID NO: 378318 - DNA, 11 bp, Homo sapiens
attccatctcc

SEQ ID NO: 378319 - DNA, 13 bp, Homo sapiens
attccatgaatgt

SEQ ID NO: 378320 - DNA, 11 bp, Homo sapiens
attcccactgc

SEQ ID NO: 378321 - DNA, 17 bp, Homo sapiens
attcccactttcattca

SEQ ID NO: 378322 - DNA, 19 bp, Homo sapiens
attcccagatagtcccagc

SEQ ID NO: 378323 - DNA, 17 bp, Homo sapiens
attcccaggcagggagg

SEQ ID NO: 378324 - DNA, 16 bp, Homo sapiens
attcccatcactgctg

SEQ ID NO: 378325 - DNA, 21 bp, Homo sapiens
attcccccatgtggctgaaga

SEQ ID NO: 378326 - DNA, 22 bp, Homo sapiens
attcccctcccacctctccttt

SEQ ID NO: 378327 - DNA, 18 bp, Homo sapiens
attccccttcccttattt

SEQ ID NO: 378328 - DNA, 20 bp, Homo sapiens
attcccgggcccttcagtcc

SEQ ID NO: 378329 - DNA, 20 bp, Homo sapiens
attccctctcatccaggtcc

SEQ ID NO: 378330 - DNA, 17 bp, Homo sapiens
attccctctcctgccca

SEQ ID NO: 378331 - DNA, 15 bp, Homo sapiens
attccctggaattca

SEQ ID NO: 378332 - DNA, 16 bp, Homo sapiens
attccctggaattcac

SEQ ID NO: 378333 - DNA, 14 bp, Homo sapiens
attccctggaccag

SEQ ID NO: 378334 - DNA, 17 bp, Homo sapiens
attccctttttaaatga

SEQ ID NO: 378335 - DNA, 23 bp, Homo sapiens
attccgaaaaaaaaatgttcatt

SEQ ID NO: 378336 - DNA, 22 bp, Homo sapiens
attccgaagagggaatggatgg

SEQ ID NO: 378337 - DNA, 15 bp, Homo sapiens
attccggccctggct

SEQ ID NO: 378338 - DNA, 16 bp, Homo sapiens
attccggccctggctg

SEQ ID NO: 378339 - DNA, 21 bp, Homo sapiens
attccgtattggttgggggct

SEQ ID NO: 378340 - DNA, 19 bp, Homo sapiens
attccgtttacattttaga

SEQ ID NO: 378341 - DNA, 19 bp, Homo sapiens
attcctaagcagtgcttgt

SEQ ID NO: 378342 - DNA, 17 bp, Homo sapiens
attcctacaatatatat

SEQ ID NO: 378343 - DNA, 22 bp, Homo sapiens
attcctacttaaacaaaaactt

SEQ ID NO: 378344 - DNA, 23 bp, Homo sapiens
attcctaggcaactattaataat

SEQ ID NO: 378345 - DNA, 16 bp, Homo sapiens
attcctcagctgccaa

SEQ ID NO: 378346 - DNA, 15 bp, Homo sapiens
attcctccagcctcc

SEQ ID NO: 378347 - DNA, 11 bp, Homo sapiens
attcctccctc

SEQ ID NO: 378348 - DNA, 12 bp, Homo sapiens
attcctctggga

SEQ ID NO: 378349 - DNA, 18 bp, Homo sapiens
attcctcttgcctctctc

SEQ ID NO: 378350 - DNA, 20 bp, Homo sapiens
attcctcttgcctctctcag

SEQ ID NO: 378351 - DNA, 13 bp, Homo sapiens
attcctgaaagaa

SEQ ID NO: 378352 - DNA, 14 bp, Homo sapiens
attcctgcagcctg

SEQ ID NO: 378353 - DNA, 19 bp, Homo sapiens
attcctgcagcctggaggc

SEQ ID NO: 378354 - DNA, 15 bp, Homo sapiens
attcctgcatttgtg

SEQ ID NO: 378355 - DNA, 18 bp, Homo sapiens
attcctgcatttgtgaaa

SEQ ID NO: 378356 - DNA, 12 bp, Homo sapiens
attcctgccttt

SEQ ID NO: 378357 - DNA, 18 bp, Homo sapiens
attcctgcctttcttcca

SEQ ID NO: 378358 - DNA, 19 bp, Homo sapiens
attcctgcctttcttccat

SEQ ID NO: 378359 - DNA, 15 bp, Homo sapiens
attcctgcctttgat

SEQ ID NO: 378360 - DNA, 16 bp, Homo sapiens
attcctggcatgacac

SEQ ID NO: 378361 - DNA, 21 bp, Homo sapiens
attcctggcatgacactctag

SEQ ID NO: 378362 - DNA, 12 bp, Homo sapiens
attcctggcccc

SEQ ID NO: 378363 - DNA, 15 bp, Homo sapiens
attcctgggcctgtc

SEQ ID NO: 378364 - DNA, 16 bp, Homo sapiens
attcctgggcctgtcc

SEQ ID NO: 378365 - DNA, 17 bp, Homo sapiens
attcctgggcctgtccc

SEQ ID NO: 378366 - DNA, 13 bp, Homo sapiens
attcctgttctct

SEQ ID NO: 378367 - DNA, 16 bp, Homo sapiens
attccttagcagctca

SEQ ID NO: 378368 - DNA, 20 bp, Homo sapiens
attccttaggcttaagagag

SEQ ID NO: 378369 - DNA, 12 bp, Homo sapiens
attccttcctgt

SEQ ID NO: 378370 - DNA, 14 bp, Homo sapiens
attccttcctgttc

SEQ ID NO: 378371 - DNA, 17 bp, Homo sapiens
attccttcctgttctga

SEQ ID NO: 378372 - DNA, 16 bp, Homo sapiens
attccttctggccttt

SEQ ID NO: 378373 - DNA, 20 bp, Homo sapiens
attccttgataatgttgtgg

SEQ ID NO: 378374 - DNA, 18 bp, Homo sapiens
attccttggagccactgg

SEQ ID NO: 378375 - DNA, 14 bp, Homo sapiens
attccttggcccag

SEQ ID NO: 378376 - DNA, 16 bp, Homo sapiens
attccttgtcaccagc

SEQ ID NO: 378377 - DNA, 20 bp, Homo sapiens
attcctttaaattctccaac

SEQ ID NO: 378378 - DNA, 21 bp, Homo sapiens
attcctttacaactaaataac

SEQ ID NO: 378379 - DNA, 23 bp, Homo sapiens
attcctttacaactaaataacac

SEQ ID NO: 378380 - DNA, 22 bp, Homo sapiens
attcgaggtgtcaccctgcaga

SEQ ID NO: 378381 - DNA, 22 bp, Homo sapiens
attcgcagcagctccgcctggc

SEQ ID NO: 378382 - DNA, 19 bp, Homo sapiens
attcgcccaaagccagaca

SEQ ID NO: 378383 - DNA, 20 bp, Homo sapiens
attcgcccaaagccagacag

SEQ ID NO: 378384 - DNA, 13 bp, Homo sapiens
attctaaaagaga

SEQ ID NO: 378385 - DNA, 12 bp, Homo sapiens
attctaaacaga

SEQ ID NO: 378386 - DNA, 18 bp, Homo sapiens
attctaagattgtacata

SEQ ID NO: 378387 - DNA, 20 bp, Homo sapiens
attctaagttatttactttt

SEQ ID NO: 378388 - DNA, 17 bp, Homo sapiens
attctactcttgtcatt

SEQ ID NO: 378389 - DNA, 16 bp, Homo sapiens
attctactttgagtgc

SEQ ID NO: 378390 - DNA, 16 bp, Homo sapiens
attctagtctctgatt

SEQ ID NO: 378391 - DNA, 23 bp, Homo sapiens
attctagtctctgatttgcaaat

SEQ ID NO: 378392 - DNA, 14 bp, Homo sapiens
attctataaattca

SEQ ID NO: 378393 - DNA, 15 bp, Homo sapiens
attctatactgttga

SEQ ID NO: 378394 - DNA, 15 bp, Homo sapiens
attctatatgaattt

SEQ ID NO: 378395 - DNA, 21 bp, Homo sapiens
attctatttcaacttcaggaa

SEQ ID NO: 378396 - DNA, 15 bp, Homo sapiens
attctatttgctggg

SEQ ID NO: 378397 - DNA, 18 bp, Homo sapiens
attctatttgctgggctt

SEQ ID NO: 378398 - DNA, 13 bp, Homo sapiens
attctcaaagcag

SEQ ID NO: 378399 - DNA, 14 bp, Homo sapiens
attctcaaagcagg

SEQ ID NO: 378400 - DNA, 16 bp, Homo sapiens
attctcactctgcttt

SEQ ID NO: 378401 - DNA, 12 bp, Homo sapiens
attctcattatt

SEQ ID NO: 378402 - DNA, 16 bp, Homo sapiens
attctcattgcagaat

SEQ ID NO: 378403 - DNA, 16 bp, Homo sapiens
attctccaaatgattt

SEQ ID NO: 378404 - DNA, 18 bp, Homo sapiens
attctccaacccaaagta

SEQ ID NO: 378405 - DNA, 15 bp, Homo sapiens
attctccctgacctt

SEQ ID NO: 378406 - DNA, 20 bp, Homo sapiens
attctcccttttgacacagt

SEQ ID NO: 378407 - DNA, 15 bp, Homo sapiens
attctcctgcctcag

SEQ ID NO: 378408 - DNA, 20 bp, Homo sapiens
attctcctgcctcagcctcc

SEQ ID NO: 378409 - DNA, 14 bp, Homo sapiens
attctcctgtgcta

SEQ ID NO: 378410 - DNA, 13 bp, Homo sapiens
attctctgcaatt

SEQ ID NO: 378411 - DNA, 23 bp, Homo sapiens
attctctgcaatttgtttaaaga

SEQ ID NO: 378412 - DNA, 17 bp, Homo sapiens
attctctgtccagggct

SEQ ID NO: 378413 - DNA, 19 bp, Homo sapiens
attctcttcgctgtgatgc

SEQ ID NO: 378414 - DNA, 12 bp, Homo sapiens
attctcttctca

SEQ ID NO: 378415 - DNA, 17 bp, Homo sapiens
attctcttggctggctt

SEQ ID NO: 378416 - DNA, 13 bp, Homo sapiens
attctgaatgtac

SEQ ID NO: 378417 - DNA, 17 bp, Homo sapiens
attctgcaacagcctgt

SEQ ID NO: 378418 - DNA, 20 bp, Homo sapiens
attctgcaacagcctgtttg

SEQ ID NO: 378419 - DNA, 19 bp, Homo sapiens
attctgcaagcacatctgc

SEQ ID NO: 378420 - DNA, 22 bp, Homo sapiens
attctgcaagcacatctgcatt

SEQ ID NO: 378421 - DNA, 19 bp, Homo sapiens
attctgctcctgaaaaatg

SEQ ID NO: 378422 - DNA, 20 bp, Homo sapiens
attctgctcctgaaaaatga

SEQ ID NO: 378423 - DNA, 10 bp, Homo sapiens
attctgggaa

SEQ ID NO: 378424 - DNA, 15 bp, Homo sapiens
attctgggaaaggtg

SEQ ID NO: 378425 - DNA, 17 bp, Homo sapiens
attctgggaaaggtgct

SEQ ID NO: 378426 - DNA, 20 bp, Homo sapiens
attctgggaaaggtgctcaa

SEQ ID NO: 378427 - DNA, 21 bp, Homo sapiens
attctgggaagcttgagcctc

SEQ ID NO: 378428 - DNA, 23 bp, Homo sapiens
attctgggctcctggaaccaatc

SEQ ID NO: 378429 - DNA, 17 bp, Homo sapiens
attctgtcccccacgtg

SEQ ID NO: 378430 - DNA, 18 bp, Homo sapiens
attctgtccctgtccctg

SEQ ID NO: 378431 - DNA, 14 bp, Homo sapiens
attctgtgaagaat

SEQ ID NO: 378432 - DNA, 15 bp, Homo sapiens
attctgtgaagaatg

SEQ ID NO: 378433 - DNA, 16 bp, Homo sapiens
attctgtgaagaatga

SEQ ID NO: 378434 - DNA, 21 bp, Homo sapiens
aggttctggttagctcagccc

SEQ ID NO: 378435 - DNA, 14 bp, Homo sapiens
aggttcttactgct

SEQ ID NO: 378436 - DNA, 14 bp, Homo sapiens
aggttgaggctaaa

SEQ ID NO: 378437 - DNA, 16 bp, Homo sapiens
aggttgagtgagccgg

SEQ ID NO: 378438 - DNA, 15 bp, Homo sapiens
aggttgatcagtgag

SEQ ID NO: 378439 - DNA, 14 bp, Homo sapiens
aggttgcagctgct

SEQ ID NO: 378440 - DNA, 15 bp, Homo sapiens
aggttgcagctgctc

SEQ ID NO: 378441 - DNA, 17 bp, Homo sapiens
aggttgcagctgctctt

SEQ ID NO: 378442 - DNA, 14 bp, Homo sapiens
aggttgctgttgtg

SEQ ID NO: 378443 - DNA, 14 bp, Homo sapiens
aggttgcttcaaga

SEQ ID NO: 378444 - DNA, 18 bp, Homo sapiens
aggttggaaaagaaatca

SEQ ID NO: 378445 - DNA, 23 bp, Homo sapiens
aggttggaaaagaaatcaatttt

SEQ ID NO: 378446 - DNA, 17 bp, Homo sapiens
aggttggaccccagaga

SEQ ID NO: 378447 - DNA, 12 bp, Homo sapiens
aggttggatggg

SEQ ID NO: 378448 - DNA, 20 bp, Homo sapiens
aggttggatgggagtgggca

SEQ ID NO: 378449 - DNA, 15 bp, Homo sapiens
aggtttaactcagat

SEQ ID NO: 378450 - DNA, 17 bp, Homo sapiens
aggtttaactcagatca

SEQ ID NO: 378451 - DNA, 19 bp, Homo sapiens
aggtttaactcagatcact

SEQ ID NO: 378452 - DNA, 23 bp, Homo sapiens
aggtttaactcagatcactactg

SEQ ID NO: 378453 - DNA, 16 bp, Homo sapiens
aggtttcactgttcat

SEQ ID NO: 378454 - DNA, 17 bp, Homo sapiens
aggtttcactgttcatg

SEQ ID NO: 378455 - DNA, 14 bp, Homo sapiens
aggtttgagtagag

SEQ ID NO: 378456 - DNA, 21 bp, Homo sapiens
aggtttggatgggagtgagac

SEQ ID NO: 378457 - DNA, 17 bp, Homo sapiens
aggtttgtcatcagatg

SEQ ID NO: 378458 - DNA, 14 bp, Homo sapiens
aggttttctgctct

SEQ ID NO: 378459 - DNA, 17 bp, Homo sapiens
aggtttttatgtgcctt

SEQ ID NO: 378460 - DNA, 16 bp, Homo sapiens
agtaaaaataaactgt

SEQ ID NO: 378461 - DNA, 20 bp, Homo sapiens
agtaaaacagatttgttcat

SEQ ID NO: 378462 - DNA, 14 bp, Homo sapiens
agtaaagataaaag

SEQ ID NO: 378463 - DNA, 21 bp, Homo sapiens
agtaaagataaaaggatagga

SEQ ID NO: 378464 - DNA, 23 bp, Homo sapiens
agtaaagttccacttagagaaca

SEQ ID NO: 378465 - DNA, 17 bp, Homo sapiens
agtaaataaactcttca

SEQ ID NO: 378466 - DNA, 22 bp, Homo sapiens
agtaaataaactcttcaaggcc

SEQ ID NO: 378467 - DNA, 15 bp, Homo sapiens
agtaaataaattgtt

SEQ ID NO: 378468 - DNA, 16 bp, Homo sapiens
agtaaataaattgttt

SEQ ID NO: 378469 - DNA, 11 bp, Homo sapiens
agtaaatgcta

SEQ ID NO: 378470 - DNA, 13 bp, Homo sapiens
agtaacacataaa

SEQ ID NO: 378471 - DNA, 14 bp, Homo sapiens
agtaacacataaag

SEQ ID NO: 378472 - DNA, 17 bp, Homo sapiens
agtaacagggccttgct

SEQ ID NO: 378473 - DNA, 18 bp, Homo sapiens
agtaacatataaattaat

SEQ ID NO: 378474 - DNA, 19 bp, Homo sapiens
agtaacatataaattaata

SEQ ID NO: 378475 - DNA, 20 bp, Homo sapiens
agtaacctctacaggcattt

SEQ ID NO: 378476 - DNA, 16 bp, Homo sapiens
agtaacgcgtcttcct

SEQ ID NO: 378477 - DNA, 18 bp, Homo sapiens
agtaacgcgtcttcctga

SEQ ID NO: 378478 - DNA, 22 bp, Homo sapiens
agtaacgcgtcttcctgagtgg

SEQ ID NO: 378479 - DNA, 15 bp, Homo sapiens
agtaactattattat

SEQ ID NO: 378480 - DNA, 14 bp, Homo sapiens
agtaagaagacatg

SEQ ID NO: 378481 - DNA, 22 bp, Homo sapiens
agtaagaccggaagctcctggt

SEQ ID NO: 378482 - DNA, 18 bp, Homo sapiens
agtaagcagagttctttg

SEQ ID NO: 378483 - DNA, 20 bp, Homo sapiens
agtaagcagagttctttgca

SEQ ID NO: 378484 - DNA, 22 bp, Homo sapiens
agtaagcagagttctttgcaag

SEQ ID NO: 378485 - DNA, 18 bp, Homo sapiens
agtaagcctccctcctcg

SEQ ID NO: 378486 - DNA, 19 bp, Homo sapiens
agtaagcctccctcctcgt

SEQ ID NO: 378487 - DNA, 14 bp, Homo sapiens
agtaagctgctttt

SEQ ID NO: 378488 - DNA, 18 bp, Homo sapiens
agtaaggcagctctgtcg

SEQ ID NO: 378489 - DNA, 23 bp, Homo sapiens
agtaagtggggttgcaaccactg

SEQ ID NO: 378490 - DNA, 12 bp, Homo sapiens
agtaatagctga

SEQ ID NO: 378491 - DNA, 15 bp, Homo sapiens
agtaatagctgaacc

SEQ ID NO: 378492 - DNA, 16 bp, Homo sapiens
agtaatagctgaacct

SEQ ID NO: 378493 - DNA, 17 bp, Homo sapiens
agtaatatctttcagtt

SEQ ID NO: 378494 - DNA, 14 bp, Homo sapiens
agtaatccacctgc

SEQ ID NO: 378495 - DNA, 21 bp, Homo sapiens
agtaatgaatttttatgatat

SEQ ID NO: 378496 - DNA, 22 bp, Homo sapiens
agtaatgaatttttatgatatt

SEQ ID NO: 378497 - DNA, 19 bp, Homo sapiens
agtaatgtttaagatctgt

SEQ ID NO: 378498 - DNA, 13 bp, Homo sapiens
agtaattatcggg

SEQ ID NO: 378499 - DNA, 22 bp, Homo sapiens
agtaattatcgggaacagtgtt

SEQ ID NO: 378500 - DNA, 12 bp, Homo sapiens
agtaattatctg

SEQ ID NO: 378501 - DNA, 22 bp, Homo sapiens
agtaattctaccctgaaagtga

SEQ ID NO: 378502 - DNA, 22 bp, Homo sapiens
agtaattggtccgatctttgac

SEQ ID NO: 378503 - DNA, 17 bp, Homo sapiens
agtaattgttacaattt

SEQ ID NO: 378504 - DNA, 11 bp, Homo sapiens
agtacaaagac

SEQ ID NO: 378505 - DNA, 15 bp, Homo sapiens
agtacaaagacaggg

SEQ ID NO: 378506 - DNA, 19 bp, Homo sapiens
agtacaaagacagggaata

SEQ ID NO: 378507 - DNA, 15 bp, Homo sapiens
agtacaataagcaga

SEQ ID NO: 378508 - DNA, 20 bp, Homo sapiens
agtacaataataaatcctca

SEQ ID NO: 378509 - DNA, 14 bp, Homo sapiens
agtacaattctttg

SEQ ID NO: 378510 - DNA, 22 bp, Homo sapiens
agtacaattctttgttgcttaa

SEQ ID NO: 378511 - DNA, 23 bp, Homo sapiens
agtacaattctttgttgcttaat

SEQ ID NO: 378512 - DNA, 14 bp, Homo sapiens
agtacagatcctct

SEQ ID NO: 378513 - DNA, 13 bp, Homo sapiens
agtacagccttca

SEQ ID NO: 378514 - DNA, 22 bp, Homo sapiens
agtacagtggttctacaatcta

SEQ ID NO: 378515 - DNA, 14 bp, Homo sapiens
agtacattccaact

SEQ ID NO: 378516 - DNA, 12 bp, Homo sapiens
agtacatttttg

SEQ ID NO: 378517 - DNA, 11 bp, Homo sapiens
agtaccaaaga

SEQ ID NO: 378518 - DNA, 15 bp, Homo sapiens
agtaccaaagtttta

SEQ ID NO: 378519 - DNA, 19 bp, Homo sapiens
agtaccaaagttttatcaa

SEQ ID NO: 378520 - DNA, 16 bp, Homo sapiens
agtaccaactgagcca

SEQ ID NO: 378521 - DNA, 16 bp, Homo sapiens
agtaccaatcatttta

SEQ ID NO: 378522 - DNA, 15 bp, Homo sapiens
agtaccaatgctgtt

SEQ ID NO: 378523 - DNA, 21 bp, Homo sapiens
agtaccagcgctctaaaagca

SEQ ID NO: 378524 - DNA, 16 bp, Homo sapiens
agtaccatcccactga

SEQ ID NO: 378525 - DNA, 22 bp, Homo sapiens
agtaccccagccactcctcaac

SEQ ID NO: 378526 - DNA, 15 bp, Homo sapiens
agtacccccctgaga

SEQ ID NO: 378527 - DNA, 15 bp, Homo sapiens
agtacctataaagta

SEQ ID NO: 378528 - DNA, 17 bp, Homo sapiens
agtacctgctgccccag

SEQ ID NO: 378529 - DNA, 17 bp, Homo sapiens
agtacctgtagtgagaa

SEQ ID NO: 378530 - DNA, 16 bp, Homo sapiens
agtaccttcagatcct

SEQ ID NO: 378531 - DNA, 20 bp, Homo sapiens
agtaccttcagatcctaccc

SEQ ID NO: 378532 - DNA, 16 bp, Homo sapiens
agtacctttgctcttg

SEQ ID NO: 378533 - DNA, 18 bp, Homo sapiens
agtacctttgctcttgca

SEQ ID NO: 378534 - DNA, 21 bp, Homo sapiens
agtacctttgctcttgcagag

SEQ ID NO: 378535 - DNA, 13 bp, Homo sapiens
agtacctttgtca

SEQ ID NO: 378536 - DNA, 15 bp, Homo sapiens
agtacctttgtcaca

SEQ ID NO: 378537 - DNA, 21 bp, Homo sapiens
agtacgtcccgctgctgtgct

SEQ ID NO: 378538 - DNA, 22 bp, Homo sapiens
agtacgtgtttacttggtgagg

SEQ ID NO: 378539 - DNA, 15 bp, Homo sapiens
agtacgttattgttg

SEQ ID NO: 378540 - DNA, 21 bp, Homo sapiens
cagagcccttcactgccatga

SEQ ID NO: 378541 - DNA, 15 bp, Homo sapiens
cagagccgttcctgg

SEQ ID NO: 378542 - DNA, 19 bp, Homo sapiens
cagagcctggtagagacta

SEQ ID NO: 378543 - DNA, 17 bp, Homo sapiens
cagagcgagactctgtc

SEQ ID NO: 378544 - DNA, 19 bp, Homo sapiens
cagagcgagactctgtctc

SEQ ID NO: 378545 - DNA, 19 bp, Homo sapiens
cagagcgcccctccctagt

SEQ ID NO: 378546 - DNA, 13 bp, Homo sapiens
cagagctcagagg

SEQ ID NO: 378547 - DNA, 22 bp, Homo sapiens
cagagctcatttcggggtcagg

SEQ ID NO: 378548 - DNA, 13 bp, Homo sapiens
cagagctcccagg

SEQ ID NO: 378549 - DNA, 15 bp, Homo sapiens
cagagctcccaggac

SEQ ID NO: 378550 - DNA, 20 bp, Homo sapiens
cagagctcccaggacgcagg

SEQ ID NO: 378551 - DNA, 13 bp, Homo sapiens
cagagctccgatg

SEQ ID NO: 378552 - DNA, 16 bp, Homo sapiens
cagagctccgatgccc

SEQ ID NO: 378553 - DNA, 20 bp, Homo sapiens
cagagctccgatgcccgccc

SEQ ID NO: 378554 - DNA, 21 bp, Homo sapiens
cagagctctggagccacctgt

SEQ ID NO: 378555 - DNA, 18 bp, Homo sapiens
cagagctcttcaagctgt

SEQ ID NO: 378556 - DNA, 21 bp, Homo sapiens
cagagctcttcaagctgtccc

SEQ ID NO: 378557 - DNA, 13 bp, Homo sapiens
cagagctggaaca

SEQ ID NO: 378558 - DNA, 14 bp, Homo sapiens
cagagctggaaggc

SEQ ID NO: 378559 - DNA, 21 bp, Homo sapiens
cagagctggaaggcagggcag

SEQ ID NO: 378560 - DNA, 12 bp, Homo sapiens
cagagctggggg

SEQ ID NO: 378561 - DNA, 13 bp, Homo sapiens
cagagctgggtgg

SEQ ID NO: 378562 - DNA, 19 bp, Homo sapiens
cagagctgtttatggcctc

SEQ ID NO: 378563 - DNA, 18 bp, Homo sapiens
cagagcttattggccact

SEQ ID NO: 378564 - DNA, 20 bp, Homo sapiens
cagagcttattggccactgg

SEQ ID NO: 378565 - DNA, 15 bp, Homo sapiens
cagatgctaataaac

SEQ ID NO: 378566 - DNA, 18 bp, Homo sapiens
cagatggatgtagataca

SEQ ID NO: 378567 - DNA, 22 bp, Homo sapiens
cagatggatttgcctgtgccac

SEQ ID NO: 378568 - DNA, 15 bp, Homo sapiens
cagatggcacctgtg

SEQ ID NO: 378569 - DNA, 20 bp, Homo sapiens
cagatggcacctgtggccag

SEQ ID NO: 378570 - DNA, 17 bp, Homo sapiens
cagatgggtattaaact

SEQ ID NO: 378571 - DNA, 13 bp, Homo sapiens
cagatgtatcatg

SEQ ID NO: 378572 - DNA, 22 bp, Homo sapiens
cagatgtctaaaagattcttta

SEQ ID NO: 378573 - DNA, 17 bp, Homo sapiens
cagatgtcttctgcctg

SEQ ID NO: 378574 - DNA, 18 bp, Homo sapiens
cagatgtcttctgcctgt

SEQ ID NO: 378575 - DNA, 18 bp, Homo sapiens
cagattaggacacagtgt

SEQ ID NO: 378576 - DNA, 13 bp, Homo sapiens
cagattcaatttt

SEQ ID NO: 378577 - DNA, 20 bp, Homo sapiens
cagattcctgggcctgtccc

SEQ ID NO: 378578 - DNA, 19 bp, Homo sapiens
cagattctagcacatcatg

SEQ ID NO: 378579 - DNA, 24 bp, Homo sapiens
cagattctagcacatcatggcagt

SEQ ID NO: 378580 - DNA, 14 bp, Homo sapiens
cagattgcctcctt

SEQ ID NO: 378581 - DNA, 15 bp, Homo sapiens
cagattgctacacac

SEQ ID NO: 378582 - DNA, 16 bp, Homo sapiens
cagattgctacacaca

SEQ ID NO: 378583 - DNA, 17 bp, Homo sapiens
cagattgctacacacac

SEQ ID NO: 378584 - DNA, 12 bp, Homo sapiens
cagattgctttt

SEQ ID NO: 378585 - DNA, 20 bp, Homo sapiens
cagattggcacccctttcta

SEQ ID NO: 378586 - DNA, 13 bp, Homo sapiens
cagattgggggcc

SEQ ID NO: 378587 - DNA, 16 bp, Homo sapiens
cagattgggggccctg

SEQ ID NO: 378588 - DNA, 18 bp, Homo sapiens
cagattgtaaaggtaggt

SEQ ID NO: 378589 - DNA, 14 bp, Homo sapiens
cagattgttatcta

SEQ ID NO: 378590 - DNA, 16 bp, Homo sapiens
cagatttccagtctcc

SEQ ID NO: 378591 - DNA, 24 bp, Homo sapiens
cagatttccagtctccaccaggaa

SEQ ID NO: 378592 - DNA, 14 bp, Homo sapiens
cagatttctcacct

SEQ ID NO: 378593 - DNA, 22 bp, Homo sapiens
cagattttaaaaagtcttcact

SEQ ID NO: 378594 - DNA, 22 bp, Homo sapiens
cagattttttacagctgcctgc

SEQ ID NO: 378595 - DNA, 18 bp, Homo sapiens
cagcaaaagttctttctc

SEQ ID NO: 378596 - DNA, 13 bp, Homo sapiens
cagcaaaatatat

SEQ ID NO: 378597 - DNA, 18 bp, Homo sapiens
cagcaaaatatatgtttg

SEQ ID NO: 378598 - DNA, 16 bp, Homo sapiens
cagcaaaccggggcct

SEQ ID NO: 378599 - DNA, 20 bp, Homo sapiens
cagcaaagcttggtgtcttg

SEQ ID NO: 378600 - DNA, 13 bp, Homo sapiens
cagcaacaacaac

SEQ ID NO: 378601 - DNA, 13 bp, Homo sapiens
cagcaacctgtaa

SEQ ID NO: 378602 - DNA, 22 bp, Homo sapiens
cagcaacttgtctttttctgga

SEQ ID NO: 378603 - DNA, 16 bp, Homo sapiens
cagcaagaataaaaaa

SEQ ID NO: 378604 - DNA, 16 bp, Homo sapiens
cagcaagagcacaaga

SEQ ID NO: 378605 - DNA, 15 bp, Homo sapiens
cagcaagataaacac

SEQ ID NO: 378606 - DNA, 12 bp, Homo sapiens
cagcaagccggc

SEQ ID NO: 378607 - DNA, 16 bp, Homo sapiens
cagcaagcttgtagct

SEQ ID NO: 378608 - DNA, 21 bp, Homo sapiens
cagcaaggaccagtgagacag

SEQ ID NO: 378609 - DNA, 12 bp, Homo sapiens
cagcaaggcagg

SEQ ID NO: 378610 - DNA, 20 bp, Homo sapiens
cagcaaggcaggttggatgg

SEQ ID NO: 378611 - DNA, 13 bp, Homo sapiens
cagcaagtcccag

SEQ ID NO: 378612 - DNA, 23 bp, Homo sapiens
cagcaagtgctgagtctgtgaat

SEQ ID NO: 378613 - DNA, 17 bp, Homo sapiens
cagcaatagggtgcagt

SEQ ID NO: 378614 - DNA, 19 bp, Homo sapiens
cagcaatatattaccagca

SEQ ID NO: 378615 - DNA, 20 bp, Homo sapiens
cagcaatatattaccagcaa

SEQ ID NO: 378616 - DNA, 18 bp, Homo sapiens
cagcaatgcaatgtggaa

SEQ ID NO: 378617 - DNA, 11 bp, Homo sapiens
cagcacagact

SEQ ID NO: 378618 - DNA, 17 bp, Homo sapiens
cagcacagactgttccc

SEQ ID NO: 378619 - DNA, 13 bp, Homo sapiens
cagcacagagagg

SEQ ID NO: 378620 - DNA, 17 bp, Homo sapiens
cagcacagagagggggc

SEQ ID NO: 378621 - DNA, 16 bp, Homo sapiens
cagcacaggggcccca

SEQ ID NO: 378622 - DNA, 22 bp, Homo sapiens
cagcacaggggccccagatctg

SEQ ID NO: 378623 - DNA, 15 bp, Homo sapiens
cagcacatgctggcc

SEQ ID NO: 378624 - DNA, 21 bp, Homo sapiens
cagcaccaccctagtcccttc

SEQ ID NO: 378625 - DNA, 17 bp, Homo sapiens
cagcaccatctctcctc

SEQ ID NO: 378626 - DNA, 19 bp, Homo sapiens
cagcaccatctctcctcct

SEQ ID NO: 378627 - DNA, 18 bp, Homo sapiens
cagcacccagcaactcca

SEQ ID NO: 378628 - DNA, 12 bp, Homo sapiens
cagcacccccac

SEQ ID NO: 378629 - DNA, 15 bp, Homo sapiens
cagcacccccaccca

SEQ ID NO: 378630 - DNA, 13 bp, Homo sapiens
cagcaccctaaga

SEQ ID NO: 378631 - DNA, 18 bp, Homo sapiens
cagcaccctttcaccccc

SEQ ID NO: 378632 - DNA, 19 bp, Homo sapiens
cagcacctcctctctgctg

SEQ ID NO: 378633 - DNA, 20 bp, Homo sapiens
cagcacctcctctctgctgg

SEQ ID NO: 378634 - DNA, 17 bp, Homo sapiens
cagcacctggagcccac

SEQ ID NO: 378635 - DNA, 18 bp, Homo sapiens
cagcacctggagcccaca

SEQ ID NO: 378636 - DNA, 23 bp, Homo sapiens
cagcacctgtaagaaacagagca

SEQ ID NO: 378637 - DNA, 14 bp, Homo sapiens
cagcacctttgtaa

SEQ ID NO: 378638 - DNA, 14 bp, Homo sapiens
cagcactactctgt

SEQ ID NO: 378639 - DNA, 20 bp, Homo sapiens
cagcactacttacttagaga

SEQ ID NO: 378640 - DNA, 13 bp, Homo sapiens
cagcactcccagg

SEQ ID NO: 378641 - DNA, 17 bp, Homo sapiens
cagcactcccagggccc

SEQ ID NO: 378642 - DNA, 12 bp, Homo sapiens
cagcactggctc

SEQ ID NO: 378643 - DNA, 16 bp, Homo sapiens
cagcactggctctctc

SEQ ID NO: 378644 - DNA, 18 bp, Homo sapiens
cagcactggctctctcca

SEQ ID NO: 378645 - DNA, 19 bp, Homo sapiens
cagcactggctctctccag

SEQ ID NO: 378646 - DNA, 21 bp, Homo sapiens
cagcactggctctctccagga

SEQ ID NO: 378647 - DNA, 14 bp, Homo sapiens
cagcactgggaagc

SEQ ID NO: 378648 - DNA, 13 bp, Homo sapiens
cagcactgtccct

SEQ ID NO: 378649 - DNA, 14 bp, Homo sapiens
cagcactgtccctt

SEQ ID NO: 378650 - DNA, 15 bp, Homo sapiens
cagcactgtctcagt

SEQ ID NO: 378651 - DNA, 18 bp, Homo sapiens
cagcactttgggaggcct

SEQ ID NO: 378652 - DNA, 16 bp, Homo sapiens
cagcagaaacccccag

SEQ ID NO: 378653 - DNA, 17 bp, Homo sapiens
cagcagaaacccccagg

SEQ ID NO: 378654 - DNA, 19 bp, Homo sapiens
cagcagaaacccccaggag

SEQ ID NO: 378655 - DNA, 19 bp, Homo sapiens
cagcagagccgttcctggg

SEQ ID NO: 378656 - DNA, 20 bp, Homo sapiens
cagcagagttattgaatctt

SEQ ID NO: 378657 - DNA, 20 bp, Homo sapiens
cagcagcacaattctgtccc

SEQ ID NO: 378658 - DNA, 21 bp, Homo sapiens
cagcagcacaattctgtccct

SEQ ID NO: 378659 - DNA, 23 bp, Homo sapiens
cagcagcacaattctgtccctgt

SEQ ID NO: 378660 - DNA, 14 bp, Homo sapiens
cagcagcagctcaa

SEQ ID NO: 378661 - DNA, 18 bp, Homo sapiens
cagcagcccagcttcctg

SEQ ID NO: 378662 - DNA, 19 bp, Homo sapiens
cagcagcccagcttcctgg

SEQ ID NO: 378663 - DNA, 21 bp, Homo sapiens
cagcagcccagcttcctggtg

SEQ ID NO: 378664 - DNA, 23 bp, Homo sapiens
cagcagcccctgcacaaagccct

SEQ ID NO: 378665 - DNA, 16 bp, Homo sapiens
cagcagcctctgaagt

SEQ ID NO: 378666 - DNA, 18 bp, Homo sapiens
cagcagcctctgaagttg

SEQ ID NO: 378667 - DNA, 12 bp, Homo sapiens
cagcagcctgct

SEQ ID NO: 378668 - DNA, 20 bp, Homo sapiens
cagcagcctgcttcccacct

SEQ ID NO: 378669 - DNA, 21 bp, Homo sapiens
cagcagcctgcttcccacctc

SEQ ID NO: 378670 - DNA, 22 bp, Homo sapiens
cagcagcctgcttcccacctcc

SEQ ID NO: 378671 - DNA, 13 bp, Homo sapiens
cagcagcctgtga

SEQ ID NO: 378672 - DNA, 15 bp, Homo sapiens
cagcagcggcccaga

SEQ ID NO: 378673 - DNA, 15 bp, Homo sapiens
cagcagctaggactg

SEQ ID NO: 378674 - DNA, 17 bp, Homo sapiens
cagcagctaggactgag

SEQ ID NO: 378675 - DNA, 19 bp, Homo sapiens
cagcagctaggactgagga

SEQ ID NO: 378676 - DNA, 16 bp, Homo sapiens
cagcagctccgcctgg

SEQ ID NO: 378677 - DNA, 17 bp, Homo sapiens
cagcagctccgcctggc

SEQ ID NO: 378678 - DNA, 18 bp, Homo sapiens
cagcagctccgcctggca

SEQ ID NO: 378679 - DNA, 19 bp, Homo sapiens
cagcagctccgcctggcac

SEQ ID NO: 378680 - DNA, 14 bp, Homo sapiens
cagcagctgaggcc

SEQ ID NO: 378681 - DNA, 18 bp, Homo sapiens
cagcagcttcaccagagc

SEQ ID NO: 378682 - DNA, 13 bp, Homo sapiens
cagcagcttggct

SEQ ID NO: 378683 - DNA, 19 bp, Homo sapiens
cagcagcttggctgagccc

SEQ ID NO: 378684 - DNA, 16 bp, Homo sapiens
cagcaggcagaggaga

SEQ ID NO: 378685 - DNA, 14 bp, Homo sapiens
cagcaggcgtgcct

SEQ ID NO: 378686 - DNA, 16 bp, Homo sapiens
cagcagggcgggccag

SEQ ID NO: 378687 - DNA, 18 bp, Homo sapiens
cagcaggtgtggtggctc

SEQ ID NO: 378688 - DNA, 20 bp, Homo sapiens
cagcaggtgtggtggctcat

SEQ ID NO: 378689 - DNA, 21 bp, Homo sapiens
cagcaggtgtggtggctcatg

SEQ ID NO: 378690 - DNA, 19 bp, Homo sapiens
cagcaggttctctcctgtg

SEQ ID NO: 378691 - DNA, 20 bp, Homo sapiens
cagcaggttctctcctgtga

SEQ ID NO: 378692 - DNA, 19 bp, Homo sapiens
cagcagtcggttggagcga

SEQ ID NO: 378693 - DNA, 20 bp, Homo sapiens
cagcagtgctgggcccagcc

SEQ ID NO: 378694 - DNA, 16 bp, Homo sapiens
cagcagttcacttcct

SEQ ID NO: 378695 - DNA, 17 bp, Homo sapiens
cagcagttcacttccta

SEQ ID NO: 378696 - DNA, 23 bp, Homo sapiens
cagcagttgaatgacaacagaag

SEQ ID NO: 378697 - DNA, 13 bp, Homo sapiens
cagcagttgacat

SEQ ID NO: 378698 - DNA, 21 bp, Homo sapiens
cagcagttgctagcaacaact

SEQ ID NO: 378699 - DNA, 13 bp, Homo sapiens
cagcatacaaaaa

SEQ ID NO: 378700 - DNA, 20 bp, Homo sapiens
cagcatcaaacatgaaaaca

SEQ ID NO: 378701 - DNA, 22 bp, Homo sapiens
cagcatcaaacatgaaaacatt

SEQ ID NO: 378702 - DNA, 16 bp, Homo sapiens
cagcatccagcctgtg

SEQ ID NO: 378703 - DNA, 12 bp, Homo sapiens
cagcatctgatt

SEQ ID NO: 378704 - DNA, 16 bp, Homo sapiens
cagcatgccccttggc

SEQ ID NO: 378705 - DNA, 17 bp, Homo sapiens
cagcatgccccttggct

SEQ ID NO: 378706 - DNA, 20 bp, Homo sapiens
cagcatgccccttggctgga

SEQ ID NO: 378707 - DNA, 15 bp, Homo sapiens
cagcatgtctactgc

SEQ ID NO: 378708 - DNA, 15 bp, Homo sapiens
cagcatgtgccaaga

SEQ ID NO: 378709 - DNA, 16 bp, Homo sapiens
cagcatgtggggaagc

SEQ ID NO: 378710 - DNA, 18 bp, Homo sapiens
cagcatgtggggaagcaa

SEQ ID NO: 378711 - DNA, 22 bp, Homo sapiens
cagcatgtgtatttccagtgca

SEQ ID NO: 378712 - DNA, 15 bp, Homo sapiens
cagcatgtgtgtgtc

SEQ ID NO: 378713 - DNA, 15 bp, Homo sapiens
cagcattaggctttt

SEQ ID NO: 378714 - DNA, 15 bp, Homo sapiens
cagcattcaaaatag

SEQ ID NO: 378715 - DNA, 12 bp, Homo sapiens
cagcattccagc

SEQ ID NO: 378716 - DNA, 19 bp, Homo sapiens
cagcattccagctctgccc

SEQ ID NO: 378717 - DNA, 15 bp, Homo sapiens
cagcattctcactcc

SEQ ID NO: 378718 - DNA, 18 bp, Homo sapiens
cagccaaaagtaagtgga

SEQ ID NO: 378719 - DNA, 15 bp, Homo sapiens
cagccaaaccctgtc

SEQ ID NO: 378720 - DNA, 22 bp, Homo sapiens
cagccaaatgacttcatttctg

SEQ ID NO: 378721 - DNA, 17 bp, Homo sapiens
cagccaagacaaggagg

SEQ ID NO: 378722 - DNA, 15 bp, Homo sapiens
cagccaagcccaccc

SEQ ID NO: 378723 - DNA, 21 bp, Homo sapiens
cagccaaggtgctaaaaggaa

SEQ ID NO: 378724 - DNA, 22 bp, Homo sapiens
cagccaaggtgctaaaaggaat

SEQ ID NO: 378725 - DNA, 23 bp, Homo sapiens
cagccaaggtgctaaaaggaata

SEQ ID NO: 378726 - DNA, 14 bp, Homo sapiens
cagccaagtgcctt

SEQ ID NO: 378727 - DNA, 17 bp, Homo sapiens
cagccaagtgccttccg

SEQ ID NO: 378728 - DNA, 15 bp, Homo sapiens
cagccacccagccag

SEQ ID NO: 378729 - DNA, 17 bp, Homo sapiens
cagccacccagccagga

SEQ ID NO: 378730 - DNA, 17 bp, Homo sapiens
cagccaccccgggctct

SEQ ID NO: 378731 - DNA, 22 bp, Homo sapiens
cagccaccccgggctctctgct

SEQ ID NO: 378732 - DNA, 22 bp, Homo sapiens
cagccacccggatctccaggcc

SEQ ID NO: 378733 - DNA, 21 bp, Homo sapiens
cagccacctccacccccaaga

SEQ ID NO: 378734 - DNA, 12 bp, Homo sapiens
cagccaccttcc

SEQ ID NO: 378735 - DNA, 13 bp, Homo sapiens
cagccaccttcct

SEQ ID NO: 378736 - DNA, 22 bp, Homo sapiens
cagccaccttcctgactgggaa

SEQ ID NO: 378737 - DNA, 21 bp, Homo sapiens
cagccacgaggtggtagctct

SEQ ID NO: 378738 - DNA, 22 bp, Homo sapiens
cagccacgaggtggtagctctg

SEQ ID NO: 378739 - DNA, 22 bp, Homo sapiens
cagccacgggcacaagacccct

SEQ ID NO: 378740 - DNA, 22 bp, Homo sapiens
cagccacttggtttttggctct

SEQ ID NO: 378741 - DNA, 15 bp, Homo sapiens
cagccagaaactgaa

SEQ ID NO: 378742 - DNA, 20 bp, Homo sapiens
cagccagaaactgaactggc

SEQ ID NO: 378743 - DNA, 20 bp, Homo sapiens
cagccagcaatgatgtccag

SEQ ID NO: 378744 - DNA, 23 bp, Homo sapiens
cagccagcaatgatgtccagaag

SEQ ID NO: 378745 - DNA, 19 bp, Homo sapiens
cagccagcaggttctctcc

SEQ ID NO: 378746 - DNA, 23 bp, Homo sapiens
cagccagcaggttctctcctgtg

SEQ ID NO: 378747 - DNA, 14 bp, Homo sapiens
cagccagccagtct

SEQ ID NO: 378748 - DNA, 12 bp, Homo sapiens
cagccagcccag

SEQ ID NO: 378749 - DNA, 15 bp, Homo sapiens
cagccagcccagctc

SEQ ID NO: 378750 - DNA, 21 bp, Homo sapiens
cagccagcccagctccactca

SEQ ID NO: 378751 - DNA, 14 bp, Homo sapiens
cagccagcccttcc

SEQ ID NO: 378752 - DNA, 18 bp, Homo sapiens
cagccagcccttcccagg

SEQ ID NO: 378753 - DNA, 22 bp, Homo sapiens
cagccagcccttcccaggccag

SEQ ID NO: 378754 - DNA, 23 bp, Homo sapiens
cagccagcccttcccaggccagc

SEQ ID NO: 378755 - DNA, 14 bp, Homo sapiens
cagccagccgtgag

SEQ ID NO: 378756 - DNA, 23 bp, Homo sapiens
cagccagctgcccacaagccata

SEQ ID NO: 378757 - DNA, 15 bp, Homo sapiens
cagccagcttggtgg

SEQ ID NO: 378758 - DNA, 23 bp, Homo sapiens
cagccagcttggtggttatgtcc

SEQ ID NO: 378759 - DNA, 23 bp, Homo sapiens
cagccagggagcccggggcagag

SEQ ID NO: 378760 - DNA, 16 bp, Homo sapiens
cagccagtaaggcagc

SEQ ID NO: 378761 - DNA, 20 bp, Homo sapiens
cagccagtaaggcagctctg

SEQ ID NO: 378762 - DNA, 23 bp, Homo sapiens
cagccagtaaggcagctctgtcg

SEQ ID NO: 378763 - DNA, 15 bp, Homo sapiens
cagccagtcttgcct

SEQ ID NO: 378764 - DNA, 20 bp, Homo sapiens
cagccagtcttgcctaggcc

SEQ ID NO: 378765 - DNA, 22 bp, Homo sapiens
cagccagtggccgaacccccca

SEQ ID NO: 378766 - DNA, 17 bp, Homo sapiens
cagccatgggccctctg

SEQ ID NO: 378767 - DNA, 16 bp, Homo sapiens
cagccatgtccaagtt

SEQ ID NO: 378768 - DNA, 19 bp, Homo sapiens
cagccattcactgccccca

SEQ ID NO: 378769 - DNA, 18 bp, Homo sapiens
cagccattcatctgggct

SEQ ID NO: 378770 - DNA, 23 bp, Homo sapiens
cagccattcatctgggctggcag

SEQ ID NO: 378771 - DNA, 13 bp, Homo sapiens
cagccattcctgt

SEQ ID NO: 378772 - DNA, 17 bp, Homo sapiens
cagcccaacagaaggaa

SEQ ID NO: 378773 - DNA, 16 bp, Homo sapiens
cagcccaaccaggagg

SEQ ID NO: 378774 - DNA, 18 bp, Homo sapiens
cagcccaaccaggagggg

SEQ ID NO: 378775 - DNA, 22 bp, Homo sapiens
cagcccaaccgggaaaggcatc

SEQ ID NO: 378776 - DNA, 12 bp, Homo sapiens
cagcccaataaa

SEQ ID NO: 378777 - DNA, 19 bp, Homo sapiens
cagcccaataaaggtccct

SEQ ID NO: 378778 - DNA, 19 bp, Homo sapiens
cagcccacagtgctcagtt

SEQ ID NO: 378779 - DNA, 11 bp, Homo sapiens
cagcccacccc

SEQ ID NO: 378780 - DNA, 16 bp, Homo sapiens
cagcccacccccctca

SEQ ID NO: 378781 - DNA, 19 bp, Homo sapiens
cagcccacccccctcattt

SEQ ID NO: 378782 - DNA, 11 bp, Homo sapiens
cagcccaccct

SEQ ID NO: 378783 - DNA, 20 bp, Homo sapiens
cagcccagaacgggcctccc

SEQ ID NO: 378784 - DNA, 19 bp, Homo sapiens
cagcccagacccccagtgt

SEQ ID NO: 378785 - DNA, 15 bp, Homo sapiens
cagcccagcccagct

SEQ ID NO: 378786 - DNA, 12 bp, Homo sapiens
cagcccagctcc

SEQ ID NO: 378787 - DNA, 14 bp, Homo sapiens
cagcccagctccac

SEQ ID NO: 378788 - DNA, 17 bp, Homo sapiens
cagcccagctgctctgc

SEQ ID NO: 378789 - DNA, 18 bp, Homo sapiens
cagcccagctgctctgcc

SEQ ID NO: 378790 - DNA, 11 bp, Homo sapiens
cagcccagggt

SEQ ID NO: 378791 - DNA, 17 bp, Homo sapiens
cagcccagggttccccc

SEQ ID NO: 378792 - DNA, 18 bp, Homo sapiens
cagcccagggttccccca

SEQ ID NO: 378793 - DNA, 16 bp, Homo sapiens
cagcccatcttgcctc

SEQ ID NO: 378794 - DNA, 18 bp, Homo sapiens
cagcccatcttgcctcca

SEQ ID NO: 378795 - DNA, 15 bp, Homo sapiens
cagcccatgcccacc

SEQ ID NO: 378796 - DNA, 19 bp, Homo sapiens
cagcccatgcccacctgcc

SEQ ID NO: 378797 - DNA, 21 bp, Homo sapiens
cagccccacccaggagggagg

SEQ ID NO: 378798 - DNA, 21 bp, Homo sapiens
cagccccacccctaagtgccc

SEQ ID NO: 378799 - DNA, 23 bp, Homo sapiens
cagccccacccctaagtgcccaa

SEQ ID NO: 378800 - DNA, 12 bp, Homo sapiens
cagccccagcaa

SEQ ID NO: 378801 - DNA, 23 bp, Homo sapiens
cagccccagcgagtctggagacc

SEQ ID NO: 378802 - DNA, 16 bp, Homo sapiens
cagccccatagaaaac

SEQ ID NO: 378803 - DNA, 18 bp, Homo sapiens
cagccccatagaaaacaa

SEQ ID NO: 378804 - DNA, 15 bp, Homo sapiens
cagccccatccttcc

SEQ ID NO: 378805 - DNA, 14 bp, Homo sapiens
cagccccccacccc

SEQ ID NO: 378806 - DNA, 12 bp, Homo sapiens
cagccccctcca

SEQ ID NO: 378807 - DNA, 13 bp, Homo sapiens
cagccccctccac

SEQ ID NO: 378808 - DNA, 24 bp, Homo sapiens
cagccccctccacaccagtggcct

SEQ ID NO: 378809 - DNA, 14 bp, Homo sapiens
cagccccctggatg

SEQ ID NO: 378810 - DNA, 12 bp, Homo sapiens
cagccccctggc

SEQ ID NO: 378811 - DNA, 16 bp, Homo sapiens
agtactattactagta

SEQ ID NO: 378812 - DNA, 14 bp, Homo sapiens
agtactattactat

SEQ ID NO: 378813 - DNA, 22 bp, Homo sapiens
agtactattactattactattt

SEQ ID NO: 378814 - DNA, 22 bp, Homo sapiens
agtactcactaaaagttctcaa

SEQ ID NO: 378815 - DNA, 15 bp, Homo sapiens
agtactcagaggctg

SEQ ID NO: 378816 - DNA, 16 bp, Homo sapiens
agtactcctgcaaaat

SEQ ID NO: 378817 - DNA, 15 bp, Homo sapiens
agtactccttaagaa

SEQ ID NO: 378818 - DNA, 18 bp, Homo sapiens
agtactccttaagaacac

SEQ ID NO: 378819 - DNA, 13 bp, Homo sapiens
agtactctctgct

SEQ ID NO: 378820 - DNA, 17 bp, Homo sapiens
agtactctctgctctag

SEQ ID NO: 378821 - DNA, 13 bp, Homo sapiens
agtacttaatata

SEQ ID NO: 378822 - DNA, 15 bp, Homo sapiens
agtacttcaggcacg

SEQ ID NO: 378823 - DNA, 11 bp, Homo sapiens
agtacttgaaa

SEQ ID NO: 378824 - DNA, 23 bp, Homo sapiens
agtacttgggagacctgtaatca

SEQ ID NO: 378825 - DNA, 23 bp, Homo sapiens
agtacttttaacgtatgtatttc

SEQ ID NO: 378826 - DNA, 17 bp, Homo sapiens
agtagaaattttacaat

SEQ ID NO: 378827 - DNA, 16 bp, Homo sapiens
agtagaaggtcggagg

SEQ ID NO: 378828 - DNA, 14 bp, Homo sapiens
agtagaataaaaac

SEQ ID NO: 378829 - DNA, 15 bp, Homo sapiens
agtagaatctcagca

SEQ ID NO: 378830 - DNA, 20 bp, Homo sapiens
agtagacctgattttcaaaa

SEQ ID NO: 378831 - DNA, 20 bp, Homo sapiens
agtagagatggggaaagaat

SEQ ID NO: 378832 - DNA, 22 bp, Homo sapiens
agtagagatttcatagctattt

SEQ ID NO: 378833 - DNA, 17 bp, Homo sapiens
agtagagcaaagactta

SEQ ID NO: 378834 - DNA, 14 bp, Homo sapiens
agtagagtcatctc

SEQ ID NO: 378835 - DNA, 16 bp, Homo sapiens
agtagagtcatctcca

SEQ ID NO: 378836 - DNA, 23 bp, Homo sapiens
agtagagtcatctccatcagctg

SEQ ID NO: 378837 - DNA, 15 bp, Homo sapiens
agtagatggtgaaat

SEQ ID NO: 378838 - DNA, 21 bp, Homo sapiens
agtagcagtcatcatcttttt

SEQ ID NO: 378839 - DNA, 17 bp, Homo sapiens
agtagccattttgtaac

SEQ ID NO: 378840 - DNA, 20 bp, Homo sapiens
agtagccctttctgtgtgca

SEQ ID NO: 378841 - DNA, 21 bp, Homo sapiens
agtagccctttctgtgtgcac

SEQ ID NO: 378842 - DNA, 14 bp, Homo sapiens
agtagctgataaag

SEQ ID NO: 378843 - DNA, 20 bp, Homo sapiens
agtagctgccaaaaagaaca

SEQ ID NO: 378844 - DNA, 21 bp, Homo sapiens
agtagctgccaaaaagaacac

SEQ ID NO: 378845 - DNA, 21 bp, Homo sapiens
agtagctgggatgacaggcgc

SEQ ID NO: 378846 - DNA, 16 bp, Homo sapiens
agtaggaccaatgttg

SEQ ID NO: 378847 - DNA, 14 bp, Homo sapiens
agtaggcattcttt

SEQ ID NO: 378848 - DNA, 21 bp, Homo sapiens
agtaggctaaaaacattttaa

SEQ ID NO: 378849 - DNA, 17 bp, Homo sapiens
agtaggggcatggtata

SEQ ID NO: 378850 - DNA, 16 bp, Homo sapiens
agtagggttgccagtc

SEQ ID NO: 378851 - DNA, 17 bp, Homo sapiens
agtaggtccaagggcca

SEQ ID NO: 378852 - DNA, 17 bp, Homo sapiens
agtaggtctgcacacat

SEQ ID NO: 378853 - DNA, 20 bp, Homo sapiens
agtaggtgggtcttggattg

SEQ ID NO: 378854 - DNA, 17 bp, Homo sapiens
agtaggttgaggacagg

SEQ ID NO: 378855 - DNA, 13 bp, Homo sapiens
agtagtaaaatta

SEQ ID NO: 378856 - DNA, 17 bp, Homo sapiens
agtagtaaaattagaaa

SEQ ID NO: 378857 - DNA, 16 bp, Homo sapiens
agtagtaatagagcaa

SEQ ID NO: 378858 - DNA, 14 bp, Homo sapiens
agtagtacttgaaa

SEQ ID NO: 378859 - DNA, 14 bp, Homo sapiens
agtagtgcctgtga

SEQ ID NO: 378860 - DNA, 22 bp, Homo sapiens
agtagttgatgaccaatctctg

SEQ ID NO: 378861 - DNA, 12 bp, Homo sapiens
agtagtttgtat

SEQ ID NO: 378862 - DNA, 17 bp, Homo sapiens
agtagtttgtataactt

SEQ ID NO: 378863 - DNA, 15 bp, Homo sapiens
agtataaagtaaaat

SEQ ID NO: 378864 - DNA, 22 bp, Homo sapiens
agtatactgtgtgggatactta

SEQ ID NO: 378865 - DNA, 17 bp, Homo sapiens
agtatagaatgaactgt

SEQ ID NO: 378866 - DNA, 17 bp, Homo sapiens
agtatataaagttttgc

SEQ ID NO: 378867 - DNA, 17 bp, Homo sapiens
agtatataagctgttta

SEQ ID NO: 378868 - DNA, 19 bp, Homo sapiens
agtatatagccttaagtct

SEQ ID NO: 378869 - DNA, 18 bp, Homo sapiens
agtatatctaatggctgt

SEQ ID NO: 378870 - DNA, 22 bp, Homo sapiens
agtatatctatctatatataca

SEQ ID NO: 378871 - DNA, 15 bp, Homo sapiens
agtatatctggacaa

SEQ ID NO: 378872 - DNA, 16 bp, Homo sapiens
agtatatttatataat

SEQ ID NO: 378873 - DNA, 16 bp, Homo sapiens
agtatatttatttcta

SEQ ID NO: 378874 - DNA, 13 bp, Homo sapiens
agtatattttctt

SEQ ID NO: 378875 - DNA, 14 bp, Homo sapiens
agtatcaaaggcag

SEQ ID NO: 378876 - DNA, 15 bp, Homo sapiens
agtatcaaaggcaga

SEQ ID NO: 378877 - DNA, 16 bp, Homo sapiens
agtatcaaggctgcct

SEQ ID NO: 378878 - DNA, 19 bp, Homo sapiens
agtatcaaggctgcctgga

SEQ ID NO: 378879 - DNA, 21 bp, Homo sapiens
agtatcaaggctgcctggaga

SEQ ID NO: 378880 - DNA, 15 bp, Homo sapiens
agtatcaggcctgcc

SEQ ID NO: 378881 - DNA, 11 bp, Homo sapiens
agtatcatgca

SEQ ID NO: 378882 - DNA, 21 bp, Homo sapiens
agtatccaattatgtgacaac

SEQ ID NO: 378883 - DNA, 14 bp, Homo sapiens
agtatcctgctggt

SEQ ID NO: 378884 - DNA, 13 bp, Homo sapiens
agtatctggctgg

SEQ ID NO: 378885 - DNA, 14 bp, Homo sapiens
agtatctggctggg

SEQ ID NO: 378886 - DNA, 14 bp, Homo sapiens
agtatctgggaact

SEQ ID NO: 378887 - DNA, 15 bp, Homo sapiens
agtatctgtatctct

SEQ ID NO: 378888 - DNA, 11 bp, Homo sapiens
agtatcttgaa

SEQ ID NO: 378889 - DNA, 14 bp, Homo sapiens
agtatgaagacact

SEQ ID NO: 378890 - DNA, 16 bp, Homo sapiens
agtatgaataaagaca

SEQ ID NO: 378891 - DNA, 13 bp, Homo sapiens
agtatgaatgatg

SEQ ID NO: 378892 - DNA, 18 bp, Homo sapiens
agtatgagaaatacagtg

SEQ ID NO: 378893 - DNA, 20 bp, Homo sapiens
agtatgagaaatacagtgct

SEQ ID NO: 378894 - DNA, 18 bp, Homo sapiens
agtatgcaagaagaatat

SEQ ID NO: 378895 - DNA, 16 bp, Homo sapiens
agtatgtaaagtatgt

SEQ ID NO: 378896 - DNA, 21 bp, Homo sapiens
agtatgtaaagtatgtaaaca

SEQ ID NO: 378897 - DNA, 14 bp, Homo sapiens
agtatgtgtaaaat

SEQ ID NO: 378898 - DNA, 20 bp, Homo sapiens
agtatgtgtctagcaaagcc

SEQ ID NO: 378899 - DNA, 23 bp, Homo sapiens
agtattatttctccatcccctcc

SEQ ID NO: 378900 - DNA, 14 bp, Homo sapiens
agtattccacctta

SEQ ID NO: 378901 - DNA, 15 bp, Homo sapiens
agtattctcagagca

SEQ ID NO: 378902 - DNA, 18 bp, Homo sapiens
agtattgacttctttttg

SEQ ID NO: 378903 - DNA, 18 bp, Homo sapiens
agtattgccacctctggc

SEQ ID NO: 378904 - DNA, 12 bp, Homo sapiens
agtattgctaat

SEQ ID NO: 378905 - DNA, 22 bp, Homo sapiens
agtattgtccatatcagacctc

SEQ ID NO: 378906 - DNA, 12 bp, Homo sapiens
agtatttatata

SEQ ID NO: 378907 - DNA, 15 bp, Homo sapiens
agtatttatatattt

SEQ ID NO: 378908 - DNA, 16 bp, Homo sapiens
agtatttatatattta

SEQ ID NO: 378909 - DNA, 17 bp, Homo sapiens
agtatttatatatttat

SEQ ID NO: 378910 - DNA, 19 bp, Homo sapiens
agtatttatatatttataa

SEQ ID NO: 378911 - DNA, 20 bp, Homo sapiens
agtatttatatatttataac

SEQ ID NO: 378912 - DNA, 19 bp, Homo sapiens
agtatttcagatgctttag

SEQ ID NO: 378913 - DNA, 16 bp, Homo sapiens
agtatttgagagttct

SEQ ID NO: 378914 - DNA, 14 bp, Homo sapiens
agtcaaaagcctgg

SEQ ID NO: 378915 - DNA, 16 bp, Homo sapiens
agtcaaacagtgtggc

SEQ ID NO: 378916 - DNA, 21 bp, Homo sapiens
agtcaaagacgctgagtggga

SEQ ID NO: 378917 - DNA, 14 bp, Homo sapiens
agtcaaataactcc

SEQ ID NO: 378918 - DNA, 14 bp, Homo sapiens
agtcaagtcaaata

SEQ ID NO: 378919 - DNA, 16 bp, Homo sapiens
agtcaagtgtgcctgc

SEQ ID NO: 378920 - DNA, 14 bp, Homo sapiens
agtcaatcatttct

SEQ ID NO: 378921 - DNA, 15 bp, Homo sapiens
agtcaatcatttctc

SEQ ID NO: 378922 - DNA, 14 bp, Homo sapiens
agtcacacattata

SEQ ID NO: 378923 - DNA, 21 bp, Homo sapiens
agtcacacattatagaaatta

SEQ ID NO: 378924 - DNA, 16 bp, Homo sapiens
agtcacactgctagca

SEQ ID NO: 378925 - DNA, 13 bp, Homo sapiens
agtcacagccatt

SEQ ID NO: 378926 - DNA, 16 bp, Homo sapiens
agtcacagccatttca

SEQ ID NO: 378927 - DNA, 17 bp, Homo sapiens
agtcacagccatttcaa

SEQ ID NO: 378928 - DNA, 21 bp, Homo sapiens
agtcacagccgtttgaatata

SEQ ID NO: 378929 - DNA, 13 bp, Homo sapiens
agtcacagctgca

SEQ ID NO: 378930 - DNA, 18 bp, Homo sapiens
agtcacagctgcagctgg

SEQ ID NO: 378931 - DNA, 19 bp, Homo sapiens
agtcacagctgcagctggg

SEQ ID NO: 378932 - DNA, 19 bp, Homo sapiens
agtcacagctttcccaggt

SEQ ID NO: 378933 - DNA, 17 bp, Homo sapiens
agtcaccaggacttggg

SEQ ID NO: 378934 - DNA, 15 bp, Homo sapiens
agtcaccctgtggca

SEQ ID NO: 378935 - DNA, 14 bp, Homo sapiens
agtcacccttctgg

SEQ ID NO: 378936 - DNA, 17 bp, Homo sapiens
agtcacccttctgggca

SEQ ID NO: 378937 - DNA, 13 bp, Homo sapiens
agtcacctcctcc

SEQ ID NO: 378938 - DNA, 14 bp, Homo sapiens
agtcacctcctcca

SEQ ID NO: 378939 - DNA, 17 bp, Homo sapiens
agtcacctcctccactc

SEQ ID NO: 378940 - DNA, 13 bp, Homo sapiens
agtcacctgctgg

SEQ ID NO: 378941 - DNA, 13 bp, Homo sapiens
agtcaccttccag

SEQ ID NO: 378942 - DNA, 12 bp, Homo sapiens
agtcagagaaaa

SEQ ID NO: 378943 - DNA, 14 bp, Homo sapiens
agtcagagccctgg

SEQ ID NO: 378944 - DNA, 21 bp, Homo sapiens
agtcagatgagcaaggacatt

SEQ ID NO: 378945 - DNA, 23 bp, Homo sapiens
agtcagatgagcaaggacattgc

SEQ ID NO: 378946 - DNA, 18 bp, Homo sapiens
agtcagcccgaatgcctg

SEQ ID NO: 378947 - DNA, 13 bp, Homo sapiens
cagccccctggcc

SEQ ID NO: 378948 - DNA, 18 bp, Homo sapiens
cagccccgttttggggac

SEQ ID NO: 378949 - DNA, 23 bp, Homo sapiens
cagcccctaccttgagaccctct

SEQ ID NO: 378950 - DNA, 14 bp, Homo sapiens
cagcccctagcaga

SEQ ID NO: 378951 - DNA, 21 bp, Homo sapiens
cagcccctcccaccacagcag

SEQ ID NO: 378952 - DNA, 18 bp, Homo sapiens
cagcccctcggctctgcc

SEQ ID NO: 378953 - DNA, 23 bp, Homo sapiens
cagcccctgctgctcctcggcca

SEQ ID NO: 378954 - DNA, 14 bp, Homo sapiens
cagcccctgctgga

SEQ ID NO: 378955 - DNA, 17 bp, Homo sapiens
cagcccctgctggacca

SEQ ID NO: 378956 - DNA, 20 bp, Homo sapiens
cagcccctgtatggcactgg

SEQ ID NO: 378957 - DNA, 16 bp, Homo sapiens
cagccccttctcccag

SEQ ID NO: 378958 - DNA, 20 bp, Homo sapiens
cagccccttctcccagcaca

SEQ ID NO: 378959 - DNA, 17 bp, Homo sapiens
cagccccttgagaaacc

SEQ ID NO: 378960 - DNA, 18 bp, Homo sapiens
cagccccttgagaaacct

SEQ ID NO: 378961 - DNA, 19 bp, Homo sapiens
cagcccgcatgcagcagct

SEQ ID NO: 378962 - DNA, 13 bp, Homo sapiens
cagcccgcctgcc

SEQ ID NO: 378963 - DNA, 19 bp, Homo sapiens
cagcccgcctgccgtgcat

SEQ ID NO: 378964 - DNA, 22 bp, Homo sapiens
cagcccgcctgccgtgcatggc

SEQ ID NO: 378965 - DNA, 18 bp, Homo sapiens
cagcccggaccttggcag

SEQ ID NO: 378966 - DNA, 23 bp, Homo sapiens
cagcccggcctgctcccagcagc

SEQ ID NO: 378967 - DNA, 22 bp, Homo sapiens
cagcccgggagatccgccctgg

SEQ ID NO: 378968 - DNA, 19 bp, Homo sapiens
cagcccgtgaagcagtgcc

SEQ ID NO: 378969 - DNA, 20 bp, Homo sapiens
cagcccgtgaagcagtgcct

SEQ ID NO: 378970 - DNA, 23 bp, Homo sapiens
cagcccgtgaagcagtgcctcga

SEQ ID NO: 378971 - DNA, 15 bp, Homo sapiens
cagcccgtgtggccc

SEQ ID NO: 378972 - DNA, 20 bp, Homo sapiens
cagccctaaggatctctcag

SEQ ID NO: 378973 - DNA, 23 bp, Homo sapiens
cagccctagaggcgagccaggca

SEQ ID NO: 378974 - DNA, 17 bp, Homo sapiens
cagccctaggctaccct

SEQ ID NO: 378975 - DNA, 15 bp, Homo sapiens
cagccctagtgggag

SEQ ID NO: 378976 - DNA, 23 bp, Homo sapiens
cagccctagtgggagcccagcac

SEQ ID NO: 378977 - DNA, 17 bp, Homo sapiens
cagccctccagagcagg

SEQ ID NO: 378978 - DNA, 12 bp, Homo sapiens
cagccctcccag

SEQ ID NO: 378979 - DNA, 15 bp, Homo sapiens
cagccctcccagctg

SEQ ID NO: 378980 - DNA, 17 bp, Homo sapiens
cagccctcccagctggt

SEQ ID NO: 378981 - DNA, 22 bp, Homo sapiens
cagccctccctgcccctccctt

SEQ ID NO: 378982 - DNA, 15 bp, Homo sapiens
cagccctcggcctcc

SEQ ID NO: 378983 - DNA, 12 bp, Homo sapiens
cagccctgaggt

SEQ ID NO: 378984 - DNA, 22 bp, Homo sapiens
cagccctgaggtgaaagggagc

SEQ ID NO: 378985 - DNA, 11 bp, Homo sapiens
cagccctgctt

SEQ ID NO: 378986 - DNA, 12 bp, Homo sapiens
cagccctgggag

SEQ ID NO: 378987 - DNA, 13 bp, Homo sapiens
cagccctggggct

SEQ ID NO: 378988 - DNA, 19 bp, Homo sapiens
cagccctggttctccatcc

SEQ ID NO: 378989 - DNA, 20 bp, Homo sapiens
cagccctgtcagtgcagccc

SEQ ID NO: 378990 - DNA, 16 bp, Homo sapiens
cagccctgtcctggtt

SEQ ID NO: 378991 - DNA, 22 bp, Homo sapiens
cagcccttcctcctgaagcctc

SEQ ID NO: 378992 - DNA, 12 bp, Homo sapiens
cagcccttctgc

SEQ ID NO: 378993 - DNA, 18 bp, Homo sapiens
cagcccttctgcctttct

SEQ ID NO: 378994 - DNA, 12 bp, Homo sapiens
cagcccttgccc

SEQ ID NO: 378995 - DNA, 15 bp, Homo sapiens
cagcccttgccccca

SEQ ID NO: 378996 - DNA, 17 bp, Homo sapiens
cagccctttccagggca

SEQ ID NO: 378997 - DNA, 20 bp, Homo sapiens
cagccgaattgtggtgtctt

SEQ ID NO: 378998 - DNA, 17 bp, Homo sapiens
cagccgagccgggcctg

SEQ ID NO: 378999 - DNA, 19 bp, Homo sapiens
cagccgagccgggcctggg

SEQ ID NO: 379000 - DNA, 14 bp, Homo sapiens
cagccgagctcgtg

SEQ ID NO: 379001 - DNA, 23 bp, Homo sapiens
cagccgcaaatccataccccctg

SEQ ID NO: 379002 - DNA, 13 bp, Homo sapiens
cagccgccacatc

SEQ ID NO: 379003 - DNA, 14 bp, Homo sapiens
cagccgccacatcc

SEQ ID NO: 379004 - DNA, 18 bp, Homo sapiens
cagccgccattgccacca

SEQ ID NO: 379005 - DNA, 21 bp, Homo sapiens
cagccgccattgccaccagga

SEQ ID NO: 379006 - DNA, 22 bp, Homo sapiens
cagccgccattgccaccaggag

SEQ ID NO: 379007 - DNA, 23 bp, Homo sapiens
cagccgccattgccaccaggaga

SEQ ID NO: 379008 - DNA, 18 bp, Homo sapiens
cagccgccccagcccctt

SEQ ID NO: 379009 - DNA, 18 bp, Homo sapiens
cagccgccttccttgacc

SEQ ID NO: 379010 - DNA, 22 bp, Homo sapiens
cagccgccttccttgaccttcc

SEQ ID NO: 379011 - DNA, 14 bp, Homo sapiens
cagccgcgctctgc

SEQ ID NO: 379012 - DNA, 17 bp, Homo sapiens
cagccgcgctctgcccc

SEQ ID NO: 379013 - DNA, 21 bp, Homo sapiens
cagccgcgctctgcccctccg

SEQ ID NO: 379014 - DNA, 14 bp, Homo sapiens
cagccgctaggaga

SEQ ID NO: 379015 - DNA, 21 bp, Homo sapiens
cagccgctaggagagactgaa

SEQ ID NO: 379016 - DNA, 16 bp, Homo sapiens
cagccggatcttggag

SEQ ID NO: 379017 - DNA, 18 bp, Homo sapiens
cagccggcacagggtctg

SEQ ID NO: 379018 - DNA, 23 bp, Homo sapiens
cagccggcacagggtctgctctt

SEQ ID NO: 379019 - DNA, 16 bp, Homo sapiens
cagccggggcctgcct

SEQ ID NO: 379020 - DNA, 18 bp, Homo sapiens
cagccggggcctgcctag

SEQ ID NO: 379021 - DNA, 20 bp, Homo sapiens
cagccgtcccgcgttcaaga

SEQ ID NO: 379022 - DNA, 23 bp, Homo sapiens
cagccgtcccgcgttcaagactt

SEQ ID NO: 379023 - DNA, 16 bp, Homo sapiens
cagccgtgatgctcag

SEQ ID NO: 379024 - DNA, 17 bp, Homo sapiens
cagccgtgatgctcagg

SEQ ID NO: 379025 - DNA, 19 bp, Homo sapiens
cagccgtgatgctcaggct

SEQ ID NO: 379026 - DNA, 9 bp, Homo sapiens
cagccgtgc

SEQ ID NO: 379027 - DNA, 18 bp, Homo sapiens
cagccgtgccttcagctc

SEQ ID NO: 379028 - DNA, 20 bp, Homo sapiens
cagcctaggaccagttttgt

SEQ ID NO: 379029 - DNA, 17 bp, Homo sapiens
cagcctagtaggagctg

SEQ ID NO: 379030 - DNA, 18 bp, Homo sapiens
cagcctatatttcctctt

SEQ ID NO: 379031 - DNA, 22 bp, Homo sapiens
cagcctatatttcctcttctgt

SEQ ID NO: 379032 - DNA, 21 bp, Homo sapiens
cagcctatgggggctctcgga

SEQ ID NO: 379033 - DNA, 18 bp, Homo sapiens
cagcctattattttttta

SEQ ID NO: 379034 - DNA, 18 bp, Homo sapiens
cagcctcacccctgcagg

SEQ ID NO: 379035 - DNA, 15 bp, Homo sapiens
cagcctcacccttgc

SEQ ID NO: 379036 - DNA, 12 bp, Homo sapiens
cagcctcagtgc

SEQ ID NO: 379037 - DNA, 14 bp, Homo sapiens
cagcctcagtgcca

SEQ ID NO: 379038 - DNA, 17 bp, Homo sapiens
cagcctcagtgccactt

SEQ ID NO: 379039 - DNA, 13 bp, Homo sapiens
cagcctccaagaa

SEQ ID NO: 379040 - DNA, 12 bp, Homo sapiens
cagcctccagag

SEQ ID NO: 379041 - DNA, 16 bp, Homo sapiens
cagcctccagagccag

SEQ ID NO: 379042 - DNA, 14 bp, Homo sapiens
cagcctccagggcc

SEQ ID NO: 379043 - DNA, 15 bp, Homo sapiens
cagcctccagggccc

SEQ ID NO: 379044 - DNA, 14 bp, Homo sapiens
cagcctccagttgt

SEQ ID NO: 379045 - DNA, 14 bp, Homo sapiens
cagcctcccaaagt

SEQ ID NO: 379046 - DNA, 16 bp, Homo sapiens
cagcctcccaccccca

SEQ ID NO: 379047 - DNA, 19 bp, Homo sapiens
cagcctcccacccccatct

SEQ ID NO: 379048 - DNA, 12 bp, Homo sapiens
cagcctccccca

SEQ ID NO: 379049 - DNA, 16 bp, Homo sapiens
cagcctcccccaggct

SEQ ID NO: 379050 - DNA, 18 bp, Homo sapiens
cagcctcccccaggctgc

SEQ ID NO: 379051 - DNA, 21 bp, Homo sapiens
cagcctcccccaggctgcgcc

SEQ ID NO: 379052 - DNA, 18 bp, Homo sapiens
cagcctcccctcccctgg

SEQ ID NO: 379053 - DNA, 17 bp, Homo sapiens
cagcctccctgtcactc

SEQ ID NO: 379054 - DNA, 13 bp, Homo sapiens
cagcctcctcctg

SEQ ID NO: 379055 - DNA, 21 bp, Homo sapiens
cagcctcctgagcctgtgggt

SEQ ID NO: 379056 - DNA, 20 bp, Homo sapiens
cagcctcgaactcctgggct

SEQ ID NO: 379057 - DNA, 21 bp, Homo sapiens
cagcctcgaactcctgggctc

SEQ ID NO: 379058 - DNA, 19 bp, Homo sapiens
cagcctctcccggctgcct

SEQ ID NO: 379059 - DNA, 20 bp, Homo sapiens
cagcctctgaagttggacag

SEQ ID NO: 379060 - DNA, 14 bp, Homo sapiens
cagcctctgccagg

SEQ ID NO: 379061 - DNA, 15 bp, Homo sapiens
cagcctctgccaggc

SEQ ID NO: 379062 - DNA, 19 bp, Homo sapiens
cagcctctgccaggcctgt

SEQ ID NO: 379063 - DNA, 19 bp, Homo sapiens
cagcctcttaaagctgcct

SEQ ID NO: 379064 - DNA, 14 bp, Homo sapiens
cagcctgagccaca

SEQ ID NO: 379065 - DNA, 19 bp, Homo sapiens
cagcctgagctccaccctc

SEQ ID NO: 379066 - DNA, 21 bp, Homo sapiens
cagcctgagctccaccctccc

SEQ ID NO: 379067 - DNA, 16 bp, Homo sapiens
cagcctgagtctcctg

SEQ ID NO: 379068 - DNA, 18 bp, Homo sapiens
cagcctgagtctcctgtg

SEQ ID NO: 379069 - DNA, 18 bp, Homo sapiens
cagcctgcacacacctgc

SEQ ID NO: 379070 - DNA, 21 bp, Homo sapiens
cagcctgcacacacctgcctg

SEQ ID NO: 379071 - DNA, 10 bp, Homo sapiens
cagcctgctg

SEQ ID NO: 379072 - DNA, 15 bp, Homo sapiens
cagcctgctgagagc

SEQ ID NO: 379073 - DNA, 20 bp, Homo sapiens
cagcctgctgagagccccca

SEQ ID NO: 379074 - DNA, 22 bp, Homo sapiens
cagcctgctgagagcccccacc

SEQ ID NO: 379075 - DNA, 23 bp, Homo sapiens
cagcctgcttcttccccagggtt

SEQ ID NO: 379076 - DNA, 14 bp, Homo sapiens
cagcctggagccgt

SEQ ID NO: 379077 - DNA, 13 bp, Homo sapiens
cagcctggaggcc

SEQ ID NO: 379078 - DNA, 21 bp, Homo sapiens
cagcctggcacagggcagtgg

SEQ ID NO: 379079 - DNA, 19 bp, Homo sapiens
cagcctggccacgcagcca

SEQ ID NO: 379080 - DNA, 12 bp, Homo sapiens
cagcctggcccc

SEQ ID NO: 379081 - DNA, 19 bp, Homo sapiens
cagcctggccccaaatgtt

SEQ ID NO: 379082 - DNA, 17 bp, Homo sapiens
cagcctggcctcccctg

SEQ ID NO: 379083 - DNA, 21 bp, Homo sapiens
cagcctggctcccaggacacg

SEQ ID NO: 379084 - DNA, 20 bp, Homo sapiens
cagcctgggactcccagtga

SEQ ID NO: 379085 - DNA, 20 bp, Homo sapiens
cagcctgggcagccaggctg

SEQ ID NO: 379086 - DNA, 21 bp, Homo sapiens
cagcctgggcagccaggctgc

SEQ ID NO: 379087 - DNA, 16 bp, Homo sapiens
cagcctggggcctggc

SEQ ID NO: 379088 - DNA, 16 bp, Homo sapiens
cagcctgtcagccaac

SEQ ID NO: 379089 - DNA, 12 bp, Homo sapiens
cagcctgtcctg

SEQ ID NO: 379090 - DNA, 14 bp, Homo sapiens
cagcctgtcctggt

SEQ ID NO: 379091 - DNA, 22 bp, Homo sapiens
cagcctgtcttcagatcctgct

SEQ ID NO: 379092 - DNA, 15 bp, Homo sapiens
cagcctgtggcatct

SEQ ID NO: 379093 - DNA, 19 bp, Homo sapiens
cagcctgtgggagaaggga

SEQ ID NO: 379094 - DNA, 12 bp, Homo sapiens
cagcctgtggtt

SEQ ID NO: 379095 - DNA, 19 bp, Homo sapiens
cagcctgtggttacagtgc

SEQ ID NO: 379096 - DNA, 20 bp, Homo sapiens
cagcctgtggttacagtgca

SEQ ID NO: 379097 - DNA, 22 bp, Homo sapiens
cagcctgtggttacagtgcaga

SEQ ID NO: 379098 - DNA, 21 bp, Homo sapiens
cagccttagcatcccctgtga

SEQ ID NO: 379099 - DNA, 14 bp, Homo sapiens
cagccttagctgcc

SEQ ID NO: 379100 - DNA, 15 bp, Homo sapiens
cagccttcccctccc

SEQ ID NO: 379101 - DNA, 18 bp, Homo sapiens
cagccttcccctccctgt

SEQ ID NO: 379102 - DNA, 13 bp, Homo sapiens
cagccttccgagt

SEQ ID NO: 379103 - DNA, 14 bp, Homo sapiens
cagccttcctctgc

SEQ ID NO: 379104 - DNA, 20 bp, Homo sapiens
cagccttcctctgcagctga

SEQ ID NO: 379105 - DNA, 17 bp, Homo sapiens
cagccttgggcctttca

SEQ ID NO: 379106 - DNA, 18 bp, Homo sapiens
cagccttgggcctttcag

SEQ ID NO: 379107 - DNA, 13 bp, Homo sapiens
cagcctttctgta

SEQ ID NO: 379108 - DNA, 14 bp, Homo sapiens
cagcctttctgtat

SEQ ID NO: 379109 - DNA, 21 bp, Homo sapiens
cagcctttctgtatcaagccc

SEQ ID NO: 379110 - DNA, 23 bp, Homo sapiens
cagcctttctgtatcaagcccct

SEQ ID NO: 379111 - DNA, 15 bp, Homo sapiens
cagcctttctgtgga

SEQ ID NO: 379112 - DNA, 17 bp, Homo sapiens
cagcgaggcgaggctgc

SEQ ID NO: 379113 - DNA, 21 bp, Homo sapiens
cagcgaggcgaggctgcctct

SEQ ID NO: 379114 - DNA, 23 bp, Homo sapiens
cagcgaggcgaggctgcctctgg

SEQ ID NO: 379115 - DNA, 12 bp, Homo sapiens
cagcgagtctgg

SEQ ID NO: 379116 - DNA, 13 bp, Homo sapiens
cagcgcatgtgtc

SEQ ID NO: 379117 - DNA, 16 bp, Homo sapiens
cagcgcccgctgggct

SEQ ID NO: 379118 - DNA, 17 bp, Homo sapiens
cagcgcccgctgggctg

SEQ ID NO: 379119 - DNA, 19 bp, Homo sapiens
cagcgcccgctgggctgag

SEQ ID NO: 379120 - DNA, 17 bp, Homo sapiens
cagcgcctcccgccgcc

SEQ ID NO: 379121 - DNA, 21 bp, Homo sapiens
cagcgcctcccgccgcctcgg

SEQ ID NO: 379122 - DNA, 22 bp, Homo sapiens
cagcgcctgtgctgaggactcc

SEQ ID NO: 379123 - DNA, 18 bp, Homo sapiens
cagcgctccctgtcgcct

SEQ ID NO: 379124 - DNA, 16 bp, Homo sapiens
cagcgctgcccacacc

SEQ ID NO: 379125 - DNA, 17 bp, Homo sapiens
cagcgctgcccacacca

SEQ ID NO: 379126 - DNA, 13 bp, Homo sapiens
cagcggcccagat

SEQ ID NO: 379127 - DNA, 15 bp, Homo sapiens
cagcggcccagattg

SEQ ID NO: 379128 - DNA, 16 bp, Homo sapiens
cagcggcccctcccac

SEQ ID NO: 379129 - DNA, 17 bp, Homo sapiens
cagcggcccctcccaca

SEQ ID NO: 379130 - DNA, 18 bp, Homo sapiens
cagcggcccggcccacgc

SEQ ID NO: 379131 - DNA, 22 bp, Homo sapiens
cagcggcccggcccacgcagag

SEQ ID NO: 379132 - DNA, 18 bp, Homo sapiens
cagcgggagacctgtgct

SEQ ID NO: 379133 - DNA, 17 bp, Homo sapiens
cagcgggccctctgccg

SEQ ID NO: 379134 - DNA, 16 bp, Homo sapiens
cagcgggtaaaaagag

SEQ ID NO: 379135 - DNA, 23 bp, Homo sapiens
cagcggtggaaggagcctgcggc

SEQ ID NO: 379136 - DNA, 18 bp, Homo sapiens
cagcgtccggggtggtgg

SEQ ID NO: 379137 - DNA, 21 bp, Homo sapiens
cagcgtctgagcggccgcctg

SEQ ID NO: 379138 - DNA, 15 bp, Homo sapiens
cagcgtggggctaac

SEQ ID NO: 379139 - DNA, 14 bp, Homo sapiens
cagcgttcttcagg

SEQ ID NO: 379140 - DNA, 21 bp, Homo sapiens
cagcgtttagtttctagaggc

SEQ ID NO: 379141 - DNA, 22 bp, Homo sapiens
cagcgtttagtttctagaggcc

SEQ ID NO: 379142 - DNA, 15 bp, Homo sapiens
cagcgtttctccacc

SEQ ID NO: 379143 - DNA, 22 bp, Homo sapiens
cagcgtttgaggggctggcctt

SEQ ID NO: 379144 - DNA, 16 bp, Homo sapiens
cagctaaagaggtggg

SEQ ID NO: 379145 - DNA, 18 bp, Homo sapiens
cagctaaattttctgaaa

SEQ ID NO: 379146 - DNA, 20 bp, Homo sapiens
cagctaacatggaagtacta

SEQ ID NO: 379147 - DNA, 15 bp, Homo sapiens
cagctaagcctgatg

SEQ ID NO: 379148 - DNA, 21 bp, Homo sapiens
cagctaagctcaaatgtatat

SEQ ID NO: 379149 - DNA, 19 bp, Homo sapiens
cagctaaggggcaggaatc

SEQ ID NO: 379150 - DNA, 19 bp, Homo sapiens
cagctacaggggaggctga

SEQ ID NO: 379151 - DNA, 20 bp, Homo sapiens
cagctacaggggaggctgag

SEQ ID NO: 379152 - DNA, 22 bp, Homo sapiens
cagctacattcctcagctgcca

SEQ ID NO: 379153 - DNA, 14 bp, Homo sapiens
cagctacctgagac

SEQ ID NO: 379154 - DNA, 20 bp, Homo sapiens
cagctacctgagacgggcat

SEQ ID NO: 379155 - DNA, 20 bp, Homo sapiens
cagctactaacctggagaca

SEQ ID NO: 379156 - DNA, 15 bp, Homo sapiens
cagctactctgtcca

SEQ ID NO: 379157 - DNA, 19 bp, Homo sapiens
cagctactgatttttgtga

SEQ ID NO: 379158 - DNA, 15 bp, Homo sapiens
cagctacttgggaag

SEQ ID NO: 379159 - DNA, 18 bp, Homo sapiens
cagctacttgggagcctg

SEQ ID NO: 379160 - DNA, 15 bp, Homo sapiens
cagctacttgggagg

SEQ ID NO: 379161 - DNA, 16 bp, Homo sapiens
cagctagactggagtg

SEQ ID NO: 379162 - DNA, 23 bp, Homo sapiens
cagctagatttgtgtccacacta

SEQ ID NO: 379163 - DNA, 12 bp, Homo sapiens
cagctagcaagg

SEQ ID NO: 379164 - DNA, 16 bp, Homo sapiens
cagctaggactgagga

SEQ ID NO: 379165 - DNA, 15 bp, Homo sapiens
cagctaggctgagat

SEQ ID NO: 379166 - DNA, 18 bp, Homo sapiens
cagctaggttaataggag

SEQ ID NO: 379167 - DNA, 13 bp, Homo sapiens
cagctatgggagc

SEQ ID NO: 379168 - DNA, 22 bp, Homo sapiens
cagctatgggagccccagggtc

SEQ ID NO: 379169 - DNA, 23 bp, Homo sapiens
cagctatgggagccccagggtct

SEQ ID NO: 379170 - DNA, 15 bp, Homo sapiens
cagctattcacacac

SEQ ID NO: 379171 - DNA, 16 bp, Homo sapiens
cagctattcacacaca

SEQ ID NO: 379172 - DNA, 17 bp, Homo sapiens
cagctattcacacacac

SEQ ID NO: 379173 - DNA, 12 bp, Homo sapiens
cagctcaagtta

SEQ ID NO: 379174 - DNA, 16 bp, Homo sapiens
cagctcacctctgaag

SEQ ID NO: 379175 - DNA, 23 bp, Homo sapiens
cagctcagcagttcacttcctag

SEQ ID NO: 379176 - DNA, 21 bp, Homo sapiens
cagctcagccccggccactcc

SEQ ID NO: 379177 - DNA, 10 bp, Homo sapiens
cagctcagga

SEQ ID NO: 379178 - DNA, 15 bp, Homo sapiens
cagctcaggcgcagc

SEQ ID NO: 379179 - DNA, 23 bp, Homo sapiens
cagctcaggctgtttttgggtgc

SEQ ID NO: 379180 - DNA, 18 bp, Homo sapiens
cagctcaggggcagctca

SEQ ID NO: 379181 - DNA, 16 bp, Homo sapiens
cagctcatctccaagg

SEQ ID NO: 379182 - DNA, 16 bp, Homo sapiens
cagctcattcgctcca

SEQ ID NO: 379183 - DNA, 15 bp, Homo sapiens
cagctccacagggtg

SEQ ID NO: 379184 - DNA, 15 bp, Homo sapiens
cagctccactcaggg

SEQ ID NO: 379185 - DNA, 16 bp, Homo sapiens
cagctccactcagggc

SEQ ID NO: 379186 - DNA, 13 bp, Homo sapiens
cagctccactctg

SEQ ID NO: 379187 - DNA, 14 bp, Homo sapiens
cagctccactctga

SEQ ID NO: 379188 - DNA, 15 bp, Homo sapiens
cagctccactggcct

SEQ ID NO: 379189 - DNA, 17 bp, Homo sapiens
cagctccactggcctgc

SEQ ID NO: 379190 - DNA, 14 bp, Homo sapiens
cagctccaggggcc

SEQ ID NO: 379191 - DNA, 16 bp, Homo sapiens
cagctccaggggccct

SEQ ID NO: 379192 - DNA, 21 bp, Homo sapiens
cagctccaggggcccttggga

SEQ ID NO: 379193 - DNA, 13 bp, Homo sapiens
cagctccccagga

SEQ ID NO: 379194 - DNA, 14 bp, Homo sapiens
cagctccccaggag

SEQ ID NO: 379195 - DNA, 15 bp, Homo sapiens
cagctcccccttgcc

SEQ ID NO: 379196 - DNA, 19 bp, Homo sapiens
cagctcccccttgcccgcc

SEQ ID NO: 379197 - DNA, 20 bp, Homo sapiens
cagctcccttcccctgcctg

SEQ ID NO: 379198 - DNA, 19 bp, Homo sapiens
cagctccgcctggcaccca

SEQ ID NO: 379199 - DNA, 21 bp, Homo sapiens
cagctcctcctcttggagctg

SEQ ID NO: 379200 - DNA, 12 bp, Homo sapiens
cagctcctctta

SEQ ID NO: 379201 - DNA, 12 bp, Homo sapiens
cagctccttttc

SEQ ID NO: 379202 - DNA, 20 bp, Homo sapiens
cagctcgtttttcagcaccc

SEQ ID NO: 379203 - DNA, 21 bp, Homo sapiens
cagctctagacaaccctgcaa

SEQ ID NO: 379204 - DNA, 14 bp, Homo sapiens
cagctctcactggc

SEQ ID NO: 379205 - DNA, 18 bp, Homo sapiens
cagctctcagttgcagcc

SEQ ID NO: 379206 - DNA, 14 bp, Homo sapiens
cagctctccagtca

SEQ ID NO: 379207 - DNA, 16 bp, Homo sapiens
cagctctgaccctgat

SEQ ID NO: 379208 - DNA, 13 bp, Homo sapiens
cagctctgagaca

SEQ ID NO: 379209 - DNA, 19 bp, Homo sapiens
cagctctgcagcaatattc

SEQ ID NO: 379210 - DNA, 14 bp, Homo sapiens
cagctctgcccccg

SEQ ID NO: 379211 - DNA, 22 bp, Homo sapiens
cagctctgcccccgcgggttct

SEQ ID NO: 379212 - DNA, 14 bp, Homo sapiens
cagctctggccaca

SEQ ID NO: 379213 - DNA, 15 bp, Homo sapiens
cagctctggccacaa

SEQ ID NO: 379214 - DNA, 19 bp, Homo sapiens
agtcagctttgccttccac

SEQ ID NO: 379215 - DNA, 22 bp, Homo sapiens
agtcagctttgccttccacgct

SEQ ID NO: 379216 - DNA, 17 bp, Homo sapiens
agtctgaaggagaggag

SEQ ID NO: 379217 - DNA, 15 bp, Homo sapiens
agtctgacaggaaga

SEQ ID NO: 379218 - DNA, 19 bp, Homo sapiens
cagctctggctcagggccc

SEQ ID NO: 379219 - DNA, 14 bp, Homo sapiens
cagctctgggagag

SEQ ID NO: 379220 - DNA, 15 bp, Homo sapiens
cagctctgggagagg

SEQ ID NO: 379221 - DNA, 17 bp, Homo sapiens
cagctctgtggcctgtg

SEQ ID NO: 379222 - DNA, 18 bp, Homo sapiens
cagctctgtggcctgtgt

SEQ ID NO: 379223 - DNA, 23 bp, Homo sapiens
cagctctgtggcctgtgtccagc

SEQ ID NO: 379224 - DNA, 12 bp, Homo sapiens
cagctcttctgg

SEQ ID NO: 379225 - DNA, 22 bp, Homo sapiens
cagctcttctgggcagagcctg

SEQ ID NO: 379226 - DNA, 18 bp, Homo sapiens
cagctctttcctccttcc

SEQ ID NO: 379227 - DNA, 22 bp, Homo sapiens
cagctctttgaaatagtctgtg

SEQ ID NO: 379228 - DNA, 22 bp, Homo sapiens
cagctgaacagtgttggctttc

SEQ ID NO: 379229 - DNA, 19 bp, Homo sapiens
cagctgacacataatttga

SEQ ID NO: 379230 - DNA, 21 bp, Homo sapiens
cagctgacacataatttgaat

SEQ ID NO: 379231 - DNA, 17 bp, Homo sapiens
cagctgacctctgttgt

SEQ ID NO: 379232 - DNA, 18 bp, Homo sapiens
cagctgacctctgttgtc

SEQ ID NO: 379233 - DNA, 15 bp, Homo sapiens
cagctgagctggcct

SEQ ID NO: 379234 - DNA, 14 bp, Homo sapiens
cagctgagcttgag

SEQ ID NO: 379235 - DNA, 17 bp, Homo sapiens
cagctgagcttgagctc

SEQ ID NO: 379236 - DNA, 21 bp, Homo sapiens
cagctgagcttgagctcccct

SEQ ID NO: 379237 - DNA, 16 bp, Homo sapiens
cagctgaggccccagg

SEQ ID NO: 379238 - DNA, 14 bp, Homo sapiens
cagctgcacattcc

SEQ ID NO: 379239 - DNA, 15 bp, Homo sapiens
cagctgcagagacag

SEQ ID NO: 379240 - DNA, 13 bp, Homo sapiens
cagctgcagctgg

SEQ ID NO: 379241 - DNA, 17 bp, Homo sapiens
cagctgcagctgggccc

SEQ ID NO: 379242 - DNA, 16 bp, Homo sapiens
cagctgcagctgggct

SEQ ID NO: 379243 - DNA, 13 bp, Homo sapiens
cagctgcaggtgc

SEQ ID NO: 379244 - DNA, 17 bp, Homo sapiens
cagctgcaggtgcccat

SEQ ID NO: 379245 - DNA, 12 bp, Homo sapiens
cagctgcagttg

SEQ ID NO: 379246 - DNA, 22 bp, Homo sapiens
cagctgccaagcactcgagacc

SEQ ID NO: 379247 - DNA, 23 bp, Homo sapiens
cagctgccaagcactcgagacca

SEQ ID NO: 379248 - DNA, 16 bp, Homo sapiens
cagctgcccacaagcc

SEQ ID NO: 379249 - DNA, 14 bp, Homo sapiens
cagctgcctcactt

SEQ ID NO: 379250 - DNA, 14 bp, Homo sapiens
cagctgcgggtctg

SEQ ID NO: 379251 - DNA, 18 bp, Homo sapiens
cagctgctcccctccctc

SEQ ID NO: 379252 - DNA, 11 bp, Homo sapiens
cagctgctcct

SEQ ID NO: 379253 - DNA, 15 bp, Homo sapiens
cagctgctctgccca

SEQ ID NO: 379254 - DNA, 17 bp, Homo sapiens
cagctgctctgcccctt

SEQ ID NO: 379255 - DNA, 20 bp, Homo sapiens
cagctgctctgccccttggg

SEQ ID NO: 379256 - DNA, 16 bp, Homo sapiens
cagctgctcttagtgc

SEQ ID NO: 379257 - DNA, 21 bp, Homo sapiens
cagctgctcttgcatctgggc

SEQ ID NO: 379258 - DNA, 15 bp, Homo sapiens
cagctgctggagaat

SEQ ID NO: 379259 - DNA, 14 bp, Homo sapiens
cagctgctggatgt

SEQ ID NO: 379260 - DNA, 14 bp, Homo sapiens
cagctgctgtcagg

SEQ ID NO: 379261 - DNA, 15 bp, Homo sapiens
cagctgctttgttac

SEQ ID NO: 379262 - DNA, 16 bp, Homo sapiens
cagctgctttgttacc

SEQ ID NO: 379263 - DNA, 23 bp, Homo sapiens
cagctggagtggggtttgctttt

SEQ ID NO: 379264 - DNA, 13 bp, Homo sapiens
cagctggcagcgc

SEQ ID NO: 379265 - DNA, 14 bp, Homo sapiens
cagctggcagcgcc

SEQ ID NO: 379266 - DNA, 15 bp, Homo sapiens
cagctggcagcgcct

SEQ ID NO: 379267 - DNA, 22 bp, Homo sapiens
cagctggccgggttggaggcct

SEQ ID NO: 379268 - DNA, 18 bp, Homo sapiens
cagctggctctccacctt

SEQ ID NO: 379269 - DNA, 14 bp, Homo sapiens
cagctggctgggtc

SEQ ID NO: 379270 - DNA, 22 bp, Homo sapiens
cagctggctgggtcgcccctcc

SEQ ID NO: 379271 - DNA, 18 bp, Homo sapiens
cagctgggacccctccca

SEQ ID NO: 379272 - DNA, 11 bp, Homo sapiens
cagctgggcaa

SEQ ID NO: 379273 - DNA, 17 bp, Homo sapiens
cagctgggcaaagccac

SEQ ID NO: 379274 - DNA, 15 bp, Homo sapiens
cagctgggccccatg

SEQ ID NO: 379275 - DNA, 17 bp, Homo sapiens
cagctgggccccatgct

SEQ ID NO: 379276 - DNA, 18 bp, Homo sapiens
cagctgggccccatgctc

SEQ ID NO: 379277 - DNA, 20 bp, Homo sapiens
cagctgggccccatgctctg

SEQ ID NO: 379278 - DNA, 14 bp, Homo sapiens
cagctgggctctgc

SEQ ID NO: 379279 - DNA, 18 bp, Homo sapiens
cagctgggctctgccacc

SEQ ID NO: 379280 - DNA, 17 bp, Homo sapiens
cagctgggctgttggct

SEQ ID NO: 379281 - DNA, 18 bp, Homo sapiens
cagctggggagcagctga

SEQ ID NO: 379282 - DNA, 18 bp, Homo sapiens
cagctggggcccctcggc

SEQ ID NO: 379283 - DNA, 23 bp, Homo sapiens
cagctggggcccctcggctaccc

SEQ ID NO: 379284 - DNA, 19 bp, Homo sapiens
cagctggggggctgtcctg

SEQ ID NO: 379285 - DNA, 20 bp, Homo sapiens
cagctggggggctgtcctga

SEQ ID NO: 379286 - DNA, 14 bp, Homo sapiens
cagctggtggatgg

SEQ ID NO: 379287 - DNA, 22 bp, Homo sapiens
cagctggtgtcactctgcctct

SEQ ID NO: 379288 - DNA, 20 bp, Homo sapiens
cagctgtaacacagctgaga

SEQ ID NO: 379289 - DNA, 20 bp, Homo sapiens
cagctgtaagaagagactgg

SEQ ID NO: 379290 - DNA, 21 bp, Homo sapiens
cagctgtagaaaggttgattc

SEQ ID NO: 379291 - DNA, 12 bp, Homo sapiens
cagctgtagcca

SEQ ID NO: 379292 - DNA, 17 bp, Homo sapiens
cagctgtagccatggct

SEQ ID NO: 379293 - DNA, 19 bp, Homo sapiens
cagctgtagccatggctca

SEQ ID NO: 379294 - DNA, 22 bp, Homo sapiens
cagctgtagccatggctcaggc

SEQ ID NO: 379295 - DNA, 21 bp, Homo sapiens
cagctgtgactgagggcctgg

SEQ ID NO: 379296 - DNA, 19 bp, Homo sapiens
cagctgtttcatcaccaga

SEQ ID NO: 379297 - DNA, 20 bp, Homo sapiens
cagctgttttagttaaattt

SEQ ID NO: 379298 - DNA, 21 bp, Homo sapiens
cagcttatgggatccttgtct

SEQ ID NO: 379299 - DNA, 14 bp, Homo sapiens
cagcttcaccagag

SEQ ID NO: 379300 - DNA, 16 bp, Homo sapiens
cagcttcaccctgtca

SEQ ID NO: 379301 - DNA, 13 bp, Homo sapiens
cagcttcatttgt

SEQ ID NO: 379302 - DNA, 17 bp, Homo sapiens
cagcttcctgagggcta

SEQ ID NO: 379303 - DNA, 15 bp, Homo sapiens
cagcttcctggtgta

SEQ ID NO: 379304 - DNA, 21 bp, Homo sapiens
cagcttcggagggcccctgcg

SEQ ID NO: 379305 - DNA, 23 bp, Homo sapiens
cagcttcggagggcccctgcgtg

SEQ ID NO: 379306 - DNA, 14 bp, Homo sapiens
cagcttcgtgctgg

SEQ ID NO: 379307 - DNA, 21 bp, Homo sapiens
cagcttctaattttgtgctct

SEQ ID NO: 379308 - DNA, 21 bp, Homo sapiens
cagcttctggtactctcctag

SEQ ID NO: 379309 - DNA, 16 bp, Homo sapiens
cagcttcttgcttgta

SEQ ID NO: 379310 - DNA, 19 bp, Homo sapiens
cagcttcttgcttgtaaaa

SEQ ID NO: 379311 - DNA, 23 bp, Homo sapiens
cagcttctttactactgcaagtt

SEQ ID NO: 379312 - DNA, 22 bp, Homo sapiens
cagcttgcacacccatcgtctt

SEQ ID NO: 379313 - DNA, 22 bp, Homo sapiens
cagcttgcgttagaatgaggag

SEQ ID NO: 379314 - DNA, 13 bp, Homo sapiens
cagcttgctgcac

SEQ ID NO: 379315 - DNA, 19 bp, Homo sapiens
cagcttgctgccctaggct

SEQ ID NO: 379316 - DNA, 14 bp, Homo sapiens
cagcttgggagagc

SEQ ID NO: 379317 - DNA, 22 bp, Homo sapiens
cagcttgggcccagctgggctc

SEQ ID NO: 379318 - DNA, 23 bp, Homo sapiens
cagcttgggcccagctgggctct

SEQ ID NO: 379319 - DNA, 13 bp, Homo sapiens
cagcttgtttcta

SEQ ID NO: 379320 - DNA, 14 bp, Homo sapiens
cagcttgtttctat

SEQ ID NO: 379321 - DNA, 15 bp, Homo sapiens
cagcttgtttctata

SEQ ID NO: 379322 - DNA, 17 bp, Homo sapiens
cagctttcaagtgcctt

SEQ ID NO: 379323 - DNA, 13 bp, Homo sapiens
cagctttcagagc

SEQ ID NO: 379324 - DNA, 16 bp, Homo sapiens
cagctttcatgattag

SEQ ID NO: 379325 - DNA, 13 bp, Homo sapiens
cagctttcccagg

SEQ ID NO: 379326 - DNA, 21 bp, Homo sapiens
cagctttccctggctcaggga

SEQ ID NO: 379327 - DNA, 14 bp, Homo sapiens
cagctttcctgggt

SEQ ID NO: 379328 - DNA, 18 bp, Homo sapiens
cagctttgccttccacgc

SEQ ID NO: 379329 - DNA, 13 bp, Homo sapiens
cagcttttaataa

SEQ ID NO: 379330 - DNA, 14 bp, Homo sapiens
cagcttttaataaa

SEQ ID NO: 379331 - DNA, 21 bp, Homo sapiens
cagcttttaataaaattgaca

SEQ ID NO: 379332 - DNA, 19 bp, Homo sapiens
cagcttttagtacccacct

SEQ ID NO: 379333 - DNA, 16 bp, Homo sapiens
cagcttttcctccctt

SEQ ID NO: 379334 - DNA, 19 bp, Homo sapiens
cagcttttcttgccagctc

SEQ ID NO: 379335 - DNA, 21 bp, Homo sapiens
cagcttttcttgccagctcag

SEQ ID NO: 379336 - DNA, 18 bp, Homo sapiens
cagcttttgttgtttata

SEQ ID NO: 379337 - DNA, 18 bp, Homo sapiens
caggaaaaaaacttttat

SEQ ID NO: 379338 - DNA, 22 bp, Homo sapiens
caggaaaacaaatcactgtatt

SEQ ID NO: 379339 - DNA, 15 bp, Homo sapiens
caggaaaactgtttt

SEQ ID NO: 379340 - DNA, 17 bp, Homo sapiens
caggaaagatcccaagt

SEQ ID NO: 379341 - DNA, 21 bp, Homo sapiens
caggaaagggaaggccccaca

SEQ ID NO: 379342 - DNA, 23 bp, Homo sapiens
caggaaatatatatgtgtgtgta

SEQ ID NO: 379343 - DNA, 16 bp, Homo sapiens
caggaaatatgtcccc

SEQ ID NO: 379344 - DNA, 15 bp, Homo sapiens
caggaacacccagcc

SEQ ID NO: 379345 - DNA, 19 bp, Homo sapiens
caggaacacccagccccag

SEQ ID NO: 379346 - DNA, 16 bp, Homo sapiens
agtgcaatttcttctg

SEQ ID NO: 379347 - DNA, 20 bp, Homo sapiens
agtgcaatttcttctgtagc

SEQ ID NO: 379348 - DNA, 11 bp, Homo sapiens
agtgcacacct

SEQ ID NO: 379349 - DNA, 21 bp, Homo sapiens
agtgcacctctcatcagccca

SEQ ID NO: 379350 - DNA, 22 bp, Homo sapiens
agtgcacctgtggcctctcagt

SEQ ID NO: 379351 - DNA, 17 bp, Homo sapiens
agtgcagaacacctggc

SEQ ID NO: 379352 - DNA, 13 bp, Homo sapiens
agtgcagacaggc

SEQ ID NO: 379353 - DNA, 16 bp, Homo sapiens
agtgcagacaggccat

SEQ ID NO: 379354 - DNA, 21 bp, Homo sapiens
agtgcagaccccttggccagc

SEQ ID NO: 379355 - DNA, 21 bp, Homo sapiens
agtgcagcccgtgtggcccct

SEQ ID NO: 379356 - DNA, 19 bp, Homo sapiens
caggaactagactgcctgg

SEQ ID NO: 379357 - DNA, 19 bp, Homo sapiens
caggaactgaaaaccagtc

SEQ ID NO: 379358 - DNA, 23 bp, Homo sapiens
caggaagaatggtgtgtttccct

SEQ ID NO: 379359 - DNA, 20 bp, Homo sapiens
caggaagaccaaggcctcgg

SEQ ID NO: 379360 - DNA, 15 bp, Homo sapiens
caggaagactggaga

SEQ ID NO: 379361 - DNA, 16 bp, Homo sapiens
caggaagactggagac

SEQ ID NO: 379362 - DNA, 18 bp, Homo sapiens
caggaagatcttaaattt

SEQ ID NO: 379363 - DNA, 22 bp, Homo sapiens
caggaagcaaggccagccctgg

SEQ ID NO: 379364 - DNA, 13 bp, Homo sapiens
caggaagcacagg

SEQ ID NO: 379365 - DNA, 16 bp, Homo sapiens
caggaagcagggagag

SEQ ID NO: 379366 - DNA, 20 bp, Homo sapiens
caggaagcagggagagttgg

SEQ ID NO: 379367 - DNA, 14 bp, Homo sapiens
caggaagccccgct

SEQ ID NO: 379368 - DNA, 23 bp, Homo sapiens
caggaagccccgctcaggtagcc

SEQ ID NO: 379369 - DNA, 21 bp, Homo sapiens
caggaagccgcctagtgcaga

SEQ ID NO: 379370 - DNA, 18 bp, Homo sapiens
caggaagcctcctgctga

SEQ ID NO: 379371 - DNA, 13 bp, Homo sapiens
caggaaggagagc

SEQ ID NO: 379372 - DNA, 12 bp, Homo sapiens
caggaaggcagc

SEQ ID NO: 379373 - DNA, 16 bp, Homo sapiens
caggaaggcagctgct

SEQ ID NO: 379374 - DNA, 19 bp, Homo sapiens
caggaaggcagctgctctt

SEQ ID NO: 379375 - DNA, 12 bp, Homo sapiens
caggaaggcctg

SEQ ID NO: 379376 - DNA, 23 bp, Homo sapiens
caggaagggaaagcgggcagccc

SEQ ID NO: 379377 - DNA, 18 bp, Homo sapiens
caggaaggtatcacacac

SEQ ID NO: 379378 - DNA, 19 bp, Homo sapiens
caggaaggtatcacacact

SEQ ID NO: 379379 - DNA, 20 bp, Homo sapiens
caggaagtactggagaaaat

SEQ ID NO: 379380 - DNA, 16 bp, Homo sapiens
caggaagtcaggagcc

SEQ ID NO: 379381 - DNA, 17 bp, Homo sapiens
caggaagtcaggagcca

SEQ ID NO: 379382 - DNA, 22 bp, Homo sapiens
caggaagtcaggagccagcagg

SEQ ID NO: 379383 - DNA, 23 bp, Homo sapiens
caggaagtcaggagccagcaggg

SEQ ID NO: 379384 - DNA, 20 bp, Homo sapiens
caggaagtccctgagaagcc

SEQ ID NO: 379385 - DNA, 18 bp, Homo sapiens
caggaagtgggagaagtg

SEQ ID NO: 379386 - DNA, 20 bp, Homo sapiens
caggaagtgggagaagtggc

SEQ ID NO: 379387 - DNA, 23 bp, Homo sapiens
caggaagttgctgagaaatgggg

SEQ ID NO: 379388 - DNA, 17 bp, Homo sapiens
caggaataggcatttgc

SEQ ID NO: 379389 - DNA, 17 bp, Homo sapiens
caggaatggaaagcgga

SEQ ID NO: 379390 - DNA, 13 bp, Homo sapiens
caggaatgtttca

SEQ ID NO: 379391 - DNA, 20 bp, Homo sapiens
caggacacatcccggcctct

SEQ ID NO: 379392 - DNA, 22 bp, Homo sapiens
caggacacatcccggcctcttc

SEQ ID NO: 379393 - DNA, 13 bp, Homo sapiens
caggacagctgca

SEQ ID NO: 379394 - DNA, 20 bp, Homo sapiens
caggaccaagcttaaggaga

SEQ ID NO: 379395 - DNA, 12 bp, Homo sapiens
caggaccaggag

SEQ ID NO: 379396 - DNA, 17 bp, Homo sapiens
caggaccaggagccagg

SEQ ID NO: 379397 - DNA, 12 bp, Homo sapiens
caggacccaggc

SEQ ID NO: 379398 - DNA, 14 bp, Homo sapiens
caggacccaggccc

SEQ ID NO: 379399 - DNA, 15 bp, Homo sapiens
caggacccaggccct

SEQ ID NO: 379400 - DNA, 21 bp, Homo sapiens
caggacccaggccctccatgg

SEQ ID NO: 379401 - DNA, 24 bp, Homo sapiens
caggacccaggccctccatgggct

SEQ ID NO: 379402 - DNA, 12 bp, Homo sapiens
caggaccccaga

SEQ ID NO: 379403 - DNA, 14 bp, Homo sapiens
caggaccccagagg

SEQ ID NO: 379404 - DNA, 19 bp, Homo sapiens
caggaccccagagggacca

SEQ ID NO: 379405 - DNA, 13 bp, Homo sapiens
caggacccctggg

SEQ ID NO: 379406 - DNA, 15 bp, Homo sapiens
caggacccttctact

SEQ ID NO: 379407 - DNA, 22 bp, Homo sapiens
caggacccttctactttttcct

SEQ ID NO: 379408 - DNA, 21 bp, Homo sapiens
caggacctcagagtccaggcc

SEQ ID NO: 379409 - DNA, 22 bp, Homo sapiens
caggacctcagagtccaggccc

SEQ ID NO: 379410 - DNA, 20 bp, Homo sapiens
caggaccttttgaagtagtt

SEQ ID NO: 379411 - DNA, 17 bp, Homo sapiens
caggacgcagggagacc

SEQ ID NO: 379412 - DNA, 16 bp, Homo sapiens
caggacgcttctgaat

SEQ ID NO: 379413 - DNA, 16 bp, Homo sapiens
caggactccctcctca

SEQ ID NO: 379414 - DNA, 22 bp, Homo sapiens
caggactccctcctcacctctg

SEQ ID NO: 379415 - DNA, 23 bp, Homo sapiens
caggactccctcctcacctctgg

SEQ ID NO: 379416 - DNA, 13 bp, Homo sapiens
caggactctcttt

SEQ ID NO: 379417 - DNA, 16 bp, Homo sapiens
caggactctctttctt

SEQ ID NO: 379418 - DNA, 20 bp, Homo sapiens
caggactctgcccagaccac

SEQ ID NO: 379419 - DNA, 20 bp, Homo sapiens
caggactctgccccttctgt

SEQ ID NO: 379420 - DNA, 14 bp, Homo sapiens
caggactctgcctt

SEQ ID NO: 379421 - DNA, 14 bp, Homo sapiens
caggactgtgactc

SEQ ID NO: 379422 - DNA, 21 bp, Homo sapiens
caggacttaacggctccagga

SEQ ID NO: 379423 - DNA, 19 bp, Homo sapiens
caggacttggggtcaggaa

SEQ ID NO: 379424 - DNA, 19 bp, Homo sapiens
caggagaaggcctgccccc

SEQ ID NO: 379425 - DNA, 16 bp, Homo sapiens
caggagaatcgcttga

SEQ ID NO: 379426 - DNA, 22 bp, Homo sapiens
caggagaatcgcttgaacctgg

SEQ ID NO: 379427 - DNA, 15 bp, Homo sapiens
caggagaccctgtct

SEQ ID NO: 379428 - DNA, 12 bp, Homo sapiens
caggagagagag

SEQ ID NO: 379429 - DNA, 16 bp, Homo sapiens
caggagagagagagag

SEQ ID NO: 379430 - DNA, 17 bp, Homo sapiens
caggagagagagagaga

SEQ ID NO: 379431 - DNA, 15 bp, Homo sapiens
caggagagcatcacc

SEQ ID NO: 379432 - DNA, 20 bp, Homo sapiens
caggagagcatcaccaccac

SEQ ID NO: 379433 - DNA, 20 bp, Homo sapiens
caggagaggagcgggacctg

SEQ ID NO: 379434 - DNA, 14 bp, Homo sapiens
caggagcaatggga

SEQ ID NO: 379435 - DNA, 18 bp, Homo sapiens
caggagcaatgggactgg

SEQ ID NO: 379436 - DNA, 15 bp, Homo sapiens
caggagcagctgtgc

SEQ ID NO: 379437 - DNA, 16 bp, Homo sapiens
caggagcagctgtgct

SEQ ID NO: 379438 - DNA, 21 bp, Homo sapiens
caggagcagctgtgctgcacc

SEQ ID NO: 379439 - DNA, 15 bp, Homo sapiens
caggagcaggaccta

SEQ ID NO: 379440 - DNA, 12 bp, Homo sapiens
caggagccagca

SEQ ID NO: 379441 - DNA, 23 bp, Homo sapiens
caggagccagcagggcgggccag

SEQ ID NO: 379442 - DNA, 12 bp, Homo sapiens
caggagccaggt

SEQ ID NO: 379443 - DNA, 16 bp, Homo sapiens
caggagccccagccag

SEQ ID NO: 379444 - DNA, 18 bp, Homo sapiens
caggagccccagccagcc

SEQ ID NO: 379445 - DNA, 20 bp, Homo sapiens
caggagccccagccagccct

SEQ ID NO: 379446 - DNA, 21 bp, Homo sapiens
caggagccccagccagccctt

SEQ ID NO: 379447 - DNA, 15 bp, Homo sapiens
caggagcgcaagata

SEQ ID NO: 379448 - DNA, 23 bp, Homo sapiens
caggagctcttcaggcctccctc

SEQ ID NO: 379449 - DNA, 12 bp, Homo sapiens
caggagctgagt

SEQ ID NO: 379450 - DNA, 16 bp, Homo sapiens
caggagcttttttaca

SEQ ID NO: 379451 - DNA, 15 bp, Homo sapiens
caggaggaactggtc

SEQ ID NO: 379452 - DNA, 19 bp, Homo sapiens
caggaggactgccccgtgc

SEQ ID NO: 379453 - DNA, 23 bp, Homo sapiens
caggaggactgccccgtgcagac

SEQ ID NO: 379454 - DNA, 20 bp, Homo sapiens
caggaggaggaaaggtagcc

SEQ ID NO: 379455 - DNA, 16 bp, Homo sapiens
caggaggccattccag

SEQ ID NO: 379456 - DNA, 13 bp, Homo sapiens
caggaggcctggg

SEQ ID NO: 379457 - DNA, 22 bp, Homo sapiens
caggaggcctgggagggcaagg

SEQ ID NO: 379458 - DNA, 23 bp, Homo sapiens
caggaggcctgggagggcaaggg

SEQ ID NO: 379459 - DNA, 13 bp, Homo sapiens
caggaggcggcag

SEQ ID NO: 379460 - DNA, 19 bp, Homo sapiens
caggaggcggcagctcttc

SEQ ID NO: 379461 - DNA, 13 bp, Homo sapiens
caggaggctggag

SEQ ID NO: 379462 - DNA, 22 bp, Homo sapiens
caggaggctttaagctccagct

SEQ ID NO: 379463 - DNA, 12 bp, Homo sapiens
caggagggaggt

SEQ ID NO: 379464 - DNA, 23 bp, Homo sapiens
caggagggaggtttgtgagagcg

SEQ ID NO: 379465 - DNA, 22 bp, Homo sapiens
caggagggattggccgcttggc

SEQ ID NO: 379466 - DNA, 23 bp, Homo sapiens
caggagggcatcagctttccctg

SEQ ID NO: 379467 - DNA, 15 bp, Homo sapiens
caggaggggcctctg

SEQ ID NO: 379468 - DNA, 21 bp, Homo sapiens
caggaggtgtgatagagcctt

SEQ ID NO: 379469 - DNA, 17 bp, Homo sapiens
caggagtctctgccacc

SEQ ID NO: 379470 - DNA, 23 bp, Homo sapiens
caggagtctctgccacccactca

SEQ ID NO: 379471 - DNA, 16 bp, Homo sapiens
caggagtctgtgctct

SEQ ID NO: 379472 - DNA, 15 bp, Homo sapiens
caggagtctttgtaa

SEQ ID NO: 379473 - DNA, 18 bp, Homo sapiens
caggagtgggctctgagc

SEQ ID NO: 379474 - DNA, 17 bp, Homo sapiens
caggagtgggtgggaca

SEQ ID NO: 379475 - DNA, 16 bp, Homo sapiens
agtggcttttgcccca

SEQ ID NO: 379476 - DNA, 16 bp, Homo sapiens
agtgggaagagctggg

SEQ ID NO: 379477 - DNA, 17 bp, Homo sapiens
agtgggaagagctgggt

SEQ ID NO: 379478 - DNA, 20 bp, Homo sapiens
agtgggaaggacttggcgcg

SEQ ID NO: 379479 - DNA, 13 bp, Homo sapiens
agtgggagaggaa

SEQ ID NO: 379480 - DNA, 14 bp, Homo sapiens
agtgggagaggaag

SEQ ID NO: 379481 - DNA, 15 bp, Homo sapiens
agtgggagaggaagc

SEQ ID NO: 379482 - DNA, 12 bp, Homo sapiens
agtgggagccca

SEQ ID NO: 379483 - DNA, 15 bp, Homo sapiens
agtgggagcccagca

SEQ ID NO: 379484 - DNA, 13 bp, Homo sapiens
agtgggagccctg

SEQ ID NO: 379485 - DNA, 14 bp, Homo sapiens
agtgggagtgggag

SEQ ID NO: 379486 - DNA, 17 bp, Homo sapiens
agtgggagtgggagagg

SEQ ID NO: 379487 - DNA, 16 bp, Homo sapiens
agtgggcacctcagaa

SEQ ID NO: 379488 - DNA, 14 bp, Homo sapiens
agtgggcaggtggc

SEQ ID NO: 379489 - DNA, 17 bp, Homo sapiens
agtgggcaggtggccac

SEQ ID NO: 379490 - DNA, 15 bp, Homo sapiens
agtgggccggcccca

SEQ ID NO: 379491 - DNA, 17 bp, Homo sapiens
agtgggccggccccagg

SEQ ID NO: 379492 - DNA, 20 bp, Homo sapiens
agtgggccggccccaggctc

SEQ ID NO: 379493 - DNA, 22 bp, Homo sapiens
agtgggccttcattaaatgttt

SEQ ID NO: 379494 - DNA, 16 bp, Homo sapiens
caggatgaacccagga

SEQ ID NO: 379495 - DNA, 17 bp, Homo sapiens
caggatgattgtacaga

SEQ ID NO: 379496 - DNA, 18 bp, Homo sapiens
caggatgcacggtttctg

SEQ ID NO: 379497 - DNA, 23 bp, Homo sapiens
caggattccagttgcgtgtctgt

SEQ ID NO: 379498 - DNA, 17 bp, Homo sapiens
caggattgtacgtggga

SEQ ID NO: 379499 - DNA, 20 bp, Homo sapiens
caggatttaaaaactggaac

SEQ ID NO: 379500 - DNA, 17 bp, Homo sapiens
caggatttggttgttta

SEQ ID NO: 379501 - DNA, 21 bp, Homo sapiens
caggatttggtttttctcttt

SEQ ID NO: 379502 - DNA, 18 bp, Homo sapiens
caggcaaaaaagggacag

SEQ ID NO: 379503 - DNA, 15 bp, Homo sapiens
caggcaaagaggtgc

SEQ ID NO: 379504 - DNA, 13 bp, Homo sapiens
caggcaagcccct

SEQ ID NO: 379505 - DNA, 18 bp, Homo sapiens
caggcaaggttggcgact

SEQ ID NO: 379506 - DNA, 15 bp, Homo sapiens
caggcaatggcctaa

SEQ ID NO: 379507 - DNA, 15 bp, Homo sapiens
caggcacatgtgttc

SEQ ID NO: 379508 - DNA, 13 bp, Homo sapiens
caggcacctggcc

SEQ ID NO: 379509 - DNA, 18 bp, Homo sapiens
caggcacctggcctgctg

SEQ ID NO: 379510 - DNA, 19 bp, Homo sapiens
caggcacctggcctgctgg

SEQ ID NO: 379511 - DNA, 20 bp, Homo sapiens
caggcacctggcctgctggg

SEQ ID NO: 379512 - DNA, 22 bp, Homo sapiens
caggcacctggcctgctgggaa

SEQ ID NO: 379513 - DNA, 19 bp, Homo sapiens
caggcactgcgccacctgc

SEQ ID NO: 379514 - DNA, 22 bp, Homo sapiens
caggcactgcgccacctgcttc

SEQ ID NO: 379515 - DNA, 16 bp, Homo sapiens
caggcactgctgccca

SEQ ID NO: 379516 - DNA, 17 bp, Homo sapiens
caggcactggtggcatc

SEQ ID NO: 379517 - DNA, 18 bp, Homo sapiens
caggcagaaaactggcag

SEQ ID NO: 379518 - DNA, 15 bp, Homo sapiens
caggcagacacatgc

SEQ ID NO: 379519 - DNA, 17 bp, Homo sapiens
caggcagagacaataaa

SEQ ID NO: 379520 - DNA, 19 bp, Homo sapiens
caggcagagctcagcacag

SEQ ID NO: 379521 - DNA, 15 bp, Homo sapiens
caggcagaggagagt

SEQ ID NO: 379522 - DNA, 16 bp, Homo sapiens
caggcagatctgtgcc

SEQ ID NO: 379523 - DNA, 18 bp, Homo sapiens
caggcagatctgtgcccc

SEQ ID NO: 379524 - DNA, 18 bp, Homo sapiens
caggcagcgatggtctca

SEQ ID NO: 379525 - DNA, 14 bp, Homo sapiens
caggcaggcacctg

SEQ ID NO: 379526 - DNA, 16 bp, Homo sapiens
caggcaggcacctggg

SEQ ID NO: 379527 - DNA, 21 bp, Homo sapiens
caggcaggccaaggccttctc

SEQ ID NO: 379528 - DNA, 19 bp, Homo sapiens
caggcaggctgtgcgctga

SEQ ID NO: 379529 - DNA, 18 bp, Homo sapiens
caggcagggagtgtctgc

SEQ ID NO: 379530 - DNA, 20 bp, Homo sapiens
caggcagggagtgtctgcag

SEQ ID NO: 379531 - DNA, 21 bp, Homo sapiens
caggcagtctttgctcagtgg

SEQ ID NO: 379532 - DNA, 17 bp, Homo sapiens
caggcagttggccagag

SEQ ID NO: 379533 - DNA, 15 bp, Homo sapiens
caggcataggcctgg

SEQ ID NO: 379534 - DNA, 22 bp, Homo sapiens
caggcatctgtaagaagtagag

SEQ ID NO: 379535 - DNA, 14 bp, Homo sapiens
caggcatgaccctg

SEQ ID NO: 379536 - DNA, 19 bp, Homo sapiens
caggcatgaccctggagcc

SEQ ID NO: 379537 - DNA, 20 bp, Homo sapiens
caggcatgaccctggagccc

SEQ ID NO: 379538 - DNA, 23 bp, Homo sapiens
caggcatgagccaccacacctgg

SEQ ID NO: 379539 - DNA, 20 bp, Homo sapiens
caggcatgcgaatgagctgg

SEQ ID NO: 379540 - DNA, 21 bp, Homo sapiens
caggcatgcgaatgagctggg

SEQ ID NO: 379541 - DNA, 18 bp, Homo sapiens
caggcatggcccagcctg

SEQ ID NO: 379542 - DNA, 20 bp, Homo sapiens
caggcatggtagctcatgcc

SEQ ID NO: 379543 - DNA, 18 bp, Homo sapiens
caggcattgcactaaaag

SEQ ID NO: 379544 - DNA, 17 bp, Homo sapiens
caggccacacgctgccc

SEQ ID NO: 379545 - DNA, 22 bp, Homo sapiens
caggccacacgctgcccaggct

SEQ ID NO: 379546 - DNA, 16 bp, Homo sapiens
caggccaccagctgct

SEQ ID NO: 379547 - DNA, 19 bp, Homo sapiens
caggccacccactgtgggg

SEQ ID NO: 379548 - DNA, 17 bp, Homo sapiens
caggccacctgccccct

SEQ ID NO: 379549 - DNA, 18 bp, Homo sapiens
caggccacctgccccctt

SEQ ID NO: 379550 - DNA, 19 bp, Homo sapiens
caggccactctcagagact

SEQ ID NO: 379551 - DNA, 13 bp, Homo sapiens
caggccactgacc

SEQ ID NO: 379552 - DNA, 14 bp, Homo sapiens
caggccactgcaaa

SEQ ID NO: 379553 - DNA, 15 bp, Homo sapiens
caggccacttgctca

SEQ ID NO: 379554 - DNA, 20 bp, Homo sapiens
caggccagcttcgtgctgga

SEQ ID NO: 379555 - DNA, 14 bp, Homo sapiens
caggccaggcctca

SEQ ID NO: 379556 - DNA, 11 bp, Homo sapiens
caggccaggtc

SEQ ID NO: 379557 - DNA, 22 bp, Homo sapiens
caggccagtggacagagggaga

SEQ ID NO: 379558 - DNA, 18 bp, Homo sapiens
caggccatccggccccca

SEQ ID NO: 379559 - DNA, 15 bp, Homo sapiens
caggccatggaggca

SEQ ID NO: 379560 - DNA, 14 bp, Homo sapiens
caggccatggccaa

SEQ ID NO: 379561 - DNA, 16 bp, Homo sapiens
caggccatgtgagcca

SEQ ID NO: 379562 - DNA, 12 bp, Homo sapiens
caggcccacatt

SEQ ID NO: 379563 - DNA, 13 bp, Homo sapiens
caggcccagcctg

SEQ ID NO: 379564 - DNA, 18 bp, Homo sapiens
caggccccaacctgaagg

SEQ ID NO: 379565 - DNA, 15 bp, Homo sapiens
caggccccagccaag

SEQ ID NO: 379566 - DNA, 22 bp, Homo sapiens
caggccccagccaagtgccttc

SEQ ID NO: 379567 - DNA, 15 bp, Homo sapiens
caggccccagcctcc

SEQ ID NO: 379568 - DNA, 19 bp, Homo sapiens
caggccccagcctccaggc

SEQ ID NO: 379569 - DNA, 15 bp, Homo sapiens
caggccccctgcatc

SEQ ID NO: 379570 - DNA, 13 bp, Homo sapiens
caggcccctgagg

SEQ ID NO: 379571 - DNA, 18 bp, Homo sapiens
caggcccctgaggactgg

SEQ ID NO: 379572 - DNA, 20 bp, Homo sapiens
caggccctccatgggctagt

SEQ ID NO: 379573 - DNA, 14 bp, Homo sapiens
caggccctccctgt

SEQ ID NO: 379574 - DNA, 13 bp, Homo sapiens
caggccctcctgc

SEQ ID NO: 379575 - DNA, 19 bp, Homo sapiens
caggccctcctgctggctg

SEQ ID NO: 379576 - DNA, 20 bp, Homo sapiens
caggccctcctgctggctga

SEQ ID NO: 379577 - DNA, 16 bp, Homo sapiens
caggccctgcagtgtt

SEQ ID NO: 379578 - DNA, 15 bp, Homo sapiens
caggcccttcctctc

SEQ ID NO: 379579 - DNA, 19 bp, Homo sapiens
caggcccttcctctccact

SEQ ID NO: 379580 - DNA, 20 bp, Homo sapiens
caggcccttcctctccactg

SEQ ID NO: 379581 - DNA, 21 bp, Homo sapiens
caggcccttcctctccactgc

SEQ ID NO: 379582 - DNA, 21 bp, Homo sapiens
caggccgcatggcccctccag

SEQ ID NO: 379583 - DNA, 14 bp, Homo sapiens
caggccggccagcc

SEQ ID NO: 379584 - DNA, 22 bp, Homo sapiens
caggccgtcctcccgggccctc

SEQ ID NO: 379585 - DNA, 19 bp, Homo sapiens
caggccgtggctgcccaca

SEQ ID NO: 379586 - DNA, 23 bp, Homo sapiens
caggcctcacctggcttcccagg

SEQ ID NO: 379587 - DNA, 13 bp, Homo sapiens
caggcctccagcc

SEQ ID NO: 379588 - DNA, 16 bp, Homo sapiens
caggcctccagcctct

SEQ ID NO: 379589 - DNA, 19 bp, Homo sapiens
caggcctccagcctctccc

SEQ ID NO: 379590 - DNA, 15 bp, Homo sapiens
caggcctcccgcatg

SEQ ID NO: 379591 - DNA, 16 bp, Homo sapiens
caggcctccctctctc

SEQ ID NO: 379592 - DNA, 23 bp, Homo sapiens
caggcctgaaagaggctgaggcc

SEQ ID NO: 379593 - DNA, 12 bp, Homo sapiens
caggcctgccaa

SEQ ID NO: 379594 - DNA, 16 bp, Homo sapiens
caggcctgccaatgcc

SEQ ID NO: 379595 - DNA, 23 bp, Homo sapiens
caggcctgccaatgccacagcca

SEQ ID NO: 379596 - DNA, 14 bp, Homo sapiens
caggcctgccagac

SEQ ID NO: 379597 - DNA, 13 bp, Homo sapiens
caggcctgccagc

SEQ ID NO: 379598 - DNA, 16 bp, Homo sapiens
caggcctgccagcccc

SEQ ID NO: 379599 - DNA, 14 bp, Homo sapiens
caggcctgccctca

SEQ ID NO: 379600 - DNA, 11 bp, Homo sapiens
caggcctggcc

SEQ ID NO: 379601 - DNA, 15 bp, Homo sapiens
caggcctggcccagc

SEQ ID NO: 379602 - DNA, 18 bp, Homo sapiens
caggcctggcccagccag

SEQ ID NO: 379603 - DNA, 18 bp, Homo sapiens
caggcctggcctcggggc

SEQ ID NO: 379604 - DNA, 12 bp, Homo sapiens
caggcctgggac

SEQ ID NO: 379605 - DNA, 21 bp, Homo sapiens
caggcctgggacccagctact

SEQ ID NO: 379606 - DNA, 23 bp, Homo sapiens
cagggcctactgccacccgcttc

SEQ ID NO: 379607 - DNA, 16 bp, Homo sapiens
cagggcctgactttta

SEQ ID NO: 379608 - DNA, 18 bp, Homo sapiens
cagggcctgggggcagtg

SEQ ID NO: 379609 - DNA, 23 bp, Homo sapiens
cagggcctgggggcagtgactgg

SEQ ID NO: 379610 - DNA, 16 bp, Homo sapiens
cagggccttgacaagt

SEQ ID NO: 379611 - DNA, 21 bp, Homo sapiens
cagggcgctccggcagaggca

SEQ ID NO: 379612 - DNA, 23 bp, Homo sapiens
cagggcgctccggcagaggcagg

SEQ ID NO: 379613 - DNA, 16 bp, Homo sapiens
cagggcgggccaggag

SEQ ID NO: 379614 - DNA, 15 bp, Homo sapiens
cagggctaccctccc

SEQ ID NO: 379615 - DNA, 21 bp, Homo sapiens
cagggctccacgggggcctag
